United States Patent 11,078,247 (RNA ENCODING A THERAPEUTIC PROTEIN) - sequence listing, part 45

SEQ ID NO: 75232 - RNA, 1899 nt, Artificial Sequence
  derived and/or modified sequence opt5 from SATL1__Homo_sapiens__NP_001012998
augaaccagagcggcaccaaucaauccucucugagcgacuccaaccaggccgggaucaaucagcccucuacaaacagccucggaaugaaucagauggauaugaaccaaggcuccgcuucucuguacgagaugaaucagguggacaugaagcagccuagcaugucccaggccgggaugagacaaagcggaacgaaccuuccggauauuaaucagcccgacaugaaacagccugauaccuggcagcugggccggucucaacccgggaugcuccagcaggaacugucccaacuuguccugagcaaggcgggaaucucucagccugaccccucccagccuggcccgagccagucuggccccucccaaagccgcaugagacagauugggacaaaccaguccggaaugucucagccuguuaugcaacagcucgauagccaguccggcgggagccagcccucuaugcggcaagugggaaccucccagcugggcacaagccagaucgggaugucucagccuggaaccuggcaaacaggccugagccagcccgugcuccgccagccgaauauguccccucccggcauguggcaaccugggguccagcagcccggaauuucucagcaagugcccagccacccugacaugucccagccgggcaugagccagcagguucccucucaaccugggaucagacagcccgauaccucccagagcugcaaaaaccagacggacaugucucaaccugaugcuaaucaguccagccuguccgacucuaaccagaccggaaucauucaacccagcccgucccuucugggcaugaaucagauggauaugaaccaguggucugccagccucuaugagaugaaccagguggacaugaagcaaccuuccaugagccaggccgggaugcggcagucuggaacaaaucugcccgacaucaaccagccuggcaugaaacaacccggcaccuggcagcuugggcgcucccagccuggaauguggccccagagccugucugaacucguccuguccgaggcuagcauuucucaaccgggcccuccccagagagcccccagccaguccgggccucggcagagcucuacaucccaagcuggaaccaaucagagcggcaucucccagccggugauguggcaacuggauaugcgccagucugggggcagccagcccuccaugagacagguuggaacgucucaaagcggcacaucccagauugggaugucucagccuggaaccuggcagacaggccucagccaacccgugccucggcagcccaacaaguccccucccgggauguggcagcgcggaauguggcagccgggcaugagccaacaggucccuucucagcuggggaugagacaacccggcaccucccagagcucuaagaaucagaccggaaugucccauccuggccgggggcagcccggaaucugggaaccgggcccuagccaacccgggcuuucucagcaggaccugaaccagcucgugcugucccaaccuggacuuagccagcccggccgcucccagcccagcgugucucagauggggaugagacaaacaagcauggauuacuuccagauucggcacgccgaggcgggcgacuguccugagauccugagacucaucaaagaacuggccgcuugcgagaauaugcuggaugccauggaacucacggcugccgaccugcuucgcgauggauuuggcgacaacccgcuguucuauugucucauugcggaggucaaugaucagcagaagcccuccgggaaacugaccguuggauuugccauguacuauuucacauacgacucuuggaccggcaaggugcuuuaucuggaggauuuuuacgugacacaggcuuaccaagacagccaucacaacuccauguga

SEQ ID NO: 75233 - RNA, 1152 nt, Artificial Sequence
  derived and/or modified sequence opt5 from SAV1__Homo_sapiens__NP_068590
augcugagcagaaagaaaaccaagaacgagguguccaaacccgccgaaguccagggcaaguacguuaaaaaggagacaucuccucuccugcggaaucuuaugccgagcuucauccgccacgggcccacgauuccuagacggaccgacaucugccugcccgauuccucuccuaacgcuuuuagcacauccggagacguggugucucgcaaucagagcuuccucagaacccccauucaacggacaccucaugaaaucaugcgcagagaguccaaccggcugagcgccccgucuuaucuugcgcgcucccuggcugauguccccagagaauacggcagcucucaguccuuugugaccgagguuagcuucgccguggagaauggggacucuggaucccgguauuacuauagcgauaacuuuuucgacggccagcgcaagagaccucucggggaucgggcccacgaagacuaccgcuauuacgaguacaaucaugaucuguuucaaagaaugccccagaaccagggacggcacgcuuccggcauuggcagagucgccgcuacaucucuggggaaucucaccaaccauggaagcgaagaccugccucuucccccgggcugguccguggauuggacgaugcgcgggcggaaauauuacaucgaccacaauaccaacacaacccacuggagccauccucuggagagagagggacuucccccuggcugggaacgcguugagucuuccgaguucgggacauauuacguggaucacaccaauaagaaagcccaguaucggcaucccugugcgcccagcgucccuagauacgaccaaccgcccccugugacguaucagccccagcagacagaacgcaaccaaucucugcuugugccugccaaucccuaccacaccgcugaaaucccggacuggcugcaggucuacgcccgggcuccuguuaaguaugaucacauucucaaaugggagcuguuucagcuggccgaccucgauacauaccaaggaaugcugaagcuccuguucaugaaggagcucgaacagaucgugaaaauguaugaggcguacagacaggcccugcuuaccgaacuggagaaccgcaagcagcggcaacagugguaugcucagcagcauggcaaaaacuuuuga

SEQ ID NO: 75234 - RNA, 753 nt, Artificial Sequence
  derived and/or modified sequence opt5 from SBDS__Homo_sapiens__NP_057122
augagcaucuucacccccacaaaccagauuagacugacgaauguggccgucguucggaugaagcgcgcuggcaaaagauuugagaucgccugcuacaagaacaaaguggugggguggcgguccggagucgaaaaggaccucgaugaggugcugcaaacccacucuguuuucgugaaugucagcaaaggccagguggcgaagaaggaagaccuuauuuccgcuuuugggacagaugaccagaccgagaucuguaaacagauucugacaaagggagaaguucaagugucugauaaagagcgccauacccagcucgagcagauguucagagacaucgccacaaucgucgccgauaagugcgugaacccugaaaccaaacggccguauacggugauucugaucgagcgcgcuaugaaggacauucacuacagcgucaagaccaauaaauccacaaagcagcaagcccuugaaguuaucaaacagcugaaggagaaaaugaagauugagagagcucauaugcggcuccgcuuuauccugcccgugaacgaaggcaaaaagcugaaggagaaacucaagccucugauuaaagugaucgaaucugaggauuaugggcagcagcuugaaaucgucugucugauugaccccggaugcuucagagagaucgaugagcucauuaagaaagaaaccaagggcaagggcagccuggaggugcuuaaucugaaagacguugaagagggggaugaaaaguuugaguga

SEQ ID NO: 75235 - RNA, 5682 nt, Artificial Sequence
  derived and/or modified sequence opt5 from SBF1__Homo_sapiens__NP_002963
auggcccggcuggcugacuacuucgugcucgucgccuuuggcccccacccucgggggagcggagagggccaggggcaaauccugcagagauucccggaaaaggauugggaggacaaccccuuuccucagggaauugaacuuuucugccagcccuccggcuggcaacuguguccugagcggaaucccccuaccuuuuucguugccgugcucacagauaucaacucugaacggcauuauugcgcuugucugacguuuugggagccggccgagcccagccaggaaaccacacgcguggaggacgccaccgaaagagaggaggaaggggaugagggaggccagacacaccuuuccccuaccgcucccgccccuucugcucagcuguucgcccccaaaacacucguccuggugagccggcuggaccauaccgaaguuuuucgcaauucccucggccugauuuacgccauccacguggaggggcuuaacgucugccuggaaaaugugauuggaaaccuccugacguguaccguuccgcuugccggcgggucucaaagaacaaucagccugggagcuggcgauagacaggugauccagaccccucucgccgacucccugcccgucagccgcugcucuguggcucuccuguucagacagcuggggauuacaaaugugcuuucccuguuuugugccgcgcucaccgagcauaagguccuguuccuuagccggucuuaucaacgccuggccgaugcuugcagaggacuccuggcccugcucuuuccucugcgguacuccuucacguauguucccauccuucccgcucagcugcucgaggugcugagcacaccuaccccguucauuaucggcgugaacgccgccuuucaggcugaaacacaagagcuucuggacgucauuguggccgaucucgacggcgggaccguuaccauccccgaaugugugcacauuccuccccugccugagccccugcagucucagacacacuccguccucagcauggugcuggauccggaacuugagcuggccgaccucgcuuucccucccccuacgaccuccacaucuagccugaaaaugcaggacaaggagcugcgcgccguuuuucuuagacucuucgcccaacugcugcagggauaccgguggugccuccauguggucagaauccaccccgaaccugugauccgcuuucauaaagcugccuuccugggccagcgggggcuugucgaggaugacuuucugaugaaggugcucgaaggaauggcguucgcuggcuuuguuuccgagagaggggugcccuaucgcccgaccgaucuguucgacgaacuggucgcccacgagguggcccggaugagagcugaugagaaucacccucagcgcguucuucggcaugugcaagaacucgccgagcagcuguacaagaacgaaaaucccuaccccgcugucgccaugcacaaagugcagagaccuggagagagcucucaucugcgccgggugccgagacccuuuccucgccucgacgagggcacaguucaguggauugucgaucaagcggccgcuaagaugcagggcgcgcccccugcugugaaagccgaacggagaaccacggugcccuccgggccucccaugacagcgauccuggagcgguguagcggacuucacgucaacucugcccgcagacuggaagugguucggaauugcauuagcuauguguucgagggcaagaugcucgaagcuaaaaagcugcugccggccguccuuagagcucucaaggggcgcgccgcccggagaugccuggcucaggagcugcaucuccacgugcagcaaaaccgcgcgguucuggaccaccagcaguuugauuucguggucagaaugaugaauuguugccuucaagacuguaccucccuggaugagcauggaaucgccgcugcccuccugccucuggugaccgccuucugccggaaacuuucucccggcguuacacaguuugcuuacagcugugugcaggaacacgucgugugguccaccccucaguucugggaggccauguuuuauggggacgugcaaacacauauucgcgcgcucuaccuggaacccacggaggaccuggcuccggcccaggaagucggcgaggccccuagccaggaggaugaaagaucugcucucgacguugccuccgagcagcggcgccuguggcccacccuuagcagagaaaagcaacaggagcuggugcagaaagaagagucuacaguguucucccaggcgauccacuaugcuaaccggaugagcuaccuccugcugccucuugauuccucuaagagccgccugcucagagagcgggccggacugggcgaccucgaauccgccucuaacagccuggucaccaauuccauggcugggagcguggccgagucuuaugauacagaauccggauuugaggacgcugagaccugcgauguugccggcgcggugguccgcuucaucaacagauuuguggacaaaguuuguacggaaagcggggugaccucugaucaccuuaagggacugcaugucauggugcccgacauuguucaaaugcacaucgagacacucgaagccgugcagcgggaguccagacgccugcccccuauucagaaaccgaagcugcuucggcccagacugcucccuggcgaagagugcguccuggaugggcuccgcguguaccugcuucccgacggccgggaggaaggagcuggcgggagcgccggaggcccugcucugcuccccgccgagggggccguguuccugaccacauacagagucaucuuuaccggaaugccuacggauccgcugguuggcgaacaaguggugguccgcucuuuccccguggcugcgcuuacaaaggagaaacggauuagcguucagaccccuguggaccagcugcuccaggacgggcugcaacucagauccuguacauuucagcugcuuaagauggccuucgaugaagaggucggcagcgacucugcugagcuguuucgcaaacagcugcauaagcuccgguaucccccugauaucagagccaccuucgccuucacccugggauccgcucacacacccggccggccgccucgcgugacgaaagacaaggggcccagccuuagaacccugucccggaaucucguuaagaacgccaaaaagacaaucggacgccagcaugugacccgcaagaaauacaaucccccuucuugggaacaccggggccaacccccuccggaggaucaggaagacgagauuagcgucuccgaggaacuggagcccucuacacucaccccuagcuccgcgcugaaacccucugauagaaugacgaugagcucccuuguggaacgcgcuugcugucgggacuaucagagacuggggcugggaacacucuccucuagccugagccgcgccaaaucugagccuuuucggaucucccccgucaacagaauguacgccauuugccgcagcuauccgggccuucugaucgugccucagucuguucaagauaaugcucuccagcggguguccagaugcuaccgccagaacagauuccccgucguguguuggcggagcgggcgcuccaaggccguucugcucagaagcggcggacugcacggcaaagggguggucggacuuuuuaaggcgcagaaugcuccuucucccggccaaagccaggccgacuccucuagccuggaacaggagaaauaucugcaagccgugguguccucuaugccucgguacgcugaugccagcgggcgcaacacccucuccggauucucuagcgcucauaugggcucccacguucccagcccgagagcccgggucaccacacugucuaauccuauggcggccuccgcuagcagacgcaccgcgccccggggcaagugggggucugugagaacauccggacgcagcuccggccuugggacggacgugggaucucggcuggcuggcagagaugcccucgcgcccccucaggcuaacgggggaccgcccgacccuggcuuucugcggccccagcgcgcggcccucuacauucugggcgacaaagcucagcuuaagggggucagaagcgauccucugcaacagugggagcuggugcccaucgaaguuuucgaggccagacaggugaaggccuccuuuaaaaagcuccugaaggcuugcgucccuggauguccggccgcggaacccagcccugcuucuuuccuucgcucccuggaggacagcgaauggcucauucagauccauaagcugcugcaagugucuguucucguggucgagcuucuggauagcggcuccucugugcugguugggcucgaggacggaugggauaucaccacacagguggucagccuggugcagcuucuguccgaccccuuuuauagaacccucgaaggcuuccggcugcugguggagaaagaauggcucucuuuugggcaccgcuucagccauagaggagcccacacacuugccggccaguccagcggcuucaccccugucuuucugcaauuccuggauugcguucaccaggugcaucuccaguuucccauggaguucgaauuuucucaauucuaccugaaguuucuuggguaucaccaugugucccggcgcuucagaacguuucugcucgacagcgauuacgagcggauugagcugggacugcucuaugaagagaaaggcgaaagacgcgggcaggucccgugucgguccgugugggaguacguugacagacuuucuaagcgcaccccuguguuccacaauuauauguacgcucccgaagaugccgagguccugcggcccuacagcaacguguccaaucugaagguuugggacuuuuauacagaggaaacccucgcggagggaccucccuacgacugggaacuggcccagggcccuccggagcccccugaggaagagagaucugaugggggagcuccccagagccgccggagaguggucuggccuugcuaugacuccuguccccgcgcccaaccggaugcuaucagccggcuucuggaggaacuccagagacuggaaacagagcugggccagccugccgagcgcuggaaagacaccugggaucgggugaaggcugcccagagacucgaaggccgccccgacgggagaggaacaccuucuucccuucuggucagcaccgcgccccaccaucggcgcucucugggcguguaccuccaagaggggccuguuggauccacgcugagccuuucucuggauagcgaccaguccucuggcagcacaaccuccgggagcagacaggccgcucggagauccaccucuacacucuauagccaguuccaaaccgccgaauccgagaaccggucuuacgaaggaacgcuguauaaaaagggcgcuuuuaugaaacccuggaaggcccgcugguucgugcuggauaagacaaaacaccagcucagauacuacgaccaucggguggauaccgagugcaagggcgucauugaccuugccgagguugaagcuguggcgccggggacaccuaccaugggagcccccaaaacaguggaugagaaggcuuucuuugacgucaaaaccacgcgcagaguguauaacuucugugcccaggacguucccagcgcccagcaauggguggaucggauccaguccugccugucugacgcuuga

SEQ ID NO: 75236 - RNA, 5550 nt, Artificial Sequence
  derived and/or modified sequence opt5 from SBF2__Homo_sapiens__NP_112224
auggccagacuggcugacuacuucaucguggucggcuaugaucacgagaagcccgggagcggagaaggccucgggaaaauuauccagcgguuuccucaaaaggacugggaugacaccccguucccccagggaauugagcuguuuugccagccuggcggguggcagcuuucccgcgaaagaaaacaacccacauucuuuguuguggugcugacggauaucgacucugaucggcauuacuguagcugccucaccuucuaugaggccgaaauuaaccugcagggaacaaagaaagaggagaucgaaggcgaggcgaaggucuccggccuuauccagccugcugaaguguuugcccccaagucucugguucucgugagccgccuguacuauccugagauuuucagagccugucuggggcucaucuacaccgucuauguggacucccugaauguuucucuugagagccugauugcuaaccucugcgccugucuggugccggcugccggaggcucccagaaacuuuuuagccugggggcgggagaucggcaacucauccagacaccccugcacgacucucugccuauuaccggcacauccgucgcccuccuguuccagcagcuugggauccaaaaugugcugagccucuuuugcgcugugcugaccgaaaacaagguccuuuuccauucugccuccuuucagcgccugagcgaugcuuguagagcccucgagucucugauguucccccugaaauacuccuacccuuauauucccauccucccggcgcagcugcuugaaguucugagcuccccuacgcccuucaucauuggagugcacucuguguuuaagaccgacguccaugagcuccuggaugugaucauugccgaccuugacggcggcacaaucaaaauuccugaaugcauccaccugagcucccuccccgagccccugcugcaccaaacccagagcgcucucucucugauccuucauccugaucuggagguugccgaccacgcuuucccgcccccucggacagcccucucccauagcaagaugcuggauaaggaagugcgcgccgucuuucugagacuuuucgcucagcucuuucagggguaccggucuugucugcaacugauucgcauccacgcggagcccgugauucacuuccauaaaaccgccuuucucggacagagaggccugguugaaaaugacuuccuuacgaaggugcugagcgggauggcuuuugccggauucgucuccgagcggggcccucccuaucgcucuugcgaucucuuugacgaacugguggccuucgaggucgagagaaucaaaguggaagagaacaauccgguuaagaugauuaaacacgugcgggaacuggcugagcagcuuuuuaagaacgaaaauccuaacccccauauggccuuccagaaagucccuagacccacagaggggagccaccuccgcgugcauauccugccuuuccccgagaucaaugaagcgcggguucaagagcugauucaggaaaacguggcuaagaaucagaacgccccgccugccaccagaaucgagaagaaaugugucgugcccgcuggacccccugugguuuccauuauggauaaggucacaaccguguuuaauagcgcccagcgccucgaggugguccggaacugcaucucuuucauuuuugaaaacaaaauccuggagaccgaaaagacacuuccggcugcccugagagcgcucaaaggcaaggccgcucgccaaugccugacggacgagcugggccuucacgugcagcagaaucgggccauucucgaucaccagcaauucgacuacaucaucagaaugaugaacuguacccugcaggauugcuccagccuggaagaguauaauauugcugccgcgcuccugccccuuacaucugccuuuuaccgcaagcuggcuccugggguuucccaguucgccuauaccugugugcaagaccaucccaucuggacaaaccagcaguuuugggagaccacguucuacaaugcuguccaggaacaagugcggagccucuaccuguccgccaaagaggacaaccacgccccucaucugaagcagaaagauaagcuucccgacgaucacuaucaggaaaaaacagcuauggaccucgcggccgagcagcugagacuguggccuacccucucuaagagcacccaacaggaacugguucagcacgaggaguccacaguguuuucucaggcuauucauuucgccaaucuuauggucaaccugcucgugccccuggauaccagcaagaauaaacugcuucgcacauccgccccgggagacugggaaagcggcucuaacuccaucguuacgaauagcauugcugggucuguggccgaguccuacgauaccgaaagcggauuugaggacucugaaaacacagauaucgcgaauagcgucgugcgguucaucaccagauuuauugacaaggugugcacagaguccggcgucacccaagaucacaucaaaagccugcauuguaugauuccugggaucguugcuaugcacauugagacgcucgaagccgugcaucgggagucucgcagacugcccccuauccagaagcccaaaauccuccggccggcccugcuuccuggcgaagagauugugugcgagggacugagaguccuccuggaccccgauggccgcgaagaggcuaccgggggacugcuuggcgggccucagcugcuccccgccgaaggagcgcuguuccucacaaccuaucggauccuguucagaggcacaccccacgaccaacuugugggggagcagaccguugugcgcuccuuuccuauugcuagcaucacgaaggaaaagaaaauuacaaugcagaaccagcugcaacagaauaugcaggagggccuccagaucaccuccgccucuuuccaacugaucaaggucgccuuugacgaggaagugagcccggagguuguggaaauuuucaaaaagcagcugaugaaauuuagauacccccaguccaucuucucuacauuugcuuucgccgcuggacagaccaccccucaaauuauccuucccaagcagaaagagaagaacacaagcuuucggacguucuccaagaccauugucaaaggcgccaagcgcgcggggaaaaugacaaucggaagacaguaucugcucaagaaaaagaccggcacaauuguggaagagcggguuaaccgcccuggguggaaugaggaugacgaugugucugucagcgacgaauccgagcugcccaccagcacgacacucaaggccucugaaaaauccaccauggagcagcugguggaaaaggcuuguuuuagagauuaccaacggcuuggacugggcaccaucagcgggucuuccagccgcucuagaccugaguauuuccggaucacagccuccaaccgcauguacagccugugcagauccuacccgggccuccugguggucccccaggcuguucaggacagcucucuuccucggguggccagauguuaucgccacaaucggcugcccguggucugcuggaaaaacagcagauccggaacccuccugcuccgcucuggcggguuccauggaaagggcgugguugggcuguuuaaaagccaaaauuccccucaggccgcucccacaucuagccuugaguccucuagcuccauugaacaggagaaguaccugcaggcgcugcucaacgccgugagcguccaccaaaagcugcggggaaauucuacgcuuaccgugagaccggcuuucgcccuguccccuggcguuugggccagccuccgcucuuccacacggcugaucagcucccccaccucuuuuauugaugugggggcuagacucgccggcaaagaccauagcgcguccuucagcaacucuuccuaucugcagaaucagcuucugaagcgccaggcugcccuguacaucuuuggagaaaaaagccaacuccggaacuucaaggucgaguuugcccugaauugugaguucgugcccgucgaauuucacgagauuagacaggugaaagcuucuuucaagaagcuuaugcgggccugcaucccuagcacaauccccaccgauuccgaaguuacguuucugaaagcgcucggcgacucugagugguucccucagcugcaucgcauuaugcagcucgcuguggucgugagcgaaguucuggagaacggguccucugugcuugucugccuggaggaaggaugggauaucaccgcccaagugacaagccuggugcagcuccuguccgacccguuuuauagaacccuugagggcuuccagaugcugguugaaaaggaguggcucagcuucgggcacaaauuuucucaacgguccagccugacacugaauugucagggauccggcuucgcccccgucuuucuccaguuccuugauugcgugcaccaggugcauaaccaauacccuaccgaauuugaguucaaucuguauuaccugaaguuucucgcuuuccacuacgucucuaaccgcuuuaaaacauuccugcuugacagcgacuaugagagacuggaacauggcacccucuuugaugacaagggggagaaacacgccaagaagggaguguguauuugggaaugcaucgaucggaugcacaaaagaucccccauuuucuuuaacuaccuguauucuccucuggagaucgaagcucucaagcccaauguuaacgugagcucccuuaaaaagugggacuacuauaucgaggagacgcugagcacaggcccgucuuacgauuggaugaugcugaccccuaaacauuuccccuccgaagacagcgaucucgccggggaggcgggaccucgcucucagcggagaaccgucuggcccuguuaugacgauguguccugcacacagccugacgcccugaccagccuuuucucugaaauugagaagcuggagcacaagcucaaucaggcucccgaaaaauggcaacagcugugggagcgcguuacgguggaucugaaggaagagccgcggacagacagaagccagcgccaucucucccggucuccuggcaucgucagcaccaaccuucccuccuaccagaaaagaagccugcugcaccuccccgacuccucuaugggggaagagcaaaauagcuccauuucuccuagcaacggaguggagcgcagagccgcuacacuguacucccaguauaccucuaagaaugaugaaaaccggagcuuugagggcacacuuuacaaacgcggcgcccugcucaagggguggaagccgagaugguucguucuggacgugaccaaacaucagcugcgguauuacgauuccggagaagacacgagcuguaagggccacaucgaucucgccgaggucgaaauggugauucccgcugggccuucuaugggagcgcccaaacacaccuccgacaaggccuuuuucgaucuuaaaacaagcaagcgcguguauaauuuuugcgcucaggacggccaaucugcccagcaguggauggauaagauccaauccuguauuagcgacgccuga

SEQ ID NO: 75237 - RNA, 4182 nt, Artificial Sequence
  derived and/or modified sequence opt5 from SBNO1__Homo_sapiens__NP_001161328
augguggagcccggccaggaccugcuccuggccgcucuuagcgaauccgggaucucuccuaacgaucuguucgacauugauggaggcgacgccgggcucgcgaccccgaugcccacaccuagcguccaacaguccguuccccugucugcucuugagcugggacucgaaacggaggccgccgugccugugaagcaggaacccgagaccgucccuacaccggcucugcugaaugugagacagcaacccccuagcaccacaaccuuuguucucaaccagaucaaucaucugcccccucuuggcuccacaauugugaugaccaaaacgcccccggucaccacaaaccggcagaccaucacacugaccaaguucauucagacgacagccucuacccgcccuagcguguccgcucccacaguuagaaaugccaugaccagcgcgccuucuaaagaucaagugcagcucaaggaccugcuuaaaaacaauucccugaacgagcucaugaagcugaagccucccgccaauaucgcucagcccgucgccaccgcugccacagaugugagcaacgggacggugaaaaaggaaucuuccaauaaagagggagcgcggauguggaucaacgacaugaagaugcgcagcuuuucuccgaccaugaaaguccccguugugaaggaagaugacgagccugaggaagaggaugaagaggaaaugggccacgccgagacauacgcugaguauaugcccauuaagcugaaaaucggccucagacacccugacgccguggucgaaaccuccagccuguccucugugacacccccggauguuugguacaagaccagcauuuccgaggaaacgaucgacaauggguggcuuagcgcucugcagcucgaggccauuacauaugccgcucaacagcaugaaaccuuccugccuaacggagaccgggcgggcuuucuuaucggggauggagccggcguggggaaaggacgcaccauugcuggcaucaucuacgagaauuaucugcucucuagaaagcgggcccugugguucuccgucagcaacgaccugaaauacgaugccgagcgcgaccucagagauauuggcgcuaagaacauccuggugcacucucuuaauaaauuuaaguaugggaagauuagcuccaaacauaacggaucuguuaagaaaggcgugaucuucgccacauacagcucccugauuggggaaagccagucuggaggcaaguacaaaacccggcucaagcaacugcuucacuggugcggggacgauuuugacggagucaucguguucgaugagugucacaaggcgaaaaaucugugccccgucggcuccagcaagccuacaaaaacgggccucgcugugcuggaacugcagaacaagcuccccaaagcccgcguuguguaugccucugcuaccggggccuccgagccuagaaauauggcuuacaugaaccggcugggaaucuggggcgaagggacacccuuucgcgaguucagcgacuuuauucaggccgucgagagacggggagugggcgcgauggaaaucguugccauggauaugaaacuuagagggauguauauugcucgccagcuguccuucaccggcgugacauucaagaucgaggaaguccuccugucucaaagcuacgugaagauguauaauaaggccgugaaacuguggguuauugcucgggagagauuucagcaggccgcggaccuuaucgacgccgagcagcgcaugaagaaauccauguggggacaauucuggucugcucaucagcgguuuuucaaguaccucuguaucgccagcaaggucaaaagaguggugcagcuggcucgcgaagagauuaagaacggcaaaugcgucgugaucgggcugcaguccaccggagaagcccggacgcucgaggcccuggaagagggcgggggagagcuuaaugauuuuguuagcaccgcuaagggcgugcugcaaucucucauugaaaaacacuucccggcgccugacagaaagaaacuguauucccugcuugggaucgaucucacagcccccagcaacaauucuagcccccgcgacuccccuuguaaggagaacaagauuaaaaagcggaaaggcgaagagaucaccagagaagcuaagaaagcccgcaaggucggaggccugacagggucuagcuccgaugacagcggaucugaguccgaugccagcgacaaugaggaauccgauuacgagucuagcaagaacauguccucuggcgacgaugacgauuuuaauccguuccuggacgaaagcaacgaggacgaugaaaacgaccccuggcucauucggaaagaucauaagaaaaauaaggagaaaaagaagaaaaaguccaucgacccugauucuauccagagcgcucugcuugccuccgggcugggaagcaaaagacccucuuuuuccagcaccccugugauuucucccgcgccuaacuccacgcccgcuaauagcaacacaaauucuaacuccagccucaucaccucccaggacgccguugagcgggcccagcaaaugaagaaagaucugcuggacaaacuugaaaagcucgcugaggaucugccgccuaauacacuggacgaacucauugaugagcugggcgggcccgagaacguggccgaaaugaccggccgcaagggaagagucgugagcaaugacgauggcucuaucagcuacgagucccggucugaacuugacguuccuguggagauucugaacaucaccgaaaagcagagauucauggacggggauaaaaauaucgcgauuaucagcgaggcugccuccucuggaauuagccuccaggccgaccgccgggcuaagaaccaaagacgcagaguccacaugacacuggagcugcccugguccgccgaucgggcuauccagcaguuuggccgcacgcacagaucuaaucaggugaccgccccggaauauguguuccuuauuagcgagcucgcgggggaacaacgguuugccuccaucgucgcuaaacgccuggagagccugggagcccucacacauggcgacagacgggcuaccgaaucucgcgaucuguccagauucaacuucgacaauaaguacgggcggaacgcccuugagaucguuaugaaaagcauugugaaccuggauucuccuauggugagcccuccucccgacuaucccggcgaguuuuucaaggauguccgccagggacucaucggcguggggcugauuaauguugaagacagauccggaauccugacacuugauaaggacuacaacaauauuggcaaauuucugaaccggauccucgggauggaggugcaccagcagaaugcccuguuccaauauuuugcugacacccucacggcggucgugcagaacgccaagaaaaauggaagauacgauaugggcauccuggaccuuggcuccggggaugaaaagguucgcaaaucugacgugaagaaguuccugacacccggauauagcaccuccggccaugucgagcucuacaccauuagcguggaacgggggaugucuugggaggaggcuacaaaaaucugggccgaacugaccggaccggaugacggcuuuuaccugucccuucagauuagaaacaauaagaaaacagccauccugguuaaggaggugaaccccaaaaagaaacucuuccuggucuaucgcccuaauacggggaagcagcucaagcuggaaauuuacgcugaucuuaaaaagaaauauaagaagguggugagcgacgaugcccugaugcacuggcucgaccaauacaacucuagcgcggauaccugcacacaugcuuauuggcggggaaauuguaaaaaggccucccugggccuggucugcgagaucggccuuagaugucgcaccuacuauguucugugcgggucugugcucagcguguggacaaaagucgagggagugcuggccuccguuucuggcaccaacgugaagaugcagauuguccggcucagaacggaagacgggcagcgcaucgugggacugaucauucccgcuaauuguguuagcccucuugugaaccugcuguccaccagcgaucaaucucagcagcucgccguccagcaaaaacagcuguggcagcagcaccacccccaauccaucacaaaccuuagcaaugcguga

SEQ ID NO: 75238 - RNA, 3930 nt, Artificial Sequence
  derived and/or modified sequence opt5 from SBNO2__Homo_sapiens__NP_001093592
augagagagccccugccuggcagcgccuccugggggaccccgggacccccuucugcuggcacaaugagccagcuccaacuguggcuucaguucgaagcccugaacaaggacuccucuuacuuugaggauuucagcaauaucuccauuuucucuagcuccguggacagccucucugauaucgucgacacgcccgauuuccugccugcggacucccuuaaccagguuagcaccauuugggaugacaaucccgcuccuucuacacacgauaaacuguuucagcucucccggccguucgccggguuugaagacuuccugcccagccauucuaccccucugcucguguccuaucaagagcagagcgugcagucccagcccgaagaggaggaugaagccgaggaagaggaggcugaagaacugggacacacagaaaccuacgccgacuaugucccuucuaagagcaaaaucggcaagcaacaucccgaucgcgugguugagacauccacccuuagcucugugccgccucccgacauuacguacacccuggcucucccuuccgacagcggggcccugucugcgcuucagcuggaagccaucacauaugcuugccagcagcacgagguccuccugcccagcggacaaagagccggcuuucugaucggcgauggggcuggagugggcaaagggcggaccguugccggagugauucucgagaaccaucugcgcggcagaaagaaggcgcuuugguucuccgucucuaaugaccugaaauacgaugccgaacgggaccuccgcgauaucgaggcuacagggauugccgugcacgcucugagcaagaucaaauauggagacaccacgacauccgaaggcgugcuuuuugccaccuacagcgcccugauuggcgagucucaggcugggggacagcacagaacacggcuccgccaaauccuggauugguguggcgaagcguucgagggggucauuguuuuugacgagugccauaaggccaaaaacgcuggauccaccaagaugggcaaggccgugcuggaucuccagaauaaacugccccuugccagaguggucuacgcuagcgccaccggggcgucugaaccucggaacaugaucuauaugucccgccugggaaucuggggcgagggcacaccguucagaaauuucgaagaguuucuccacgcuauugaaaagcgcggggugggagccauggagaucguugccauggacaugaaagugagcggcauguacauugcucggcagcuguccuucucuggggucacguuuagaaucgaggaaauuccccuugccccugcuuucgaguguguguauaaccgggccgcgcugcucugggccgaagcucugaauguuuuucagcaagccgcugauuggaucggacuggagagcagaaagucccucuggggccaguucuggucugcccaucagcgcuuuuucaaauaccugugcaucgcggccaaggugcggagacuugucgagcuggcucgcgaggagcucgcccgggacaaauguguggucauugggcugcagagcaccggcgaagcuagaacacgcgaggugcugggagaaaacgacggccaccuuaauugcuuuguuuccgccgccgaggggguguuccucagccugauccaaaagcacuuucccucuaccaagcggaaaagagaucgcggagcuggcuccaagcggaaaagacgcccucgggggagaggagcgaaggcuccccggcuggccugugagacagccggcgucauucgcaucagcgacgauucuuccaccgaaagcgacccggggcucgauucugacuucaacagcuccccugagagccugguggaugacgauguugugauugucgacgccgugggccuucccucugaugacagaggaccucugugccuccugcagcgggauccccauggcccuggggugcuggaaagaguugagcgccuuaaacaggaccuccuggacaagguccggagacugggacgcgaacuccccgugaauacgcuggaugagcuuaucgaccagcugggcgggccgcaaagaguggcugagaugacaggacggaagggccgcgucguguccagaccugaugggaccguugccuuugaaagccgggcggagcagggccucuccaucgaccacgugaaccugcgcgaaaaacagagauucaugucuggagagaagcuggucgcuauuaucagcgaagccuccucuagcggcgugucccuucaggccgaucggcgcguucaaaaccagagacggcgcgugcauaugacccucgagcugcccuggucugcugacagagccauucagcaauucgggcggacacacagaagcaaucaggucuccgcgcccgaguauguguuucugaucagcgaacucgcuggagagcgccgguucgccucuauuguugccaaaagacuggaaucccuuggcgcucugacccauggggaucgccgggccacagagagcagagaccucucuaaguacaacuuugagaauaaauauggaacgcgcgcucugcacugugugcugaccacaauccuuucccagaccgaaaacaaggucccugugccgcagggcuaccccgggggcgugccuacauucuuucgggauaugaagcaaggacuccugagcgucggcauugggggaagagagucucgcaauggcugccuggacguugaaaaagauuguuccaucaccaaguuccucaaccggauccuggggcuugaggugcacaaacagaaugcccuguuucaguacuucagcgacacguuugaucaucucauugaaauggacaagagagagggaaaauaugacaugggcauccuggaucuggcgcccggcauugaggaaaucuacgaggaaucccagcaaguguuccuugccccugggcacccccaggacggacaggucguguuuuauaagauuagcguugaucggggccugaagugggaggacgcuuucgccaaaucucucgcucugaccgggccuuacgauggauuuuaucucagcuacaaggugcgcggcaacaaacccuccugccugcuugccgaacagaauagagggcaauucuucacagucuauaagccgaacaucggacggcagucucagcuggaggcccucgacagccugcgcagaaaauuucaucgggugaccgcugaggaagcgaaggagccuugggaauccggcuacgcccugucucuuacacacugcagccacuccgcuuggaauagacauugucgccuggcccaagagggcaaagauugccuccaggggcugcggcucagacaccauuacaugcuguguggagcccuucugcgcguuuggggccggaucgcugccgugauggcggacgucucuagcuccagcuaucuccagauugugagacugaagaccaaggaucgcaaaaagcagguugggaucaaaauucccgaaggaugcgugcggagaguccugcaagagcuucgccugauggacgcugaugugaagagacggcaggccccugcccucggcugucccgcuccgccugcgccccgcccucuggcccuccccugcgggcccggagaggugcuggaccuuacguacucuccuccggcugaagccuuucccccucccccucacuuuuccuuccccgccccucugagccuggacgcuggcccgggcgucguuccccucgggacaccugaugcccaggcugaccccgccgcgcuggcccaucagggaugugauaucaacuuuaaagaggugcuugaagacaugcugagaucucuccacgcuggcccucccuccgagggggcccugggagagggcgcuggggccggaggcgccgcuggcgggggaccggaacggcaaagcgugauucaguucuccccucccuuucccggcgcgcaggccccucucuga

SEQ ID NO: 75239 - RNA, 1773 nt, Artificial Sequence
  derived and/or modified sequence opt5 from SBSN__Homo_sapiens__NP_001159506
augcaccuggccagacucgugggcagcugcucccugcuucugcuccugggggcucuuucuggaugggccgcgagcgacgaucccaucgagaaggucauugaaggcaucaaccgggggcuguccaaugcugagcgcgaaguuggaaaagcccucgacggcauuaacucugggaucacccaugccggaagagagguggaaaagguguucaauggccugagcaacaugggcucccacacagggaaagagcuggauaagggaguccagggccucaaucaugggauggacaaaguggcucacgagauuaaccauggaaucggccaagccgggaaggaagcugagaagcugggacacggcguuaauaacgccgcgggccagguggggaaagaagccgauaaacuuauccaccauggaguccaccauggcgcuaaucaggccgggucugaggcuggaaaguuuggccaggggguggacaacgccgcgggacaagccggcaaugaggcuggccgguucgggcagggaguucaccacgccgcuggccaggccgggaacgaagccggacgcuuuggccagggggugcaucacgcugcgggccaagccggaaaugaggcuggcagauucgggcagggagcccaucacggccugagcgaaggguggaaggagacggaaaaauuuggacagggcauucaucacgccgcugggcaggucggcaaggaggccgagaaguucggacaaggcgcgcaccaugcugccgggcaggccggaaacgaagcuggccgguuugggcagggagugcaccauggccucuccgagggguggaaagaaaccgagaaguucggccaaggagugcaccacacagccggccaggucgggaaagaagcugagaaguuuggacagggcgcccaucacgcggccgggcaggcuggaaaugaggccggccgcuucgggcaaggcgcucaucacgccgcgggacaggccggcaacgaagcugggagauuuggacagggcguucaucacgggcugagcgagggauggaaagaaaccgagaaguucggccagggcgugcaccaugccgcuucucaauuugggaaagaaacagagaaacuuggacacggcgugcaucacggggucaacgaggccuggaaggaagccgagaaguucggacagggcgugcaucacgcugcgucccagguugggaaggaagaggaucgggugguccagggacugcaccauggcgugagccaagccggccgcgaggcugggcaguucggacacgacauccaucacaccgccggccaggccgggaaagaaggagauauugcuguucacggcgugcagccugggguccaugaggccggaaaggaagcgggccaauuuggccagggggugcaccauacacucgagcaggcuggaaaagaagccgacaaggccguccaaggcuuccacaccggggugcaucaggcuggaaaggaggccgagaaacugggccaggggguuaaucacgcggcugaucaggccggaaaggaaguggagaaacugggccaaggcgcccaccaugcugccgggcaggcuggaaaggaacuccagaacgcccacaauggcgucaaccaggcgucuaaagaggccaaucaacugcuuaacgggaaucaucaguccggaucuagcucccaccagggcggggcuacgaccacaccgcuggccagcggagcuuccgugaacacccccuuuaucaaucucccugcccuguggagaucuguugccaacauuaugcccuga

SEQ ID NO: 75240 - RNA, 900 nt, Artificial Sequence
  derived and/or modified sequence opt5 from SC5D__Homo_sapiens__NP_008849
auggaccuggugcucagagucgccgauuacuauuucuuuacccccuacguuuauccugcuacauggccggaggacgauaucuuccggcaggccauuagccugcuuaucgugacgaacgugggcgcguacauucuguauuucuucugcgcuacccucuccuacuauuuugucuucgaccacgcccugaugaagcauccccaauuucuuaaaaaucaggugcgcagagaaaucaaguucacaguucaggcccugccuuggauuucuauccucaccguggcucuguuucugcucgagauccggggguacagcaaacugcacgaugaccuuggagaauuucccuacggccuguuugagcucgucguguccauuaucucuuuccuguuuuucacagauauguucauuuauuggauccaucgcgggcuucaccauagacugguuuacaagcggcuccacaaaccucaccauauuuggaagauccccaccccuuuugccagccacgcuuuccauccgauugacggauuucugcagucccugcccuaucacaucuacccuuucaucuuuccccuccacaagguggucuaucugucucuuuacauucuggugaacaucuggacaauuagcauccaugauggcgacuuccgcgugccucaaauucuccagcccuuuaucaauggguccgcccaccauaccgaucaccauauguucuuugacuauaacuacggacaguacuucacgcugugggauagaaucggcggcagcuuuaaaaauccgucuuccuucgaagggaagggaccucuuagcuaugucaaagagaugaccgagggcaagcggucuucccacagcgggaacggauguaaaaaugaaaagcuguuuaacggcgaguucacaaagaccgaauga

SEQ ID NO: 75241 - RNA, 4392 nt, Artificial Sequence
  derived and/or modified sequence opt5 from SCAF11__Homo_sapiens__NP_004710
augaagaaaaagaccgugugcacacugaacaugggcgacaaaaaguacgaagauauggaaggggaggaaaauggagacaacacgaucagcaccggccuccuguauuccgaggccgauagaugucccauuugccuuaauugucugcucgaaaaagaggucggguucccugagucuugcaaccacguguuuuguaugacaugcauccugaagugggcugaaacccuugccagcuguccgauugaccggaagcccuuccaggcgguuuuuaaauucuccgcucuggagggauacgugaagguccaagugaaaaagcagcuccgcgaaacaaaagauaagaagaaugagaacucuuuugagaaacagguuagcugccaugaaaauuccaagucuuguaucagacggaaagccauugugcgcgaggaccugcugagcgccaaggucugcgaucucaaauggauccacagaaacucccuguauagcgaaaccggcgggaagaaaaaugcugccaucaagauuaacaagccucagcggucuaauugguccacaaaccaauguuuccgcaacuuuuucagcaauauguuuucuuccgugagccauucuggagaguccagcuucaccuacagagcuuauugcacggaauuuaucgaggccuccgagauuucugcgcuuauccggcagaaacgccacgaacuggagcucagcugguuccccgacacccugccuggcauuggcagaaucggguuuauucccuggaauguugaaacagaggugcuuccucugaucuccagcguccucccgcggaccaucuuccccacaucuaccauuuccuucgaacauuuuggaacgagcugcaagggcuacgcccuggcucacacacaggagggggaggagaaaaagcagaccucuggaacaagcaacacccgcggcuccagacggaaaccugccaugaccacacccacgcgcagaucuacccggaacacaagagcugaaaccgccagccaaucccagcgcagcccuaucucugauaauuccgggugugacgcgcccggaaacagcaauccgucucuguccgugccuagcuccgccgaaucugagaagcagacacggcaggcucccaagagaaaaagcgugcgccggggcagaaagccuccccuccugaaaaagaaacuucgcuccucugucgccgcucccgaaaagagcuccagcaacgauucuguugacgaggagaccgccgaauccgauacgagcccugugcuggagaaggaacaccaaccggacguggacucuuccaauauuugcacaguccagacccauguggagaaccagagcgccaauugucucaaaucuugcaacgagcaaaucgaagagagcgaaaagcacaccgcuaauuaugauacagaggaacggguuggcuccuccucuuccgagagcugugcgcaggaccugcccgugcuugucggggaggaaggagaggugaaaaagcuggaaaacaccggcauugaggccaauguucucugccuggaaagcgagaucucugagaacauccuggaaaaagggggagauccucucgagaagcaggaccagauuagcggccugucccaaucugaagugaagacagaugucuguacggugcaucuucccaaugacuucccuaccugccugacaagcgaguccaaagucuaccagcccgugucuuguccgcucagcgaucuguccgaaaacguugagagcguggucaaugaggaaaagaucaccgagucuucccuuguggaaauuacagagcacaaagacuuuacccugaagacggaggaacucaucgagagcccuaaacuggaaucuuccgagggggaaauuauccagaccguugauagacagagcgugaagucucccgagguccaacugcucggacacguggagacagaagacguggagaucauugcuaccugcgauacauucggcaacgaagacuuuaacaauauccaggacuccgagaacaaucugcuuaaaaacaaucugcucaacaccaagcuggaaaagagccuggaggagaaaaaugaaucccuuacggagcauccucgcagcacagaacuccccaagacccacauugagcagauccagaaacauuucucugaagauaacaaugagaugauuccuauggagugugacagcuuuugcuccgaucaaaacgaaucugagguugaacccagcgucaaugccgaccugaagcagaugaacgagaacuccgugacacacugcucugagaauaauaugccgagcuccgaucuggccgacgaaaaaguggagaccgucucucagccuagcgaaucccccaaggauaccaucgacaagaccaaaaagccccggacgagacgcagccgguuccauucuccuuccaccacauggagcccgaacaaagauacaccccaggagaagaaaagaccucaaucucccuccccucggcgcgaaacaggcaaggagagcagaaagucccagucucccagcccuaaaaacgaguccgcucgggggagaaagaaaagccgcucucagucccccaagaaagacauugcccgggaaagacgccaaagccagucuagaagcccgaagcgggauaccacgcgcgaguccagacggucugaaagccucuccccucgcagagagacaucucgggaaaauaagcgcagccagcccagagugaaagacuccagcccuggagagaagucucggucccagagccgcgagagagaauccgaucgggacggccaaagacgcgagcgggaaagacgcacccggaaauggucuagaagccgcucccacucucggagccccuccagaugucgcaccaagagcaaaucuuccagcuuugggcggaucgacagagauucuuacuccccgcgguggaagggacgcugggcgaacgacggcuggagaugcccucgggggaaugaucgcuaucggaaaaacgaccccgagaagcagaaugaaaacacaagaaaggagaaaaaugauauccaccuggacgcugaugacccuaacagcgccgauaagcauagaaaugacugucccaacuggauuaccgagaaaaucaauucuggccccgauccucgcacacggaacccggaaaaacuuaaggagagccacugggaagagaauagaaacgagaacuccggaaauucuuggaacaagaauuucggcagcggguggguuuccaaccgcggacggggcagagggaaucgcggacggggcacguacagaagcuccuuugccuauaaggaccagaacgaaaaucgcuggcagaacagaaaaccccugucugggaauagcaacuccucuggcagcgaguccuucaaguuuguggaacaacagucuuacaaacgcaagagcgagcaggaguucuccuucgauaccccugcugaccggagcggauggacaucugccuccagcugggcugucagaaaaacccuccccgccgacgugcagaauuauuacucucggcgcggcagaaacuccagcgggccucaaucuggauggaugaagcaggaagaggaaacauccggccaggauagcucccugaaggaccaaaccaaucagcagguugaugggagccagcugcccauuaacaugaugcaaccucagaugaaugugaugcagcagcaaaugaacgcgcagcaucagccgaugaauaucuuucccuauccugucggagugcacgcuccccuuaugaacauucagcggaauccuuucaacauccacccccaacucccgcugcaucugcacacgggcguuccucucaugcaaguggccacccccacaucugucagccaggggcugcccccucccccuccgcccccucccccuucccaacaggugaacuacaucgccucucagcccgacggcaaacagcuucagggcauuccgagcuccucucaugugagcaauaacauguccaccccuguccugcccgcuccuacagccgcgcccggaaauaccgggaugguucagggaccuucuagcggcaacacauccucuagcucccacagcaaggccucuaaugcugccgugaaacucgcugaguccaaggugagcgucgccguggaagccuccgcugauucuagcaaaaccgacaagaagcugcagauccaggagaaagcggcccaagaaguuaagcuggcuauuaaacccuuuuaccagaacaaggauaucacgaaagaggaguauaaggaaauugugagaaaggccgucgacaaagugugccauuccaagagcggggagguuaauucuacaaaaguggccaaccuugucaaggcuuacguggauaaauauaaguacucccgcaaaggaagccagaagaagacccucgaggaaccgguuucuaccgagaaaaauaucggcuga

SEQ ID NO: 75242 - RNA, 3939 nt, Artificial Sequence
  derived and/or modified sequence opt5 from SCAF1__Homo_sapiens__NP_067051
auggaggaagaggacgaaagcagaggcaagaccgaggaauccggggaggaucggggagacggccccccugaucgcgacccgacacugucucccagcgccuucauccucagagcuauucagcaagccgugggguccucucugcagggagaucuuccuaacgacaaagauggcagccggugccacgggcugcgcuggagacggugucgcucccccagaucugagccucggagccaggaauccggaggcacggacaccgcgacaguccucgauauggcuaccgacagcuuucuggccggccuuguuucugugcuggaucccccugacacaugggugccgucccgccucgaucugagacccggggagagcgaagacaugcuggagcucgucgccgaggugcggaucggagaccgcgauccuauuccccugccuguucccucucuucugccgagacuccgggcuuggcgcaccggcaagacaguguccccucagagcaauucuuccagacccaccugcgcccggcaucugacgcuugggaccggagacggcgggccugcuccccccccugccccgagcuccgcgucuagcucccccagcccuucucccuccagcucuagcccuucccccccgccucccccucccccucccgccccgccugcuccccccgccccuagauucgauaucuacgacccguuucaccccacagaugaagcuuauucuccucccccugcccccgagcaaaaauacgacccuuucgaacccaccggaagcaacccguccagcucugcgggcacaccuucccccgaggaagaggaggaagaggaagaggaagaggaggaagaggaagaggaugaagaggaggaagagggccugagccagucuauuucccgcaucagcgaaacccucgccgggaucuaugacgauaauucccugucucaggacuuuccuggagaugagagcccccggccggacgcucagccuacgcaacccacaccugcccccggcacccccccucaggucgacuccacaagagcugauggggccaugcgccggagaguguucguugugggaaccgaggccgaagcuugucgcgagggcaaggucucuguggaaguggucaccgcggggggagccgcucugccgcccccucuccugcccccuggcgacagcgagauugaagagggcgagaucguucagcccgaagaggaaccucggcuugcccugucccucuuuagaccggggggacgcgccgcucggcccacaccugccgcgagcgcuacgcccaccgcccagccucugccccaaccgccugcccccagagcucccgagggcgaugacuuccuuucucugcaugccgaauccgauggggagggagcucuccagguggaccugggcgagccugcccccgcgccuccggccgcugauagccgcugggggggccuggaccuccggagaaaaauucugacacagcggcgcgaaagauaccggcaaagaucucccuccccugcccccgcuccugcccccgcggccgcugccggaccgccuacccgcaagaagagccggagagagcgcaaaagaucuggcgaagcuaaggaggccgccagcuccagcucugggacacagcccgcuccucccgcgccugccucccccugggauagcaaaaagcaccggucccgcgacagaaaaccgggaucucaugcuagcuccucugcccggcgcagaagccggucccgcucuagaagccgguccacccgcagacggagcagaucuacggaucgccggagaggcgggucccgccggagcagaucucgcgaaaagcggagacgccggagacgguccgccagcccuccccccgcuacaucuuccagcuccagcucucgcagagagcggcaccgcggaaagcacagagacggcgggggcagcaaaaagaaaaagaaacgguccagaucucgcggagagaagcggagcggcgauggguccgaaaaagccccugcgccggcucccccucccucuggaagcaccuccugcggcgacagagacucucgccggagaggggccgugccucccagcauccaggaucuuaccgaccaugaucuguuugccauuaagcgcacaaucaccgucggacggcucgacaaguccgauccuagaggcccgagccccgcuccugccucuucccccaaacgcgaggugcuguaugacagcgaagggcuuucuggcgaggagagaggaggcaaguccagccagaaagaucggcgcagauccggggcggcuucuagcuccagcucuucccgggaaaagggaagccgcagaaaagcccuggacggcggggaucgggacagagaucgcgaccgggauagagaccgcgaccggucuagcaagaaggccagaccucccaaagaguccgcuccgucuagcggaccuccccccaagccucccguuuccucuggcagcggguccagcucuuccagcuccucuuguagcucccggaaagugaagcuccaaucuaaagucgccgugcugauucgcgaaggcguuagcuccacaacgccugcuaaggaugccgcgagcgccggacugggcucuaucggggugaaguucuccagagaccgggagagccgcucuccguuucucaaacccgaugaaagagcuccuaccgagauggccaaggcugcccccggauccacaaaaccuaagaaaaccaaggucaaggccaaagcuggcgcgaagaaaacaaaggggaccaaaggaaagacgaaacccagcaagacccggaagaaagugcgcucuggcggcgggagcggaggcuccgggggacaggucucucugaagaaaagcaaggccgacuccugcagccaggcugccggcacaaaaggggccgaggaaaccuccuggucuggagaggaaagagcugccaaggugccgagcacaccucccccuaaggcggcucccccucccccggcccuuaccccugauucccagacgguugacucuagcuguaaaacacccgagguguccuuccugcccgaagaggccaccgaggaagcuggcguccggggcggggccgaggaagaggaagaggaggaagaggaagaggaggaagaggaagaggaagaggagcaacagccugcgacaaccaccgcuacaucuacggccgccgcugccccgagcaccgcucccuccgccggaagcacagcgggcgauucuggggccgaagacggaccugcuucccgcgugagccagcuccccacccugccucccccuaugcccuggaaccugccggccggcguugauugcacaaccucuggggugcuugcucucacggcccugcuguuuaagauggaggaagccaaucucgcuuccagagcgaaagcccaggagcugauccaagcuacaaaccagauucuuagccaccggaagccucccucuucccugggaaugaccccugcccccgucccgaccagccucggccugccucccggccccuccagcuaccugcuuccugggucucucccccugggaggcugugggagcacaccuccgacccccacaggacuggccgcuacguccgacaaaagagaaggcucuagcuccucugaggggcgcggagauaccgacaaguaucucaagaaacugcauacacaggagcgggccguggaagaggugaagcuugcgaucaaaccuuacuaccagaagaaagacauuaccaaggaagaguauaaggauauccugagaaaagcuguucacaagauuugccacagcaaauccggcgaaaucaaucccgucaaggugucuaaccucgugcgcgccuacguccaacgguauagauacuuccgcaaacauggccggaagccuggggaccccccuggaccgcccagaccucccaaagagccuggccccccggauaaggggggaccuggccugccccugcccccucuuuga

SEQ ID NO: 75243 - RNA, 3399 nt, Artificial Sequence
  derived and/or modified sequence opt5 from SCAF4__Homo_sapiens__NP_001138916
auggacgccgugaacgcuuucaaucaggagcuguuuagccucauggauaugaagcccccuaucuccagagccaaaaugauucugaucaccaaggcggcuauuaaagccaucaagugcaaaccggaauacaagguccccggccuuuauguuauugacucuaucgugcggcaaagccgccaccaguucgggacagauaaggacguguuuggaccuagauucuccaaaaacaucacggccaccuuucaguaccuguaucucugucccucugaggauaagagcaaaauuguccgggugcugaaucuuuggcagaagaacggcguuuucaaaaucgaaauuauccaaccucugcucgacauggcugccgggacauccaaugcugcccccguggcggagaacgucaccaauaacgaaggaucuccuccgcccccugugaagguuagcuccgagcccccuacacaggccacccccaauagcgugccggcugucccucagcugcccucuuccgaugccuuugcugccguggcgcagcuguuccaaacaacccagggccagcagcuccaacagauucugcagacguuucaacagccucccaagccccagagcccugcccuugacaacgcugugauggcccagguccaagcuaucaccgcccagcugaaaacaaccccgacacagcccucugagcagaaggccgcuuucccucccccugaacagaaaaccgcguuugauaagaaacuccuggaccgcuucgauuacgacgaugagcccgaagccguugaggaguccaagaaagaagacacgacagcugugaccacaaccgccccggccgcugccgugccucccgcgccuaccgcuacaguccccgccgccgcugccccugcugccgcgucucccccgccuccccaggcccccuuuggguucccuggagacggcaugcagcagccggcuuauacgcaacaucagaauauggaucaguuccagcccagaaugaugggcauucaacaggacccuaugcaccaucaggugccccuuccucccaacgggcaaaugccuggauuuggccugcuccccaccccgccuuuucccccuauggcccagcccguuaucccgccuacacccccugugcagcagcccuuccaggcuagcuuccaagcccagaaugagccccugacccagaagccucaccaacaggaaauggaggucgaacagccgugcauccaggaggugaagcggcauauguccgauaaccgcaaaagcagaucccggucugcgagccgcucccccaagagacggcgcagcagaucugggucccggagccgcagaucucggcacagacgcagccgguccagaucucgcgaccggagacgccacagcccucgguccagaagccaagagcgccgggauagagaaaaagagcgcgaacggagacagaagggacugccccagguuaaaccugagacagccucuguguguuccaccacgcucugggucggccaacuggacaagcggacaacccagcaggauguggcuagccuucuggaagaguuugggcccauugagucuaucaauaugauuccuccgcgcggaugcgccuacaucgucauggugcauagacaggacgcuuaucgggcccuccaaaagcuguccagaggcaacuacaaaguuaaccaaaagagcauuaaaaucgccugggcucuuaauaagggcaucaaagcggauuacaagcaguauugggacguggaacugggggucaccuacauucccugggauaaggugaaaccugaggaacucgaguccuucugugaaggaggcaugcuggacucugacacacugaaccccgauuggaaggggaucccuaaaaagcccgagaaugagguugcccagaacggaggcgcugaaaccagccacacagagccgguguccccuauucccaaaccccucccuguccccgugccuccgauccccgugccugcccccauuacgguuccucccccgcaagucccuccccaucagccugggcccccuguggugggagcccugcagcccccggcuuuuaccccuccccuuggcauucccccuccgggcuucgggcccggagucccucccccucccccuccgcccccuuuucugcgccccggcuucaauccuaugcaccucccgcccggguuucugccucccggacccccucccccuaucacaccgcccgugucuaucccucccccucacacacccccgaucagcauuccuaacuccaccaucgccggcauuaaugaagacaccacgaaggaucuuagcaucgggaaccccauuccuaccguugugucuggcgcgcggggaaaugcugaguccggcgacagcgucaagauguaugggucugccgugcccccugccgcucccacaaaccugccgaccccucccguuacacagcccgugucccuccugggaacccaaggcgucgccccugggccggugaucggacugcaggcgcccagcacgggccuccugggggcuagaccuggccuuaucccccugcagcgcccucccggaaugccucccccgcaucuccagagauucccucugaugcccccucggcccaugccgccucacaugaugcaucgcggcccuccucccgggcccggaggcuuugccaugcccccgccccacgggaugaaaggaccuuuucccccucauggccccuucguuagaccugggggcaugccgggacugggcgggcccggaccuggccccgggggaccugaggaucgggacggccgccaacagcccccgcagcaaccucagcagcagccccaaccccaggccccucagcagccccaacagcagcagcaacagcagccuccgcccucucaacagccucccccuacacagcagcaaccccagcaguucagaaaugauaaccggcagcaauucaauagcgggcgcgaccaggaaagauuuggccggcgcuccuucggaaacagaguggagaaugaucgggaaagauacggcaaccgcaacgacgaucgggacaauagcaacagagaucgccgggagugggggagacgcucuccggaccgggacagacaccgcgaucuugaggaacggaauagacgguccagcggacaccgcgacagagagcgggauucccgcgacagagaaucucggagagagaaggaagaggcucgcggcaaagaaaagccugaggucaccgaucgggccgggggaaacaaaacaguggagcccccuauuagccaggugggcaaugucgacaccgcuuccgaacucgagaagggcguuucugaagccgcggugcugaaacccagcgaggaacugccggccgaggcuaccuccucuguggagccugaaaaggauagcggguccgccgcugaggcccccagauga

SEQ ID NO: 75244 - RNA, 4014 nt, Artificial Sequence
  derived and/or modified sequence opt5 from SCAF8__Homo_sapiens__NP_001273118
augccccagccucugcucccggcccugcccccucuuagcucccccucuggcgcugggagcugcggaccuuccggcggggaguguucuggaagacggcuguuccgcagacgggcccgcggccucagaagcgacaacauggaagcggugaagaccuuuaauuccgaggauugcgcuucuacacccgccuguacggacugcuucagcuccagcauggauacccggucuauccuguacucccuuaacgacuauaaaccuccgauuagcaaggccaaaaugacacaaaucaccaaggcugccauuaaagcuaucaaguuuuacaagcacgucguucagucuguggaaaaauucauucagaaguguaaacccgaguauaaggugccugggcuguacgucaucgauuccaucgugcgccagagcagacaucaauuuggacaggaaaaagacguuuucgcgccccgguuuucuaauaacauuaucuccacauuccagaaucucuaucgcugcccuggcgaugacaagagcaagauugugagaguccugaaccuguggcagaaaaauaacguguuuaaguccgagaucauucaaccccuccuggauauggccgccggcaucccgccucccguugugaccccuguccuugcuucuacaaccacggccaugagcaauacccccgggacacccgugaccccugugacaccggcuaacgucguucagggacugcccgacccuugggugucccagauuaccaauacggauacacucgccgcgguggcccagauccugcaaagcccccagggccagcaacuucagcagcugauccagacccuccaaauucagcagcagaaaccucaacccucuauccugcaggcucuggacgccgggcucgucgugcagcugcaggcucuuacagcccaacugaccgccgcugcggccgcugccaacacccucacaccgcuggagcagggaguuuccuucaauaagaaacuuauggaucgguuugacuucggcgaagacagcgagcacucugaggaaccuaagaaagagauucccgccagccagcugucccaugugucugaaagcgucaacaauuccaucuuucaccagauugcugagcaacuccagcagcaaaaccuggaacaucugcgccagcagcuccuggagcagcaacagccucagaaggccacgccccaggauagccaagaagggaccuucggaucugagcacuccgcgagcccuucucagggcuccagccagcagcacuuccuugagcccgaagugaaccuggacgauuccaucgacauccaacagcaggauauggacauugaugagggccaagacgggguugaagaggaaguguuugagcaggaggcuaagaaagucgccgugagaucucggagccgcacacauuccagaucucggagcagauccccgcgcaagcggagaagccgcucucgguccggaagcagaaaacgcaagcaccggaaaagaucucgcucccggagcagagaacgcaagcggaagucuagcagauccuacagcucugagcggcgcgccagagaacgggagaaagaaagacagaagaaaggccucccucccauccgcuccaagacccugagcgucuguuccacaacccuuuggguggggcagguugauaaaaaggcuacgcaacaggaccugacaaaucucuucgaggaguuuggacagauugaaucuaucaacaugauucccccucggggcugcgccuauguguguaugguccauagacaggaugcuuuccgcgcccugcaaaagcugagcuccgggucuuacaaaaucggaagcaaggugaucaaaauugcgugggcccucaauaagggcguuaaaaccgaguacaagcaguuuugggacguggaccugggcgucaccuauaucccgugggaaaaggugaaaguggaugaccuugagggguucgcugagggaggcaugauugaucaggaaacaguuaacaccgagugggaaacagucaaguccucugagcccgugaaagaaacggugcagaccacacaaagcccuacccccgucgagaaggagacagugguuaccacgcaggccgaaguguuuccucccccugucgcuaugcugcagauccccguggccccggcgguuccuaccgugucccucgugcccccugccuuccccgucagcaugccgguuccucccccuggguuuucucccauucccccuccgcccuuccugagagcuuccuuuaauccuagccagcccccucccggauucaugccuccgcccgugccucccccugucgugcccccgccuacaaucccucccgugguccccaccucucugguucaacccucccuuagcaugacaccugagaccgugaaagacgugggcuuugggucucucgucauuccgggcggauccguggccagcaaccuggcuacguccgcccugcccgccggcaauguuuucaacgcuccuacaaagcaggcggaacccgaggaaaaagugccucaccucaucgaucaccagaucagcucuggggagaauacccggagcgucauucccaacgacaucuccucuaaugccgcuauucugggaggccaaccgccuaacgugacaagcaauuccgggauccuuggaguucagcgccccaacgugucuagcaauuccgagauucugggcgucagaccuucuaacgugagcuccagcucugggaucaucgccgcccagcccccuaacauucucaauaacuccggcauccugggcauucagcccccgagcguuucuaauuccagcggacugcuuggggugcucccucccaacauccccaauaacuccggacuggucggcgugcaaccuccgaaugugcccaacaccccugggcugcucggaacccagcccccugcuggcccccagaaucugccuccgcuuucuauucccaaccagcggaugccuacaaugcccaugcuggauauccgcccugggcucaucccccaagccccgggcccuagauucccccugauucagcccggaaucccuccccagcggggcauuccuccgcccagcguccuggacuccgcgcuucauccucccccucgcgggcccuuuccgccuggagauaucuucagccagcccgaaagaccuuuucucgcucccggccggcaaucuguugacaaugugacgaacccugagaagcgcauuccccuggggaaugauaacauccagcaggaaggagacagagauuaccgguucccgccuaucgagaccagagaauccauuagccgcccuccgcccguggacguccgggacgugguuggcagacccaucgauccccgcgaggggccuggccggcccccucuggacggaagagaucacuuuggccggcccccuguggacauucgcgagaaucucgucagacccgggaucgaucaucugggacgccgggaccacuucggcuuuaacccggaaaagccuugggggcauagaggagauuucgacgagcgggaacaccgcgugcuucccguuuauggcggcccuaaagggcugcacgaggagagaggacgguuucgcucuggcaacuacagauucgauccccggagcgggccguggaauagaggauuuggccaagaagugcaucgcgacuucgaugaccggagacgcccuugggagcggcagagagaucgcgacgaccgggauuuugacuucugcagagaaaugaacgggaaucgccucggaagagaucggauucagaacacaugggucccuccuccccacgcccgcguguucgacuauuuugagggcgccaccucccagagaaagggcgauaaugucccccaagugaacggggaaaauacagagcggcaugcucagcccccgcccaucccuguucagaacgaccccgagcuguacgaaaaacugaccucuagcaaugagauuaacaaggaaaaauccgauacgguggccgacaucgagucugaaccugucguggagagcacagagaccgaaggaaccuga

SEQ ID NO: 75245 - RNA, 1821 nt, Artificial Sequence
  derived and/or modified sequence opt5 from SCAI__Homo_sapiens__NP_001138349
auggugagaggcgcccggcagccccaacagccucgcagcagacuggcuccgcggcucaccgggacagucgagaagcccccucgcaaaagacggucccgcacggaguucgcccugaaggaaaucaugucuagcggaggcgcggaagacgauauuccccagggggagagaaaaaccguuacagacuuuugcuaccuucuggauaaguccaaacaacucuucaacggacugcgggaccuuccucaguauggccagaagcaguggcagucuuacuuugggcgcaccuucgauguguauacaaagcuguggaaauuucaacagcagcacagacaggugcucgacaaucgguacggacugaagcgcuggcaaaucggcgaaauugcuagcaaaaucggccagcuguauuaccauuauuaccucagaaccuccgagacaucuuaccugaacgaggccuucagcuuuuauuccgccauucggcagcgcagcuacuauucucaagucaauaaggaagauagacccgagcuugugguuaaaaagcugcgguacuaugcuagauucaucguggucugucuccugcuuaacaagauggacgugguuaaagaucuggugaaggaacucuccgacgagaucgaggauuacacccaccgcuuuaauacggaagaccaggucgaguggaaccuggugcugcaggaaguggccgcuuucauugaggccgauccugucaugguucucaaugacgacaacaccaucgugauuacaagcaaucggcuggcggaaaccggggccccgcuucuggagcagggaaugaucgugggccaacucucucuggcugaugcccuuauuaucgggaacugcaauaaccaggucaaauuuuccgagcugacaguggacauguucagaaugcuccaggcucuggaacgcgagcccaugaaucuggccagccagaugaacaagccuggaaugcaagaaucugcggauaaacccacccggagagagaauccucauaaguaucuccuguacaaacccacguuuucccagcuuuacacauuccuggccgcuagcuucaaggaacucccggccaacuccguucugcuuauuuaucugucugcuaccggcguguuuccuacagggcgcagcgacuccgagggacccuacgauuucggcggcguccucaccaacagcaaucgggacaucaucaacggggaugccauucacaagagaaaucagucucauaaagagaugcacugucugcacccuggagaccuguaucccuuuacccgcaagccccucuucaucauuguggauuccagcaacucuguugccuacaaaaauuuuacaaaccuguucggccagccucuugugugccugcucagcccgacggcuuaucccaaggcgcugcaagaccagucccagcgggggucucuguuuacccuuuuccucaauaacccucugauggccuuucuguucgucagcggacucuccagcaugagacgcggccugugggaaaaaugucaggaguaccuucggaagaucaauagagauauugcucaacugcucacacauucucgguccaucgaccaggccuuucugcaguucuuuggggacgaguuccugcgccuucuccugaccagauucaucuuuugcagcgccacaaugcggaugcacaagauuuucagagaaacccgcaacuaucccgaaucuuacccucaacugccccgggaugagacgguggagaauccgcaucuccagaaacacauccuggaacuugcuuccauucuggacgucagaaacguguuuuucgagaauacaaucgaugacuacuga

SEQ ID NO: 75246 - RNA, 990 nt, Artificial Sequence
  derived and/or modified sequence opt5 from SCAMP2__Homo_sapiens__NP_005688
augagcgccuucgacaccaaccccuuugcugauccuguggacgucaauccguuccaggaucccuccguuacacaacugacgaacgccccucagggcgggcucgcggaguuuaaucccuucucugaaaccaacgcugccacaaccgugccugugacacagcugcccggaagcucccagccugccguccuucaaccgucuguggagcccacccagccuacaccccaggcuguugugagcgccgcucaggccggccugcucagacaacaggaggaacuggaccggaaggcggccgaacuugagcgcaaagagagagaacugcagaauaccgucgcuaaccuccacgugcggcagaauaacuggccuccccugccguccuggugcccuguuaagcccuguuuuuaccaagauuucucuacggagaucccugccgacuaucagcgcauuugcaaaaugcuguacuaucucuggaugcugcauagcgugacccuuuuucugaaucuccuggcuugucuugccugguucuccgggaacagcucuaagggagucgauuuuggccuguccauccucugguuccugauuuuuacacccugcgcguuccuguguugguacagacccaucuauaaagccuuucggagcgacaauucuuucuccuucuuuguguucuuuuucguguuuuucugccagauugggaucuacaucauucaacucgucggaaucccuggccugggcgauagcggguggauugcugcccuuucuacccuggacaaccacucccucgcuaucagcguuauuaugauggugguggccggauuuuucacacugugugccguccuuuccguguuucugcuccagcgcguucauucucuguauagacggaccggcgcuagcuuccagcaggcgcaagaagaguuuucccaggggaucuucagcucucgcacguuucacagagccgcuuccagcgccgcccagggagcuuuccagggcaauuga

SEQ ID NO: 75247 - RNA, 762 nt, Artificial Sequence
  derived and/or modified sequence opt5 from SCAMP5__Homo_sapiens__XP_006720483
auggaguucagaaccaagcggugcggccaggccacagggcccgcuggaaacaucauggccgaaaaagugaauaacuuuccuccgcugcccaaguucauuccucucaaacccuguuuuuaccaagacuucgaggcggauaucccuccccagcacgucagcaugacgaagcgccuguauuaccuuuggaugcucaauuccguuacccuggcugugaaccuggugggcugccuugccuggcugauugggggaggcggggccacaaauuuuggacucgcuuuccuguggcugauccucuuuaccccuuguucuuaugucugcugguucagaccgauuuacaaagccuuuaagacagacagcuccuucucuuuuauggcuuucuuuuucaccuucauggcccagcuggugaucagcaucauucaggcgguuggcauccccggcuggggaguguguggguggauugccacaaucuccuuuuucggcaccaacauugggucugcugucgugaugcuuaucccuacgguuauguuuaccgugauggccgucuucagcuuuauugcucuguccauggugcauaaguucuaucggggaagcggcgggucuuuuuccaaagcccaagaagaguggacaaccggagcguggaagaauccccacgugcagcaggccgcucagaacgccgcuaugggcgccgcccaaggcgcuaugaaucagccucagacacaguacagcgcgacccccaacuauacguacucuaaugaaauguga

SEQ ID NO: 75248 - RNA, 3465 nt, Artificial Sequence
  derived and/or modified sequence opt5 from SCAPER__Homo_sapiens__NP_001139395
augaagaccaaauacaucuucugcaacauuacagagagaaaggacgccgaaggcugggagacggugcagcgggggcgccccaucagaagccgguccaccgcugucaugccuaaaguuucucuggccacagaagcgacccgcagcaaggaugacuccgauaaagagaaugugugucuccugccggacgaaucuauucaaaagggacaguuugugggcgaugggacaagcaacaccaucgagucccaccccaaggacucucuucauagcugcgaucacccucuggcugagaaaacacaguucaccgucuccacgcucgacgaugugaagaauagcggaucuauuagagacaacuauguucggaccuccgaaaucagcgccgugcauaucgauacagagugugucucugugaugcugcaggccggcacacccccucuucaaguuaaugaagagaaauuucccgcugagaaggcccgcauugaaaacgagauggacccuuccgauaucagcaauucuauggcugaagugcuggccaaaaaggaggaacucgcggacagacuggagaaggccaacgaggaagcuauugccuccgcuaucgccgaggaggaacagcugacccgggaaauugaggcggaggaaaauaacgacaucaauauugagaccgauaacgacagcgauuucuccgccucuauggggagcggauccgucagcuuuugcggcaugucuauggacuggaaugaugugcucgcugacuacgaagcccgcgaguccuggagacagaacacgagcuggggcgauaucguggaagaggagccggcucggcccccugggcacggaauccauaugcacgaaaaacugucuagccccucccgcaagagaacaauugccgagucuaaaaagaaacacgaagagaagcagaugaaagcccaacagcuucgggagaagcugcgcgaagagaagacccucaaacugcagaaacuucuggaaagagagaaagacguccggaaguggaaagaggaacuccuggaucagagacgccggaugauggaggaaaagcugcuccaugcugaguucaagagagaaguucaacugcaggcgaucgugaaaaaggcccaggaggaagaggcuaaagugaaugagauugccuuuaucaacacacuugaagcccaaaacaagcgccacgacguccugagcaaacucaaggaguaugaacagcggcugaaugagcuucaggaagagagacagcgccggcaagaggaaaagcaggcuagagaugaggccgugcaggaacgcaaacgggcgcuggaggcugagagacaggcccgcguugaggaacuccugaugaagcggaaagaacaagaggccagaauugaacagcagcggcaggagaaggagaaagcucgcgaagacgccgcuagagagcgggccagagaccgcgaggaacggcuggcggcccucaccgcugcccaacaggaagcuauggaggagcugcagaagaagauccagcuuaaacaugaugaauccaucagacgccacauggagcaaauugaacagagaaaggagaaagccgcggaacugagcucuggccggcacgccaacaccgacuacgcuccuaagcucacacccuaugagcgcaaaaagcaguguucccugugcaaugugcuuaucagcucugaggucuaccuguucucccaugugaaagggagaaagcaccaacaggccguucgggaaaacacgagcauucagggacgcgagcucuccgaugaagagguggagcaucugucucugaagaaauauaucauugacaucgucguggaaagcaccgcuccggccgaggcccucaaggauggcgaagagagacagaaaaauaagaaaaaggcuaagaaaaucaaggcgcggaugaacuuucgcgccaaagaauacgagucccugauggagacaaagaacucugggagcgacuccccuuacaaagcuaaacuucaaagacuggccaaggaucuccugaagcagguccaggugcaggacagcggaucuugggccaauaauaagguuuccgcucuggaucggacccuuggcgaaauuacacgcauccucgagaaagaaaacguggccgaccaaauugcguuccaggcugccggcgggcugaccgcccuggagcacauccuccaggcugucgugcccgccacgaauguuaacacagugcugcggauuccucccaagagccuuuguaaugcgaucaacgucuauaaucugaccugcaacaacuguucugaaaauugcuccgaugugcucuuuagcaacaaaauuaccuuccugauggaccugcuuauccaucagcucacaguguacguucccgaugagaauaacaccauccugggaagaaauacaaacaagcaagucuuugagggccugacgaccgggcuccugaaggugucugcugugguccuuggaugucugauugccaauagaccugacggcaacugccagccggccacacccaaaaucccuacccaggaaaugaagaauaaacccagccaaggggacccuuucaacaaucgcgugcaggaucucauuuccuauguugugaacaugggacugaucgacaagcugugcgcuuguuuccuuagcguccagggccccguggaugagaauccgaaaauggccauuuuucuccagcacgcugccggccugcugcacgcgaugugcacacucuguuucgccguuaccgggcggucuuacuccaucuuugacaacaauagacaagauccuacgggacugaccgcugcccuucaggcuacagaccuggccggcgugcuccauaugcuguauugcguccuguuccacgggaccauccuugaucccagcacagccuccccuaaggaaaacuacacccagaacacgauucagguggcuauccaaucucuccgcuuuuucaauagcuuugcggcccugcaucugcccgcuuuccaguccauuguuggagccgagggccucucucuggccuuucggcacauggcuagcucccuucuggggcacuguucucaggugagcugcgaaucccuccugcaugaggucaucgugugugugggcuauuucacagucaaccacccugacaaucagguuauugugcaaagcggaagacaucccaccgugcugcagaaacuuugccagcugccguuucaguacuucucugauccucgccucaucaagguccuguuucccucccucaucgccgcguguuacaacaaucaccaaaacaagauuauccuggagcaggaaaugagcugcgugcuucuggcuacauucauucaggaccucgcccaaacccccggccaggccgagaaucagccuuaucagccgaaagggaagugucugggaucucaagauuaccuggaacuugcuaaccgguucccccagcaggccugggaggaggcgagacaguuuuuccugaaaaaggaaaagaaguga

SEQ ID NO: 75249 - RNA, 3840 nt, Artificial Sequence
  derived and/or modified sequence opt5 from SCAP__Homo_sapiens__NP_036367
augacccugacagagagacuccgggaaaagaucagccgcgccuucuacaaccacggccugcuuugcgcuuccuaucccauuccuaucauucuguuuacgggguucuguauccucgccugcuguuacccgcugcuuaaacugccccucccuggaaccggccccguggaguuuacaaccccugucaaggacuauucucccccuccgguugauagcgacagaaaacagggggaacccacagagcaaccugaaugguacgugggagcgcccguggcuuauguccagcagauuuucgugaaguccucuguuuuuccuuggcauaaaaaucugcuggccguggaugucuuccggagcccccucucccgcgccuuucagcugguggaggagaucagaaaccacguucuucgggacucuagcggcauccgcucccuggaggaacucugccugcaagugaccgaucuucugccggggcucagaaagcugcggaaucugcucccugaacauggaugucugcuucugagccccggcaacuucuggcagaaugacugggagcgcuuucacgcugauccugacauuaucggcacaauucaucagcacgagcccaagacccuccagacgucugccacccugaaagaucuucuguucgggguccccggaaaguacuccggcgugagccucuauacaagaaaacggauggugucuuacaccaucacacuggucuuucaacacuaccaugcuaaguuccuggggucccuccgcgccagacugaugcuucugcacccuagcccgaacugcucucuccgggcggaaucccugguucaugugcacuuuaaagaggaaauuggaguggccgagcuuaucccccuggucaccacguauauuauccucuucgcuuacaucuauuucagcacacgcaagauugacauggugaaguccaaauggggccuggcccuggcugccguugugaccguccucucuagccugcuuauguccguggggcuguguacacucuuuggacugaccccuacccugaauggcggcgaaaucuuccccuaccuuguuguggucauugggcucgagaacgugcugguccugacaaagagcgugguuucuacgccuguggaucucgaggucaaacugagaaucgcgcagggacuuuccagcgaaucuuggagcauuaugaagaauauggccaccgagcugggcaucauccucauuggguauuuuacacuggugcccgcuauccaggaauuuugccuguuugccguugugggacuugucuccgacuucuuucuccagaugcuguucuuuaccacagugcugucuauugauauccggagaauggagcucgcugaccugaacaaacgccuuccgccugaagccugucugcccagcgccaagccugugggccaacccacccgguacgagagacagcucgcuguucgcccuuccacgccccacacaauuacccugcagccgagcucuuuccggaaucugagacuuccuaaacgccuccgggucguguauuuucuggcgagaacccgccuggcccaacggcucaucauggcugggacaguggucuggaucggcauucugguguacaccgaccccgccggacuuagaaacuaccuggccgcucagguuacagagcagagcccccucggcgaaggggcccuggcgccuaugccggugcccuccggaaugcugccucccucucauccugaucccgcuuucuccaucuuuccucccgacgccccgaaacuuccugagaaucagacgagccccggcgaauccccugagcgcgggggacccgccgaagucgugcacgauucuccgguuccugaggugaccuggggccccgaggacgaggaacucuggcggaagcugagcuucagacauuggccuacacuguucuccuauuacaacauuacccucgcuaagcgguauaucucucugcuucccgucauucccgugacacugcgccucaauccuagagaagcccuggaggggcggcacccgcaagauggcagaagcgcuuggcccccucccggaccuauccccgccggccauugggaggcggggccuaagggaccgggcgggguucaggcccacggagacgugacccuguacaaagucgcugcccuuggccuggcuacggggauugugcucgugcugcuccugcuuugccuguaucgcguccucuguccccggaacuacggccagcugggaggcgggccuggaagacgcagacggggcgaacugcccugcgaugacuauggguacgccccucccgagaccgaaaucguuccgcuugugcugcgcggacaccucauggauaucgagugccuggcguccgacggcaugcuccuggugagcuguugccuugccgggcaugucugugugugggaugcucagacaggcgacugccugacccgcauuccucggcccggacgccaaagacgggacucuggcguuggguccggacucgaagcccaggagagcugggagcgccugucugauggcgggaaggcuggacccgaggaaccuggcgacuccccuccccugagacaccggccgcgcgggcccccucccccuagccuuuuuggcgaucagcccgaccugacaugucucaucgauaccaacuucucugcccagccgagaagcucccaaccuacgcagcccgaaccucggcauagagccgugugcggacgcagccgggacucucccggcuacgauuuuuccugucugguccagagaguguaucaggaggaagggcucgcugcgguuugcaccccugcccugagacccccgagcccuggacccgugcuuucccaagcucccgaggacgagggcgggucuccugaaaaaggaagcccgucccuggccugggcccccucugcugagggcagcauuuggucccuggaacuccagggcaaucugaucgucguggggcggucuagcggaagacuugagguuugggaugccauugaaggcgugcuguguugcuccagcgaggaggucucuuccgggaucacagcgcucguguuccuggacaagcgcaucguggcugcccggcucaacggaagccuggauuucuucucucuugaaacacacaccgcccuguccccucugcaguuuagaggcacccccgggcgcggaagcucuccugcuucccccgucuacagcuccagcgacacaguugccugucaccucacgcauaccgugccuugcgcgcaccaaaagccgauuacagcucugaaagccgccgcuggccggcuugugaccggcucucaggaucauacacugagagucuuccggcucgaggacagcugcugucuguuuacccuccaggggcacuccggagccaucacgacaguguauauugaccagaccaugguucuggcuucuggcgggcaagauggagccaucugccuuugggacgugcugaccggcagccgcgucucccauguguucgcgcacagaggggauguuacaucucugaccuguacaacgagcugcgugauuuccucuggacucgacgaucugaucagcaucugggaccgguccaccggcauuaaguuuuacagcauccagcaggaucuuggcuguggggccucucugggagucauuuccgacaaucuccuggugacaggcgggcagggaugcgucagcuucugggaucucaacuauggcgaccugcuucaaaccguguaccuggggaaaaauucugaagcucagcccgcccgccagauccugguucucgauaacgcugccauuguguguaauuuuggauccgagcugagccuugucuaugugccuuccguucuggagaagcucgacuga

SEQ ID NO: 75250 - RNA, 1821 nt, Artificial Sequence
  derived and/or modified sequence opt5 from SCARA3__Homo_sapiens__NP_057324
augaaggugagaagcgccggcggggacggagaugcucugugcgucaccgaggaagaccucgccggcgaugacgaggauaugcccacauucccuuguacgcagaaagggcggccgggaccccgcugcuccagaugucaaaagaaccugucucuucacaccagcguucggauccuguaccucuuucuggcgcuucugcucguggcuguggccguccuggccucccugguguuccgcaaaguugacucucucagcgaagauauuucccugacacagucuaucuaugacaagaaacuugugcugaugcagaagaaucuccagggccuggauccuaaggcucuuaacaauugcagcuuuugucaugaggccgggcaacugggacccgaaauuagaaaacuccaggaggagcuggaaggcauccagaagcugcuccuggcucaggagguccaacuugaccagacccugcaggcccaggaagugcucuccacaaccagccggcaaauuucucaggagaugggcuccugcagcuucucuauccaccagguuaaccaaucccuggggcuuuuucuggcccaggugcgcggauggcaggcgacaaccgcuggccucgaucugagccugaaagaccucacgcaggaguguuacgaugucaaggccgcugugcaucaaaucaauuucaccguggggcagacaucugaauggauucacggaauccagagaaaaaccgacgaggaaacacugacccuucagaagauugucacggacuggcaaaacuauacacggcuguuuuccggccuccgcaccacaagcaccaagaccggggaggccguuaaaaauauccaggcgacacugggagccuccucucagagaauuagccagaacuccgaaagcaugcaugaucuugugcugcaagugaugggccuccagcugcagcuggacaauaucucuuccuuccucgaugaccacgaggagaacaugcacgaucugcaguaccauacgcacuaugcucaaaaucggaccgucgaacgcuuugagagccuugaaggcagaauggccucucaugagauugaaaucgggacaaucuucaccaacauuaaugcuacagacaaccacgugcacagcaugcugaaguaccucgaugacguucggcuguccugcacccugggauuucauacgcacgccgaggagcuuuauuaccucaauaaaucugugagcaucaugcugggcacaaccgaucugcuccgcgaaagauucucccugcuuagcgcccggcuggaccucaacgucagaaaccugucuaugauuguggaggaaaugaaggcuguugauacccagcauggggagauccugcgcaaugugacaauucuucggggagcgccugggcccccugggccgagaggauuuaaaggcgacaugggcgucaaggggcccgugggaggccgcgggccuaaaggagaccccggcucccucgggccucugggcccccagggaccgcaaggccagccuggggaagccggacccgucggcgagcgggggccugugggacccagaggcuuccccgggcugaagggcagcaagggaucuuucggcaccgggggaccucgcggccagccggggcccaaaggagauaucggcccucccgggccugagggacccccgggcuccccuggccccagcgggccucagggaaagcccggcaucgcugggaaaacaggauccccuggccaacggggcgccaugggccccaagggagaaccgggcauucaggggccucccggacuccccggcccuccggggcccccuggaucucagagcuuuuacuga

SEQ ID NO: 75251 - RNA, 1488 nt, Artificial Sequence
  derived and/or modified sequence opt5 from SCARA5__Homo_sapiens__NP_776194
auggagaacaaggccauguaccugcacaccgugagcgacugcgauacauccucuaucugugaagacagcuucgauggcagaucccucucuaaacugaaucuuugcgaggacgggcccugucauaagcggcgcgcuagcauuugcuguacgcagcugggaucccucucugcccugaaacacgcgguccuuggccuguaucuccugguuuuucugauccucguggggauuuucauccuggcugugagcagaccucgguccagcccggaugaccuuaaggcccugacccgcaacgucaauagacucaacgaaucuuuucgggaucugcaacuucgccugcuccaggcuccccugcaggccgaccugacagaacagguguggaaaguucaagaugcccuccagaaucaguccgacagccugcuugcucuggccggagcggugcagagacucgagggcgcccugugggggcuucaagcucaggccguccagaccgagcaggcuguggcccugcuccgggaucgcacaggacaacagucugacaccgcgcagcuggagcuguaccaacuccagguugaauccaacagcucucagcugcuucugagacggcaugccggccuccuggauggccuugcucgcagaguggggauucugggagaggaacucgccgacgucggcggggugcugcggggacugaaucacucccucagcuaugacguggcucugcaucgcacaagacuucaggaucugcggguccucguuuccaacgccucugaggacaccagacgccugcggcuggcccacgugggcauggagcuucaacucaagcaggaacuggcuaugcugaaugcggugacggaggaucucagacugaaggacugggaacacagcaucgcccuucgcaacaucucccuggcuaaagggccucccggaccuaagggcgaucagggcgacgaggggaaagaaggacggcccggcauuccugggcucccgggacugagaggccugcccggggagcgcggaaccccuggccuucccggcccuaagggggaugacggaaaacucggcgccacagggcccaugggaaugcggggcuucaagggggauagaggcccgaagggagagaaaggcgaaaagggggaccgcgccggagaugcuagcggcgucgaggccccuaugaugauccggcuggugaaugggucuggaccccaugaaggcagaguugagguguaccacgaccgccggugggggaccgucugcgacgauggcugggacaaaaaggauggagacgugguuuguagaaugcugggcuuucgcgggguggaagaggucuaucggacagcgagauucggacagggcaccgggcggauuuggauggaugacguggcuugcaaaggaacggaggaaacaaucuuuagauguuccuucagcaaguggggcgucaccaacugcgggcaugccgaggaugccucugugacauguaaucgccacuga

SEQ ID NO: 75252 - RNA, 1521 nt, Artificial Sequence
  derived and/or modified sequence opt5 from SCARB1__Homo_sapiens__NP_001076428
augggcugcagcgccaaggcuagaugggccgcgggggcucugggaguggccggccuccugugugccguccuuggggcuguuaugaucgugauggugcccucccugauuaaacagcaaguccucaagaacgugcggaucgacccuucuagccuguccuucaauauguggaaagagauuccgauccccuuuuaccuuucuguuuauuucuuugaugugaugaacccuagcgaaauucugaagggagagaaaccccagguccgcgaaagaggcccuuacguguaucgggaguuccgccacaaguccaauaucaccuuuaacaauaacgacacaguuucuuuccucgaauacagaacguuucaguuccagcccagcaagucccaugggagcgagucugauuauaucgugaugccuaauauucugguccugggagccgcugugaugauggagaacaaaccgaugacccucaagcugaucaugacacuugccuuuaccacacugggcgaacgggcguucaugaaucgcaccgugggcgagauuauguggggguacaaagacccccucgucaaccugaucaauaaguauuuuccuggaauguuccccuuuaaagauaaguucggccuuuucgccgaacugaacaauuccgacagcgggcucuuuacaguuuucaccggagugcaaaacauuucuagaauccaccugguggauaaguggaauggccuguccaaagucgacuuuuggcauagcgaucagugcaacaugauuaacgggacgucuggacagauguggccucccuucaugaccccggaguccagccucgaguuuuacuccccugaggcuugucggucuaugaagcugauguacaaagaaagcggcguguucgaaggcauccccacauaucgcuuuguugccccuaagacccuuuucgcuaauggguccaucuacccucccaacgagggauuuugccccugucuggaaagcggcauucagaaugugucuacaugcagauucuccgccccgcucuuucugagccacccccauuuccuuaacgcggacccuguccuggccgaggcugugaccgggcuccaccccaaucaagaggcccacucucuguuucuggauauccauccuguuacgggcauucccaugaacuguagcgugaaacuccagcugucccuuuauaugaagucugucgcuggaaucgggcagacaggaaaaauugaaccggugguccugccucuccugugguucgccgagagcggcgccauggaaggcgagacccuucacacauucuacacccagcuggugcucaugcccaagguuaugcauuaugcucaauacgugcugcuggcgcucgggugcguccugcuucuggugccuguuaucugucagauccggucccagggacccgaagacaccgugagccaaccuggccucgccgcugggcccgaucgcccgccuucucccuauacaccccugcugccugacuccccgagcggacagcccccuucucccacggccuga

SEQ ID NO: 75253 - RNA, 1008 nt, Artificial Sequence
  derived and/or modified sequence opt5 from SCARB2__Homo_sapiens__NP_001191184
augggcagaugcuguuucuacaccgccgggacacugagccuccugcuucuggugacguccgucacccuccugguugcucggguguuucagaaggccguggaccaaucuaucgagaaaaagauuguccuucgcaacggaacagaagcguucgauagcugggagaaacccccucugccgguguauacccaguuuuacuucuuuaauguuacaaaccccgaagagauccucagaggcgaaaccccucggguggaggaggucgggcccuauacauaccgcucccuggacugguggauuaccgauaagugcaauaugaucaacggaacggacggcgauucuuuccacccucugauuaccaaagacgaagugcucuauguuuuucccagcgauuucuguagauccguguacaucacauuuucugacuaugagagcguccaggggcugccugcuuuccgguacaaggugccggccgaaauccuugccaauaccuccgauaacgcuggauuuugcauucccgagggcaauugucugggcagcggggugcucaacgucucuaucugcaagaauggagccccuauuaucauguccuucccccauuuuuaccaggcugacgagcgcuucguuagcgccauugaaggcaugcacccuaaccaagaggaucaugaaacauucguggacaucaauccccugaccgggauuauccuuaaagcggccaagagauuucagaucaacauuuaugugaaaaagcuggaugacuucgucgagacgggagacauccggacaaugguguuuccgguuauguaccucaaugaaucugugcacauugauaaagagaccgcuucccgccucaagagcaugaucaacacaacccugauuaucaccaauaucccuuauauuaucauggcccugggcgucuucuuugggcugguguucacauggcuugcuuguaagggacagggcucuauggacgagggcacggccgaugaaagagcgccccugauucggaccuga

SEQ ID NO: 75254 - RNA, 2616 nt, Artificial Sequence
  derived and/or modified sequence opt5 from SCARF2__Homo_sapiens__NP_699165
auggagggcgccgggcccagaggagcuggcccugcccggcgcagaggggcgggaggcccgcccagcccucugcuccccucccugcuucugcuccugcuucuguggaugcucccugacaccguggcuccccaggaacugaacccucgggggcgcaaugucugcagagccccgggaucucaaguucccacauguugcgccggcuggcggcagcagggcgaugagugugggaucgcugugugcgaaggaaacagcacguguuccgagaaugaagugugcguccgcccuggcgaguguagaugccggcacggguacuucggagccaacugugacaccaagugcccccgccaguuuuggggcccugauuguaaagagcugugcucuugccauccccacgggcaaugugaagacgugacaggacagugcaccugucaugcuagacgguggggcgcccgcugcgagcacgcgugucagugccagcauggcacaugucacccgagaagcggggccugccggugugaaccuggaugguggggcgcucaaugcgccuccgcuuguuauugcucugccaccagccgcugcgauccccagacaggggcgugucucugccacgccggaugguggggcagauccuguaauaaccagugcgcuuguaauagcucuccuugcgagcagcaauccgggcggugucagugcagagagcgcaccuucggagcccggugugacagauacugccaguguuuucgcggccggugccaucccguugauggcacgugcgcuugugaacccggguauagaggaaaguacugccgcgagccuuguccggccggcuucuaugggcugggaugccggagacgcuguggccaaugcaaagggcagcagcccuguaccguggccgaaggccggugccuuacaugugagccuggauggaacggcaccaagugcgaccagcccugugcuacaggguuuuacggagaaggcugcagccacagaugcccucccugucgcgaugggcaugcgugcaaucacgucaccggaaaauguacgcggugcaacgccggcuggauuggggacagaugugagacaaagugcucuaauggcaccuauggagaggauugugcuuucgugugcgccgacuguggcuccgggcacugcgauuuucaaagcggacggugucugugcucuccgggcguucaugggccucacugcaacgugacaugucccccuggacuccauggcgccgacugcgcucaggccuguuccugccacgaagacaccugugaucccgucaccggggcgugccaucuggagacaaaucagcgcaagggcgugaugggagcuggcgcccuucuggugcuccuggucugucugcuccugagccuucuggggugcuguugcgccuguagaggaaaagacccuacgcggagaccccgcccgcggagagaacucucccugggccgcaagaaagcuccucacagacuuugcgggcgguucucucgcaucagcaugaagcugcccagaauuccccuccggcgccagaaacugccuaagguugugguggcccaccaugaucuggacaacacccucaauugcuccuuucuggagccgcccagcggacuugaacaaccuucucccuccuggagcucuagagcuagcuucuccucuuuugauacaaccgacgagggcccugucuacugugugccccacgaggaagccccugcggagagccgggaucccgaaguuccgacagugccugccgaggcucccgccccuucccccgucccgcugaccacgccugcuagcgccgaagaggcgaucccccucccugccucuuccgacagcgagcgcucugcuuccagcguggaagggcccggcggagcccuguacgcuagaguugcccggcgcgaggccagacccgcucgggcgagaggcgaaauugggggacuuucccugucuccuagcccggagcgccggaagcccccucccccugaucccgccacaaaaccuaagguguccuggauccauggcaaacacucugcugccgccgcugggagagccccgagccccccucccccuggauccgaggcggcucccagcccgucuaagcgcaaacggaccccuuccgacaagagcgcccacaccgucgaacauggcucucccagaacacgcgaucccaccccucggcccccuggccucccggaggaagccacagcucuggccgcgcccuccccucccagagcucgcgcccgggggagaggaccuggccugcucgagcccacggacgccgggggaccgccucggagcgcucccgaagccgcuucuaugcuggccgcggagcuucgcggcaaaaccagaagccuggggcgggccgagguggcucucggagcccagggcccucgcgaaaagcccgcuccuccccagaaggccaaaagauccgucccgccugccagccccgcucgggcgcccccugccacagagaccccgggccccgaaaaggcugccacagaccugccugcccccgagaccccuagaaaaaagacgcccauccagaaaccuccgcgcaagaagucucgggaagcugccggggagcugggaagagcgggcgcucccacccuuuga

SEQ ID NO: 75255 - RNA, 1290 nt, Artificial Sequence
  derived and/or modified sequence opt5 from SCCPDH__Homo_sapiens__NP_057086
auggccaccgagcagagacccuuccaccugguggucuuuggcgcuagcggguucacaggacaauuuguuacggaagagguggcccgggaacagguggacccugagcgcuccucuagacucccgugggcggucgcuggccggagccgcgaaaagcugcagagagugcuugagaaagccgcccugaagcucgggcggcccacccuguccucugagguuggaaucauuaucugcgauauugcuaacccugccagccuugacgaaauggcuaaacaggccacagugguccugaauugugugggccccuaccgcuucuauggggagccuguuaucaaggcgugcauugaaaacggagccuccuguaucgauaucucuggcgagccccaauuucucgagcugaugcagcugaaauaccaugaaaaggcugccgacaagggcguguauauuaucgggagcuccggauucgauagcauuccugcugaccucggcgucaucuacaccagaaauaaaaugaacgggacacugaccgccguggagucuuuucuuacaauucacuccggaccggaaggccugagcauccaugaugggaccuggaagucugcgauuuauggauucggcgaccaguccaaucuccggaaacugcgcaacgugagcaaucuuaagcccgucccucugaucggccccaaacucaagagacgguggccuaucucuuacugccgcgagcugaagggguauuccauucccuuuaugggaagcgauguuuccguggugagacggacgcagcgcuaccuguacgaaaaccucgaggagucuccgguccaauaugccgcuuacgugaccguuggcgggaucacaagcgugauuaaacugauguucgccggacuguuuuuccuguuuuucgucagauucggcaucgggcggcagcuccugauuaaguuuccuugguucuuuuccuucggauauuuuagcaaacagggccccacccagaagcaaaucgacgcugccucuuucacacuuaccuuuuucggccagggguacucccagggaacgggcacagauaaaaauaagccuaacaucaaaauuuguacccaagugaaggggcccgaagccggauauguugcuacacccaucgcgauggugcaggccgcuaugacccugcucagcgacgccucucaccuuccuaaggccggcggggucuuuaccccgggcgcugccuucagcaaaacaaagcugauugauagacucaauaaacauggaaucgaguuuuccgugauuucuagcuccgaagucuga

SEQ ID NO: 75256 - RNA, 993 nt, Artificial Sequence
  derived and/or modified sequence opt5 from SCD5__Homo_sapiens__NP_001032671
augcccggcccugccaccgacgcugggaagaucccguucugcgaugccaaagaggaaauuagagcgggacuggagagcuccgaaggcgggggaggccccgagcggccuggggcucgcggacagagacaaaacaucguguggcggaaugucguucucaugucucugcuucaccugggcgccguguacagccucgugcugauucccaaggccaaaccucuuacacugcucugggcuuauuuuuguuuccugcuggccgcucucggcgucacggccggggcgcaucgccuguggucccacagaucuuaccgggccaaacuuccccugcgcaucuuucucgcuguggccaacagcauggcuuuccagaaugacauuuuugaaugguccagagaucaucgggcccaccauaaguauucugagaccgacgcggauccucacaacgcccgcagaggauucuuuuucagccacaucggcuggcuguuuguucggaagcaucgcgacgugaucgagaaggggagaaaacuugaugucacagaccugcucgcugauccggugguucggauucagcgcaaguacuauaaaaucuccgugguccugaugugcuucguggugcccacccuggucccuugguacauuuggggagaaagccucuggaacucuuauuuucuggccuccauccuuagauacacaauuagccugaauaucucuuggcucguuaauuccgcugcccacauguacggcaaccggcccuaugacaagcauauuagcccuagacagaauccccugguggcccuuggggcuaucggagagggcuuccacaacuaccaccauaccuuuccguucgauuauucugcguccgaguucggccugaauuuuaacccuacaaccugguucaucgacuuuauguguuggcucgggcuggccacggaucgcaaacgggcuaccaagcccaugauugaagccagaaaggcccgcacaggagacagcuccgcuuga

SEQ ID NO: 75257 - RNA, 1080 nt, Artificial Sequence
  derived and/or modified sequence opt5 from SCD__Homo_sapiens__NP_005054
augcccgcccaccuucuccaggacgauaucagcuccucuuacaccacaacgaccacaauuaccgcuccuccgagcagagugcugcaaaacggcggggacaagcuggagacaaugccccuguaucucgaagaugacauccggccugauauuaaagacgauaucuacgaccccaccuauaaggauaaagagggaccuucccccaaggucgaauacguuuggcgcaauauuauccugaugucucuucugcaucucggcgcccuguaugggaucacacugauuccuaccugcaaauucuacacguggcucuggggaguguuuuauuacuucgugagcgcgcugggcaucaccgcuggggcccacagacuuuggucccaucggucuuacaaggcccgccugccgcucagacuguuucuuauuaucgcuaacacaauggccuuccagaaugacgucuaugagugggcucgggaucaccgcgcccaucacaaguuuagcgaaacccacgcggacccccauaacuccagacggggauucuuuuucagccacgugggcuggcugcucguucgcaaacauccugccgugaaggagaaaggcucuacacuggaucuguccgaccucgaggcugaaaagcuggucauguuucagagacgguacuauaaacccgggcuucugaugauguguuucauucucccuacccuggugcccugguacuuuuggggagagacguuccagaauagcguuuuuguggccacauuccuucgcuaugcugucgugcugaacgccaccuggcucgucaauucugcggcccaccuguucggcuacagaccguaugacaagaacaucuccccucgggaaaauauucuggugagccucggggcuguuggagagggcuuucacaacuaccaucacucuuuccccuacgauuauuccgccagcgaguaccgcuggcauaucaauuuuacaaccuucuuuaucgacugcauggcugcccuggggcuugccuaugauagaaagaaaguguccaaggcugcgauucuggcccggaucaaaagaaccggagacggcaacuacaagucuggcuga

SEQ ID NO: 75258 - RNA, 1653 nt, Artificial Sequence
  derived and/or modified sequence opt5 from SCFD1__Homo_sapiens__NP_001244305
augcccaccgaggaaaacaucgacagaaugugccaggaucugcggaaucaacucuacgagagcuauuaccugaacuucauuuccgccaucucucgcagcaaacuugaagacauugcuaaugccgcgcuggcugccuccgccgugacacaggucgcuaagguuuuugaucaguaucucaacuucaucacgcuggaggacgauauguuugugcuuuguaaucagaacaaggaacuggugucuuacagagccauuaaucggccugacaucaccgauacagagauggagaccgucauggacacaaucguggauagccucuucugcuuuuucguuacccugggcgcugugccgauuauccgcuguuccagagggacagccgcggaaauggucgccgugaaacuggacaagaaacuccgggagaaccugcgcgaugcuagaaauucucuuuuuaccggagacacgcugggcgccgggcaauucagcuuucagcggccccuccugguucuuguggaucgcaacauugaccuggcuaccccucuccaccauacauggaccuaucaggcccugguccacgacgugcuggauuuccaucucaauagagugaaccuggaagaguccagcggagucgagaauagccccgcgggcgcccggccuaagcgcaagaacaaaaaguccuacgaccuuacacccguugauaaauuuuggcagaagcacaaagggagcccuuucccggaaguggcugagucugugcaacaggaacuggaguccuauagagcccaggaagacgaggucaagcggcucaagagcaucaugggacuggagggcgaagaugagggcgcuauuucuaugcuuuccgacaauaccgccaaacugacgagcgccguguccucucuccccgaacugcuggagaagaaacgccucaucgaucugcauacaaacguugcuaccgcggugcuugaacacauuaaggccagaaaacuggacgucuacuuugaguacgaggaaaagaucaugagcaaaacaacccucgauaagucccugcuugacaucauuagcgauccugacgcugggacccccgaggacaagaugcggcuguuccucaucuauuacauuucuacacagcaagccccuuccgaagccgaucuggagcaguauaaaaaggcucugacggacgccggaugcaaccucaauccccugcaguacaucaaacaauggaaggcguucaccaaaauggcuagcgccccggccucuuauggcagcacaaccacaaagccuauggggcuucuguccagagugaugaacaccggaucucaguuuguuauggaaggcgugaagaaucucguccugaaacagcagaaccugcccgugacgcgcauucuugauaaucucauggagaugaagucuaacccugagacagacgauuaccgguauuucgaccccaaaaugcugagagggaaugauuccagcgucccccgcaacaagaauccuuuucaagaagcuaucguguucguugugggaggcggcaacuacaucgaguaccagaaucuggucgacuauauuaaagggaagcagggaaagcacauccucuacggcuguucugaacuguuuaacgccacccaguucauuaaacaacuuucccagcuggggcagaaguga

SEQ ID NO: 75259 - RNA, 2055 nt, Artificial Sequence
  derived and/or modified sequence opt5 from SCFD2__Homo_sapiens__NP_689753
augagcgccuccggcgugcugucuuucacccagcaagggugggagcagguccucgcuaagguuaaaagagccgugguguaccuggacgcggcuugcgccgaaagccuucacuggggauguggcuccacacggcugcucgaggccgucgggggacccgauugccaucugcgcgaauuugagccugacgcuaucggcgggggagccaagcagccgaaagcuguguucguucuuucuugucugcucaagggcagaacgguggaaauucugcgggauaucauuugccgcagccacuuucaguauugugucgugguuaccacagugucccaugccguccaccugaccgcgaaccaugugcccgccgcugccgcugccgagauggagggccaacagccuguguucgaacagcucgaggaaaaacugugcgaguggauggggaauaugaacuacacagcggaggucuuucacguuccccuucugcucgccccuguggcuccccacuucgcccugaccccugcuuuugccucucuuuucccgcugcucccccaggacgugcaucugcugaauagcgccagaccugauaagcggaagcucggaucccugggcgacgucgauagcacaacccuuacgcccgaacugcuccugcaaauccgcugucuugugucugggcuguccagccucugcgagcaccugggaguuagagaagaguguuuugcugugggcucucugucccaggucauugcggccgaccucgcuaacuaugccccugccaaaaaucggaagaaaaccgcugccgggcgcgcgagcgugguuuucguggauagaacacuggaccuuaccggagcugucggccaucacggcgauaaccugguggaaaagaucaucucugcccucccccagcugccggggcacacaaaugacgucauggugaacaugauugcccuuaccgcucugcauacggaggaggaaaauuacaacguuguggccccuggaugccucucccagagcuccgauacaaccgcuaaagcccugugggaggcgcugcucaauacaaagcacaaggaagccgucauggaggugcggcgccaucugguugaagcugccucuagagagaaccuucccaucaaaaugagcaugggccgggugaccccugggcaacugauguccuauauucagcucuuuaagaauaaccugaaagcucugaugaaucacuguggacuucuccagcugggccuggccaccgcgcaaacacucaagcauccccagacggccaaaugggacaacuuccuggcuuuugagcgccuucugcuccagagcaucggggaaucugccauguccgucgugcugaaccagcugcuucccaugauuaagccugugacccaaagaacaaaugaggacuacagcccggaggaacuccugauccugcucauuuauaucuacucuguuaccggagaacugacagucgauaaagaccuuugcgaggcugaggaaaaggugaagaaagcccuggcccagguguucugcgaggaaagcggccucucuccccugcugcagaagaucaccgauugggacuccagcauuaaccuuacguuccacaaauccaagaucgcugucgaugagcucuuuacaagccugcgggacauugcgggcgccagaucucugcucaaacaguucaaguccguguacguuccugggaaucacacccaucaagcuagcuauaagccccugcuuaaacagguggucgaggaaaucuuucacccugagcgccccgauucuguggacauugaacauauguccagcggacugaccgaucuccugaagacaggcuucuccauguuuaugaaaguuucucggccgcacccuagcgacuacccccugcuuauccucuucguggucgggggagugaccguuuccgaggugaagauggucaaagaucugguggccucucugaagccuggcacacaggugaucguccucagcacgagacugcuuaagccccugaacauuccugaacuccuguuugccaccgaccgccugcaccccgaccuuggguucuga

SEQ ID NO: 75260 - RNA, 1854 nt, Artificial Sequence
  derived and/or modified sequence opt5 from SCG2__Homo_sapiens__NP_003460
auggccgaggcuaagacccacuggcugggcgccgcgcucagccugaucccccuuauuuuccugaucuccggggcugaagccgccucuuuucagagaaaccaacuccugcagaaagagccugaccuucggcuggaaaaugugcagaaguucccgagccccgagaugauucgcgcucucgaauacaucgagaaccugagacagcaagcccauaaagaggaauccucuccugauuauaaucccuaccagggagucagcguuccucugcagcagaaggagaacggcgacgaaucccaccuccccgagcgggauucucugagcgaggaagacuggaugcgcauuauccuugaggcucugagacaagccgaaaaugagccucaguccgcgccgaaagaaaacaagcccuaugcccucaauagcgagaagaacuuuccuauggauaugucugacgauuacgagacacagcaguggcccgaacggaaacugaagcauaugcaauucccucccauguaugaggaaaauucccgcgacaacccguuuaaaagaacgaaugagaucguggaagaacaguacaccccucagagccuugcuacacuggagucuguguuccaagaacucgggaagcugaccggacccaacaaucagaaacgggagcgcauggaugaggagcagaagcuguauacagacgaugaagacgauauuuacaaggccaacaauaucgcuuacgaggacgucgugggcggggaggacuggaacccuguugaagagaaaauugaaucccagacccaagaggaggugagagauagcaaggaaaacaucgagaaaaaugaacagauuaacgacgagaugaagcggucuggacagcucggcauccaggaagaggaucugcgcaaagaguccaaggaccaacuuagcgaugacgucuccaaagugauugccuaucugaagagacucguuaaugcggccggcucugggcggcugcagaacggacagaauggcgaacgcgcuacaagacuuuuugagaagccccuggauagccaguccaucuaccaacucaucgaaauuagccggaaccugcagauucccccugaggaccugaucgaaaugcucaaaaccggggagaagccgaauggaucuguggagcccgaaagagagcuggaucuuccugucgaccuggaugacaucuccgaagccgaccucgaucaccccgaccuguuccagaaccgcaugcuuagcaaaucuggcuauccuaagacgcccgggcgggcuggaaccgaggcccugccggauggccucagcguggaagacauucugaaucugcucggcauggaguccgccgcuaaccagaaaacaucuuacuuuccuaaucccuauaaccaagagaaggugcugccuagacuucccuacggggcgggacgcagccgguccaaucagcugccuaaggccgcuuggaucccccaugucgaaaacagacagauggccuaugagaaucucaacgauaaagaccaagaacugggcgaguaccuggcccgcaugcuuguuaaguacccggagaucauuaacagcaaucaggugaaacgggugccugggcagggaucuuccgaagaugaccuccaggaggaggaacaaaucgaacaggcuauuaaggagcaccugaaccagggcagcucucaggagaccgauaaacuggcccccgucuccaagagauuccccguggggccuccgaagaaugacgauacacccaaccgccaauauugggacgaagaucuccugaugaaaguucuugaguaccugaaucaggaaaaggcggagaaaggacgggaacacaucgcuaagagagccauggagaacauguga

SEQ ID NO: 75261 - RNA, 711 nt, Artificial Sequence
  derived and/or modified sequence opt5 from SCG3__Homo_sapiens__NP_001158729
auggccgcuauccaggacggccuggccaagggggagaacgaugaaaccgugagcaauacacucacgcugaccaacggacuugagagacggacaaaaaccuacuccgaagacaauuucgaggaacugcaauauuuucccaacuucuacgcgcuccugaagucuauugauagcgagaaagaggcuaaggaaaaagagacacuuaucaccauuaugaagacacugaucgacuuugucaagaugaugguuaaauauggcaccauuuccccugaagagggggugucuuaccucgagaaucuggaugaaaugaucgcccugcagacgaagaacaaacucgagaagaaugccaccgacaacaucagcaaacuguucccggcucccuccgaaaagucucacgaggaaacagauagcaccaaggaggaggccgcuaaaauggaaaaggaguauggaucccuuaaagacagcacaaaggaugacaauucuaacccuggcgggaaaaccgaugaacccaagggaaaaacggaggccuaccuggaagcgauucgcaagaauaucgaguggcucaagaaacaugacaagaaaggcaacaaggaggauuaugaccuguccaaaaugagagacuuuauuaauaagcaggccgaugcuuacguggaaaagggcauccuugacaaagaggaagccgaggcuauuaagcggaucuacagcucucuguga

SEQ ID NO: 75262 - RNA, 639 nt, Artificial Sequence
  derived and/or modified sequence opt5 from SCG5__Homo_sapiens__NP_001138229
auggugagcagaauggucuccaccaugcugucuggccuccuguucuggcuugccagcggguggacacccgcuuuugccuacuccccucggacgccggaccgcguuucugaggcggauauccagagacugcuccacggagugauggaacaacugggcauugcucggccccgcguggaguauccugcccaucaggccaugaaccuugucgggccccagagcaucgaaggaggcgcucacgaggggcugcagcaucucggaccuuucggcaauauucccaacaucguggccgaacugaccggcgacaauauuccuaaggauuuuuccgaggaccaaggguacccggaucccccuaaccccugcccuguuggaaaaacagcugacgauggcugucuggagaauacccccgacacagccgaguucucuagagaauuucagcuccaccagcaucuguucgauccggaacacgacuauccugggcuuggaaaguggaacaaaaagcugcucuacgagaaaaugaagggcggggagcggcgcaagagacggagcgugaaucccuaucugcagggacaacgccuugauaacgucguggcgaaaaaguccguuccucacuuuagcgacgaagauaaagaccccgaguga

SEQ ID NO: 75263 - RNA, 276 nt, Artificial Sequence
  derived and/or modified sequence opt5 from SCGB1A1__Homo_sapiens__NP_003348
augaagcuggccgugacccucacacuggucacgcuugcucugugcuguagcuccgccucugcggagaucugccccagcuuccagagaguuauugaaacccuccugauggacacaccuuccucuuacgaggcugccauggaacuuuuuagcccggaucaagacaugcgggaggccggcgcucagcugaaaaagcucguggauacccugccccagaaaccucgcgaauccaucauuaagcugauggagaaaaucgcccagucuagccucuguaacuga

SEQ ID NO: 75264 - RNA, 273 nt, Artificial Sequence
  derived and/or modified sequence opt5 from SCGB1D1__Homo_sapiens__NP_006543
augagacugagcgugugccuccugcuucugacccucgcccuguguugcuaccgggcuaacgccgucguuugucaggcgcuuggcuccgagaucacaggguuccugcucgcuggaaagcccguguuuaaauuccaacuggccaaguuuaaagccccucuggaagcuguggccgcuaagauggaggucaaaaagugcguggacacgauggccuaugaaaagcgcguucucauuaccaaaacacugggcaagaucgcggagaaaugugauagauga

SEQ ID NO: 75265 - RNA, 273 nt, Artificial Sequence
  derived and/or modified sequence opt5 from SCGB1D2__Homo_sapiens__NP_006542
augaagcugagcgugugccuccugcuugucacccuggcccucuguugcuaccaggcuaacgccgaguucugucccgcgcugguuuccgaacuucuggacuuuuucuuuaucucugagccucucuucaaacugagccuggcuaaguuugaugccccgcccgaagccguggcugccaaacucggcgugaagagaugcacagaccaaaugucccugcagaaacggucucuuauugcugagguccuggugaagauccucaagaaauguagcguuuga

SEQ ID NO: 75266 - RNA, 288 nt, Artificial Sequence
  derived and/or modified sequence opt5 from SCGB2A1__Homo_sapiens__NP_002398
augaagcugcucauggugcugaugcuugccgcucugcuccugcacugcuacgccgacagcggcuguaaacuucuggaggauauggucgaaaagaccaucaacagcgacauuucuauccccgaguauaaagaacuccugcaggaguucauugauagcgacgcggcugccgaagccauggggaaguuuaaacaaugcuuccugaaucagucccauagaacacucaagaacuuuggacugaugaugcacacgguuuacgauucuaucugguguaauaugaaguccaacuga

SEQ ID NO: 75267 - RNA, 282 nt, Artificial Sequence
  derived and/or modified sequence opt5 from SCGB2A2__Homo_sapiens__NP_002402
augaagcugcucauggugcugaugcuugccgcucugagccagcacugcuacgccggcuccggguguccccuccuggagaacgucaucucuaaaaccauuaauccucaaguuagcaagacagaauauaaagagcuucugcaggaauuuaucgacgauaacgcgacgaccaaugcuauugacgagcucaaggaaugcuuucugaaccagacagaugagacccuguccaauguggagguguucaugcagcucaucuacgacucuagccugugugaucuuuucuga

SEQ ID NO: 75268 - RNA, 291 nt, Artificial Sequence
  derived and/or modified sequence opt5 from SCGB2B2__Homo_sapiens__NP_001020762
augagagugaccagcgccacaugcgcucugcuccuggcccuuaucuguuccguccagcugggcgacgcgugccucgauauugacaagcugcuugcuaacguuguguucgaugugucucaagaccugcucaaagaggaacuggcccgguacaaucccagcccucugacggaggaauccuuucucaacguccagcaguguuucgccaaugugucuguuaccgagcgcuuugcucacagcguggucaucaagaaaauucugcaguccaacgauugcaucgaagccgcuuucuga

SEQ ID NO: 75269 - RNA, 315 nt, Artificial Sequence
  derived and/or modified sequence opt5 from SCGB3A1__Homo_sapiens__NP_443095
augaagcuggccgcucuccugggccuuugcguggcccugagcuguuccucugcggcugccuuccucgucgggagcgccaaacccguugcucagccuguggccgcucuggaguccgccgcggaagccggagcuggcacccuugccaacccgcuggggacacucaauccccugaagcugcuccugucuagccuuggaaucccugugaaccaccugauugagggcucccaaaaaugcgucgcugaacucgggccccaggccgugggagcgguuaaggcccugaaagcccuucugggcgcucucacgguguuuggcuga

SEQ ID NO: 75270 - RNA, 282 nt, Artificial Sequence
  derived and/or modified sequence opt5 from SCGB3A2__Homo_sapiens__NP_473364
augaagcuggugaccaucuuccuccuggucacaauuagccuuugcuccuacucugccacggcuuuucugaucaacaagguuccccucccuguggacaagcuggccccgcuuccccuggauaauauucucccuuucauggacccccugaaacugcuccugaagacccuuggcaucagcguggagcaccuggucgaagggcucagaaaaugugugaacgagcugggaccugaagcguccgaggcuguuaagaaacuucuggaagcccucucucaucugguguga

SEQ ID NO: 75271 - RNA, 831 nt, Artificial Sequence
  derived and/or modified sequence opt5 from SCGN__Homo_sapiens__NP_008929
auggacagcuccagagagcccacccugggccggcucgaugccgcuggguucuggcaaguguggcagcgcuuugacgccgaugaaaagggauacaucgaggaaaaagagcuggacgcguucuuucuucacaugcugaugaagcucggcacagaugacacggucaugaaagcuaaccugcauaagguuaaacagcaguucaugaccacacaggaugccucuaaggacgggcggauucggaugaaggaacuugccggaauguuucugagcgaggaugagaauuuccuccugcuguuucgcagagaaaacccucucgacuccucuguggaguucaugcaaaucuggcggaaauaugaugcugacagcuccggcuuuauuucugccgcugaacugcgcaauuuccuuagagaucuguuucuccaccauaagaaagccaucagcgaggcgaagcuggaggaauacaccgggacaaugaugaaaauuuucgaccggaacaaggacggacgccuugaucugaaugaccucgccagaauccuggcucugcaggagaacuuucuccugcaguucaagauggaugccugcuccaccgaagagagaaaacgcgacuucgaaaagaucuuugcuuauuacgaugugagcaaaacaggcgcccuugagggcccggaggucgacggguucgugaaggauaugauggaacugguucagcccucuauuuccggaguggaccucgauaaauuuagagagauccugcuucggcacugugacgucaauaaggauggcaaaauucaaaagagcgaacuggcgcucugccuggggcugaagaucaacccuuga

SEQ ID NO: 75272 - RNA, 1425 nt, Artificial Sequence
  derived and/or modified sequence opt5 from SCHIP1__Homo_sapiens__NP_001184036
auggagagaagcggccagcgggugaccacaugggacugcgaucaagggaagcacuccgacucugauuaccgcgaagacggaauggaucugggcagcgacgccggguccucuagcuccucuagcagagcuuccagccagucuaacuccacgaaagucacccccuguagcgagugcaagucuuccagcucuccuggaggcucccucgaucugguuagcgcccuugaagacuaugaggaaccguuccccguguaccagaaaaaggugaucgaugagugggcgccugaggaagacggggaggaagaggaggaagaggaugaacgggaccagcgcggauauagagaugaccggucccccgcucgcgagccuggcgacgucucugccagaacacggagcggcgggggaggcgggcgcuccgccaccacagcuaugcccccuccggugcccaauggaaaccugcaucaacacgauccucaggaccucagacauaauggcaacguuguggucgccgggcggcccagcuguucucgcggaccuagacgggcuauucagaaaccccagccggccggcggccgcagauccgggcggggaccugcggccggcgggcugugccuucaacccccugauggaggcaccugugugcccgaggaacccccuguuccgcccauggacugggaggcucuggaaaagcaccucgccgggcugcaguuuagagagcaggaagcucagaagaaugagcgcgaaagcauccggcaaaaacuggcccucggaucuuucuuugaugacggcccuggcauuuacacaagcugcuccaagucugggaaacccagccuguccagcagacuucagucuggaaugaaccugcagaucuguuucgugaaugauuccggcagcgacaaggauucugacgcggaugacuccaaaaccgagacgagccucgacaccccucugucccccaugucuaagcaaagcuccucuuauagcgaucgcgacacaaccgaggaagaguccgaaagccuugaugacauggauuuucugacacggcagaagaaacuccaggccgaggcuaagauggcccuggcuauggccaaaccgauggccaagaugcaggucgaaguggagaaacaaaacagaaagaaaucuccuguggcugaccugcucccccauaugccucacauuuccgagugccugaugaagcgcagccuuaagcccaccgaucugcgggacaugacgaucgggcagcuccaggucaucguuaaugaucugcacucucagauugaaucccuuaacgaggaacuggugcaacuccugcugaucagagacgagcuccauacagagcaggaugcgaugcugguggacauugaagaucuuacccgccacgccgagagccagcagaaacauauggcugaaaagaugccugccaaauga

SEQ ID NO: 75273 - RNA, 2148 nt, Artificial Sequence
  derived and/or modified sequence opt5 from SCIN__Homo_sapiens__NP_001106177
auggccagagagcuguaccacgaagaguucgcucgggccggcaagcaggcggggcuccaaguguggcgcaucgaaaaacuggagcuuguccccguuccucagagcgcucauggagacuuuuaugugggcgaugccuaccuggugcuccacaccgccaagacauccagaggguucacguaucaucugcacuuuuggcuuggaaaagaaugcucucaggacgagagcaccgcugccgcuauuuucacaguccagauggaugacuaccugggcgggaagccggugcaaaaccgggagcuccagggauaugaauccaaugauuuuguuucuuacuucaaaggcggccugaaguauaaggccgggggaguggcgagcggccugaaccauguccucaccaaugaccugacagccaaacgccuucugcacgugaaggggagacggguugugcgcgcuaccgaggucccccucuccugggauucuuuuaacaaaggagacuguuucaucauugaucugggcacagaaaucuaccaguggugcgggagcuccuguaauaaguacgagagacuuaaagccaaccagguggcuaccggcauucgguauaaugagcgcaagggaagaagcgaacugaucguggucgaggaaggcucugagccuuccgaacucaucaagguucugggggagaaacccgagcugccugacggaggcgaugacgaugacauuaucgccgacauuagcaaccggaagauggcgaaacucuacauggugucugaugccuccgggagcaugcgcgugacggucguggcugaagagaaucccuuuucuauggccaugcugcuuuccgaagagugcuucauccuggaccacggagcugccaagcaaauuuuuguuuggaaaggcaaggaugccaacccucaggaaagaaaagcugcgaugaagaccgccgaggaguuccuccagcagaugaauuauagcaagaacacacaaauccaggugcugccggaagggggagagacccccauuuuuaaacaguucuucaaggacuggcgggauaaagaccaauccgauggcuuuggcaaggucuacgugacagaaaaaguugcucagaucaagcagaucccuuucgacgccucuaaacuucauagcagcccccagauggccgcucaacacaauaugguggaugacggguccggaaaagucgagauuuggcgcguggaaaacaauggcagaauccaggucgaucagaacucuuauggggaguuuuacggaggcgacuguuauauuauccuguacaccuacccucgggggcagauuaucuauacguggcaaggcgccaacgcgacaagagacgagcucaccacauccgcuuuccugaccgugcagcuggaucgcagccucggaggccaggccguucagauccgggugucucaagggaaggaacccguccaucugcuuagccuguuuaaagacaagccgcucauuaucuacaaaaauggaaccuccaagaagggcgggcaggccccugcucccccuacaagacuguuccaggugcgccggaaccuugccucuauuacgagaaucguugagguggaugucgacgcuaauagccugaacuccaaugauguguuugugcucaaacugccccagaacagcggauauauuuggguuggcaagggggccucucaagaagaggagaaaggcgcggaauacgucgccuccgugcugaagugcaaaacccuccgcauccaggagggagaggaacccgaagaguucuggaauagccugggcgggaagaaggacuaucagacaucuccucuucuggagacccaagcugaagaucacccgccccggcucuacggauguuccaacaaaacaggcagauuugugaucgaggaaauuccuggggaguucacccaggacgaucuggccgaagacgaugucaugcugcuugacgcuugggagcagaucuuuauuuggaucggaaaggaugccaaugagguggaaaagaaggagagccucaaauccgcgaagauguaucuggaaacggaccccucuggccgcgacaaacggacaccuauuguuaucauuaagcaggggcacgagcccccgaccuucaccggcugguuucugggaugggauagcuccaagugguga

SEQ ID NO: 75274 - RNA, 240 nt, Artificial Sequence
  derived and/or modified sequence opt5 from SCLT1__Homo_sapiens__NP_001287826
auggccgcugagaucgacuuccugagagaacagaaccggcgccucaaugaggauuuuagacgguaccaaauggagagcuucuccaaguauucuagcgugcagaaagccgucugccagggcgaaggggacgauaccuuugaaaaccugguuuucgaccaguccuuucuugcgccccuggugacagaguacgauaagcaccucggagagcugaauggccaacuuaaauauuaccaggcuuga

SEQ ID NO: 75275 - RNA, 1362 nt, Artificial Sequence
  derived and/or modified sequence opt5 from SCLY__Homo_sapiens__NP_057594
augcccggcagcuccggggccggaauggaggcugccguggcgccuggcagagacgcuccggcccccgccgcuucucagccuagcgggugcggaaagcacaacucccccgaacggaaagucuacauggauuauaaugccaccacaccucuggagcccgaaguuauccaagcuaugacgaaggccaugugggaggcguggggcaacccuucuagcccguacuccgccgggcgcaaagcuaaggacauuaucaaugccgcuagagaaucucucgccaaaaugauuggaggcaagccccaggauaucauuuucaccagcggcgggacagaguccaacaaucuggugauccauagcguggucaagcacuuucaugcgaaccagaccucuaaaggacacacaggcgggcaucacuccccugugaagggagccaaaccccacuucaucaccagcucuguugagcaugacuccauucggcuuccucuggaacaccucguggaggaacaggucgcugccgugacauuuguucccgugagcaaggucucuggccaagcugagguggaugacauccuggccgccgugcgcccgaccacgagacuugucaccauuaugcuggcuaauaacgagacagggaucguuaugccugugcccgaaauuucccagcggaucaaagcgcucaaucaggagcgcguggccgcuggacugccucccauucugguccauaccgaugccgcccaggcucucggcaagcaaagaguggacguugaagaucugggcguggacuuccuuacaaucgucgggcacaaguuuuauggaccccggaucggcgcccuguacauucgcgggcucggagaguucaccccucuguauccgaugcuuuuuggcgggggacaggaaagaaacuuccggcccggcacggagaauacaccuaugaucgcgggccuggggaaagcugccgagcucgugacccagaacugugaagccuacgaggcucacaugcgcgauguuagagacuaucuggaggaacggcuggaagccgaguuuggacagaagcgcauucaucucaauagccaauuccccggcacacagagacugccuaauaccugcaacuuuuccauccgggggcccagacuucagggacacgugguccuggcucaaugucgcgugcucauggccucugucggcgcggccugccauagcgaucacggggaccagccguccccugugcugcuuagcuacggcguucccuucgacguggcucggaacgcccugagacucucugucggacgcuccaccacacgggcugagguggaucugguugugcaggaccugaaacaggccgucgcgcaacucgaagaucaggccuga

SEQ ID NO: 75276 - RNA, 2103 nt, Artificial Sequence
  derived and/or modified sequence opt5 from SCML2__Homo_sapiens__NP_006080
augggccagaccgugaacgaggacagcauggaugucaagaaagaaaaucaagagaagacaccccaguccucuacgagcuccguucagagagacgauuuccacugggaagaguaccugaaagaaaccgggucuaucagcgccccuuccgagugcuuucggcagucucaaauuccgcccgugaacgacuucaaggugggaaugaaacucgaggcucgcgauccuagaaaugccacaagcgucuguaucgcgaccgugauuggcaucacaggggcucggcugcgccuuagacuggacggauccgauaaccggaaugacuuuuggcgccucguugauagccccgacauucagccuguggggaccugcgaaaaggagggcgaucugcuucagcccccucugggauaucagaugaacacaucuuccuggccgauguuccuccugaagacccugaauggcagcgaaauggccucugccacgcucuuuaaaaaggagcccccuaaacccccucugaacaauuucaaggucggcaugaaacuugaggcuaucgacaagaagaaccccuaccugaucuguccggccaccauuggggaugugaaaggagacgaaguucauaucacauuugacggcugguccggggcuuucgauuauuggugcaaguacgacagcagagauauuuuuccugccggauggugucggcucaccggcgacgugcugcaacccccugggacaucuguccccaucgugaaaaauauugcgaagaccgaguccagccccuccgaagccucucagcacagcaugcaguccccucagaaaacgacacuuauccugccgacccaacaggugcgcagaagcucucggauuaagcccccuggacccacagcugucccuaaacgcuccagcucuguuaagaacaucacccccagaaagaaaggcccgaauagcggcaagaaagagaagccucuccccgugaucugcuccaccucugccgcuagccugaaaucccugacacgggaucgcgggaugcucuauaaggacguggccagcggaccuuguaagauugucaugucuacggugugcguuuacgugaacaaacauggcaauuucgggccccaccuggauccuaagagaauccagcaacuucccgaccauuuuggaccgggcccugucaacgugguucugcggagaauugugcaggcgugugucgauugcgcccucgaaaccaaaacaguguucggguaucugaagcccgacaaccgcggaggcgaggucaucaccgcuuccuuugauggcgagacacacagcauucagcuucccccuguuaauucugccuccuucgcucugcgguuccucgaaaacuuuugucacagccugcagugcgacaaucugcucuccucucaaccguucagcuccucuagagggcauacccacagcuccgccgagcaugacaaaaaccagagcgccaaggaagaugugacggagcgccagucuacaaagcggagcccccagcaaaccgugccuuacgucgugccccuguccccuaaacuucccaagaccaaagaauacgcuucugagggagagccucuguuugcgggcggguccgccauccccaaggaagagaaucucagcgaagacucuaaaagcuccagccugaacucuggaaauuaucuuaacccggcuugcagaaauccuauguacauccacacauccguuagccaggauuucucccgcucugugcccggcaccacaagcuccccucuggucggggacauuucucccaagagcuccccgcacgaggugaaguuucagaugcagcggaaaucugaagccccuagcuauaucgccgugcccgauccuuccguucucaagcaaggcuucagcaaagaccccucuacgugguccgucgaugaggugauucaguuuaugaagcauaccgacccccagaucagcggaccucuggcugaucuguucagacagcacgagauugacggcaaagcccucuuucugcuuaagucugaugugaugaugaaauacauggggcugaagcucggaccggcgcugaagcuguguuauuacaucgaaaaacuuaaggagggcaaauauuccuga

SEQ ID NO: 75277 - RNA, 1245 nt, Artificial Sequence
  derived and/or modified sequence opt5 from SCML4__Homo_sapiens__NP_932347
augcagagccaaagaauccccggccggaagcgcgggagaccuucccugcacucuaccccgaugaaaauggccgugcauaaccucuacagcgcuuccgccggaucucugcccgcggucaagauuccuaaaaagcggggccgcaaacccggguauaagaucaagagcagaguucuuaugacaccucuggcucucucucccccucgguccacgccggagcccgaccugagcuccauuccucaggaugccgccaccgugcccagccuugcugccccucaggcucugacagugugccucuacaucaauaaacaggccaacgcgggacccuaucuggaacgcaagaaaguccaacagcugccggagcacuucggcccugaaagacccucugccgugcuccagcaggcuguucaagccuguauugacugcgcucaucagcagaagcugguguuuucccuugucaaacagggguacggaggcgagauggugagcguuucugccuccuucgauggcaagcaacaucugcggagccucccuguggucaauucuaucggguaugugcugcgcuuucuugcgaagcuguguagaucccuccugugcgacgaucuguucagccaccagcccuuuccccggggauguuccgccucugaaaaagugcaggagaaggaggaaggccgcauggagagcgucaaaaccguuacaaccgaagaguaccucgugaacccuguggggaugaauagauauuccgucgacacaagcgcuucuaccuucaaccaccggggaucccugcacccgagcucuagccuuuacugcaagcgccaaaauuccggcgauucucaucucgggggaggccccgccgcuacggccggcgggccuagaaccagccccauguccagcggaggcccuucugcccccgggcugcggccgccugcuuccagccccaaaagaaacacaaccucucuggagggaaaucgcugugcguccagcccuucccaggacgcccaggaugcucggagaccccgcucucggaacccuagcgccuggacaguggaagacguugugugguuugucaaggaugccgacccccaggcucuuggcccgcacguggagcuguucagaaaacaugaaaucgaugggaaugcccuccugcugcucaaguccgacaugguuaugaaguaccugggacuuaaacugggcccugcgcucaagcugugcuaucacauugacaaacuuaagcaagcuaaauuuuga

SEQ ID NO: 75278 - RNA, 5871 nt, Artificial Sequence
  derived and/or modified sequence opt5 from SCN10A__Homo_sapiens__NP_006505
auggaguuccccauuggcagccuggaaacaaacaauuuuagacgguucacaccugagucccucguggaaauugagaagcagauugccgcuaaacaagggacgaagaaagccagagaaaagcacagagagcagaaagaccaggaggaaaagccccggccccagcuggaucuuaaggccugcaaccaacugccuaaauuuuacggggagcuccccgcugaacugauuggcgagccucuugaggaccuggaucccuucuauucuacccaucgcacauuuaugguccucaauaaggggagaaccaucagccgguucuccgccacacgcgcccuguggcuguuuucuccuuucaaccucauuagacggaccgcuauuaaaguuagcgugcacuccugguuuucucuguucaucacagugaccauucuugucaauugugugugcaugacgcgcaccgaccugccggaaaagaucgaguacguuuuuacagugauuuauaccuucgaagcccucaucaaaauucuggcuagaggauuuugucuuaacgaguucacauaccugcgggaucccuggaauuggcucgacuucagcgucaucacccuggccuaugugggcacggcgauugaucugcgcgggaucuccggacucagaacauuucggguucugcgcgcccuuaagaccgugagcgucaucccuggccugaaggugauugugggcgcucucauccauucugucaaaaagcuggccgacguuacaauucuuaccaucuucugccuguccguguuugcucucguggggcugcagcuguucaaaggaaaccucaagaauaaaugugucaagaacgauauggccgugaaugaaaccacaaacuacagcucucacagaaaacccgacauuuauaucaauaagcggggcacguccgauccucugcuuugcgggaacggaagcgacucuggccauugucccgauggguacaucugccugaagaccuccgacaauccggacuuuaacuacaccagcuucgauuccuuugcgugggccuuccucucucuguuuagacuuaugacccaggacagcugggagcgccuguaucagcaaacacuccggaccuccggaaaaauuuacaugaucuucuuuguucuggugauuuuccugggcagcuuuuaucucgucaaccugauccuugcugugguuacgauggccuacgaggaacagaaucaggcuacaaccgaugagauugaagccaaggagaaaaaguuccaggaagcccuggagaugcucagaaaagagcaagaagugcuggcugcgcugggcaucgacaccacaucucuucacucccacaacgggagcccucucaccucuaagaaugccagcgagcgccggcauagaaucaagccccgcgucuccgaaggaucuacagaggauaacaaaagcccucgguccgaccccuauaaucagagacgcaugagcuuccugggccuggcuucugggaagcggagagccucccacggaagcguguuucauuuccgcucucccggccgggauauuucccucccugaaggggucacggacgauggaguguuuccgggcgaccacgagagccacagaggcucccugcuucucgggggcggcgccgggcagcaaggaccccugccucggucuccccugccucagcccagcaacccggauucccgccauggcgaggacgaacaccagccucccccuaccucugagcuggcucccggggccguugacgugagcgcguucgaugcuggccagaaaaagacauuucuuuccgccgaauaccucgacgagccuuucagagcccaacgggcuaugagcgucgugucuaucauuaccuccguucuggaggaacuggaggaaagcgagcagaaaugucccccgugccucacaucucugucccagaaguaucuuaucugggauuguugcccuaugugggugaagcugaaaaccauucucuuuggacuggucacggaccccuucgccgaacugaccaucacacuuugcauuguggugaauaccaucuuuauggcuauggagcaucacggcaugagccccacauucgaggccaugcuccagaucgggaacauuguuuuuaccaucuucuuuacggcggaaauggucuucaagauuaucgccuucgauccuuacuacuauuuucagaaaaaguggaauauuuucgacuguaucaucgugacagugucucugcuggagcucggagucgcuaaaaagggcagccuguccgugcuucgcagcuuucgccugcuccggguuuucaagcuggccaaaucuuggccgacccugaacacacuuauuaagaucauuggaaauuccgugggagcucucggcaaccugaccaucauucuggccaucaucgucuuuguguucgcgcucguugggaaacagcugcuuggcgaaaauuacagaaacaaucgcaagaacauuagcgcgccccaugaggauuggccuagauggcacaugcacgacuuuuuccauuccuuucugaucguguuccggauucucugcggagaauggaucgagaacaugugggcuuguauggaggucggccagaaaucuauuugccugauccuguuucuuaccgugaugguucuggggaaucucgugguccugaaccucuucaucgcccugcuucugaauagcuucuccgcugauaaccucacagcccccgaagacgauggagaggugaauaaccuucagguggcccuggcucgcauucaagucuuuggccacagaacgaagcaggcgcuguguucuuucuuuagccgguccugcccuuucccccagccuaaagccgaacccgagcugguugugaagcucccgcugucuagcuccaaggcugaaaaucauaucgccgccaacaccgcucgcgggagcucuggaggccuccaggccccuagagggccccgggacgagcacuccgauuuuauugcgaauccuacagugugggucagcgugcccaucgcugagggcgaaucugaccuggacgaucuugaggacgauggaggcgaagacgcccaauccuuccagcaggagguuauuccgaaagggcaacaggagcagcugcagcaaguggaacgcuguggagaucaccucaccccuagaagccccggcacagggaccucuuccgaggaccuggccccuagccugggagaaacguggaaggaugaguccgucccccaggugcccgcugaaggcguugacgauacaagcucuagcgagggguccaccguggacugccuugauccugaggaaauccugcggaaaauuccggagcucgccgacgaucuggaggaacccgacgacuguuuuaccgaaggcugcauccgccauuguccuugcugcaagcucgauacaaccaaaucucccugggacgucggauggcaagugagaaagacauguuaucggaucguugagcacagcugguucgaguccuuuauuaucuucaugauucugcuuucuagcggcucccuggcguuugaagauuacuaucuggaccagaagccuacggugaaagcucuccuggaguacaccgauagagucuucacauuuaucuucguguucgaaaugcuucugaaguggguggccuauggguuuaaaaaguacuucaccaacgccuggugcuggcucgacuuucugauugucaauaucucucucaucagccugacagcuaaaauucuugaguacuccgaaguugcccccaucaaggcucugcgcacccugcgggcccucagaccucugcgcgcgcuuagccgguucgagggaaugagagugguggucgaugcccuggugggcgcuauuccgucuaucaugaacguucuccuggugugucucaucuuuuggcugaucuucuccaucaugggggucaaucuuuuugccggaaaguucuggcgcugcauuaacuauacggacggcgaguuuagccuggugccccugucuaucguuaauaacaaauccgauuguaagauucaaaacagcaccggcuccuucuuuugggugaaugucaaagugaacuucgacaaugucgcuaugggguaccucgcccugcuucagguggccacauuuaagggauggauggauaucauguaugcugcgguugacucucgggaagugaacaugcagccuaaaugggaggacaaugucuacauguaucuguacuucgugauuuucaucauuuuuggcggguucuuuacccucaaccuguucguuggagugaucaucgauaauuuuaaccagcaaaagaagaaacucggcgggcaggacauuuucaugacagaggaacagaagaaauauuacaaugccaugaagaaacugggaagcaagaaaccccaaaagccuauccccagaccgcuuaacaaguuucagggcuucgucuuugauauugugacccgccaggcuuucgacaucacaauuauggugcugaucugccugaauaugaucaccaugaugguugagacggaugaccaguccgaagagaaaacaaagauucucggcaaaaucaaccaauuuuucgucgccguguuuaccggggaaugugugaugaagauguucgcccugcggcaguacuauuucaccaauggauggaacgucuuugauuucauugugguugugcuuagcaucgcuucucugaucuuuuccgccauccucaaaagccugcagucuuacuucagcccuacacuguuuagagucauccggcucgcgcgcauuggcagaauccuucggcugauucgcgcugccaaggggaucagaacccuccuguucgcccugaugaugucccuucccgcucuguuuaauauuggacuccugcuguuccucgugauguuuaucuauucuauuuucggcaugagcuccuuuccccauguucggugggaggccgggaucgacgauauguucaacuuucagacguucgcgaacucuaugcuuugccuguuccaaaucacaaccagcgcuggaugggacggccugcucuccccuauucugaauacaggacccccuuacugugauccgaaccuucccaauagcaacgggaccagaggagacugcggcucuccugccguggggaucaucuuuuucacaaccuauaucauuaucuccuuucugaucgucgugaauauguacauugccguuauccucgaaaacuucaauguggcuacggaggagagcaccgaaccccuguccgaggaugacuuugacauguucuaugaaacaugggagaaguuugauccugaagccacccaguucauuacauuuucugcucugagcgacuucgccgauacccucuccggaccccuucgcaucccgaaaccuaaccggaauauucugauccagauggaccugccccucgucccuggcgauaagauccacugucuggacauucuuuuugcguucacgaaaaacgugcugggggagucuggagagcucgauagccugaaggccaauauggaagagaaauuuauggcuacaaaccuguccaagagcucuuacgaacccaucgccaccacacucagauggaagcaggaggacauuuccgcuaccgugauccaaaaagccuaccgcagcuauguccuucaucggucuauggcccuguccaauaccccuugcguucccagagcugaagaggaggcggccagccugccggaugaaggcuucguggcuuucacagccaacgagaauugcgugcucccugacaagucugaaacggccagcgcuaccuccuuuccgcccucuuacgagagcgucacacgcggccuguccgaucgggugaacaugagaaccagcuccucuauucagaaugaggacgaagccacaagcauggagcuuaucgcgccugggccguga

SEQ ID NO: 75279 - RNA, 5376 nt, Artificial Sequence
  derived and/or modified sequence opt5 from SCN11A__Homo_sapiens__XP_011531622
auggacgauagaugcuaccccgugauuuucccugacgagcggaacuuuagacccuucaccagcgauucccuggcggcuauugaaaagagaaucgccauucagaaagagaagaaaaagucuaaagaccagacaggcgaagucccccagccucggccccagcucgaucugaaggcgagccgcaaacuuccuaaacuguauggggacauccccagagagcucauuggaaagccucuggaagaucuugacccguuuuaccggaaucacaaaacguucaugguucugaaccgcaagagaaccaucuaucgguuuuccgcuaaacaugcccucuucaucuuuggccccuucaauucuauucgcagccuggccaucagaguguccgugcacucucuguuuagcauguucauuaucgggacagucauuaucaacuguguguuuauggcuaccggaccugccaaaaauuccaacagcaauaacacagauauugcugagugcguuuucaccggcaucuacaucuuugaggcccucauuaagauccuggcgcggggguucauucuugacgaauuuucuuuucugcgcgaucccuggaauuggcucgacuccaucgugauuggaaucgccaucgucagcuauauuccuggcaucacaauuaaacugcuuccccugagaaccuuccggguguuucgcgcucucaaggccaucucuguuguguccagacugaaagucauugugggcgcucugcuccggagcgugaagaaacuggucaacguuaucauccuuacguucuuuugucugucuauuuucgcccucguggggcagcaacuguuuaugggaucccuuaaucugaagugcaucagcagagauuguaaaaacauuuccaauccggaggcguacgaccauugcuucgaaaagaaggagaacucuccugaguuuaaaauguguggcaucuggauggggaauagcgccugcuccauucaguaugaauguaagcacaccaaaaucaaccccgacuacaacuacacaaauuucgauaacuuuggauggagcuuccucgcuauguuucgccugaugacccaggacucuugggagaagcuguaucagcaaacacuccggaccacgggccuguacuccguguucuucuuuauugucgugaucuuccuugggagcuuuuaucugaucaaucucacacuggccguugugaccauggcuuacgaagaacagaacaaaaaugucgccgccgaaauugaggcuaaggagaagauguuccaggaagcgcagcaacuucugaaagaggaaaaggaggcccucguggcuaugggaaucgauagaucuagccugacaucccuggaaaccucuuauuuuaccccuaaaaagcgcaaacucuucggcaacaagaagagaaagagcuucuuccugcgggaguccggcaaggaccagccgcccgggagcgauucugacgaggauugccagaaaaagccucaacuucuggaacagacaaaacgccucucccagaaucugagccuggaccauuuugaugagcacggagacccgcuucagcggcaaagagcccucucugccguuuccauucugacgaucaccaugaaggaacaggaaaagagccaggaacccugucugccuugcggcgagaaccucgcuuccaaauaccugguguggaauugcuguccccaguggcuuugcgucaagaaagugcugcgcacagucaugaccgauccuuucacagagcucgccauuaccaucuguaucauuaucaacacgguguuucuggcgauggaacaccauaagauggaggcuucuuucgagaaaaugcugaauauugggaaccuuguuuuuacaagcaucuucauugccgagaugugccucaagaucaucgcccuggaccccuaucacuacuuccggagaggauggaauauuuuugacuccaucguggcucugcucucuuucgccgaugucaugaacugugugcugcaaaaacgcagcuggccguuucuucgguccuucagaguucugcggguguuuaagcucgcuaagagcuggccuacccugaauacccugauuaaaaucauuggcaacucugucggggcccuuggaucccucacaguggugcugguuaucgucaucuucauuuuuagcguggugggcaugcagcuguucggccgcucuuuuaacucccaaaagagccccaaacucugcaauccuaccgggcccacagucucuugucugagacauuggcacaugggagacuucuggcacagcuuucuugugguuuuccggauccugugcggcgaguggauugaaaacaugugggaguguaugcaggaagcgaaugccuccagcucucucugcgugaucgucuucauucugaucacggugauugggaagcugguugugcuuaaccucuuuaucgcucugcugcucaauuccuucagcaacgaggaaagaaauggaaaccuggagggcgaggcccgcaaaaccaagguccaacuugcucuggaucgguuuagacgcgccuucuguuuugugagacauacacucgaacacuucugccauaaguggugccggaaacagaaucugccucagcagaaggagguugccgggggcugugccgcucaauccaaagacaucauuccccuggugauggaaaugaagcgcggaucugagacccaggaggaacuuggcauccugacaagcgucccgaaaacccucggggugagacacgauuggacguggcuggccccucucgcugaggaagaggacgauguggaauuuuccggagaggacaacgcccagcggauuacccaacccgaacccgagcagcaggccuacgagcugcaucaggaaaauaagaagccuacaucucaacgcguccagagcguugagaucgauauguucuccgaagacgagccgcaccuuaccauucaggauccccgcaaaaagucugacgugacaagcauccuguccgagugcagcaccaucgaucuccaggacggcuuuggguggcugccugaaauggugcccaaaaagcaaccugagcggugucugcccaaaggauucggcugcuguuuuccuugcuguucugucgacaagcgcaagcccccgugggugauuugguggaaccuuagaaaaacgugcuaucagaucguuaagcacuccugguucgagagcuuuauuaucuucgugauucugcucucuuccggggcucugaucuucgaggauguccaucucgaaaaucagccuaaaauccaggagcugcuuaacuguacagacauuaucuuuacccacauuuucauccuggagauggugcucaaguggguugcguuuggcuucggaaaauacuuuacaagcgccuggugcugucuggauuucauuaucgugauugucucugugaccacccugaucaaucuuauggaacugaaguccuuucggacacuccgcgcucugagaccccuccgggcccugagccaauucgagggcaugaaaguuguggucaacgcccuuaucggggcuauuccugccauccugaacgugcugcucgugugccugaucuuuuggcuugucuucugcauccugggaguuuacuuuuucuccggcaaguuugggaaguguauuaauggaacggacagcgugaucaacuacaccaucauuacaaauaaaucucagugcgaaagcggcaacuucuccuggaucaaucagaaggugaacuucgauaaugucgggaacgcguaucucgcucugcuccaaguggccaccuuuaaaggcuggauggacauuaucuacgccgcuguugauucuacagagaaggaacagcagcccgaguucgagagcaauucccugggauauauuuacuuuguggucuucaucaucuuuggcucuuucuuuacccuuaaccuguucauuggggugaucauugacaauuuuaaccagcaacagaaaaagcugggaggccaggauaucuucaugacggaggaacagaagaaauacuauaaugccaugaagaaacucgggagcaagaaaccgcaaaagccuauucccagaccucugaacaagugucagggacuuguuuuugacaucgugacaucccagauuuucgauaucaucauuaucucucugauuauccucaauaugauuagcaugauggcggaauccuacaaccagcccaaagcuaugaaaagcauccuggaccaucucaacugggucuuuguggucaucuucacccuggagugccuuauuaagaucuucgcccugcgccaauauuacuuuaccaauggcuggaaccuguucgauugugugguugugcuccugucuauugucuccacaaugaucagcacccuugaaaaucaggagcacauucccuuuccuccgacacuguuccggaucgugagacucgcccgcaucgggcggauucugagacucguucgcgcugcccggggcaucagaacgcugcuuuuugcucugaugaugucucugcccucccucuucaacauuggacugcuucuguuucucaucauguucauuuaugccauccugggcaugaauugguuuagcaaggugaacccugaguccgggauugacgacaucuucaauuuuaaaaccuucgcgucuagcaugcugugccucuuucagaucuccacaagcgccggaugggauucucuucugucccccaugcugcgcagcaaggaaucuuguaacagcuccucugagaauugccaccucccuggcauugcuaccagcuacuucgucuccuauaucauuaucucuuuccugauuguggugaacauguacaucgccguuauccuugaaaauuuuaacacagcuaccgaggagagcgaagacccccugggggaggaugacuucgauaucuuuuaugaagucugggagaaguucgacccugaagccacgcaguuuauuaaauauuccgcccucagcgauuucgcugacgcgcugccggagccccugcggguggccaagccuaauaaauaccaauuucucgugauggaucuucccauggucucugaggacagacugcauuguauggauauucuguucgcuuuuaccgcccgggugcucggaggcuccgacggccuggacagcaugaaggccaugauggaagagaaauucauggaagcuaacccucuuaagaagcuguaugagcccaucguuacaaccacaaaacgcaaggaagaggagagaggggccgcgauuauccagaaggcuuuucggaaguacaugaugaaagugaccaagggagaucagggcgaccaaaaugaucucgaaaacgggccgcacuccccucugcagacacugugcaauggagaccucucuagcuucggcgucgccaaagggaaggugcauugugauuga

SEQ ID NO: 75280 - RNA, 6030 nt, Artificial Sequence
  derived and/or modified sequence opt5 from SCN1A__Homo_sapiens__NP_001159435
auggagcagaccgugcugguccccccuggcccggacagcuucaacuuuuucacaagagaaucccucgccgcuaucgagcggcgcauugccgaagagaaggcgaaaaaucccaagccugauaaaaaggacgaugacgaaaacgggcccaaaccuaauucugaucuggaggcuggaaagaaccuucccuuuaucuacggcgacauuccuccggagaugguuagcgaaccccuggaggaucucgacccuuauuacaucaauaagaaaacguucauugugcugaacaaggggaaagccaucuuuagauucuccgccaccucugcucuuuauauccugacacccuuuaauccucuccggaagauugccaucaaaauucuggugcacagccuguucuccaugcucaucaugugcaccauucugacaaacugugucuuuaugaccaugucuaaucccccggauuggacaaagaacguggaauacaccuucacgggaaucuauaccuuugagagccuuauuaagaucaucgcucgcggcuucugccuggaggacuuuacauuccucagagauccuuggaauuggcuggacuucaccguuauuacauuugccuacgugaccgaauucgucgaucuugggaacguguccgcgcugcggacguuucgcguucucagagcccugaaaacaaucagcgugauucccggacugaagaccaucgucggcgcucucauucaaucugugaaaaagcuguccgacgugaugauccuuacagucuucugucugagcguuuuugcccucaucggccugcagcuuuucauggggaaucugcggaacaaaugcauucaguggccucccaccaaugcuucucucgaggaacauuccaucgagaagaacauuaccgugaacuauaauggaacacugaucaacgaaacgguguuugaguucgacuggaaaagcuacauucaggauucucgcuaccacuauuuucuggagggcuuccucgacgcccugcuuugugggaauuccagcgaugcgggacaaugccccgaaggcuacaugugugucaaggccgggagaaacccuaauuauggauacaccuccuuugacacauucucuugggcuuuucugagccucuuccggcugaugacccaggauuucugggagaaccuuuaucagcugacacuccgcgccgcuggcaagaccuacaugaucuuuuucgugcugguuaucuuucugggcuccuucuaucucauuaaucugauccuugccguggucgccauggcuuacgaagagcagaaccaagcgacgcuggaagaggccgagcagaaagaagcugaguuucagcagaugauugaacaacucaagaaacagcaggaggccgcccaacaggcugccacagcgaccgcuagcgaacauucuagagagccguccgccgccgggcggcugagcgacucuagcuccgaggcuucuaagcugagcuccaaaagcgccaaggaacgcagaaaucggagaaagaaacgcaagcagaaagagcagucuggaggcgaagagaaggaugaggacgaauuccaaaaauccgagagcgaagauucuauccggagaaagggguuucgcuucuccauugagggaaaccggcuuaccuacgaaaagagauauagcuccccccaccagucucuccugagcauccgcggcucccuguuuucuccucggagaaauagccgcacaucccucuucagcuuucgggggagagcuaaagacgugggaucugagaacgauuucgccgacgacgagcauuccaccuuugaagauaaugagagccgccgggacucucuguucguucccagacggcacggcgaacgcagaaacuccaaucuuagccagacaucucggagcuccagaaugcuggcgguguucccugccaacggcaagaugcacagcacggucgauugcaacgggguggucucucucgugggaggccccuccguuccgaccagcccuguggggcagcugcugcccgaggucauuaucgacaaaccugcuacagaugacaauggaaccacaaccgaaacggagaugcgcaagcggagauccucuagcuuucauguguccauggauuuccuugaggaccccucucaacgccagagagccaugagcaucgcuuccauucucaccaacacaguugaagagcuggaagagucucggcagaaauguccucccugcugguacaaguuuagcaauaucuuccugauuugggauuguuccccguauuggcucaaggugaaacacgucgugaaccuggugguuauggacccuuuugucgaucuugccaucaccauuugcaucgugcugaauacacucuucauggcgauggaacauuaccccaugaccgaccacuuuaacaaugugcugacggucggcaaccugguguucacagggaucuuuaccgccgagauguuccuuaagauuaucgcuauggaucccuauuacuauuuucaggagggcuggaauauuuucgacggauucaucguuacacucagccugguggaacugggccucgccaacgucgaggggcugucugugcuucgcuccuuuagacugcuccggguuuucaaacuggcuaagagcuggccuacccugaauaugcuuauuaaaaucaucggaaacucugugggcgcccucgggaaucugacccugguccucgccauuaucguguuuauuuucgcuguugugggaaugcaacuguuuggcaaguccuacaaagacugcgucuguaagaucgcgagcgauugccagcuuccgcgcuggcacaugaacgacuucuuucauucuuuccugauuguguuuagagugcucuguggggaauggaucgagacaaugugggauugcauggaggucgccggccaggcuaugugucugacgguuuucaugauggugauggugaucggaaaucuggucgugcuuaaccuguuucucgcccugcuccuguccagcuucuccgccgacaaccuugcugccaccgaugacgauaaugaaaugaacaaucugcagauugcgguugaccggaugcacaagggcguggcuuacgucaaacgcaagaucuaugaguuuauucaacagagcuucaucagaaaacagaagauucucgaugaaaucaaaccccuggacgaucugaacaauaagaaggacucuugcaugagcaaccauacagccgagauugggaaagaucuugacuaccugaaggacgugaauggaaccacauccggcaucgggaccggaucuagcguugaaaaauauaucauugaugaguccgacuacaugucuuucaucaacaauccuagccucacggugacaguccccauugccgugggcgaguccgauuuugaaaaccugaauaccgaggacuucucuagcgaauccgaucucgaggaaagcaaggagaaacugaacgagucuuccagcucuuccgaagggagcaccguugacaucggcgcuccuguggaggaacaacccgucguggagccugaagagacacuugagcccgaagccuguuuuaccgagggaugcgugcagcgguucaaguguugccagauuaaugucgaagagggccgcgggaagcagugguggaaccugagacggacauguuuuagaaucguugagcacaauugguucgaaacguuuaucguguucaugauucuccuguccucuggagcgcuggcuuuugaggauaucuauauugaccaacgcaaaaccaucaagacaaugcuugaauacgccgauaaaguguucaccuauauuuuuauccuggagaugcuccugaagugggucgccuacggcuaccagacauauuucaccaacgcuuggugcuggcucgacuuucugaucguggauguuagccuugugucccugacggccaacgcucugggguacagcgaacucggagccauuaaaucucugcggacccuuagagcgcugcgcccgcuccgggcccuguccagauucgagggcaugcgcgucgugguuaaugcucuccugggggccaucccuagcauuaugaacgugcuucuggucugccugaucuucuggcucauuuuuucuaucaugggcgugaaucuguucgcuggaaaguuuuaucauuguauuaacacaaccacaggcgaccgguucgacaucgaggaugucaauaaccacaccgacugccuuaagcugaucgaaagaaaugagacagcccgcuggaaaaacgugaagguuaauuuugauaacgugggguucggauaccucagccugcuccaggucgccaccuuuaaaggcuggauggacauuauguaugcugcgguggauucccggaauguugaacugcagcccaaguacgaggaaucucuuuauauguaccuguacuucgugaucuuuauuaucuucgggagcuuuuucacgcugaaccucuuuauuggagucaucaucgacaauuucaaccaacagaaaaagaaauucggcggccaggauauuuuuaugacagaggagcagaagaaguauuacaaugccaugaaaaagcugggguccaaaaagccucaaaaacccaucccgagaccuggaaacaaguuccagggcaugguguuugacuucgugacccggcagguuuuugauauuucuaucaugauucuuaucugucugaauauggucaccaugaugguggaaacagacgaucaaagcgaguaugugaccacgauccucucccgcauuaaccuggucuucaucgugcucuuuacaggggaaugcguucugaagcuuauuagccugagacacuacuauuucaccaucggauggaacauuuuugacuucguggucgugauccugucuauuguuggcauguuucucgcugagcugaucgaaaaauacuucgugucccccacacuuuuucgggucauccgccuggccagaauugggcggauccucagacugauuaagggagccaaaggcauccgcacccugcucuucgcucuuaugaugagccugccugcccuguucaauauuggccuccugcuuuuucuggugauguucaucuaugcgaucuuugggauguccaacuucgcuuacguuaagcgggaggugggaauugaugacauguuuaauuucgagacauuuggcaacucuaugaucugucucuuccagauuaccacgagcgccgggugggacggacugcuggcccccauccucaauuccaaacccccugauugcgacccgaacaaggucaaucccggcucuagcgugaagggggauuguggaaacccuuccgugggcauuuuuuucuuugucagcuacaucaucauuucuuuccuuguuguggugaauauguauaucgcugucauucuggaaaacuuuuccguggccaccgaggaaagcgcggagccccugucugaggacgauuucgaaauguucuacgagguuugggaaaaauuugacccugaugcuacacaguucauggaguuugaaaagcucucccaguucgccgccgcucuggagcccccucuuaaucugccgcaacccaacaaacuccagcugaucgccauggaccugccuauggugagcggcgauagaauucauugccucgacauccuuuuugcuuucaccaagcgcguccugggggagucuggagaaauggaugcccugcggauucagauggaggaaagauuuauggcgagcaaucccuccaaagugucuuaucagccuaucacaaccacgcucaagcgcaagcaagaggaaguuagcgccgugaucauucagcgggcuuacagacgccaccugcuuaaaagaacagucaagcaggccuccuucaccuauaacaaaaauaagaucaaaggcggggcuaaccugcucauuaaggaggacaugaucauugaucggaucaacgagaauagcaucacagaaaagaccgaccugaccauguccacagccgccugucccccgucuuacgaccgcgugacgaaaccuauugucgagaagcaugaacaggagggaaaagaugaaaaggcuaaaggcaaguga

SEQ ID NO: 75281 - RNA, 657 nt, Artificial Sequence
  derived and/or modified sequence opt5 from SCN1B__Homo_sapiens__NP_001028
augggcagacugcucgcccugguggucggggcugcccuuguuagcuccgcgugcggaggcuguguggagguggacucugaaaccgaggcugucuacgggaugacauucaagauccugugcauuagcuguaaacggcgcuccgaaacgaacgccgagaccuuuacagaauggaccuucagacagaagggaacagaggaguuugugaaaauccuccgguaugaaaaugagguucugcaacuugaagaggaugagcgcuucgaaggcagaguggucuggaacgggucucggggaaccaaggaccugcaggaucucagcauuuuuaucacaaaugugaccuacaaccacuccggcgacuaugagugccauguuuaccgccugcuguucuuugaaaauuaugagcacaacacgucuguggucaaaaagauucauaucgaagugguggauaaggccaauagagacauggcuagcaucgucuccgagauuaugauguacguucucaucguggugcugaccauuuggcuugucgccgagaugaucuauuguuacaaaaagauugcugccgcgacagaaaccgccgcucaggagaacgccagcgaauaccuggcuaucacaucugaguccaaagaaaauugcaccggcgugcagguugccgaguga

SEQ ID NO: 75282 - RNA, 6018 nt, Artificial Sequence
  derived and/or modified sequence opt5 from SCN2A__Homo_sapiens__XP_005246807
auggcucagucuguccuggugcccccuggcccggacuccuucagauuuuucacccgggagucucucgcugccaucgaacaacgcauugcggaggaaaaggcuaaaagacccaagcaggagcggaaagaugaagacgaugagaacgggccuaagcccaauagcgaccuggaggccggaaaaucccuuccuuuuaucuacggcgauauucccccugaaaugguuucugugccgcuggaggaccucgaucccuauuacauuaacaagaagacauucauugugcugaauaaagggaaggccaucagccgcuuuuccgcuacgccugcccuuuauauccugacccccuucaacccuauuagaaaacucgcuaucaagauucugguucacucucuguuuaauaugcucaucaugugcacaauucugaccaacuguguguucaugacaaugagcaaucccccggacuggaccaaaaacguugaauacacauuuaccggaaucuauacguucgagucccuuauuaagauccuggcccggggcuuuugccucgaggauuucaccuuucugcgcgacccuuggaauuggcuugauuucacagugaucaccuucgcguacgucacagaauuuguggaccuggggaacguuagcgcccucagaaccuuccgggugcugcgcgcucugaagacgauuucugucauccccggacucaaaacaauugugggcgcccugauccaguccgugaagaaacuuagcgaugucaugauucugaccgucuuuugucucucuguguucgcucugaucggccuucagcuguuuauggggaaucucagaaacaagugccugcaauggccucccgacaauuccagcuucgagaucaacauuaccagcuuuuucaauaacucccuggacggaaacggcacaaccuuuaaucggacagugagcaucuucaacugggaugaauauauugaggacaaaucccauuuuuacuuccucgaagggcagaaugaugcccugcuuuguggaaacucuagcgacgcgggccagugccccgagggguacaucugugucaaggccggacgcaauccuaacuauggcuacacguccuuugauaccuucagcugggcuuuccugucucucuuuagacugaugacacaggacuucugggagaaucuuuaucaacugacccuccgggccgcuggcaaaacauacaugaucuuuuucgugcugguuaucuuucugggguccuucuaucucaucaaccugauucuugccguggucgccauggcuuacgaggaacagaaucaggcgacccuggaagaggccgaacagaaggaggcugaguuucaacagaugcucgaacagcugaagaaacaacaggaggaagcccaggccgcugccgcggcugccagcgccgagucucgcgauuucagcggagcuggcgggaucggaguguuuuccgaaucuagcuccguugccagcaagcugucuuccaaaagcgagaaggagcuuaaaaacagacggaagaagaaaaagcagaaagaacaaucuggcgaggaagagaagaaugacagagugcgcaaauccgagagcgaagauuccauucggagaaagggguuccgcuuuucucucgagggaagccggcugacguaugaaaagagauucuccucuccgcaccagagccugcucuccauccgcggcagccuguuuucuccccggagaaacucccgcgcuagccuuuucucuuuccggggcagagccaaagacauuggguccgagaaugauuuugcggacgacgaacauagcacauucgaggauaacgacucucgccgggauagccuguuugucccucacagacauggagagcggcgccacuccaaugugagccaggccucuagagcuucccggguccuccccauccugccuaugaacggcaagaugcacagcgccguggacugcaacgggguugugucccuggucggaggccccucuacccuuaccagcgcugggcagcuccugccggaaggcacaaccacagagacggaaauuagaaaacgccgguccucuagcuaccauguguccauggaucugcucgaggacccuaccucuagacaacgcgccaugagcaucgcguccauccugacaaauaccauggaagaacuugaggaaagcagacagaagugucccccuugcugguacaaauucgccaacaugugucugauuugggauugcugcaagcccuggcucaagguuaaacaccuggugaaucuggucgugauggacccuuuuguggaucuugcuaucacaauuuguaucguucucaacacccuguucauggccauggagcauuaucccaugacggaacaguuuucuuccguccugagcgugggaaaucucguguucaccggcauuuuuacagcugagauguuccugaagaucaucgccauggacccguacuauuacuuucaggaaggguggaacauuuucgauggauucaucgucucucuuucccugauggagcucggccuggccaauguggaggggcugagcguucuucggucuuuucgccuccugagaguguucaaacuggcuaaguccuggccuacccucaacaugcugauuaaaaucauuggaaauagcgucggcgcgcuugggaaccugacacucgugcuggccaucaucguuuuuauuuucgcuguggucggcaugcaacuguuuggaaaguccuauaaagaaugcguguguaagaucagcaaugacugcgagcuuccccgguggcacaugcacgauuucuuucauucuuuccugauuguuuuucgcgugcucuguggcgaauggaucgagaccaugugggacugcauggaggucgccgggcagacgaugugucugacaguguucaugauggugauggucauuggaaaccucguugugcugaaucuuuuucuggcccuccugcugagcuccuucucuagcgacaaccuugcugccaccgaugacgauaaugaaaugaacaaccugcagaucgcggugggcagaaugcagaaggggaucgacuuugucaaacggaagauucgcgaguucauccaaaaggcuuucgugagaaagcagaaagcccucgaugaaauuaagccccuggaggaccucaauaacaagaaagauuccugcaucucuaaucacacaaccauugaaaucggaaaggaccugaacuaccuuaaagauggcaaugggaccacaagcggcauuggauccucuguugagaaguauguggucgacgagagcgauuacauguccuuuaucaacaauccuagccugacggugaccguuccgaucgccgugggcgaaucugacuucgagaaccucaauacagaagaguuuuccagcgaaucugauauggaggaguccaaagaaaagcugaacgcuaccagcuccucugaggggagcacagucgacauuggagcccccgcggaaggcgagcagccugaaguggagcccgaggaaucccuggagccugaggcuuguuucaccgaggacugcguucggaaguuuaaauguugccaaaucagcauugaggaagggaagggaaaacuuugguggaaucugcgcaagacgugcuacaaaaucguggagcauaacugguucgaaacauuuauugucuucaugauccuccugucuuccggcgcccucgccuuugaggauaucuauauugaacagagaaagaccaucaagaccaugcuggaguacgcugacaaaguguucacauauauuuuuauccuugagaugcugcugaaguggguggccuacggguuccaggucuauuuuaccaaugcuugguguuggcucgauuuccugauuguugacgugagccuugugucucugacagccaacgcgcucggcuacagcgaacugggagccaucaaaucccuccggacgcugagagcccuucgcccccugcgggcccugucuagauucgagggcaugcgcgucgugguuaaugcucuccugggggccaucccuagcauuaugaacgugcuucuggucugccucaucuuuuggcugauuuucuccaucaugggagugaaccucuuugccggcaaguucuaucacuguauuaauuacaccacaggggaaauguuugauguuucuguggucaacaauuacagcgagugcaaagcucugaucgaauccaaccagaccgcgcgguggaagaaugugaaagucaacuucgacaaugugggacuuggcuaucugagccugcuccaaguugccacauuuaagggcuggauggauauuauguacgcugccguggacucuagaaacgucgagcugcagcccaaguaugaggauaaucuuuacauguaucuguacuucgugaucuuuaucauuuucggguccuuuuucacccucaaccuguuuaucggaguuauuaucgacaauuucaaccagcagaaaaagaaauucggcgggcaagauauuuuuaugacggaggaacagaagaaauauuacaaugccaugaagaagcucggaagcaaaaagccgcagaaaccuaucccccgcccugcuaacaaguuccagggcaugguguuugacuucgucaccaaacaaguguuugacaucuccauuaugauccugauuugucuuaauauggugacaaugaugguugaaaccgaugaccagucucaggagaugacaaacauccuguacuggauuaaucuggucuucaucgugcucuuuaccggggaaugcgugcugaaacuuaucagccugcgguauuacuauuucacaauuggauggaacaucuuugauuucgucgugguuauucucuccaucgugggcauguuucuggccgagcugauugagaaguacuucgucucucccacccucuuuagagugauccgccuugcgcggauuggcagaauccugcggcugaucaaaggggcuaagggcauucgcacgcuccuguucgcccuuaugaugagccugccggcccucuucaacaucggccugcugcucuuucuuguuauguucauuuaugcuaucuuugggauguccaauuucgccuacgugaaaagagaagucggaauugacgauauguuuaacuucgagacauuuggcaauagcaugaucugucuguuccaaaucaccaccucugcggggugggacggacugcucgcuccuauucugaacuccggacccccugauugcgaccccgauaaggaccaucccggcagcucugugaaaggggauuguggaaauccuuccguuggcaucuuuuucuuugugagcuauauuaucauuucuuuccuugucguggugaacauguacaucgccgucauccuggaaaauuuuagcguugccacagaggaguccgcugaaccgcucucugaggacgauuucgaaauguucuacgaggugugggaaaaguuugaccccgacgccacccaguucauugaguuugcuaagcugagcgauuucgccgacgcgcuggauccuccccuccuuaucgccaaaccuaacaaggugcagcugauugcuauggaccugcccauggucuccggggaucggauccacugccucgacauucuguuugccuucacgaaacgcgugcuuggagagagcggcgaaauggaugcucugagaauccagauggaggaacgguuuauggccuccaauccuucuaagguuagcuaugagccgauuacaaccacacucaaaagaaagcaagaagagguguccgccaucaucauucagcgcgcuuaccggagauaucugcugaagcagaaagucaagaaagugucuagcaucuacaagaaagacaaggggaaagagugugauggaacccccauuaaggaagacacacucaucgauaaacuuaacgaaaauuccaccccugagaagacggacaugacccccucuacaaccagcccucccuccuaugauagcguuacaaagccggagaaagaaaaguucgagaaagacaagucugagaaggaagacaaaggcaaggauauucgcgaguccaaaaaguga

SEQ ID NO: 75283 - RNA, 648 nt, Artificial Sequence
  derived and/or modified sequence opt5 from SCN2B__Homo_sapiens__NP_004579
augcacagagacgccuggcugccccggccugcuuucagccucaccggccugucccuguuuuucucucuggugccgcccgggcgcagcauggaggucacaguuccugccacgcucaacgugcugaauggauccgaugcgagacuucccugcaccuuuaacucuuguuacacagugaaucauaagcaguucagccugaacuggaccuaucaagaaugcaauaacuguuccgaggaaauguuucuccaguuccggaugaaaaucauuaaucugaagcuggagcgcuuucaggacagagucgaguucucuggcaacccuagcaaauacgauguguccguuaugcuccggaaugugcagcccgaggacgaggggaucuauaacugcuacauuaugaauccuccggaucgccacagaggacauggcaagauccaccuucaaguccuuauggaagaacccccugaacgggacagcacaguggcuguuauugugggggccucugucggaggcuuucuggccguggugauccucguccugaugguugugaaaugugugcgcagaaagaaggagcagaaacuuuccaccgaugaccugaagacagaggaagagggcaaaaccgauggggaaggaaaccccgacgauggcgcuaaguga

SEQ ID NO: 75284 - RNA, 5856 nt, Artificial Sequence
  derived and/or modified sequence opt5 from SCN3A__Homo_sapiens__NP_001075145
auggcccaggcucugcucgugcccccuggcccggagagcuucagacuguuuacccgggaaucccuugccgcgaucgagaagcgcgcugccgaagagaaagccaagaaacccaagaaagaacaagacaacgaugacgagaauaagccuaagcccaacucugaucuggaggcugggaaaaaucucccuuucauuuacggagacauccccccugaaauggucagcgagccgcuggaagaucuugaccccuauuacauuaacaagaaaacauuuaucguuaugaauaagggcaaagccauuuucagauuuuccgcuacgucugcccuguauauccucaccccucugaaccccgugcggaagaucgcgauuaagauccuggugcacagccucuucuccaugcugauuaugugcacaauccuuaccaauugugucuuuaugacacugucuaacccucccgauuggaccaaaaauguggaguacacauucaccgggauuuauacguuugagagccucaucaagauucuggcccgcggauucugccuugaagacuuuaccuuccugagagauccguggaacuggcucgacuuuuccguuaucgugauggcuuacgucacagaguucguggaucugggcaauguuagcgcccugcggaccuuccgcgugcucagagcucugaaaacaaucucugucauuccugggcuuaagaccaucgugggagcccugauucaguccgugaaaaagcucagcgacgucaugauccugacgguuuuuugucuuucuguguucgcgcugauuggccuccagcuguuuaugggcaaccugcggaauaaaugccuccaguggcccccuuccgauagcgccuucgaaacaaacaccacaucuuauuuuaaugggaccauggacuccaacggaaccuucgugaacgucacaaugagcacguuuaauuggaaggacuacaucggcgaugacucccauuucuacgugcuggaugggcaaaaggacccccuucuguguggaaacggcucugaugcugggcagugccccgagggauauaucuguguuaaagccggccgcaauccuaacuacggcuauaccagcuuugacacauucuccugggcuuuucucagccuguucagacuuaugacccaggauuacugggaaaaucuguaucagcucacacugcgggccgccgggaagaccuacaugauuuuuuucgugcuggucaucuuccucggaucuuuuuaucuggugaaccuuauucuggcuguuguggcgauggccuacgaggagcaaaaucaggcuacgcucgaagaggccgaacagaaagaggccgaauuccagcaaaugcuggagcagcugaagaaacagcaagaggaagcucaggccgucgcggcugccuccgccgcuagccgcgacuuuucuggcaucgggggacuuggcgagcuccuggaaagcuccucugaggccagcaagcuguccagcaagucugcuaaagaauggagaaaccggcgcaagaaaagacggcagagagagcaccucgaggggaauaacaagggagaacgcgauuccuucccgaaaagcgagucugaagacuccgugaagcggagcuccuuucuguucucuauggauggcaauagacuuacaagcgacaagaaauuuugcuccccccaucagucucugcucagcauucgcggcucccuguucagcccucggagaaacucuaagaccuccaucuuuagcuuccgcgggcgggccaaagacgucggaucugagaaugauuuugcggacgaugagcacuccaccuucgaagacagcgagucuagacgcgauagccuguuugugccccaucggcacggcgaaagacgcaacuccaaugggacaaccacagagacggaaguucggaagagacggcuuagcucuuaccaaaucuccauggagaugcucgaggacagcuccggacgccagagagccgugucuauugcuagcauccugaccaacacaauggaagagcuggaagagucccggcagaaauguccucccugcugguauagauucgccaacgucuuccucauuugggauuguugcgacgcuuggcugaaggugaagcaccuuguuaaucugaucgugauggauccguuugucgaccucgccauuaccaucugcauugugcugaacacacuguucauggcgauggaacauuacccuaugaccgagcaguuuucuagcgugcuuacgguuggcaaucucgucuucaccgggaucuuuacagccgagauggugcugaaaaucauugcuauggaucccuauuacuauuuccaagaaggcuggaacaucuuugacggaauuaucgugucccugucucucauggagcugggccuuagcaaugucgaagggcuguccgugcuccgcagcuuccggcugcugagaguuuuuaagcuugccaaaucuuggccuacccucaacaugcugauuaagaucaucggaaauuccgugggcgcucuggggaaccucacacugguccuugccauuaucguguucauuuuugccguugugggaaugcagcuguucggcaaaagcuacaaggagugugucugcaaaaucaaugaugacuguacccucccccgcuggcacaugaacgacuucuuucauucuuuccugauuguguuuagaguucugugcggggaauggaucgagacgaugugggauuguauggagguggcuggccagacaaugugccuuaucgucuucaugcuggugauggugauuggaaaucucgucguucugaaccucuuucuggcgcuucugcucuccagcuucucuuccgacaaucuggccgcuaccgaugacgauaacgaaaugaauaaccugcagaucgccgugggccggaugcaaaaggggauugacuaugugaagaacaaaaugcgcgaguguuuucagaaggccuucuuuagaaaaccuaaggucaucgaaauucacgagggaaauaaaaucgauagcugcauguccaacaauacaggcaucgagauuagcaaggaacuuaacuaccugcgggacgggaauggaaccaccucuggcguggggacaggcagcuccguugagaaguacgugaucgaugaaaacgacuauaugucuuucauuaauaaccccagccucacggucaccgugccgaucgcuguuggagaguccgauuuugaaaaucugaacacagaggaguucucuagcgaauccgagcucgaagagucuaaagaaaagcugaaugccaccagcuccagcgagggcucuacaguggacgucgugcuuccucgcgagggggaacaggcggagaccgaacccgaggaagaucugaaacccgaggcuuguuuuacggagggaugcauuaagaaauucccuuucugucagguuuccacagaagagggcaaggggaagaucugguggaaccucagaaaaaccugcuacagcauuguggaacacaauugguuugagaccuucaucgucuuuaugauccugcugucuuccggagcccuugccuucgaggacauuuauaucgaacaacggaagacaauuaaaaccaugcuggaguacgcugacaagguguuuacauauaucuucauucucgaaaugcugcucaaauggguggccuacggcuuucagacguauuucaccaacgcguggugcuggcuggauuuucuuaucgucgacguuagccuggugucccugguggcuaaugcccucggguacucugagcugggcgccaucaagagccuucgcacacugagagcucuccggccgcugcgcgcccucuccagauucgaaggaaugcgggucgugguuaacgcucuggugggcgccauucccagcaucaugaacguccuucuggugugucugauuuuuuggcucaucuucucuauuauggggguuaaucuguuugcgggaaaguucuaccauugcgugaacaugaccacaggcaauauguucgauaucuccgacgucaacaaucuuagcgauugucaggcccuggggaaacaagcuagauggaagaacgugaaagucaauuuugacaacgugggagccggcuaucucgcucugcuccagguugccaccuucaagggcuggauggauaucauguacgccgcuguggacucucgcgaugucaaacugcagccuguguaugaggagaaucuuuacauguaucuguacuuuguuauuuucaucauuuuugggagcuucuuuacgcugaaccucuucaucggagugauuaucgacaauuuuaaccagcaaaagaaaaaguucggcgggcaggauauuuuuaugaccgaagagcagaagaaauauuacaaugcgaugaagaaacugggauccaagaaaccccagaagccuaucccccggccugccaacaaguuccaaggcauggucuuugacuucgugacaagacagguguucgacaucucuauuaugauccuuauuugccugaauaugguuaccaugauggucgaaacagaugaccaggggaaauacaugacccucgugcugagccgcaucaaccucguguuuauuguccuguucacaggagaguuugugcuuaagcugguuucccugcggcacuauuacuucaccaucggcuggaauaucuuugauuucguggucgugauucucucuaucguuggcauguuucuggcugaaaugauugagaaauauuucgugagccccacgcuuuuuagagucauccgccuggcccggauugggagaauccuccgccugaucaagggagccaaaggcauucggacacugcucuucgcucuuaugaugucccugccggcccuguuuaacaucgggcuccugcuuuuccuggugauguuuauuuacgcgaucuucggaaugagcaacuucgcuuauguuaagaaggaggccggcauugacgauauguuuaauuucgaaaccuuugggaacucuaugaucugucucuuccagauuaccacauccgccggaugggacggccugcuggcuccuauccucaauagcgcccccccugauugcgaccccgauaccauccauccgggcuccucugugaaaggggacuguggaaacccuagcgucggcauuuuuuucuuuguguccuacaucauuaucucuuuccuuguggucguuaauauguauauugcggugauccuggagaacuuuagcguggcuacggaagaguccgccgaaccccugagcgaggaugacuucgagauguuuuacgaagucugggagaaguucgauccugacgccacacaauuuaucgaauucucuaaacucuccgacuucgcugccgcucuggaucccccccuucugauugccaagccuaauaaagugcagcucaucgcgauggaccugccgaugguuagcggggauagaauucacugccuggacauccucuuugccuucaccaagcgggugcuuggagagucuggcgagauggaugcucugcgcauucagauggaagacagauuuauggccuccaaccccagcaaggucucuuacgagccuaucacaaccacacugaaacggaagcaagaagaggugagcgcugccaucauucagcgcaauuucagauguuaucuccugaaacagcggcuuaagaacaucuccucuaauuacaacaaagaagccauuaaggggagaaucgaucugcccauuaagcaggacaugaucauugauaaacucaauggaaacagcaccccugagaagacggacggcuccagcuccaccacaucucccccuagcuaugauuccguuaccaaaccggacaaggagaaauuugaaaaggauaaacccgagaaggaaucuaagggcaaagaggugcgcgaaaaucaaaaguga

SEQ ID NO: 75285 - RNA, 648 nt, Artificial Sequence
  derived and/or modified sequence opt5 from SCN3B__Homo_sapiens__XP_011541199
augcccgccuucaacagacuguuuccucucgcuagccuggugcuuaucuacugggucuccguuugcuucccgguguguguggagguccccucugaaaccgaggccgugcagggcaauccuaugaagcugcggugcauuagcuguaugaaacgcgaagagguugaagcgacaacgguggucgagugguuuuauagacccgaagggggaaaggacuuccucaucuacgaguaucggaacggccaccaagagguggaauccccuuuucaggggcgccugcaguggaauggaucuaaagaucuucaggacguuagcauuaccgugcugaacgucacacucaaugauuccggccuguauaccugcaacgugucuagagaguucgaguuugaagcucaucggcccuucgugaagacaacccgccugaucccucucagagucacagaggaagccggggaggacuuuaccagcguuguguccgaaauuaugauguacauccugcuuguguuccugacgcucuggcugcuuaucgagaugauuuacuguuaucggaaagucagcaaggccgaggaagcugcccaagagaaugcuucugauuaccuggccaucccguccgaaaacaaggagaauagcgcggugcccguugaagaguga

SEQ ID NO: 75286 - RNA, 5511 nt, Artificial Sequence
  derived and/or modified sequence opt5 from SCN4A__Homo_sapiens__NP_000325
auggcuagacccucucugugcacccucgugccucugggcccggagugucuucggcccuucacacgcgaaucccuggcugccauugagcaaagagccguugaagaggaagcucggcuccaacgcaacaagcagauggagauugaggaaccugagagaaaaccccggucugaccuggaagccgggaagaaucuuccuaugaucuacggcgaucccccuccggagguuauuggcaucccccuggaggaccucgauccuuauuacagcaacaaaaagacguuuauugugcugaauaaagggaaggccaucuuccgcuuuuccgcuacccccgcccuguaucuccugucuccuuucagcguggucagacggggagcuaucaaggugcuuauucacgcccuguuuuccauguucaucaugauuacaauccucaccaacugcguuuuuaugacaaugucugaucccccucccuggagcaaaaauguggaauacaccuucacaggcauuuauaccuuugagucccugaucaagauucuugcgcgcggguucugugucgaugacuuuacguuccugagagaucccuggaacuggcucgacuuuagcgugaucaugauggccuaccugaccgaguucguugaucugggaaauaucucugcucuccggacauuccgcgugcugagagcccuuaaaaccauuacagucaucccuggccugaagaccauugugggcgcucucauccaguccgugaaaaagcugagcgacgucaugauucuuacggucuuuugucugucuguguucgcccucguggggcugcagcuguuuaugggaaaccuccggcaaaaguguguccgcuggccgcccccuuucaaugauacaaacaccacaugguauuccaaugacaccugguacggcaacgauaccugguacgggaaugagaugugguauggaaacgacagcugguacgcgaaugacacauggaacucucacgccuccugggcuacgaacgauaccuuugacugggaugccuauaucagcgacgaaggcaauuucuacuuucuggagggguccaacgaugcccuucugugcggaaauucuagcgacgccggccacuguccggagggcuaugaaugcaucaaaacagggagaaaccccaauuacggauauaccuccuacgauacauucagcugggccuuucucgcucuguuccggcuuaugacccaggacuacugggagaaccuguuucagcucacgcugagagcggccggcaagacauauaugauuuucuuugugguuaucauuuuccuggggucuuucuaccucaucaaucugauucuugcuguggucgccauggccuaugcugaacagaacgaggccacccuggcggaagauaaagagaaggaggaagaguuucaacagaugcucgaaaaauucaagaaacaucaggaggaacuggagaaggcuaaggccgcccaggcucuggagggaggcgaagccgacggggauccugcucacggaaaagacuguaauggcucccuugacaccagccaaggcgagaagggggcgccccgccagucuagcuccggagauucuggcaucagcgacgcgauggaagaacucgaggaagcccaucagaaaugcccucccuggugguacaagugugcucacaaagugcugaucuggaacugcugcgccccguggcugaaguuuaagaauauuauccaccucauuguuauggauccuuucguggaccuggggaucacaauuuguaucguccuuaacacccuguuuauggcuauggagcauuaucccaugacagaacacuucgauaaugugcucacggucggaaaccugguguuuaccggcauuuucacagccgagaugguucugaaacuuaucgcgauggacccuuacgaauauuuucaacagggguggaauaucuucgauuccauuaucgugacccucagccuggucgagcugggccucgccaacgugcagggacugucuguucuucgguccuuuagacugcuccgcguguucaagcuggcuaaaagcuggcccacacugaacaugcuuauuaagaucauuggcaauucugucggggcccucggaaaccugacccuggugcucgcuaucaucguguuuauuuucgccguugucggcaugcagcuguucgggaaauccuacaaggagugcguguguaagaucgcccuugacugcaaucugccucgguggcauaugcacgacuuuuuccacagcuuucucauuguguucagaauccuguguggagaauggauugagacgaugugggacugcauggaagucgcuggccaagcgaugugucugaccguguuucuuaugguuauggugaucgggaaccucgucgugcugaaucuguuccucgcccugcuucuguccucuuuuagcgcugauucccucgccgccucugacgaggauggcgaaaugaacaaucugcagaucgcuauuggacgcaucaaacugggcauuggguucgccaaggcguuucuucugggacuccugcauggcaaaauccucagccccaaggacauuaugcugucccuuggggaggcugacggagccggcgaggccggggaagcuggcgagacagccccggaagaugagaaaaaggaaccucccgaggaggaccugaagaaagauaaccacauccucaaucauaugggacuggcggacggacccccuagcucucuggaacuugaucaccugaacuucaucaauaacccguaccucaccauucagguucccaucgcuuccgaggaaagcgaccuggagaugccuacagaggaagagaccgauacguuuucugaacccgaggacuccaagaaaccuccccagccucucuaugaugggaauagcucugugugcagcacagccgacuacaagcccccggaagaggauccugaggaacaagccgaggaaaaccccgagggagaacagccugaggaguguuucaccgaggcuugcguccagcgguggcccugucuguauguggacauuucccagggcagagggaaaaagugguggacacuucgccgggccugcuucaaaaucguugagcauaauugguuugaaaccuucauuguguuuaugauccugcucagcucuggagcucuggccuucgaggauauuuacaucgaacaaagacgcgucauccggaccauucuggaguaugcggacaagguguuuacauacaucuucauuauggagaugcuucugaaguggguggccuauggcuuuaaagucuacuucacgaacgcuuggugcuggcucgacuuucugaucguugauguguccauuaucagccucguggccaacuggcugggguacuccgaacuuggcccgaucaagucucugagaacccugcgggcucuccgcccucugagagcccuuagccgguucgagggaaugagagucgugguuaaugcccugcucggcgcuauucccuccaucaugaacgugcugcucgucugucugaucuuuuggcuuaucuucucuauuaugggggugaaucuguuugcgggaaaauucuauuacugcaucaacacaaccacaagcgaacgcuucgacaucuccgagguuaauaacaagucugagugugaaagccugaugcacaccggccaggugcgguggcucaaugucaaagugaacuaugauaauguugggcugggauaccuuucccugcuccagguggccacguuuaagggcuggauggacauuauguaugcugccgucgauagcagagagaaggaagaacaaccucaauacgaagugaaccuguauauguaccucuacuucgugaucuuuauuaucuucggcagcuuuuucacacugaaucuuuuuauuggggucaucauugacaacuucaaucagcagaaaaagaaacugggaggcaaggauaucuuuaugaccgaggagcagaaaaaguauuacaacgccaugaagaaacugggguccaagaaaccccagaagcccaucccucgcccgcagaauaaaauucagggaaugguuuaugaccucgugaccaagcaggcuuucgauaucacaauuaugauccugauuugccuuaacauggugaccaugauggucgaaacagacaaccagagccagcugaagguggauauccucuacaauaucaacaugauuuuuaucauuaucuucacgggcgaguguguucugaaaaugcucgcccugagacaguauuacuuuaccgugggguggaauauuuucgacuucgucgugguuauccuuucuaucgugggacuggcgcuguccgaccucauucaaaaguauuuugucagccccacacuguuccgggugauccgccuugcuagaauuggccggguccugcgccucaucagaggcgccaaagggauucggacccugcuguuugcccucaugaugucucuuccugcucuguucaacaucggacugcuccuguuucuugugauguucauuuacuccaucuuuggcaugagcaauuucgccuacguuaagaaagaauccgggaucgaugacauguuuaacuucgagacauuuggaaauagcauuaucugccuguucgaaauuaccacgucugcgggcugggaugggcuccugaaccccauccugaauagcggaccucccgacugugauccuaaccucgagaauccgggcaccuccgugaagggcgacugcgggaaccccucuauuggaaucugcuuuuucugcagcuauaucauuaucuccuuccuuauugucgugaauauguacaucgcuauuauccuggagaacuuuaauguugccacagaagagucuagcgaaccucugggcgaggaugacuucgaaauguuuuaugagaccugggagaaauucgaucccgacgccacacaguuuaucgcuuacucccgccucucugauuucguggacacccugcaggaaccucuuagaauugccaagcccaacaagaucaaacugauuacacucgaucugccgauggucccuggggacaagauccacugucuggacauucucuuugcucuuaccaaagaggugcugggagauagcggcgaaauggacgcccugaagcagacgauggaggagaaauucauggcggccaaucccuccaaggugagcuaugaacccaucacaaccacccucaagcggaaacaugaggaaguuugcgcuauuaagauccaacgcgccuacagacggcaucugcuucagagaucuaugaaacaggcuuccuauauguaccgccauagccacgaugggucuggagacgaugccccugagaaggaaggccugcucgccaacacaauguccaaaauguacggccacgagaacgggaauagcuccucucccagcccugaggaaaagggagaggcuggcgacgcggggccgaccaugggacugaugcccaucuccccuagcgauacggccuggcccccugcucccccgccuggccaaacaguccggcccggggugaaggaaucucugguguga

SEQ ID NO: 75287 - RNA, 285 nt, Artificial Sequence
  derived and/or modified sequence opt5 from SCN4B__Homo_sapiens__NP_001135820
augcccggcgccggggacggaggcaaggcuccugccagauggcuggggaccggacuccugguggaggaagucgauaacacaguuacgcuuaucauucuggcgguggugggcggggucaucggacuccugauucuuauccugcucauuaaaaagcugaucaucuucauucugaaaaagacccgggagaaaaagaaggaaugccucgugagcuccucuggcaaugacaacacagagaauggccugccggggagcaaagcugaagagaagcccccuuccaaaguuuga

SEQ ID NO: 75288 - RNA, 6048 nt, Artificial Sequence
  derived and/or modified sequence opt5 from SCN5A__Homo_sapiens__NP_000326
auggccaacuuccugcuccccagaggaaccagcuccuuucggcgcuucacaagagagucucuggcugccauugaaaagcggauggcggagaaacaggcucgcgggagcacgacccuucaagaauccagagagggacugccugaagaggaggccccgcggccccagcucgaucugcaggccucuaagaaacuuccugaucuguacggcaaucccccucaggaacucauuggggagccccuggaagaccuggauccuuuuuauagcacacaaaagaccuucaucgugcucaacaaaggaaagacaauuuuucgcuucuccgcuaccaaugcccuguacguccuuucuccguuucaccccaucagacgggcugccguuaagauucuggugcacagccucuucaacaugcugaucaugugcacaauccuuaccaauugcguguuuauggcccagcacgacccucccccuuggacgaaauaugucgaguacaccuucacagccauuuauaccuuugagucccuggugaagauccucgcucgcggcuucugccugcaugccuuuacauuccugagagaucccuggaacuggcucgacuucagcguuauuaucauggcuuacaccacggaauuuguggaucuggggaaugucucugcccuucggacauuccgcgugcugagagcgcucaaaaccauuuccguuaucagcggacugaagacaauugugggcgcccuuauccagucugucaaaaagcuggcugacgugauggugcucaccgucuuuugucuguccguuuucgcccugaucggccuccagcuguuuauggggaaccuucggcacaagugcgugcgcaauuucaccgcucugaacggaacaaauggcagcguggaggccgaugggcucgucugggaaucucuggaccuuuaucuguccgauccggagaacuaccuccugaaaaauggaacgagcgacgugcugcucuguggcaacuccucugaugccgggaccugcccugaaggauacagaugucugaaggcuggcgagaaucccgaccauggcuauaccagcuucgacuccuucgcgugggccuuucuugcucuguuccggcucaugacacaagauugcugggagagacuguaccagcagacacugcgcagcgccgggaaaauuuauaugaucuuuuucaugcuuguuauuuuucucggaucuuucuaccuggugaaccugauccucgccgucguggcuauggccuaugaggaacagaaccaagcgaccauugcugaaacggaggaaaaggagaaacgguuccaggaggccauggaaaugcugaagaaagagcacgaagcccuuacaaucagaggcguugacaccgugucccgcagcucucuggagaugagcccucucgcucccgucaauucccacgaacggagaucuaagcgccggaagagaaugagcuccgggaccgaggaguguggagaagaucgccugcccaaaagcgacucugaggauggcccucgggccaugaaccaucugucccuuacaagagggcucagccgcaccucuaugaagccgcgguccagcagaggauccaucuuuacauuccggcgcagagaccugggcucugaagcugauuuugccgacgaugagaauagcacggcgggcgaguccgaaucucaccauaccagccugcucgugcccuggccucugcggagaacauccgcccaggggcaacccagcccuggaaccucugcucccggccacgcccuucacgggaaaaagaacuccacagucgacugcaauggagugguuagccugcucggcgcuggggauccggaggccaccucuccuggcucccaucugcugcgccccgugaugcuugaacacccucccgacacgaccacaccuagcgaggaacccggaggcccgcagaugcucaccucucaggcgccuugugucgacggguucgaggagcccggagcccggcagagagcucugagcgccguguccguucugacaagcgcucucgaggaacuggaagagucucgccauaaaugucccccuugcuggaacagacuugcccaacgguaccugauuugggaauguugcccgcucuggauguccaucaagcagggcgugaagcuggucgugauggaucccuuuaccgaccugacgauuacaauguguaucgugcuuaauacccucuucauggcccuggagcacuauaacaugacaagcgaguuugaagagaugcugcagguugggaaucucgucuucaccggaauuuuuaccgcugaaaugacauucaaaaucaucgcgcuggauccuuacuacuauuuucagcaaggcuggaacauuuucgacuccaucauugugauccuuucucugauggagcucgggcugagccgcauguccaaucugucugugcuucgcagcuuucggcugcuccgcgucuucaagcuggccaaauccuggcccacgcucaacacccugauuaagaucauuggcaauucugugggagcucuuggcaaccugacacucguucuggccaucaucguguucauuuuugccgucguggggaugcagcuguucggcaaaaauuacagcgaacuuagagauuccgacagcggccugcucccucgguggcauaugauggacuuuuuccacgcuuuucugaucauuuuccgcauccucugcggggaguggauugagaccaugugggacuguauggaaguuucuggacagucccugugccuucugguguuucuccuggucauggugaucggcaaccugguugugcuuaaccuguuccucgcccugcuccugagcucuuuuuccgcggauaaucuuacagcucccgacgaggauagagaaaugaacaaucugcagcuggcccucgcccggauccaacgcgggcugagauucgucaagcggaccacgugggacuuuuguugcggccuucugagacagcgcccucagaagcccgcugcccucgcggcucagggacaacugccgagcuguauugccacaccuuauucucccccucccccggagaccgagaaagugccucccacccggaaggaaacaagauucgaggaaggcgagcagccugggcagggaacccccggcgaucccgaaccugugugcgucccgaucgccguugcugaguccgacacagacgaucaagaggaagacgaggaaaacagccucgggacggaggaagaguccagcaaacaggagucucagcccgugagcggaggcccugaagcgcccccugauucccgcaccuggucucaggugagcgcuacagccuccucugaggcggaagccagcgcuucccaagccgacuggcggcagcaguggaaggcugagccccaggccccuggguguggcgaaaccccggaggauucuugcagcgagggauccacagccgacaugaccaauacggcugaacugcuugagcaaauucccgaucugggccaggacgucaaagauccugaagacugcuucaccgaggggugugugagacgcugccccuguugcgcgguugauacaacccaggccccuggaaaggugugguggcggcugagaaagacauguuaccacaucgucgagcauagcugguuugaaaccuucauuaucuuuaugauccuccugucuuccggcgcucuugccuucgaggacauuuaucuggaagaaagaaaaacaaucaaggugcuccuggaauacgccgauaaaauguuuaccuauguuuucgugcucgagaugcugcuuaagugggucgcuuacggguuuaaaaaguacuucacgaacgccuggugcuggcuggacuuucugauuguggacguuagccucgugucucuggucgcgaauacacuuggauucgcugagaugggccccaucaaaucccugcggacccucagagcccugcggccgcuccgcgcccugagcagauuugaaggcaugcgggugguggucaacgcucuuguuggggccauuccuuccaucaugaaugugcugcuggugugucucaucuucuggcugaucuuuucuaucaugggagucaaccuuuucgcgggcaaguucgggcgcugcauuaaucagaccgagggagaucugccccucaacuauacaaucgugaauaacaagagccaaugugaaucccugaaucugaccggcgagcucuacuggacgaaaguuaaggugaacuuugacaacgucggggcuggauaucuugcccugcuccagguggccacauucaaaggcuggauggauauuauguacgcugccguugacagcagaggcuaugaggaacagccccaaugggaguacaaucucuauauguacaucuacuuugugauuuucaucaucuuugggucuuucuuuacccugaaccuuuucauuggagucaucauugauaauuuuaaccagcagaagaaaaagcugggcgggcaggacaucuucaugacagaggagcaaaagaaauauuacaaugcuaugaagaaacucggauccaagaaaccucagaagcccauuccucggccgcugaacaaguaucagggcuuuaucuucgauaucgugaccaaacaggccuuugacgucacaauuauguuccugaucugccucaauauggugaccaugaugguugaaacggaugaccaaagccccgagaagauuaacauccuugcgaaaauuaaucugcuguucguggccaucuuuaccggggaauguaucgucaagcucgcugcccugagacacuacuauuucacaaacucuuggaauauuuuugauuucgugguugugauccuuagcauugucggaaccgugcuguccgacaucauucagaaauacuuuuucucuccuacacucuuucgcgugauccggcuggcuagaauuggccgcauccugcggcucaucagaggcgccaaggggauucgcacccuucuguucgcccugaugaugagccuccccgcucuguuuaacaucggacuucuccuguuccugguuauguuuauuuauuccaucuucggcauggcgaauuuugccuacgucaagugggaggcugggauugacgauauguucaacuuccagacguuugccaauucuaugcugugccucuuccagaucacaaccagcgccggaugggacggccuucuguccccuauccugaacacagggcccccguacugcgauccuacccuccccaacagcaauggaucucggggcgacuguggcuccccugcuguggggauucuguuuuucaccacauauaucauuaucagcuuucuuauuguggucaacauguacaucgccaucauucuggagaauuucuccguggcgacggaagagucuaccgaaccccucagcgaggaugacuuugauauguucuaugagaucugggaaaaauuugacccugaggcuacacaauucauugaauacuccguucugucugauuuugccgacgcccugagcgagccccucagaaucgcuaagccgaaccagauuucccuuaucaauauggaucugccuauggugagcggagaccgcauucauugcauggauauccuguucgccuuuaccaaaagaguccucggcgaaucuggggagauggacgcgcugaagauccagauggaggaaaaauucauggccgcuaaccccuccaagauuagcuaugagcccaucacaaccacgcuucggcgcaaacacgaagaggugucugccaugguuauucagagagcuuuccggcgccaucugcugcaaagaucccugaagcaugccagcuuucuguuccggcagcaggcuggaucuggccucagcgaagaggacgccccugagagagaagggcuuaucgcguacgugauguccgagaauuuuucucgcccgcugggacccccuagcuccagcuccauuucuagcacauccuuucccccuucuuaugauagcgucacccgggccaccuccgacaaccugcaagugagaggcucugauuacagccacuccgaagaccucgcugauuuucccccuagcccggaccgcgaucgggagucuaucguuuga

SEQ ID NO: 75289 - RNA, 5049 nt, Artificial Sequence
  derived and/or modified sequence opt5 from SCN7A__Homo_sapiens__NP_002967
augcuggccagccccgagccuaagggccucgugccguucaccaaagaauccuuugagcugaucaagcagcacauugcuaaaacacauaacgaagaccacgaggaagaggaucuuaagcccacgccugaccuggaggucgggaaaaagcuccccuucaucuacggaaaucugucucaaggcaugguuagcgaaccucuugaggauguggaccccuauuacuauaagaaaaagaacaccuuuauugugcugaauaaaaacagaacaaucuuccgguuuaaugccgcguccauucucugcacccugucuccuuucaacuguauccgcagaacaaccaucaagguccuggugcauccguuuuuccagcucuuuauucugaucagcguucuuauugauugcguguucaugucccugacaaaucuccccaaauggcggccuguccuggaaaacacccuucuggggaucuacacguuugagauucucgugaagcuguucgcucgcggaguuugggccggcucuuuuagcuuccugggggaccccuggaauuggcucgauuucuccgugaccgucuuugaggugaucauuagauauagcccucuggacuucauccccacacuucagaccgcccggacacugcgcauccucaagauuaucccgcugaaccagggacuuaaaucucuggugggcguccucauucacugucugaagcaacugaucggcguuauuauccucacccuguuuuuccuuuccaucuuuagccugauugggaugggacucuucaugggcaaucugaaacauaagugcuuuagauggccucaggaaaacgagaaugaaacgcuucacaaccggacagggaaucccuacuauauccgcgagaccgaaaacuucuacuaccuggagggagagagauaugcucuccuguguggcaaccggacagaugccgggcagugcccugaaggauacgugugugugaaagcuggcauuaaucccgaccagggcuuuaccaacuucgauucuuuugggugggcccuguucgcgcucuuucgccugauggcccaagacuaucccgagguccuuuaccaccagauccuguaugcuuccggaaagguguacaugauuuucuucguuguggucagcuuucucuucucuuuuuauauggccucccuguuccugggcauccuugcuauggccuacgaagaggaaaaacagagagugggggagaucagcaagaagauugagccuaaauuucagcaaaccggaaaggaacuccaggagggcaaugaaacagaugaggcgaaaacgauccagauugaaaugaagaaacgguccccgaucucuaccgacacaagccuggacguucuggaggaugccacccuccgccauaaggaggaacuggagaaguccaaaaagauuugcccccuuuacugguauaaauucgcuaagacauuucugaucuggaacuguagcccuugcuggcucaaacugaaggaauucgugcacagaauuaucauggcccccuuuaccgaccuguuccuuaucauuuguaucauucucaaugucugcuuucugacgcuggagcauuacccuaugucuaagcaaacaaacacccuccugaauaucgggaaccuuguguucauuggaaucuuuaccgcugagaugaucuucaaaauuaucgccaugcaccccuauggcuacuuccaggucggcuggaauauuuuugauuccaugaucguguuccacgggcugauugaacucugccuggccaacguugcuggaauggcgcugcuucggcucuuuagaaugcugcgcaucuucaagcugggcaaauauuggccgacauuucagauccucauguggagccugucuaauagcuggguggcccuuaaggaccugguccuccugcuguucaccuuuauuuucuuuuccgcugccuucgggaugaaacuuuuuggaaagaacuacgaggaauucgugugucauaucgauaaggacugccagcucccucgguggcacaugcaugauuucuuucacucuuuccugaauguuuuuagaauucuguguggcgaguggguggaaacacucugggacugcauggaggucgccgggcaaagcugguguauccccuucuaucugauggugauucuuaucggcaaccugcucgugcuguaccuguuucuugcucugguuuccagcuucucuuccugcaaagaugucacggccgaggaaaauaacgaggcgaagaaccuccagcuggcuguggcccgcaucaaaaagggaauuaauuacgugcuccugaaaauccuuuguaagacccagaacgucccuaaagacacaauggaucaugugaaugaaguuuaugugaaggaggacauuagcgaccacacccugucugaacucuccaacacacaggauuuucugaaggacaaagagaagagcuccggcaccgagaaaaaugccacggaaaacgagucucaaagccugauccccuccccuucugucagcgaaaccgugcccauugcuuccggggagagcgauaucgaaaaucuugacaacaaggagauucagucuaaauccggagauggcgggagcaaggagaagaucaaacagucuuccagcucugaaugcagcacaguugacaucgccauuuccgaggaagaggagauguucuacggaggcgaacggagcaagcaccugaaaaauggguguagacgcggcucuucccucggacagaucagcggcgcuuccaagaaagggaagauuuggcaaaacauccggaagaccugcuguaaaauuguggagaauaacugguuuaagugcuucaucggacuggucacacuccugucuaccggcacgcuugccuuugaagauaucuauauggaccagagaaaaacaauuaagauccugcucgaguacgcggauaugauuuucaccuauaucuuuauucuggaaaugcugcuuaaauggauggccuacggguucaaggcuuauuucagcaauggaugguaccgccuggacuuugugguugugaucgucuucugccucucccugaucggcaagacacgggaggagcucaaaccgcugauuucuaugaaguuucuuagaccucugcgcgugcugagccaguucgaacggaugaaaguggucguuagagcccucaucaagaccacccugcccacacuuaacguguuucuggugugucucaugauuuggcugaucuucuccauuaugggggucgaucucuuugcuggccgguucuacgagugcaucgaccccacgucuggagaacgcuuuccuagcuccgaggugaugaauaaaagcagaugugaaucucugcuuuucaacgaguccaugcugugggagaacgccaagaugaauuuugauaacguuggcaauggguuccugagccuccugcagguggcgaccuuuaacggauggauuacaaucaugaauucugccaucgacuccgucgcugugaacauucaaccgcauuucgaaguuaauaucuauauguacugcuauuucauuaacuuuaucauuuucggcguguuucuuccccugagcaugcucaucaccgucaucauugacaauuucaacaaacacaagaucaagcuggggggaucuaauauuuuuaucacagugaaacagcggaagcaguacagacgccucaaaaagcugauguaugaggauucccaacggccuguucccagaccucuuaacaaacugcagggcuucauuuuugacguggucaccagccaggccuucaaugugaucgugaugguccugaucuguuuucaggcuauugccaugaugaucgauacggacguucaaucccuccagaugagcauugcccuguacuggaucaacucuauuuucgugaugcuuuauacaauggaaugcauccugaagcucauugcuuuucgcuguuucuacuuuaccaucgcguggaauaucuucgauuucaugguggucauuuuuagcaucaccgggcugugccuccccaugacagugggcuccuaccugguuccucccucucuugugcagcugauucugcucagcagaaucauucauaugcugcggcuuggaaagggcccgaaagucuuccacaaccugaugcucccucugaugcugucccuccccgcccuucugaacaucauccugcucauuuuucuggugauguucaucuaugcuguuuuugggauguacaauuucgccuaugugaagaaagaggccggaauuaacgacgucucuaauuuugaaaccuucggcaacagcaugcuuugucuguuucagguggcuaucuucgccgggugggauggaaugcucgacgcgauuuuuaauuccaaguggucugauugcgacccugauaaaaucaaccccggcacacaaguccgcggcgacugugggaauccgagcgugggaaucuucuacuuuguuuccuauauucugaucagcuggcugauuaucgugaacauguacauugucgugguuauggaguuccucaauaucgcuucuaagaagaaaaacaagacgcuuuccgaggaugacuucagaaaauuuuuccagguguggaagcgguuugacccugaucgcacccaguauauugacagcucuaaacuguccgauuucgccgccgcucuggaccccccucucuuuauggccaagcccaauaagggccagcugaucgcgcuugaucugcccauggcugucggggacagaauccacugccucgauauucugcuggccuucacaaaacgggugaugggacaagacgugcgcauggaaaagguugucagcgagaucgaauccggcuuucuccuugccaacccuuucaaaauuaccugcgagccgaucacaaccacgcugaagagaaaacaggaggcugugucugccaccauuauccagcgggcuuacaagaauuaccgccugagacggaacgauaagaauacaagcgacauccauaugauugauggggacagagacgugcacgccaccaaagaaggagcguauuuugauaaggccaaagagaagucccccauccaaagccagauuuga

SEQ ID NO: 75290 - RNA, 5820 nt, Artificial Sequence
  derived and/or modified sequence opt5 from SCN8A__Homo_sapiens__NP_001171455
auggccgcuagacugcucgcgcccccuggcccggacagcuucaagcccuuuaccccugagucccuggcgaacaucgaacggagaauugcugagucuaaacuuaagaaacccccuaaggccgaugggagccacagagaagacgaugaggacuccaaacccaagccuaauucugaucuggaagccggaaagagccucccguucaucuacggcgacauuccccaggggcugguggcugucccucuugaggauuuugaccccuauuaccugacacagaagacguucguugugcucaaccggggaaagacccuguuucgcuucuccgccaccccugcucuguauauccucucucccuuuaaucugauuagacggaucgccaucaaaauucuuauccauagcguguucuccaugauuaucaugugcaccauucugacaaacugugucuuuaugaccuucagcaauccgccugauuggucuaagaacguggaguacacauuuaccggcaucuauacguucgaaucccucguuaaaauuaucgcccgcggguuuugcaucgacggauucaccuuccugagagaucccuggaauuggcuugacuuuagcgugauuaugauggccuacaucacagaguucgucaaccugggcaaugugucugcucuccggaccuuucgcguucugagagcccugaagacaauuuccgugaucccuggccucaagaccauugucggggcucugauccagagcgugaagaaacuuucugaugugaugauccugacggucuucugucucuccguuuuugcccugauuggacuucagcuguucaugggcaaccuccggaauaaaugcgugguguggcccaucaacuuuaaugaaagcuaucuggagaacgggacaaagggauucgacugggaggaauacauuaauaacaaaaccaacuuuuacacaguccccggcaugcuggagccucuccuguguggaaauuccucugacgcggggcagugcccggaaggcuaucaauguaugaaggccggccgcaaccccaauuacggguauaccagcuucgauaccuuuuccugggcuuuccuugcccuguuuagacucaugacacaggacuacugggagaaccuguaucagcuuacgcugcgggcugccggaaaaaccuacaugaucuucuucgugcucguuauuuuugugggcagcuucuaucuggucaaucugauccucgccgugguugcuauggcguacgaggaacaaaaccaagccacacuggaggaagcugagcagaaggaagccgaguuuaaggccaugcuugaacagcugaaaaagcagcaagaggaggcucaggccgcggcuauggccaccucugccgggacaguguccgaagaugcuaucgaggaagagggagaagagggcgggggaagcccucgcucuagcuccgagauuucuaaacucagcuccaagagcgccaaagaaagacggaauagacgcaagaagcggaaacagaaggagcugucugaaggcgaggagaaaggcgaccccgaaaaggucuucaaauccgagagcgaagaugggaugagacgcaaggcuuuucggcugccugacaacagaaucggacgcaaguucucuauuaugaaucaaucccuucucagcauccccggcuccccguuucugucucggcacaacagcaaauccucuauuuucagcuuuagagggccuggacgcuuccgggaucccggcuccgagaaugaauuugccgacgaugagcauagcaccguggaggaaucugaggggagacgcgacucccuguucaucccuauucgggcgagagaacggcgcagcucuuacuccggcuauagcggauacucucagggcagcagauccagccggaucuuucccucucucagacgcuccgucaagcggaacagcacgguggauugcaaugggguugugucccugaucggaggcccugggucucacauuggaggcagacuucugcccgaggccacaaccgaagucgagaucaaaaagaaagggccgggcagccuccugguguccauggaccagcuggcuucuuauggacgcaaggacagaauuaacagcaucauguccguugugaccaauacacuugucgaggaacucgaggaaucucagcggaaguguccucccugcugguacaaauucgccaacaccuuccugauuugggagugucaucccuauuggaucaagcugaaagaaaucgugaaccucauugugauggauccuuuuguugaccuggcuaucacaauuugcaucguccuuaauacgcuguucauggccauggagcaccacccgaugacaccccaauuugagcaugugcucgcggugggcaaccuggucuucacagggauuuuuaccgccgaaauguuccugaaacuuaucgcuauggauccuuacuauuacuuucaggagggauggaauaucuucgacggcuuuauugugagccucucccugauggaacugagccucgccgauguugaggggcugucugugcuucgcuccuucagacugcuccgggucuuuaaacuggcuaagagcuggcccacacugaacaugcuuaucaaaauuaucggaaauucugugggcgcccucgggaaccugacccugguucucgccauuaucguguucaucuucgcugucgugggcaugcagcuguuuggaaaguccuacaaggagugcguuuguaaaauuaaucaggacugcgaacuuccucgcuggcacaugcaugauuucuuucacagcuuccugaucguguuuagaguccucuguggcgaguggauugaaacgaugugggacugcauggagguggcggggcaagccaugugucugaucguguucaugauggucaugguuauuggaaaccugguggugcuuaaucuguuucucgcucugcuccugucuuccuucagcgccgauaaccuugccgcuaccgacgaugacggcgaaaugaauaaccugcagaucuccgucauucggaucaagaaagggguggccuggacaaagcucaaaguucacgcguuuaugcaggcucauuucaagcagcgcgaggccgaugaggugaagccccuggacgaacuguaugagaaaaaggccaauugcaucgcuaaccacaccggagccgacauucauagaaauggcgauuuucagaagaacgggaacggcacaaccagcggaaucggcucuagcgucgaaaaguacauuaucgacgaggaucacauguccuucauuaauaacccuaaucuuacggugcggguucccaucgcggugggggaaucugacuuugagaaccugaauacagaggaugucagcuccgaaucugacccggagggaagcaaagauaagcucgacgauaccuccucuagcgaaggcuccacaaucgacauuaagccugagguggaagagguucccguggagcagccugaagaguaucuggaucccgacgcuuguuucaccgaagggugcguccagcgcuucaaauguugccaggugaacaucgaggagggacucggcaagagcugguggauucugagaaaaaccuguuuucuuaucguggaacauaauugguucgagacauuuauuaucuucaugauccugcucucuuccggcgcccuggccuuugaagauauuuacaucgagcaacggaagacgauuagaaccauccuggaauaugcugacaaagucuucacauacauuuuuauccuugagaugcugcucaaguggaccgccuauggguucguuaaguuuuucacaaacgcuuggugcuggcuggacuuucucauuguggccguggucgugaaugcgcugguuggagccaucccgagcaucaugaacgugcuucuggucugccugauuuucuggcucaucuuuucuauuaugggcgugaaucuguucgcugggaaauaccacuacuguuucaacgagaccuccgaaauccgcuuugagauugaagauguuaauaacaagacggagugcgaaaaacuuauggagggaaauaacacagagauccgguggaagaacgugaaaaucaauuucgacaacgucggcgccggguaucuggcucuccuccagguggccaccuuuaagggauggauggauauuauguacgccgcugucgacagcagaaaaccugaugaacagcccaaguaugaggacaauaucuacauguauauuuacuucgugaucuuuauuaucuucggcuccuuuuucacccugaaccuguuuaucggcguuauuaucgauaauuucaaccaacagaagaaaaaguuugggggacaggacauuuucaugacagaggaacagaaaaaguauuacaaugcgaugaagaaacuuggcucuaagaaaccucaaaaacccaucccccgcccucugaacaaaauucaagggaucguguuugauuucgucacccagcaggccuucgacauugugaucaugaugcugaucugucucaauaugguuacaaugaugguggaaacggauacccaaagcaagcagauggagaacauucuguacuggaucaaucuugucuuugugauuuucuuuacaugcgagugugugcugaaaauguucgcucuccggcacuauuacuuuaccaucggauggaacauuuucgacuuuguugucgugauccuguccaucgugggcauguuccucgccgacauuaucgaaaaguauuuugucagcccgacacuguucagagugauucgccuugcccggaucgggcgcauucugcgccugaucaagggagcuaaaggcauccggacccuccuguuugcccuuaugaugucucugcccgcucucuucaauauuggccugcuccuguuucuuguuauguucaucuucuccauuuuugggaugagcaacuucgcguacgugaagcaugaggccggaaucgaugacauguuuaauuucgaaacguuuggcaacucuaugauuugccuguuccagaucaccacaagcgccgggugggauggacugcuccugccuauucuuaauagacccccugacuguucccuggauaaagagcaccccggcucuggguuuaagggagacugcggcaacccuagcgucggcaucuucuuuuucguguccuauaucauuaucucuuuucucauuguugugaacauguacaucgcuauuauccuggagaauuucagcgucgccaccgaagaguccgcggauccgcugagcgaagacgauuuugagacauucuaugaaaucugggagaaauucgaccccgaugcuacccaguuuauugaguacuguaagcucgccgacuucgccgaugcucuugaacauccucugcgggugcccaagccuaacacaaucgagcugauugccauggaccuccccaugguuucuggggaccgcauccacugccuggauauucuuuuugcuuucaccaaaagagugcugggagacuccggcgaacucgauauccugcggcaacagauggaggaacgcuuugucgccagcaauccguccaaggugucuuacgagccuaucacgacaacccugagacggaaacaggaggaagugagcgcggucguucuccaaagagccuaucgcgggcaccuugcucggagaggauucauuuguaagaaaaccacauccaacaagcuggagaauggcgggacccaucgcgaaaagaaagagucuacgcccagcacagccucccugcccagcuacgacucugugaccaagccugaaaaagagaagcagcagcgggcugaggaaggaagacgcgagcgggccaaaagacagaaggaagugcgcgaguccaaaugcuga

SEQ ID NO: 75291 - RNA, 5934 nt, Artificial Sequence
  derived and/or modified sequence opt5 from SCN9A__Homo_sapiens__NP_002968
auggccaugcugcccccucccggaccccagagcuucgugcacuuuaccaagcaaucccucgcucugaucgagcaaagaauugccgaacggaagucuaaggagccuaaggaagagaagaaagacgaugacgaagaggcgcccaagccuagcuccgaucuugaggcugggaagcagcugcccuucaucuacggagacauuccuccgggcaugguuucugaaccccucgaggaucuggacccuuauuacgccgauaaaaagacauuuaucguucuuaauaaagggaagacgauuuuccgcuuuaaugccacccccgcucuguauaugcucagcccuuucagcccccugagacggaucucuaucaaaauucuggugcauagccucuuuuccaugcugaucaugugcacaauucuuaccaacuguaucuucaugacaaugaauaacccgccugacuggaccaagaauguggaauacacauuuaccggaauuuauacguucgagagccuggucaagauccucgcccgcggcuuuugcgugggggaguucaccuuucugagagaucccuggaacuggcuugacuucguugugauugucuucgcuuaccugacagaauuugugaaucucggaaacguuucugcccugcggaccuuccgcgugcugagagcgcucaaaacaaucuccgucaucccuggccugaagaccauugugggcgcccuuauccagagcgugaaaaagcugucugaugucaugauucucacggucuuuugucuguccguguucgcucuuaucgggcugcaacucuuuaugggaaaucugaaacacaagugcuuccggaacagccuggagaauaacgaaacacucgagucuauuaugaauacccuggaauccgaggaggacuuucgcaaauauuucuacuaccuugaaggcagcaaggaugcccugcucuguggguuuuccacagacucuggacagugccccgagggcuauaccugugugaagaucgggagaaaccccgacuacggauauaccagcuucgauacauuuuccugggcuuuccuggcccuuuuucggcugaugacgcaggacuacugggaaaaucucuaucagcaaacccugcgcgcggccggcaaaacauacaugaucuucuucgucgugguuauuuuucugggcagcuucuaucucaucaaccugauucuugcuguggucgccauggcuuacgaggaacagaaccaggccaauaucgaggaggccaagcagaaagaacuggaguuucaacagaugcucgauagacugaagaaagaacaggaggaagcugaggcgauugccgcugccgccgcugaguacaccucuauccggcgcuccagaaucauggggcugagcgaaucuagcuccgagacaucuaaacuuagcuccaagagcgccaaagaacggagaaaccgccggaagaaaaagaaucagaagaagcucucuuccggagaggagaagggcgacgcggaaaaacugagcaagucugaguccgaagauagcauuagacgcaaauccuuccaucuggggguggagggacaccggagagcucaugaaaagcgccucucuaccccuaaccagagcccgcuguccauccggggcucucuuuuuagcgccagacgcuccagccggacgucucuguucuccuuuaaagggagaggacgcgacauuggcagcgagacagaguucgccgaugacgaacacucuaucuuuggcgauaaugagucccggagagggagccucuucguuccccaccggccucaggaacgcagaucuagcaacauuucccaggcuagccggucucccccuaugcugcccgugaauggaaagaugcauuccgccgucgacugcaacggcguggucagccugguggaugggagauccgcucuuaugcucccgaauggacaacugcugccugagggcaccaccaaccagauccacaagaaacgccgguguucuagcuaucuccuguccgaagacaugcuuaaugaccccaaccugagacagcgcgccaugucuagagcgagcauucucacaaauaccguugaggagcuggaagagucccggcagaagugcccucccuggugguaccgcuuugcccauaaauuccugaucuggaacuguucuccuuauuggaucaaguuuaaaaagugcauuuacuucaucgugauggaucccuucgucgaccuugcuauuacaaucugcauugugcucaauacgcuguuuauggccauggaacaccacccgaugaccgaggaguucaaaaacguucuggcuaucgggaaccucguguuuacaggcaucuucgccgcggaaaugguccugaaacuuauugccauggauccuuaugaguacuuucaagugggauggaauaucuucgacagccugauugugacccucucccugguugaacuguuucuugcugaugucgagggccucagcgugcugagaucuuuccggcugcuccgcguguuuaagcuggccaaauccuggcccacacuuaacaugcugaucaagauuaucgggaauagcgucggagcucucggcaaccugacccuggugcuugccaucauuguuuucaucuuugccguggucgggaugcagcuguucggaaaaucuuauaaggaaugugugugcaaaauuaaugacgauuguacgcuccccagauggcauaugaacgacuucuuucacuccuuccugaucguuuuucgggugcucugcggcgaguggauugagaccaugugggauuguauggaagucgcugggcaggcgaugugccugaucguguacaugaugguuauggugaucggcaaucuugucgugcugaaccucuuccuggcccugcuucugagcucuuuuuccagcgacaaucucacagcuauugaggaagauccugacgccaacaaucugcagaucgccgugacccgcauuaagaagggaaucaacuacgucaaacaaacacucagagaguucauucugaaggcuuuuuccaaaaagccgaaaaucagccgggaaauucgccaggccgaggaucuuaauaccaagaaggagaacuauaucucuaaucauacgcuggcggaaaugagcaaaggccacaacuuccucaaggagaaagacaagaucuccggguuuggaucuagcguugacaaacaucugauggaagauuccgacggccagucuuucauucacaaccccagccugacagugaccgugccuaucgcucccggggaguccgaucuugaaaauaugaacgccgaggagcugucuagcgacuccgauagcgaauacucuaaggucagacucaaucgguccuccucuuccgaguguagcacaguggacaacccucugcccggagaaggcgaggaagccgaggcugagccuaugaacuccgaugaacccgaggccugcuuuaccgacggguguguuagacgcuucucuugcugucaggugaacauugaaagcggcaagggaaaaaucugguggaauauucggaagaccugcuauaaaaucgucgagcacuccugguuugagagcuucaucgugcucaugauucugcuuucuuccggcgcgcuggcuuucgaagauaucuacauugagagaaagaaaacaaucaagauuauccuggaauaugccgacaaaaucuuuacguacauuuucauccucgagaugcugcuuaaguggauugccuauggguacaagaccuacuuuacaaacgcuuggugcuggcuggauuuccucaucguugacgugagccuggucacccucguggccaauacacugggauauucugaucuuggcccgauuaaaagccugcgcacccugcgggcucucagaccucugcgcgcccuuucccgguuugaagggaugagaguuguggucaacgcgcugaucggagccauucccucuaucaugaaugugcuccuggugugucucaucuucuggcugauuuuuagcaucaugggcgucaaccuuuucgcugggaaguuuuacgagugcauuaauacgacagacggcucccgcuucccugccucucaaguucccaaccggagcgaguguuuugcucugaugaaugugucccagaacgugagauggaaaaaccugaaggucaauuucgacaacgugggacucggcuaucugagccuucugcagguugccaccuuuaaaggguggaccaucauuauguacgccgcuguggauucugucaauguggacaagcaaccgaaguaugaauacucccucuauauguacaucuacuucguuguguucaucauuuuuggcagcuucuuuacacugaaccucuucaucggcgucauuaucgauaauuuuaaccagcagaaaaagaaacuugggggacaggacauuuucaugaccgaggaacaaaagaaauauuacaaugcgaugaagaaacugggcuccaaaaagccucagaaacccaucccucggcccggcaacaagauccaggggugcauuuuugaucuggugacaaaucaggccuucgacaucucuauuaugguccugaucugucucaacauggugacgaugaugguugagaaagaaggacaaagccagcauaugaccgaggugcuguauuggauuaaugucguguuuaucauucuuuucacaggcgagugcguucugaagcucaucucccugcgccacuacuauuuuaccgugggguggaacaucuucgauuuugucguggugauuaucucuauuguuggaauguuccuggcugaccucaucgaaacauacuucgucagccccacccuuuuuagagugauucggcuggcccgcaucggcagaauccugcggcucgugaagggggccaaaggaauuagaacgcugcuuuucgcucugaugaugucccucccugcccuguuuaauaucggccugcuccuuuuccuggucauguuuauuuaugcgaucuucggcaugagcaacuuugcuuacgugaagaaagaggaugggauuaaugacauguucaacuuugaaaccuucggaaauucuaugaucugucuguuucagaucacaaccuccgccggcugggaugggcuccuggccccgauucuuaacagcaagcccccugacugcgaccccaaaaagguucauccuggaucuuccguggagggcgauugugggaaccccagcgucggaaucuucuacuuugugucuuauauuaucauuagcuuccugguuguggucaauauguacaucgcugugauucucgaaaacuucuccguugccacagaggagucuaccgaaccucugagcgaggacgauuuugaaauguucuaugaggugugggagaaguuugacccggaugcgacacaguucaucgaauuuuccaaacugagcgacuucgcugccgcccucgaucccccucuucugaucgcuaagcccaauaaaguccaacugauugccauggaccucccuaugguguccggcgaucgcauccacugccuggacauucuuuuugcuuucaccaagcgggugcugggcgagucuggggaaauggauagccucagaucccagauggaggaacgcuuuaugucugccaaccccagcaaagucuccuacgagccgaucacgacaacccugaagcggaaacaggaggacguuucugcgaccgugauucaaagagccuaucgccgguacagacugcgccagaaugugaagaacaucagcuccaucuauauuaaggauggagacagagacgaugaccuccuuaauaaaaaggauauggcuuucgacaacgucaaugaaaacagcucuccugagaaaacagaugccaccuccagcacgacaucuccgcccuccuacgacagcgugaccaagccugauaaagaaaaguacgagcaggaccggacagaaaaggaggauaaaggcaaggacucuaaagaguccaagaaauga

SEQ ID NO: 75292 - RNA, 588 nt, Artificial Sequence
  derived and/or modified sequence opt5 from SCNM1__Homo_sapiens__NP_001191785
augcugagagacggccgguucgccugcgcuaucuguccccaccgcccugugcucgauacccuggccaugcuuacagcgcauagagcugggaagaaacaccugagcucccuccagcuguuuuacggaaagaaacaaccgggcaaggagcggaaacagaaccccaagcaucagaaugaacuucgcagagaggaaacgaaggccgaggccccucugcucacccagacacggcugauuacccaaucugcucugcaccgcgcuccccauuauaacagcugcuguagacggaaauaccgcccugaagcccccgggccuuccgucucucucagcccgaugcccccuuccgagguuaagcugcagucuggaaaaaucagcagagagcccgaaccugccgcgggcccccaggccgaggaauccgcuacagugagcgccccggcuccuaugucucccacccggcgcagagcccuugaccacuaucugacacuccgguccagcggguggauuccugauggacgcggcagaugggugaaggacgagaaugucgaguucgauucugacgaagaggaaccucccgaucugccccuugacuga

SEQ ID NO: 75293 - RNA, 2010 nt, Artificial Sequence
  derived and/or modified sequence opt5 from SCNN1A__Homo_sapiens__NP_001029
auggagggcaacaagcuggaggaacaggacagcucucccccucaaucuaccccggggcucaugaaaggaaauaagagagaggaacagggccuggggcccgaaccugccgcuccccagcagccuacagccgaggaggaagcgcuuaucgaguuccaccggagcuaccgcgaacuguuugaguucuuuugcaacaauacgaccauucauggagcuaucagacucguguguucccaacacaaccggaugaaaacagccuucugggccguccuguggcuuugcaccuuuggcaugauguauuggcaguucgggcugcucuuuggagaguacuucucuuaucccguuagccugaauauuaaccuuaauuccgauaagcucguguuuccugcugugacaaucuguacccugaacccguaccgcuaucccgaaauuaaagaggaacuugaggaacuggacagaaucacagagcagacccucuucgaucuguacaaguauucuagcuuuacgacccuugucgccggcucccggagccgcagagaccugcggggcacacucccucauccccugcagcgccugagagugccucccccgccucacggggcucggcgcgccagaucuguugcguccagccuccgggauaauaacccccaaguggacuggaaggauuggaaaaucggauuccagcugugcaaucagaacaagucugacuguuuuuaccagaccuacuccagcggcgucgaugccgugcgcgagugguauagauuccauuacauuaauauccuuucucggcugccugaaacacuccccucccuggaggaagacacccuugggaacuucauuuuugcuugcagauucaaucaaguuagcuguaaccaggccaacuauucccacuuucaccaucccauguacggaaauugcuauacguucaacgauaaaaauaacucuaaucuguggaugagcuccaugccuggcaucaacaaugggcucagccugaugcugcgcgcugagcagaacgacuuuauuccgcuccugucuacagugaccggagcccgggucauggugcacggccaagaugaacccgcguucauggacgacggcggguuuaaucuuagaccuggaguggagacauccaucagcaugcgcaaggagacccuggaucggcucggcggggacuacggagauuguaccaaaaacggcucugacguccccguugaaaaucuguauccuagcaaguacacacaacaggugugcauucauuccuguuuccaggagucuaugaucaaggaaugcgggugcgccuacaucuuuuaucccagaccgcagaacguggaguacugugauuaucgcaaacacagcuccuggggauacugcuauuacaagcugcaggucgacuucagcucugaucaccugggcuguuuuacgaaaugccggaagccuuguuccgugaccagcuaucagcucucugcuggcuacuccagauggcccagcguuacaucccaggaauggguguuccaaaugcugucucgccagaauaacuacaccgucaauaacaaacggaacgggguggccaagguuaauaucuuuuucaaagagcugaacuauaagacaaauagcgaguccccuucugugaccauggucacgcuccugagcaaccuuggaucccaguggagccugugguucggcuccuccgugcucagcgucguggaaauggcugagcugguuuuugaccugcuugugauuauguuccucaugcugcugagacgcuuucggucuagauacuggucccccgggcggggaggccgcggggcccaggaagucgccagcacacucgcuucuagcccucccucccauuucugcccgcacccuaugagccugucucuuucccaacccggccccgcgccuagcccggcccugaccgcucccccucccgccuaugccacccucggaccuagacccuccccuggcgggucugcuggagccagcuccucuacauguccccugggcgggccguga

SEQ ID NO: 75294 - RNA, 1923 nt, Artificial Sequence
  derived and/or modified sequence opt5 from SCNN1B__Homo_sapiens__NP_000327
augcacgugaagaaauaccugcucaagggccugcauagacuucagaaagggcccggauauaccuacaaggagcugcucgucugguauugcgacaacacaaauacgcacggcccuaaacggaucauuugugaagggccgaagaagaaagccaugugguuccugcuuacccugcucuuugcugcccugguuugcuggcaauggggaaucuucauucgcacauaccugagcugggagguguccgugucucucagcgucggcuuuaagaccauggauuuccccgcggugacaaucuguaacgcuuccccuuuuaaauauucuaagauuaaacaucugcuuaaggaccuggaugaacucauggaggccguucuggaaagaauccuugcccccgagcugagccacgcuaaugccacccggaaccucaauuucuccaucuggaaccauacaccucuggugcugauugacgagcgcaauccccaccacccuaugguccucgaucuguuuggggacaaccauaauggacuuaccucuagcuccgcuagcgaaaagaucugcaacgcccacggcuguaaaauggcgaugagacugugcucucucaaucggacgcaguguaccuuccgcaacuuuacauccgccacccaggcucugacagagugguacauucuucaggccaccaauaucuucgcucaagugccgcagcaggaacugguugagaugagcuaucccggcgagcagaugauucucgccugccuguuuggggcggaaccuuguaacuacagaaauuucacgucuaucuuuuacccccauuauggaaacugcuacauuuucaacuggggcaugacagagaaggcccugccuuccgcuaaucccgggaccgaguucggacucaaacugauccuugauaucggccaagaagacuaugugccguuucuggccagcacagcugggguccggcucaugcugcacgaacagcgcucuuacccuuucauuagagaugagggaaucuaugccauguccggcaccgagaccagcauuggcgugcuuguggacaagcugcagcggaugggggaacccuacuccccuuguacagucaacggaucugagguucccgugcagaauuuuuauagcgauuacaacacgaccuacuccauccaagccugccuccgcagcugcuuccaggaccacaugauuagaaauuguaacugcggccauuaucuguacccccugccucgcggggaaaaauauuguaauaaccgggauuuuccggacugggcucacugcuacucugaccuccagauguccguggcgcaaagagagacauguaucggaaugugcaaggaaagcuguaaugauacccaguauaaaaugacaaucucuauggccgacuggcccagcgaggcuuccgaggauuggauuuuccauguccugucucaggaacgggaccagagcaccaacaucacgcuuuccagaaagggcauugugaagcugaauaucuacuuucaagaguucaacuaucgcacaauugaagagagcgccgccaauaacaucguuuggcuccugucuaaucuugggggacaguuuggcuucuggaugggcggguccgugcuuugccucaucgaauuuggagagauuaucauugauuucgucuggaucaccauuaucaaacugguggcucuggccaagagccuccggcagagacgcgcgcaggcuucuuacgccggcccucccccuaccguugccgagcugguggaagcucacacaaacuuuggguuccaacccgacaccgccccgcgguccccuaacacaggacccuacccuagcgagcaggcucugcccauuccuggcacgcccccgccuaauuaugauucccugagacuccagccccuggacgucaucgaaucugauagcgagggggacgccaucuga

SEQ ID NO: 75295 - RNA, 2688 nt, Artificial Sequence
  derived and/or modified sequence opt5 from SCNN1D__Homo_sapiens__XP_011540201
augcccggcgccugccaucugcaggggagcgcugugaccgaggacaacacagccccuucccucccggucgcgagacccccucaacggcccaaggaaguuucuagccagccuuguuccgugaauggagcuuggcccucuuuccugggcgagagccgcgggaugggaccuaaaggcgccagagaugccugcccgucccuucugucuuuucggcucacguggagcugguguuccgaccaccgcacccccacaugcagagaacuggggagcccucaccccaccccuuguacaggacccgcucggggcuggccgcgcagaggcgggggaccuugcggcuucaccucugccgggcaugugcuuuguggauacccccugugccuccuguccggcccuauccagggguguggaacaggcgcugcccacgcgcagagcugccccgaugucgugggcgagaagccccaagccugugcuguuucugggggaccugccgcugaccuguggggccucugcgauauuuccaaaccgcccgccgcgagccuggaacggcauccuucucccaucuggcacucccgcaagagcgcccagagagggcggcaccgcuggcagcuucugccuuccagagcuggacggcaggaggcccgcggcucuauucuccugcaaagcugccagcuucccccgcaguggcuguccaccgaggcuuggacgggggaauggaaacagccucauggaggcgcccucaccagcagaucucccggcccuguggcuccccaacggccuugucaccugaagggguggcagcauagacccacacagcacaacgccgcgugcaagcaaggacaggccgcugcccagaccccgccucgccccgggcccccuuccgccccgcccccucccccuaaagagggccaccaggaaggacuggucgagcuccccgcuagcuuucgggagcugcuuacauucuuuuguaccaaugccacgauccauggcgcgauuagacuggugugcucucgcgggaaccggcucaagacaaccagcuggggccugcuuucccugggagcucucguugcccuguguuggcaacugggccuccuguucgaaagacacuggcaucgcccugugcuuauggccgucucugugcacagcgagcggaaacugcucccccuggugacacuuugcgacgggaauccgagacgcccuucccccguccugcggcaucucgaacugcuggaugaguuugcuagagaaaacaucgacagccucuauaauguuaaccugucuaagggacgcgccgcucuuuccgccaccgugccucggcacgagcccccguuccaccuggauagagagauccggcuccagcgccugagccauucuggcuccagagugcgggucggguuuagacuguguaauagcaccggaggcgacugcuucuaccgcggguauacauccggcguggcggccguucaggauugguaccacuuucauuauguggacauucuugcucuccugccugccgcuugggaagauucucacggaagccaggacggccacuucguccuguccuguucuuacgacgggcucgauugccaagcccggcaguuuagaacguuccaucaccccaccuauggaagcuguuacacaguggacggcguuuggaccgcgcagcgcccugggaucacacauggagugggccugguccuuagaguggagcagcaaccccaucugccccuccuguccacccuggccgggauucgggucauggugcacggccgcaaccacacgccuuuccuuggacaccauagcuuuucuguuagaccgggcacagaagcuaccaucuccauucgggaggaugaagugcaccgccucgggagccccuacggacauugcaccgccggcggggagggagucgagguggaacugcugcacaauacaucuuauaccagacaggcuugccucguuuccuguuuccagcagcugaugguggagacaugcagcuguggcuacuaucuucauccucugcccgccggggccgaauacugcucuagcgcucggcacccugcguggggccacuguuuuuaucgccucuaccaagaccuggagacgcauagacugcccugcaccucccgguguccucgcccgugcagagaaagcgccuucaaacuuucuacaggaaccucccgguggcccagcgcuaaguccgccggcuggacacucgccacccugggggagcagggacugccucaccagucucauagacaacgcagcucccucgcuaagaucaacauugucuaucaggagcugaauuaccggucuguggaagaggcccccguguacagcguuccucagcuucuguccgcgaugggcucucucuguagccugugguuuggggcuuccguccugagccuucucgaacugcuggagcuccugcuugaugccucugcccugacgcucgugcugggaggcagacgccugcggagagcuugguucuccuggccccgcgccagcccggcgucuggcgcuuccagcaucaaaccugaggccucucagaugcccccucccgccgggggaaccuccgacgaucccgaaccuagcggcccgcaccuuccccgggugaugcugccugggguccucgcuggaguguccgccgaggaaagcugggcuggcccccaaccucuggagacacucgacaccuga

SEQ ID NO: 75296 - RNA, 1950 nt, Artificial Sequence
  derived and/or modified sequence opt5 from SCNN1G__Homo_sapiens__NP_001030
auggcccccggcgagaagaucaaagcuaagauuaaaaagaaccugccugugaccgggccgcaggcccccacaaucaaagaacucaugagaugguacugccugaauacgaacacccacggaugucggcgcauugucguuagcagaggccggcuucgcagacugcucuggaucggguucacacugaccgcgguggcucuuauucuguggcaaugcgcccuccugguguuuuccuucuauacagucucugugagcaucaagguucauuuucggaagcuggacuucccugccgugaccaucuguaauauuaaccccuacaaauauuccacaguccgccaccuccuggcugaucuugagcaggaaaccagagaggcccugaagucucucuacggauuuccugaaagccggaaacgcagagaggcugaguccuggaacucugugagcgaaggcaagcagccccgguucucccaucgcaucccucugcuuauuuuugaccaggaugagaaagggaaggccagagacuucuuuacgggacggaagcgcaaaguuggcggcagcaucauucacaaggcgucuaaugugaugcauaucgaauccaaacaagucgugggguuccagcugugcagcaaugauaccucugacugugccacauauaccuuuuccagcggaauuaacgcuauccaggagugguacaagcuccacuauaugaauaucauggcccaggugccgcuggagaaaaagauuaacaugucuuacuccgcugaagaacugcucgucacaugcuucuuugauggcguuagcugugacgccagaaauuucacccuguuccaccaucccaugcacgggaacugcuacacguuuaauaaccgggaaaaugagacaauccuuuccaccucuaugggaggcagcgaauaugggcugcaagugauucucuacaucaacgaggaggaauauaacccuuuccugguguccagcacaggagcgaaagucauuauccauagacaggaugaguaccccuuuguggaagacguuggcaccgagaucgaaaccgccauggugacaucuauuggcaugcaccuuacggaguccuucaagcugagcgagccuuauucucaguguaccgaagaugggagcgacguccccauccgcaauauuuacaacgcugccuauucccuccagaucugccugcacucuuguuuucaaacaaagaugguggagaaaugcggaugcgcucaguacagccagccgcugccucccgccgccaauuacuguaacuaucaacagcauccuaauuggauguacugcuauuaccagcuccaccgggcuuucguucaggaggagcugggcugucaauccgugugcaaggaagcguguagcuuuaaagaguggacccuuacaaccucucuggcccaguggcccuccgucgugagcgagaaguggcuccugcccguccuuacgugggaucaggggagacaggugaacaaaaagcugaauaagacagaccucgcuaaacugcugauuuucuauaaggaccucaaccaacgcucuaucauggaauccccugccaauagcaucgagaugcugcuuuccaacuuuggaggccagcuggggcucuggaugucuugcagcguugugugugucauugaaaucauugagguguucuuuaucgauuucuuuuccauuaucgcccggagacaguggcagaaagcuaaggaguggugggccuggaaacaagcgccgcccugcccugaagcuccccgcucuccucagggacaggacaaucccgcccuggauauugacgaugaccugccgaccuucaacagcgcccuucaucucccucccgcucugggcacccagguuccuggcacacccccucccaaguacaauacccugcggcucgagagagccuucuccaaccaacugacagauacgcagaugcuugacgaacuguga

SEQ ID NO: 75297 - RNA, 906 nt, Artificial Sequence
  derived and/or modified sequence opt5 from SCO1__Homo_sapiens__NP_004580
auggccaugcuggugcucguccccggcagaguuaugcggccucuugggggacagcuguggcgcuuccugccgagaggccucgaguuuugggggcccgcugaaggaaccgcccgggugcugcuucgccaauucugcgcgagacaggcugaggccuggcgggccagcggccgcccuggguacugucugggaacaagaccccucuccacggcucggccucccccuccguggucucagaagggccccggcgacagcacccgcccuuccaaacccgggccugugucuuggaaaagccuggccaucacauuugcuauuggaggcgcccugcucgcggggaugaaacacgucaagaaagaaaaggccgagaagcuggaaaaagagagacagcggcauaucggaaagccccuucugggcgggccguucucccucaccacacacaccggagagcgcaaaacagauaaggacuaucugggccaauggcuucugauuuacuuuggcuucacccauugcccugaugugugucccgaggaacucgaaaagaugauccagguuguggacgagauugauucuaucacgacccugccugaccugacaccccucuuuaucagcauugaucccgagagagacaccaaggaagcuaucgccaacuaugucaaggaguucuccccuaaacugguggggcuuacaggaacccgggaagagguugaucagguggcucgcgccuacagagucuauuacagcccgggccccaaggacgaagaugaggacuauauuguggaucacacgaucauuauguaccugaucgggccugacggagaguuucucgacuacuucggccagaauaaacggaagggggaaauugcggccucuaucgcuacacauaugagacccuaucgcaaaaaguccuga

SEQ ID NO: 75298 - RNA, 801 nt, Artificial Sequence
  derived and/or modified sequence opt5 from SCO2__Homo_sapiens__NP_001162582
augcugcuccugaccagaagccccacagccuggcaccggcuuucccagcugaagccucgcgugcucccgggcacgcuugggggacaagcucugcaucugagaucuuggcuccugagccggcagggccccgccgagaccgggggacagggccagccucaagggcccggacugcgcacaagacuccugaucaccggccuuuucggcgcggggcugggaggcgcuuggcucgcccugcgggccgaaaaagagcgccuucagcagcagaagagaacagaagcucugcggcaagccgcugucgggcagggagacuuucaccuccuggaucaucgcggcagagcccggugcaaagcggacuuccgcgggcaguggguucugauguacuuuggauucacccacuguccugauauuugccccgacgagcucgaaaagcugguccagguggugagacaacuugaggccgagccuggccugccgcccgugcagccuguuuuuaucacaguggaucccgaacgggacgaugucgaggcuauggcccgcuaugugcaggacuuccauccuagacuccugggccuuaccggguccacgaaacaaguugcucaggccucucacagcuaccggguguauuacaacgcgggacccaaggaugaagaccaggauuauauugucgaccacuccaucgccauuuaccugcucaauccggauggccuguuuaccgacuauuacgggagaucucgcagcgcugagcagaucuccgacagcgugcggagacauauggccgcuuuccgcucugugcuguccuga

SEQ ID NO: 75299 - RNA, 471 nt, Artificial Sequence
  derived and/or modified sequence opt5 from SCP2D1__Homo_sapiens__NP_848578
auguggaagagaagcgaccaccagcccaaaaucaaggccgaggauggcccucugguggggcaauucgaaguccucggauccguuccggagcccgcuaugccucauccccuggaacuuucugaguuugagagcuucccuguguuucaggacauucggcugcacauccgcgaagugggcgcccagcucgucaaaaaggugaacgcgguuuuccagcuggauauuaccaaaaaugggaagacaauccuuagauggacgauugaccugaagaacggauccggcgauauguaccccgggccugcucggcucccggccgacaccguguuuacaauccccgagucugucuucauggaacuggugcugggaaaaaugaauccucaaaaggccuuucucgcuggcaaauucaagguuagcggcaaagugcugcuuuccuggaagcuggagcgcgucuuuaaggauugggccaaauucuga

SEQ ID NO: 75300 - RNA, 1359 nt, Artificial Sequence
  derived and/or modified sequence opt5 from SCPEP1__Homo_sapiens__NP_067639
auggagcuggcccucagacggagccccgugccucgcuggcugcuucugcucccgcugcuucugggccucaacgcuggggccgucaucgacuggcccaccgaagagggaaaggaaguuugggauuacgugacagugagaaaagacgcguauauguucugguggcuguacuaugcuaccaauuccugcaagaacuuuucugagcugccucucgucauguggcugcagggcgggcccggaggcagcuccacgggguucggaaauuuugaagagauuggcccucuugauucugaccugaaaccccggaagacaaccuggcuccaagccgccagccugcuuuucguggauaacccuguuggcacaggguuuuccuacgugaauggaucuggcgcuuaugccaaagaccuggcuauggucgccagcgauaugauggugcuccugaagaccuucuuuuccugucacaaggaguuccagacaguuccguuuuacaucuucagcgaaucuuaugggggaaaaauggcggccggcauugggcuggagcucuacaaggcuauccagcgcggaaccauuaaaugcaacuuugccggcguggcucugggcgacuccuggaucagccccgucgauucugugcuuuccugggggccuuaccuguauagcaugucucuccuggaagacaagggacuugccgagguguccaaagucgcggagcagguucugaaugccgugaacaagggccucuacagagaagcuacggagcugugggggaaggccgaaaugaucauugagcaaaauaccgauggagugaacuucuauaauauccugacaaaaagcacccccacauccaccauggaaucuagccucgaguuuacgcagucccaucuggucugucuuugccagcggcacgugcgccaucugcagagagacgcucucagccaacugaugaacggcccuauucggaagaaacuuaagaucauucccgaggaucagucuuggggagggcaggccacaaauguuuucgugaacauggaagaggacuucaugaaaccggucaucuccauuguggacgaacugcucgaggccggcaucaauguuaccguguacaacggccagcuggaucugaucgucgacacaauggggcaagaggcuugggugcgcaagcucaaauggccugaacugcccaaguuuagccagcuuaaguggaaagcgcuguauucugauccuaagagccucgagaccuccgccuucgucaaaucuuacaagaaccuggcuuuuuauuggauucugaaagccggacacauggugcccagcgaccagggcgauauggcccuuaagaugaugagacucguuacccaacaggaauga

SEQ ID NO: 75301 - RNA, 4893 nt, Artificial Sequence
  derived and/or modified sequence opt5 from SCRIB__Homo_sapiens__NP_056171
augcugaagugcaucccccucuggagauguaaccggcacguggagagcgucgacaaacgccauugcucccugcaggccguuccugaagagauuuacagauauucucggagccuugaggaacugcuccuggaugcuaaucaacuucgcgaacugccgaagcccuucuuuagacuccugaaccugcggaaacucggccuguccgacaaugagauccagcgccuuccucccgagguggccaacuucaugcagcugguggaacucgaugucucuagaaaugacauuccugagauccccgaaagcauuaaguuuuguaaagcgcuggagaucgcugauuucuccgggaacccucuuucucggcugccggacggauuuacccagcuccgcagccuggcccaccuggcccucaaugaugugucccugcaagcccuucccggcgacguugggaaccuggcuaaucucgugacacuggagcuuagagaaaaccugcucaagagccugccugcuucucuguccuuccucgucaagcuggagcagcuugaucugggaggcaaugaccucgaagugcugcccgauacgcuuggggcccugccuaaccuccgggagcuguggcuggaccgcaaucagcucagcgcgcugcccccggaacuuggaaaccugagacggcucguuugccuggaugugucugagaaucgccuggaggaacuuccugccgagcucggcggccugguccugcucaccgaccugcuucugucccagaaccuccugagacggcugcccgacgggaucggacaacuuaaacagcucagcauucugaagguggaucagaacagacugugugaagugacagaggcuaucggcgacugcgaaaaucucucugagcugauucuuaccgagaaccugcucauggcccugccucgcucccuggggaaacuuacaaagcucaccaaucugaacgucgaucggaaucaucuggaagcucucccucccgagaucggaggcuguguugcccugagcgugcuuucccugagagacaaccgccucgcggugcugcccccggaacuggcccacacaaccgagcuucauguccucgauguggcugggaaucggcugcagucucugcccuuugcccucacgcaccugaaccuuaaagcucuguggcucgccgaaaaucaagcccagccuaugcugagauuccagaccgaggacgaugcucgcacaggagagaagguucugaccugcuaccuucugccccaacagccucccccgagccucgaagacgcgggccagcagggcucccugagcgagacauggucugaugccccucccucccgggugagcgucauucaauuucucgaagcuccuaucggggacgaggaugccgaggaagccgcugccgagaagagaggacugcagcgccgggcgacgccccacccuucugaacuuaaagugaugaagagaagcauugagggccgccgguccgaggcuugucccugccagccggacucugggagcccucugcccgccgaagaggagaaaagacucuccgccgaaagcggacugucugaagacucccggcccagcgcuucuaccguuuccgaggccgaaccugagggcccgagcgcugaggcccaagggggaucccagcaggaagcgacaaccgccggcggcgaggaagaugcugaggaagacuaucaggagcccacagugcauuucgccgaggaugcucugcuuccuggggacgaucgcgaaaucgaggaaggacagcccgaggccccuuggacccugcccggcgggagacaacggcucaucagaaaggacaccccucacuacaaaaagcauuuuaaaauuucuaagcugccccagccggaggcggucguggcccuccugcagggaaugcagccugauggcgaagggcccgucgcuccuggcggauggcacaacggcccccacgccccgugggcuccucgcgcccaaaaggaggaagaggaagaggaggaagggagcccccaggaggaagaggaagaggaggaagaggaaaaucgggccgaggaagaggaggcuuccacagaagaggaagacaaagagggagcggugguuucugccccuagcgugaagggcgucuccuucgaucaggcuaacaaucuucugaucgagcccgccagaauugaagaggaggaacucacgcugaccauccugcgccaaacagggggacuuggcauuagcaucgccgggggcaaaggaucuacccccuauaagggcgacgaugaagggaucuuuauuuccagagugagcgaggagggaccugcugcccgggcgggcguucgcgugggggacaaacugcucgaagucaacggaguggcucugcagggcgccgagcaucacgaagccguggaggcucucagaggggccggcacagcgguucagaugcgggucuggcgcgaaagaaugguggagccggagaaugcugugaccaucacgccccugcggccugaagaugacuacucuccccgcgagagacggggaggcgggcuucgccugccucugcugcccccugaauccccgggaccccucagacagcggcaugucgccugucuugccagaagcgagcgcggccugggguucucuauugcuggaggcaaggggagcacaccuuaucgggccggcgacgcuggaaucuucguguccagaauugccgaaggcggggcggcccaccgcgcuggaacccuccaaguuggcgaucgggugcugagcaucaacggggucgacgugaccgaggccagacaugaucacgcuguuucucuccugacagccgccucccccaccaucgcgcuucugcuggagcgcgaagcuggaggcccucugcccccgagcccucucccccacuccucucccccuacagccgcuguggccacgaccagcauuacaaccgccacacccggcgucccugggcuuccgucccuggcucccucucuccuggccgcggcucucgagggaccuuaccccguggaagagauccggcugccuagagccggcgggccccuuggacugagcauuguuggcggguccgaccauucuagccacccguuuggagugcaggagccuggcgucuucaucuccaaggugcugccccgcggccucgccgcucggagcgggcugagagugggagaucggauucuugccgucaacggccaggacguucgcgaugcgacccaucaggaagcugugucugcccugcucagaccuugccuggagcucucccugcuugugcggcgcgaccccgccccucccgggcugagagaacugugcauccaaaaagcuccgggagagcggcucggcauuagcaucagagggggagcccgcggccacgcuggcaauccucgggaucccacggacgaagggaucuuuauuucuaaggucucccccaccggagccgcgggcagagaugggcgccugcgggugggacuuagacugcucgagguuaaccagcagagccugcugggccucacacacggggaggccgugcagcuucugcgcucugucggagacacccugacagugcucguuugugauggcuucgaggcuuccaccgacgccgcucuggaagugagcccuggcgucaucgccaauccguuugccgcugggauuggacaucggaacucccuugaaagcaucucuagcauugacagagagcugucccccgaaggcccugggaaagagaaggagcuccccggacaaacgcugcacuggggcccugaagcgacagaggccgcugggcgcggacugcagccccucaaacuugauuacagagcccuggccgcugugccuucugccggcagcguucagcgggugccguccggcgcggcugggggaaagauggccgaaucucccugcagcccuuccggccaacagcccccuucucccccgagcccugacgagcugcccgccaaugucaagcaggcuuaucgcgccuucgcggccgugcccaccucccauccucccgaagaugcuccugcccagccgcccacaccugggcccgcugccagcccugagcaacucucuuuuagagagcggcagaaauacuucgaacuggaggugcgcgucccccaggcugaaggaccgccuaagagaguuucccuugugggcgccgacgaucugcggaaaaugcaggaggaggaagcgagaaagcuccaacagaaacgcgcccagaugcugcgggaggcugccgaagcuggggccgaggccagacuggcucucgacggagaaacccuuggcgaggaggaacaggaggaugaacaacccccuugggcgagccccucuccuaccucccgccagagccccgccuccccgccuccccugggcgggggagcucccgugcggacagccaaggccgagagacggcaccaggaacgccugagaguccagucuccugagccgcccgcuccugagcgggcccucagccccgcggaacugcgcgcccuugaggcugaaaagagagcccuguggcgggcugcccgcaugaaaucccucgagcaagacgcgcugagagcccagauggugcugagccggucucaggaaggccgcgggacgagaggaccucucgagcggcuugcugaggcccccuccccugcucccaccccgagcccuacacccguugaagaucugggcccucaaaccucuacaagccccgggagacuguccccggacuuugccgaggaacuccgcucucuggagccuagccccucccccggaccucaggaggaagauggcgagguggcucuuguccugcucggccggcccucuccuggggccgugggaccggaagacguugcgcuguguagcuccagacgccccgugcggccuggcagacgcgggcugggacccgucccuagcuga

SEQ ID NO: 75302 - RNA, 1305 nt, Artificial Sequence
  derived and/or modified sequence opt5 from SCRN1__Homo_sapiens__NP_001138986
auggugcaggacggcaccuucaagacaagagauagcacguggaccugcgaguccacacggauggccgcugcgcccccuucuuacuguuuugucgccuucccgccccgcgcuaaagacgggcugguuguguuuggaaagaacagcgccagaccucgggaugaagugcaagaggucguguauuucuccgccgcugaccacgaacccgagucuaaaguugaaugcaccuacaucagcauugaucaggugccucgcacauaugccaucaugauuuccagacccgcuuggcucuggggcgccgagaugggggcgaaugagcauggagucuguaucgccaacgaagcuauuaauacccgggagccugccgcugaaaucgaggcccugcuuggcauggaccuggugcgccucgggcuggagagaggagaaacagcgaaggaggcccuugauguuaucgugucucugcucgaagaacacggccagggcgggaacuacuuugaagacgcuaauagcugccauuccuuccagagcgccuaucugauugucgaucgggacgaggcuugggugcuggagaccaucggaaaauacugggccgccgaaaaggugacggagggcguccgcuguauuugcucucaacucucccugaccacaaagauggaugcugaacacccggagcuuagaagcuaugcgcagucucaggggugguggaccggagaaggcgaguuuaacuucuccgagguuuuuagccccguggaagaccaucuggauuguggggccggaaaagacucucucgagaagcaggaagaguccaucacagugcaaaccaugaugaauacgcugcgggacaaagcuagcggcgucugcauugauuccgaguucuuucuuacaaccgccucuggcgugagcguucugccucagaaccgcuccagccccuguauccacuacuucacagggaccccugaccccucuagauccauuuuuaagccguucaucuucguggaugacgucaaacucgugccuaagacccagagccccugcuuuggagaugacgauccugccaagaaagagccccgguuccaggagaagcccgaccgcagacacgaacuguacaaagcucaugagugggcccgggcgaucauugaaucugaucaagagcagggcagaaagcugcgcagcacaaugcucgagcuggaaaaacaggggcuugaggcuauggaagagauccugacguccucugaaccucucgacccggccgagguuggagaucuguuuuaugacuguguggacaccgagauuaaguucuuuaaauga

SEQ ID NO: 75303 - RNA, 366 nt, Artificial Sequence
  derived and/or modified sequence opt5 from SCT__Homo_sapiens__XP_011518583
auggcccccagaccucugcuccugcuucugcuccugcuuggcgggagcgcugcccggccggcgcccccucgcgcuagacggcacuccgacggaaccuucacaucugagcugagccgccucagagaaggcgcccggcugcagcgccugcuccaagggcuggugggaaagagauccgagcaggaugccgaaaacucuauggcuuggacgcggcuuagcgccggccugcucugccccuccgggucuaauaugccuauccugcaggcuuggaugccccuugacggaaccuggagcccuuggcugccgcccggcccuauggucuccgagcccgccggcgcggccgcugaagggacacuccgcccuagauga

SEQ ID NO: 75304 - RNA, 1323 nt, Artificial Sequence
  derived and/or modified sequence opt5 from SCTR__Homo_sapiens__NP_002971
augagaccccaccugagcccuccgcuccagcaacugcuucugcccgugcuccuggccugcgcugcccauuccaccggcgcgcuuccucggcugugugacguccuccagguucugugggaggaacaggaucagugccugcaagagcucucucgcgaacagacaggggaccugggaacggagcagcccgugccuggcugugaagggaugugggauaacaucagcugcuggcccuccucugugccuggaagaauggucgagguggaguguccgcgguuccuucgcaugcugaccagcagaaauggcucccucuuucggaacugcacacaggacggguggucugaaaccuucccccgcccuaaucuggcuuguggaguuaacgugaaugauagcuccaacgagaagagacacagcuaccuucugaaacucaaggucauguauacagugggcuacucuuccagccugguuaugcugcucguggcccugggcauucuuugcgccuuucggcgccugcauuguaccagaaauuauauccacaugcaucucuucgucucuuuuauucugcgggcucuuuccaacuucaucaaagacgccgugcuguuuagcucugaugacgugacauacugcgaugcucaccgcgccggguguaagcucgucaugguucuguuccaauauugcauuauggcgaauuacuccuggcugcucguggaaggacuguaucuucacacccugcucgccaucagcuuuuucuccgagagaaaauaccugcagggcuuuguggcuuucggguggggaucucccgccaucuuugucgcucuuugggccauugcgcggcauuuccuggaggacgugggcugcugggauaucaacgccaaugcuagcauuugguggaucauucgcgggccuguuauccucuccauucugaucaacuucauccuguuuauuaauauccuccggauucugaugagaaaacuuagaacgcaggaaacccgcggaaacgaggugagccacuacaagcggcuggccagaucuacacuccugcugaucccccuuuucggcauucauuauaucgucuuugcuuucuccccggaagacgccauggagauccagcucuuuuucgaacuggcccugggcagcuuucaagggcucgugguugcugugcuguacuguuuccuuaauggagagguccagcuggaggugcagaagaaguggcaacaguggcaccuccgcgaauuuccucugcaccccgucgcgucuuucagcaacuccaccaaagccucucaucuggagcagagccagggcacaugccggaccuccauuaucuga

SEQ ID NO: 75305 - RNA, 2967 nt, Artificial Sequence
  derived and/or modified sequence opt5 from SCUBE1__Homo_sapiens__NP_766638
augggcgccgcugccgugagauggcaccugugcguccuccuggcgcuugggacccggggacgccuggcuggcgggagcggacuccccggcuccguugacguggaugaguguucugaagggacagacgauugccauaucgacgccauuugucagaacacgccuaagagcuacaaaugccuguguaagccgggauauaaaggcgagggcaagcaaugcgaagauaucgacgagugugaaaaugauuacuauaacgggggaugcgugcacgaguguauuaauauccccggcaacuacagaugcaccuguuucgacggguuuaugcuugcccaugauggacacaauugccuggacgucgaugagugccaggacaacaauggcgggugucagcagauuugcgugaacgcuaugggauccuaugaaugucaaugccauucuggcuucuuucucagcgauaaucagcacacauguauccaccgguccaacgagggcaugaauugcaugaacaaagaccaugggugugcccacaucugccgcgaaaccccuaagggaggcguugcuugugacugcagacccggguucgaucuggcccagaaucagaaggacuguacacugaccugcaacuacggaaauggcgggugccaacauucuugugaggauacagacaccggaccuacgugcggcugucaccagaaauaugcgcuccacagcgauggccggaccugcauugagacaugugccgugaacaacgggggaugcgaccgcaccuguaaggauacagcuaccggcgucagaugcuccugucccgugggguuuacgcugcagccugacggaaaaacaugcaaggauaucaaugaaugucuuguuaacaauggcgggugcgaccauuucugccggaacaccgugggcagcuuugaguguggaugccgcaaaggcuacaagcugcucacagaugaaagaaccugucaggacauugacgagugcucuuucgaacggaccugugaucacaucugcauuaauuccccggggagcuuucaaugucugugccaucgcggauacauccuuuauggcacaacgcacuguggggacgucgaugagugcucuauguccaacggaagcugugaccagggcugcgugaauaccaaggggucuuacgagugcgugugucccccuggcagacggcugcauuggaacggaaaagauugcgucgaaacaggcaagugucucucccgcgccaaaaccagccccagagcucagcuguccugcucuaaggccgggggaguugagagcuguuuccuguccugcccugcgcacacacucuuugugcccgacagcgaaaauucuuaugugcuguccuguggcgucccggggccucaaggaaaagcccuucagaagcggaacggcaccagcucugggcugggccccagcugcuccgaugcuccuacgacacccauuaaacagaaggccagauucaagauccgcgacgcuaaaugucaccuccggccccauucucaggccagagccaaggagaccgcucgccaaccucugcuugaucacugccaugugaccuuuguuacacugaaaugugacagcuccaagaaacggagacgcggacggaaguccccgucuaaggaagugucccacaucaccgcggaguucgagauugaaacaaaaauggaggaagccagcgauacgugcgaggcugacugccucagaaagcgcgccgaacagucucugcaggccgcuaucaaaacccugcggaaguccauuggcagacagcaauucuacguccaggugagcgggacagaguaugagguugcccagcgccccgcgaaagcucucgaaggacagggcgccuguggggccggacaagugcugcaggauuccaagugcgucgcuuguggcccugggacccacuuuggcggagagcuuggccagugcgugucuuguaugcccgggacauaccaggacauggaaggacaacugagcugcaccccuugucccuccucugacggccucgggcugccgggagcccggaaugucagcgagugcggcggccaguguuccccuggguucuuuagcgcugauggauucaagcccugccaggccuguccugugggcacguaucaacccgagccugggagaaccggaugcuuucccugcggcgggggacuucugacaaaacaugaaggcaccacaucuuuccaggacugugaggcgaagguucacugcuccccgggccaucacuacaacaccacgacacaucgguguauccgcugcccuguggggaccuaccagcccgaauuuggacagaaucacuguauuacaugccccggcaacaccagcaccgauuucgacgggucuacaaaugucacgcacuguaaaaaccaacauugcggaggcgagcucggggauuauaccggauacaucgaauccccuaacuauccgggcgacuaccccgccaaugcugaguguguguggcacaucgccccucccccuaagagacggauucugaucguugugcccgagauuuuucugccuaucgaagaugagugcggcgacguccucgugaugagaaaaagcgcuucucccacaagcauuaccacauaugaaaccugucagacguacgagcgcccgaucgccuucacaucccggagcagaaagcuguggauccaguuuaagucuaacgaagggaauagcggaaaaggcuuccaggugccuuauguuaccuacgaugaggacuaccaacagcuuauugaggauaucguccgcgacgggagacuguaugcgagcgaaaaccaucaggagauucucaaggauaaaaagcugaucaaagcccuguuugacgugcuugcucacccccagaauuacuucaaguauaccgcccaagaauccaaagagauguucccucggucuuuuauuaagcuccugcgcagcaagguguccagauuccugcggcccuacaaauga

SEQ ID NO: 75306 - RNA, 2424 nt, Artificial Sequence
  derived and/or modified sequence opt5 from SCUBE2__Homo_sapiens__NP_001164161
augggcguggccgggagaaaccggcccggagcugccugggcgguccugcuccugcuucugcuccugccuccgcuucugcuccuggcuggcgccguucccccugggcgcggcagagccgcuggaccccaggaggacguggaugaaugcgcccaagggcuggacgauugucacgcugacgcccucugccagaauaccccuacaagcuacaaguguuccugcaaacccggauaucagggcgagggccggcagugugaagauaucgacgagugcgggaacgaacugaauggaggcugugugcaugauugccuuaacauuccugggaauuaccgcuguacgugcuucgacggauuuaugcuggcgcacgauggccauaacugucucgacgucgaugagugccuggagaauaacgggggaugccaacacaccugugugaauguuaugggcucuuaugaaugcuguugcaaggagggcuucuuucuuagcgacaaccagcauacauguauccacagauccgaagaggggcugucuugcaugaauaaagaucacggauguagccauauuugcaaggaggccccgcggggcuccguggcuugugaaugccgccccggguucgagcucgccaaaaaccagagagacuguauccugaccugcaaucacggaaacggcgggugccagcauucuugugacgauacagcugacggaccugaaugcagcugucacccccaauacaagaugcacaccgauggccgguccugccuggagcgcgaagacacaguccucgaggugaccgagagcaauacgaccucuguuguggauggcgacaagagagucaaacggcgccugcuuauggaaacaugugccgugaacaacgggggaugcgauagaaccuguaaggacacauccaccggcgugcauugcagcuguccugucggguuuacgcugcagcucgauggaaaaacaugcaaggacauugaugagugucagacccggaauggcgggugcgaccacuucugcaaaaacaucguuggcucuuuugacuguggaugcaagaagggcuucaaacugcuuacagaugaaaaguccugucaggacguggaugagugcagccuggaccgcaccugugaucauucuugcaucaaucaccccgggaccuuugcgugugccugcaacagaggauauacacucuacggcuucacgcauuguggggacaccaaugaaugcuccauuaacaauggaggcugucaacaggugugcgucaacacaguggggagcuaugagugccagugucacccgggcuacaaacugcacuggaauaagaaagauugcguugcuuccugugaccugucuugcaucgugaagcggaccgagaaaagacuccgcaaggccauucggacacugagaaaggcuguccaucgcgaacaauuucaccuucagcugagcggaaugaaccucgauguggccaaaaagccuccccggaccuccgagagacaggccgaaagcuguggcguugggcagggacaugcugagaaucaaugcgugucuugucgcgcgggcacguacuaugacggggcccgggaaagaugcauccuguguccuaacggaacauuccagaaugaggagggccagaugaccugcgaacccuguccccgcccugggaacuccggcgcucuuaaaaccccggaggccuggaauaugagcgaaugcggaggccugugccagcccggggaguacucugccgauggauuugcuccuugucaacucugcgcccugggcacauuccagcccgaggcggggcggaccagcuguuucccuugcggaggcgggcuggcuacaaagcaccagggcgccacguccuuucaggacugugaaaccagaguccaaugcucucccggacacuucuauaacacaaccacacaucgcuguauucggugcccggugggcaccuaccagccugaguuugggaaaaacaauugugucagcugccccggaaacacgaccacagauuucgacggcuccaccaauaucacacaguguaagaccagcucuaacuccgugacgacauaugaaaccugccagacauacgagagaccuauugccuuuaccagccggucuaagaaacucuggauccaauucaaguccaaugaagggaacagcgcucgcggauuucagguucccuaugugaccuacgacgaggauuaccaggagcugaucgaagacauugucagagauggccggcuuuaugccuccgagaaucaccaagaaauccugaaagacaagaaacucauuaaggcucuguucgaugugcuggcccauccucagaacuacuuuaaguauacagcgcaggagucuagagaaauguucccccgcagcuuuauccggcuucucagauccaaaguuucucgcuuccugagaccguacaaguga

SEQ ID NO: 75307 - RNA, 2982 nt, Artificial Sequence
  derived and/or modified sequence opt5 from SCUBE3__Homo_sapiens__NP_689966
augggcagcgggagagugcccggacugugccuccugguccuucugguucacgcccgggcugcccaguacuccaaggcggcucaagacguggaugaguguguggaaggcaccgacaacugccauaucgaugccauuugucagaauacaccucgcucuuauaaaugcaucuguaagagcggguacacgggagacggcaaacacugcaaggaugucgacgagugugaaagagaggauaacgccgggugcgugcaugacuguguuaauauuccgggaaacuaucggugcaccuguuacgauggcuuccaccucgcucaugacggccacaauugccuggauguggacgaaugcgccgaggggaacggaggcugucagcaguccugcgucaauaugauggggucuuaugagugucacugccgcgaaggauuuuuccuuagcgauaaccaacauacauguauccagagacccgaggaaggcaugaauugcaugaacaaaaaucacgggugugcucauauuugccgggagaccccuaagggaggcaucgccugugagugccgccccggcuuugaacugacaaagaaccagagagacuguaaacugaccugcaauuacgggaacggaggcugccagcacacaugugacgauaccgagcaagggccucggugcggaugucacaucaaguucgugcuccauacggacggcaaaaccugcauugaaacaugugcgguuaauaacgggggaugcgauuccaagugucacgacgccgcuaccggcgugcauugcacaugucccgucggcuuuaugcugcagccugaucgcaaaaccugcaaggacaucgaugaguguagacucaacaaugggggaugcgaccacauuugccggaacacggugggcucuuucgaauguagcugcaagaaaggguauaagcugcuuaucaaugagcgcaacugucaggauauugacgagugcuccuuugauagaacaugugaccauaucugcgugaauaccccgggcagcuuccagugucugugccaccggggauaccuccuguacgggauuacacacuguggcgacgucgaugaaugcucuaucaaccgcggaggcuguagauuugggugcaucaauacccccggauccuaucaaugcaccuguccugccggccaggggcggcuucauuggaacggaaaagacugcacagagccccugaagugucagggcagcccuggggcuucuaaagccaugcucuccugcaauagaagcggcaagaaagauacgugugcgcugaccugccccucucgcgcccgguuccugccggaauccgagaacggauuuacaguuagcuguggcaccccuucccccagagcugccccugcucgcgccgggcacaauggaaacucuacaaauagcaaccauugccacgaagccgcugugcucuccauuaagcaacgggcgagcuucaagaucaaagacgccaaguguagacugcaccuucgcaauaaaggcaagaccgaggaggcugggcggauuacgggacccggcggggcccccugcucugaaugucaggugacauuuauccaucugaaaugcgauuccagcagaaagggcaagggacgccgggccagaaccccuccgggcaaagaggucacccgccucacacuggaacuugaggcugaagugcgggccgaggagaccacagcgucuugcgggcugcccugucucagacagcggauggaacgcagacugaagggaagccugaaaaugcuccggaaguccauuaaccaggacagauuccugcuucgccuggcuggccucgauuacgagcuggcccacaaaccugggcuuguugccggagaacgggcugagcccauggagucuugcagaccuggccaacaucgcgccgggacgaagugugugagcugcccccagggcaccuauuaccacggacagacagaacagugugucccgugcccugcuggcaccuuccaagagagagaagggcagcuguccugugaccucugccccggaagcgaugcccauggcccucugggggcgacaaacgugaccacgugugccggacagugucccccuggccagcacucuguugacggcuuuaagcccugccaaccgugcccucgggggaccuaucagcccgaggcuggacgcacacugugcuuccccuguggcgggggacucaccacaaaacacgaaggcgccaucuccuuucaggauugcgacaccaaggugcaguguagcccugggcauuacuauaauacgucuauccacagaugcauucggugugcuaugggauccuaccaaccggauuuccgccagaacuuuugcagcagaugucccggcaauacauccaccgacuucgacggcucuacaagcgucgcccagugcaaaaaccggcaaugugggggagagcugggcgaguuuaccggguacaucgaauccccuaauuaucccggaaacuacccugcgggcguggagugcauuuggaauaucaaucccccucccaagcgcaaaauucuuaucgucgugccggaaaucuuccugccuucugaggaugaauguggggacguucucgugaugagaaagaacagcucccccagcucuauuaccacauaugagacgugccagaccuacgagcggccuaucgccuuuacagcucgcuccagaaagcuguggauuaacuucaaaaccagcgaagccaauucugcucggggauuucagauccccuaugucacauacgaugaggacuaugaacagcugguggaggauauuguuagagacggccgccuuuacgccuccgaaaaccaucaagagauccucaaggauaaaaagcugauuaaagccuucuuugaggugcuggcucacccgcagaauuacuucaaguauaccgaaaaacauaaggagaugcucccuaagagcuucaucaaacugcuucggucuaaggucagcuccuuucugagacccuacaaauga

SEQ ID NO: 75308 - RNA, 2376 nt, Artificial Sequence
  derived and/or modified sequence opt5 from SCYL1__Homo_sapiens__NP_001041683
augugguucuuugccagagaccccgugcgggauuucccuuuugagcugaucccggaacccccugagggcgggcuccccggaccuugggcucugcaccgcggcagaaagaaagccaccgggagccccgucuccauuuucguuuacgacgugaagccuggagcggaagaacagacacaaguggcuaaagccgccuuuaagcgguucaaaacgcuucgccauccgaacauccuggcuuauauugauggccucgaaaccgagaagugccugcacgucgugacagaggccguuacaccccuugggaucuaccugaaggcuagaguggaagccggaggccucaaagagcuggaaauuucuuggggccugcaucagaucgucaaggcgcucagcuuucuggugaaugacuguucccuuauccacaacaauguuugcauggccgcuguguucgucgaucgggccggggaguggaaacugggaggccucgacuauauguacucugcucaggggaacggaggcgggccuccccgcaaggggauuccugagcuggaacaguaugaucccccggagcuugccgacagcuccggcagaguggugcgggaaaaauggucugcggauauguggcgccugggcugucucaucugggaggucuuuaaugggccucugcccagagccgcugcccugcggaacccuggaaagauucccaagacccucguuccccauuacugcgaacuggugggcgcuaauccuaaagugcgcccgaaccccgccagauuccuucaaaauugucgggccccugggggauuuaugagcaaccgcuucgucgagaccaaucuguuucucgaggaaauccagauuaaggagcccgcugaaaaacagaaguucuuccaggagcuguccaaaagccuugacgcguuuccugaagauuucugcagacacaaggugcugccccaacuccugacagccuuugaguucggcaacgcuggggccguugugcugaccccgcucuuuaaagucggaaaguuccugucugccgaggaauaucagcagaagaucauuccugugguugugaaaauguuuuccagcacggaccgggcuaugagaauccgccuucugcagcaaauggagcaguucauccaguaccucgaugaacccaccgucaauacacaaauuuuuccucacgugguccauggcuuccuggacaccaaccccgccauccgggagcagacagugaagucuaugcuucugcucgcgccuaaacugaaugaagcuaaccugaacguugagcucaugaagcacuuugccagacugcaggccaaagacgagcagggccccauucgcuguaauaccacggugugccuugggaagaucggauccuaccugagcgcuucuacacggcauagaguccucaccuccgccuucagccgcgcuacacgggauccguuugccccuuccagaguggcgggcguucugggguucgccgcuacccacaaccuguauucuaugaaugacugugcccaaaagauucuucccgugcucugcggacugaccgucgaucccgagaaaagcgugcgcgaccaggcuuucaaggccauccgguccuuucugagcaaacucgagucuguguccgaagauccuacacagcuggaggagguugaaaaggacguccacgcggccagcucuccgggcaugggaggcgcugccgcuagcugggccggaugggccgugacgggcguguccucucuuaccagcaaacugaucagaucccaucccacaaccgcuccuacagagaccaacauuccccagcgcccuacgcccgaagggcacugggagacacaagaagaggauaaggacaccgcggaggauagcucuaccgccgaccggugggaugacgaagacuggggaucccucgagcaggaagcugagagcguccuggcccagcaggaugacuggucuacaggcgggcaaguguccagagccagccagguuuccaauucugaucauaagagcuccaaaucuccugaaagcgacugguccagcugggaggcugagggaucuugggaacagggcuggcaggagcccuccagccaagaaccgccucccgaugggacccggcuggccucugaguacaacuggggcggaccugaauccagcgacaagggcgaucccuucgcgacacuuucugcucgcccgagcacgcagccuagacccgacuccuggggagaggauaauugggaggggcucgaaaccgacagcagacaggugaaagccgagcuggcccggaagaaacgcgaggaacggagacgcgagauggaagcuaagagagccgagcggaaggucgcgaaaggcccuaugaagcugggggcucgcaaacucgauuga

SEQ ID NO: 75309 - RNA, 2067 nt, Artificial Sequence
  derived and/or modified sequence opt5 from SCYL3__Homo_sapiens__NP_065156
augggcagcgagaacuccgcccugaagucuuacacccucagagaacccccuuucacacugccgagcgggcuugcuguguaucccgccguccugcaggacggaaaauuugcguccguuuucguguacaagcgggagaaugaagauaaagugaacaaggcugccaaacaccucaagacgcugcgccauccuugccuucugagauuucucucuuguaccgucgaggccgacggcauccaccuggugacagaacggguucaaccccuggagguggcucucgagacccugagcuccgccgaagucugcgcugggauuuaugauauccuucuggcccucauuuuccugcaugaccgcggacaccuuacacauaauaacgugugucugucuagcguuuuuguguccgaggauggccacuggaagcucgggggaauggaaaccgucugcaaagugagccaggcgacaccugaguuccugagaucuauccaguccauucgggaccccgccagcaucccuccggaggaaaugucucccgaguuuaccacgcugccugaaugucacggccaugcucgcgaugccuucuccuuuggcacccucguggagagccugcuuacaauccugaaugaacaggucucugcugacguucucuccagcuuccaacagacccugcacuccacacuucugaaccccauuccuaagugcagacccgcccucuguacccugcugucucaugacuuuuuccggaaugauuuucucgagguggugaacuuccugaaaagccuuacgcugaaguccgaggaagagaaaacagaguucuuuaaguuccuccuggaucgcgucagcugccuuucugaggaacugaucgcguccagacucgugccgcugcugcucaaucagcugguuuuugccgagccuguggcugucaagagcuuccuucccuaccugcucgggccuaaaaaggaccacgcccagggagagacccccugucugcugucucccgcucuuuuucaaagccgggugauuccuguucuccugcagcuguucgaagugcacgaggaacauguccgcauggugcuccugucccacaucgaggccuaugucgaacauuuuacacaggagcagcuuaaaaaggugauucugccgcaaguucuccugggccugagagauaccucugacagcaucguggccauuacccuucacucccucgcuguccuggugagccugcucgggcccgagguuguggucggaggcgaacggacaaaaaucuucaagcgcacggcgccuucuuuuaccaaaaacacagaccugucccuugagggggaucccuucagccagccuaucaaguuucccauuaauggacugucugacgugaagaacaccuccgaagauagcgagaauuucccguccucuagcaaaaaguccgaggaauggccugacuggucugagcccgaagaaccugaaaaccagacagugaauauccaaauuuggcccagagagccuugcgaugacguuaaaagccaguguaccacgcucgaugucgaggaauccagcugggacgauugcgagcccucuucccuggacacaaaggugaacccgggcggcgggaucaccgccaccaaaccugugacaagcggagaacagaagcccauucccgcucugcuuucucucaccgaggaauccaugccuuggaaaagcucucugccgcagaagaucagccugguccaacggggcgaugacgccgaccagaucgagcccccuaagguguccagccaggagagaccccucaaaguuccuucugaacuggggcuuggagaggaauuuacaauucaggugaagaaaaagcccgucaaggauccugagauggacugguucgccgauaugauccccgaaauuaaaccguccgcugccuuccugauccucccugagcugcgcacggagauggugcccaagaaagacgauguuagcccugugaugcaauuuuccucuaaguucgcggcugccgaaauuaccgagggcgaagccgaggggugggaggaagagggagaacugaacugggaggacaauaacugguga

SEQ ID NO: 75310 - RNA, 933 nt, Artificial Sequence
  derived and/or modified sequence opt5 from SDC1__Homo_sapiens__NP_001006947
augagacgggccgcucuguggcucuggcugugcgcccuugcgcugagccuccagcccgcucugccucaaaucguggccaccaaccuuccgcccgaggaccaggauggcuccggggacgauucugacaauuucagcggauccggcgccggggcucugcaggauauuacacucucucagcaaacgccuagcaccuggaaggacacacagcugcugaccgccauccccacauccccugaacccaccggacucgaggcuacagccgcgucuaccagcacgcugccugccggcgaagggccgaaagagggagaagcugucguucuucccgagguggagccuggccugaccgcccgcgaacaggaggcuacacccagaccucgggaaaccacacagcuccccaccacgcaccaagccuccacaaccacagcgaccaccgcccaggagccggcuacaagccauccucaccgcgauaugcagcccggccaucacgagacgucuaccccugccgggcccucccaggcugaccugcauacaccccacaccgaagauggaggcccuagcgccacagagagagccgcugaagacggggcgucuucccaacuuccggccgcugagggaagcggcgaacaggauuuuaccuucgagacgucuggggagaacacagccguggucgccguggaacccgaccggcgcaaucaguccccuguugaucaaggagcuaccggcgccagccagggccugcucgacagaaaggaggugcucgggggagucauugcgggcgggcuggugggacugaucuuugcuguuugucuggugggcuucaugcuuuaccggaugaaaaagaaagacgaaggguccuauucucuggaggaacccaagcaggccaacggaggcgccuaccagaagccuaccaaacaagaggaguuuuaugcuuga

SEQ ID NO: 75311 - RNA, 606 nt, Artificial Sequence
  derived and/or modified sequence opt5 from SDC2__Homo_sapiens__NP_002989
augagacgggccuggauccugcucacccugggccuuguggcuugcgucagcgccgagucccgcgcggaacugacaucugacaaggauauguaccucgacaacagcuccauugaggaggcuucugggguuuaucccaucgaugacgaugacuacgccagcgccuccggaucuggcgcugaugaagacguggaaagcccugagcugacgaccuccagaccgcuucccaaaauucugcucacaagcgccgcuccuaagguggagaccacaacccugaauauccagaacaaaauucccgcccaaacaaagucuccugaagagaccgauaaagaaaagguccaccuguccgacagcgagcggaagauggaucccgcggaggaagacacgaauguguauaccgagaaacauucugauucccucuucaagcgcacagaaguucuggccgcugugaucgccgggggagucaucggcuuucuuuucgcuauuuuucugauccuccugcuuguguacagaaugcggaaaaaggacgaggggagcuaugaccugggagaacgcaaaccuucuuccgccgcguaccagaaggccccgaccaaggaguucuaugcuuga

SEQ ID NO: 75312 - RNA, 1332 nt, Artificial Sequence
  derived and/or modified sequence opt5 from SDC3__Homo_sapiens__XP_011540764
augcccacccagaugcuguucccucuccacggccuguuucuuuacagcuccgugaacucuuauacaagcuccaagacgcaacauagaugccugcuccugugggagucuaauaacgacccgagcuaccagcccccuuccaccgcccagcgguggcgcucugaaaauuucgagagacccgucgaucuugaagggagcggagacgaugacuccuuuccugaugacgagcuggaugaccucuauagcggcucuggguccggauacuucgaacaggagagcggcaucgagacagcuaugcgguuuucucccgauguugcccuggcgguguccaccacacccgcugugcugccgaccacaaacauucaacccgucgggaccccuuucgaagaacuccccagcgaacgcccuacgcuggagcccgccaccucuccgcuugugguuacagaggugccugaagaacccucccagagagccaccacagucagcaccacgauggcuacaaccgccgcuacauccaccggagacccuaccguggccacaguucccgcgacgguggccaccgcuacacccucuaccccugccgcuccgcccuuuacagccaccacggcggucauccggacaaccggcgugcgcagacugcucccucugccccuuaccacaguggccaccgcucgggccacaacgccugaagcucccagcccgccuaccacagccgccguccuggauaccgaggcucccacaccucgccucguuuccaccgcgacgagcagaccccgggcccugccucgccccgcuaccacacaggaaccggacauuccugagagaucuacccugccccucggcacaaccgcccccgggccuacggagguggcccagacaccgacccccgaaacauuccugaccaccauccgggaugagccugaagugcccgucuccggaggcccuagcggggacuuugagcuucccgaagaggagacaacgcaaccugacaccgcuaaugaagugguugccgugggaggcgcggcugccaaagccucuagcccuccggggacacugccuaagggagcucgccccggcccuggccuccuggauaacgccauugacuccgggucuagcgcugcccagcuuccccagaaauccauccuggagagaaaggaaguccucguggcgguuaucgugggaggcgucgugggggcccuguucgcugccuuucuggucacccuccugauuuaucggaugaaaaagaaggaugagggaagcuacacacuugaggagccgaaacaggcuucugugaccuaucaaaagccugacaaacaggaggaguucuacgccuga

SEQ ID NO: 75313 - RNA, 597 nt, Artificial Sequence
  derived and/or modified sequence opt5 from SDC4__Homo_sapiens__NP_002990
auggcccccgcuagacuguucgcccuccugcuuuucuucgugggcggggucgcggagagcauccgggaaaccgagguuauugacccucaggaucugcucgaaggacgcuacuuuuccggcgcucugccggacgaugaggacgugguggggcccggacaagaaucugaugacuucgagcuuagcggcuccggggaucuggacgaucucgaggacucuaugaucggaccugaagucgugcacccccugguuccucuggauaaccauauucccgagagagccggcagcggcucccaggugccuacagaaccgaagaaacucgaggagaaugaagucauccccaagcggauuucuccuguggaggaaagcgaggacguuuccaacaaagugagcaugucuuccacgguccaggggagcaauaucuuugaacgcaccgaggugcuggccgcucuuaucgugggaggcauugucgggauccuguucgccguuuuucucauucugcuucugauguauagaaugaagaaaaaggaugagggaucuuacgaccucggcaagaaacccaucuauaagaaagcuccuacaaacgaauuuuacgccuga

SEQ ID NO: 75314 - RNA, 879 nt, Artificial Sequence
  derived and/or modified sequence opt5 from SDCBP2__Homo_sapiens__NP_001186713
augagcucccuguaccccucucucgaggaccugaagguggaucaggccauccaagcucaggucagagccagcccuaaaaugccggcgcuucccguucaggcuaccgccauuuccccucccccugugcuguaucccaaccucgccgaacuggagaauuacaugggccuuucucugagcucccaggaagugcaagagucucuccugcagaucccugaaggggacagcacagcugucuccggaccgggccccgggcagaugguggccccuguuacgggauauagccugggcgugcggcgcgcugagauuaagcccggggucagagagauccaccucugcaaagaugaacggggaaagaccggccugcgccuuagaaaaguggaccagggccuguucguucaacucgugcaggccaacaccccugcgucucuggucgggcuucgguuuggagaucagcugcuccagauugacggccgcgauugugccgggugguccagccauaaggcucaccaaguggugaagaaagccucuggagacaagaucgucguuguggugagagaucggcccuuccagcgcacagucacaaugcauaaagacuccaugggccacgugggguuuguuaucaagaaaggaaagauugugagccuggucaaggggucuuccgcugccagaaauggccugcucaccaaccauuacgugugcgagguugauggccagaaugugaucggacugaaagacaagaaaauuauggaaauccuugcgacagccggcaacgucgugacccugacgauuaucccgagcgucauuuaugagcacauggugaagaaacucccucccguucugcuucaccauaccauggaucacuccaucccugacgcuuga

SEQ ID NO: 75315 - RNA, 879 nt, Artificial Sequence
  derived and/or modified sequence opt5 from SDCBP__Homo_sapiens__NP_001007069
augagccuguaccccucccucgaggaccugaaggcccagaccgcuuucucugccaacccugcgaauccggcuauccuuagcgaagccuccgcccccauuccucacgauggcaaccuguaucccagacucuacccugagcugucucaauauauggggcuuagccugaaugaagaggaaauccgggcuaacguggccgucguuuccggagcuccccuccagggccagcugguggcccgcccuucuagcauuaauuacaugguggcgccggucacagggaacgacgugggaaucagacgggccgagauuaaacagggcauccgcgagguuauccugugcaaggaucaagacgggaaaauuggacucagacugaaguccaucgauaauggcauuuuugugcagcuuguccaggcuaacagccccgccucucuggugggccuccgguucggggaccagguucugcaaaucaauggagaaaacugugcuggcugguccagcgauaaagcccauaaggugcuuaagcaggcguuuggggagaaaauuacgaugaccauccgcgacagaccuuucgaacggacaauuaccaugcacaaggauucuacaggacaugucggcuuuaucuucaaaaaugggaagaucaccuccauugugaaagacagcucugccgcucgcaacggacugcucacagagcacaauaucugcgagauuaacggccagaaugugaucggccugaaggauucccagauugccgacauccugagcaccuccgggacggucguuaccaucacaauuaugcccgcuuuuaucuucgaacauauuaucaagagaauggccccuucuauuaugaaaagccucauggaucacaccauccccgagguguga

SEQ ID NO: 75316 - RNA, 1308 nt, Artificial Sequence
  derived and/or modified sequence opt5 from SDCCAG3__Homo_sapiens__NP_001034796
augagcggcuaccagagacggcccggggccaccccucugucccgcgcuagaucucucgccaucccggacgcgcccgcuuucuaugagcggcgcagcugccugccucaacuuaacugugaaagaccccacggacgggaucuggacucccccuuuuucggcauucgcccugccuuuaugugcuacgugccuucuccgguccucgccagcguuggggauacagacuucggauauggcaaggggaaauguuccaagcagucucccagcggagcucauggcacgcacuuuggcgaugacagauucgaggaucuggaagaggccaauccuuuuuccuuccgggaauuucuuaaaaccaagaaccuggggcucagcaaagaggaccccgcuucucgcaucuacgccaaggaggcguccagacauagccugggacuggaucacaauucuccucccucccagacaggcggguauggacucgaauaccagcaaccguucuuugaggacccuaccggcgccggggaucugcuugacgaagaggaggaugaagacacaggauggagcggcgcuuaucugcccucugccauugagcagacccauccugaacgggugcccgcuggcacaucccccugcagcaccuaccucuccuucuuuucuacgccuagcgagcuggccgggccggaaucccuucccagcugggcgcugucugacaccgauucccgcgugagcccugccucucccgcuggaagcccuuccgccgacuucgcuguccacggcgagucucucggggauagacaccuucggacacugcagaucagcuacgacgcccucaaggaugagaacuccaaacugcgcagaaagcugaaugaagugcagagcuucucugaggcccaaaccgaaaugguucggacacuggagagaaaacucgaagcuaagaugauuaaagaggaguccgacuaucaugaucuggaaagcgugguccaacagguggagcagaaccuugaacugaugaccaagcgcgcgguuaaggccgagaaucacguggucaaacucaagcaagaaaucucucugcugcaggcucagguguccaacuuucaacgggagaaugaggcccucagauguggacagggcgccagccugacgguggucaaacagaacgcugacguugcccuucagaaucugcgcguggugaugaacuccgcgcaggcuucuaucaagcagcucgucagcggggccgaaacacugaaucuuguggccgagauucugaaauccaucgaucggauuucugaaguuaaggacgaggaggaagauagcuga

SEQ ID NO: 75317 - RNA, 2142 nt, Artificial Sequence
  derived and/or modified sequence opt5 from SDCCAG8__Homo_sapiens__NP_006633
auggccaagagccccgagaacuccacccuggaagagauccucggccaguaccaaagaucucugcgggaacacgcuagccgcuccauucaucagcuuacaugcgcccugaaagagggggacgugacgaucggagaagaugcgccuaaucucucuuucagcaccuccgucggcaacgaggacgcuagaacagccuggccggagcugcagcagucucacgccguuaaucaacuuaaggaucugcuccggcagcaggcugacaaagaaagcgaggugucccccagccgcagacggaagaugucuccucugcgcucccuggaacaugaggagaccaacaugcccacaaugcacgaucucgugcauaccauuaaugaccagagccaauauauccaccaccuggaagccgaggucaaauuuuguaaggaagaacuuucugggaugaagaacaaaauucaggugguugugcuggaaaaugagggacuccagcagcaacugaagucccagagacaggaggaaacacuucgggagcaaacccugcucgaugcuagcggcaacaugcauaauucuuggaucacgaccggggaagacuccggagucggcgagacaagcaaacgcccuuucucccacgauaacgccgacuuuggcaaggcggccucugcuggggaacagcuggagcuggagaaacucaagcugaccuacgaagagaagugcgaaaucgaggaaagccagcuuaaauuccugagaaaugaucucgccgaguaucagcggacaugugaggaccugaaggaacaacuuaaacauaaggaguuucugcucgcugccaauaccugcaaccgcgugggaggccugugucugaaaugcgcgcagcacgaagccguucucucccagacgcacacaaacgugcauaugcagaccauugagagacuggucaaggagcgggaugaccuuaugagcgcucuggugucugugcgcuccagccucgccgacacacaacagagagaggcuucugccuacgagcaggucaaacagguucugcaaaucagcgaagaggccaauuucgaaaagaccaaggcucuuauucagugugaucagcugcggaaagagcucgagagacaggcggaacgccuggagaaggaacuggccucccaacaggagaaacgggcuaucgaaaaggacaugaugaaaaaggagauuaccaaggagagagaauauauggggucuaaaaugcucauccugagccagaacauugcccaacuugaggcccagguggaaaaggugacaaaagagaagaucuccgcuaucaaccagcuggaagagauucagagccaacucgccucucgcgagauggaugucacgaaagugugcggagaaaugcgguaccagcugaauaagaccaacauggagaaggacgaagcggagaaagagcacagagaauuucgcgcuaagacaaaucgggaucuggagaucaaagaccaggaaauugagaaacuuagaaucgaacucgaugaguccaagcagcaucuggagcaagaacagcagaaggccgcccuggcucgcgaggaaugucuccggcugaccgagcuucugggcgaaagcgagcaccagcuccaucugacaagacaagagaaggacucuauucagcaguccuucagcaaagaagccaaggcucaagcccugcaggcgcagcagcgcgagcaagaacuuacccagaaaauccagcagauggaggcccaacacgauaagacggaaaacgagcaguaucuccugcugacaucccagaauaccuuucucaccaaacugaaggaggaaugcuguacacuugcuaaaaagcuggagcagaucucucaaaagacccggagcgaaauugcccagcucucccaggagaaaagauacacauacgacaagcuggggaaacugcagcggcgcaacgaggaacuugaggaacaaugcguucagcacggaagagugcaugagacgaugaagcagcggcucagacaacuggauaaacacucucaggcuaccgcccagcagcugguccaacuccugagcaagcagaaucagcuucugcucgaacgccagucccugagcgaggagguggaccggcugagaacacaacuucccucuaugccucaguccgacugcuga

SEQ ID NO: 75318 - RNA, 636 nt, Artificial Sequence
  derived and/or modified sequence opt5 from SDF2__Homo_sapiens__NP_008854
auggccguggucccccugcuccugcuuggcgggcuguggagcgcuguuggagccuccucucucggcguggugaccugcgggagcgucgugaagcugcuuaacacaagacacaauguucggcugcauucccacgacgugcgcuacggaucuggcagcgggcagcaauccgucacgggagugaccucuguugaugacagcaacuccuauuggagaauccggggcaaaagcgcgacagugugugagcgcggcaccccuauuaagugcgggcagccgaucagacucacacaugucaauaccggacggaaccugcacucucaucacuucacaagcccccuguccggcaaucaggaagugucugcuuuuggggaggaaggagagggcgauuaccucgacgauuggaccgugcuguguaacgggccuuauuggguccgcgacggagaaguuagauucaaacacuccagcacggaggugcuucugucugugaccggcgagcaguacggccggcccauuuccgggcaaaaggaaguccauggaauggcccagccuagccagaauaacuauuggaaagccauggagggcaucuuuaugaagcccuccgaacuccugaaggcugaggcccaccaugcugagcuuuga

SEQ ID NO: 75319 - RNA, 666 nt, Artificial Sequence
  derived and/or modified sequence opt5 from SDF2L1__Homo_sapiens__NP_071327
auguggagcgccggcagagggggagcugccuggcccgugcugcucggccugcuucuggcgcuccuggucccugggggaggcgcugccaagaccggggccgagcuuguuacaugcggauccgugcugaaacuccugaacacgcaccaucgggugcgccugcacucucaugacaucaaguacggcagcggcuccgggcagcaaucugucaccggaguggaagcuagcgaugacgccaauuccuauuggcggauuagaggcgggucugagggaggcuguccgcgcgggagccccguuagaugcggacaggcugugcggcucacacacguccugaccggcaaaaaccuucauacacaccacuucccuagcccccuguccaauaaccaggaagugucugccuuuggcgaggauggggaaggagacgaucucgaccuguggaccguucgcuguuccggccagcauugggagagagaggcggccgugcgguuccaacacgucgggacaagcguguuucuuucugugaccggagaacaguacggcuccccuauccgcgggcagcaugagguccacggaaugcccagcgcuaauacgcacaacaccuggaaggccauggaaggcauuuucaucaaaccuucuguugagccguccgcuggccaugaugagcuguga

SEQ ID NO: 75320 - RNA, 609 nt, Artificial Sequence
  derived and/or modified sequence opt5 from SDF4__Homo_sapiens__XP_011539858
augguguggcccugggucgccauggcuagcagauggggcccucugaucgggcucgccccgugcugucuguggcuucugggagcgguucuccugauggacgcuuccgcccggcccgccaaccacucuagcacccgcgagagaguggcuaaucgggaagagaacgaaauucuuccucccgaucaucugaauggcgugaagcucgagauggacgggcaccugaaccgcggauuccaucaggaagucuuucugggcaaagaucucgggggauucgacgaggaugccgagccuagacggucccgcagaaagcugauggugaucuuuucuaaaguugacgugaauacagaucggaagauuagcgcuaaagaaaugcaacgcuggaucauggagaagacggccgaacacuuccaggaggcgauggaggaauccaagacccauuuuagagccgucgaccccgauggcgacggccacgugucuugggaugaguacaaaguuaaguuccuugcuagcaaagggcacuccgaaaaggagguggccgacgcuauucggcugaacgaggaacucaaagucgaugaggaacgccauggaccuccgggccccagagcccuguga

SEQ ID NO: 75321 - RNA, 348 nt, Artificial Sequence
  derived and/or modified sequence opt5 from SDHAF1__Homo_sapiens__NP_001036096
augagcagacacucccggcugcagcgccaagugcucucucuguacagagaccuucugcgggccggccgcgggaagcccggagcugaggccagaguccgggcggaguuccgccagcaugcuggccucccuagaagcgauguucugcggaucgaauaucuuuaccgcagagggcggcgccagcugcagcuccugagauccggacacgccaccgccaugggcgcuuuugugcggccgcgcgcccccacaggggaaccuggaggcgugggcucucaacccgacgauggggacagcccuagaaacccccaugauuccacgggagcuccugagacccggccggacggcagauga

SEQ ID NO: 75322 - RNA, 501 nt, Artificial Sequence
  derived and/or modified sequence opt5 from SDHAF2__Homo_sapiens__NP_060311
auggccgugagcaccgucuucuccacaucuagccugaugcucgcucuguccagacacucucuucugagcccccuccuguccguuacgucuuuucggcgcuucuacagaggcgacagcccuaccgauucccagaaggacaugaucgagauuccgcuucccccuuggcaagaacggacagaugagagcaucgaaaccaaacgcgccagacugcucuaugagucucggaagcgcgggaugcuggaaaacugcauucugcucucccuguuugcgaaagagcaucuucagcacaugacagagaagcagcugaaucucuacgacagacugaucaacgaacccagcaaugauugggacauuuauuacugggcuaccgaggccaaaccugcccccgaaaucuucgagaacgaggugauggcccuucugcgggauuuugcuaagaauaagaacaaagaacagcgccucagagcuccugaccuggaguaucuguucgaaaagccgcgguga

SEQ ID NO: 75323 - RNA, 327 nt, Artificial Sequence
  derived and/or modified sequence opt5 from SDHAF4__Homo_sapiens__NP_660310
augacccccagcagacugccuuggcuccuguccugggugucugccacagcuuggcgggccgcgcgcagcccgcuucugugccacucccucagaaagacgucuagcucccagggcgggaaaucugagcuggucaagcaaagccuuaaaaagcccaaacugccugaaggacgguucgacgcucccgaggauucccaucucgaaaaggagccucuggaaaaguuucccgacgauguuaacccugugaccaaagagaagggcgggccgcgcggacccgagccuacaagauacggcgacugggaacggaaagggcgcuguaucgauuucuga

SEQ ID NO: 75324 - RNA, 1851 nt, Artificial Sequence
  derived and/or modified sequence opt5 from SDHA__Homo_sapiens__NP_001281261
augagcggcgugagagggcugucccggcuccugucugcccgcagacuugcucuggccaaggcguggcccaccguccuccagacaggaacgcggggcuuccacuuuaccguugacgggaacaaacgcgcuagcgccaagguguccgauucuaucagcgcccaauacccuguggucgaccaugaguucgaugcugugguugugggagccggcggggcuggacugagagccgcguuuggccuuuccgaagccggcuucaauacagcuugcgucaccaaacuguuuccgacacggucucacaccguggccgcucagcucgagaacuaugggaugcccuucagccgcacagaagacggaaagauuuaccagagagccuuuggcgggcagucccugaaauucggaaagggcgggcaagcgcaucgguguugcuguguugccgaucgcaccggacacagccugcuccauacgcuguauggcagaucucuucgguacgacaccuccuauuuuguggaguacuucgcucuggaucuccugauggaaaauggcgagugccgcggggucaucgcccuuuguauugaggacggaagcauccaccggauuagagcuaagaacacagugguggccaccggcggguauggacgcacauacuuuucuugcaccuccgcccacacgagcacaggcgaugggaccgcuaugaucacaagagcgggacugccuugucaggaccucgaguucguccaguuucaucccaccggcaucuacggcgccgggugccugauuaccgaaggaugucggggcgaagggggaauccugauuaauucucagggcgagagauucauggagcgcuaugcuccuguugccaaagaucucgccucccgggacguggugagcagauccaugacacuggaaauccgcgaggggcggggcugcggacccgaaaaggaucacgucuaccuucaacugcaucaccucccuccggagcagcuggcuacgagacuucccggcauuucugaaaccgccaugaucuucgcggggguggacguuacaaaagagccuauucccgugcugccuaccguccacuauaacaugggaggcauccccacaaauuacaagggacaggugcuccgccauguuaacgggcaggaccaaaucgugccgggccuguaugcuuguggggaggccgccugcgcuagcguccacggcgccaaucggcugggagcuaacucccuccuggaucuuguggucuuuggcagagccugcgcgcugagcauugaagagucuugucgcccuggggacaaagugcccccuaucaagcccaaugccggagaagaguccguuaugaaccucgauaagcugcgguucgcugacggcagcauuagaaccucugaacuucgccugagcaugcagaaauccaugcagaaucaugccgcuguguuucgggucgggucugugcuccaagagggaugcggcaagaucagcaaacuguacggggaucugaagcaccucaaaacguucgacagaggcaugguuuggaacacagaucugguggagacccuugaacugcagaaucucaugcugugugcccugcagaccauuuauggagcggaggcccggaaggaaucccgcggcgcucaugccagagaggacuacaaaguccggaucgaugaauacgacuauagcaagcccauccaggggcaacagaagaaaccuuuugaggagcacuggagaaagcacacacuuucuuacguggaugugggaaccggcaaaguuacacucgaauaucgcccggucauugacaagacgcugaacgaggcugacugcgccaccgugcccccugccauccgguccuacuga

SEQ ID NO: 75325 - RNA, 453 nt, Artificial Sequence
  derived and/or modified sequence opt5 from SDHC__Homo_sapiens__NP_001030588
auggccgcucugcuccugagacacgugggccggcauugccuucgcgcccacuucagcccccagcuguguaucagaaacgcggucccucucgggaccacagcuaaggaggaaauggagcgguuuuggaauaaaaacauuggauccaaucgcccgcugucuccccauaucacgauuuacagcuggucccuuccuauggccaugucuaucugccacagaggcaccgggauugcccugagcgcugacguuggaccccggaagcgcccugaagauucccccgccaucccuguguggucuggcuguccggggagcuauugcgugguccucuacggagcuggcucccaugugaaaaagggcgggagccaacaccaucugcccacacacuauuacauccacccuucuuucugucuguccuuucucagccccgccugggagaaauucucucuguuuguuuga

SEQ ID NO: 75326 - RNA, 480 nt, Artificial Sequence
  derived and/or modified sequence opt5 from SDHD__Homo_sapiens__NP_002993
auggccgugcuguggagacucagcgcugucugcggcgcccuugggggacgggcgcugcugcuccgcacccccguugugagaccugcucacaucuccgccuuccugcaggaccggccgauucccgagugguguggcgugcaacauauccaccuuucuccuagccaucacuccgggucuaaggccgcuagccugcauuggacauccgaacgcgucgugucuguucuccugcugggacuccugcccgccgcuuaccuuaacccuugcagcgccauggauuauucccuggcggccgcucucacgcugcacggccacugggggcuuggacagguggucaccgacuacgugcauggcgaugcccugcagaaagcugccaaggcgggccuccuggcccugagcgcucucacauuugccgggcuguguuauuucaauuaccacgacguuggaauuugcaaagcuguggccaugcuuuggaagcuguga

SEQ ID NO: 75327 - RNA, 6642 nt, Artificial Sequence
  derived and/or modified sequence opt5 from SDK1__Homo_sapiens__NP_689957
auggcuagaggcgcucggcccuccgccgcugggggaggcgggggaggcgcggagccuccggaacgcgccgggcccggaagaccucggggcucucccccuggccgcgccagacccucccuggcuccucggccggggcccgagccuagccgccccagagccgcuccugaaaccuccggaggcgacaccgccggggccggacggugcggcgggcgcagagccgcuaagcucggacccggccggcgcggcuggugggcccugcuugcucugcagcuccaucugcuuagagcccuggcgcaagaugacguggccccguacuucaaaacggagccugggcucccccagauccaccuggaaggaaaccggcuggugcucaccugucuggcugagggcucuuggccucuugaguuuaaguggaugcgcgaugacagcgaacugacaaccuauuccucugaguacaaauauauuauccccagccuccagaagcuggaugccggguucuacagaugcguugugcggaauagaaugggagcccuucugcagcgcaaauccgaagugcaagucgccuauaugggcagcuuuauggacacagaucagcggaagaccgugucucaggggagagccgcuauucucaaccugcugcccaucacauccuacccucgcccgcagguuaccugguuccgggagggacacaagauuauccccagcaauagaaucgcgauuacgcucgagaaccaacuggugauccuugccaccacaaccucugacgcuggcgccuauuacguccaggccgugaaugagaaaaacggcgagaauaagacauccccuuuuauucaccugagcaucgcucgcgauguugggacccccgaaacgauggccccuacaauuguggugccgccgggaaaccggucugugguggcgggcuccagcgagaccacacucgaauguaucgcuuccgccagaccugucgaggaccugucuguuaccuggaaacgcaauggggugcggauuaccagcggacuucacuccuucggcagacgccugacaaucagcaaccccacgucugccgauaccgggccuuacgugugcgaggcugcccuccccggcuccgcuuuugaaccugcccgggcgacagccuuccuguuuaucauugagcccccguauuucaccgcugaaccugagagcagaaucucugccgaagucgaggagacaguggacauuggaugucaggcuaugggcguuccccugcccacccuccagugguacaaggaugccaucagcauuucccggcugcaaaauccucgcuauaaagugcuugcgucugggggacugagaauccagaagcuccggccggaagacagcggcaucuuucagugcuucgccuccaacgaagggggagagauucaaacgcauacauaccuggacgucaccaauaucgcucccguguuuacccagagaccuguugauacaaccgugacagacggcaugacggccauucuucgcugugaggucagcggggcucccaagccugccaucaccuggaaacgggaaaaccacauucuggccucuggcuccgugagaaucccccgcuucaugcuccuggagagcggaggccugcagaucgcuccugucuucauucaggaugcggggaauuauacaugcuacgccgcuaacaccgagggaucucucaacgccuccgccacacugaccguguggaauagaacgagcaucguucaucccccggaagaccauguggucauuaagggcaccacagcuacccuucacuguggggccacacaugauccucgggugucccugcgcuauguuuggaaaaaggacaacguggcgcucacccccucuagcacguccagaaucgucguggagaaagauggaucucugcugauuagccaaacaugguccggcgacaucggggauuacagcugcgaaauugugucugagggcggaaaugacucccggauggcucgccuugagguuaucgaacucccucacagcccccagaaccugcuggucucucccaauuccagccacucucaugccguggugcucagcugggucagaccuuuugauggcaacucccccauccuguacuauauuguggagcuuagcgaaaauaacucuccuuggaagguucaccuguccaauguggggcccgagaugaccggagucacagugagcggccucacccccgcccggaccuaccaguuccgcguuugugcugugaacgaagucgggagaggacaguauuccgccgagacaucucggcugaugcugccugaggaaccgcccagcgcgccucccaaaaauaucguggcuuccggccgcacgaaccaaucuauuaugguucaguggcagccucccccugagaccgaacauaauggggugcuuagaggcuacauccuccgguauagacuggccggacugccgggcgaguaccagcaacgcaacauuacaagccccgaagucaauuauugccucgugaccgaccugaucaucuggacacaguacgagauucagguggccgcuuacaacggggccggacuuggcgucuuuucccgggcuguuaccgaguauacgcugcagggggugccuacagcgcccccucaaaacgugcagaccgaagcggucaauucuaccacaauccaguuccucuggaaucccccgccucaacaguuuauuaacggaaucaaccagggcuacaagcugcuggccuggcccgcugacgcccccgaggcugugaccguugugacaauugccccugauuuccacggcguccaucacgggcacaucacgaaucuuaagaaauuuaccgccuauuucacaagcgugcucugcuuuaccacacccggagacggcccuccguccacaccccagcugguuuggacgcaagaagauaagccuggggcugugggacaucugagcuucaccgagauccucgacacaucucugaaagucuccuggcaggaaccccuugagaagaacggcauuaucaccggguaccagauuagcugggagguguauggaagaaaugauucucgccugacacacacccucaacuccacaacccaugaauacaaaauccagggccugagcucucugacgacauauaccauugacguugcggccgugaccgcugucggcacagggcuugugaccuccagcacgaucuccagcggagugccucccgaucucccgggcgccccuucuaaucuggucaucagcaacauuagcccccggucugccacacugcaauuuagaccuggguacgacggaaagaccagcaucucccgcuggauuguugagggccaggugggggcuaucggagaugaagaggagugggugacacucuacgaagaggaaaaugagcccgacgcccagaugcuggaaauuccuaaccuuacccccuauacacacuaccgguucagaaugaagcaggucaauaucgugggcccgucuccuuauagccccuccucucgcguuauucaaacccugcaggcgcccccugauguggcuccgacgagcgucaccgugcggacagccuccgagaccagccucagacugcgguggguuccccugccugacucucaguacaacggcaaucccgaguccgugggguaucgcaucaaauacuggagaagcgaucuucaaucuuccgccgucgcucagguggucagcgaccggcuggaacgcgaguuuacaaucgaagaacucgaagaguggauggaguaugaacugcagaugcaggccuucaacgcggugggagcuggcccuugguccgagguugugagagggcggaccagagaaucuguccccagcgccgccccugagaacguguccgcugaagccguuagcucuacgcaaauucuccugacauggaccuccgugccggagcaggaccagaauggacuuauccugggcuacaagauucucuuccgcgcuaaagaucuggaccccgagccucggagccacaucgucagagggaaccauacacagucugcccugcuugcgggacugcgcaaguuugugcucuacgaacugcaagugcucgccuucacccggauuggcaauggcguucccagcaccccucugauccuugagagaacaaaagaugacgcucccgggccgccuguccgccugguguuucccgaagugcggcucacguccgucagaaucguguggcagcccccugaggagcccaacggaauuauccugggcuaucagauugccuaccgccuggcuucuagcuccccucacaccuucacaaccguugaagugggggccacagucagacaguuuaccgccacggaucuugcuccggagucugcguauaucuuccggcugagcgccaagacacgccaaggauggggcgaaccccucgaggcuaccgugauuaccacagaaaagagagagcggccugcgcccccucgcgagcugcucguuccccaggccgaagugaccgcuagaucccugcggcuucagugggucccggggagcgacggagccucuccuaucagauacuuuacaaugcagguccgcgagcugccccggggcgaauggcaaacguauuccagcuccaucucucaugaggcgaccgcuuguguuguggauagacugcgcccuuucacaagcuacaaacuccggcugaaggccaccaaugacauuggcgauuccgacuuuucuagcgaaacagaggccgucaccacgcuucaggaugugcccggggagccucccggauccgugagcgcuaccccgcacacaaccucuuccguccugauccaguggcaaccucccagagacgaaagccucaacggccugcuccagggguaucggauuuacuaccgcgagcuggaauaugaggccggaucuggcacagaagcgaaaacccuuaagaaucccaucgcccugcaugcugagcugacagcccaguccagcuucaaaacgguuaacucuagcuccaccucuacaaugugcgagcucacccaccugaagaaguacagacgguaugaagugauuaugaccgcuuacaauaucauuggggagagcccugccuccgcuccgguggaagucuuugugggagaggccgcgcccgccauggcuccucagaacguucaagugacaccccuuacggccagccagcuggaggucaccugggauccucccccucccgaaucccagaauggcaacauccagggcuauaaaaucuacuauugggaggcugacucucaaaaugaaacagagaagaugaaaguccucuuccugccggaaccuguugugcgccucaagaaccugaccagccacacaaaauaccuugucuccauuucugccuuuaaugccgcuggggacggacccaagagcgauccucagcagggcagaacccaucaggcggcccccggggcuccguccuuccuggccuucucugagaucacgagcacaacccugaacguguccuggggagagccugccgcugccaacggcauucuccaaggguaccgggucguguaugaaccccuggcgcccguucagggagugagcaaaguggucaccguugaggugcgcggcaauuggcagagauggcuuaaggugcgggaccugacaaagggcgucaccuacuuuuuccgcgugcaagccagaacaaucaccuaugggccugaacuccaggcuaacauuacggccggacccgcugagggcucuccuggguccccgcgggauguucuggugacaaaaagcgccucugaacucacccugcaguggacagagggacacuccggcgacacccccacgaccggguacgucaucgaggcgagaccuagcgaugaaggccuuugggacauguuugugaaggauaucccccgcucugccacauccuauacccugagccuggacaaacuccggcagggagucacauacgaguucagagugguugcugugaaugaagccggcuauggggagccuuccaaccccagcaccgcugucucugcccaaguggaagcuccuuuuuacgaggaguggugguuccugcuuguuauggcccugagcucccucauugugauccugcuggucguguuugcgcucgugcuucauggacagaauaagaaauacaagaacuguucuacaggcaaggggauuagcaccauggaagaguccguuacgcuggauaauggaggcuucgccgcucuggaacucucuagccgccaccugaacgucaaauccacauuuucuaagaaaaaugggacccggagcccgcccagaccuucccccggcggacuucauuauagcgacgaggauaucugcaacaaguacaauggcgccgugcugaccgagucugugucccucaaagaaaagagcgcugacgccucugaguccgaagccacagacagcgauuaugaggacgcgcugccuaagcacuccuucgucaaccacuacaugucugaucccaccuauuacaauagcuggaaacgccgggcucaggggagagccccggcuccucaucgcuaugaagccguugccggauccgaggcuggcgcccagcugcaccccgugauuacaacgcaaagcgccgggggaguguacacccccgccggcccuggggcucggacaccccucaccggcuuuucuuccuucgucuga

SEQ ID NO: 75328 - RNA, 6519 nt, Artificial Sequence
  derived and/or modified sequence opt5 from SDK2__Homo_sapiens__NP_001138424
auguggggccugcucaucuggacccugcuugcccugcaccagauuagagcugcccgggcgcaagacgaugugagccccuacuucaagaccgagccugugagaacgcagguucaucucgaagggaacagacuggugcuuaccugcauggcugagggauccuggccgcuggaguucaaauggcuccacaacaaccgggaacugacaaaguucucucuggaauauagauacaugaucaccagccucgacagaacacaugccggcuuuuaucgguguauugugcgcaauagaaugggggcccugcuucagcggcagaccgagguccaaguggcuuacaugggauccuucgaggaaggcgagaaacaccagucuguuagccauggggaagccgcugugauccgcgcccccagaauugcguccuuuccucagccccaggucacaugguuccgggauggacgcaagaucccucccucuagcagaaucgccauuacccuggagaacacgcucgugauccuguccaccguugcuccugacgccggccgguauuacgugcaagcugucaaugauaaaaacggcgacaauaagacaagccagcccauuacccuuacaguggagaacgucgggggacccgccgauccuaucgcgcccaccauuaucauuccucccaagaauacgucugucguugccggcacauccgaagugacccuggagugcguggcuaacgcccgcccgcucaucaaacugcacaucauuuggaagaaagacgggguccugcucagcggaggcaucucugaucacaauagacggcugacaauuccuaaccccaccggguccgacgcuggauauuacgaaugugaggccgugcuuagauccucuagcguuccuagcgugguccgcggcgccuaccuguccgugcucgaaccgccccaguuuguuaaggagccugagcggcauaucaccgcugaaauggagaaaguggucgauauuccgugccaggcgaagggcgugcccccucccucuaucacaugguauaaggacgccgcugucguggaaguugagaaacugacgagauuccgccaacggaaugaugggggacuucagaucagcggccuggugccugacgacaccgggauguuucaguguuucgccagaaacgccgcuggagaaguccaaacauccaccuaccucgccgugacaagcauugcgcccaauaucacccgcggcccgcuggauucuacgguuauugacgggauguccgugguccuggcuugcgagacaagcggagccccucggcccgccaucaccuggcagaagggcgagcgcauucucgcuucuggcagcgugcagcugccucgcuuuacaccccuugaauccgggucucugcucaucagcccuacacacaucuccgaugccggaaccuauacaugucuggcuacgaacagccggggcguggacgaggccucugcggaucuuguugucugggccagaacccgcauuacaaaacccccgcaggaccaauccgugaucaaggggacccaggcuagcauggugugcggagucacacaugauccucgggugaccauuagauacaucugggaaaaagacggcgccacgcuggggaccgagucucacccccggauucgccucgauagaaacggcucccugcacaucagccagacaugguccggagacauuggcaccuauacaugucggguuaucucugcugggggaaaugauagcagauccgcccaucugcgcgugcggcagcucccccacgcgccugaacauccggucgccacccugucuacgguggagagacgcgcuaucaaccuuacauggaccaagcccuucgacggcaauagcccucugauuagauacauccucgagauguccgaaaacaaugcccccuggacaguucugcuggcuagcguggacccuaaagccaccucugucaccgugaaggggcuuguucccgcccgguccuaucaauuucgccucugcgcugugaacgaugucggaaagggccaguucagcaaagacacagagagagugucucugccugaggaacccccgacggcgccuccccagaaugugauugccuccgggcggaccaaccagagcaucaugauucaauggcagccucccccggagucucaccagaauggcauccugaagggauacaucauucgcuacugucucgcuggccugccugucggguaucaguucaaaaacaucacagaugccgacguuaauaaccuucugcucgaagaucugauuaucuggaccaauuacgagauugaaguggccgcuuauaacagcgccggacugggcguguacuccagcaaggucacagaguggacccuucaaggggugcccacgguuccucccggaaaugugcaugcggaagcuacaaacucuaccaccaucagauuuacauggaacgcccccuccccucaguucaucaauggcauuaaccagggguauaaacucaucgccugggagccggagcaagaagaggaagucaccauggugacagcucggcccaauuuucaggacagcauucacguuggcuucguguccggacugaagaaguuuacggaguacuucaccucuguccugugcuuuacaaccccuggcgaugggccccgcagcacaccucagcucgugagaacccacgaagacguucccggaccugugggccaucuguccuucucugagauccuugauacgagccugaaagucuccuggcaggagccgggggaaaagaacggcauucucaccggauaucggaucucuugggaggaauacaaucgcacaaacaccagagugacacacuaccugcccaaugugacccuggaguaucgggucacagggcuuaccgcccucacgacauacaccaucgaaguugcggcuaugaccagcaaaggccaaggacagguguccgccagcacaauuucuuccggcgugccucccgagcugccugggcccccgaccaaccugggaaucagcaauauuggcccuagaucugucacgcuccaguuucgccccggguaugacggaaagacauccaucagccgguggcugguggaggcccagguuggcguggucggcgaaggggaggaauggcuucugauucaucaacucucuaacgagcccgaugcuagauccauggaggugccugaccugaaucccuuuaccugcuacagcuuucgcaugcggcagguuaacaucgugggaacauccccuccgagccagcccucuagaaaaauucagacccugcaagccccucccgauauggcuccugccaaugucagccuucgcacagcguccgaaaccucucucuggcugcgguggaugccccugccggagauggaauauaacggcaauccugagagcgugggguacaagaucaaguauuccagaucugacggacacggcaaaacgcucagccacgucgugcaggaccgcguugaacgggauuacaccaucgaggaccuggaggaauggacagaguacagagugcagguccaagccuucaacgcuauuggguccggacccuggucucagaccgugguuggccggacacgcgaaagcgugccuuccagcggccccaccaacgucucugcccuugcuacgacauccagcucuaugcuggugagaugguccgaggugccugaagccgaucggaaugggcucguucugggauauaaggucauguacaaagagaaggacagcgauacccagccccgcuuuuggcugguggagggcaacuccucuagaagcgcccagcuuacagggcugggaaaauaugugcucuacgaaguccaagugcuggcuuucacccggaucggcgacggguccccgagccauccucccauucucgagagaacccuggaugacguucccggaccuccgaugggcauccuuuuccccgaagugcgcacaacgucuguccggcugauuuggcagccucccgcggccccuaauggcaucauccucgcuuaucagauuacccacagacugaacacaaccacagccaauaccgccacgguggagguucuggcucccuccgcccgccaguacacagcgaccgggcuuaagccugaaagcguguaucuguuucggaucaccgcucaaacaagaaagggauggggcgaggccgccgaggcucucgucgugaccacagaaaaacgcgaucggccgcagcccccuucuagacccaugguucagcaggaggacgugcgcgccagaagcguccugcucuccugggaaccugggucugauggacugagccccgugcgguacuacacgauucaaacccgcgagcuuccguccggcagaugggcgcugcauucugcuagcgugucccacaacgccagcucuuucaucgucgaccggcucaagccuuuuacauccuauaaauuccgcguuaaggccaccaaugauauuggggacagcgaguuuuccgaagagucugaaagccugacaacccugcaggcugcccccgacgaggcucccacgauccuuuccgugaccccucauacaaccacaucugugcugaucagauggcagcccccugccgaagauaaaauuaacggaauccuccugggcuuccggauuagauaccgcgagcuccuguaugagggccuucggggguuuacccugagaggaaucaauaacccgggcgcgacaugggccgaacugacgagcauguacuccaugcgcaaucucagccggcccucucugacccaguaugagcuugacaaccugaauaagcacagacgguacgaaauucgcauguccgucuauaacgcugugggggagggaccuagcucucccccucaagaaguuuucgugggcgaggccguccccacagcugccccgagaaaugugguugugcacggggccaccgcuacccagcucgaugucacaugggagccucccccucuggacucccagaacggagauauccaaggcuacaaaauuuacuuuugggaagcgcagcggggcaaccucacggagcgcgugaagacccuguuccuugccgaaaauagcgucaagcugaaaaaccugacaggguauaccgcuuacauggugucuguugccgccuuuaaugcugccggagacggccccagaagcacaccuacccaggggcagacgcaacaggcggcucccuccgccccgucuagcgugaaguucuccgagcucacaaccaccagcgugaacgucuccugggaagccccucaguuucccaauggaauccuggagggcuaucggcuuguuuacgagcccuguucuccuguggauggggugagcaaaaucgucacaguggacguuaagggaaacuccccgcuguggcucaaagugaaggaucuggcugaaggcgucaccuaucgcuuccgcauucgggccaagacauucaccuacggccccgagaucgaagcgaaugugacgacagggccuggagagggcgcccccgggccucccggagucccuauuaucgugcgcuauucuagcgcuauugccauccauugguccucuggcgaccccgggaaaggaccgaucaccagauacguuauugaggcucggccuagcgaugaaggccucugggacauccugauuaaggacauccccaaagagguguccagcuacacauuuucuauggauauucuuaagccuggcgucuccuaugacuucagagugaucgccguuaacgauuacggguuuggaacccccagcucuccgucccagagcgugccugcucaaaaagccaaucccuucuaugaagaguggugguuucuggucgugaucgcgcuggugggccucauuuucauccugcuucugguuuuuguccucauuauccgcgggcagucuaagaaguacgccaaaaagacggacuccggaaacagcgcuaaauccggcgcccuggggcacagcgaaaugaugucucucgaugagagcuccuuccccgcucuggagcuuaauaaccggagacugucugugaagaauagcuuuugccgcaaaaacggccuguauacccgguccccucccagaccuucuccgggaagccuccauuacuccgacgaagaugugacaaaguauaaugaccugauucccgccgagucuagcucccuuaccgaaaagccuagcgagaucucugauucccagggcagcgacucugaauacgaggucgauuccaaccaccagaaagcccauagcuucguuaaucacuacauuuccgaccccacauauuacaacucuuggcgccggcaacagaaggggaucagcagagcucaggcguauuccuacaccgagagcgauucuggagaaccugaccacacaaccgugacgaacuccacaagcacccaacagggcucucuguuucgccccaaagccagccggaccccuacaccgcagaaucccccuaaucccccuucccagcaaucuacccucuauagacccccgagcucccuggcuccugggucucgcgcccccaucgccggauucagcuccuucguguga

SEQ ID NO: 75329 - RNA, 1278 nt, Artificial Sequence
  derived and/or modified sequence opt5 from SDPR__Homo_sapiens__NP_004648
augggcgaggacgccgcucaggccgaaaaguuccaacaccccgggagcgauaugagacaggagaaaccuuccucuccgagccccaugccuuccucuacccccagcccuucccugaaccucggaaauacagaagaggcgauccgggacaacucucaggugaaugcugucacgguucugacccuucuggauaagcucgugaacaugcuggacgccgugcaggaaaaucaacauaaaauggagcagcgccagauuagccuugagggcuccgucaaggggauccagaacgaucugacaaaacucagcaaguaccaagccucuaccuccaauacagugagcaagcugcuggaaaaaucuagaaagguuuccgcucacacccgggccgugaaagagcgcauggacagacagugcgcucaggucaagcggcucgaaaacaaucaugcccagcugcuucgcagaaaccacuuuaaagugcugauuuuccaagaggagaaugaaauccccgcgagcguuuuugugaagcagccugucucuggagccguggagggcaaggaagaacucccggaugaaaacaaaucccuggaggagacacuucauaccguggaccugagcuccgaugacgaucucccccacgacgaagaggcucuggaagauucugccgaggaaaaggucgaggagagccgggcugagaaaauuaagcgcuccagccugaaaaagguugacucucucaaaaaggccuucuccagacagaauaucgagaagaaaaugaacaagcuggggacgaaaaucgugagcguggaacggcgcgagaagauuaaaaagucucuuaccagcaaucaccaaaagaucuccucuggaaaaagcuccccuuuuaaggucagcccccugacauucggccggaaaaaggugagagaaggcgagucucaugcggagaacgaaaccaaauccgaggaccucccuagcucugaacagaugcccaacgaucaggaggaggaauccuuugccgaggggcacagcgaggcuucccuggccucugcucuuguugaaggagaaauugccgaggaggccgcugaaaaggcgacaagccgcggcuccaauucugggauggacagcaacaucgaucugaccauuguggaggacgaagaggaagaguccgucgcccucgagcaggcucaaaaggugagauaugaaggaagcuacgcccugacgucugaggaagccgagcgguccgauggcgacccgguucagccugcugugcugcagguccaucagacaagcuga

SEQ ID NO: 75330 - RNA, 1182 nt, Artificial Sequence
  derived and/or modified sequence opt5 from SDR42E1__Homo_sapiens__XP_011521772
auggaccccaagagaagccagaaagaguccgugcugaucaccggcgggucuggauacuucggcuuucggcucgggugcgcccugaaccaaaauggaguccacguuauucuuuucgauaucagcuccccugcucagacaauuccggaaggcaucaaguuuauucagggggacauccgccaucugucugauguggagaaagccuuccaggacgcggaugugacgugugucuuucacaucgcuagcuauggaauguccggcagagaacaacucaaccggaaucugauuaaggaggugaacguucgcggcaccgacaauauccuucaggugugccagagacggcgcguccccagacugguguacacaucuaccuucaacguuauuuuugggggacaggugauccggaauggcgaugaaagccucccuuaucugccccugcaucuccacccugaccauuacucccgcacaaaaagcauugccgagcaaaagguccuggaggccaacgcuacaccccuugauagaggggacggagugcugcggaccugugcccuccgcccugcuggcaucuaugggccgggagaacagagacaucugccccggauugugucuuacaucgagaagggccuuuucaaauuugucuauggcgauccucgcucccugguugaguucgugcacguggacaaucucguccaggcccacauccuggcgagcgaagcccugagagcugauaaggggcacauugccucuggacagcccuacuuuaucuccgacggccggccugugaacaauuucgaguuuuucagaccccucguugaagggcugggauacaccuucccgagcacgcgccuuccucugacccucguguauugcuuugcuuuccugacagagaugguccauuuuauucuuggccggcuguacaacuuccaacccuuucucaccagaacagaaguguauaaaaccgggguuacgcacuacuucucucuggagaaggccaaaaaggaacugggauauaaggcgcagccuuuugaccuccaggaggccguggagugguucaaagcucacggccauggccgcuccagcgggucccgggauucugaauguuuugucugggacggacugcuuguguuccugcucaucauugccguccugauguggcuucccagcuccgugauccugagccucuga

SEQ ID NO: 75331 - RNA, 942 nt, Artificial Sequence
  derived and/or modified sequence opt5 from SDR9C7__Homo_sapiens__NP_683695
auggccgcucugaccgaccucagcuucauguacagaugguuuaagaacugcaaucuggugggcaaccuuuccgagaaauaugucuucaucacagggugugauucuggauuuggcaaucugcucgccaagcagcugguugaccgggggaugcaagugcuugcggcuugcuucacggaagagggaagccagaaacugcagcgcgauaccuccuacagacuccagacaacccugcuggacgugacaaagucugaaagcauuaaagccgccgcucaauggguccgggauaaggugggcgagcaggggcucugggcccugguuaacaaugcuggagugggccuucccuccggcccuaacgaauggcugaccaaggacgauuuugucaaagugaucaauguuaaccucguggggcugauugaggucacacuucacaugcugccgauggugaagcgcgccagaggacggguggucaauaugucuagcuccggcgggcgcguugcggugaucggaggcggguauugugugagcaaauucggagucgaggccuuuucugacuccauuagacgggaacucuacuauuucggcgugaagguuugcaucaucgagcccggcaacuaccgcaccgcuauucuggggaaagaaaaucuggagagcagaaugcggaagcucugggagcgccugccucaggaaacgagagauucuuauggagaggacuacuuucggaucuacaccgauaaacuuaagaacauuaugcaggucgccgaaccccgcgugagagacgugaucaauuccauggagcaugcuauuguuagccggucuccuagaauccgcuauaaccccggccuggaugccaagcuccuguacauuccucuugcgaaacugccgacacccgugaccgacuucauccucucccgguaucugccuagacccgccgacagcgucuga

SEQ ID NO: 75332 - RNA, 987 nt, Artificial Sequence
  derived and/or modified sequence opt5 from SDS__Homo_sapiens__NP_006834
augaugagcggcgagccccugcacgugaagaccccuaucagagacuccauggcccucucuaaaauggcugggacaagcgucuaccugaagauggauuccgcccagccgucugggagcuucaaaauucggggcaucgggcauuuuugcaagcgcugggcgaaacaaggaugugcucacuucguuugcuccucugccggcaacgccgggauggcugccgcuuaugccgcgagacagcuuggagugcccgccacgauuguggucccuagcaccacacccgcucugaccaucgaacggcucaagaaugagggcgccacagugaagguugugggcgaacugcuugacgaggcuuuugaacuggccaaagcgcucgccaagaacaauccugggugggucuacauucccccuuucgaugacccgcugaucugggagggacaugcuuccaucgugaaagagcugaaggaaacccucugggagaaacccggcgccauugcucugagcguugggggaggcgggcuucuguguggagugguccagggccuccaggaagugggcuggggagaugugccugucaucgccauggagacauuuggagcccacucuuuccaugcugcgaccacggccggcaagcugguuucccuucccaagauuaccagcguggcuaaagcccugggggugaagacagucggagcccaagcucucaaacuguuucaggagcacccuaucuucucugaagugauuuccgaccaggaggccguugcggcuaucgaaaaguuuguggaugacgagaaaauucuggucgaacccgccugcggcgccgcucucgccgcuguguauagccacguuauccagaagcugcaacuugaggggaaccugcgcaccccgcucccuucucugguggucaucguguguggaggcuccaauauuagccuugcccagcugagagcgcucaaagagcagcugggcaugacaaaccggcugcccaaguga

SEQ ID NO: 75333 - RNA, 462 nt, Artificial Sequence
  derived and/or modified sequence opt5 from SEC11A__Homo_sapiens__NP_001258847
augaucgugagcuccgcccugaugauuuggaagggccucauggucaucaccgggucugagagccccauuguuguggugcuguccggaucuauggaaccugcuuuccacagaggcgaccuucuguuucucacaaaccgggucgaggauccgauccgcgugggggaaauuguuguguucagaaucgagggacgggaaauccccauuguccaucgcgugcugaaaauccacgagaagcagaauggccauauuaaauuucuuacgaagggggacaacaaugccguugaugacagaggacuguacaaacaaggccagcacuggcucgagaagaaggauguggucggccgggcgcgcggguucgugccuuauaucggaauugugaccauccugaugaacgacuaccccaaauuuaaguaugcuguccuguuccuccugggccuuuuuguucuggugcauagagaauga

SEQ ID NO: 75334 - RNA, 579 nt, Artificial Sequence
  derived and/or modified sequence opt5 from SEC11C__Homo_sapiens__NP_150596
auggugagagccggcgcugucggggcccaucugcccgcgagcggacucgacaucuucggcgaucugaagaaaaugaacaagcggcagcuuuacuaucaaguucugaauuuugcuaugauuguguccucugcccucaugaucuggaaagggcugauugugcuuaccggaagcgaguccccuaucgucgugguucugucuggcagcauggaaccggccuuccaccgcggggaccuccuguuucugacaaacuucagagaggaucccauucgggcuggagaaaucguggucuuuaagguggagggccgcgacaucccuauuguucacagagugaucaaaguccaugaaaaggauaauggcgacauuaaguuccucacgaaaggggauaacaaugagguggacgaucggggacuguacaaggagggccagaacuggcuugagaaaaaggacguggucgggcgcgccagaggauuucugcccuauguuggcauggugaccaucauuaugaaugauuacccuaaauucaaguaugcucuccuggccgugaugggggcguacguccuucugaagcgggaauccuga

SEQ ID NO: 75335 - RNA, 1107 nt, Artificial Sequence
  derived and/or modified sequence opt5 from SEC13__Homo_sapiens__NP_001129498
augagagagcccgugcugaccuggugcgucccucucgaacugcuuuguagccacccgcugccccucuccgccuuccugaagucucagguuaaacuuuacacauaucgggcuugcgccggcaaggacgagauggggaaaauggugagcgugaucaacacggucgauaccucccaugaagacaugauucacgaugcgcaaauggacuacuauggaacacgccuggcuaccuguucuagcgauagauccgugaagaucuuugacguucggaauggcgggcagauucucaucgccgaucugcgcggacaugagggcccuguguggcaggucgccugggcucaccccauguacgggaacauucuggccucuugcagcuaugacagaaaagugaucaucuggcgggaagagaauggaacaugggagaagucccaugaacacgcuggccacgauagcucuguuaacuccguguguugggccccucaugacuacggccucauucuggcgugcgggagcucugauggagccaucucccuucugaccuauacaggcgaggggcagugggaagucaagaaaauuaauaacgcucacaccaucggauguaaugccgugagcugggcucccgccguggucccuggcucucucauugaccauccguccgggcaaaagcccaacuacaucaaacgcuucgcgagcggaggcugcgauaaucugauuaaacuuuggaaggaggaggaagacggccaguggaaggaggaacagaagcuggaggcccacuccgacuggguuagagauguggcuugggccccuucuaucgggcuccccacgagcaccaucgcuuccuguagccaggacggacggguguuuauuuggacaugcgaugacgccucuuccaacaccuggagcccuaaacugcugcacaaguucaaugaugucguguggcauguuucuuggagcaucacagccaacauucucgcuguguccggcggggacaauaaagucacccuguggaaggaaucuguggauggacaauggguuuguaucagcgacgugaacaaaggccagggguccgucagcgcgucugugacggagggacagcagaaugagcaauga

SEQ ID NO: 75336 - RNA, 2148 nt, Artificial Sequence
  derived and/or modified sequence opt5 from SEC14L1__Homo_sapiens__NP_001137470
auggugcagaaguaccaaagccccgucagaguuuauaaauacccuuucgagcugaucauggccgcuuaugaacggcgcuuuccgaccugcccccucauuccuauguucgugggcuccgacacagugaacgaguuuaagucugaagauggggccauccacgucauugagagacgguguaaacuggacguggaugcgccccgccuucugaagaaaaucgcuggaguugacuacguguauuucguccagaagaauagccucaacuccagagaacggacgcugcauauugaggccuacaaugagaccuuuucuaaccgcgugaucaucaaugaacacugcuguuauacaguucauccugagaacgaagauuggaccugcuucgagcagagcgccucccuugacauuaagagcuuuuucggcuuugagagcacaguggagaaaaucgcuaugaagcaguacaccuccaauauuaaaaaggggaaagaaaucauugaauacuaucugagacaacucgaggaagagggaaucacauucgucccccgguggagcccuccgucuauuacccccuccagcgagacgucuuccucuucuuccaagaagcaggccgcuagcauggccguggugaucccugaagcggcccugaaagagggccuguccggggaugcucucucuagccccuccgccccugaacccgucguuggaaccccggacgauaagcuggacgcugauuacaucaaacgcuaucuuggcgaccugacaccucuccaggagagcugucugauuagacuucggcaguggcugcaagaaacccacaagggcaaaauccccaaggaugagcauauucuccgcuuucugagagcccgggacuucaacaucgacaaagcgcgcgagauuaugugccagucucugacauggagaaagcagcaccagguggauuacauccucgaaaccuggacgccuccccaagugcugcaggacuauuacgccgggggauggcaccaucacgauaaggacggccggccccuuuauguccugagacucgggcagauggauacaaaaggacuggugcgcgcucuuggcgaggaagcccugcuccgguacguucuguccaucaaugaggaagggcugagacgcugugaggagaacaccaagguguuuggacggccuauuagcucuuggacaugccucgucgaccuggaaggccuuaauaugagacaucuguggcgcccgggcgugaaagcucuccugcggaucauugagguuguggaagccaacuaccccgagacccuugggagacugcucauccugcgcgccccucgggucuuccccgugcuguggacccucgucagcccuuucauugaugacaauacaagacgcaaguuucugaucuaugcuggaaacgauuaccaaggccccgggggacuucuggacuauaucgauaaagagauuaucccggacuuccucuccggcgaauguaugugcgaggugccugaagggggacugguucccaagucucuguaccggacggcggaggaacuugagaaugaggaccucaagcuguggaccgaaacaauuuaucagagcgccuccguguuuaaaggcgcuccucacgagauccugauucagaucgucgaugccagcucugugauuaccugggacuucgauguuuguaagggcgacaucguguuuaacaucuaccacuccaaaagaagcccccagccucccaagaaagauucucucggggcccauuccauuacaagcccgggaggcaacaauguccaacugaucgacaagguguggcagcuugggcgggauuauuccaugguggaaucuccucugauuugcaaggagggagaaagcguucagggcucccacgucacccgcuggcccggguucuacauccuccaguggaaauuucauucuaugcccgcuugcgccgcgagcucccugccuagaguggacgaugugcuggcuagccuucaagucucuucccacaaguguaaagugauguacuauacggagguuauuggcagcgaggacuuccggggaucuaugacaucccucgaaagcucucauagcggcuuuucccagcugagcgccgccaccaccucuuccagccagucccacucuagcuccaugaucucuagauga

SEQ ID NO: 75337 - RNA, 963 nt, Artificial Sequence
  derived and/or modified sequence opt5 from SEC14L2__Homo_sapiens__NP_001191133
augagcggcagagugggggaccugagcccccggcagaaggaggcccucgcuaaauuccgcgaaaacguccaagauguucugccugcccuuccgaaucccgacgauuacuuucugcucagauggcugcgggcgcgcucuuucgaccuucagaaguccgaggcuaugcugagaaaacucggacggaagguggaaaccaucacaauuaucuaugauugcgagggccuggggcugaaacaccucuggaagccugccguggaagccuacggagaguuucuguguauguucgaggaaaacuaucccgagacgcuuaagcgccuguuugucgugaaagcuccuaaacucuuccccguugccuacaaucugauuaaaccuuuucuuuccgaagacaccagaaagaaaaucauggugcugggcgcuaacuggaaggagguccuccugaagcauauuucuccggaucaggugcccguugaguaugggggaacaaugaccgacccugauggcaaucccaaaugcaagagcaaaaucaacuacggcggggacaucccucggaaguauuacgugcgcgaucaggucaaacaacaguacgaacacuccgugcagauuucuagaggaagcucccaucagguggaguaugaaauccuguuccccggcuguguccuccgguggcaauuuaugagcgacggggccgauguuggauucggcauuuuucugaagacaaaaaugggggagcgccagagagcgggagaaaugaccgaggugcuuccgaaucagcgguacaacucucaccuggugccugaggacggcacacugaccugcuccgaccccggcaucuauguccuccgcuucgauaauacguacagcuuuauucaugccaagaaggugaacuucaccguugaagugcuucugccugacaaggcuucugaggaaaagaugaaacagcucggggccggaacacccaaguga

SEQ ID NO: 75338 - RNA, 972 nt, Artificial Sequence
  derived and/or modified sequence opt5 from SEC14L3__Homo_sapiens__NP_001244307
auggugauccagaaguacaugcccggcgggcugugcggauaugacagagauggcuguccugucugguacgacauuaucgggccgcucgaucccaaaggacugcuuuucagcguuaccaagcaagaccugcucaaaacaaagaugcgggauugcgagcgcauucugcacgaaugugaccuucagacggagagacugggcaaaaagaucgaaaccauugugaugaucuuugauugcgaggggcucggacugaagcauuucuggaaaccucugguggaagucuaucaggaguuuuucggccuccuggaggaaaacuaccccgagacacuuaaguuuaugcugaucgugaaagccaccaaacucuucccuguuggcuauaaucugaugaagcccuuucuuuccgaagacacacggcgcaagauuaucgugcuggggaacaauuggaaggagggacuccugaaacugauuucuccugaggaacucccggcucaguucggcgggacccugacagaucccgacggaaacccuaagugucuuaccaaaaucaauuacggcggggagauucccaagagcauguaugucagagaucaagugaaaacgcaguacgaacacuccguucagaucaaccggggaucuagccaucagguggaguacgaaauucuguuuccuggcugcguccuccgcuggcaauucuccucugacggcgccgauaucggguuuggaguguuccugaagaccaaaaugggcgagagacagcgggcgggggagaugacagacgugcuucccagccagcgcuauaaugcucacauggucccggaagacggaaaccugaccuguuccgaggccggcguuuacgugcucagauuugauaauacauauagcuucgugcaugccaagaaggucucuuucaccguggaaguucugcugccugacgaggggaugcagaaauacgauaaggaacucacgcccguguga

SEQ ID NO: 75339 - RNA, 3183 nt, Artificial Sequence
  derived and/or modified sequence opt5 from SEC16B__Homo_sapiens__NP_149118
auggagcugugggcuccccagagacucccucaaacccggggcaaggccacagccccgagcaaagaccccgaucgcggguucagacgggacggacaccaucgcccugugccccacuccuggcauaacggcgaaagauuucaccaguggcaggauaaucgggggucuccucagccccaacaggagccucgcgcggaccaucagcagcaaccgcacuacgcuagcagacccggagauuggcaccagccugucuccggcguugacuauuacgaagggggauaucggaaccagcuguacucucgccccggcuaugagaauagcuaccaguccuaucaaucuccuacgaugagagaagaguacgccuacggcagcuauuacuaucaugggcacccccaguggcuucaggaggaacgggugccgcgccaaagauccccuuacaucuggcaugaggauuaucgggaacagaaguaccuggacgagcaccacuaugagaaccagcauagccccuucggaaccaauucugaaacacacuuucaguccaacagccgcaauccuugcaaagauucucccgccuccaacagcggccaagaguggcccggggaacucuucccuggaucucugcuugcugaggcccagaagaauaaaccgucccuggcuagcgaauccaaccuccugcagcagagagagucuggccugagcuccagcucuuacgagcucucccaauacauucgggacgcccccgaaagagaugacccucccgcgagcgccgcuuggucuccugugcaggccgaugucagcuccgcugggcccaaggccccgaugaaguuuuauaucccucaugugcccguuucuuucggaccuggcggccagcuggugcacgucgggcccagcuccccuaccgacggacaggcggcccuuguggagcugcauagcauggaaguuauucucaaugacucugaggaacaagaggagaugcgcuccuuuagcggcccccugauccgggaagaugugcacaaagucgacauuaugacauucugucagcagaaggcugcccagucuugcaaauccgagacccuugggagcagagauuccgcucugcucuggcaacugcuggugcuccugugucgccagaacggaucuauggugggcagcgacaucgccgaacuucugaugcaggauugcaagaaacucgagaaguacaagcggcaaccgccugucgccaaucugaucaaccuuacagacgaagauuggcccguucuguccucugggacccccaaucuccugacgggagagauuccuccgagcguggagacccccgcucagaucguggaaaaauuuacaagacugcucuauuacggccgcaagaaagaggcgcuggaaugggccaugaagaaccaccuuuggggccaugcucuguuccucuccagcaaaauggacccucagaccuauucuugggucauguccggguuuacaagcacccuggcccuuaacgauccccugcagacacucuuccaacugaugucuggacggauuccucaggccgcuacauguugcggcgagaagcaguggggagacuggagaccccaccuggccgugauccucuccaaucaggcgggggauccugagcuguaccaacgcgcuauuguugccaucggcgacacccuugccgggaaaggccugguggaagcugcccauuuuuguuaucucauggcucacguccccuucggacacuacacagugaagaccgaccaucugguucugcuuggcagcucucacagccaggaguuccucaaguuugccaccacagaagcgauucagcggacggagaucuucgaauacugccagaugcuggggagaccgaaauccuuuaucccuagcuuccaaguguauaagcugcucuacgccucucgccuggcugauuauggacuugucucccaggcccugcauuacugugaggcuauuggcgccgcggugcucagccagggggaguccucucaccccguccugcugguggaacuuaucaaacucgccgagaagcugaaacugagcgacccucucguucuggaacggagauccggagaucgggaccuugagcccgauuggcuggcucaacuccgcagacagcuggaacagaagguggccggcgacauuggggauccgcauccuacccggucugacaucagcggcgcuggaggcacaaccacagagaacaccuuuuaucaggauuucuccgggugccaaggauacucugaggcccccggcuauagaagcgcccuguggcuuacgccugaacagacaugucuccugcagcccagcccccagcaaccuuuuccgcugcagcccggguccuacccugcuggaggcggggcgggccagaccggaacaccccgcccuuucuacucuguccccgagacccaccucccuggcaccggguccagcguggccguuacagaagcuacgggaggcaccgugugggaggaaaugcugcagacacaccuugggccgggagagaauaccgucucucaagagacaucccagcccccugacggccaggaagugauuagcaagccccagaccccucuggccgcccggcccagaucuaucuccgagagcuccgcuagcucugccaaagaagaugagaaggagagcuccgacgaagcggauaaaaacucuccgcgcaauacggcucaaagagggaagcucggcgacggaaaagagcauaccaagagcuccggcuuugggugguucucuugguuucggagcaagccuacgaaaaacgccucccccgccggagacgaagauucuagcgacucccccgauagcgaggaaaccccucgcgcuucuagcccccaccaggccggccuggggcugucccuuacaccuucuccggaguccccuccccuccccgacgugagcgcguucuccagaggacggggcggcggggagggacgcggcucugcuagcuccgggggagccgccgcuggcgccgggguuggaggccugagcggcccugaaucugucuccuuugagcugugcagcaaucccggggugcuccugccgccucccgcucuuaagggagccgugccucuguauaaccccucucaggucccucaacuccccaccgcgacgagccugaauagaccgaaccggcuggcccagcgcagauacccuacacagcccugcuga

SEQ ID NO: 75340 - RNA, 2298 nt, Artificial Sequence
  derived and/or modified sequence opt5 from SEC23A__Homo_sapiens__NP_006355
augaccacauaccuggaguucauccagcaaaacgaagagagagacggcgugcgguuuagcuggaaugucuggcccuccucucgccucgaagccacgagaaugguugugccuguggcugcccuguucaccccgcuuaaggagcggcccgaucugccucccauucaguaugaaccuguccucugcagccgcacaaccuguagagcggugcugaacccccuuugccagguugacuaccgggcuaaacugugggccuguaauuuuugcuaucagcgcaaccaauucccuccguccuacgccgggaucucugagcucaaucagcccgcugagcugcugccucaguuuagcuccauugaauaugugguccucagaggaccccagaugccucugaucuuccuuuacgugguugauacauguauggaggacgaagaucugcaagcccucaaggagucuaugcagaugagccugucccuucugcccccgaccgcucucgugggccugauuacauuugggcggaugguccaggugcacgagcugggaugcgaaggcaucagcaaaucuuauguguuccgcgggaccaaggaccucuccgccaaacagcugcaagagaugcuuggacugagcaaggucccucucacgcaggcgaccagaggcccccagguucaacagccuccucccucuaaccgguuucugcagcccgugcagaagaucgauaugaaucuuacagaccugcucggcgaacugcaacgcgauccguggcccgugccucaggggaaaagaccccugcgguccagcggagucgcccucucuauugcugugggccugcuugaguguaccuucccuaacacaggggcccgcaucaugauguuuauuggaggccccgcuacccaggggccgggaaugguugugggcgacgaacugaagacgccuaucagauccuggcaugauauugacaaagauaaugccaaguacgucaaaaagggcacaaagcacuucgaggcgcucgccaaccgggcugccaccacagggcaugugaucgacauuuacgcuugcgcccuggaccagaccggacuucuggagaugaaauguugccccaaucucaccggcggguauaugguuaugggagauagcuuuaacacaucccuguucaagcaaacguuccagagaguguuuaccaaagacaugcacggccaguucaagaugggguuuggaggcacacuggaaaucaaaaccucucgcgagaucaagauuagcggcgccaucgggccuugugucucccucaauagcaaaggacccugcgugucugaaaacgagauuggcacagggggaaccugccaguggaagaucuguggccuguccccuacgacaacccuugcuauuuacuucgaagucgugaaucaacauaacgcgcccaucccgcagggcggccggggagccauccaguuuguuacccaguaucaacacagcucuggccagagacgcauucgggugacaaccaucgcuagaaacugggccgaugcccagacacaaauucagaauaucgcugccagcuucgaccaggaggcggcugccauucugauggcccgccucgcuaucuaccgggccgagacggaagaggggccugauguccugagauggcuggaccgccagcuuauccggcucugccaaaaguuuggagaauaucacaaagaugaccccuccucuuucagauuuagcgagaccuucucccuguacccccaguuuauguuccaucugcgccggagcucuuuucuccagguguucaacaauuccccugaugaaagcucuuauuacagacaccauuucaugcggcaggaccugacacaaucccuuauuaugauccagccgauucuguacgcuuauagcuuuuccgggcccccugagcccguucuccuggauucuagcuccauccuggccgaccgcauucuucucauggacaccuucuuucagauccugauuuaccacggggagacaaucgcgcaguggagaaagucuggauaucaagauaugccugaauacgagaacuuccggcaucugcuccaggcccccguggacgaugcucaggaaauccugcacagcagauuuccuaugccccgcuauauugacaccgagcacggcgggucccaagcccgguuccuucugagcaaagucaauccgucucagacgcauaacaauauguacgcuuggggccaggaguccggagccccuauccucaccgaugacgugagccuucagguguuuauggaucaccugaagaaacuggcgguuucuuccgccgcuuga

SEQ ID NO: 75341 - RNA, 2250 nt, Artificial Sequence
  derived and/or modified sequence opt5 from SEC23B__Homo_sapiens__NP_001166217
auggccaccuaccuggaguucauccagcaaaacgaagagagagacggcgugcgguuuagcuggaaugucuggcccuccucucgccucgaagcuacaagaaugguugugccucuggccugccuucugacgccgcucaaggagcggcccgaucugccucccgugcaguaugaaccuguccuuuguagccgccccacaugcaaagcggugcugaacccucucugucagguugacuacagagcuaagcugugggccugcaauuucuguuuucagcggaaccaauucccgcccgccuaugggggaauuuccgaggugaaucagccugcugagcugaugccccaguuuucuacaaucgaauacgucauucaggaggaugaccuccaagcccugaaagaaagccuucagaugucccugucucuccugccucccgaugcucuugugggccugaucaccuucgggcgcaugguucaggugcacgagcucagcugcgagggaauuuccaagagcuaugucuuuagaggcacaaaagaccugaccgccaagcagauccaagauaugcuggggcucacaaagccggcgaugccuaugcagcaggcccggcccgcucaaccucaggaacaucccuucgccucuucccgcuuucugcagcccgugcacaaaaucgacaugaaccuuaccgaucugcucggagagcugcagagagacccuuggccggugacgcaaggcaagcggccccuucgcagcaccggcgucgcucugucuauugccguugggcuccuggaaggaacauucccuaauaccggcgcgagaaucaugcuguuuacagggggacccccuacccagggccccgggaugguggugggagaugagcucaaaauuccgauccgguccuggcaugacauugaaaaggauaacgcccgcuucaugaaaaaggcuacgaagcacuacgagaugcuggccaauagaacagcugccaacggccauuguaucgacauuuaugccugcgcucuugaccagaccggccugcucgagaugaaauguugcgcgaaucugacagggggauacauggucaugggcgauagcuuuaacaccucucuuuucaagcagaccuuccaacggaucuuuacaaaagacuucaauggggauuuuagaauggccuucggagcuacgcuggacgugaagaccucccgcgaacucaaaaucgccggcgccauugggccuuguguuagccugaacgugaagggacccugcgucuccgagaaugaacugggcgugggcgggacaucucaguggaaaaucugcggacucgauccuaccagcacacugggcauuuacuuugagguugugaaccagcacaacacccccaucccucaagggggacggggcgcuauucaguucgucacgcacuaucagcauuccagcacacagagacgcauccgggugaccaccaucgccagaaauugggcggacguccagucucaacuucgccacauugaagcugccuuugaucaggaggccgcugccgugcugauggcucggcucgggguuuucagagccgaguccgaagagggccccgacgugcugcgcuggcuggaucggcagcuuaucagacucugucaaaaguuuggacaguacaacaaggaagacccgaccagcuuccgccugucugauagcuuuucccuguauccucaguucauguuucaucuccggagaucucccuuccugcaggucuucaauaacagccccgacgaguccagcuacuaucggcaccacuuugcgcgccaagaccuuacccagucucugauuaugauccagccuauucucuacuccuauagcuuccauggcccgcccgaaccugugcugcuggauucuuccagcauccuugccgacagaauccuccugauggauacauuuuuccagauuguuaucuaccugggggagacgauugcucaauggcggaaagccggauaccaggacaugcccgaguaugaaaauuuuaagcaccuccugcaggcuccucuugaugacgcccaggagauccugcaagcgagauuccccaugccucgcuacauuaacaccgaacauggcgggucccaggcccgguuucuccugucuaaagugaaucccagccagacacacaacaaucuguaugcuuggggacaagagaccggcgccccgauccuuacagaugacgucucccuccagguguucauggaucaucugaagaaacuggcugugucuagcgccugcuga

SEQ ID NO: 75342 - RNA, 3003 nt, Artificial Sequence
  derived and/or modified sequence opt5 from SEC23IP__Homo_sapiens__NP_009121
auggccgagagaaagcccaacggcgggagcggaggcgcuuccaccucuagcuccgggacaaaucuucucuucucuagcuccgccacggaauuuucuuucaacgugccuuuuaucccggucacccaggcgagcgcuucccccgccagccugcuucugccuggagaggacucuacagauguuggcgaagaggacuccuuccucgggcaaaccagcauucacacaucugcuccccagaccuuuuccuacuucagccaggugucuuccagcuccgauccuuuuggaaauaucggccagucuccccugacaaccgcugccacgagcgugggccaauccggguucccuaaaccgcuuaccgcucugcccuuuacaaccggaagccaggacgucucuaacgccuucuccccuagcauuucuaaggcgcagcccggcgccccucccagcucccucauggggaucaauucuuaucugccgagccagccuuccagccugcccccuucuuacuuuggaaaccaaccccagggcauuccccagccuggguauaauccguaccggcauacacccggauccagccgcgcuaacccuuauaucgcucccccucagcuccaacagugccagacccccggcccgccugcccaucccccucccucuggcccucccgugcaaauguaccagaugccgccugggucccugccucccguucccagcuccgugcagucuccggcccagcaacagguccccgcgagaccuggagcccccagcgugcagguuccuucccccuuccuucugcagaaucaauaugaaccugugcagccccacugguuuuacuguaaagaggucgaguacaagcagcucuggaugccguucucuguguucgauagccugaaccuugaagagaucuauaauuccgugcagccugaccccgaaagcgucguucugggcacggaugggggacgguacgacguguaucucuacgaucgcauuagaaaagcugccuauugggaggaggaaccugcugaggugcggcgcugcacaugguuuuacaagggcgacaccgauucuagauucauccccuauacagaagaguuuuccgaaaagcuggaggccgaguacaaaaaggccgucaccaccaaccaauggcaccggcgccuggaguucccgagcggggaaacaauugugaugcauaauccuaaaguuaucgugcaguuucagcccucuuccgucccugacgaauggggaacgacccaggauggccaaacaagaccccgggugguuaagcgcggcauugacgacaaccucgaugagauccccgacggggaaaugccucagguggaucaccuggucuucgugguccacggaauuggcccggugugugaccuuagauuucggagcaucaucgagugcguugaugacuuccgcguggucucucugaaacuccugagaacccauuuuaaaaagagccuugaugacgggaaggugucccggguugaguuccugcccgugcacuggcauagcucucucggaggcgaugcuacaggggucgacagaaauauuaagaaaaucacccugccuuccauuggccgcuuucggcacuucacgaacgaaacacugcucgauauccuguuuuacaacagccccaccuauugucagaccauuguggagaaggugggaauggaaaucaaucaccuucaugcgcuguucauguccagaaacccugacuucaaaggcgggguuucugucgccggacacagccucggcucccugauccuuuuugacauucugucuaaucaaaaggaucucaaccugagcaaaugccccgggccucuggcuguggccaauggaguggucaagcagcuccauuuccaggagaagcagaugccggaggaacccaaacugacacuugacgaguccuacgaucuggugguugaaaacaaggaggugcucacccugcaagaaacacuggaggcccuuucucucagcgaguauuuuuccacguucgaaaaagagaagaucgacauggaaagccugcugauguguaccgucgaugaccucaaagagaugggcauuccucuggggccccgcaagaagaucgcuaauuuuguggaacacaaagccgcgaagcugaaaaaggcugccucugagaaaaaggccguugcugccacauccaccaagggccaggagcagagcgcucagaaaacaaaggauauggccucucugccuuccgaaagcaacgagcccaaacggaagcucccggugggagcgugcgucucuuccguguguguuaauuacgagagcuucgaagugggcgccgggcaagucuccguggcuuauaacagccuggacuuugaaccugagauuuucuuugcccugggaucucccaucgcuauguuccuuaccaucagaggcguggaucgcauugacgagaauuacagccuccccacgugcaaaggguuuuucaacaucuaucauccucuggaucccgucgccuaccggcuggaaccuaugauuguuccggaccucgaucugaaggcggugcuuaucccccaccacaagggaagaaaacgccugcaucucgagcugaaggaaucccugucucggaugggcagcgaccuuaaacagggguuuauuuccucucucaagagcgccuggcagacccugaaugaguucgcuagagcccacacauccucuacccagcugcaagaggaacucgagaaaguggcuaaccagaucaaggaagaggaagagaaacaggucguggaggccgaaaagguuguggagagcccugacuucuccaaggaugaagacuaccugggcaaagucggaaugcuuaauggcgggcgccggauugauuaugugcugcaagagaagcccaucgagagcuuuaacgaauaccucuucgcccugcagucucaucuguguuauugggaguccgaagacacagcccuucuccugcugaaagagaucuacagaaccaugaacauuagcccugaacagccccagcacuga

SEQ ID NO: 75343 - RNA, 1842 nt, Artificial Sequence
  derived and/or modified sequence opt5 from SEC24A__Homo_sapiens__NP_001239160
augagccagcccggcaucccugccuccgggggagcuccggccucucugcaagcgcagaacggcgcugcccucgccagcgggucccccuacaccaauggaccugugcagaacgcucugcuuucuagccaggaguccgucucucaaggcuauaauuuccagcugcccgggagcuacccucaccccauuccugccaagacacucaacccgguuuccggacagagcaauuauggcggcucucagggguccggacaaacgcugaacagacccccuguggcuagcaaucccgugaccccuucucuucauuccggccccgccccgcggaugccucugcccgcgagccagaacccugccacaacccccaugcccucuuccagcuuucucccugaagcuaaucugccgcccccucugaacuggcaguacaauuaucccuccacagccucucagaccaaccacugcccucgcgcuagcucccaacccacagucagcgggaauaccucucucacgaccaaccaucaguacguguccagcggauauccgucucugcagaauagcuucaucaaauccggcccuucuguucccccucuugugaaucccccucugcccacaaccuuucaaccgggggccccucacggacccccucccgcgggcggcccgcccccugucagagcccucacaccccugaccagcuccuaccgggacgugccucagccccuuuucaacagcgcuguuaaccaggaggggauuacgucuaacacaaauaacggauccauggugguccauagcucuuacgaugaaaucgagggcgggggacugcucgccaccccucagcugacaaauaagaaccccaaaaugucccgcagcgugggcuauuccuacccgucucugccucccggguaucaaaauaccaccccucccggagcuacaggcgugccgccuagcucccucaacuaccccucuggcccucaggccuuuacgcagacaccccugggggccaaucaccuuaccaccagcauguccggacugagccuccagcccgaaggccugagagucguuaaccuucugcaagagcggaauaugcucccuucuacaccgcugaagcccccugugcccaaccugcacgaggacauucagaaacucaauuguaacccugaacuguuccgcugcacccuuacguccaucccccagacacaggcucugcucaauaaggcgaagcugccucuugggcugcuccugcauccguuuaaagaucuggugcaacuccccgucgugaccagcucuaccaucguuagaugucgguccugccgcacauauauuaacccuuucgugagcuuucuggaccagagacgguggaaguguaaccuuugcuaccgcgucaaugaugugcccgaggaguuccuguauaacccucucaccagaguuuacggagaaccccaccggcgcccggaggugcagaaugccacaaucgaauuuauggcuccuucugaguacaugcugagaccuccccagccucccgucuaucuguucguguuugacgucagccauaacgccguggaaacgggcuaccuuaauuccguuugucaaagccuccuggauaaccuggaccuccugcccgggaauacccggacaaaaauuggcuucaucaccuucgauucuacaauucacuuuuauggacuucaggagucccugagccagccgcaaaugcucaucguguccgacauugaagaugucuucauccccaugccugagaaccugcuggugaaucuuaacgagucuaaggaaagcguuaucggcguguccucugaggaaacccucauuacgugccuggagaucgccaugagauga

SEQ ID NO: 75344 - RNA, 3702 nt, Artificial Sequence
  derived and/or modified sequence opt5 from SEC24B__Homo_sapiens__NP_001036199
augagcgcccccgcuggcuccucucacccugccgcgagcgcuagaaucccgcccaaguucgggggagccgccguguccggcgcugccgcuccugccgggcccggagcgggcccugcuccccaucagcaaaacgggccugcccagaaucagaugcaggucccgucuggauacggccugcaccaucaaaacuauauugcccccagcggccacuacucccaggggccuggaaaaaugaccucucucccccuggacacacagugcggcgauuauuacagcgcucuuuauacgguuccuacccagaaugugacacccaacaccgugaaucaacagccgggggcccagcagcuguacucccggggaccucccgcgccucauaucgucggcagcacacucgggucuuuucaaggagccgcuuccagcgccucucaccuucacaccuccgcuagccagcccuauucuuccuucgugaaccauuacaauagccccgccauguacuccgccucuagcuccguugcuagccagggcuuuccuucuacauguggccacuaugcgauguccaccgugagcaacgccgcuuacccgucugucagcuaucccucccuuccugccggggacacguacggacaaauguucaccucucagaaugcccccacagugcgcccuguuaaggauaacagcuuuuccggccagaauaccgcuauuagccaucccucuccgcugccuccccucccuucccagcaacaccaccagcagcagagccugucuggguauuccacacugaccuggagcucccccggacucccuucuacgcaagacaaccugaucagaaaucauacaggcagccuugccguggcgaacaauaaccccaccauuacagucgcugauucccugucuugcccggugaugcagaacgugcagccucccaaaagcucccccgucguuagcaccgugcucucuggguccagcggaucuuccagcacccggacaccuccgacggccaaucaccccguggagccugucaccucugugacacagcccagcgaacugcuucaacagaagggcguugacuccagcucuaccacauccagcgccuccccuaugcccaacucuuacgaugcucuggagggcgggagcuauccugacaugcucuccucuagcgccuccucucccgcuccggauccugcccccgaaccugaccccgcgagcgccccggcuccugccuccgcucccgccccuguggucccccagcccagcaaaauggcgaagccuuucggauacggcuacccgacccugcagcccggguaucaaaaugccacggcuccucugaucucuggagugcagcccuccaacccuguuuacagcggcuuucagcaauauccccagcaguacccuggggugaaucagcucucuuccagcaucggcggacugucucuucaauccagcccgcagcccgagucccugcgcccugucaaccucacacaggaaagaaauauucugcccaugaccccugugugggcccccgucccgaaccuuaaugcugaucugaagaaacucaacuguagcccugacucuuuccggugcacccugacaaauaucccccagacccaagcccugcucaacaaggccaaacugccccuuggccugcuccugcauccuuuucgcgaucuuacacagcugcccgugauuacgagcaauaccaucguuagaugucgguccugccgcacauauauuaacccuuucgugucuuuuaucgaccagagacgguggaaguguaaucucugcuaccgcgucaacgacgugccggaggaguucauguauaacccccugaccagaagcuacggggaaccucacaaacggcccgagguucaaaauuccacaguggaauuuauugcuucuagcgauuacaugcugcgcccuccccagccggcggucuaucucuucgugcuggacgugucccauaacgccguugaggcuggauaccuuaccauccugugucagucucuccuggagaaucuggauaagcugccuggcgacagcagaacgcggaucggguucaugaccuuugauuccacaauucacuucuauaaccuccaggaaggacugagccaaccccagaugcugaucgucucugacauugaugacguguuucucccuacccccgauucccugcuugugaaucuguacgagagcaaggaacucaucaaagaccugcugaacgcccuuccuaauauguucacaaacaccagagagacgcacucugcccucggccccgcucugcaggccgcguuuaagcugauguccccgacagggggccgcgucagcguguuccagacccaacucccuucccugggagcuggccuucugcagucucgggaagaucccaaucagagaagcuccacaaaaguugugcagcaucucgggcccgccaccgacuuuuauaagaaacuggcccuggacugcagcggacaacagaccgcugucgaucuuuuccuccugucuucccaguacagcgaccuggccucucucgcguguaugagcaaguauuccgcuggcugcauuuacuacuauccuucuuuucacuacacacauaacccgagccaggccgagaaacugcaaaaggaucuuaagcgcuaucugacgcggaaaaucggguucgaggccgugaugagaauccgcugcaccaagggacucuccaugcacacauuucacggcaauuucuuuguucggucuaccgaccugcugagccuugcuaacauuaaucccgaugccggguucgcugugcagcucuccaucgaagagagccugacagacaccucucuggucuguuuccagacggcccuccuguacacauccagcaaaggcgaaagacgcauucgggugcauacccuuugccugccuguuguguccucucucgcggaugucuaugccggaguggacgugcaggcugccaucugucugcuggcuaacauggccgucgauagaagcguuuccucuagccuuuccgacgcccgcgaugcucuggugaaugcgguggucgacagccucucugccuacggcuccaccgugagcaaccugcaacacucugcucucauggcccccuccagccugaagcuguuuccucuguauguucucgcccugcugaaacagaaggcuuuccggacagggaccucuacaagacuugaugaccggguguacgccaugugccagauuaagagccaaccccugguccaucucaugaaaaugauccacccuaaccuguaccgcaucgacagacucacggaugagggagcggugcauguuaaugaccggauugugccgcagcccccucugcagaaacuuuccgcugaaaagcugaccagagagggcgccuuucucauggauugugggucugucuucuauaucugggugggaaagggcugcgacaacaauuuuauugaggauguucugggguacacaaacuucgccagcaucccccagaaaaugacccaccuuccugaacuugacacacuguccagcgagcgcgcucgguccuuuauuaccuggcucagagauucucgcccccugagcccgauccuccacauugugaaggacgaauccccugccaaggcggaguucuuucaacaucugaucgaagauagaacggaggcugccuucucuuauuacgaguuucuucugcacguccagcagcagaucuguaaauga

SEQ ID NO: 75345 - RNA, 3285 nt, Artificial Sequence
  derived and/or modified sequence opt5 from SEC24C__Homo_sapiens__NP_940999
augaacgugaaucagagcguucccccugucccgcccuucggccaaccucagcccaucuacccuggguaucaccaguccucuuacggaggccagagcggguccaccgcccccgcuauuccuuauggagccuacaacggcccggugcccggguaucaacagacaccuccccagggaaugucuagagcgccucccagcuccggcgcuccgccugccucuacggcccaggcucccugcggccaagccgcuuacgggcaguuuggacagggcgacgugcagaaugggccuagcuccaccguccaaaugcagcggcugcccggaagccagcccuucggcucuccucucgccccgguggggaaccaacccccuguucugcagcccuauggaccucccccgacauccgcccagguggcgacccagcuuagcggcaugcaaaucucuggcgcugucgccccugcucccccuuccagcgggcugggauuugggcccccuacaucucucgccuccgcgagcggcuccuuccccaauucuggacuguacggcagcuacccgcaggggcaggccccuccccuuucccaggcucaaggacaucccggcauucagaccccucagcgcagcgccccgucucaggcuuccagcuuuacacccccugccucuggcgggcccagacugccuagcaugaccggaccccuccugccuggccaauccuucgggggacccucugugagccagccgaaccacguuuccagcccuccccaggcccugccucccggcacgcagaugaccgggccgcucggcccucugcccccuaugcauucuccccaacagcccggauaucagccucaacagaauggcuccuuugggccggcucggggaccccagagcaacuacggcgggccuuaucccgcggccccuacauucggaucucagcccggcccuccgcaaccccuuccucccaagcgccuggauccugacgcuauccccuccccgauucaggugaucgaggaugacagaaauaaccgggggaccgaaccuuuugucacaggcgugcgcggacaggugccuccccucgucaccacgaauuuccugguuaaagaucagggcaacgccagccccagauacauccgguguacauccuauaauauucccugcaccucugacauggccaagcaagcucaggugccucuugccgcggugaucaaaccgcuggcucgccugcccccugaggaagccagccccuacgucguggaucacggggaguccggaccucucagauguaaccggugcaaggccuauaugugucccuuuaugcaguucauugaaggcgggcgcagauuucagugcuguuucugcucuuguaucaaugacguuccgccucaauacuuccagcaucuggaucacacaggaaaacggguggacgcuuacgaucgccccgagcucagccugggcuccuaugaguuucuugccaccgucgacuacugcaagaacaacaaguucccuucucccccugcuuuuauuuucaugaucgaugugagcuauaaugccauuagaaccgggcugguucggcuccugugugaggaacuuaaaucccugcucgacuuucugcccagagaaggcggagcggaggagagcgccauccgcgugggcuucgucacauacaacaaggugcugcacuuuuauaaugucaaaucuucccucgcucagccgcaaaugauggugguuagcgacguggccgauauguucgucccucugcuugacggguuucuggugaacguuaaugaaucucgggcugugaucacgagccuccuggaucagauucccgagauguucgccgacaccagagaaacagagaccgucuuugugcccgugauccaggcgggaauggaagcccuuaaggcugccgagugcgcuggcaaacuguuccucuuucauacaucccugccuauugccgaggccccggggaagcugaagaaccgcgaugaccggaaacucaucaauaccgauaaggagaaaacgcuguuccagccccaaacaggagcuuaccagacccuugcgaaggaaugcguugcccagggcuguugcgucgaccuguuccucuuuccuaaccaguauguggauguggcuacccugagcgucgugccccaacugacagggggcucuguuuacaaauacgccuccuuccagguggaaaaugaccaggagagauuucuuagcgaucuccgccgggacguccagaaggugguuggauucgacgccgugaugagaguccgcaccuccacaggcauucgggcuguggacuuuuucggggccuuuuauaugucuaacacgaccgauguugaacuggcgggacuggauggcgacaaaacagugaccgucgaguucaagcacgaugacagacucaaugaggaaagcggggcucugcuucaaugugcccugcucuacacauccugcgccggacagcgccggcugagaauccauaaccuggcucuuaauuguugcacccagcucgccgaucuguaucggaacugugagacggacacccugaucaauuacauggcgaaguuugcuuaucgcggcgugcucaacucuccugugaaagccgucagagauacacugauuacccagugcgcccaaauccuugcuuguuaccggaagaacugcgccagccccuccucugcuggccagcugauucucccugaauguaugaaacugcugccgguuuaucuuaauugcgugcucaagagcgacgugcugcagcccggggccgaggucacaaccgaugacagagcguacgugcgccaacugguuacguccauggaugugacagaaaccaacgucuucuuuuacccucggcuccugccccuuacaaaaagcccuguggagucuaccaccgagcccccggccguuagagcuuccgaggaacgccugagcaauggagacaucuaucuccuggaaaacggccugaaucuuuuccucugggugggggccucuguccagcagggagugguucagucccuguuuagcgugucuuccuucagccaaauuacauccggccugagcguccucccugugcuggacaacccccuuucuaagaaggugagagggcugaucgauagccuccgggcucagcgcuccagauacaugaaacugacggucguuaagcaggaggacaaaauggagaugcuguucaagcacuuucuuguggaagauaaaucucugagcggaggcgccuccuauguggacuuccucugccacaugcauaaggagauccggcagcugcucucuuga

SEQ ID NO: 75346 - RNA, 3321 nt, Artificial Sequence
  derived and/or modified sequence opt5 from SEC31A__Homo_sapiens__NP_001070674
augaagcugaaagagguggacagaaccgccaugcaggcuuggagccccgcccaaaaccacccuaucuaccucgcgacaggcacguccgcucagcagcuggaugccaccuucucuacaaaugccagccuugaaauuuuugagcuggaccucuccgauccgucucuggacaugaaaagcugcgcuaccuucuccucuagccaucgguaucacaaacuuaucugggggcccuacaagauggauuccaaaggagacgucagcggcguucugauugccgggggagaaaacggcaauaucauucucuaugauccuucuaagaucaucgcuggggacaaggagguggugauugcccagaacgauaaacauacaggacccguccgcgcgcuggacgugaauaucuuucaaaccaaccugguugccuccggcgcuaaugaaagcgagauuuacaucugggaucucaacaauuucgccacaccuaugacccccggcgcuaagacgcagccuccggaggacauuucuuguaucgccuggaacagacaggugcagcacauucuggcguccgccagccccucugggcgggcuaccgucugggaucuucgcaaaaaugaaccuaucaucaagguguccgaccauagcaacagaaugcacugcuccggacuggccuggcaccccgacguugcuacacaaauggugcucgccucugaggaugaccggcugccugucauucagaugugggaucuucgcuuugccagcagcccccugagagugcucgaaaaucaugcucggggcauccuggcgauugccugguccauggcugacccggagcugcuccugucuugugggaaagaugccaagauccuuugcuccaacccuaauaccggagaggugcuguaugaacuccccacaaacacccagugguguuucgacauucaguggugcccucgcaaccccgccguccugagcgcugccucuuuugauggcagaaucagcguuuacuccaucaugggagggucuacggacggccuucggcaaaaacagguggauaaacugagcuccagcuucggcaaucucgaccccuuugggacaggacagccucugccgccccugcaaauuccucagcagaccgcgcagcacucuaucgugcucccccugaagaaaccucccaaguggauucgcagaccggucggcgcuuccuucagcuuugggggaaaacuugugacauucgagaacguucggaugccuucucaucaaggcgccgaacagcagcagcaacagcaccacguguuuaucucccaggucgugaccgagaaggaguuccugagccgcuccgaucagcuccaacaggccguucagucucagggguucauuaauuauugucaaaagaagaucgacgcuagccagaccgaauuugagaagaacgugugguccuuccugaaagucaauuuugaagacgauucuagaggaaaguaccuugagcugcucggcuaccggaaagaagaccugggcaagaaaaucgcccuggcucucaacaagguggauggggccaaugucgcgcugaaggacagcgaucagguggcccaauccgacggagaggaaagccccgcugccgaggagcagcuucugggcgaacauauuaaagaggaaaaggaggaaucugaguuccucccuuccagcgggggaacauuuaacaucucuguuuccggcgauauugacgggcugaucacgcaggcucugcuuaccggcaauuucgagagcgccguggaucucugccugcacgacaacagaauggcggaugccauuauccuggcuauugccggaggccaggaacuccuggcucgcacacaaaagaaguauuuugccaaaucucagagcaagaucacccggcuuaucacagccgucgugaugaagaauuggaaagagauuguugaauccugugaccugaagaacuggagagaggcucucgcggccgugcugaccuacgcuaaacccgaugaguucagcgcccugugcgaccuucucgggacgcgccuggaaaaugagggagacucucugcuccagacacaggccugucugugcuauaucugcgcuggcaacgucgaaaaacuuguggccuguuggaccaaggcgcaagaugggucccauccucugagccuccaggaccugauugagaaggugguuauccugcggaaggcuguccagcuuacccaggccauggauacauccaccgugggagugcuccuggccgcuaaaaugucucaauacgccaaucugcucgcggcucagggcagcauugccgccgcucuggccuuucuucccgacaacacaaaccagccgaauaucaugcaacugagagaucgccucugccgggcucagggggaaccugucgccggccacgagucccccaagauccccuaugagaaacagcagcugccuaagggaagaccgggccccguggcggggcaucaccaaaugccucgcguucagacgcagcaguacuauccccacggagaaaacccucccccucccggcuucauuaugcaugggaaugugaacccgaaugccgcuggacaacugccuaccucucccggccacaugcauacacaggucccucccuacccgcagccucagcggccccaaaacggguggaaugacccucccgcccuuaacagagugcccaaaaagaaaaagaugccugagaauuuuaugccgcccguuccuaucaccagccccauuaugaacccucucggcgauccccagucccagaugcugcagcaacagccuucugcuccggugccccugagcucccagagcucuuucccucaaccccaccucccuggaggccagcccuuucacgggguccagcagccgcugggacaaacaggcaugccucccuccuucagcaagcccaauaucgaaggggccccuggagcccccauuggcaacaccuuccagcaugugcagucucuuccuacgaaaaagaucaccaaaaagccgauccccgacgagcaccugauucucaaaacaaccuuugaagaucugauccagcgcugucuguccagcgcuacagacccucaaaccaagcggaaacuugaugacgcgucuaagagacuggaguuccucuacgauaagcugcgggagcagacgcucucccccacaauuaccagcgggcugcauaauaucgcccgcuccauugaaacaagaaacuauagcgagggccuuaccaugcacacccauaucguuucuacaagcaauuuuuccgaaacgucugcuuucaugccugugcugaaagucgugcucacccaggccaacaagcugggaguguga

SEQ ID NO: 75347 - RNA, 1431 nt, Artificial Sequence
  derived and/or modified sequence opt5 from SEC61A1__Homo_sapiens__NP_037468
auggccaucaaguuccuggaggugauuaaacccuuuugcgucauccucccugaaauucagaagccggagagaaaaauccaauucaaggaaaaaguucuguggaccgcuauuacacuuuuuaucuuccugguguguugccagaucccccucuuuggcauuaugagcuccgacucugccgauccuuucuacuggaugcgggugauccuggcgagcaaccgcgggacgcuuauggagcugggaauuucccccaucgucaccucuggccucauuaugcagcugcuggcuggggccaagaucauugaagugggagacacaccuaaggauagagcccucuuuaauggcgcucagaaacuguucgggaugaucaucaccauuggacaaagcaucguuuaugugaugacaggcauguacggcgaccccuccgagaugggggccggaauuugucuucugaucaccauucagcucuuugucgcuggccugaucgugcuucugcucgaugagcugcugcagaagggguauggacucggcucugggaucagccuguucauugccacaaacaucugcgaaaccauuguuuggaaagcguuuuccccuacgaccgugaauacaggacggggcauggaguucgaaggcgccaucauugcucuuuuucaucugcucgccacccgcacagacaaggucagagcucugcgggaggccuucuaccgccagaaccuuccgaaucugaugaaccucaucgcgaccaucuucguguuugccguggucauuuauuuccaaggguuuagaguugaucugcccaucaaaagcgcucgguaccgcggacaguauaauacguacccuauuaagcuguucuacacaucuaacauccccauuauccuccaguccgcccuggugagcaaucuuuaugugauuucucagaugcuguccgcuagauuuagcggcaaccuccuggucucucuucuggggaccugguccgacacaagcuccggaggcccugcccgggccuaccccguugggggacucuguuauuaccugucuccgccugagagcuucggcuccgugcuggaagaucccgugcacgcugucguguauaucguuuuuaugcucggcagcugcgcguucuuuucuaagaccuggaucgagguguccgggagcucugccaaagacgucgcuaagcaacugaaagaacagcagauggugaugcgcggacacagagagaccagcaugguccaugaacuuaaucgguacauuccuacagccgccgcuuucggcgggcuguguaucggagcccucuccgugcuggcggauuuucugggcgcuauugggucuggcacgggaauccuucucgccguuaccauuaucuaucaauacuucgagaucuuugugaaggagcagagcgaagucggcuccaugggggcccugcuguucuga

SEQ ID NO: 75348 - RNA, 207 nt, Artificial Sequence
  derived and/or modified sequence opt5 from SEC61G__Homo_sapiens__NP_055117
auggaccaggugaugcaauucgucgaacccagcagacaguuuguuaaggauuccauccggcuggugaaacgcugcaccaagccugacagaaaagaguuccagaagauugccauggcuacagccaucggcuuugcgauuaugggguucaucggauuuuucgugaaacucauucacaucccgaucaacaauauuaucgucggcggguga

SEQ ID NO: 75349 - RNA, 1200 nt, Artificial Sequence
  derived and/or modified sequence opt5 from SEC62__Homo_sapiens__NP_003253
auggccgagagacggcgccacaagaaaagaauccaggaagugggcgagcccagcaaggaagagaaagcugucgccaaguaccugcgguucaacugcccuaccaaauccacaaauaugauggggcaucgcguugacuauuuuauugcgucuaaggcuguggauugucuccuggacagcaagugggccaaagccaagaaaggagaagaggcucuuuucacgaccagagaguccguggucgauuacugcaaccggcugcucaagaaacaauuuuuccaccgcgcccugaaggugaugaagaugaaauaugacaaggauaucaaaaaggaaaaagacaagggcaaagcugagucugggaaggaagaggauaagaaaagcaagaaagagaauauuaaggacgaaaagacaaagaaggagaaagaaaagaaaaaggauggagagaaagaagaguccaagaaggaggaaaccccgggcacacccaaaaagaaagagaccaagaaaaaguuuaaacuugaaccucaugacgaucagguuuuccuggacgggaacgagguguacgucuggaucuaugaucccgugcacuuuaaaacauucguuaugggacucauucuggugaucgccgucaucgcggccacccuguuuccucucuggcccgcugaaaugagagugggcguguacuaucugucugucggcgccggguguuucguugcuagcauucuucugcucgccguggcgcggugcauccuguuucuuauuaucuggcugauuacgggaggccgccaucacuucugguuucucccuaaucugaccgccgacgugggguucaucgacuccuucagaccgcuguacacacacgaguacaagggacccaaagcugaucucaagaaagacgaaaagagcgaaaccaaaaagcagcagaagucugauuccgaggagaaaagcgacucugagaagaaagaagaugaggagggcaaggucgggccuggaaaccauggcacagaaggcuccgggggagagcggcacagcgacaccgauucugaccgcagagaagaugaccggucccaacauagcuccggcaaugggaacgauuuugagaugauuacgaaagaggaacuggagcagcagacagacggagacugugaagaggaugaagaggaggaaaaugacggcgagacccccaagucuagccacgaaaaguccuga

SEQ ID NO: 75350 - RNA, 2283 nt, Artificial Sequence
  derived and/or modified sequence opt5 from SEC63__Homo_sapiens__NP_009145
auggccggccagcaauuccaguacgacgauagcgggaacaccuuuuucuauuuucugacauccuucgugggacucaucgucauucccgcuacguacuaucuguggccuagagaccagaaugccgagcagauccggcuuaagaacauucgcaaaguuuacggcagaugcaugugguaucggcugcgccuccugaagccgcaacccaauaucauuccuaccgugaaaaagaucgugcuucuggcggggugggcucucuuucuguuccuggccuacaaagucucuaagacagauagagaauaucaggaguacaaccccuacgaagugcucaaucuggacccuggagccaccguugcugagaucaagaaacaguaucggcuucugagccucaaguaccaccccgauaaaggcggggacgaagugauguuuaugcgcauugccaaggcuuaugccgcgcugacagaugaggaguccagaaagaacugggaagaguucggaaauccugacggcccgcaggccaccucuuuuggcaucgcccuucccgcuuggauugucgaucaaaagaacagcauccuggugcuccugguuuacgggcuggcuuucauggugauucucccugucguggugggauccuggugguaucggucuauccgcuacagcggcgaccagauucugaucagaacaacccagaucuauacguacuuugucuacaagacccggaauauggauaugaaacgccuuauuaugguucuggccggggcguccgaguucgacccccaguauaacaaggaugccacaagcagaccuaccgacaauauccucauuccccaacugauccgggagauuggaucuaucaaccuuaaaaagaaugagccgccucugacaugucccuacucccucaaagcucgcgugcugcugcucagccaucuggccagaaugaagaucccugaaacccuugaggaagaccagcaguuuaugcugaaaaagugccccgcucuccugcaagagauggugaacgucauuugucagcuuaucgugauggcccggaauagagaagaacgcgaguuccgggcccccacgcuggcuucucucgaaaacugcaugaagcugucccagauggcgguucagggccugcaacaguucaaaagcccucuccugcagcuuccgcacauugaggaagauaaccugagacgcgugucuaaucauaagaaauauaagaucaaaacaauucaggaccucgucucccugaaggagagcgaucggcacacccugcuucauuuucucgaagacgagaaguacgaggaagugauggccguucugggguccuuccccuaugugacaauggauaucaaaucucaaguccuggacgaugaggacagcaacaauaucaccgugggaucccucgucaccgugcugguuaaacuuacaagacagacgauggcugaaguguuugagaaagaacagagcauuugugccgccgaggagcagccugcugaagauggccaaggcgagaccaacaagaaucgcacaaaagggggauggcagcagaagucuaagggccccaaaaagaccgccaaauccaagaaaaagaagccucugaaaaagaaacccacaccgguccuccugccucagagcaagcaacagaaacagaagcaagcgaacggggugguuggaaaugaagcugccgugaaagaggacgaggaagaggucucugauaagggcagcgacuccgaagaggaagagaccaaccgggacucucagagcgagaaggaugacggguccgauagagacagcgaucgcgaacaggacgagaaacagaauaaggaugacgaagccgaguggcaagaacugcagcagucuauccagcggaaagagagagcccuucucgagacgaaguccaaaauuacacaccccguguacagccuguauuucccugaagagaagcaagaauggugguggcuguacaucgcugaucgcaaggagcagacccucauuucuaugcccuaccacgugugcacccugaaagacacagaagagguugagcuuaaguuuccugcucccggaaaaccgggcaacuaucaguacaccgucuuccugcgguccgauagcuauaugggccucgaccagaucaagccucugaaacuggaagugcaugaggccaagcccgugcccgaaaaucacccucaaugggauacagcgauugagggggacgaggaccaggaagauuccgagggauuugaagacucuuucgaggaagaggaggaagaggaagaggaugacgauuga

SEQ ID NO: 75351 - RNA, 2565 nt, Artificial Sequence
  derived and/or modified sequence opt5 from SECISBP2__Homo_sapiens__NP_076982
auggccagcgagggccccagagaaccugaguccgaagggaucaagcugucugcugacgugaaaccguucgucccccgguuugccggacucaacguugcguggcuggagagcuccgaggcuugcguguucccuucuagcgccgccaccuacuaucccuuugugcaggaaccucccgucacagagcaaaagauuuacacggaagauauggcuuucggcgccuccaccuuuccuccgcaguaucuuucuagcgagaucacacugcaccccuacgcuuauuccccuuacacccucgacagcacacagaauguguauucuguucccgggucccaguaccuguacaaccaaccuagcuguuaucgcggauuccagaccgugaaacauagaaaugaaaacacaugcccccuuccgcaggagaugaaggcccuguuuaaaaagaagaccuacgaugagaaaaagacguaugaccagcaaaaauucgauucugaacgggcggacggcaccauuuccagcgagaucaagucugcccgcgggucccaccaucucagcauuuacgcugaaaauucccugaaaucugauggauaucacaagagaacagaccgcaagagccggaucaucgccaaaaacgucuccaccagcaagccugaguuugaguucacaacccuggauuuucccgaacuccagggcgcugagaauaacaugucugaaauucagaaacagccuaaguggggccccgugcauuccguuagcacggacaucucucugcuuagagagguggucaaacccgccgcggugcugagcaagggggaaauuguggucaaaaauaacccuaaugaguccguuacagccaacgcugccaccaauucuccgagcuguacacgggaacucuccuggacccccaugggauacguggugcgccaaacccugagcacagagcuuucugcugccccuaagaacgucacguccaugaucaaucugaagaccauugccagcucugcugaucccaaaaacguguccaucccuagcuccgaggcgcucucuagcgaccccuccuauaacaaggaaaaacacauuauccacccgacacagaagucuaaagccagccagggcuccgaucuggagcaaaaugaagcuagcagaaagaacaagaaaaagaaagagaagucuaccuccaaauacgaaguucugacagugcaggagccuccccggaucgaggacgccgaagaguucccuaaucucgccgucgcuagcgaacgcagagaccggauugagacccccaaguuucagucuaagcagcaaccucaggauaacuucaaaaauaacgugaagaaaucccagcugcccguucagcuugaccucgggggaaugcugacggcccuggagaagaaacaacauagccagcacgcgaagcagucuagcaagccgguggucguguccgucggcgcugugccuguucuuagcaaagaaugcgccucuggggagcgcggaagacggaugucccagaugaagacaccccauaauccccuggauagcuccgccccucucaugaaaaagggcaaacaaagagaaaucccgaaggcuaaaaagcccaccucucugaagaaaauuauccugaaggagcgccaggaacggaaacagagacuccaggagaacgccgugagcccugcuuucaccuccgacgauacacaagacggcgagucugggggagaugaccaguuucccgaacaggccgagcugagcggcccugaagggauggaugagcuuauuuccacccccucugucgaagacaagagcgaggagccucccggaacagaacugcaacgcgauacggaggcgucccaccucgccccgaaucacaccacauucccuaaaauccauagccggagauuucgcgacuacuguucucagaugcuguccaaggaaguggacgcuugcguuaccgaucuucugaaggagcucgugcgguuccaggacagaauguaucagaaagaucccgucaaggccaaaacaaagcgccggcuggugcugggccucagagaagugcugaaacaccuuaagcugaagaaacucaaguguguuaucauuagcccuaacugcgagaaaauccaaucuaaagggggacuggacgauacccugcauacgauuaucgacuacgcuugugagcagaauauucccuuugucuucgcccuuaaccgcaaggcgcucggccggucccugaauaaggccgugccggugagcgucgugggcaucuuuucuuaugauggggcucaggaccaguuccacaagaugguugaacugaccguggccgcuagacaagccuacaaaacaaugcucgagaacguccagcaggaacuggugggagagccucggccccaggccccucccucccuucccacccaaggcccuagcugcccggcugaggaugggcccccugcgcugaaggaaaaagaggaaccccauuauaucgagauuuggaagaaacaccucgaagccuacuccggauguacacuggagcuggaggaaagccuugaggcuucuaccagccagaugaugaaucucaaccuguga

SEQ ID NO: 75352 - RNA, 3306 nt, Artificial Sequence
  derived and/or modified sequence opt5 from SECISBP2L__Homo_sapiens__NP_001180418
auggacagagcccccaccgagcagaacgugaagcugagcgcugaagucgagccuuucaucccgcagaaaaagucccccgauacauuuaugauuccuauggcccuccccaaugacaacggcucuguuagcgggguggaaccuacgcccaucccuuccuaccugauuaccugcuauccguucgugcaggagaaucagucuaaccggcaguuuccccuuuacaauaacgauauccgcuggcaacagccuaaucccaacccuacaggacccuauuucgcguacccgauuaucagcgcucagccucccgucuccaccgaauauacauacuaucagcugaugccugcccccugugcccaagugaugggcuuuuaccaccccuucccuaccccguacucuaauacauuucaggcugccaacaccguuaaugcuaucacgaccgagugcacagagagacccagccagcucgggcaaguguucccucuguccagccaucggucucgcaacuccaauagaggaagcgucgugcccaaacaacagcuucugcagcaacacauuaagucuaaacggccucucguuaagaacguggccacccagaaggaaacaaaugcggccggccccgacucccgcagcaaaaucguccugcugguggaugcuucucagcagaccgacuuuccguccgauauugccaacaagagccucuccgagacgacagcuaccaugcuguggaaaucuaaggggagacggcgcagagccagccauccuacagcggaauccagcucugagcaaggagccuccgaggcugacaucgauagcgacucuggcuauuguagccccaaacacuccaacaaucagccugccgcuggcgcccuucggaaccccgauucugggaccaugaaucauguggaaagcuccaugugcgccggaggcgucaacuggagcaauguuaccugucaggcuacacagaagaagccuuggauggagaaaaaccaaacguucucucgcgggggaagacagaccgaacagcggaauaacucccaggugggcuuucgcugcagagggcacagcacaucuuccgagcggagacaaaaucugcagaagcgccccgacaacaaacaccucagcuccucucagagccaucgguccgaucccaauucugaaagccuguacuucgaggacgaggacggauuucaggaacuuaacgagaauggcaacgcgaaggaugaaaauauucaacagaaacuguccagcaaggugcucgacgaucugccugagaacucucccaucaacauuguccagacccccaucccuaucacaaccuccgugccgaaaagagccaagagccaaaagaaaaaggcucuggccgccgcucucgccacggcgcaggaauauucugagauuuccauggagcagaaaaagcugcaggaagcucuuagcaaagccgccggcaagaagaauaaaacacccguucaacuggaccucggggauaugcuggcugcccuugagaagcagcagcaggcuaugaaagcccgccaaaucaccaacacccggccucugucuuacacaguggucaccgcggccagcuuccacacaaaggacuccacgaauagaaaaccccucaccaagagccagccuugucugacaucuuucaacuccguggauauugcuagcuccaaggccaaaaagggaaaagaaaaggagaucgcuaaacugaagcgccccaccgcccucaagaaaguuauucugaaggaacgggaggagaaaaagggcagacuuacaguggaccauaaucugcucgggucugaggaaccuaccgaaaugcaccuggauuuuaucgacgaucuuccccaggagaucgucagccaggaggacacgggacuguccaugccgucugacaccagccucuccccugcgucucaaaacagccccuauugcaugacaccugugucccagggcagccccgccucuuccgggauuggaagcccgauggcuucuuccaccaucacaaaaauucacagcaagcgcuuccgggaauacuguaaucagguccugugcaaagagaucgaugaaugugugacccugcuccugcaagagcuuguuucuuuucaggaaagaauuuaucagaaggacccugugcgcgccaaggcucggagacggcuggucaugggccuccgcgaggugacgaaacauaugaagcugaacaaaaucaagugcguuaucauuucccccaauugcgagaaaauccagagcaagggcgggcuggaugaagcccuuuacaacgugauugccauggcuagagagcaagaaaucccuuucgucuuugcgcucggacggaaggcccugggcagaugugugaauaaacuggugcccguuuccgucguggggauuuucaacuacuuuggagcugagagccucuucaauaagcugguggaacuuacagaggaggcccgcaaagccuauaaggacauggucgcugccauggaacaggagcaggcggaagaggcucugaaaaacgugaagaagguuccccaccauaugggccacucucggaauccuagcgccgccuccgcuaucucuuuuugcagcgugauuuccgaaccgaucucugaggucaacgagaaagaauacgagaccaacuggagaaauaugguggaaacaagcgaugggcucgaggccuccgagaacgaaaaggagguuucuuguaaacauagcaccuccgaaaagcccagcaaacugccuuucgacaccccgccuaucggcaagcagcccucucugguggcgacaggauccacgaccagcgcuacaucugccggcaaguccaccgccagcgauaaagaggaagucaagccugacgaucuugagugggcuucccaacagucuacagagaccgggagccucgacggauccugccgcgaucugcugaauagcucuauuacguccacaaccagcacccucgugccgggcaugcuggaagaggaagaggacgaagaugaggaggaagaggaagacuauacacacgagcccaucucuguugaagugcagcuuaacagcagaauugaguccugggucucugagacccagcggacaauggaaacgcugcaacucgggaaaacccugaauggaagcgaggaagacaacguggagcaguccggcgaggaagaggccgaagcuccugaggugcuggaacccgggauggauucugaggccuggacagcggaccagcaggccagcccuggccaacagaaguccagcaauuguucuucccuuaacaaagagcacagcgauuccaauuacaccacacagaccacguga

SEQ ID NO: 75353 - RNA, 747 nt, Artificial Sequence
  derived and/or modified sequence opt5 from SECTM1__Homo_sapiens__NP_002995
augcagaccugcccccuggccuucccuggccacgugagccaagcucucgggacacugcuuuuucuggccgcgucccucucugcucagaacgagggaugggacagcccgaucuguacggaaggcgucguuuccgugucuuggggagagaauaccgugaugagcugcaacauuuccaaugccuucucucaugucaacaucaagcugagagcccacgggcaggaaagcgcuauuuuuaaugagguggcccccggcuacuucucccgggauggguggcagcuucaaguucagggaggcguggcucagcuggucaucaaaggcgcccgcgacagccaugcggggcucuauauguggcaccuggugggacaucagagaaacaaucggcaaguuacacuggaagugucuggcgccgagccucaguccgcucccgauaccggguuuuggccuguccccgccguggugacagcugucuucauucuccugguugcccuugugauguuugcgugguaccgcuguagaugcagccagcagcggcgcgagaagaaauucuuucugcucgaaccucaaaugaagguggccgcucugagagccggagcucagcagggccuuucucgggccuccgccgagcuguggaccccggacagcgaacccacaccucgcccccucgcucuggucuucaaaccuucuccccugggggcgcucgagcugcuuuccccgcaaccucuguuucccuaugccgcugauccuuga

SEQ ID NO: 75354 - RNA, 906 nt, Artificial Sequence
  derived and/or modified sequence opt5 from SEL1L__Homo_sapiens__NP_001231913
augagagugcggaucggccugacccuccugcuuugcgccguccugcucagccuggcuuccgccucuagcgacgaggaagggucccaggaugagucucuugacagcaagacaacgcugaccuccgaugaaucuguuaaagaccacacaaccgcgggacgcgugguggcuggccaaauuuuccucgauagcgaggaauccgagcuggagagcucuauccaggaagaggaagacucccucaagagccaggagggggagucugucacagaagauauuuccuuucuggagagccccaacccugaaaauaaagacuacgaggaaccgaagaaagugagaaagcccgcccugaccgccaucgagggaacagcucauggcgagccuugucacuuccccuuucuuuuccuggauaaggaauaugacgagugcaccucugaugggcgggaagacggacgccucuggugugccacgaccuacgauuauaaagcugacgagaaguggggcuuuugcgaaacagaggaggaagccgcgaaaagacggcagaugcaagaggccgaaaugauguaccagaccggcaugaagauucugaacggguccaauaaaaagagccagaagcgcgaggcuuauagauaccuucagaaagccgcuuccaugaaccauacaaaggcccuggaacggguuucuuaugcgcuccuguucggagacuaccugccucaaaauauccaggccgcucgcgagauguuugagaaacucaccgaagagggcagccccaaggggcagacggcccugggauuccuuuacgcuuccggccugggggugaacagcucucaggccaaagcccucgucuauuacacauuuggagcucugggcggcaaucuuaucgcgcacauggugcugguuuccagacucuga

SEQ ID NO: 75355 - RNA, 1833 nt, Artificial Sequence
  derived and/or modified sequence opt5 from SELE__Homo_sapiens__NP_000441
augaucgccagccaguuccuguccgcucucacccuggugcuucugauuaaggagucuggcgccuggagcuacaacacauccacggaagcgaugaccuaugacgaggcuucugccuacugccaacagagauauacacaccucgucgccauccagaauaaagaagagauugaauaccugaacagcauccuuuccuauucucccagcuacuauuggauugggauccggaagguuaauaacgugugggugugggucggaacccagaaaccucugacagaggaggcuaagaauugggccccgggcgaacccaacaaucgccaaaaagaugaggacuguguggaaaucuacauuaagagagagaaggauguugggauguggaacgacgagcggugcuccaaaaagaaacucgcucuguguuacaccgccgcgugcacaaauaccagcuguucuggacauggcgaaugcguggagacgaucaacaauuauaccuguaagugcgauccuggguuuuccggacugaaaugugaacagauugucaacugcacagcccucgagagccccgaacacggcucucugguguguucccauccucuuggcaauuucagcuacaacucuuccugcagcaucuccugcgaccgcggguaucugcccucuagcauggagaccaugcaguguauguccagcggagaguggucugcuccuauuccggccugcaauguuguggaaugugaugcugucacaaaccccgccaacggcuuuguggagugcuuccagaauccuggguccuuucccuggaacaccacguguacauucgacugcgaagagggauuugaacucaugggcgcgcaaagccugcaguguaccucuagcgggaauugggauaacgagaagccuacaugcaaggccgugaccuguagagcuguccggcagccccagaauggauccguucgcugcucucacagcccggccggcgaguucaccuuuaaauccagcuguaacuucacaugcgaagagggcuuuaugcuucaagggccugcucagguggaaugcacgacccagggacaauggacacagcagauccccgugugugaggccuuccagugcaccgcccugucuaauccugaaagaggcuacaugaacugucuccccuccgcuagcgggucuuuucgguauggauccagcugcgaguucuccugugagcaaggcuucguccugaaggggucuaaacgccugcagugcggacccacaggcgaaugggacaaugagaagccuaccugugaagcggugagaugcgaugccguucaucagccgcccaaaggccucgugcggugugcucacagcccuauuggggaguuuacguacaaguccucuugcgccuucagcugugaggaaggauuugagcugcacggcuccacacagcuugaaugcaccagccaagggcaguggaccgaggaaguccccucuugccaggugguuaaauguuccagccuggccgugccuggaaagaucaacaugucuugcuccggcgagcccgucuucgggacaguguguaaguuugcuugcccggagggcuggacccucaauggaagcgccgcgcgcacauguggcgcuacggggcauuggucuggacugcuuccuaccugcgaagcccccacagagagcaacaucccucuggucgccggccucuccgcugccgggcugagccugcucacccuggcucccuuccuucuguggcucagaaaaugucugcggaaggccaaaaaguuugugccugcgucuuccugccagagccuugaauccgacggaucuuaucaaaaacccagcuacauucuguga

SEQ ID NO: 75356 - RNA, 1233 nt, Artificial Sequence
  derived and/or modified sequence opt5 from SELENBP1__Homo_sapiens__NP_001245217
auggccaccaagugcggcaacugugggcccggauacagcacaccucuggaggcuaugaaaggcccgagagaagagaucguguaucuccccugcauuuaccggaauacggggaccgaagccccugacuaucuggcgacagucgauguugaccccaaguccccucaguacugucaagugaucgagcccaaagauauucacgcuaagugcgaacuugccuuccugcauaccucucacugucucgccagcggagaggugaugaucuccucucugggcgacgucaaagggaacggaaagggcggcuuugugcuucuggauggggagacauucgaaguuaagggaaccugggagcgcccuggcggggcugccccgcucggauaugacuuuugguaccagcccagacauaaugugaugauuagcacagaaugggcugccccuaacguccugcgggauggcuucaaucccgcggacguggaggccgggcuguauggaucccaccucuacguuugggauuggcagcgccaugagaucgugcagacccugucucuuaaagacggccugaucccucucgaaauuagauuucugcacaaccccgaugcugcccaaggcuucgucgggugcgcucuuagcuccacgauccagcgguuuuacaagaaugagggaggcaccuggagcguggaaaaagugauucaggucccgccuaagaaaguuaagggguggcugcuccccgagaugccuggacugaucacagacauucugcucucucuggaugaccgcuuccuuuauuuuuccaacuggcugcacggcgaccucagacaguacgauaucagcgacccccaacggccccgccugaccgggcagcuuuuccugggaggcucuauugugaagggcgggccugugcagguccucgaagaugaggagcugaaaucccagccggaaccccuggugguuaagggaaaaagaguggccggcgggccucaaaugauccagcucagccuggacggaaagcggcuuuauaucacaaccucucuguacuccgcgugggauaaacaguuuuaucccgaccucauucgcgagggcagcgucaugcugcaaguggauguugacacggugaaagggggccuuaagcugaauccuaacuuccucgucgauuuuggaaaggaaccccugggcccggcccuggcucaugagcucagauacccugggggagacuguuccucugauaucuggauuuga

SEQ ID NO: 75357 - RNA, 1158 nt, Artificial Sequence
  derived and/or modified sequence opt5 from SELL__Homo_sapiens__NP_000646
augggcugcagacggacccgcgaggggcccagcaaggccaugaucuucccuuggaaaugucaguccacacaaagagaccuguggaacauuuuuaagcucuggggauggacgaugcugugcugugauuuccuugcucaccauggcaccgacugcuggacauaccacuauucugaaaaaccgaugaauuggcagcgggcccgcagauuuugucgggauaacuacaccgaccugguggcgauccagaauaaggcugagauugaauaucucgagaaaacacugcccuucagccgcuccuacuauuggaucgggauuagaaagaucggaggcaucuggaccugggucgggacaaacaagucucuuaccgaagaggccgagaauuggggagauggcgaaccuaacaauaaaaagaacaaagaggacugcguugaaauuuacaucaagcggaauaaagaugccggcaaguggaacgacgaugcuugucauaagcugaaagccgcucucugcuauacggccagcugucagcccugguccugcucugggcacggagaguguguggagauuaucaauaacuauaccugcaauugcgacgugggcuacuacgggccucaaugucaguuugucauucagugcgaaccccuggaggcgccugaacugggaacaauggauuguacccauccgcucggcaacuucagcuuuuccagccagugcgccuucucuuguuccgaggggacaaaucugaccggaaucgaagagacgacaugcggccccuuuggcaacuggagcucuccugagcccaccugucaagugauucagugcgaaccucuuuccgcucccgaccuggggaucaugaacuguagccacccgcucgccucuuucuccuuuacaagcgcuugcaccuucaucuguuccgagggaaccgaacugauuggcaagaaaaagacaaucugcgagucuagcgggauuugguccaauccuagccccaucugccagaaacuugauaagucuuuuuccaugauuaaagaaggagacuacaacccucuguucauccccguugccgugauggucacggcguucagcggccucgccuuuaucauuuggcuggcucgcagacugaagaaggggaaaaagucuaaacggagcaugaaugaccccuauuga

SEQ ID NO: 75358 - RNA, 2493 nt, Artificial Sequence
  derived and/or modified sequence opt5 from SELP__Homo_sapiens__NP_002996
auggccaacugccagaucgcuauucuguaccaaagauuccagcggguggucuuuggcaucagccagcuccuguguuucuccgcccuuauuucugagcugaccaaucagaaggaaguugcggcuuggacauaucacuacagcacgaaagccuauuccuggaacaucucucgcaaguacugccaaaauagauauaccgaccucguggccauucagaacaaaaaugagaucgauuaccugaacaaggugcuucccuauuacagcuccuacuauuggaucgggauucggaaaaauaacaagacauggaccugggucggaacaaagaaagcucugaccaaugaagccgagaacugggcugacaaugaaccuaacaauaagcgcaacaaugaggauuguguggagaucuacauuaaaucuccgagcgcccccggcaaguggaacgacgaacauugccucaaaaagaagcacgcgcuguguuauacagccuccugccaggauaugagcuguucuaaacagggggagugccuggaaaccaucggaaacuacacguguuccugcuauccuggcuuuuacgggcccgagugugaguauguuagagaaugcggagagcucgaacugccucaacaugugcuuaugaauugcagccacccccugggcaacuucucuuuuaauucccaguguagcuuccauugcaccgacggcuaccaggucaacgggccuucuaagcucgagugucuggcuuccggaauuuggacaaauaaaccgccccagugccuugccgcucaauguccuccccugaagaucccugaacggggcaacaugaccugccuccacagcgccaaagcguuucagcaccaguccucuuguagcuucuccugcgaggagggguuugcccuggugggacccgaaguugugcaauguacagcuagcggcgucuggaccgccccggcuccugugugcaaggccgugcagugucagcaucuggaggcccccucugaagggacgauggauugcguccacccucucacagcuuucgcguacggauccagcugcaaauuugagugucagcccggcuaucgcguuagaggccuggacaugcuucggugcauugauucugggcauuggagcgcuccccugccuaccugugaagccaucuccugcgagccgcucgagucucccgugcacggaagcauggacuguuccccuagccugcgcgccuuccaauacgauacaaauugcucuuuuagaugugccgaaggcuucaugcuucgcggggcugacaucgugcggugcgauaaccugggacaguggaccgcccccgcgccugucugucaggcucuccagugccaagaccugcccgugccgaaugaggccagaguuaacuguucccacccuuucggcgccuuucgguaucagagcgugugcucuuuuaccugcaaugaagggcugcuccuggucggagcuuccgugcuucagugucuggccacaggcaacuggaauagcguucccccugagugccaggcuauucccuguacgccucuccugucuccccaaaacggcaccaugacaugcgugcagccgcuuggguccagcuccuacaagucuaccugucaguucaucugcgacgaaggauauagccuguccggcccugagcgccucgauuguacaagaagcgggcgguggaccgacucuccucccaugugcgaggccauuaagugucccgaacuguucgcgccggagcagggaucccuggauugcagcgacacgagaggcgaauuuaaugucgggucuacaugucauuucuccugcgauaacggcuuuaaacucgagggacccaacaauguggagugcaccaccagcggccgcuggucugccacaccucccaccuguaaggggaucgcuagccugccuacacccggaguccaaugcccugcccuuacgacccccggccaggggacaauguacugucggcaccauccgggaaccuucggcuuuaacacaaccugcuauuucggguguaaugcuggcuuuacgcugauuggagacuccacccucagcugcagaccuucuggccaguggacagccgugacccccgcgugucgcgccguuaaaugcuccgaacugcacgugaacaagccuaucgcuaugaauuguagcaaccugugggggaauuucuccuacggaucuaucugcagcuuucauugucuugagggccaacuccugaacggguccgcccagacagcuugccaggaaaauggacacuggucuaccacgguccccacaugccaggccggcccgcugaccauucaagaggcccucacauacuucgggggcgcuguggcgagcaccaucggacugauuaugggcgggacccuucuggcccuccugcggaaaagauuccgccagaaggaugacggaaaguguccucugaacccccacucccaucuuggcacauaugggguuuuuacgaaugcugccuucgauccuucucccuga

SEQ ID NO: 75359 - RNA, 1287 nt, Artificial Sequence
  derived and/or modified sequence opt5 from SELPLG__Homo_sapiens__NP_001193538
auggccgugggcgcuagcgggcuggagggagacaagauggccggcgcgaugccccuccagcugcuucugcuccugauccuucuggggccuggaaacucccuccaacugugggauaccugggcugacgaagccgagaaagcccugggcccgcuccuggcuagagaucggcgccaggccacagaauacgaguaucuugacuacgauuuccugcccgaaacggagccucccgagaugcucagaaauucuaccgacacaaccccucugacagggcccggaaccccugaaagcacaaccgucgagccggcugcccggcgcuccacgggccuugaugcgggcggggccguuaccgaacugacaaccgagcucgcuaacaugggaaaucugucuacagacagcgccgcuauggagauucagaccacgcagcccgccgcgacagaagcccaaaccacacagccugugcccaccgaggcucagaccacaccucuggccgcuacggaagcccagaccacaagacucaccgccacagaggcucaaaccacgccccuggcggccacagaagcucagaccaccccgccugccgccacagaggcucagaccacacagcccacgggccuugaggcccaaaccacagcgccugcugccauggaagcccagaccacagcucccgccgcuauggaggcccagaccacgcccccugcggccauggaagcucaaaccacacagaccacagccauggaggcucagaccacggccccggaagcgacagaggcccagaccacacaacccaccgcuaccgaggcccagacaacgccucuggcugccauggaagcccucuccaccgagcccucugcuacagaagcgcugagcauggagccuaccacaaagcgggggcuuuuuauccccuucuccgugagcucugucacccacaaaggcauuccgauggccgcuuccaaccugagcgugaauuauccuguuggagcccccgaucauaucucugugaagcagugccuccuggccauucugauccucgcucuggucgccacgaucuuuuucguguguacaguugugcuugcgguccgccuguccagaaaagggcacauguacccugugcggaacuauagccccaccgaaauggugugcauuucuucccuccugccugacggaggcgagggccccagcgcuaccgccaaugggggacuuuccaaggccaagucuccgggccugacaccugagccccgcgaagauagagagggggacgaucucacccugcauagcuuucugcccuga

SEQ ID NO: 75360 - RNA, 2316 nt, Artificial Sequence
  derived and/or modified sequence opt5 from SEMA3A__Homo_sapiens__XP_006715902
augggcuggcugaccagaaucgugugccucuucuggggaguccugcuuacagcccgggcuaacuaccagaaugggaagaacaauguuccccgccugaaacucagcuauaaggagaugcuggaauccaacaaugugauuacguuuaacggccuugccaauucuagcuccuaccacaccuuccugcucgacgaggaaagaucucggcuguaugugggggcgaaagaucauaucuuuagcuucgaccuggucaacauuaaggauuuucagaaaaucguguggccuguuuccuacacacgcagagacgaguguaagugggcuggaaaggauauucucaaagaaugcgccaauuucaucaaggugcugaaagccuauaaccaaacccaccuuuacgcuuguggcacaggggccuuucauccgaucugcaccuauauugagaucggacaccaucccgaggacaauauuuucaagcuggaaaacucucacuuugagaauggccggggcaaaagcccuuacgaucccaagcuccugacagcuucccuucugaucgacggggaacucuacagcggaaccgccgcggauuucaugggccgcgacuuugccauuuucagaacgcuggggcaccaucacccuauccggaccgagcagcaugauucucgcuggcugaacgaccccaaguuuauuuccgcucaccucaucagcgagucugauaauccugaagacgacaaagucuauuucuucuuuagagagaacgccaucgauggagaacacuccggcaaggcuacacaugcccggauugggcagaucuguaaaaacgacuucggaggccaccgcagccuggugaauaaguggaccacauuucuuaaagcgagacugauuugcucuguuccgggccccaacgggaucgauacccauuucgacgagcuccaagauguguuucugaugaauuucaaggacccuaaaaaccccgucguguacggaguguuuacgacauccagcaauauuuucaagggcuccgccgucuguauguauucuaugagcgauguucggcgcguguuucuugggccuuacgcucacagagacggacccaacuaucagugggugccguaccagggccgggucccuuaucccagaccugggaccugccccuccaagacauucggaggcuuugauagcaccaaagaccugcccgaugacgugaucaccuucgcccgcucucauccugcuauguacaauccgguuuuucccaugaacaaucggccuaucgugauuaagacagacgucaacuaccaguucacgcaaaucgugguugauagaguggacgccgaagauggccaguaugacgucauguucauugggaccgaugugggaacaguccucaaagugguuuccauccccaaggagaccugguacgaccuggaggaagugcugcucgaggaaaugacagucuuucgcgagccuaccgccauuagcgcuauggaacugucuacgaaacagcagcaacuuuauaucggcagcacagcggggguggcccagcugccccuccaccggugugauaucuacggaaaggcuugcgccgaguguugccuggccagagacccguauugcgcuugggauggcuccgccuguucucgcuacuucccuaccgcgaagcggagaacccgccggcaggacauuagaaauggggauccccuuacacacugcagcgaccugcaucacgauaaccaucacggccacuccccugaggaacgcaucauuuauggaguugagaauagcucuaccuuucucgaauguucccccaaaagccaacgggcucugguguacuggcaguuccagagacggaacgaggaacgcaaggaggagaucagagucgacgaccauauuauccggacagaucagggccugcuccugagaucucuucaacagaaagacuccgggaauuaccugugccacgccguggaacauggauuuauucagacgcuccugaaggugacccuggagguuaucgauacagaacaccuugaggagcuccugcauaaagacgaugacggcgaugggagcaagaccaaggaaauguccaacucuaugacaccuagccagaaagucugguaucgcgacuucaugcaacugaucaaccaccccaaucucaacaccauggaugaguuuugugaacagguguggaagcgggacagaaaacagcgcagacagcggccgggacacacgccuggcaauuccaacaaguggaaacaucugcaagagaauaagaaggggcgcaacagacggacccacgaguucgaacgcgcccccagaucuguguga

SEQ ID NO: 75361 - RNA, 2250 nt, Artificial Sequence
  derived and/or modified sequence opt5 from SEMA3B__Homo_sapiens__NP_001276989
augggcagagccggggcugccgcggugauccccggacuggcucuccugugggccgucggccuugggagcgccgcuccuuccccgccccggcugcgccucucuuuccaggagcugcaagccuggcacggacuucagaccuuuagccuggaaagaacaugcuguuaccaggcucuccugguugacgaggaacggggccgccuguucgugggggccgagaaccauguggcgucccucaaucuggauaacauuucuaagagagccaaaaagcuggcuuggccugcccccgucgaauggcgggaggagugcaauugggcuggaaaagacaucggcacggaauguaugaacuuugugaagcugcuccacgccuauaaucgcacccaucugcuugcgugcggcacaggggccuuccacccuaccugugcuuuuguugaggugggacauagagccgaagaacccguccugcggcucgauccuggccgcauugaggacgggaaaggaaagagcccguacgaucccagacaccgggcugccuccgugcugguuggcgaggagcuuuauucugggguggccgcugaccucaugggacgcgauuucacaaucuuuagaagccugggccagcggccuucccuucgcaccgaaccccacgacagcagauggcugaacgagccuaaguucgucaaaguguuuuggauucccgaaucugagaauccggaugacgauaagaucuacuucuuuuuccgggagacagcgguggaagccgcuccugcccucggcagacuguccgucagccgcguugggcaaaucugccggaacgacgugggaggccagagaucucuugugaauaaauggaccacguuucugaaggcccgccucgucuguuccgugcccgggguugagggagauacccauuucgaccagcugcaggacguguuccugcucagcucucgggaucacagaacaccucugcuuuaugcugucuuuuccaccagcuccucuauuuuccaaggcagcgccgugugcguuuacuccaugaacgacgugcgccgggcguuucuggggcccuucgcucauaaagaaggacccaugcaccagugggucagcuaucagggcagagugccuuacccgcgccccggcauguguccuucuaagacauuugggaccuucuccagcacgaaggauuuucccgacgaugucauccaguucgcccggaaucacccucucauguacaacucugugcugcccacaggaggcagaccgcuuuuucugcaaguuggggccaauuauaccuucacacagauugcugccgaccgcguggcugccgcggauggacauuacgacguccucuuuaucggcaccgauguggggaccguucugaaagugauuagcgucccuaagggcucccggcccucugccgagggacugcuccuggaagaacuucacguguucgaggacagcgcugccgugacauccaugcagaucagcucuaaaagacaucaacuguauguugcuucccggagcgccgucgcgcagauugcccuccaccgcugcgcugcccauggcagaguguguacggagugcugccuggcucgggauccuuacugugccugggacgggguggccugcaccagauuucagcccucugcuaagcgccgguucagacgccaggacgucagaaacggagauccuuccacacuguguagcggcgacuccucucggcccgcgcuucucgagcacaaaguguucgggguugaaggaagcuccgccuuucuggagugcgaaccgcgcucucugcaagcuagaguggaguggaccuuccagcgggccggcgucacagcccacacccaggugcucgcugaggaacgcacggagagaacagcccgggggcugcuucugcgcagacuccggcgcagagauagcggcguuuaucugugugcggcuguggaacagggauuuacccaaccucugcggagacuuucccuccauguccugagcgccacccaggccgagcgccuggcucgggccgaggaagcggcucccgccgcucccccuggcccgaagcucugguacagagacuuccugcagcuuguggagcccgggggaggcgggucugccaauucccugcgcaugugccggccucagcccgcccuccaaagccugccucuggaaucuagacgcaaaggacggaacagacgcacacacgcucccgagccucgggccgaaagaggcccccgguccgcgacccauugguga

SEQ ID NO: 75362 - RNA, 2256 nt, Artificial Sequence
  derived and/or modified sequence opt5 from SEMA3C__Homo_sapiens__NP_006370
auggccuucagaaccaucugcgugcuggucggcguuuuuauuuguagcaucugcgugaagggguccucucagccccaagcucggguguaccucacauucgacgagcugcgcgaaacgaaaaccagcgaguauuuuucccuuucucaccauccucuggauuaccggauucuccugauggacgaagaucaggacagaaucuaugucggaagcaaggaucacauucuuucccugaacaucaauaacaucucucaggaggcccucagcguguucuggccggcguccacaauuaaaguugaagaguguaagauggcuggcaaagaccccacccaugggugcggaaauuuugugcgcgucauccagacauucaacagaacccaccuguacguguguggcagcggggccuuuucuccuguuugcacauaucugaaucggggacgcagauccgaggaucaaguguucaugauugacagcaagugugaaucuggcaagggccggugcuccuuuaaccccaaugucaacaccgugagcgugaugaucaaugaggaacucuucucugggauguacauugauuuuaugggaacggacgccgcuaucuuccgcucccugaccaaaagaaacgccguccggacagaucagcauaauagcaaguggcuuuccgagccuauguuuguugacgcucacgugauucccgauggcaccgacccuaacgacgccaaaguguauuucuucuuuaaggagaaacugacagauaauaaccgcucuaccaagcagauccacagcaugaucgcgagaauuuguccgaaugacacagggggacuccggucccuggucaacaaguggacgaccuuccuuaaagcccgccuggugugcagcguuacagaugaagacggccccgagacccauuuugaugaacucgaggacguguuccugcuggaaaccgauaacccuagaacaacgcucgucuacgggaucuuuaccacaucuuccagcguguucaagggaucugcuguuuguguguaccaccugagcgacauucagaccgucuuuaauggccccuucgcccauaaagagggcccuaaccaccaacuuaucuccuaucaggggcggauucccuacccgagaccuggaacaugccccggcggggcuuuuaccccuaauaugcgcacgacaaaggaguuccccgaugacguggucaccuuuauccggaaccacccccugauguauaauucuaucuacccuauucauaaaagaccgcucaucgugcgcauuggaaccgauuauaaguacacaaaaaucgccguugaccgggugaacgcggccgacggcagauaucacguccuguuccuugggaccgaucgcggaacagugcagaagguugugguccugcccacgaauaacagcguguccggcgaacucauucuggaggaacuggagguguuuaagaaucaugcuccuaucaccacaaugaaaaucagcucuaagaaacagcaacucuacguuuccagcaacgaaggcgucucucaggugucccugcaccggugccauauuuacgggaccgccugugcugacugcugucuugccagagaucccuauugcgccugggacggacacagcuguucccgcuucuacccuacaggcaagcggagaucucgccggcaggaugugagacacgggaauccccugacccaaugccggggauucaaccucaaggcuuaucgcaaugcggccgagaucguccaguacggcgugaagaacaauacgaccuuucuggagugugcuccgaaaagcccucaggccuccauuaaauggcuucugcagaaggacaaagauagacggaaggaaguuaaacucaacgagagaaucauugccacaucucaagggcugcugauccgcagcgugcagggcuccgaccagggacucuaucauugcauugcuaccgaaaacagcuucaagcagacaaucgccaagaucaauuuuaaaguccuggauucugagaugguggcgguugugaccgacaaguggucccccuggacgugggcuagcucuguccgggcccuuccuuuccaccccaaagauauuaugggcgccuuuucccauagcgaaaugcaaaugaucaaccaguacuguaaggacacaagacagcagcaccaacagggggaugagucucagaaaaugcgcggagacuauggcaagcugaaggcucucauuaauagcagaaaaucccggaaccgcagaaaucagcugccugagagcuga

SEQ ID NO: 75363 - RNA, 2334 nt, Artificial Sequence
  derived and/or modified sequence opt5 from SEMA3D__Homo_sapiens__NP_689967
augaacgccaauaaggacgagagacugaaagcucggagccaggauuuccaccucuuucccgcccugaugaugcuuuccaugaccaugcuguuccucccugugacaggcacgcugaagcaaaacaucccgcgccuuaaacugaccuacaaggaccuccugcugucuaauagcugcauucccuuucucggguccucugaaggacuggauuuccagacacuucugcucgacgaggaaagaggccggcugcuucugggggcgaaagaucauaucuuucuccugagccuggucgaccucaacaagaauuucaagaaaauuuauuggccugcugccaaggagcgcguugaacuguguaaacuugccggaaaggaugcuaacaccgagugcgccaauuuuaucagagugcugcagcccuacaacaaaacacacauuuauguguguggcaccggggcuuuccauccuaucugcggauacaucgaccucggcgucuauaaggaggauauuaucuuuaagcuggacacacacaaucuugaauccggccggcugaaaugucccuucgauccucagcaaccguuugccucugugaugaccgacgaguaccucuauagcgggacggcguccgauuuccugggaaaggacaccgccuuuacacgcagccugggccccacccaugaccaccacuacauuagaacagauaucucugaacauuacuggcucaacggggcuaaauucauuggaaccuucuuuaucccugacacguauaaucccgaugacgauaagauuuacuucuuuuuccgggaguccagccaggagggcucuacauccgacaaaaccauccugagccgcguugggagagugugcaagaacgaugucggaggccagcggucucuuaucaauaaauggacaaccuuucugaaggcccgccucauuuguuccaucccuggcagcgacggggcugauaccuauuucgacgaacugcaggauauuuaccuucugcccacaagagacgagcggaacccggugguuuauggaguguuuacgaccacauccucuaucuucaagggcagcgccgucugcguguacuccauggcggacauucgcgccguguuuaaugggccuuaugcucacaaagaaagcgccgaucauagauggguccaauacgacggacggauccccuacccuagacccggcaccugucccucuaagacauaugauccucucaucaaauccacccgcgacuucccggaugacguuauuagcuuuaucaagcggcacucugugauguacaaaagcguguaucccgucgcugggggaccuacguucaagagaauuaacguggauuaccgccugacacagaucguuguggaccacgucauugccgaggauggccaguaugacgugauguuucugggcaccgauaucgggaccguucucaagguggucuccaucucuaaagaaaaguggaacauggaggaggugguccuggaagaacuucagauuuucaaacauagcuccaucauucugaauauggaacucagccugaagcaacagcagcuguacaucggaucucgggacggccuugugcaacucucccugcacagaugcgauacauaugggaaagccugugcugacugcugccuggcgcgcgaccccuacugugccugggauggaaacgcuugcagccgguacgccccuaccucuaagagacgcgcccggagacaggacguuaaguauggcgaucccauuacacaguguugggacaucgaggauuccauuagccaugaaacggcugacgagaaagugaucuucgggaucgaguuuaauuccaccuuccucgaaugcauuccgaagucucagcaagccacaaucaaaugguacauucagcgcagcggcgaugagcaccgggaggagcugaagccugacgaaagaaucauuaaaaccgaguauggacuucugauccggucccuccagaagaaggauucuggcauguacuauuguaaagcgcaggagcauacauuuauccacaccauugucaagcugacgcugaacgugaucgaaaaugagcaaauggaaaacacccagcgcgcugagcacgaggaagggaaaguuaaggaccuucucgccgagagcagacugcgguacaaagauuauauucagauccuguccagccccaauuucucucucgaccaguacugcgaacaaauguggcauagagagaagcgccggcagagaaacaaaggaggcccuaaguggaagcacaugcaggaaaugaaaaagaaacgcaauagacggcaucaccgcgaucuggacgagcuucccagagccguggcuacauga

SEQ ID NO: 75364 - RNA, 2148 nt, Artificial Sequence
  derived and/or modified sequence opt5 from SEMA3E__Homo_sapiens__NP_001171600
augcugcucgacgaguaccaggaaagacuguucgugggcgggcgggaucuugucuauagccugucccucgagcgcaucucugacggauacaaggaaauucacuggcccagcaccgcccugaaaauggaggaaugcaucaugaagggcaaagaugcuggggagugugccaacuauguuagagugcuucaucacuacaaucggacacaucugcucacgugcggaaccggcgcguuugacccugugugugcuuucauucgcgucggguaucaccuggaggauccgcuguuucaucucgaaucccccagaucugagcggggacgcggcagaugcccuuucgaccccagcuccucuuuuaucagcacacugauuggcuccgaacuuuucgccgggcuguacagcgauuauuggucucgggacgccgcuaucuuucgcuccaugggaagacucgcccacauccggaccgagcacgaugacgagcgccugcuuaaggaaccuaaauucgugggcagcuacaugauucccgauaacgaggacagagaugacaauaagguuuacuuuuucuuuacagaaaaggcucuggaggccgaaaacaaugcgcaugccaucuauacccggguggggcgccucugugucaacgacgugggaggccaacggauucugguuaauaaauggucuacauuccugaaggcuagacucgugugcuccgucccugggaugaacggaaucgauaccuacuuugacgagcuggaggauguguuccuucugccgacgagagaccacaaaaaucccgugauuuucggccucuuuaacaccacaagcaauaucuuccgcggccaugccauuugugucuaucacaugucuuccauccgggcugccuuuaacgggccuuacgcgcacaaggaaggacccgaguaucauuggagcguuuacgaaggcaaagugccuuaucccagaccgggguccugcgccucuaaggugaauggaggccgcuacgggaccacaaaggauuacccugacgaugcuauccgguucgccagaagccacccccugauguaucaggcuauuaaaccugcccauaagaaacccauccuugucaagaccgacggaaaauacaaccugaagcagauugccguggaucgcguugaggcugaagacggccaguaugaugugcucuuuaucggcacggacaaugggauuguccugaaagugaucacaaucuacaaccaagagauggaguccauggaagagguuauucuggaggaacuccagaucuucaaggaccccgugccuauuaucagcauggaaauuucuuccaagcggcagcagcuguauaucggaagcgcgucugccgucgcucaagugagauuucaccauugugauauguacggcagcgccugcgccgacuguugccuugcucgcgauccguauugcgccugggacgggaucuccuguucucgguacuaccccaccggaacacacgcgaaaagacgcuuccggagacaggauguccggcacggcaacgcugcccagcagugcuuugggcaacaguucgugggcgacgcccuggauaagaccgaggagcaucucgcuuauggaauugaaaauaacagcacccugcuugaguguacaccucgcucccugcaggccaaaguuaucugguuugugcaaaagggcagagaaacgcggaaagaggaggucaagaccgacgauagagugguuaagauggaccucgggcugcuguuccuccgccugcacaaaagcgaugcuggaacauacuuuugccagaccguggaacauucuuucguccacacagugcggaagauuacccuugaggugguugaagaggaaaaagucgaggacauguucaauaaggaugacgaggaagacagacaccaucgcaugcccuguccugcccaguccagcaucucucagggcgcgaaacccugguauaaggaguuucugcaacucauuggguacuccaacuuccagagaguggaagaguauugcgaaaaggugugguguacggaucggaaacgcaagaaacugaagaugagcccguccaaauggaaguacgccaauccucaggagaagaaacugagaucuaagcccgagcacuaucggcuuccucgccauacacucgacagcuga

SEQ ID NO: 75365 - RNA, 2358 nt, Artificial Sequence
  derived and/or modified sequence opt5 from SEMA3F__Homo_sapiens__NP_004177
augcugguggccggccuccugcuuugggcuagccugcucaccggggccuggcccuccuucccuacacaggaccaccuuccggcgacgcccagaguccggcuuucuuuuaaggagcugaaagcuaccggaacagcccauuucuuuaacuuccuccugaauaccacagauuaccgcauccugcucaaggacgaagaucacgacagaauguauguuggcagcaaagauuacgugcugucccuugaccugcaugauauuaaccgggagccucucaucauucacugggccgcuucuccccaacgcaucgaagagugcgugcugagcgggaaggacgucaauggagaauguggcaacuuugugagacuuauucagccuuggaaucggacccaucuguauguuugcgggacaggagccuacaaccccauguguaccuaugugaaucgcggcagacgggcucaggccacgccuuggacccagacacaagcgguccgcggcagagggucccgggccaccgauggagcucuccgcccgaugcccacagccccuagacaggacuacaucuucuaucuggagcccgagcggcuggaaucuggcaaagggaagugcccuuacgaucccaagcucgacaccgcuagcgcccugaucaacgaggaacuuuacgcgggaguguauauugauuuuaugggcacggacgccgcuaucuuccgcacacuggggaaacagaccgccaugagaacagaccaguacaauucccgguggcucaacgauccgagcuuuauucacgcugagcugaucccugacucugccgagagaaaugaugacaagcuguauuucuuuuuccgcgaacgguccgccgaggcuccccaaagcccugcgguuuacgccagaauuggacgcaucugucugaacgaugacggcggccacugcugucucgugaauaaauggucuaccuuucugaaggcucggcuggucugcuccgugcccggggaagauggaauugagacccauuucgacgaacuccaggauguguucguccagcagacacaagacguuagaaaccccgugaucuaugccguguuuacgagcucuggcuccgucuuccgcgggagcgccguguguguuuacuccauggcugauauccggaugguguuuaauggaccuuucgcccacaaagagggcccgaacuaucaguggaugcccuuuucugggaagaugccuuaccccagaccuggaaccugccccggcggcacauucaccccgagcaugaaguccacaaaagacuacccugacgaggucauuaacuuuaugcgcagccauccccugauguaucaggcgguguacccucuucaacggagaccccugguugugcgcaccggggcuccuuaucggcucacgacaaucgccgucgaucagguggacgccgcugauggaagauacgaaguccuguuccuuggcaccgaccgggggaccgugcagaagguuauugugcugcccaaagaugaccaggagcucgaggaacugaugcuggaagaggucgagguguuuaaggauccggccccuguuaaaacaaugaccaucucuuccaagcgccaacagcucuauguggcuagcgccgucggagugacacaccugucucuucacagaugucaggcguacggcgccgcuugcgccgacugcugucuggcucgggaucccuauugcgccugggacgggcaggcguguagcagauacacggccuccucuaaacgccggagcagacgccaagaugugagacauggcaaucccauucggcagugccgcggauucaacuccaaugcuaacaagaaugccguugaaagcguccaguacggcguggcugggucugccgccuuucucgagugucagccuagauccccgcaagcuaccgugaaguggcuguuccagcgggaccccggagaucgcagacgggaaauccgcgcggaggacagauuucugcggacagaacagggccuucuccugcgcgcccugcagcucagcgacagagggcuguauucuugcaccgcuacagagaacaauuucaaacacgucgugacccggguucaacuucaugugcugggaagagaugccguccacgccgcucucuucccuccccuguccaugagcgccccucccccucccggcgcggggccgccuacgcccccuuaccaggagcuggcucagcuucucgcccaacccgaagugggccugauccaucaguauugucagggauacuggcgccacguuccgccuucuccccgggaggccccuggcgcucccagaucccccgaaccucaggaccaaaagaaaccgcgcaaccggagacaccaucccccugauaccuga

SEQ ID NO: 75366 - RNA, 2349 nt, Artificial Sequence
  derived and/or modified sequence opt5 from SEMA3G__Homo_sapiens__NP_064548
auggcccccagcgcuugggccaucugcuggcugcucggcgggcugcuucugcacggaggcuccucugggccuagcccgggacccuccgugccuagacuccggcugucuuaccgcgaccuucugagcgcgaacagauccgcuauuuuccucggcccccaggggucucugaaucugcaagccauguaucucgaugaguaccgggaccgccuguuucuuggaggccuggaugcccucuauagccugagacuugaccaggcuuggccugauccccgggaaguccuguggccuccgcagcccggccagcgcgaggaauguguuagaaaggggcgggacccucucaccgagugcgccaacuucgugcgcgugcugcaaccccauaauagaacacaucugcucgcuuguggaacgggcgccuuucagccuaccugcgcgcugaucacagucgggcaccggggagaacacgugcuucaucuggagcccggcuccguugagagcgggcgcggaagauguccgcacgaaccuucucggcccuucgccuccaccuuuauugauggcgagcucuacacaggccugaccgcugacuuccuugggcgcgaagccaugaucuuuagaagcggaggcccucggcccgcucugagaucugauuccgaccagagccuccugcacgauccccgcuucgugauggccgcgcggauuccugagaacucugaccaggauaaugacaaagucuacuuuuucuuuuccgagacagugccgagccccgacgggggauccaaccauguuaccgugucuagagucggccgcgugugcgugaaugaugccgggggacaacggguccugguuaacaaguggagcacguuccucaaagcuagacugguguguuccgugccuggccccggcggggccgaaacccacuuugaccagcuugaggaugucuuccugcucuggccuaaggcuggaaaaagccuggaaguguaugcccuuuucucuacaguuuccgccguguuucagggcuucgcugucugcguguaucauauggcggacaucugggagguuuuuaaugggcccuucgcccaccgcgauggaccgcagcaccaauggggcccuuacgggggcaaggugcccuuuccucggcccggagucuguccuagcaagaugaccgcucagcccggcagaccguucgggucuacaaaagacuacccugaugaagugcugcaguuugcccgcgcccauccccucauguucuggcccguccggccuagacacggacgcccggugcugguuaagacccaucuggcucaacagcuccaccagaucguggucgaccggguggaggccgaggauggcacguaugacguuauuuuucuggggacagauagcggauccgugcuuaaagucaucgcgcugcaggcuggcgggucugccgaacccgaggaaguggugcucgaggaacugcaaguuuucaaggucccuacccccauuacagagauggagaucagcgugaaaagacagaugcuguacgugggcucccggcuuggagucgcccagcuccgccugcaucagugcgaaaccuauggcaccgcuugugccgagugcugccuggcuagagacccuuacugugccugggacggggcgagcugcacacacuaucggcccucucucggaaagagacgcuuucggagacaagauauucgccacggcaacccugcccugcagugucuugggcagucccaggaagaggaagcugugggacugguugccgcuacgaugguguacggcaccgagcauaauagcacauuccucgagugccugcccaagucuccgcaagccgcggucagauggcugcuucagcggccuggggacgaaggccccgaucaggugaaaaccgacgagcgcguucuccacacagaaagaggacugcuguuucggcgccucuccagauucgaugccggcaccuauacguguacaacccuggagcauggguucagccagaccgugguccggcuugcucuggugguuaucguggccucccaacucgacaaccuguuuccucccgagccgaagccugaggaacccccugcucgcggaggccuggccucuacaccucccaaagccugguacaaggauauucuucagcucaucggguucgcuaaucugcccagagucgacgaauacugcgagcggguguggugucgcggaaccacagaaugcagcggcuguuuuagaucccggucuagagggaaacaggcgcgcggcaagagcugggccggacuggagcucggcaaaaagaugaagucccgggugcacgcugagcacaacagaacgccgcgcgaagucgaggccaccuga

SEQ ID NO: 75367 - RNA, 1890 nt, Artificial Sequence
  derived and/or modified sequence opt5 from SEMA4A__Homo_sapiens__NP_001180231
augauccccuggccugccagcgacagaaagaaauccgagugcgcuuucaagaaaaagucuaacgaggaacugcaggauagcuaccuccugccgauuuccgaagacaaagugauggagggcaaggggcaaucucccuuugauccugcccacaagcauaccgcgguccuuguugacggaaugcuguauagcggcacaaugaauaacuuccucggguccgaacccauccugaugcggacgcuuggaucucagccugugcugaaaaccgauaauuuucuccgcuggcugcaccaugacgcuagcuucguggccgccauucccuccacacaggucguguacuuuuucuuugaggagaccgcuagcgaauuugauuucuucgagagacugcacacaucucggguugcccgcguguguaagaacgacgucggcggggaaaaacuccugcagaagaaauggaccacauuucuuaaggcucaacugcucugcacccagccuggacagcugccguucaaugugaucagacaugccguucuucugcccgcggauuccccuacggcuccccacauuuaugccguguuuaccagccaguggcaagucggcggcacacggucuuccgccgugugugcuuucagccuccuggacaucgagcgcguguucaaggggaaauacaaggagcugaacaaagaaaccucuagauggacaaccuaucggggaccugagacgaauccccgcccgggcuccugcagcgucgggccuuccucugauaaggcccucacauuuaugaaagaccacuuccugauggaugaacagguugugggaacaccccuucuggucaagagcggcguggaguacaccagacucgcgguggaaaccgcccaggggcuggacggacauucccaccuuguuauguaucugggcaccacaacgggcagccuccauaaagcuguggucucuggggacuccagcgcccaccugguggaggagauccagcuguuuccugaucccgaacccguucggaaccuccaacuggcuccuacccagggagccguguucgucggcuuuucugggggaguguggcgcgucccgagagccaauuguagcguguacgaguccugcguugacugugugcuugcucgggauccccacugcgcgugggacccugaaucucgcacauguugccugcucagcgcccccaaccuuaauuccuggaagcaggauauggagagaggcaacccugaaugggcuugugccagcgggcccaugucucggucccugagaccgcaaagccgcccucagauuaucaaggagguccuggccgugcccaauucuauucucgagcugccuugcccccaucuguccgcucucgccagcuacuauuggucccacggaccugcggcuguucccgaagccucuagcaccguguacaacggcucccugcuucugaucguccaggacggcguugggggacucuaucagugcugggccacagagaauggcuucucuuacccggugauuagcuauuggguggauucccaagaccagacccuggcucuggauccugaacuugccgggaucccccgggagcaugucaaagugccccucacgagagugagcggaggcgcugcccuggcggcccagcagucuuacuggccucacuuugucacagugaccguucuguucgcucucgugcuguccggggcccuuauuauccuggucgcuagcccgcuccgcgcccugcgggcgagaggcaaggugcaaggaugugaaacccugcgccccggcgagaaagccccucuuucucgggagcagcaucuccagucccccaaggaaugcagaacaagcgcuucugacguugaugccgacaacaacugucuggggaccgagguggcuuga

SEQ ID NO: 75368 - RNA, 2514 nt, Artificial Sequence
  derived and/or modified sequence opt5 from SEMA4B__Homo_sapiens__NP_064595
augcugagaaccgccaugggccuccggagcuggcuggcugcccccuggggagcgcuuccuccgagacccccucugcuccugcuucugcuccugcugcuccugcuucagcccccucccccuacaugggcucuguccccgcgcaucucucucccccuggggagcgaggaacggccuuuccuucgcuuugaggccgaacacauuuccaacuacacggcccugcuccugucuagagacggccggacccuguaugugggggcucgcgaggcccucuucgcucugagcuccaaucuuucuuuucugcccggaggcgaauaccaagagcuccuguggggagccgaugcggagaagaaacagcagugcagcuucaaggggaaagacccucagagagauugucaaaacuauaucaagauucuucugccccucuccggcagccaucuguuuacaugcggcaccgccgcuuucucuccgauguguacauacaucaauauggaaaacuuuacccuggcccgggacgagaaagggaauguccuccuggaagauggaaagggccgcugcccuuucgaccccaacuuuaaguccacagcucuuguuguggauggggagcuguauaccggaacggugagcucuuuccagggcaaugacccugccauuuccagaagccagucucuccggcccaccaaaacagaguccagccugaacuggcuucaggaucccgcguuugucgccuccgcuuacaucccugaaucucuggggagccuccaaggagacgaugacaagaucuauuucuuuuucuccgagaccggccaggaguucgaguuuuucgaaaauacaauugugagccgcaucgccagaauuuguaaaggcgaugaagggggagagcggguucugcagcagcgcuggaccucuuuucugaaggcucaacuccugugcuccagaccggacgacggcuuccccuuuaacgugcuucaggaugucuucacgcugagcccuucuccccaggacuggcgggauacacucuuuuacgggguguucaccagccaauggcacagaggaacaaccgaaggcuccgccguuuguguguuuaccaugaaagacguccagcgcguguucucugggcuguacaaggaggugaaucgggaaacacagcagugguauacggucacccauccuguucccacaccgagaccuggagccugcaucaccaacagcgcucgcgagcggaagauuaauuccagccugcaacuucccgauagagugcucaacuuucugaaagaccacuuccugauggauggccaggugcgcucucggaugcuccugcuucagccucaggcgagauaccaacgcgucgccgugcaucggguucccggccugcaccacacauaugacgugcucuuucuggggaccggagauggcagacugcauaaggcugucuccguggggccucgcguucacaucauugaagaacuucagaucuucagcucuggacagcccgugcagaaucuccugcuggacacgcaucggggccuccuguacgccgccucccacagcggggucgugcaagucccgauggcuaacuguucccuuuauagaucuugcggcgauugucugcucgcccgggacccuuacugcgcguggagcggauccucuugcaaacacgugagccuguaucagccccagcuggcuacacgccccuggauccaggacauugagggcgccuccgccaaggaucuuuguagcgcuucuuccguugugagcccuucuuucgucccgaccggggaaaaacccugcgagcaagugcaguuucagccuaacaccguuaauacacucgccuguccccugcuguccaaccucgcuaccagacuguggcuucggaauggagccccugugaacgcgagcgccucuugccauguccugcccacaggcgaccuccugcugguggggacgcaacagcuuggagaguuccaguguuggagccucgaggaaggcuuucagcaacugguggcuuccuacugcccugagguugucgaggaugggguggccgaccagaccgaugaaggcggaagcgugcccgucaucauuucuacauccagagugagcgcuccggccggcgggaaggcguccuggggagccgaccgcucuuacuggaaagaguuccugguuauguguacccucuuugugcuggcuguccuucugccuguucucuuccugcuguaucggcacagaaauagcaugaagguguuucuuaagcagggcgaaugcgccuccgugcaucccaaaacauguccugucgugcugcccccggagacccgcccucucaacgggcugggacccccuucuacgccccucgaucacagaggcuaccagagccuguccgacucucccccugggagccggguuuucaccgaguccgaaaagcgcccgcuuagcauccaagauucuuuuguggaggucucccccgugugcccuagaccccgggugcgccugggcagcgaaauuagagacucugucguuuga

SEQ ID NO: 75369 - RNA, 2589 nt, Artificial Sequence
  derived and/or modified sequence opt5 from SEMA4D__Homo_sapiens__XP_005251711
augagaaugugcacccccauccggggccugcucauggcccuggcugugauguucgggacagccauggcguuugcuccuauuccgcgcaucacgugggagcacagagaaguccaucuuguucaguuccacgagcccgacauuuacaacuauagcgcccugcuccuguccgaagauaaggacacccuuuacaucggagcccgggaggcuguguuugccgugaaugcucugaacauuucugaaaaacaacaugaggucuauuggaaggugagcgaggauaaaaaggccaaaugugcggaaaagggcaaguccaaacagacagagugccucaauuacauccgcguucugcagccucugucugccaccagccucuaugugugugggacaaacgcuuuccagcccgccugcgaccaccugaaucuuaccuccuuuaaguuccugggcaaaaacgaagauggaaaggggagauguccuuuugaccccgcucauucuuacacaagcgucaugguggauggagagcucuauuccggcaccagcuacaauuuccugggcucugagccuaucauuucccggaacagcucucacuccccgcuucgcacggaauacgccauccccuggcugaaugagccuagcuuuguuuucgcggacgugauuagaaaaucucccgauuccccugacggggaagaugaccgggucuacuuuuucuuuaccgaggugagcguggaauaugaguucgucuuccgcguucucauccccagaauugcccgggugugcaagggagaucaaggcgggcugcgcacacugcagaagaaauggaccuccuuucucaaggcuagacugaucuguucucggccggacagcggacuuguguucaacguccugcgcgacguguuuguucucagauccccuggccugaaagugcccgucuucuaugcccuuuuuacaccucagcugaauaacguggggcucagcgcuguuugcgccuacaaucugucuaccgccgaggaaguguucucccacggaaaguauaugcagagcacgacagucgagcaaucucauaccaaaugggugcgguacaacggccccguccccaagccuagaccgggcgcuuguauugauagcgaagcgcgcgccgcuaauuauacauccucucugaaccuccccgacaaaacccugcaguuugugaaggaucacccucuuauggacgauagcguuacccccaucgacaaccggccuagacugaucaagaaagaugugaauuacacacagauugucguggaccgcacgcaggcccucgaugggaccguuuacgacgugauguucgucuccacagaucggggagcccugcauaaggcuaucagccuugagcacgccgugcacauuaucgaagagacccaacuguuucaggacuucgagcccgugcagacacuccugcugucuuccaaaaagggcaacagauuuguuuaugcggggagcaauucuggagucgugcaagcuccgcucgccuucugcggcaaacaugggaccugugaagacugcgugcuggcccgcgauccuuacugcgcuugguccccucccacggccacaugugucgcccuucaccagaccgagagccccucccggggacugauucaggaaaugucuggcgacgcuagcgugugcccugauaaguccaagggcucuuauagacagcacuuuuucaaacaugggggaaccgcggagcucaaguguagccaaaaauccaaccuggcccgcguuuucuggaaguuucagaauggcgugcugaaagcugaaagccccaaguacgggcuuaugggacggaagaaccuccugaucuucaaucugucugagggcgacuccggggucuaucagugccucagcgaggaaagagugaaaaacaagacaguuuuucagguggucgccaaacaugugcuggagguuaagguggucccgaaaccugugguggcucccacccuuucugucguucaaacagaaggcucccgcaucgccacgaaggugcugguggcgagcacccagggaucuagcccucccacaccggccguccaggcuaccuccagcggcgccauuacacuucccccuaagcccgcuccuaccgggacgucuugugagcccaaaaucgugauuaauaccguuccucagcugcacuccgagaagacaauguaccugaaaagcuccgauaaccggcuucucaugucucuguuccuguuuuucuuuguccucuuccugugccucuuuuucuauaauuguuacaagggauaccugcccagacaaugccucaaauuucggagcgcccugcugaucggcaagaaaaagccgaaguccgacuucugugaucgcgaacagucucuuaaagagacccucguggaaccugggagcuuuucccagcagaacggagagcaccccaagccugcccuggacacaggcuaugaaaccgagcaagauacgauuacaucuaaagugcccaccgacagagaggauagccagcggaucgacgaucuguccgcuagagacaagccguucgacguuaaaugcgaacucaaguucgcggauagcgacgccgauggggacuga

SEQ ID NO: 75370 - RNA, 1848 nt, Artificial Sequence
  derived and/or modified sequence opt5 from SEMA4F__Homo_sapiens__NP_001258590
augcccgccagcgcugccagaccucggccgggccccgggcagccuaccgcgucccccuucccucugcuccugcuugcugugcugucuggacccgucagcggccgcguuccuagauccgugccgcggacaucucuccccaucagcgaggccgacuccugccugacgcgcuuugccgugccucacaccuacaacuauucuguccuucugguggaucccgcuagccauacacucuacguuggggccagagacaccauuuucgcucugucccugccuuuuagcggagaacggccccgcagaaucgauuggauggugccggaggcccaccggcaaaauugucgcaagaaaggcaagaaagaaggggaccucggaggcagaaagacacugcagcagcgguggaccacauuccuuaaagcggaucugcucugcccuggccccgagcaugggcgcgccucuuccguccugcaggacguggcuguucuuagaccugaacugggagccggcacccccaucuuuuaugggauuuucagcucucaaugggagggagcuacgauuuccgccgugugugcguuucggccccaggauauccgcaccguccucaacggcccuuucagagagcugaagcacgacugcaaucgggggcugccggugguggauaacgacgucccccagccuagacccggagaauguaucacaaauaacaugaagcuccgccauuuuggcagcucucugucccuuccugaucggguucugaccuucauuagagaccacccccucauggaucgcccgguguuuccugccgacggccacccccugcuugugacaaccgacacggcuuaccugcgggucguggcccauagaguuacaagccucuccgggaaagaguaugaugugcuguaccugggaaccgaagacggccaccuccaucgcgcuguccggaucggggcccagcugucugugcuugaggaucuggcccucuucccugagccccaaccuguugaaaauaugaagcuguaucacagcuggcuucuggugggauccagaacagaggucacccaggugaacaccacaaauugcggccgccuccagagcuguucugaaugcauucuggcucaggaccccgucugugcgugguccuuucggcuggaugagugcguggcccacgcuggggaacauagaggacucguucaagacaucgagagcgccgaugugucuagccuguguccgaaagagccuggcgaacgccccgucguguucgagguucccguggccacggcugcccacgucgugcuuccuugcuccccgucuagcgcgugggcuuccugcguguggcaucagcccagcggcguuaccgcccugacaccucggagagacgggcucgaagucguggugacccccggagccaugggcgcuuacgccugugagugccaggaagggggagcugcccacgucguggcggccuacucucugguuuggggcucccaacgggaugcuccuagccgcgcccauacagugggggcuggccuggccggauucuuucuuggcauucucgcggccucucugacccugauccucauugggagacggcagcagagacgccggcagagagagcugcuugcucgcgacaaggucggacuggaucucggcgcucccccuuccgggacgacaagcuauucccaagaucccccgucuccuagccccgaggacgaaagacugccucuggcccuugccaaacggggauccggcuucgggggcuuuucucccccguuccuccuggacccuugucccagcccugcccacauccgccugaccggagcuccccucgcgaccugcgacgagacauccaucuga

SEQ ID NO: 75371 - RNA, 2109 nt, Artificial Sequence
  derived and/or modified sequence opt5 from SEMA4G__Homo_sapiens__NP_001190173
auguggggcagacuguggccccuccugcuuagcauccugaccgccacagcugugccugggccgucccuccggcgccccucuagagagcuggacgccacgccucggaugaccauucccuacgaggaacuuagcggaacacgccacuucaagggccaggcgcaaaacuauuccacccugcuccuggaagaggcuucugccagacugcucgucggggcccggggagcucuguuuagccuuuccgccaaugauaucggcgacggggcucauaaagaaauucacugggaggccucuccugagaugcagagcaagugccaucagaaaggaaagaacaaucagacagaauguuucaaccacguucgcuuucugcaaagacucaauuccacccaucuguacgcgugcggcacacacgccuuccagccccuuugugcugccaucgaugcugaggccuuuacccugccuacgagcuucgaagagggcaaagagaagugcccguaugaccccgcgcggggguuuaccggacucauuaucgauggcgggcuguacacagccacccgcuaugaauuuagaucuaucccugacauucggcgcuccagacacccccauagccugcggacagaggaaaccccuaugcacuggcucaacgaugcugaguuuguguucucugugcugguccgcgaauccaaggccagcgcugugggagacgaugacaaaguuuacuauuucuucacggagagagccacagaggaaggcucuggguccuuuacccagagccgguccucucauagaguggcccgcgucgcucggguguguaagggagaucuuggcggcaaaaagauccugcagaaaaaguggaccagcuuccucaaggcgagacugauuugccacaucccccuuuacgagacacugcgcgggguuuguucccucgacgccgaaaccagcucucggacacacuucuacgcugccuuuacgcuguccacccaauggaaaacacuggaggccagcgcuauuugcagauaugaucucgccgaaauccaggcgguguucgcuggaccguacauggaguaucaggacggcucucgccggugggggagauacgagggaggcgucccugaaccccgcccugggagcuguauuaccgacucccugcggucucagggauauaauagcucccaagaucuucccagccuggugcucgacuuugugaagcugcauccccuuauggccagaccugucguuccgacacgcggccggccccugcuccugaaaagaaacauccgguacacccaccugacgggcacaccugugaccacccccgccgggccuacauaugaucuccuguuccuuggaaccgcugacggcuggauccauaaggccgugguccuggggucuggaaugcacauuaucgaggaaacacagguguuucgcgagucccagagcguugaaaaucucgugauuucucugcugcaacauucccuuuacgucggcgcucccagcggggugauccagcucccgcuguccucuugcagcagauaccgguccuguuaugauugcauucuggccagagacccuuacugcggcugggaucccggaacgcacgcgugugccgcugccaccacaaucgcuaaccgcucucagggcagccggaccgcccucauccaggacauugagagagggaaucgcggaugcgaguccagcagagauacaggccgggcgcugcaaguucacauggggucuauguccccucccagcgccuggccuugugugcuugacggacccgaaacccgccaggaucugugccagccgccuaaacccuguguccauucucacgcucauauggaggaaugccucuccgccggccugcaguguccccacccucaucugcuucucgugcacagcugcuucaucccggcuucugggcugggcguccccagccaacugccucaccccauuugguccagcucuccugcccccuguggagaccucuuugugaagucccugggcacggggcagccuggagagguuagacuucaucacagcccgccccugccuuccugcguggcccucgucaaccagcccccucauucucccuggagcuucucccggguguga

SEQ ID NO: 75372 - RNA, 3225 nt, Artificial Sequence
  derived and/or modified sequence opt5 from SEMA5A__Homo_sapiens__NP_003957
augaaggggaccugcgugaucgccuggcuguucagcucccucggccuguggagacuugcucaccccgaggcccagggaacaacgcaaugucagcggaccgaacauccugucauuucuuacaaagagaucggcccguggcugcgcgaauuuagagcgaagaacgcuguugacuucagccagcucacauuugaucccgggcagaaagagcugguggugggagcccggaauuaucuuuuccgccugcaacucgaagaccugucccugauucaggccgucgagugggagugcgaugaagcuaccaagaaagccuguuacucuaagggcaagagcaaagaggaaugccagaacuauaucagagugcuccugguugggggagaccggcuuuuuacauguggcaccaaugcuuucacaccugugugcaccaaccgcucccugucuaaucucacggagauucacgaucagaucagcggcauggccagaugucccuacuccccucaacauaacagcaccgcgcugcuuacagccgggggagagcuguaugcugccaccgcuauggacuuucccggccgggauccugccaucuaccgcucucucgggauucugccgccccugagaacagcgcaguauaauuccaaguggcucaacgaaccuaauuucgucagcucuuacgacaucggaaacuuuaccuacuucuuuuuccgggagaaugccguggaacacgauugcggcaaaacgguguuuucccgcgcugccagaguuuguaagaacgacauugggggacgguuccugcuugaggauacauggaccacauucaugaaagcucgccugaauugcagcagacccggcgaagucccuuuuuauuacaacgagcuccagucuaccuucuuucugcccgagcuugaccugaucuauggcauuuucaccacaaaugugaacuccaucgccgccagcgcugugugugucuuuaaccucuccgcgauugcccaggcuuucucugggccguuuaaguaccaagaaaauagccgguccgccuggcugccuuaucccaacccuaauccccauuuccagugcggaacgguugaucagggccuguacgugaaccucaccgagagaaaucugcaagacgcccagaaguuuauccuuaugcacgaagugguccagcccgugacaaccguuccuagcuucauggaggacaacucucgcuuuucccacguggcugucgaugugguucaggggcgggaagcccuggugcauaucauuuaucucgcgacagacuacggaaccaucaaaaaggucagagugccgcugaaucaaacgagcucuagcugccuucuggaggagauugaacucuuccccgagcgccggagagaaccuauccgcucccugcagauucugcacucucagagcguccucuuugugggccugcgggagcauguugugaaaaucccccuuaagagaugucaguucuaccgcacacgguccacaugcaucggggcucaagauccuuauuguggaugggacgucgugaugaaaaagugcaccagccuggaagagucucucuccaugacccagugggagcagagcauuucugccugucccaccagaaaccugacaguugauggccacuucggcgugugguccccguggacgccuugcacccacacagacgggagcgccgucggauccugucugugccgcacccggucuugugauagccccgcuccucagugcggcggguggcaaugugaaggacccggcauggagaucgccaauugcuccagaaacgggggcuggacaccuuggaccucuuggagccccugcuccacgaccuguggaauuggcuuucaggugcggcagcgcagcugcucuaauccgacaccuagacaugggggacggguguguguuggccagaacagagaggaacgcuacugcaaugagcaccuucucuguccuccccauauguucuggaccggguggggacccugggaacggugcacagcucaauguggcgggggcauccaggccagacgcagaauuugcgagaacggaccggacugugcgggcugcaaugucgaauaucaguccuguaacaccaaccccugcccugagcugaaaaagacgacacccuggaccccuuggacacccgugaauaucagcgauaacgggggacacuacgaacaacgguuucgcuauaccugcaaggccagacuggcugacccuaaucuccuggaggugggccggcagcgcaucgagaugagauacuguucuuccgaugggaccagcggaugcucuacagacggccuuagcggggacuuccugcgggccggccgcuauuccgcucauacggucaacggagccuggagcgcguggaccucuuggucccaguguagcagagauugcucccggggcauucgcaauagaaaacggguguguaacaaucccgaaccgaaguacgggggaaugccuugccucggccccucucuggaguaccaggaauguaacauccugccuugccccguugacgggguguggagcuguugguccccguggacaaaaugcucugccaccuguggaggcgggcacuauaugagaacacgcagcugcuccaauccugcucccgccuacggcggagauauuugccuuggccuccacaccgaggaagcucuguguaacacgcaaccuugccccgagucuuggagcgagugguccgacuggagcgaaugugaggccucugggguccaggugcgggccagacagugcauccugcucuuucccaugggaucccaguguagcggcaauacaaccgaaucucgcccuugcguuuucgauuccaacuuuauuccggaggugagcgucgcucggucuuccagcguggaagagaagagauguggggaguucaauauguuucauaugaucgcgguuggacuguccagcucuauucuuggcugccugcucacccugcugguguauacauacugucaacgcuaucagcagcagagccacgacgccaccgucauccaucccguguccccugcuccccuuaacacaucuaucacgaaucacauuaacaaacucgauaaguacgacagcguggaagccaucaaggccuucaacaaaaauaaccugauucuggaggaacggaauaaguauuuuaacccucaccucaccggcaaaacauacuccaaugcuuacuucaccgaucugaacaauuaugacgaguacuga

SEQ ID NO: 75373 - RNA, 3456 nt, Artificial Sequence
  derived and/or modified sequence opt5 from SEMA5B__Homo_sapiens__NP_001026872
augcccugcggcuucagcccuuccccgguggcccaccaucugguccccgggccucccgacaccccugcucagcaacucagauguggauggacaguuggcggguggcugcuuucucuggugcggggacuccugcccugccuuccuccgggcgcccgcacggcggaggggcccaucauggugcuggcuggaccucucgccgucagccugcugcuccccucccugacccuucuggugucucaccucagcuccucucaggauguuagcuccgaaccuagcucugagcagcagcugugugcccuuuccaagcaucccacaguggcuuuugaagaccugcaaccgugggucagcaacuucaccuacccuggcgccagagauuuuucucagcucgcucuggaccccuccggcaaucagcugauugugggggcccggaacuaucucuuccgccugagccuugcgaauguuucucugcuccaggccacagagugggcuuccagcgaagauaccagacgguccugccaaucuaaaggaaagacagaggaggaaugucagaacuacgugcgcguccugaucguggccggcagaaaaguguuuaugugcgggaccaaugcuuucagcccuauguguacgucccggcaggucggaaaccuuagccgcaccauugagaagaucaauggcguugccagaugccccuaugacccccggcacaacucuacagcggugauuuccagccagggggaacuguacgccgcuaccgugaucgauuuuucuggacgcgacccugccaucuauagaagccucggcuccggcccgccccugcggacagcucaauacaauucuaaauggcugaacgagccuaauuucgucgccgccuaugauauugggcucuuugcuuacuucuuucugcgcgagaacgcgguggaacaugacuguggaagaaccguuuacagccggguggccagagucugcaagaaugaugugggcgggcgcuuccuucuggaggacacguggacaaccuuuaugaaggcucggcucaacuguuccagacccggagaaguuccuuucuauuacaaugagcugcagagcgccuuccaccuucccgaacaggaucugaucuauggcguguuuacaaccaacgucaacucuauugccgcuuccgccgugugcgcguucaaucucagcgcuaucucucaagccuuuaacgggccguuccgcuaccaggagaauccucgggccgcuuggcugcccauugccaacccuauccccaauuuucagugcggaacccugccugagacaggccccaacgaaaaucucacggagagaucccugcaggacgcucaacgccuuuuccugaugagcgaagccguccagccggugaccccugagcccuguguuacacaggacuccgugcgguuuucucaccucgucguggaucugguucaggcgaaagacacccuguaucaugugcuuuacauuggcacagaaagcgggaccauccucaaggcccuguccacggcuucuagaagccugcacggaugcuaucucgaggagcugcauguccuucccccuggccgccgggaaccgcugagaucccuccgcauccugcacagcgcccgggcucuguucguggggcuuagagauggagugcuccggguuccccuggagcgcugugccgcguacagaucucaaggcgccugccugggggcucgggacccuuacuguggcugggauggaaaacagcagagaugcuccacacucgaagacagcucuaacaugucccuguggacccagaauauuaccgccugucccguccgcaacgugacacgggauggcggguuuggaccuuggagccccuggcaaccuugcgagcaccuugacggcgauaauucugggagcugucugugcagagcucgcuccugugacagccccagaccgcggugcggaggccucgauugccuggggccugccauccauauugccaacuguucucgcaauggcgcuuggacccccugguccagcugggcgcugugcuccacaucuuguggaaucggcuuccaggugagacagcggagcugcuccaacccugcuccccgccacgggggaagaauuugugucggcaagucucgggaggaacgcuuuugcaaugagaacacgccguguccugugcccaucuucugggcuagcuggggguccuggucuaaaugcagcuccaacuguggaggcgggaugcagagcagacggcgcgccugcgaaaauggcaacucuugucuuggaugcggcguugaguuuaagaccugcaauccugaagggugucccgaggugagacggaacacacccuggaccccuuggcucccggucaaugugacacaaggaggcgccagacaggagcagcgcuuccgguuuaccugcagagcuccccuggccgacccucaugggcugcaauucggacgccggagaacggaaacccgcacaugucccgcggacggcuccgggagcugcgauaccgacgcucucguugaggugcugcuucggucuggcuccacaagcccucacaccgucucuggaggcugggccgccugggggcccugguccagcuguuccagagauugcgaacugggauuccgcgugcggaagagaacguguacaaacccugagccgcggaauggcgggcuccccugcguuggagacgcugccgaauaucaggauuguaacccucaggcgugccccgugcgcggcgcuuggagcuguuggaccucuuggagcccuugcuccgccucuugcggcgggggacauuaccagagaacacggagcuguaccucccccgccccgucuccuggcgaggacaucugccuggggcugcacaccgaggaagcucuuugugccacacaagccugccccgagggauggagccccugguccgaauggucuaaauguacggaugacggcgcccagagccgcuccagacacugcgaggaacuccugccugggagcucugcgugugccggaaauuccagccagucucggcccugcccuuauuccgagauuccggucauccugcccgcuagcuccauggaggaagccaccgauugugcuggcuuuaaccucauucaucugguggccacaggcaucucuugcuuccuugggagcggacugcucacccuggccguguaccuguccugucagcacugccaaagacagagccaggagucuacacuuguccauccugcuacccccaaucaucugcacuauaagggcgggggaacgccuaaaaacgaaaaguacacacccauggaguuuaaaacccucaauaagaacaaucugauuccggacgaucgcgcgaacuucuauccucuccagcaaaccaacguuuacacaaccacauacuaucccuccccucugaauaaacacagcuuucggcccgaagccucuccuggccagagaugcuuccccaacagcuga

SEQ ID NO: 75374 - RNA, 3144 nt, Artificial Sequence
  derived and/or modified sequence opt5 from SEMA6A__Homo_sapiens__NP_001287709
augagaagcgaggcccugcuccuguacuucacccuucugcacuuugcuggcgccggguuccccgaagacuccgagccuaucucuauuagccauggaaacuauacaaagcaguacccgguguuugucggccacaaacccgggcggaauacgacccaacgccauagacucgauauccagaugauuaugaucaugaacggaacacuguauauugcggcucgggaccacaucuacaccguugauaucgacacaucccauaccgaagagauuuauugcucuaagaaacuuacauggaaaagccgccaggccgauguggacaccuguagaaugaagggcaagcacaaggaugaaugccacaauuucaucaaagugcugcucaagaaaaacgacgaugcccuguuugucugugggacgaaugcuuucaacccuuccugccggaauuacaagauggacacccuggagcccuuuggagaugaguucucuggcauggcccgcuguccuuaugacgcuaaacaugccaacguggcgcucuuugccgauggcaagcuguacagcgcuacaguuaccgacuuccuugccauugacgcugugaucuacagaucccugggggaaagccccacacuccggaccgucaagcacgauucuaaauggcugaaggagccuuauuuugugcaggccguugacuacggagauuauauuuacuucuuuuuccgcgaaaucgcgguggaguauaauacgaugggcaaagucguguucccgagaguggcccaagucugcaagaacgacaugggagggucccagcggguucuugagaaacaguggaccagcuuucugaaggcucgccucaauuguucugugcccggcgauucccauuucuacuuuaacauucugcaggccgugaccgacgucaucagaaucaaugggcgggaugugguucuggcuacauucagcaccccuuauaacucuauucccggauccgccgugugcgccuacgacaugcucgauaucgcuagcgucuuuaccggccgcuucaaagaacaaaaguccccugacucuacauggacgcccgugccggaugagagaguuccuaagccccggccuggcuguugcgcggggagcuccagccuggaaagauacgccaccucuaaugaguuucccgacgacacacuuaacuucauuaaaacccacccccugauggaugaagcugugccuuccaucuuuaaccgcccgugguuccuccggacaauggucagauaucgccugaccaagauugccguggacacggccgcuggacccuaccagaaucacacagucguguuucuuggcagcgagaaagggaucauccugaaguuccucgcccggauuggaaacucuggcuuucugaaugauagccuguuccucgaggaaauguccguuuauaacucugagaaauguagcuacgacgggguggaagauaagagaaucaugggaaugcagcuggaccgcgcguccagcucucuuuaugucgcuuucuccacaugcgugauuaagguuccucugggccggugcgagagacauggcaaauguaagaaaaccugcaucgccagccgcgaucccuacuguggguggauuaaggaaggaggcgccugcucucaccucuccccuaauagccggcugacauuugagcaggacaucgagagagggaacaccgauggacuuggcgacugucauaauuccuucguggcucugaacgauaucucuacaccccucccggacaaugaaaugagcuauaacacggucuacgggcacuccucuagccugcugccuuccaccacaaccagcgauucuacagcccaagagggcuacgaaucccgcggaggcaugcucgacuggaaacaucugcuugacagccccgauucuaccgacccucugggggcuguguccagccacaaucaccaggauaagaagggagugauucgggagucuuaucucaaaggccaugaccagcugguucccgucacgcugcuugccaucgcggugauucucgccuuugugaugggggcugucuucagcggaaucaccguguacugcguuugugaucacagacggaaggacguggccgucgugcaacgcaaagaaaaggagcugacacauuccagacggggcagcaugucuuccguuaccaaacugagcgggcucuuuggcgauacacaguccaaggacccuaagcccgaggcuauucugaccccgcuuaugcacaacggaaaacuggccacgccuggcaauacagcgaagaugcucaucaaagccgaucagcaccaucuggaccugaccgcccuucccacacccgaaucuaccccuacccuccagcaaaagagaaaaccgagccgcgggucccgggagugggaaagaaaccagaaucugauuaacgcuugcacaaaggauaugcccccuaugggaucucccgugaucccuacggaccugccccuccgcgcuagcccuucccacauccccucugucgugguucugccgauuacccagcagggcuaucaacaugaguacguggaucagccuaaaaugagcgaggucgcccagauggcccuugaagaccaggcugcgacacuggaguauaagaccaucaaggaacaccucuccagcaaaucucccaaccauggggugaaucugguggagaaccuggacucccuuccucccaaggucccgcaaagagaagccagccucggaccucccggcgcuucucugucccagacagggcugagcaaacggcucgagaugcaccacucuuccagcuacggcguugauuauaagcgcuccuacccuaccaauagccugacgagaucucaucaggccacaacccuuaaacggaacaauaccaacagcuccaauucuagccaccugucccgcaaccagucuuucggaagaggcgacaaucccccucccgccccgcaacggguggauagcauucaggugcauuccucucagcccagcgggcaagcugucacagugucccgccagccuagccucaacgccuacaauucucugaccagauccggacugaagcggacacccagccuuaagccugacguucccccuaaaccgucuuuugcgccccucuccacgagcaugaagccuaacgaugcuuguaccuga

SEQ ID NO: 75375 - RNA, 2667 nt, Artificial Sequence
  derived and/or modified sequence opt5 from SEMA6B__Homo_sapiens__NP_115484
augcagacccccagagccagcccuccgcggcccgcucugcuccugcuucugcuccugcuuggcggggcccacggacuguucccugaggaacccccuccccucuccguggcgccucgcgacuaccugaaccauuauccggucuuuguuggcucugggcccggaagacugacgccugcugagggcgccgaugaccucaauauccaacgggugcugcgcgugaacagaacgcuuuucauuggggaucgggacaaucuguaccgcgucgaacucgagcccccuaccagcacagaacugagauaucagcggaaacuuaccuggcgcuccaaccccucugauaucaaugugugcagaaugaagggaaagcaggagggcgagugucggaacuuuguuaaagugcugcuccugcgcgacgaaagcacacuguucgucugcggcuccaaugccuuuaacccggugugugcuaauuacucuauugauacccuccagccuguuggggacaacaucagcggaauggccagaugccccuaugauccuaagcacgcuaauguggcccuguucuccgacggcaugcuuuuuacagcgaccgucacggauuuccuggccauugacgcugugaucuaccggagccucggggaucgccccacccugagaacagugaaacaugacucuaagugguuuaaggagcccuauuucguccacgccguugaauggggaucccauguguacuuuuucuuucgggagaucgcuauggaguucaacuaccuugaaaaaguggucgugagcagaguugcccgcguguguaagaaugacgucggcgggucuccucgggugcuggagaaacaauggaccuccuuccucaaggcgagacugaacugcagcguuccgggagauucucacuuuuauuucaaugugcugcaggccgucacaggcguggucucccucggcgggcgccccgugguucuggcuguguuuagcaccccuuccaacucuauucccggaagcgccgucugugcuuucgaccuuacacagguggccgccguuuuugaaggccgguucagagagcagaaauccccugaaagcaucuggacacccgugccggaggaucaagucccucgcccccggccugggugcugugcugcgcccggaaugcaguacaacgccucuuccgcucugccugacgauauucucaauuuugugaagacccacccccugauggacgaggccgugccgagccuuggccaugccccuuggauccugagaacacucaugcgccaccagcugacccggguugcugucgaugugggggccggacccuggggcaaccagaccguggucuuccugggcucugaagcggggacagugcucaaguuucugguuagacccaaugcuagcacguccggaaccucuggccuuagcguguuccuggaggaauuugagacauaucgcccugaccggugcgggagaccgggaggcggggaaaccggccaacggcuccugucccuggagcuugaugccgccagcggaggccuccuggcugccuucccccgcugugucgugagaguuccuguggcucggugccagcaguacucugggugcaugaaaaacuguauuggaucccaagaccccuauugcggcugggccccugaugggagcuguaucuuucugucucccggaacaagagcggccuucgagcaggacgucuccggcgcuagcaccuccgggcucggcgacugcacgggacugcuucgcgccucucugagcgaagaucgggcuggccucguguccguuaaucugcuggugacaucuagcgucgccgcguucguggugggggccgucguuuccggauuuagcgugggcugguucguggggcuuagagagcgcagagaacucgcucggcgcaaggacaaagaggccauucuggcucauggagccggcgaagccguccugucuguguccagacucggggagcggcgcgcucagggcccuggaggcagagggggaggcgggggaggcggggcgggcguucccccggaggcccugcuugcuccucugaugcagaacggaugggccaaggccacccuccugcaaggcgggccccacgaucuggacagcggacuucucccuacccccgaacagacaccgcugccucagaaacggcugcccaccccucacccccauccccacgcucucggcccucgcgccugggaucaugggcacccgcugcuucccgcgucugcuuccagcucucugcuccugcuggccccugccagagcucccgagcagccucccgccccuggagaaccgacacccgacggccggcuuuacgcggcucgcccuggcagagccagccauggggauuuuccccucacgccucacgccucccccgaccggagacgcguggucagcgcuccgaccggaccucuggaucccgccucugcugccgacggccugccccggccuugguccccucccccgacagggagccucagacgcccccugggaccucacgcgcccccugccgcuacccuucggagaacacauaccuucaauuccggcgaggcccgccccggggaucggcacagaggaugucaugcucgcccgggcacggaccuggcccaccuccugccuuauggcggggccgaucggaccgcucccccugugcccuga

SEQ ID NO: 75376 - RNA, 3036 nt, Artificial Sequence
  derived and/or modified sequence opt5 from SEMA6D__Homo_sapiens__NP_001185928
augagaguguuccugcucugcgccuacauccugcuucugauggucagccagcuccgggcuguuuccuuucccgaggacgaugaaccucugaacaccguggacuaucacuacucucgccaauauccgguguucagaggccggcccagcgggaaugagucccagcaucgccuugauuuucagcugaugcucaagauuagagacacacuguacaucgccggacgggaucaggucuauacggugaaccugaaugaaaugccuaaaaccgagguuauucccaacaagaaacucacauggcgcucuagacaacaggaccgggaaaauugugcgaugaagggcaaacacaaggaugagugccauaacuucaucaagguguuugucccucgcaaugacgagaugguguucguuugugggaccaacgcuuuuaaucccaugugcagauacuaucggcugagcacacuugaauacgauggagaggaaauuuccggccuggcccgcuguccuuucgacgccagacagaccaacguggcucucuuugccgaugggaaacuguacucugcuacagucgccgacuuccuugcgagcgaugccgugaucuaucgguccaugggagacggcagcgcucugcgcaccaucaaguacgacucuaaauggauuaaggagccgcacuuucuccaugccaucgaguauggcaauuacguguauuucuuuuucagagaaauugcugucgagcacaacaaucuggggaaagccguuuacucccggguggcgagaaucugcaagaacgauaugggaggcagccagcgcgugcuggaaaagcacuggacgucuuuccucaaagcccggcugaauuguuccguccccggggacagcuuuuucuauuuugaugugcuucaaucuauuaccgacaucauucagaucaacggaaucccuacaguugugggcgucuucaccacacagcugaacuccauucccgggagcgcugugugcgccuuuuccauggaugacaucgagaagguuuucaaaggaagauuuaaggaacagaaaaccccugauucuguguggacggcuguccccgaggacaaggugccgaaaccucgccccggcuguugcgccaagcauggccucgccgaggcuuacaagacaagcauugauuucccugacgaaacccuguccuuuaucaaaagccacccccuuauggauucugcggugcccccuauugccgacgagccgugguucacaaagacccgggucagauaccgccugaccgcuaucuccguugaccauagcgccgggcccuaucaaaauuacacagugaucuuugucggaucugaagccggcauggugcucaaaguucuggcuaagacgagcccuuucucccugaacgauucugugcuccuggaggaaauugaggccuauaaucacgcgaaauguagcgcugagaacgaagaggacaagaaggucaucucccuucagcuggauaaagaccaccaugcccucuacguggccuuuagcucuugcauuauccggauuccccuguccagaugcgaacgcuaugggagcuguaagaaaucuugcaucgcuucccgggauccuuacuguggauggcuuagccagggcuccugcgggagagugacccccggaaugcugcuccugacagaggacuucuucgccuuucacaaucauucugcugaaggcuaugagcaagauaccgaguucggcaacacagcccaccugggggacugucauggaguucgcugggaaguccagagcggcgaguccaaucagauggugcacaugaacgugcucauuaccugcgucuuugcggccuucgugcugggggcuuuuaucgccggaguugcuguguacuguuaccgggauauguucgucagaaagaaucggaaaauccacaaggacgccgaaucugcgcagagcugcacggauuccagcggcucuuuugccaaacuuaacgggcuguucgacuccccggugaaagaguaucaacagaauauugauagcccuaagcucuacucuaaccugcugacaucccgcaaagagcuucccccuaauggcgacaccaagagcaugguuauggaccauagaggacagcccccugaacucgcugcccugcccaccccggagucuacaccugugcugcaccagaaaacccuccaagcuaugaaaagccauuccgaaaaggcccacggccacggggccagccggaaggagacaccccaguuuuuccccucuuccccuccgccccauagcccucugucccacggacauauccccucugcuauuguccuuccuaacgcgacgcacgauuauaauaccagcuuuuccaacucuaacgcccauaaggcugaaaagaagcugcagaauaucgaccacccccucacaaaaagcuccucuaagagagaucaccgccggagcguggacuccagaaacacccugaaugaucugcuuaaacaucucaacgacccuaauagcaaccccaaggccauuaugggcgauauccagauggcccaccaaaaucugaugcuggacccgauggggucuauguccgagguuccucccaaggugccuaaccgcgaggcuagccucuacucucccccguccacacugccuagaaauagccccaccaaacgggucgaugugccuacgacccccggagugcccaugacaucucuugaacgccagagaggcuaucauaagaacuccagccagcggcacuccaucagcgccaugccuaaaaaucugaacucuccgaaugggguccuccugagccgccagcccuccaugaacagaggcggauacaugccuacccccacaggcgcgaagguugacuauauucaagggaccccugugucugugcaucugcagcccagccuuucccggcagucuagcuacacguccaauggaacacucccucgcaccggccugaaaagaacaccgucucugaagcccgaugucccucccaagccuagcuucgugccccaaaccccguccguucggccucucaacaaauacaccuauuga

SEQ ID NO: 75377 - RNA, 1959 nt, Artificial Sequence
  derived and/or modified sequence opt5 from SEMA7A__Homo_sapiens__NP_001139501
augaccccgccuccgcccggcagagccgcuccuagcgcgccccgggcccgcgugccugggcccccugcuagacugggacucccgcugcggcuucgccugcuccugcuucugugggccgccgcugccuccgcucagggccaccucagaucugggccccggaucuucgccgucuggaagggacauguuggccaagaccgcguggauuuugggcagacagagccucacacggugcuguuccaugaacccggaagcuccucugucugggugggcggcagagggaaaguuuaccuguuugacuucccugagggaaagaacgcgagcgugcggaccgauugcgaaaauuauauuacacuccuggagcgcagauccgaaggccuucuggccugugggaccaacgcucggcaccccucuugcuggaaucucgucaacggaacagugguuccgcugggcgagaugcgcggguacgccccuuuuagccccgacgaaaauucccuugugcuguucgagggagaugaggucuauagcaccaucagaaaacaggaauacaacggcaagauuccucgguuucgcagaauccggggcgagucugagcucuauacauccgacaccgugaugcagaauccccaauucauuaaagcuacgaucgugcaucaggaucaggccuacgacgauaagaucuauuacuuuuucagagaagacaaccccgauaagaauccugaggcgccgcugaacgucagccgcguugcccagcuguguagaggggaccaaggaggcgaaucuucccucagcgugucuaaauggaauaccuuucugaaggcuaugcuugugugcuccgaugccgcuacaaacaaaaauuucaaccggcugcaggacgucuuucuccugcccgacccuagcgggcaguggcgcgauacccggguguacggaguuuucuccaaucccuggaacuauucugccgugugugucuacagccuuggcgacauugauaagguguucagaacauccagccugaaaggguaucacucuucccucccuaacccccgcccgggaaagugccugccugaccagcaacccaucccuaccgagacguuucagguugccgaucggcaccccgaaguggcucagagagucgagccuaugggcccccugaagacaccccucuuccauagcaaauaccacuaucaaaagguggcgguccaucgcaugcaggccucucacggcgagaccuuucacgugcuguaccuuacaaccgaccgggggaccauucauaaaguuguggaaccuggagagcaggaacacagcuucgcuuuuaauaucauggagauucagcccuucagacgcgccgccgcuauccaaacaaugucccuggaugccgaacggagaaagcucuaugucucuagccagugggaggugucccagguuccccuggaccuuugugagguguacggcgggggaugccauggcugucugaugagccgggauccuuacugcgggugggaccagggccgcuguauuucuaucuauuccagcgaaagaucuguccuccaauccaucaacccggcggagccccacaaagaaugcccuaaucccaagccugauaaagcuccccugcagaaggugagccuggccccuaacucccgguacuaucucucuugccccauggagagcagacaugccacguacuccuggcgccacaaggaaaauguggagcagucuugugagccgggacaccagagcccuaacugcauucuguuuaucgaaaaucuuaccgcucaacaguauggccauuacuucugugaggcccaggaaggguccuauuuucgggaggcucagcacuggcaacugcuccccgaggacggaauuauggccgaacaucugcugggccacgcgugcgcccuugcugccagccucuggcuggggguucugccuacacucacccugggacuucugguccacuga

SEQ ID NO: 75378 - RNA, 1389 nt, Artificial Sequence
  derived and/or modified sequence opt5 from SEMG1__Homo_sapiens__NP_002998
augaagcccaacaucauuuucgugcugagccuccugcuuauccuggagaaacaggccgcugucaugggccaaaaagggggauccaaaggcagacucccuucugaauuuagccaguucccgcacgggcagaagggacagcauuacuccggccaaaaagggaagcagcagaccgagucuaagggcagcuuuuccauucaguauacauaccacguugacgccaaugaucaugaccaaucucggaaaagccagcaguaugaucugaacgcgcuucacaagacgaccaaaucccagcgccaucugggaggcagccaacagcuccugcacaauaagcaggaagggagagaccacgauaaaucuaagggacauuuccaccggguggugauccaucacaagggcgggaaagcucaccgcggaacacaaaaccccucccaggaccagggcaauagcccuucugggaagggaauuuccagccaguacucuaacaccgaggaaagacuguggguccauggccucuccaaagagcaaacaagcguguccggcgcccagaaggggcggaaacagggaggcucucagagcuccuauguucugcaaaccgaggaacuuguggccaauaagcagcagcgcgagacaaagaacagccaccagaauaaggggcauuaccaaaacgucguggaaguuagagaggagcacucuuccaaggugcagaccagccugugccccgcucaucaggauaaacuccagcacggaucuaaggacaucuuuagcacgcaagaugaacugcuugucuauaauaaaaaccagcaccagaccaagaaucugaaccaagaccagcagcauggccggaaagccaauaagaucuccuaccagucuagcuccacagaggaacgcagacuccacuacggggagaacggagugcaaaaggaugugagccagucuuccauuuauagccagaccgaagagaaagcucagggcaagucucaaaaacagaucacaauuccuucccaggagcaggaacauagccaaaaggccaacaaaaucuccuaccagucuagcuccaccgaggaacggcgccugcacuauggcgagaaugggguccagaaggacguuucucaaagaagcauuuacucccagacggaaaagcugguggcgggaaaaagccagauccaggcccccaacccuaagcaagagccguggcacggcgagaaugcuaaaggggaaucuggacaguccacaaaccgggagcaggaucuccugagccaugaacagaagggccgccaccaacaugggucucacggcggacuugacauugugaucaucgagcaggaagacgauuccgacagacaucuggcccagcaccucaauaacgaucggaauccccuguucaccuga

SEQ ID NO: 75379 - RNA, 1749 nt, Artificial Sequence
  derived and/or modified sequence opt5 from SEMG2__Homo_sapiens__NP_002999
augaaaagcaucauucuguucgugcucucccugcuucugauccucgagaaacaggccgcugucaugggccaaaaagggggaucuaaaggccagcugcccagcggguccucucaguuuccucacggacagaagggccaacauuacuucgggcagaaagaccagcagcacaccaagagcaagggauccuuuucuauucaacauacauaucacguugauaucaacgaccaugauuggacgagaaaaagccagcaguacgaccuuaaugcccugcacaaggcgaccaaauccaagcagcaccucggcggcagccaacagcugcugaacuauaaacaggaagggcgggaucaugacaagucuaagggacacuuccauaugauugugauccaccacaaaggcgggcaagcucaucacggaacacagaauccgucccaggaucagggcaacagccccucugggaagggacucuccagccaaugcucuaauaccgagaaacgccugugggugcauggccuuuccaaggaacaggccagcgccuccggcgcucagaaagggagaacacagggaggcucucaaagcuccuacguccugcagaccgaggaacucgugguuaacaagcagcagcgggagacaaagaauagccaccaaaacaaggggcauuaucagaauguggucgacgugcgcgaggaacacucuuccaagcugcagaccagccuucacccugcccaucaggauagacugcaacacggacccaaagacaucuuuacgacccaggaugagcuccugguuuacaacaagaaucagcaucaaacaaagaaccugucucaggaccaggaacacggccggaaggcucacaaaauuagcuauccuuccucucgcaccgaggagagacagcuccaucacggggaaaagagcgugcaaaaggaugucuccaaaggaagcaucucuauucagacagaggaaaagauccauggcaaaucccagaaucaggugaccauucacagccaagaccaggagcauggccacaaggaaaacaaaaucucuuaccaguccagcuccacggaggagcggcaccugaauuguggggaaaagggcauucagaagggagugucuaaagggagcaucuccauccaaacagaggaacagauucauggaaagucucagaaccaaguccgcauccccagccaggcccaggaguacggccacaaagaaaacaagauuuccuaucagagcagcuccaccgaggagagacggcuuaauagcggggaaaaagacguucaaaagggcgugucuaagggauccaucagcauucagacagaggagaaaauccauggcaagucucagaaccaggugaccaucccuagccaagaucaggaacacgggcauaaagaaaauaagauguccuaccagucuucuuccaccgaggagcgcagacugaacuauggaggcaaaagcacacagaaggacgucucccaaucuagcauuuccuuccagaucgaaaaacucguggaggggaagucucagauucagacgccgaaucccaaccaagaucaguggagcggacagaaugcgaagggcaaauccgggcaaucugccgacagcaagcaggaucugcuuucccacgaacagaaaggccgguacaagcaggagagcucugagucccacaacaucguuauuaccgaacaugagguggcucaagacgaucaccugacacagcaguauaaugaagaccgcaacccuaucagcaccuga

SEQ ID NO: 75380 - RNA, 1935 nt, Artificial Sequence
  derived and/or modified sequence opt5 from SENP1__Homo_sapiens__NP_001254524
auggacgauaucgccgacagaaugcggauggaugcuggcgaggugacccuggucaaccacaauagcguuuucaagacacaucuccugccccagacgggguuuccugaagaccaacuuucccugucugaucagcagauucucagcucccgccagggacaccuggacagaucuuuuaccugcagcacacgguccgccgcguacaacccgucuuauuacagcgauaaucccuccagcgacucuuuccuuggcuccggggaucugcgcaccuucggacaaagcgcuaacggccaguggagaaauucuacaccuuccucuucuuccagccuccagaaaucccggaacucucgcagccuguaucuggagaccagaaagacauccagcgggcucucuaauuccuuugccggaaaaagcaaccaucacugucaugugucugccuacgaaaagagcuuccccaucaaaccugugcccuccccuucuuggagcggcuccugccggcgcagccugcuuucuccgaagaagacccagagacggcacgucuccacggcugaggaaaccgugcaagaggaggaacgcgagauuuauagacagcugcuccagaugguuacaggcaaacaguuuaccaucgccaagcccacaacccacuucccucugcaucuuagccggugucugucuuccagcaaaaauacgcucaaggacucccuguuuaaaaacgggaauagcugcgcuagccaaauuaucggauccgauacaucuagcuccggcagcgccucuauccugaccaaccaggaacagcucucccacagcguguacucucuguccagcuauacacccgacgucgcguucgggucuaaggauagcggaacccuucaucacccucaccaucaccauuccgugccccaccaaccggacaaucuggccgcuagcaacacccagucugagggcuccgacagcguuauucuccugaaggugaaagauucccagacaccuacgcccucuagcaccuuuuuccaggccgagcuuuggaucaaggaacugacauccgucuacgacucucgcgcuagagagcggcucagacaaauugaggaacagaaagcccuggcgcugcagcuccagaaucaacgccugcaggaacgggagcauagcgugcacgauuccguggagcuucaccugagagucccucucgaaaaggagauccccguuaccguggugcaggaaacacagaaaaaggggcauaaacugaccgacucugaggaugaauuucccgagauuacggaggaaauggagaaggaaaucaagaacgucuuccgcaacggaaaucaagacgaggugcuuagcgaagccuuccggcugacaauuaccagaaaagauauccagacccucaaccaccugaauuggcugaacgacgagaucauuaauuuuuacaugaacaugcucauggagcgcuccaaggaaaaaggccugccuagcguucaugcuuucaauacauuuuucuuuaccaaacuuaagacagccggcuaucaggcugugaagcgguggacgaagaaagucgauguguucucuguugacauccugcucgugccgauucaccuggggguccacuggugucuggccguggucgauuuuagaaagaaaaacaucaccuacuaugacuccaugggaggcauuaauaacgaggccugccgcauccuucuccaguaccugaagcaagaaagcaucgacaaaaagcggaaggaguucgauacaaauggguggcagcuguuuucuaaaaagucccaggagauuccccaacagaugaacggaagcgacuguggcauguucgcuugcaaauaugcggauuguaucaccaaggacagaccuauuaauuuuacacagcagcauaugcccuacuuccgcaaacggauggugugggaaauccuccacagaaagcugcuuuga

SEQ ID NO: 75381 - RNA, 1770 nt, Artificial Sequence
  derived and/or modified sequence opt5 from SENP2__Homo_sapiens__NP_067640
auguacagauggcuggugcggauccucggcaccauuuuccgcuuuugcgacagaagcguucccccugcccgggcucugcuuaagcgcagacgguccgauucuacacuguucagcacggucgacaccgaugagaucccggccaaacgccccagacucgacuguuuuauucaccaggugaagaacucccuguauaaugcggcuucucuuuucggguuuccuuuccaacugacaaccaaacccauggugacaagcgccugcaacggaacccggaaugucgccccuuccggcgaaguguuuucuaacagcuccagcugugagcucacagggucuggauccuggaauaacaugcugaagcugggcaauaaaagccccaacgggaucucugauuacccuaagauucgcguuaccgugacgagagaccagccgcggcgcguccuccccuccuucggauuuacccugaauagcgaaggcugcaacagacggccuggcgggcgcagacauucuaagggaaaucccgaguccagccuuauguggaaaccucaggaacaggcugugacagagaugaucuccgaggaaucuggcaaggggcugcggagaccccacuguaccguugaggaaggagugcaaaaagaggagcgcgaaaaguaucggaaacuccuggagagacuuaaggaaagcggccaugggaacuccgucugcccggugacaagcaauuaccacucuucccagcgcagccagauggauacccugaagacgaaaggauggggcgaggaacagaaccauggcgugaagacaacccaauucgucccuaaacaguaucggcucguugagacaagagggccccuguguucucugcgcagcgagaagcggugcuccaaaggaaagaucaccgacaccgaaacaauggugggcauuagauuugagaaugaaucucgccggggguaccagcucgagccugaucugagcgaagagguguccgccagacuucgccugggaagcggcucuaacgggcuccugcggagaaaagucuccaucauugagacgaaggaaaagaacuguagcggaaaagagcgggaccgcagaaccgaugaccuucuggaacucacagaggauauggaaaaggagaucucuaaugcucugggccacggcccccaggacgagauucuguccagcgccuucaaacuccggaucaccagaggggacauucaaacacugaagaacuaucacuggcuuaaugaugaagugaucaacuuuuacaugaaucugcucguugagcgcaacaaaaagcagggauaccccgcgcugcauguguucuccaccuucuuuuauccuaaacuuaagucuggcggguaccaggccgucaagcgguggacgaaaggagugaaucuguucgaacaagagaucauucucguuccgauccacagaaaggugcauuggagccuggucgugauugaccugcgcaaaaagugccucaaguaucuggauuccaugggccagaaagggcacagaaucugugagauucuucugcaguaccuccaggacgaaucuaagacaaaacggaacagcgaucugaaucugcuugaguggacccaccauuccaugaagccccacgaaaucccucaacagcucaacggcagcgacugcggaauguuuaccugcaaauaugcugauuacaucucucgcgacaagcccauuacauucacccagcaucagaugccucuguuuagaaagaaaauggucugggagauccugcaccaacagcuccuguga

SEQ ID NO: 75382 - RNA, 1725 nt, Artificial Sequence
  derived and/or modified sequence opt5 from SENP3__Homo_sapiens__NP_056485
augaaggagaccauccagggcacagggagcuggggacccgaaccuccgggccccgggauuccucccgccuacuccucuccuagacgggagcgccugagauggcccccuccgcccaagccucggcucaagagcggaggcggguucggacccgacccuggcuccggcacgaccgugcccgcucgcagacugccggucccucggcccucuuuugaugccagcgcguccgaagaggaagaggaggaagaggaagaggaggacgaagaugaggaagaggaaguugcugccuggcgccuuccucccagauggucucaacuggggacaagccagcggccccgcccuuccagaccgacccaccggaaaacaugcagccagcgcagacggcgcgccaugagagcuuuccggaugcuccuguauucuaaguccaccagccuuacauuucauuggaaacuguggggaagacaccgcggccggagacgcgggcucgcccaucccaagaaccaccugucuccucagcaaggaggcgcuacgccccaggugccuucccccuguugccgguucgacagcccgagagggccucccccuccccgccugggacuccugggcgcccuuauggcggaggauggcgugcgggggucuccucccgucccguccggaccucccauggaggaagacggccugagauggacccccaagagcccucucgauccggacuccgggcugcuuucuuguacccugcccaauggauuuggcgggcagagcggaccugagggcgaacgcucccucgcucccccugaugccagcauccugauuucuaacgugugcuccaucggcgaccauguugcccaggagcuguuccaagggagcgaucucggaauggcugaagaggccgagcggcccggcgaaaaagcggggcagcacucuccucugagagaggaacacgugacauguguccagagcauucuugacgaguuucugcagaccuacggaucccucaucccccugucuacagaugaagugguugagaaacuugaggacaucuuccaacaggaauuuagcaccccgucccgcaagggccuggugcuccagcugauucaaagcuaucagcggaugccugggaaugccauggucagaggcuuccggguggcuuacaagcgccaugugcugacgauggacgaucucggaacacuguauggccagaacuggcuuaaugaccaggucaugaacauguacggggaucugguuauggacaccgugcccgagaaagugcacuuuuucaauuccuuuuucuaugauaagcucagaacaaagggauacgacggcgucaaacgguggaccaagaacguggauaucuucaauaaagaacugcuucugauuccuauccaucucgagguucacuggucucugauuagcguggacgucagacgccggaccaucacauacuuugauucucaaagaacgcugaaccgcagaugccccaagcacauugccaaauaucuccaggcugaggccgugaagaaagaccggcuggauuuccaucagggguggaagggauacuuuaagaugaauguugcccgccagaacaaugacuccgacuguggcgcuuucgugcuucaauauugcaaacaccuggcgcucagccagccguuuuccuucacccagcaggauaugccuaagcugagacggcaaaucuacaaagaacugugucauugcaaacuuacagucuga

SEQ ID NO: 75383 - RNA, 2268 nt, Artificial Sequence
  derived and/or modified sequence opt5 from SENP5__Homo_sapiens__NP_689912
augaagaaacagagaaagauccuguggcggaaaggcauucaccucgccuucagcgagaaguggaacaccggguuuggaggcuucaaaaaguuuuacuuccaucaacaccugugcauccuuaaggcuaaacuggggcgccccgugacauggaauagacagcuccggcauuuucagggacgcaagaaagcccugcagauucaaaagacguggaucaaagacgaaccucuuugugcgaagaccaaguucaacgucgcuacacagaauguuuccacccugucuagcaaagugaagagaaaagaugccaagcacuuuauuuccucuagcaaaacacuccugcggcugcaggccgagaagcuccuguccucugcuaaaaacagcgaccaugaauauugccgcgagaagaaucuucugaaggccgugaccgauuucccguccaacagcgcucucggccaggccaaugggcacagaccccggacagacccucaacccucugauuuuccuaugaaauucaacggagaaucccagagccccggcgagucuggcaccaucgucgugacgcugaauaaccacaagcgcaaaggguuuuguuacggaugcugucagggcccugagcaucacagaaaugggggaccgcuuauccccaagaaauuccagcugaaccaacaucggcgcauuaagcucuccccucugaugauguaugaaaagcugagcaugaucagauuucgguaccgcauucucagaucucagcacuuccggaccaaauccaagguuugcaaacugagaaaggcgcagcgcagcugggugcaaaaagucacaggcgaccaccaggagacccggagagaaaauggggagggaggcuccuguucucccuucccuagccccgagccgaaggauccuuccugccgccaucagcccuauuuuccugacauggauagcucugccgugguuaagggcacaaacucccacgugcccgacugucauaccaaagggagcucuuuccuuggaaaggaacugagccucgaugaggcuuuucccgaccagcaaaauggcuccgccacgaacgcuugggaucagucuagcugcuccagcccuaaaugggaauguacagagcugauccacgacauuccgcuucccgaacaucggucuaacaccauguucaucuccgagacagagagagaaauuaugacccuggggcaggagaaucagaccagcucugucuccgacgaucgcgugaagcucagcguguccggagccgacacaucugucagcuccguugauggcccugugucucaaaaagcggugcagaacgaaaauagcuaccagauggaggaagacgggucccugaagcagagcauccugucuuccgagcuccuggaucaccccuauugcaagagcccucuugaggcuccccuggucugcucuggacucaaacuggaaaaccaagugggcggcgggaaaaauucccagaaggccagcccgguugacgaugagcagcuuucugugugucugagcggauuucucgacgaagucaugaagaaauacggcucccuggugccucugagcgagaaggaaguucucgggcggcugaaagauguguucaacgaggacuuuucuaauagaaagcccuucaucaaccgcgagauuacgaauuaccgggccagacaccagaagugcaacuuucgcaucuucuauaauaaacauaugcuugauauggacgaccuggcuacccucgauggacaaaacuggcugaaugaccaggucauuaacauguacggcgaacugaucauggaugccgugccugacaagguccacuuuuucaauuccuuuuuccaucggcagcuugugacaaaaggguauaacggcguuaagagauggaccaaaaagguggaucucuucaagaaaagccugcugcucauucccauccaccuggagguccacuggucccuuaucacagugacccugucuaaccggauuaucagcuuuuacgacucccaaggcauucauuucaaguuuuguguugaaaauauccgcaaauaucuccugacggaggccagagagaagaaccggccugaguuccugcagggauggcagacagcugugaccaaaugcauuccccagcaaaagaaugauucugacuguggggucuuugugcuucaguacugcaagugucucgcgcuggaacagccguuccaguuuagccaagaagauaugccuagagugcgcaaacggaucuauaaggagcugugcgaauguagacucauggacuga

SEQ ID NO: 75384 - RNA, 3318 nt, Artificial Sequence
  derived and/or modified sequence opt5 from SENP6__Homo_sapiens__NP_001093879
auggccgcuggcaagagcgggggauccgccggcgagaucaccuuccuggaagcgcucgcuagaucugagagcaaacgggacgggggauuuaagaacaauugguccuucgaucacgaagaggaaucugagggcgacacagauaaagacgggacgaaccugcuuagcguggaugaggacgaagauuccgagaccucuaagggcaaaaagcugaaucgcagaagcgaaauugucgccaacuccagcggagaguuuauccucaagacauacguucggcgcaauaaaucugaguccuucaagacccugaaaggcaaccccauugggcuuaauaugcugagcaacaauaagaaacucucugaaaacacacagaauaccucccugugcagcggaacaguggugcauggcagacgguuucaccaugcccacgcucaaaucccugucgugaagaccgccgcucagcgcaaggaguauccgccccauguucagaaaguggaaauuaacccugucagacugucucggcuccaggggguggagcgcaucaugaagaaaacggaagaguccgagagccaaguugaacccgagaucaagagaaaagugcagcagaagcggcacuguuccaccuaccagccuacacccccucugucuccggccagcaaaaagugccuuacccaccuggaagaccuccaacgcaauuguagacaggcgauuacacugaacgaguccaccggaccccuucugcggacgagcauccaucaaaauucuggcgggcagaagucccaaaacacaggacucaccaccaaaaaguucuauggcaacaaugucgaaaaagugccuauugauaucauugugaacugcgacgauagcaagcacacauaccugcagaccaauggcaaagucauccugcccggggccaagauuccuaagaucacaaaccucaaagagcgcaagacgucucugagcgaccuuaaugaucccaucauucuguccucugacgacgaugacgauaacgacagaaccaaucggagagagagcaucuccccgcagccugcugauagcgccuguucuucccccgcuccuagcacaggaaaaguugaagccgcgcucaacgagaauaccugccgcgccgaacgggagcugagaucuauucccgaagacuccgagcuuaacacagugacccugccccgcaaggcucggaugaaagaucaauuuggcaauagcaucauuaacacgccucucaagagacgcaagguguucucccaggagccgcccgacgcccuggcucugucuugucagagcuccuuugauucugucauccucaauugccggagcaucagaguggggacacuguuccgccuucugauugaaccuguuaucuuuugucucgacuucauuaaaauccagcuggaugagcccgaccaugacccuguggaaauuauccuuaacaccuccgaucugaccaagugcgagugguguaauguccggaaacuccccgugguuuuucugcaagccaucccggccguguaucagaagcugagcauucagcuccagaugaacaaagaggacaaggucuggaacgauugcaagggagugaauaaacugacaaaccuugaggaacaauacaucauucugaucuuccagaauggccucgacccucccgcuaacauggucuucgaaucuauuaucaaugagauugggaucaagaacaauaucuccaacuuuuucgcgaaaauuccuuuugaagaggccaauggaagacugguggcuugcacccgcacauaugaggaaagcaucaagggcucuuguggccagaaagagaacaagauuaaaacgguuuccuucgaaagcaagauccagcugcggucuaagcaagaguuucaguucuuugaugaagaggaggaaaccggggagaaucacacaauuuucaucggacccguggaaaaacuuaucgucuacccucccccgccugccaagggcgggauuagcgugaccaacgaggaccuccacugccugaaugaaggagaguuucugaacgauguuaucauugacuucuaccucaaauaucuggugcuugagaagcugaaaaaggaagaugccgacagaauccauaucuuuuccagcuucuuuuacaagcggcucaaucagcgcgagagacggaaccacgaaacaaccaaccugucuauucagcagaaaagacauggccgcgucaagacguggacccggcacguggauaucuucgagaaagacuucauuuuugugccccugaaugaggcugcccauugguuccuugcgguugucuguuuucccgggcucgaaaagccuaaauaugagccgaacccccacuaccacgaaaaugcugugauccagaagugcuccacaguggaggauagcuguauuuccucuagcgccuccgaaauggagucuugcagccagaacuccucugccaagccugucaucaaaaagaugcugaauaaaaagcauuguauugcugugaucgacagcaaccccggccaagaggaauccgacccuagauauaaacgcaauaucugcagcguuaaguacucugugaagaaaauuaaccacaccgccuccgagaaugaagaguucaacaagggagaaagcacaucucagaaagucgcugauagaaccaaguccgagaauggccugcagaacgagagccucucuuccacgcaucacacagacgggcugagcaaaauccggcuuaauuauuccgaugaaagccccgaggccggaaagaugcuggaagacgagcucguggauuuuucugaagaccaggauaaccaagacgauagcuccgacgauggcuuccuggcggacgauaauuguucuagcgagauugggcaguggcaccugaaaccuaccaucugcaagcagcccuguauucuucucauggacucccugcgcggaccgucuagaagcaacguugugaagauccugcgggaguaccucgaagucgagugggaagugaaaaagggcuccaaacgcucuuuuagcaaggacguuaugaaaggguccaacccuaaggugccccagcaaaauaacuucagcgauugcggcgucuacgugcugcaguauguggaguccuuuuucgagaauccuauucuuucuuuugaacugcccaugaaccucgccaauugguucccgccucccagaaugcggacaaagcgcgaggaaaucagaaacaucauucugaaacugcaggaggaccagagcaaggaaaaacggaagcauaaagauaccuacucuaccgaggcuccucuuggagagggcacagaacaauaugucaauuccaucagcgacuga

SEQ ID NO: 75385 - RNA, 639 nt, Artificial Sequence
  derived and/or modified sequence opt5 from SENP8__Homo_sapiens__NP_001165580
auggaccccgugguccugagcuacauggauucccuccugagacagucugacguuagccuucuggauccuccguccuggcucaacgaccacaucauuggcuucgccuuugaguauuucgcuaauucucaauuucaugauugcagcgaccacguguccuucaucucucccgaagugacccaguuuauuaaguguacaagcaacccugccgagaucgcgauguuccuggaaccccuugaucugccuaauaaacgggucguguuucucgcuauuaacgacaauuccaaccaggccgccgggggaacgcauuggagccugcugguuuaccuccaggauaaaaauucuuucuuucacuaugacucccauagccgcucuaacuccgugcacgcuaaacaagucgccgagaagcuggaggcuuuccuuggcagaaaaggggauaagcuggccuuuguggaagagaaggcgcccgcccagcagaauagcuacgacugcggaauguauguuaucuguaacaccgaagcucucugccagaauuucuuucggcaacagacagagucucugcuucagcugcucaccccugccuacaucacaaagaagcgcggcgaauggaaagaucugauuaccacacuggcuaagaaauga

SEQ ID NO: 75386 - RNA, 978 nt, Artificial Sequence
  derived and/or modified sequence opt5 from SEPHS1__Homo_sapiens__NP_001182531
auggauaccugcgugaucccccugagacacggcgggcucagccugguccagacaacggacuacauuuauccuaucguugacgauccguacaugaugggacggauugccugugcuaacgugcuuuccgaccuguaugccaugggcgugaccgagugcgauaauaugcucaugcugcuuggggucucuaacaagaugacagaccgcgaaagagauaaagugaugccccugaucauucaaggauucaaggacgcggcugaggaagccggcaccagcguuacagggggacagaccgugcucaauccuuggaucguccugggcggcguggccacaaccguuugucagcccaacgaguuuaucaugccugauaaugcugugcccggggacguccuggugcucacgaaaccucugggaacccagguggccgucgcuguucaucaauggcuugauauuccggaaaaguggaacaaaaucaagcugguggugacacaggaggacgucgagcucgccuaccaggaagcgaugaugaauauggcccggcugaaccgcaccgcugccggccuuaugcacacauucaaugcucaugccgcgaccgauauuacgggguuuggaauccugggccacgcccagaaccucgcuaagcaacagagaaaugagguguccuucguuauucauaaccugcccgugcuggccaaaauggcugccgucucuaaggccugcgggaauauguuuggacucaugcacggcacauguccugaaaccagcggcgggcugcuuaucugccugccccgggagcaggcugcgcgcuucugugccgagauuaaauccccuaaguauggagaaggccaccaggcuuggaucaucgggauuguggagaaaggaaacagaacagcccggaucauugacaagccccgcaucauugaaguugccccgcaaguggcuacccagaaugucaacccuacccccggcgccacaucuuga

SEQ ID NO: 75387 - RNA, 1506 nt, Artificial Sequence
  derived and/or modified sequence opt5 from SEPSECS__Homo_sapiens__NP_058651
augaacagagagagcuucgccgcuggcgaacggcuggugucccccgccuacguccgccaggggugcgaggcgagacggucucacgaacaucucauccgccugcuucuggagaagggaaaauguccugaaaauggcugggacgagagcacccucgagcuguuucuucacgaacuggcuauuauggauuccaacaauuuccucgggaacugcggaguuggcgagagagaagggcggguggccucugcccugguggcucgcagacauuaucgguuuauccacggaauuggccgcagcggcgacaucuccgccguccaaccgaaggcugccgggucuagccugcucaauaaaauuacaaacucccuggugcuugauaucaucaagcuggcgggaguucauacgguggccaauuguuucgucgugcccauggcuaccggcaugagccucacacugugcuuucuuacccugagacacaaacggccuaaggccaaguacauuaucuggccccgcauugaccagaaaucuuguuucaaguccaugaucacagcuggguuugagccuguugugauugagaacguccucgaaggagaugagcugagaaccgaccugaaagccguggaagcgaaggugcaggagcucggccccgauugcauccuguguauucacagcacaaccucuugcuucgccccucgggucccggaccgccuugaggaacuggcuguuaucugugccaauuaugauaucccccauauugugaacaaugcuuacggggugcaguccagcaaaugcaugcaccucauccaacagggagccagagucggccggauugacgccuuugugcagucucuggauaagaacuucaugguuccugugggcggggcuaucauugcgggauuuaaugacuccuucauccaggagaucagcaagauguaucccggcagagccuccgcuucuccuagccuugauguccugauuacgcuccugucccuggggagcaacggauacaaaaagcuccugaaagaacgcaaggagauguuuucuuaucuuuccaaucaaaucaaaaagcugagcgaagccuacaacgagcggcuccugcauacaccccacaacccgauuucucuugccaugacccugaaaacccucgacgaacacagagacaaggcugugacacagcugggcagcaugcuguucacccgccagguuuccggggcccggguggucccucucggaucuaugcagacggugagcggcuacacauucagaggcuuuaugucccauaccaauaacuaucccugugcguaccugaaugcugccagcgccaucgggaugaagaugcaagaugucgaccuuuucauuaaacgccuggaucggugccucaaggcugugagaaaagagcgcucuaaggaguccgacgauaacuaugacaaaacagaagauguugacaucgaggaaauggcccugaagcuggauaaugugcuucucgacaccuaccaggaugcuagcucuuga

SEQ ID NO: 75388 - RNA, 1965 nt, Artificial Sequence
  derived and/or modified sequence opt5 from SERAC1__Homo_sapiens__NP_116250
augagccuggccgcuuacugcgugaucuguugcagacggauuggcaccuccacaucucccccuaagagcgggacgcacuggcgcgacaucagaaacauuaucaaauucaccggaucccucauucugggcgggucucuuuuucugacauaugagguccucgcccugaagaaagcgguuacccuugauacacaggugguggaacgggagaagaugaaaagcuacaucuauguccauaccgugucccuggacaagggagaaaaucacggcaucgcuuggcaagcccgcaaggagcuccauaaagccguuagaaaggugcuggcuacaucugccaaaauucugcggaacccguucgcugaucccuuuagcaccgucgacaucgaagaucacgagugugccguguggcuccugcuucgcaaguccaaaagcgacgauaagacgaccagacuggaggcgguucgggaaaugucugagacacaucacuggcacgacuaccaguaucgcauuaucgcccaggcuugcgauccuaagacccucauugggcuggccagauccgaagagagcgaccuucgguucuuucugcugcccccuccccucccuucucugaaagaggauuccagcacagaagaggaacuccgccagcugcuugcuucucugccgcaaaccgagcucgacgaauguauccaguacuucacgucccuggcccuuagcgaguccucucagagccuggcggcccagaagggaggccucuggugcuuuggcgggaauggacugcccuaugcugaguccuucggcgaagugccuagcgccacagucgagauguuuugucuggaagcuauugugaaacauucugagaucuccacccacugcgauaagaucgaagccaacgggggacuccaacugcuucagagacuguaccggcuccauaaagacugucccaaggugcagcgcaauauuaugagagucaucggcaacauggcccugaaugagcaccuucacagcucuauuguucggagcggguggguguccaucauggcugaggcgaugaaaucuccucauauuauggaaagcucccacgccgcuagaauccuggccaaccucgaccgcgagacagugcaggaaaaguaccaagauggagucuaugugcugcauccccaguaccggaccagccagccgaucaaggccgacguucuguucauucacggccucaugggcgcugccuuuaaaaccuggagacaacaggauucugagcaggcggugaucgaaaagccuauggaggacgaggaucgcuauacaacgugcuggcccaaaaccuggcuggcuaaggacuguccugcccuucggauuaucuccgucgaauacgauacaagccugucugacuggagagcccgcugccccauggagcggaaauccauugcuuucagaagcaaugaacuccugcgcaagcugcgggccgcuggggugggagauagacccguuguguggaucucccauucuaugggcgggcuucucgucaagaaaaugcugcuggaggccagcaccaagccugagauguccacagugaucaacaauacccgcggaauuaucuuuuauucugucccgcaccacggcagccggcucgcggaauacuccgugaacauuagauaucugcuuuuccccagccuggagguuaaagaacucucuaaggacuccccugcccugaaaacgcugcaggaugacuuccuugaguuugcuaaggacaagaauuuccaagugcucaacuuugucgaaacacugcccaccuacaucgggagcaugauuaaacugcaugugguuccuguggagucugccgaucucggaaucggcgaccugauucccgucgaugugaaucaccuuaacaucugcaagccgaaaaagaaagacgcuuuccuguaccagcggacccuccaguuuauccgcgaggcccuggcgaaggaucuggaaaacuga

SEQ ID NO: 75389 - RNA, 333 nt, Artificial Sequence
  derived and/or modified sequence opt5 from SERF1A__Homo_sapiens__NP_068802
auggccagaggcaaccagcgggagcuggcucgccaaaagaauaugaaaaagacccaggaaaucagcaaagggaagagaaaagaggacucccucacagccucucagcggaagcagagcuccggaggccaaaagucugaaagcaaaauguccgcggggccccaccuuccucugaaggcuccgcgcgagaaccccugcuucccucugcccgccgccggaggcucuagauacuaucucgcuuacgggagcauuacgccuaucuccgccuuuguguucgucguuuucuuuagcguguuuuuccccucuuuuuaugaagauuucuguugcuggauuuga

SEQ ID NO: 75390 - RNA, 1377 nt, Artificial Sequence
  derived and/or modified sequence opt5 from SERGEF__Homo_sapiens__NP_036271
auggagagagaacccagcgccuccgaggcugccccugcggcugccgcccuguucgcuuggggcgccaacucuuacgggcagcucggacugggccacaaggaagacgugcuucugccgcaacagcucaaugauuuuugcaaaccccggagcguccgcagaaucaccgggggaggcgggcauuccgcuguugugacagacggaggcgaucuguucguguguggccuuaacaaggacgggcagcugggacucggccacacggaggauauuccuuauuuuacccccugcaaaucucuguucggguguccuauccagcaagucgccugcggaugggacuuuacaauuaugcugaccgaaaauggccaggugcucagcuguggguccaacucuuucggacagcugggcguuccccauggcccucggcgcugcguggucccgcaggcgaucgagcuucacaaggagaaagugguuuguauugccgcugggcugagacaugccguggcugccacagcgagcggaaucgucuuucaauggggcaccgggcucgccuccugcggacggcgccugugucccggccagacacuuccucuguucuuuaccgcuaaggaacccagcagagugacggggcucgaaaauucuaaggccaugugcgugcuggcuggauccgaucacagcgccucucugaccgacgccggcgaggucuacguuuggggcuccaacaaacacgggcagcucgcuaaugaggcggccuuccugccugugccccagaagaucgaggcucauuguuuucaaaacgaaaaagugacagccauuuggagcggauggacccaccuugucgcccagacagagaccggcaagauguucacgugggggcgggcugauuauggacagcugggccgcaaacucgaaacauacgagggguggaagcuggaaaagcaagacucuuuucuuccgugcuccagaccucccaauagcaugccuuccucuccccauugccugaccggcgccacagaggugagcuguggauccgagcacaaccucgcgaucauuggcgggguuugcuauagcuggggauggaaugaacacggcauguguggggauggaaccgaggcuaacgugugggcccccaaaccuguccaggcccugcugucuuccagcggccuccugguggggugcggcgcuggacauucucuugcccugugucagcucccggcucaccccgcccugguucaggacccuaaggugaccuaccuuagccccgaugcgaucgaagacacagagucccaaaaagccauggacaaggaacggaauuggaaagagcgccagucugagacgagcacccagucccagagcgauuggucuagaaacggcgggcuguga

SEQ ID NO: 75391 - RNA, 1362 nt, Artificial Sequence
  derived and/or modified sequence opt5 from SERINC1__Homo_sapiens__NP_065806
augggcagcgugcuggggcucugcuccauggccucuuggauccccugucugugcggaagcgcuccuugucuucugugcagauguugcccguccggcaacaauucuaccgucacacggcucauuuacgcccuguuccuucugguugggguguguguggcgugcgucaugcucauccccggaauggaggaacagcugaacaagauuccuggcuuuugugagaaugaaaaaggggugguucccugcaacauccuggugggauauaaggcugucuaccgccucuguuucggccuggccauguuuuaucuucugcucagccugcuuaugauuaaagugaaguccucuagcgacccuagagccgcuguucacaauggcuucugguuuuucaaauuugccgcugccaucgcgaucauuaucggggccuucuuuauucccgagggaacguucaccacagugugguuuuacgucggcauggcuggggccuucugcuuuauccugauucaacucgugcugcugaucgauuucgcucauuccuggaacgaaagcuggguggagaagauggaggaaggaaauucucggugcugguaugccgcgcuccuguccgccaccgcucuuaacuaccugcucagccuggucgccauuguucuuuucuuuguguauuacacacacccugcuucuuguuccgagaauaaggccuucaucagcgugaacaugcugcucugcgucggcgccucugugauguccauccugccgaaaauucaggaaagccagccccgcuccgggcugcuccagucuagcguuaucaccguguacacaauguaucugaccugguccgcuaugacgaaugagccugagaccaacuguaaucccagccuucugucuauuaucggauacaacacaaccuccacagucccuaaggaaggccaaagcgugcagugguggcaugcgcagggcauuaucgggcucauccuguuucuucugugcguuuucuauucuagcauuagaaccuccaauaacucucaggugaacaaacucacgcugacaagcgacgaguccacccugaucgaagauggaggcgcccggagcgacgggucucucgaggauggagacgauguccaccgcgcuguggacaaugaaagagauggcgucacauacuccuauagcuuuuuccauuuuaugcuguuccuugccucucuguacauuaugaugacccucaccaacugguaucgguacgagcccucccgcgagaugaaaagccaauggacagccguguggguuaagaucuccucuagcuggauugggaucgugcuguacgucuggacgcugguggcuccgcuuguucucaccaauagagacuuugauuga

SEQ ID NO: 75392 - RNA, 1422 nt, Artificial Sequence
  derived and/or modified sequence opt5 from SERINC3__Homo_sapiens__NP_006802
augggcgccgugcugggggucuucagccucgccuccuggguucccugccuguguucuggagccagcugccuucuguguuccugcuguccuaacucuaagaauagcaccgugacaagacucaucuacgcguuuauucugcuucuguccacgguggucucuuauaucaugcagcggaaagagauggaaaccuaccucaagaaaauuccgggcuucugcgaagggggauuuaagauccacgaggcugacauuaacgccgauaaagacugugaugugcugguuggcuauaaggccguguaccgcaucagcuucgcuauggccaucuuuuucuuugucuucucccugcucauguuuaaggugaaaacaagcaaggaccugagagcugccguucauaauggguucugguuuuucaaaauugcggcccuuaucggaauuauggugggcucuuuuuauauccccggcggguacuucuccagcgucugguucguggugggaaugauuggcgcugcccuguuuauccucauucaacugguccuucugguugauuucgcucacucuuggaacgaguccugggugaaucggauggaagaggggaacccucgccucugguaugccgcgcugcugagcuuuaccucugccuucuacauccucuccaucauuugcgugggacugcuuuacacauauuacaccaagcccgacggcuguacagagaauaaauuuuucaucagcauuaaccugauccucugcgucguggcuuccauuaucucuauccauccuaagauucaggaacaccagcccagaagcgggcugcuucaguccagccugaucacccucuauacgauguaccugaccuggucugccauguccaaugagccugaucggagcuguaacccgaaucugaugucuuuuauuacacgcaucaccgcucccacacucgccccuggaaacagcaccgccguugugcccacgccuacacccccguccaagucuggcagccugcuugacuccgauaauuucauuggccuguuugucuucgugcucugccugcuuuauagcucuaucagaaccuccacaaacagccaaguugacaaacugacccucucuggguccgauagcgugauccugggagacaccacaacguccggcgcuucugaugaagaggacgggcagccucggcgcgcggucgacaaugagaaggaaggagugcaguacagcuauucccuguuucaucucaugcugugccuugccucucuguacauuaugaugacccucacaagcugguacucccccgaugcuaaauuccagagcaugaccucuaaguggccugccgucugggugaaaaucuccagcucuuggguuugucugcugcuuuauguguggacacucgucgcuccccuggugcugaccuccagagacuuuagcuga

SEQ ID NO: 75393 - RNA, 1263 nt, Artificial Sequence
  derived and/or modified sequence opt5 from SERINC5__Homo_sapiens__NP_001167542
augagcgcccagugcugugcuggccaacuggccugcuguugcggguccgcgggauguucucucugcugugacugcugucccagaauccggcagagccuguccacccgcuucauguacgcucuuuauuuuauucugguggucguucucugcuguaucaugaugucuacaacgguggcccacaagaugaaagagcauauuccuuucuuugaagauaugugcaagggcaucaaagccggggauaccugcgagaagcuggugggauacagcgcugucuauagaguguguuucggcauggccugcuuuuucuuuauuuucugucuucugacacucaaaaucaacaauuccaagucuugccgggcucacauccauaacggguuuugguucuuuaagcugcugcuccugggagccauguguagcggcgcguucuuuauuccggaccaggacaccuuccuuaaugccuggcgcuacguuggcgcugucgggggauuccuguuuaucggcauucagcuccugcuucugguggaguucgcccacaaauggaacaagaauuggacagcugggaccgccuccaacaaacucugguaugcgagccuggcccuggugacacucaucauguacucuauugcuaccggaggccugguucuuauggccguguuuuauacgcaaaaggauuccugcauggaaaauaaaauccugcucggggucaacggaggccugugucuucugauuagccucguggcuaucucucccugggugcagaauagacagccucauuccggccugcugcagagcggggucaucucuugcuacguuaccuaccucacauucuccgcccugagcuccaagcccgccgaaguggugcuugacgagcacggaaagaacgucaccauuugugugccugauuuuggccaagaccuguaucgggaugagaaucucguuacaauccuggggaccucucuucugauuggaugcauccucuacagcugucugacguccacaacccgcucuagcuccgacgcucugcagggcagauaugcggcccccgaacucgagauugcucggugcugcuucuguuuuagcccugggggagaagauacagaggagcagcagccgggcaaagaaggcccccgcgugaucuacgacgagaagaaagggaccgucuauaucuacucuuauuuccacuuuguguucuuucuggccagccuuuacguuaugaugaccgugacaaacugguucaaguccgccuuucaucugcucccuuga

SEQ ID NO: 75394 - RNA, 201 nt, Artificial Sequence
  derived and/or modified sequence opt5 from SERP1__Homo_sapiens__NP_055260
augguggccaagcagagaauccggauggcuaacgagaaacacagcaagaauauuacccaacgcggcaacgucgccaaaacauccagaaaugcgcccgaagagaaggcuucuguugggccuuggcugcucgcccuguucaucuuuguggugugcggaagcgccauuuuccagaucauucaguccauccggaugggcauguga

SEQ ID NO: 75395 - RNA, 198 nt, Artificial Sequence
  derived and/or modified sequence opt5 from SERP2__Homo_sapiens__NP_001010897
augguggccaagcagagaauccggauggcuaacgagaaacacagcaagaauauuacccaacgcggcaacgucgccaaaacacugagaccccaggaagagaaguacccuguugggccguggcuccuggcgcuuuucguguuuguggucugcggauccgcuaucuuccagauuauccagucuauucggaugggcauguga

SEQ ID NO: 75396 - RNA, 1335 nt, Artificial Sequence
  derived and/or modified sequence opt5 from SERPINA10__Homo_sapiens__NP_001094077
augaaggugguccccagccugcuccuguccguucuucuggcccagguguggcucgugccuggccuggcuccgucuccccaaagcccugagacccccgccccucagaaccagacauccagagucgugcaggcgcccaaagaagaggaagaggacgaacaagaggcuucugaggaaaaggccagcgaggaagagaaagccuggcuuauggcuucccggcagcagcuggccaaggagacgucuaauuucggguuuagccuccugcgcaaaaucuccaugagacacgauggaaacaugguuuucagcccuuuuggcaugucucuggcuaugaccgggcucaugcugggagccacaggcccgaccgaaacacagauuaagcgggggcuucaucugcaagcgcucaagcccaccaaaccuggacugcuucccucccuguucaagggccuccgcgagacacugagcagaaaucuggaacucggccugacccaggggucuuuugccuucauccacaaagacuuugaugugaaggagacguucuuuaaccuuuccaaacgguacuucgacaccgaaugcgucccuaugaauuuucgcaacgcuagccaggccaagagacugaugaaucauuauauuaacaaggagacacggggaaaaauccccaaacucuucgaugagauuaauccggaaaccaaacugauccuuguggacuacauccuguuuaagggcaaauggcucacaccuuucgaucccguuuucaccgagguggacacguuucaccuggauaaguauaaaacaauuaaggucccuaugauguacggggcuggaaaguucgccucuaccuuugacaaaaacuuccgcugucaugugcugaagcuccccuaucagggcaaugcgacaaugcuggugguccuuauggaaaagaugggggaucaccuggcccucgaggacuaccugaccaccgaucuuguugaaacauggcugagaaacaugaagacgcggaauauggagguguuuuuccccaaauuuaagcucgaccaaaaguaugagaugcacgaacugcugcgccagaugggaaucagacggauuuucuccccuuuugcugaccucagcgagcuguccgccaccggccgcaaccuucaggugucuagaguccugcaacggacagugaucgaaguugaugagagaggcaccgaagcuguggccgggauucucagcgagaucacagccuacuccaugccgcccgucauuaaaguggaccgcccuuuccauuuuaugaucuacgaggaaaccagcggaaugcugcuguuccuuggccggguugugaaucccacgcuccuguga

SEQ ID NO: 75397 - RNA, 1269 nt, Artificial Sequence
  derived and/or modified sequence opt5 from SERPINA11__Homo_sapiens__NP_001073920
augggccccgccuggcuguggcuccuggggaccggaauccuugcuagcgugcacugccagccucugcucgcccauggcgacaagucccugcaagggccgcagcccccuagacaccagcuuucugagcccgcgccugcuuaccaucggauuacacccacgaucaccaacuucgcccugcgccucuauaaagaacuggccgcugaugccccuggaaauaucuuuuucagcccggucuccauuucuacaacccuggcucuccugagccuuggcgcccaggcgaacacauccgcccugauucucgaggggcugggauuuaaucuuaccgaaacacccgaggcugacauccaccaaggcuucagaucucugcuccauacccuggcccugccuagccccaagcucgaacugaaaguuggcaacucccuuuuucuggauaagcggcucaaaccucgccagcacuaccuggacagcaucaaggagcuuuauggggcuuucgccuuuucugcgaauuucacggauuccgugaccacaggaagacagauuaacgacuaccugcggcgccagaccuauggccaaguggucgauugucuccccgaguuuagccaggacacauucauggugcuggccaauuacaucuuuuucaaggcuaaauggaagcacccguuuucuagauaucagacccagaaacaagaauccuucuucguugaugagcggacgagccuccaggugccuaugaugcaucagaaggaaaugcaccgcuuucuguacgaccaagaucuggccugcacaguccuucagauugaguacagagggaacgcucuggcccuccuggugcuucccgacccuggaaaaaugaagcagguugaggccgcucugcagccccaaacccuccggaaguggggccagcugcugcuccccucucugcuugaucugcaucucccucgcuucuccaucagcgggacauauaaucuggaagacauucugccgcagaucggacuuaccaacauucucaaucuggaggcggacuuuuccggcgugaccggccagcugaacaaaacaaucucuaaggucagccacaaagccaugguggauauguccgaaaaggggacggaggcuggagccgccagcggccuccugucucaacccccuucccuuaauaccaugagcgacccccacgcucauuucaacagaccuuuucugcuccugcugugggaagugacaacccagucucuucucuuccuggggaaagucguuaaucccguggccggauga

SEQ ID NO: 75398 - RNA, 1245 nt, Artificial Sequence
  derived and/or modified sequence opt5 from SERPINA12__Homo_sapiens__NP_001291390
augaaccccacccugggccucgccaucuuccuggcugugcuucugacagucaaggggcuccugaaaccuagcuuuuccccgagaaauuacaaggcccuuucugagguucagggauggaaacaacggauggcggcuaaggaacuggcccgccagaacauggaccucggcuucaaacugcugaagaagcucgccuuuuauaaucccgggagaaacauuuuccugagcccucuuuccaucucuacggcuuuuagcaugcugugccucggagcccaggauuccacccuggacgagauuaaacagggcuucaauuuucggaagaugcccgaaaaagaucuucacgagggguuccauuacaucauucacgaacugacacaaaagacccaggaccucaaacugucuaucggaaacacacuguuuaucgaucagcgccuccagccucaaagaaaguuccuggaggacgcuaagaauuuuuauagcgccgagaccauucuuacaaacuuccagaaucuggaaauggcgcagaaacagaucaacgauuuuauuucccaaaagacccauggcaaaaucaauaaccucauugagaauaucgaccccggcacggugaugcugcuugccaacuacauuuucuuccgggcucgcuggaagcacgaauuugauccuaaugugaccaaagaggaggacuucuuucuggaaaagaacagcucugucaaagugccgaugauguucagauccgggaucuaucagguuggauacgaugacaagcucagcuguacaauccuggagauucccuaucagaagaacaucaccgccauuuuuauccugccugaugaaggcaaacucaagcaucuggagaaagggcuucaaguggacacauucucucgguggaagacccugcucucccgcagagucguggacguuagcgugccccggcugcacaugacgggaacauuugaucuuaaaaagacccugucuuacauuggcgucuccaagaucuucgaggaacacggggaccucacaaaaaucgcuccucaucgcagccugaaggugggagaggccgugcacaaagcggaacugaagauggaugagagaggcaccgaaggcgccgcugggaccggagcccagacacuccccauggagacgccgcuggucguuaaaauugacaagccuuaccuucugcucaucuauuccgaaaagauucccucugugcuguuucugggcaaaaucgugaauccuauugggaaguga

SEQ ID NO: 75399 - RNA, 1257 nt, Artificial Sequence
  derived and/or modified sequence opt5 from SERPINA1__Homo_sapiens__NP_001121179
augcccuccuccgugucuuggggcauccugcuccuggccgggcuuugcugucuggucccuguuagccucgcugaggacccgcagggagaugccgcgcaaaagaccgacacaucccaccaugaucaggaccaccccacguucaacaaaauuaccccuaaucuggcugaauuugccuucucucuuuacagacagcuggcccaucagagcaacuccacaaauaucuuuuucucucccgugagcauugcuaccgccuuugcuaugcucucccugggcacaaaggccgauacccacgacgagauccuggaagggcucaacuucaaucugacagagauuccugaagcgcaaauccaugagggauuucaggagcuucugcggacccucaaccagcccgauagccagcugcaacuuacgaccggcaaugggcuguuccucucugaaggacugaaacugguggacaaguuucucgaggaugucaaaaagcuguaucacuccgaagccuucacagugaacuuuggcgacaccgaggaggcuaagaaacagaucaaugauuacguugaaaagggcacacaggggaaaauuguggaccuugucaaggagcuggaucgcgacaccguguucgcccucguuaacuauaucuuuuucaaaggaaagugggaaagaccuuucgaggugaaggacacggaagaggaggauuuucacgucgaccaggugacaaccgugaaagucccgaugaugaagcggcugggcauguucaauauucaacauugcaaaaagcugagcucuuggguucugcucaugaaauaccuggggaacgcuacagccaucuuuuuccugcccgaugaaggaaagcuccagcaccuggagaaugaacuuacccaugacauuaucaccaaauuucuggagaacgaagaucgcagauccgcgagccuccaccuuccuaaacuuucuauuacaggcacguaugaccugaaguccgugcucgggcagcugggaaucaccaagguguucagcaauggcgccgaucuguccggcgucacagaggaggcuccccucaagcugucuaaagccgugcacaaggcuguucuuaccaucgacgaaaaagggacagaggccgccggagcuauguuucuggaagcgauuccuaugagcauucccccggaggugaaguucaacaagccuuuugucuuccucaugaucgaacaaaacaccaaaagcccccuguuuaugggcaaggugguuaauccuacgcagaaauga

SEQ ID NO: 75400 - RNA, 1272 nt, Artificial Sequence
  derived and/or modified sequence opt5 from SERPINA3__Homo_sapiens__NP_001076
auggagagaaugcugccccuccuggcccuuggccugcucgcugccggguucugcccugcggugcugugucacccgaacagcccccuugacgaagagaaucugacccaagaaaaccaagaucggggaacacaugucgaccucggccuggcuuccgccaauguugauuuugccuucucucuguacaagcagcucgugcugaaagcuccugacaagaacgugaucuuuagcccccuuuccauuucuacggcccuggcuuuccucagccugggggcccacaauaccacacuuaccgagauccugaaaggacucaaguuuaaccugacagaaaccuccgaggcggagauucaucagucuuuccagcaucugcuccgcacacugaaucaaagcuccgaugaacuucagcugagcaugggcaacgccauguuugucaaagagcagcucucucugcuugacagauucaccgaagaugcuaagcggcuguauggguccgaggccuuugcuacggacuuccaggauagcgccgcggccaagaaacucaucaaugacuacgugaagaacggaacccgcggcaaaauuacagaucugaucaaggaccuggauucucaaaccaugaugguucucgugaauuauaucuuuuucaaagcuaagugggagaugccuuuugacccccaggacacacaccaguccagauucuaccugagcaagaaaaagugggucauggugccuaugaugucucuucaccaccugaccauuccguauuuccgggaugaagaacucuccugcacgguuguggaacugaaauacacaggcaacgccagcgcucuuuuuauccugcccgaccaggauaagauggaggaagucgaggccaugcuccugccugagacccugaaacgcuggagagacucccucgaguuccgggagauuggggaacuguaucuucccaaguuuucuaucagccgcgauuacaaucugaacgacauucuccugcaacugggaaucgaggaagccuucacauccaaagcugaucuuagcggcauuaccggggcgagaaaucucgccgugucucaggugguccauaaggcuguucuggacguguuugaggagggaaccgaagccuccgccgcuacagccgugaagaucacgcugcucagcgcgcuggucgagacccggacaaucgugcgcuucaacagaccuuuucuuaugauuaucguucccaccgauacacagaacauuuucuuuaugucuaaagugaccaauccgaagcaggcuuga

SEQ ID NO: 75401 - RNA, 1395 nt, Artificial Sequence
  derived and/or modified sequence opt5 from SERPINA4__Homo_sapiens__NP_001275961
augcccggcgacccugagaagccgcccccugggacccacagcugguacagagccgcucugacagaaggacagggccuccuggccgcgaaccccgggcuucgggugcaacgcaugcaucugaucgauuaucuccugcuucugcucgucggacugcuggcucucucccacggccagcugcauguugagcacgacggggaaucuugcagcaauuccucucaucagcagauucuugagacgggagaaggcagcccuucccugaaaaucgcccccgccaacgcugauuucgccuuuagauucuacuaucucauugcuucugagaccccuggcaagaauaucuuuuucagcccgcuguccauuagcgccgcguacgccaugcuuucucugggggcuuguucccacagccggucucaaauccucgagggacugggcuuuaaccugacagaacucuccgagagcgacgugcaccgcggguuccagcaucugcuucacacccugaaucuccccggacauggccuggaaacaagaguggggucugcccuuuuucugucccacaaccucaaauuccuggcuaaguuucugaaugauaccauggccgucuaugaggcgaaacucuuccacacaaacuuuuacgacaccgugggaacgauccagcugauuaaugaucauguuaagaaggagacccggggcaaaaucguggaccuugucagcgaacugaagaaagaugugcucaugguucuggugaacuauauuuacuucaaggcccuuugggagaaaccuuuuaucuccucucgcacaacccccaaggacuucuacgucgaugaaaauacaaccgugagagugccuaugaugcugcaggaccaagagcaccauugguaucuccacgaucgguaccugcccugcagcguccugcgcauggacuauaagggcgacgcuacgguuuucuuuauucucccgaaccaggggaaaaugagagaaaucgaggaggugcugacaccugaaaugcuuaugcgguggaauaaccugcuccgcaagagaaauuucuacaaaaagcuggagcugcaucuucccaaauuuuccauuagcggaucuuaugugcucgaucagauccugccucggcugggcuucaccgaccucuuuuccaagugggccgaucugagcgggaucacaaaacagcaaaaacuugaggcuucuaagagcuuccacaaggccacccuggacgucgaugaagccggaaccgaagcugcggccgcuacauccuuugccauuaaguucuuuucugcccagacgaaccgccacauccucagauucaaccggcccuuucuggugguuauuuucagcaccuccacacagagcgugcuguuucuuggcaaagucguggaccccaccaagccuuga

SEQ ID NO: 75402 - RNA, 1221 nt, Artificial Sequence
  derived and/or modified sequence opt5 from SERPINA5__Homo_sapiens__NP_000615
augcagcuguuccuccugcuuugccuggugcuccugagcccccaaggcgccucccuucacagacaucacccucgggagaugaagaaacgcgucgaagaccugcauguuggggcuaccguggccccgucuagcagacgggauuuuacauucgaccucuaccgcgcgcuggcuuccgccgcccccucucagagcaucuuuuucuccccugugucuauuagcaugucccuggcuaugcucagccugggagccgggucuuccacgaagaugcagauccuugagggccugggacucaaccugcagaaaagcucugaaaaggagcuucacagaggcuuucaacagcugcuccaggaacugaaucagccccgggauggguuccaacugucccucggaaacgcucuguuuaccgaccuugucguggaucugcaggacacauucguuagcgccaugaaaacccucuaucuggcggauacauuuccuaccaauuuccgcgacucugccggcgcuaugaagcagauuaacgauuacguggccaagcagacaaaaggcaagaucgucgaccuucugaaaaaucucgauuccaacgcugugguuauuauggugaauuauaucuuuuucaaggccaaaugggagaccagcuuuaaccauaaggggacgcaagagcaggacuucuacgucaccuccgaaacaguggugagaguccccaugaugucucgggaggaucaguaucacuaccugcuggaccgcaaucucagcuguagaguugugggagugccuuaucaaggcaacgcgaccgcccuguucauccuuccguccgaagggaagaugcagcaggucgagaauggacugagcgagaaaacacuccggaaguggcugaaaauguuuaagaaacgccagcuugaacuguaccuccccaaguucucuauugagggcuccuaccaacuggaaaaagugcugccuagccucgggaucucuaacguuuuuaccagccacgcugaccuguccggaauuucuaaucauagcaacauccagguguccgagaugguccacaaggccgugguugaaguggaugagagcggcacgagagcugccgccgcuacaggcaccauuuucacauuucggucugcgcgccuuaauucccagagacuggucuucaaccggcccuuucucauguucaucguggacaacaauauucuguuucuggggaaggucaacagaccuuga

SEQ ID NO: 75403 - RNA, 1218 nt, Artificial Sequence
  derived and/or modified sequence opt5 from SERPINA6__Homo_sapiens__NP_001747
augccccugcuccuguauaccugccuucuguggcucccuacaagcggccuguggacggugcaggccauggacccgaacgcugccuacgucaauauguccaaccaccauagagggcuugcgucugcuaauguugauuucgccuuuagccuguacaagcaccucguggcccugucccccaaaaagaacaucuucauuucuccugugagcaucuccauggcucuggccaugcucucucugggaaccuguggccauacacgggcucaacuucugcaggggcucggauuuaaucugaccgagcgcagcgaaacagagauucaccagggcuuccagcaucuucaccaacuguuugccaaauccgacaccagccucgaaaugacaauggggaacgcgcuguuccuggauggaucucucgagcugcuugaauccuuuagcgccgacaucaagcacuauuacgagucugagguccuggcuaugaauuuccaggauugggccaccgcuuccagacagauuaacagcuaugugaaaaauaagacgcagggcaagaucguugaccucuuuucuggccuggauucccccgccauccuugugcuggucaacuacauuuucuuuaaagggaccuggacacaaccuuucgaccucgcgagcacccgggaagagaauuuuuauguggaugaaacaaccguugugaagguccccaugaugcugcaguccucuacgaucagcuaccugcaugacgccgagcucccuugccagcuggugcagaugaacuacgugggaaauggcacagucuucuucauucuuccggauaaagggaagaugaacaccguuaucgcugcccugucccgcgacacaauuaauagauggagcgcuggacucaccucuucccaaguggaucuguauauccccaaagugaccauuagcggcgucuacgaccuuggggacgugcuggaggaaaugggaaucgccgaucucuuuacaaaccaggccaacuucucucggaucacgcaggacgcucaacucaagagcuccaagguugugcacaaagcgguccugcagcugaaugaggaaggcguggauaccgccggcucuacagggguuacccugaaccuuacaagcaagccuauuauccugcgcuuuaaucagcccuucauuaucaugauuuuugaccauuucaccugguccagccucuuucuggcuagagugaugaacccugucuga

SEQ ID NO: 75404 - RNA, 1248 nt, Artificial Sequence
  derived and/or modified sequence opt5 from SERPINA7__Homo_sapiens__NP_000345
augagccccuuccuguaccucgugcugcuuguccugggccuccacgccaccauccauugcgcuuccccugaggggaagguuacagccugucacucuagccagccgaacgcgacgcuguauaaaauguccucuauuaaugcugacuuugccuucaaccuuuacagacgguuuaccguggaaacacccgauaagaauaucuucuuuagcccuguguccauuucugccgcucuggucaugcucagcuucggagccugcuguuccacccaaacagagaucguggaaacccugggcuuuaaccugacagacacccccaugguugagauucagcauggguuccagcaccucaucugcagccugaauuuuccuaaaaaggaacuugagcugcagaucggaaacgcucucuucauuggcaaacaucugaagccccuugccaaguuucugaaugaugugaaaacgcucuaugagaccgaagucuucucuacagacuuuuccaacaucagcgcggccaagcaagagauuaauucucacguggaaaugcagaccaaagggaagguugugggacugauccaggaucugaaaccuaacacaauuaugguccucgugaauuacauccacuucaaggcucagugggccaacccguucgaccccuccaagaccgaggauagcagcuccuuucugauugacaaaacgacaaccgugcaagucccuaugaugcaucagauggagcaguauuaccaccuuguugauauggaacugaauuguacagugcuccagauggacuauagcaagaacgcucuggcccuuuucgugcugcccaaagagggccaaauggaauccgucgaggcggccaugucuagcaagacccucaaaaaguggaaucgccugcugcagaaaggcuggguggaucucuuuguuccuaaguucuccaucagcgcuaccuacgaccugggggccacacuucugaagaugggaauccagcaugcuuacucugaaaacgccgauuuuuccggccucacggaggacaacgggcugaaacuuagcaaugccgcucacaaggcggugcugcacauuggagagaaaggcaccgaagccgcugccguccccgagguggaacucucugaccaaccggagaacacauuccugcauccuaucauucagaucgauagaucuuuuaugcugcucauucuggaacgguccacccgcucuauccuuuuccuggggaagguugugaaucccacagaggccuga

SEQ ID NO: 75405 - RNA, 1008 nt, Artificial Sequence
  derived and/or modified sequence opt5 from SERPINA9__Homo_sapiens__NP_001035983
augcagggccaagggagacggcgcggaaccugcaaggacaucuucuguagcaaaauggccuccuaccuguauggcgugcucuuugcugucgggcugugcgcccccauuuacuguguuucuccugcgaacgcuccgagcgccuaucccagaccuuccucuacaaagagcacgcccgccucccagguguacucucuuaauaccgauuucgcuuuucggcuguaucgcagacucgugcuggagacaccuagccagaacaucuucuuuucccccgcccggauuaauagccacgucaaaaagaaaacccagggaaaggugguugacaucauucaaggccuugaucugcucacagcuauggugcuggucaaccauaucuucuuuaaggccaaaugggaaaagccuuuccacccggaguacacccgcaaaaauuuucccuuccuggugggggaacagguuacagugcaugucccuaugaugcaccagaaggagcaguuugcguucggaguggacaccgaacucaacugcuuugugcugcaaauggauuauaaaggcgacgccgucgcuuucuucguucuucccucuaagggcaagaugagacagcuggagcaggcccucuccgcucggacgcugcgcaaauggagccauucucuucagaagagauggaucgagguguuuauuccucgguucuccaucagcgccucuuacaaucuggaaaccauucuccccaaaauggggauccaaaacguguuugauaagaaugcggacuucuccggaauugccaaacgcgauagccugcaggucuccaaggcuacacacaaagccgugcuggacguuucugaggaaggcaccgaggcuacagccgccaccacgacaaaguuuaucgugagaagcaaggaugggccguccuacuucaccgucagcuuuaaccggacauuccucaugaugauuaccaauaaagcuaccgacggaauccuguuucuuggcaagguggagaacccuacaaaaucuuga

SEQ ID NO: 75406 - RNA, 1194 nt, Artificial Sequence
  derived and/or modified sequence opt5 from SERPINB10__Homo_sapiens__NP_005015
auggacagccuggccaccuccaucaaccaguucgcucucgagcugucuaagaaacuugccgaaagcgcgcaaggcaagaauaucuuuuucuccucuuggagcauuuccacaucucugacgauuguguaccucggggcuaaaggaaccacagccgcccagauggcucagguccugcaguuuaacagagaucaaggcguuaagugcgaccccgagagcgaaaagaaacggaagauggaguucaaucuuuccaacagcgaagagauccacucugauuuucagacccugauuuccgagauccucaaaccuaaugacgauuaucugcugaagacagccaacgcuaucuacggggagaaaaccuaugccuuccauaauaaguaccucgaagacaugaaaacauauuuuggagcggaaccgcagcccgugaacuucguggaggccagcgaucagauucgcaaggacaucaauucuugggucgagagacaaaccgaaggcaagauucagaaccugcuuccugaugacuccguggauagcacgacccggaugauccugguuaaugcucucuacuuuaaagggauuugggagcaccaguuccuggugcagaacacaaccgaaaagcccuuucgcaucaaugagacaaccucuaaaccuguccaaaugauguucaugaagaaaaagcugcauauuuuucacaucgaaaaacccaaggccgugggacuucagcucuauuacaaguccagagaccugagccugcucauccugcuuccugaggauauuaacggccuggagcagcucgaaaaagcuaucacguacgagaagcugaaugaauggacauccgccgacaugauggagcuuuaugaaguucaacugcaucucccgaaauucaagcuggaggacucuuacgaucugaaaagcacccucuccagcaugggcaugucugacgcguucucccagagcaaggccgauuuuucugggaugagcuccgcucggaaccuguuccuuucuaacguguuucacaaggccuucgucgagauuaaugaacagggaacagaggcugccgccggcagcggguccgaaaucgacauucgcaucagagugcccagcaucgaguuuaacgcuaaucacccuuuccuguuuuucauucggcauaacaaaaccaauaccauccucuuuuauggacgccuguguucucccuga

SEQ ID NO: 75407 - RNA, 1176 nt, Artificial Sequence
  derived and/or modified sequence opt5 from SERPINB13__Homo_sapiens__NP_036529
auggacagccugggcgccguguccaccagacucggguucgaucuguuuaaggagcuuaaaaagacaaacgacggaaauaucuucuuuucucccgucggcauucugacggcuaucgggaugguucuccugggaacccggggcgccacagcgagccagcuugaagagguguuccacuccgaaaaagagaccaagucuagccgcauuaaagcugaagagaaggaggugaucgaaaacacagaggccguccaucaacaguuucagaaguuccugaccgaaauuuccaaacucacaaaugauuacgagcugaacaucaccaauagacuguuuggggagaagacguaucucuuccugcagaaauaccuugacuauguggaaaaguacuaucacgccucucuggagccuguugauuuugugaacgcugccgacgaaagccggaaaaagaucaauuccugggucgagagcaagaccaacgaaaagauuaaagaucucuucccggacggaucuaucuccagcucuacaaaacuggugcuuguuaauaugguguacuuuaagggccaaugggaucgcgaguucaaaaaggagaacaccaaagaagagaaguuuuggaugaauaaguccacaagcaaaucuguccagaugaugacccagucccauagcuucuccuucacguuucuggaagaccuccaggcuaagauucugggcauccccuauaaaaacaaugaucugucuauguucgugcuccugccuaacgacauugaugggcuugagaagaucauugacaaaaucagccccgaaaagcugguggaguggacauccccuggacacauggaggaaagaaaggucaaucuccaucugccccgguuugagguugaagacggcuacgaucuugaggccgugcuggcggccauggggaugggagacgcuuucagcgaacacaaagccgauuacucuggcauguccagcgggucuggacucuaugcucaaaaguuucugcacagcuccuucguggccgucaccgaggagggcacagaagcggccgcugccaccggcaucggguuuaccgugacaucugcuccuggacaugagaacguucacugcaaccauccguuccuguuuuucauucgccacaaugaaagcaacuccauccucuuuuucggcagauuuagcucucccuga

SEQ ID NO: 75408 - RNA, 1140 nt, Artificial Sequence
  derived and/or modified sequence opt5 from SERPINB1__Homo_sapiens__NP_109591
auggagcagcugagcuccgccaacaccagauucgcucucgaccuguuucuugcccugucugaaaauaaccccgcgggcaauaucuucauuagcccuuuuuccaucucuagcgcuauggccaugguguuccucgggacacggggaaacacggccgcucaacuguccaagaccuuucacuucaauacagucgaggaaguucauucucgcuuucagagccuuaacgccgauauuaauaaaagaggcgcuuccuacauccugaagcucgccaaccggcuguauggggagaaaaccuacaauuuccugccggaauuucucgugagcacacagaagaccuauggagcggaccuggccucuguggauuuccagcacgcuuccgaggacgcccgcaaaacaauuaaccaaugggucaagggccagaccgaggggaagauccccgaacuucuggcuagcggaaugguggauaauaugacgaaacucguucuggugaacgccaucuacuuuaagggcaauuggaaagacaaguucaugaaagaggcgaccacaaacgccccuuuuagacuuaauaagaaggaucggaaaaccgucaagaugauguaucagaaaaagaaauucgcuuacggcuauauugaagaccugaagugccgcgugcucgagcugcccuaccagggggaggaacugucuaugguuauccuccugccugaugacauugaggaugaauccacaggacuuaaaaagaucgaggaacaacugacccucgagaagcugcaugaguggacgaaacccgaaaaccuugacuucauugaggugaacgucagccugccuagauuuaagcucgaagagucuuacacacugaauagcgaucuggcccggcucggcgugcaggaccuguucaacagcuccaaagcugaccuuucugggaugagcggagcccgcgauaucuuuauuuccaagaucgugcacaaauccuucgucgaaguuaaugaggagggcaccgaagccgcugcggccacagcugggaucgccaccuuuuguaugcugaugccggaggaaaacuucaccgccgaccaucccuuucucuucuuuauuagacacaauucuuccggaagcauccuguuccuuggccgguuuucuagcccuuga

SEQ ID NO: 75409 - RNA, 1248 nt, Artificial Sequence
  derived and/or modified sequence opt5 from SERPINB2__Homo_sapiens__NP_001137290
auggaggaccugugcguggccaacacccucuucgcucugaaucuuuuuaagcaccuggccaaagcgagccccacacagaaccucuuccuguccccuuggucuaucagcuccacgauggcuauggucuacaugggcucuagagggagcaccgaagaucaaauggccaagguucuucaguuuaaugaggugggagccaacgcugugacaccgaugacccccgaaaauuucacauccuguggcuuuaugcagcagauucaaaaagggucuuauccugacgccauccugcaggcucaggccgcggauaagauucauagcuccuuccggagccucucuuccgccaucaacgcuagcaccggaaauuaccugcuggagucugucaacaaacucuuuggcgaaaaguccgccagcuuccgcgaggaguauauuagacugugccagaaguacuauucuuccgaaccccaagcuguggacuuucuugagugugccgaagaggcgcggaaaaagaucaauagcuggguuaaaacacagaccaaggggaaaaucccuaaccugcuccccgagggauccguggauggcgacacgcgcaugguccuggugaaugccguuuacuucaagggcaaguggaaaaccccuuuugaaaagaaacuuaacgggcuguauccguucagagucaauucugcucagcggacacccgugcagaugauguaccuccgcgagaagcugaacauuggauacaucgaagaucugaaagcccaaauucucgagcugccuuaugcuggcgacgugagcauguuucuucugcuccccgaugaaaucgccgacguguccaccgggcuggagcuucuggagagcgaaauuacauacgauaagcucaauaaauggaccucuaaggacaagauggccgaggaugaagucgagguuuauaucccucaguucaaacuggaggaacacuacgagcugagauccauucuccggagcaugggaauggaagacgcuuucaacaagggccgcgcgaacuuuucugggaugagcgagagaaaugaccuguuccuuuccgaaguguuucaucaggccaugguggaugucaacgaggaaggaacggaggcugccgccggcacaggcggggugaugaccggacggacaggccacgggggaccccaauucguugcugaccauccguuucuguuccucaucaugcacaaaaucaccaauugcauucuguuuuucggccgcuuuucuagcccuuga

SEQ ID NO: 75410 - RNA, 1173 nt, Artificial Sequence
  derived and/or modified sequence opt5 from SERPINB3__Homo_sapiens__NP_008850
augaacagccuguccgaggccaauaccaaguucauguuugaccucuuccagcaauuuagaaaaucuaaggaaaacaauaucuucuacagccccauuuccaucacaucugcucugggcauggugcuucugggggccaaagauaacacggcgcagcagauuaagaaaguccuccacuuugaccagguuaccgagaauacaaccggaaaggcugccacauaucauguggaucggagcggcaacgugcaccaucaauuccagaagcugcuuaccgaauuuaauaaauccacagacgccuacgagcugaagaucgcuaacaaacucuucggggaaaagaccuaucuguuucugcaggaguaccucgaugccauuaaaaaguucuaucagacgucugucgagagcguggacuuugcuaaugccccugaagagucccgcaagaaaaucaacagcuggguugaaucucaaaccaaugagaagaucaaaaaccugauuccggagggaaauaucggcuccaacacaacccuugugcuggucaaugcgauuuacuucaaggggcagugggagaaaaaguuuaacaaagaagauacaaaggaagagaaguucuggcccaacaaaaauaccuauaagagcauccagaugaugagacaguacacgucuuuccacuuugccucccucgaagacgugcaagcuaaaguucuggagauuccuuacaagggaaaagaucuuagcaugaucgugcugcuccccaacgagauugacggccugcagaagcuggaagagaagcucacagccgaaaaacugauggaguggaccucucuucagaauaugcgggaaacacgcgucgaucugcaucucccuagauucaagguggaggaguccuaugaccugaaagauacccuucggaccaugggcaugguggacaucuuuaacggggacgcugaucugagcggaaugacaggcucccgcgggcucguccugucuggaguucugcacaaggccuucguggaagugacggaggaaggcgcggaggccgcugccgcuaccgccgucgugggguuuggaagcucccccacaagcaccaaugaagaguuccacugcaaccauccuuuucucuucuuuaucagacaaaauaaaacaaacucuauucuguucuacggccgguuuuccagcccguga

SEQ ID NO: 75411 - RNA, 1110 nt, Artificial Sequence
  derived and/or modified sequence opt5 from SERPINB4__Homo_sapiens__NP_778206
augaacagccuguccgaggccaauaccaaguucauguuugaccucuuccagcaauuuagaaaaucuaaggaaaacaauaucuucuacagccccauuuccaucacaucugcucugggcauggugcuucugggggccaaagauaacacggcgcagcagauuagcaagguccuccacuuugaccagguuaccgagaauacaaccgaaaaagcugccacauaucauguggaucgguccggaaacgugcaccaucaauuccagaagcugcuuaccgaguuuaauaagucuacagacgccuacgaacugaaaaucgcuaacaaacucuucggcgagaaaaccuaucaguuucugcaggaguaccuggaugccauuaagaaauucuaucaaacgagcgucgaauccaccgacuuugcuaaugccccugaggaaagccgcaagaagaucaacucuuggguggagucccagacaaaugagaaaaucaagaaccucuucccggaugggaccauuggaaaugacacaacccugguucuugugaacgcgaucuacuuuaaaggccagugggaaaauaaguucaaaaaggagaacacgaaagaagagaaguucuggcccaacaaggauguccaggccaaagugcuggaaauuccuuauaaggggaaagaccucagcaugaucguucugcuucccaaugagauugauggacugcaaaagcucgaggaaaaacugacagcugagaagcugauggaauggaccucucuccagaacaugagagagacaugcguggaccugcaccuuccucgguuuaagauggaagaguccuacgaucugaaagacacccuccgcaccaugggcauggucaauaucuucaacggcgacgccgaucugagcgggaugacauggucucauggacuuuccgugagcaaggugcugcacaaggcuuuugucgagguuacggaagagggcguggaagccgcggccgcuaccgccguggucgugguugagcucuccucucccagcacaaaugaagaguucuguugcaaccacccuuuucuguucuuuauuagacagaauaagaccaacuccauccuguucuacgggcgguuuagcucuccguga

SEQ ID NO: 75412 - RNA, 1128 nt, Artificial Sequence
  derived and/or modified sequence opt5 from SERPINB5__Homo_sapiens__NP_002630
auggacgcccugcagcucgcuaacagcgccuucgcgguggaucuguuuaagcaacuuugcgagaaagaaccccugggcaauguccucuucuccccuaucugucugucuaccagccuuucccuggcucagguuggggccaagggagacacagccaacgagauuggccaggugcuccacuuugaaaaugugaaagaugucccguucggguuucagacggugaccucugacguuaacaagcugagcuccuucuacucucugaaacucaucaagagacuguauguggauaagagccuuaaucuguccacagaguuuauuagcucuaccaaacggcccuacgcuaaggaacucgagacagucgacuucaaagauaagcuggaggaaaccaaaggacaaaucaacaauuccauuaaggaccuuacagauggccauuuugagaacauccuggccgacaauagcgugaacgaucagaccaagauccucguugugaaugcugccuauuucgucgggaaauggaugaagaaauuuucugaauccgagacgaaggagugcccuuuccgcgugaacaaaaccgacacaaagcccgugcagaugaugaauauggaagcgaccuuuuguaugggaaacauugauagcaucaauugcaaaauuaucgagcugccuuuccagaacaagcaccugucuauguucauucuccugcccaaggacgucgaagacgaguccacaggccuugagaaaaucgaaaagcaacugaacagcgagucccucucucaguggaccaauccuagcacgauggccaacgcuaaaguuaagcuguccauuccgaaauuuaagguggaaaagaugaucgaucccaaagccugucuugagaaucugggccucaagcauaucuucagcgaagacacaucugauuuuuccgggaugagcgagaccaaaggaguggcucugucuaacgucauucacaaggugugccuggaaaucacagaggacggcggggauagcauugagguuccuggagccagaauccuccagcauaaagacgaacugaaugcggaucaccccuucauuuacaucauccggcacaacaagacccgcaauauuaucuuuuucggcaaguuuuguuccccuuga

SEQ ID NO: 75413 - RNA, 1143 nt, Artificial Sequence
  derived and/or modified sequence opt5 from SERPINB6__Homo_sapiens__NP_001182220
augagcgccaucauggacgugcuggcugaggccaacggcaccuucgcgcucaaucugcuuaagacacuggggaaagauaacuccaagaaugucuuuuucucucccaugagcauguccugcgcucucgccaugguuuacaugggagccaaaggcaacacggcugcccagauggcucaaauucugucuuuuaauaagagcgggggaggcggggacauccaccagggauuccagucccuucugaccgaagugaacaaaacaggcacccaguaucuccugagaauggccaaucggcuguuuggcgagaagucuugugauuuccucagcuccuuucgcgacagcugccaaaaguucuaccaggcggaaauggaggaacuggauuuuauuucugccguggagaaauccagaaagcauaucaacacaugggucgcugagaaaaccgaagggaagauugccgagcuucugagcccuggaucuguggacccgcucacacggcugguucuugugaaugcugucuauuuccgcggcaacugggaugaacaguuugacaaagagaauaccgaggaaagacuguucaagguguccaagaacgaggaaaaacccguucagaugauguuuaagcaaagcacguucaaaaagaccuacaucggggagaucuucacacagauucucgugcugccuuaugucggaaaagaacugaauaugaucauuaugcuccccgaugagaccacagaccugcggaccguggagaaggaacuuacguacgagaaauuuguggaauggacacgccuggauaugauggacgaggaagaggucgagguuucucucccuagauucaagcuggaagaguccuaugauauggaaagcgugcuucggaaccugggcaugaccgacgccuuugagcucgggaaggcggacuucuccggaaugucucagacagaucugagccuguccaaagugguccacaagagcuuuguggaaguuaaugaggagggcaccgaagccgcugccgcuaccgccgccaucaugaugaugcgcugugcuagauucgugccccgguuuugcgcggaccauccuuuccucuuuuucauucagcacucuaaaacaaacggcauccuguuuugugggcgcuucuccagcccguga

SEQ ID NO: 75414 - RNA, 1092 nt, Artificial Sequence
  derived and/or modified sequence opt5 from SERPINB7__Homo_sapiens__NP_001248760
auggccagccuggcugccgcgaacgcugaguucugcuuuaaucucuucagagaaauggacgauaaccagggcaaugggaacguguuuuucuccucucugagccuuuuugccgcccuggcucucguccggcugggagcccaagacgauucccuuucucagaucgacaagagcggccugcagucccagcucaaacgcguuuucucugauauuaaugcuagccacaaggacuacgaucuguccaucgugaacgggcuguuugccgagaaaguguauggauuccauaaggacuacauugaaugugcggagaaacucuaugaugccaaggucgaaagaguggacuuuaccaaucaccuggaggauacacggcgcaacaucaauaaguggguugagaacgaaacgcauggcaaaauuaagaaugugaucggggagggaggcaucucuagcuccgcugucauggugcuuguuaacgccguguacuucaaaggcaaguggcaaagcgcuuuuaccaaaucugaaacaauuaauugccacuucaagucccccaaguguagcgggaaagccgucgcgaugaugcaucaggagagaaaguuuaaccugucugugaucgaggacccuuccaugaaaauucucgaacugcgguauaauggaggcaucaacauguacgugcuucugccggagaacgaucucagcgaaauugagaauaagcugaccuuccagaaccugauggaauggacaaauccccgcagaaugaccuccaaauaugucgagguuuucuuuccucaguucaagaucgagaaaaacuacgaaaugaagcaauaccuccgggcccuggggcuuaaggacauuuuugacgagucuaaagcugaucugagcggaaucgccuccggcgggcgccucuauaucagcagaaugaugcacaagucuuacauugaagugacagaggaaggaaccgaggcuacggccgccaccggcuccaauaucguggagaaacagcugccccagagcacacuuuuccgggcugaccacccuuuucuguucgucauucgcaaggaugacaucauucucuuuucuggcaaagugagcugccccuga

SEQ ID NO: 75415 - RNA, 729 nt, Artificial Sequence
  derived and/or modified sequence opt5 from SERPINB8__Homo_sapiens__NP_001027018
auggacgaucugugcgaggccaacggcaccuucgcuaucagccucuuuaagauucugggggaagaggacaauuccagaaacguguucuuuucucccaugagcaucuccucugcccuugcgauggucuucaugggagcuaaaggcagcacagccgcccagaugucccaagcucugugucucuacaaggauggggacauucaccggggauuucagucucugcuuagcgaaguuaaucgcacgggcacccaguaucugcucagaacagccaaccggcuguucggggagaaaaccugcgauuuucugccugacuucaaggaauacugucagaaauuuuaucaagcugagcucgaggaacuguccuucgccgaggauacagaagagugccgcaagcauaucaaugacuggguggcggagaagaccgaaggaaaaauuagcgaggugcuugaugccggcacagucgacccgcugaccaagcucgugcugguuaacgcuaucuacuuuaaaggcaaguggaaugaacaguucgauagaaaauauacgcgggggaugcuuuuuaagaccaacgaggaaaagaaaacagugcagaugauguucaaggaggccaaauucaagaugggauacgcugacgagguccacacccaggugcuggaacuccccuauguugaggaggaacugucuauggugauccugcucccugaugacaauacagaccuggccgucaaagaauga

SEQ ID NO: 75416 - RNA, 1131 nt, Artificial Sequence
  derived and/or modified sequence opt5 from SERPINB9__Homo_sapiens__XP_005249241
auggagacccugagcaacgccuccggcacauucgcuaucagacuccugaagauucuuugccaggacaaucccucucacaacguguuuuguagcccugucuccaucucuagcgcccuggcgaugguucuccugggggcuaaaggaaauacggccacccaaauggcccaggcucuuucccugaacacagaagaggauauucaucgggccuuccagucucuccugaccgaagugaauaaggcuggcacacaguaccugcuccgcaccgccaacagacuguuuggggagaaaacaugccaauuccuuagcaccuuuaaggaauccugucugcaguucuaucacgcggagcucaaagagcugagcuuuauccgggccgcugaagagucucgcaagcauauuaauacguggguguccaagaaaaccgaaggaaagaucgaggagcuucugccgggcagcucuaucgacgccgaaacaagacucguccuggugaacgcuauuuacuucaaagggaaguggaaugagcccuuugaugaaaccuauacacgggagaugccuuucaaaaucaaccaggaggaacagcgccccguucaaaugauguaccaggaggccaccuuuaagcuggcgcacgugggagaagucagagcccagcuccuggagcuuccuuaugcucggaaggaacugucccuccuggugcuucugcccgacgauggcguugagcucagcacgguggaaaaaucucugacauucgagaagcugaccgccuggacaaaaccugacugcaugaaguccaccgaggucgaagugcuccugccgaaauuuaaacuucaggaggauuacgacauggaaagcgugcugcgccaucucggcauugucgaugcuuuccaacaggggaaggccgaccuguccgccaugucugcugagagagaucuuugucugagcaaguucguucacaaguccuuuguggaagugaaugaggagggaaccgaagcggccgcugccagcucuugcuucgucguggccgaguguugcauggaauccggcccccgguuuugugcugaccacccuuuccucuuuuucauccgccauaacagagccaauagcauucuguuuugcgggcgguucucuagccccuga

SEQ ID NO: 75417 - RNA, 1395 nt, Artificial Sequence
  derived and/or modified sequence opt5 from SERPINC1__Homo_sapiens__NP_000479
auguacagcaacgugaucggcaccgucacauccgggaagagaaaaguuuaucugcucucucugcuucugauuggauucugggacugcgugacgugucacggcagccccguggauaucugcaccgccaagccucgggacauuccgaugaaucccauguguaucuaccgcuccccugagaaaaaggcuacagaagaugaggggucugaacagaaaauucccgaggccaccaacagacgggucugggaacucagcaaggcuaauucccgcuuugcgacaaccuucuaucaacaucuggccgacucuaagaacgauaaugacaacaucuuucuuagcccucuguccaucagcacagccuucgcuaugaccaaacucggagccugcaaugauacgcugcagcagcugauggagguguuuaaguucgacaccauuucugagaaaacauccgaucagauccacuuuuucuuugcuaagcucaacuguagacuguaccggaaagccaauaagagcucuaaacuuguuuccgcgaaccgccuguucggcgacaagagccucaccuuuaaugaaacauaucaagauauuucugagcugguguacggggccaaacuucagccccuggacuucaaggaaaacgcugagcaguccagagccgcuaucaauaagugggucagcaacaaaaccgagggacggauuacggaugugaucccuuccgaagccauuaaugagcucacaguucuggugcuggucaacaccaucuauuuuaagggccucuggaaaucuaaguucagcccggaaaacacacgcaaggagcuguucuacaaagcggacggcgaauccugcagcgccucuaugauguaccaggaggggaaguuuagauaucggcgcguggcugagggaacccaagugcuugaacugcccuucaaaggcgacgauaucaccaugguccucauucugccuaagcccgagaaaucccuugccaagguugaaaaggagcugacaccugaagugcuccaggaguggcuggacgagcuggaagagaugaugcucgugguccauaugcccagauuucggaucgaagauggguucagccugaaagagcagcuucaggacaugggacugguggaucucuuuucuccggaaaagagcaaacugccuggcauuguugcugaggggcgcgacgaucuuuacguguccgacgccuuccacaaggccuuucuggaggucaaugaagagggaucugaagcugcggccagcacggcugugguuaucgccggcagaucccucaaccccaaucgggugaccuucaaagccaacagaccuuuucuggucuucauucgcgaggugccccugaauacaaucaucuuuaugggccgggucgcuaaccccugugugaaguga

SEQ ID NO: 75418 - RNA, 1500 nt, Artificial Sequence
  derived and/or modified sequence opt5 from SERPIND1__Homo_sapiens__NP_000176
augaagcacagccugaacgcccuccugaucuuccuuauuaucaccuccgcuuggggcgggucuaaaggaccccuggaccagcucgagaagggcggggaaacagcccaaagcgcggauccucagugggagcagcugaauaacaaaaaucuuuccaugccgcugcuccccgcugacuuucauaaggaaaacacggugaccaaugauuggauuccugagggagaagaggacgaugacuaccuggaucuggagaaaaucuucucugaagacgaugacuauauugauaucgucgacagccucuccguuucucccacagauagcgacguguccgccggcaacauccugcagcuuuuucacggaaagagccggauucaaagacugaauauccucaacgccaaguucgcuuuuaaucuguaccgcgugcuuaaagaccaggucaacaccuucgauaauauuuuuaucgccccuguggggauuucuacagcuaugggcaugaucucccugggccucaagggggagacccaugaacagguucacagcauucugcauuucaaagacuuugugaacgccucuuccaaguaugagaucacaaccauccacaaucuguucagaaaacucacgcaccggcuguuucgcagaaacuucggauacacccuucggagcgucaaugaucuguauauucagaagcaauuucccauccuccuggacuucaagacaaaagugcgcgaguacuauuucgcggaagcccagauugcugauuuuucugacccugccuucaucuccaagaccaacaaccauauuaugaaacuuacaaagggccugaucaaagaugcucucgagaauaucgacccggccacccagaugaugauucugaacugcaucuacuuuaaggggagcuggguuaauaaauuccccguggaaaugacgcacaaccauaauuuuagacugaacgagcgggaagucgugaagguguccaugaugcagacaaagggaaauuuccucgcggccaacgaucaagagcuggacugugauauucuucagcuggaguacgucggcgggaucucuaugcucauuguugugccucacaaaaugagcggaaugaagacccuggaagcucagcuuacaccccgcguggucgagagauggcaaaaauccaugaccaaucggacccgcgaagugcugcucccuaaguuuaaacuggagaagaacuauaaucugguugaaagccucaagcugaugggcaucagaaugcuuuucgacaaaaacggcaauauggccgggaucucugaccagcggauugcuaucgaucuguuuaagcaccagggaacaauuacggugaacgaggagggcacccaggccacaaccgucacaaccgugggguucaugccccucuccacgcaaguucgcuuuacaguggacagaccguuccuguuucugaucuacgaacaucggaccagcugccuucucuucaugggaagagucgccaauccuucucgcagcuga

SEQ ID NO: 75419 - RNA, 1209 nt, Artificial Sequence
  derived and/or modified sequence opt5 from SERPINE1__Homo_sapiens__NP_000593
augcagaugagccccgcccugaccugccucgugcugggccuugcucuggucuucggggagggauccgccguucaccauccuccgucuuacguggcgcaccucgcuagcgacuuuggcgugagagucuuccaacagguggcccaggccuccaaggaucggaacguuguguuuucucccuauggggucgcuagcgugcuggccaugcuucagcugacaacgggaggcgaaacccaacagcagauccaggcugccaugggguucaaaauugacgauaagggaauggcgccugcccuccgccaucuguacaaagagcugaugggccccuggaauaaggacgaaaucuccacaaccgaugcuauuuuuguucaaagagaccucaaacuggugcagggcuucaugccucacuuuuuccggcuuuuucgcucuacagucaaacagguggauuucagcgagguggaaagagcccgguuuaucauuaacgacugggucaagacccauacaaaggggaugaucuccaaucugcucggaaagggcgcuguugaucagcugacccgccuugugcuggugaacgcccucuauuucaaugggcaauggaaaacgcccuuuccugacagcucuacccacagacggcuguuccacaaguccgauggaagcacagucucugugccgaugauggcgcagaccaacaaauucaauuacacagaguuuaccacgcccgacggccauuauuacgauauccuggagcucccuuaucacggggacacacuguccauguucauugccgcucccuacgaaaaggagguuccucuuagcgcccugaccaacauccucucugcucagcugauuucccauuggaagggaaauaugacacgccuucccagacugcucgugcugccgaaauuuagccuggaaaccgaggucgaccuccggaagccucuggagaaccuuggcaugaccgauauguuccgccaauuucaggccgacuucacaucccugucugaucaggaaccccuccacguggcccaggcucugcaaaaaguuaagaucgaggugaaugaaagcggcacggucgcguccagcucuaccgccgugauugucuccgcuagaauggccccugaggaaaucauuauggaccggcccuuucuuuucgugguucgccacaaccccacagggaccgugcuguuuaugggacaggucauggagccuuga

SEQ ID NO: 75420 - RNA, 1194 nt, Artificial Sequence
  derived and/or modified sequence opt5 from SERPINE2__Homo_sapiens__NP_001130000
augaacuggcaucugccccucuuccugcuugccagcgugacccugccuuccaucugcucucacuuuaauccgcucagccuggaggaacuuggcuccaacacagggauucaggucuucaaucaaaucguuaagucuagaccccacgacaacauugugaucagcccucauggaauugcuuccgugcugggcaugcuccagcugggggccgauggacggacgaaaaagcagcuggcgauggucaugcgcuacggcgugaaugggguuggaaaaauccucaagaaaaucaacaaggcuauugugucuaagaaaaauaaggacaucgucaccguggccaacgccguuuuugugaaaaaugcuagcgagauugaaguccccuucgugacaagaaacaaggauguguuucagugugagguccggaauguuaacuucgaagacccugccuccgcuugcgauagcaucaaugccugggugaaaaacgagacccgcgacaugauugauaaucugcuuucucccgaccugaucgauggcgugcucacaagacugguccuugugaacgcgguuuauuuuaagggccuguggaagucccgguuccaaccugagaacaccaaaaagcgcacauuuguggccgcugacgggaaaagcuaccaggucccgaugcucgcccagcugucuguguucagauguggauccaccagcgcucccaaugaucugugguauaacuuuauugaacucccuuaccacggcgagucuaucuccaugcugaucgcccuucccacggaaagcuccaccccucugucugcgauuaucccccauauuagcacaaagaccaucgacuccuggaugagcauuaugguuccgaaacgggugcaggucauccucccuaaguucacagccguggcucaaaccgaucugaaagagccccuuaagguccuggggaucacggacauguuugacucuuccaaggccaauuucgcuaaaauuacacgcagcgagaaccuccacgugucucacauccugcagaaggccaaaauugaaguuagcgaggauggaaccaaggccuccgcugcgacaaccgccauccugauugcuagaucuagcccucccugguucaucguggaccggcccuuucucuucuuuauccgccauaauccuaccggcgccguccuguucauggggcagauuaacaaaccguga

SEQ ID NO: 75421 - RNA, 1275 nt, Artificial Sequence
  derived and/or modified sequence opt5 from SERPINE3__Homo_sapiens__NP_001094790
augcccccuuuccugaucacccucuuucuguuccacagcugcugucuuagagccaacggccaucugcgggaggggaugacacuccugaagacggaauuugcgcuucaccuguaccaguccguggccgcgugccgcaaugagaccaacuucgucauuucuccggcuggaguuagccucccccuggaaauccugcaauuuggcgccgagggguccacaggacagcagcucgccgacgcucugggcuauaccgugcaugauaaaagagugaaggacuuccuucacgccgucuacgcuacacugccuaccucuagccaggggacagaaauggagcucgccuguucccuguuugugcaaguuggaacgccccuuucuccuugcuucguggagcaugucagcuggugggcuaauuccagccuggaacccgccgaucucucugagccuaacuccaccgcuauucagaccagcgaaggcgccucucgggagacagcuggcgggggaccguccgagggccccgggggauggccuugggaacaggugagcgccgcguuugcccagcugguucuggugucuaccauguccuuccaaggcacauggcgcaaaagauuuagcuccaccgacacgcagauccuccccuucacaugugcuuaugggcugguccuucaggugccuaugaugcaccagaccacagaggugaauuacggacaauuucaggauaccgccggccaccaggucggcguucuggaacuccccuaucuggggucugcugugagccuuuuccuggugcucccgcgggacaaggauaccccucugucccauauugagccccaccugacagccagcacgauccaucucuggaccacaucucugcgcagagcccggauggacgucuuccuuccucgcuuuagaauccaaaaccaguucaaucugaaauccauucucaacagcuggggagugaccgaucuguuugacccccuuaaggcuaaucugaagggcaucucugggcaggauggauucuacguuagcgaagcgauucacaaagccaagaucgaggugcucgaggaaggcacaaaggcuuccggggccaccgcccugcugcuccugaaacggucucgcauucccaucuuuaaagcugacagaccuuucauuuauuuucuucgggagccgaacacgggaaucacagucuucuuugaucgcauccagauuaucuaccaaugccugagcuccaauaagggcagcuucgugcacuacccccucaagaacaaacauucuuuuuga

SEQ ID NO: 75422 - RNA, 1257 nt, Artificial Sequence
  derived and/or modified sequence opt5 from SERPINF1__Homo_sapiens__NP_002606
augcaggcccuggugcuccugcuuugcaucggcgcucugcucgggcacagcuccugucaaaaccccgccucuccuccggaggaaggaagccccgacccugauuccaccggcgcgcuggucgaggaagaggaccccuucuuuaagguuccugugaauaaacuugcugccgccgugucuaacuucggguacgaucuguauagaguccggagcuccacaucucccacgaccaaugugcuccugagcccucuguccguugcuacagcccucagcgcucugucucuuggagccgaacagcgcaccgaguccauuauccauagagcgcuguacuaugaccucauuagcucuccggauauccacggcacauacaaggagcugcuugacaccgugacagcuccccagaaaaaccugaaguccgccagccggauugucuuugaaaagaaacuccgcaucaagucuuccuucguggccccucuggagaaaagcuaugggaccagaccccggguucugacgggaaauccucgccucgaucugcaggaaaucaacaauugggugcaagcucagaugaagggcaaacuugccagauccaccaaggagauucccgacgagaucucuauucugcuccugggcgucgcgcauuuuaaagggcagugggugacaaaguucgauagccggaagaccucccuugaagacuuuuaccuggaugaggaacgcacagugagagucccgaugaugagcgacccuaaagccguucuccgguauggacuggauucugaccuguccugcaagaucgcucagcucccccugaccggcagcaugucuauuaucuucuuucuuccucugaaagugacgcaaaaccucacacugauugaggaaagccuuaccuccgaguucauccacgacaucgaucgcgagcugaagacagugcaggccguccucaccgugcccaaacugaagcugucuuacgaaggggagguuaccaaaagccuccaggaaaugaagcugcagucccuuuuugacagccccgauuucucuaagauuacaggaaaaccuaucaagcugacgcaaguggagcauagagcuggcuuugaauggaaugaggacggggccggaaccacaccgucccccggccuccagccugcccaccugaccuucccccuggauuaccaccuuaaccagccuuucauuuuuguccuccgggacacagauaccggcgcucugcuguucaucgggaaaauucucgacccccgcggaccguga

SEQ ID NO: 75423 - RNA, 1476 nt, Artificial Sequence
  derived and/or modified sequence opt5 from SERPINF2__Homo_sapiens__NP_001159392
auggcccugcucuggggccugcuugugcugagcugguccugccuccaggggcccuguucugucuucagcccuguuuccgcuauggagccgcugggacggcaacuuaccucuggccccaaccaggaacaggugagcccucugacacuccugaagcuggggaaucaggagcccggaggccaaacggcccucaaauccccucccggggugugcucucgggacccuaccccggaacagacacaccgccuggcgagagcuaugauggccuuuaccgccgaucuuuucagccuggucgcucagacauccaccugucccaaccucauccugagcccucuuucuguggcccuggcucucucccaucuggcccugggagcgcagaaucacacacuccaacggcugcagcagguucuucaugccggcagcggccccugccugccucaccuccugucucgccuuugucaggaccuggggcccggagcuuuuagacucgccgcucggauguaccugcaaaagggcuucccgauuaaagaggauuuucuggaacaguccgagcaacucuucggggccaagccugugagccugaccggaaaacaggaggacgaucuugcgaacaucaaucagugggucaaggaagccacggagggcaagauucaggaauuucugucugggcuccccgaggacaccgugcugcuucugcucaacgcuauccauuuccagggauuuuggcgcaauaaauucgauccuucccugacacaaagagacagcuuucaccuggaugagcaguucaccguucccguggaaaugaugcaggcccggacauauccccuccgcugguuucugcuugagcagccugaaauucaagucgcucacuucccguucaagaacaauauguccuuuguggugcugguccccacccauuucgaguggaacguuucucaggugcucgccaaucugagcugggacacgcugcacccuccccuugugugggaaagaccuacaaaaguccggcuccccaagcuguaccugaaacaucagauggaucucguggccacccugucccagcuuggccugcaagagcucuuucaggcuccggaccugcgcggcaucagcgagcagucucugguuguguccgggguccagcaccaaagcacacuugaacucucugaggugggaguugaagcggccgcugccaccagcaucgccauguccagaaugucucugagcuccuucagcgugaaccggccuuuucuguucuuuauuuucgaggauaccacaggccucccccuguuugucgggucugugcgcaauccuaaccccuccgcuccuagagaacuuaaggagcagcaggacagccccggaaauaaggacuuccugcaaucucucaaaggcuuuccgagaggggauaagcuguucggaccugaccugaaacuugucccucccauggaggaagauuauccccaguuuggcuccccgaaguga

SEQ ID NO: 75424 - RNA, 1503 nt, Artificial Sequence
  derived and/or modified sequence opt5 from SERPING1__Homo_sapiens__NP_000053
auggccagcagacugacccuccugacacuucugcuccugcuucuggcuggcgaccgggccuccucuaaccccaaugcgacgagcuccucuagccaggauccugagucccuccaagaccgcggggaaggaaagguggcuaccacagucaucucuaaaaugcuguucguugagccgauucuggaagugagcucccuccccaccacaaacagcaccacaaauucugccaccaagaucacggccaacaccacagaugagccuaccacacagcccaccacggaaccuacaacccagcccacaauucagccuacccaaccgaccacacagcugcccacggacuccccuacccagcccacaaccggcagcuuuugcccugggcccgugacacuuuguucugaucuggagucccacagcaccgaggcuguccucggagacgcccugguggauuucucucuuaaacuguaccaugcuuuuuccgccaugaagaaaguugaaacgaauauggcguucagcccguuuuccaucgccucucuccugacacaggugcugcucggcgcuggggagaacaccaagaccaaucuggaaagcauucuuuccuauccuaaggacuucacaugcguccaccaagcccugaaaggauuuaccacaaagggcgugacgagcguuucucagaucuuccauucccccgaucucgcuaucagagacaccuuugugaacgccagccggacacuguacucuagcuccccucgcguccuuucuaauaacagcgaugcgaaucuggagcucauuaacaccuggguggccaaaaauacaaacaauaagaucuccagacugcuggacagccuccccucugauacccggcuggugcuucugaacgcuauuuaucucuccgccaaauggaagacgaccuucgaccccaagaaaacacgcauggagccuuuucacuucaagaacagcgucaucaaaguuccgaugaugaacucuaagaaauaccccguggcucauuuuauugaccagacccugaaggccaaagugggccagcuucaacugucccacaaucucagccuggucauccuggugccucagaaucucaagcacagacuggaagauauggagcaggcccuuucccccucuguuuucaaggcuauuauggaaaaacuggagaugagcaaguuccaaccuacacuccugacccugccccggaucaaagugacgacaucccaggacaugcuuucuaucauggaaaagcucgaguuuuucgauuuuagcuaugaccugaaccugugugggcucaccgaggauccggaccugcaggucuccgcgaugcagcaucaaacagugcuugaacugaccgagaccggaguugaagccgcugccgccagcgcuauuucuguggcccgcacacuccuggucuucgaggugcagcagccuuuucuguucguccuuugggaucagcaacacaaauuucccguguucaugggcagaguuuacgacccucgggcguga

SEQ ID NO: 75425 - RNA, 1257 nt, Artificial Sequence
  derived and/or modified sequence opt5 from SERPINH1__Homo_sapiens__XP_011543629
augagaagccugcuccugcuuuccgccuucugccugcucgaggcugcccuggcggcugaagugaagaaacccgccgccgcugccgcuccuggcaccgccgagaaacuuucuccgaaggcggccacacuggcugaacggagcgccgggcucgcuuuuucccuguaccaggccauggcgaaggaccaagccgucgagaacauccugguuucucccgugguggucgcuagcucccucggacuggugucucuuggcgggaaagccacgaccgcuagccaggccaaggccguucuguccgcugaacagcuccgcgaugaggaggugcacgcgggacugggcgaacuucugagaagccucucuaauuccacagcccggaacgucaccuggaagcuggggagccgccuguauggaccuucuuccgugagcuucgcugacgauuuuguuagaucuuccaaacagcauuacaauugugagcacagcaagauuaacuuccgggacaaacgcuccgcccuccaaucuaucaaugaaugggccgcucagacaaccgauggcaagcugcccgaggugacaaaagacgucgagagaaccgauggcgcccuucuggugaacgcgauguuuuucaagccucauugggacgaaaaguuucaccauaaaaugguggauaaucggggguucauggucacgcgcagcuauaccguuggagugaugaugaugcacagaacaggccucuacaacuauuacgacgaugagaaggaaaaacugcagauuguggagaugccccuugcucacaagcuguccagccucaucauucugaugccucaucacgucgaaccgcuggagcggcucgagaaacugcuuaccaaggaacagcugaaaaucuggauggggaagaugcaaaagaaagccguggccaucucucuccccaagggaguuguggaggucacacaugaccugcagaaacaccuugcuggccuggggcucaccgaagccauugauaagaauaaagcugaccugucccgcaugagcggaaagaaggaccuguaucucgccucuguguuucacgcgacggccuucgagcuggauacagacggcaacccuuuugaucaggacaucuacggcagagaggaacuucggagccccaaacuguucuacgcugaucauccuuuuauuuuccucguucgcgacacccaguccgggucucugcuguucaucggaagacuugugcggcccaagggcgauaaaaugagagacgagcucuga

SEQ ID NO: 75426 - RNA, 1233 nt, Artificial Sequence
  derived and/or modified sequence opt5 from SERPINI1__Homo_sapiens__NP_005016
auggccuuccugggccucuuuagccugcuugugcugcaguccauggcuaccggggccacauuccccgaggaagcgaucgcugaccucucugucaacauguacaauagacugcgggccacgggagaggaugaaaacauucuuuuuagcccucuguccaucgcccucgcuaugggcaugauggagcugggggcccaaggaucuacccagaaggaaauucgccacagcaugggcuaugacucccugaaaaauggggaggaguucucuuuucucaaggaguucagcaacaugguuacagcuaaagagucccaguacgugaugaagaucgccaauagccuguuugugcagaacggauuccaugucaaugaagaguuucuucaaaugaugaaaaaguauuucaacgcggccgugaaucacguugauuuuucucagaacguggcugucgccaauuacauuaacaaguggguggagaauaacaccaauaaccugguuaaagaccucguguccccgagagauuucgacgcugccacauaucuggcgcuuaucaacgccgucuacuuuaagggcaauuggaaaagccaguuccggcccgaaaacacccgcacauucucuuuuaccaaggaugacgaguccgaagugcagaucccuaugauguaucaacagggcgaguucuacuacggggaauuuagcgauggaucuaaugaggcuggcgggauuuaucaggugcuggagauccccuacgaaggagacgagauuuccaugaugcucguccugagcagacaggaaguuccucuggccacgcucgagccccuggugaaagcucaacuuguggaagagugggccaacuccgucaagaagcagaaaguggagguuuaucugccucgguucaccguggaacaggagaucgaucucaaggacguccugaaagcccuuggcauuacagaaaucuuuauuaaggaugcuaaucugaccgggcucucugacaacaaagagaucuuccugagcaaggcgauccauaaauccuuucuggaagugaaugaggagggaagcgaagccgcugccguuucuggcaugauugccaucucccgcauggcugugcucuacccgcaagucauuguggaccaccccuucuuuuuccugaucagaaaccggcgcacaggcaccauucuuuuuauggggagagucaugcauccugagacgaugaauacaagcggacacgauuucgaagaacuguga

SEQ ID NO: 75427 - RNA, 1248 nt, Artificial Sequence
  derived and/or modified sequence opt5 from SERPINI2__Homo_sapiens__NP_001012303
augauccagaaccugaugagagaggugaagauggacaccauuuuccucuggagccugcuucugcucuuuuucggcucccaagccucucggugcagcgcucagaaaaauacagaauuugccgucgaucuguaccaggagguuucccuuucucacaaggacaacaucauuuucagcccccuggggaucacgcucgugcuggaaauggugcagcugggagcgaaaggcaaggcucaacagcagauucgccagacccucaaacaacaggagacauccgccggggaagaguuuuucguccugaagucuuucuuuagcgccaucuccgagaagaaacaggaauuuaccuucaaucuugcuaacgcccuguaucuccaggagggauuuacagugaaggaacaauaccugcauggcaauaaagaguucuuucagagcgcuaucaaacuuguugauuuccaggacgccaaggcgugugccgagaugauuucuaccuggguggaaagaaagacagaugggaagaucaaagacauguucuccggagaggaauuuggcccucugacccggcucguccuggugaacgcuauuuauuucaagggcgauuggaaacaaaaguuucgcaaagaggacacgcagcugaucaauuucaccaagaaaaacgggagcacaguuaagauuccgaugaugaaggcccuccugagaaccaaauacggauauuuuucugaauccagccuuaauuaccaggugcuggagcucucuuauaagggcgaugaguucucccugaucauuauccuucccgcugaagggauggacaucgaggaagucgagaaacugauuacagcccagcaaauccucaaguggcugagcgaaaugcaggaggaggaaguggagauuucccugccucgguuuaaaguggaacagaaggucgauuucaaggacguucucuacucucugaacaucaccgagauuuuuagcggaggcugcgaucuuuccgggaucacggacagcucugaaguguacgugucccaggucacacaaaaaguguucuuugagaucaaugaggacggaagcgaagcggccaccucuacaggcauucacauccccguuauuaugagccuggcucagucccaguucaucgccaaccauccuuuucucuucauuaugaagcacaaucccaccgagucuauccuguucaugggccgcgugaccaacccugauacacaggaaaucaaagggagagaccuugauagccuguga

SEQ ID NO: 75428 - RNA, 711 nt, Artificial Sequence
  derived and/or modified sequence opt5 from SERTAD1__Homo_sapiens__NP_037508
augcugagcaagggccucaaaagaaagcgggaggaagaggaagagaaagaaccccuggccguggacuccugguggcuugauccugggcacaccgcugucgcccaggcgccgcccgcuguugccucuagcucccuguucgaccucucugugcugaaacuucaucacagccugcaacaguccgagccugaucuccgccaucuggugcuggucgugaacacacucagacggauccaggccucuauggcucccgccgcugcccugccucccguuccuagcccgcccgcggccccuuccguggcugacaaucuucuggccagcucugaugcugcccucuccgcgagcauggccucucugcuugaggaccugucccacauugaaggacucagccaggcuccccaaccucuggccgaugaggggcccccgggccgcucuaucggaggcgcugccccuucccugggggcccucgaccugcuuggacccgcuacgggcugccugcucgaugacggccuggaagggcuuuuugaggauauugacaccagcauguacgauaacgagcugugggcgccugccuccgaaggacucaagcccggccccgaggacgggccuggaaaggaagaggcuccggaacuggacgaggccgagcuggauuaucucauggacguccuggugggcacacaggcccuugaaagacccccugggcccggacgguga

SEQ ID NO: 75429 - RNA, 966 nt, Artificial Sequence
  derived and/or modified sequence opt5 from SERTAD2__Homo_sapiens__XP_011531506
augcugcccgugauccaguacaugcucggcaaagggggaaagagaaaguucgacgagcacgaagauggccuggaggggaaaauugucagcccuugcgacggaccguccaagguuucuuauacccuucaacggcagacaaucuuuaacauuagccugaugaaacucuacaaucaucgcccccugacggaaccuucccuucagaagaccgugcugaucaacaauaugcucagacggauucaggaggaacugaagcaagagggcucucugcgccccauguucacaccuagcucccagcccaccacagagccuucugauagcuauagagaagccccgcccgcuuuuucccaccucgccagcccuucuucccaucccugugaccuggggagcaccacaccucuugaggcgugccugacccccgcuucucuccuggaagaugacgaugacacguucuguaccucccaggccaugcagccgacagccccuaccaaacuuucucccccugcucugcuccccgagaaggauagcuuuuccagcgcccuggacgagaucgaggaacugugccccacauccaccucuacggaagcugccacagcggccaccgauagcgugaaaggaacauccagcgaggcuggcacccaaaagcucgacggcccucaggaaucucgggccgaugacuccaaacugauggacagccuuccggggaacuucgagaucaccacaucuacgggauuucugaccgaucucacacuggacgauauucuuuucgcugacaucgauaccagcauguacgacuuugaucccuguacauccucuagcggcaccgccuccaagauggcgccugucagcgccgacgaucugcucaagacgcuggcucccuauucuucccagccugugacacccagccagccguucaaaauggaccugaccgagcucgaucacauuauggaaguucugguggggucuuga

SEQ ID NO: 75430 - RNA, 1479 nt, Artificial Sequence
  derived and/or modified sequence opt5 from SESN1__Homo_sapiens__NP_001186862
augagacuggccgcugccgcgaacgaggcuuacaccgcuccccucgccgugagcggccugcuugggugcaagcaguguggaggcgggcgggaccaagaugaggaacugggaauccgcauuccuagaccgcucggccaggggcccucccgguucaucccugaaaaagagauucugcaggucggaucugaagacgcccagaugcacgcccuuuuugcugauagcuucgccgcgcugggccgccucgacaauaucacacugguuaugguguuucauccccaauaucuggaguccuuccucaagacgcagcacuaccugcuucagauggauggcccucugccccuccauuauagacacuacauugggaucauggccgcugcccggcaucagugcucuuaucuggugaaccuucacgucaaugacuuucugcacgugggaggcgauccuaaauggcucaacgggcuggagaaugcuccgcaaaagcugcagaaccucggagaacugaauaaaguucuugcccaucgccccuggcugaucaccaaggagcacauugaaggccuccugaaggcggaggagcauagcuggucccuugccgaacuggugcacgcugucgugcuccugacacacuaccauucucuggccagcuucaccuuuggguguggaaucuccccugagauucacugcgacggcggccauacauucagacccccuagcguuucuaacuauuguaucugcgauauuaccaaugggaaccacuccguggacgaaaugcccgucaauagcgcugagaacgugucuguguccgauagcuuuuucgaagucgaggcccucauggagaaaaugcggcagcugcaggaaugucgcgacgaggaagaggccucucaagaagagauggcuuccagauuugagaucgaaaagcgggagagcauguucguguuuuccucugaugacgaagagguuacaccggcgcgcgccgugagcagacauuucgaagacaccuccuacggauacaaagauuucagccggcacggcaugcacgucccuacguuucgcgugcaggacuauugcugggaggaucauggguacucucuuguuaauagacuguaucccgacgugggacagcucauugaugagaaguuccacaucgcuuacaaccugaccuauaauacaauggccaugcauaaagacgucgauaccuccaugcuucggagagccaucuggaacuacauucacuguauguuuggcauccgcuaugacgauuacgacuacggggaaauuaaccaacugcucgaucggagcuucaagguguauaucaagacaguugugugcaccccugagaaagucacgaagagaauguacgacucuuuuuggcgccaguucaaacacagcgaaaaggugcaugucaaucugcugcucauugaggcucggaugcaggccgagcugcuuuaugcgcugagagcuaucacacgcuacaugaccuga

SEQ ID NO: 75431 - RNA, 1062 nt, Artificial Sequence
  derived and/or modified sequence opt5 from SESN3__Homo_sapiens__NP_001258523
augagccugcacacccaguaccucgaguccuuccugagaucucaauuuuauaugcuucggauggacggcccccugccucucccguaccgccauuauaucgccauuaugaagcuggugaaaacaggggaaaacaauuggagccuucccgagcugguccacgcuguugugcuccuggcccauuaccacgcgcuggcuuccuucguguuuggaucuggcaucaacccugaaagagaucccgagauuagcaauggguuccggcucaucuccgucaacaauuuuugcgugugugaccuggccaacgauaauaacauugaaaaugccucucuuagcggauccaacuucggcaucguugacagccugucugagcucgaggcucugauggaacgcaugaagagacuucaggaggaacgggaggaugaggaagccucccaggaggaaaugagcacgcgcuuugagaaagaaaagaaagagucucuguucguggucuccggggacaccuuucauagcuucccucacucugauuuugaggacgauaugaucauuacauccgacgugagcagauauaucgaagaucccggauucggcuacgaggacuuugcucggcgcggcgaggaacaccucccuaccuucagagcccaggauuauacaugggaaaaucauggguucucccugguuaaccggcuguacucugacauuggacaccuccuggacgagaaguuucgcaugguguacaaucuuaccuauaacacaauggcgacccaugaggaugucgacacgaccaugcugagacgggcccucuucaauuacgugcacugcauguuuggcauccgcuaugaugacuacgauuauggggaagugaaccaacugcuugagagaagccugaaggucuacauuaaaacaguuaccuguuauccggaacggacaaccaagagaauguacgacuccuacuggcgccaguucaaacacagcgagaaggugcaugugaaccuccugcugauggaagcucggaugcaggccgagcuccuguaugcucuuagagccaucacgcgccaccugacauga

SEQ ID NO: 75432 - RNA, 729 nt, Artificial Sequence
  derived and/or modified sequence opt5 from SETBP1__Homo_sapiens__NP_001123582
auggagagcagagaaacccuguccucuagccggcagcgcggcggggaguccgacuuccuccccgugucuagcgccaagccuccggcugcccccggaugcgcgggcgaaccucugcuuuccacacccgggccuggaaaaggcauccccgucgggggagagagaauggaaccugaggaggaagaugagcugggcucuggccgggacguugauagcaacuccaaugcugacagcgaaaaguggguggccggggauggacucgaggagcaagaauuuucuauuaaagaggccaacuucacggaaggcucccugaaacuuaagauccagaccacaaagcgcgcuaagaaaccgcccaagaaucuggagaacuacauuuguccucccgaaaucaaaauuaccaucaagcagagcggggaccagaaagugucuagagccggaaagaacuccaaggcuacaaaagaggaggaacggagccacucuaagaaaaagcuccugaccgccuccgaucuggcggccagcgaccucaaaggcuuucaaccucagaucaaggauuccucuaaagaggaagucuggaagcgcagagggggacagggcauucccuucaagaaacaguuucugagccaagagcgggcuaugugcuucuccuguccgcgcaauccuuuucccgccaagccuggcagccuuacacugcccuuccauucugaacccgcugugugggcccaggagguuuga

SEQ ID NO: 75433 - RNA, 5124 nt, Artificial Sequence
  derived and/or modified sequence opt5 from SETD1A__Homo_sapiens__NP_055527
auggaccaggagggcgggggagauggccaaaaggcccccagcuuccaguggagaaacuacaaacugaucguggacccugcucucgaucccgcccugcggcgccccucccagaaggucuauagauacgacgggguucacuuuucugugaaugauagcaaauauauuccuguggaagaccuucaggauccccggugccauguccgcuccaagaacagagacuucucucugccugugcccaaauuuaagcucgaugaguucuacaucggacaaauuccucugaaggaaguuaccuuugcgcggcuuaaugacaacgugcgcgagacauuccugaaagauauguguagaaaguauggcgaagucgaggagguggaaauccuccugcacccccggacgcgcaaacaucuggggcucgcuagaguucuguuuaccagcacacggggagccaaggagaccgugaaaaaucuucaccugacauccgucaugggcaacauuauccaugcccagcucgacaucaagggccagcagcgcaugaaguacuaugaacugauugugaaugggucuuacacaccccaaacagugccuaccggaggcaaagcucuuagcgagaaguuccagggguccggagccgcuacggagaccgccgaaagcagacggagaucuagcagcgauacagccgccuaccccgcuggcaccacagccgucgggaccccuggaaacggcacgcccugcucucaggacacauccuuuuccucuagcagacaggacaccccgagcuccuucggccaauuuacaccucagucuagccaggggacccccuauaccucccggggaagcacaccuuacucucaagauuccgcuuauagcucuagcacgaccuccacaucuuucaaacccagacgcagcgaaaauagcuaccaggacgccuuuagccggagacacuucucugcguccagcgccucuaccacagcuuccaccgccaucgcugccacgacagccgcuaccgcgagcuccucugccagcuccucuagccuguccuccucuagcuccucuuccagcucuagcuccagcucucaguuccgcuccagcgaugcuaacuaucccgccuacuaugaauccuggaaucgguaccagagacacaccucuuacccuccgcgccgggccacaagagaggaacccccuggcgcucccuuugccgagaacaccgcggagcgcuucccucccagcuauacauccuaccucccgccugaacccucucggccuacggaccaagauuauagacccccugcuagcgaggcgcccccucccgaaccgcccgagccugggggaggcgggggaggcggcgggccgucccccgaacgcgaggagguucggaccucuccuagacccgccagcccugcucgguccggaagccccgccccugaaacaaccaaugagucugugcccuuugcucagcauuccagccuggacucucgcauugaaaugcugcucaaggagcagagauccaaauucagcuuucuggccucugauacagaagaggaggaagagaacuccagcauggugcuuggcgcgcgggacaccggguccgaagucccgagcggaucuggccacgggccuuguacgcccccucccgccccggcuaauuucgaggauguggccccuaccggcagcggagagcccggcgcuacaagagaauccccuaaggccaacgggcagaaccaagcgucucccugcagcuccggagacgauauggagaucucugacgacgaucgcggcggguccccucccccggcccccaccccuccccagcagccucccccuccgcccccucccccucccccgccuccgcccuaccuggcuucccucccucugggauaucccccucaucagccggccuaccuucugcccccucggcccgacggcccucccccgccugaauaucccccucccccucccccgccuccccacauuuacgauuuuguuaauucucucgagcugauggacagacugggggcucaauggggcggaaugcccaugagcuuccagaugcagacacagaugcucacccgccugcaccaacuuagacagggcaaagggcugaucgccgccuccgcuggaccuccgggcggggcguuuggagaagccuuccuccccuuuccucccccucaggaggcugccuacggccugcccuaugcccuuuacgcucaagggcaggagggccggggagccuauagccgcgaagcguaccaucugccuaugccgauggcugccgagccccucccuucuuccagcgugucuggcgaagaggccagacugcccccucgggaagaggcugagcuggccgaagggaagacgcuccccacagcgggaaccgucggccgcgugcuggcuaugcuuguucaggagaugaaguccauuaugcagagagaucugaaccggaaaaugguggaaaaugucgccuucggggccuuugaccaauggugggagagcaaggaagagaaagcuaagccguuccagaacgccgcuaaacagcaggccaaggaggaagauaaggagaaaacaaagcucaaagaaccuggacugcugucccuuguggacugggcgaagucuggcgggaccaccggcaucgaggccuucgcuuuuggaagcggccuccgcggggcccugagacugcccuccuucaaagucaagcggaaggagcccagcgaaaucucugaggcuuccgaagagaaacgcccuagacccagcaccccugccgaagaggaugaggacgauccggaacaagagaaggaagccggagagcccggccggccugggacgaaacccccuaagagagacgaggaacgcggaaaaacccagggcaagcaccggaagucuuuugcucucgauagcgagggcgaagaggcgucccaggaaucuagcuccgagaaagacgaagaggacgaugaggaagacgaggaagaugaggacagagaggaagccguggauacaaccaagaaagagacagaaguuucugacggggaggaugaagagagcgacuccagcucuaaguguucccuguaugcugauagcgacggagagaaugauuccaccucugacagcgaauccucuagcuccagcagcuccucuucuuccagcucuagcuccucuagcuccagcuccucuagcuccucuagcgaguccucuagcgaagaugaggaagaggaggaacgccccgccgcccuuccguccgcuagcccucccccucgggaggugcccgucccuacgcccgccccgguggaaguuccugugcccgagagagucgcgggcucucccgugacaccucugccggaacaggaggcuucccccgcccgcccugccgggcccaccgaggaaagcccucccucugcuccucuccggcccccggagccucccgccggaccucccgcgccggcuccuagacccgacgaacgccccuccagcccuauuccccugcugccuccgcccaaaaagcggagaaaaaccgugucuuucuccgccaucgagguugucccugcccccgagccucccccugcuacaccgccccaagccaaguuuccuggccccgcuagccggaaggccccucgcgggguggaaagaaccauucggaaccuuccccucgaccaugcgucccuggugaaaagcuggccggaggaagucucucgcggaggcagaagccgggccggcgggagaggacgccugacagaggaagaggaggcugaaccuggcacggagguggaucucgccguucuggcugaccuugcccugacccccgcccggagagggcuccccgcucugccugcgguggaagauuccgaggccacagaaaccucugacgaggcugagcgcccccggccucugcuuagccacauccuccuggaacauaauuacgcccuggccgucaagccgacacccccugcucccgcccucagaccucccgagccggugccugcgcccgcugcccuguucuccucuccugccgaugaaguucuugaggcucccgaaguggucguggccgaggcggaggaaccgaaaccucagcagcugcaacagcagcgcgaggaaggagaggaggaaggcgaggaagagggggaagaggaggaagaggaaagcuccgacucuagcuccagcucugauggagagggcgcccuccggagacgcucccugagaagccacgcucggcgcagacggccgcccccucccccuccgcccccucccccucgcgccuaugaacccagaucugaguuugagcagaugaccauucuguacgacaucuggaacuccggccuugauagcgaagacauguccuaccuccggcugacguaugagagacugcuccaacagaccucuggggcugauuggcugaaugacacacacuggguucaucacaccaucacaaaccuuaccacaccuaagcgcaaacggagaccgcaggacggaccccgcgaacaucagaccggcagcgcccgguccgagggguacuauccuauuagcaagaaggaaaaagauaaguaccuggacgugugccccgucucugcuagacaacucgagggaguggauacgcagggcacaaaucgggugcuguccgagcgcagaagcgaacagcggcgccugcuuucugccaucgggaccagcgcgauuauggacuccgaucugcucaaacugaaccagcucaaguuccgcaaaaagaagcugcgguuuggacgcucuagaauccacgaguggggccuuuucgccauggaaccuauugcugccgacgagauggucaucgaguauguuggccaaaauauccggcagaugguggcugauaugcgcgagaaaagauacgugcaggaggggauuggaagcuccuaucuguuucgggucgaccacgauaccaucauugacgccacaaaguguggcaaccucgccagauucaucaaucauugcuguacccccaacugcuacgcuaaagugauuacgaucgaaucucagaagaaaauuguuaucuacagcaagcaaccgaucgggguggaugaggaaauuacauaugacuacaaguuuccucuggaggauaacaaaauccccugucugugcggaaccgaguccugccgcggcagccuuaauuga

SEQ ID NO: 75434 - RNA, 5772 nt, Artificial Sequence
  derived and/or modified sequence opt5 from SETD1B__Homo_sapiens__NP_055863
auggagaacagccaucccccucaucaccaucaccagcaaccgcccccucagcccggcccuuccggggaaagacggaaucaccacuggcgcucuuacaagcugaugaucgaccccgcucucaaaaagggacaccacaaacuguauagauacgauggccagcacuucagccuugcuauguccucuaaccggccuguggagauugucgaagacccccgcguuguggggaucuggaccaagaauaaagagcuggaacucagcgugcccaaguucaagauugaugaguucuaugucggaccugugcccccuaaacagguuaccuuugccaagcugaacgacaauaucagagagaacuuccuucgggauaugugcaaaaaguacggcgaaguggaggaagucgagauucuguauaaucccaaaacgaagaagcaucucgggaucgccaaagugguuuuugcuaccgugcgcggagccaaggacgccguccaacaucugcacuccacgucugugaugggcaacaucauucauguggagcuggauaccaaaggcgaaacaagaaugcgguucuacgagcuccuggucaccgggcgcuauacaccccagacccuuccuguuggagaacuggacgcugugagccccaucgugaaugagacgcuccagcuguccgaugcccuuaagagacugaaagacggcgggcucagcgcuggauguggcucuggguccagcucugucaccccuaacuccggaggcacacccuuuagccaggauaccgccuacucuuccugccggcuggacacacccaauagcuacggccaagggaccccucugacgccgcgccucggaacacccuucucccaggauucuagcuauuccagcagacagccuacccccucuuaccuguuuucccaggacccugccgugacauucaaggcccggcgccacgaaagcaaauuuaccgacgcuuauaacagacggcaugagcaccauuacguucacaauucucccgccgugaccgcugucgccggcgcgacagccgcuuucagagggagcuccgaucuucccuuuggagccgugggcgggacgggaggcucuagcggcccucccuucaaggcucaaccucaggacuccgccaccuucgcccacacacccccucccgcucaggcgaccccggccccuggguuuaagagcgcuuucucucccuaucaaacacccguugcccauuuuccuccgcccccugaggaacccaccgccacggcugccuucggagcgcgcgauuccggcgaguuucggagagcuccugcgcccccuccccugccgccugccgaaccccucgcuaaagagaagccugggacacccccgggaccucccccucccgacaccaacagcauggaacugggcgggcgccccaccuucggcuggucuccugagccgugugauucccccggaacaccuacccuugagagcucccccgccggcccugaaaaaccccacgacucucuggauagccggauugagaugcuccugaaggaacagagaacaaaacugcucuuucugcgcgagccugacuccgauacggaacuucagauggaggggucuccgaucagcuccuccucuagccagcugagcccccucgcuccuuucggaaccaauucucaacccggcuuucgggggccuacacccccguccagcagaccuucuagcaccggacuggaggacauuucccccacaccccuuccugauagcgacgaagacgaggaacuggaucucggccuggggccccgcccuccgcccgagccuggacccccugaccccgccggacugcucucucagaccgcggagguggcccuggaucuugucggcgaccggacgccgaccuccgaaaagauggaugaggggcagcagagcuccggagaagacauggagaucucugaugacgaaaugccuagcgcucccauuacauccgccgauugcccuaagcccaugguggucaccccuggcgcugccgcgguggccgcucccucuguucuggccccgacacucccucugccgcccccuccgggguuucccccucugcccccucccccuccgcccccucccccucaacccggauuuccgaugccuccgccccuuccucccccuccgcccccucccccucccgcucauccggccgugaccgucccucccccuccccucccugcgccucccggcgugcccccgcccccuauccugccgccccugccucccuucccucccgggcucuuuccuguuaugcaaguggacaugagccacguccugggcggacaguggggcgggaugcccauguccuuccagaugcaaacacaggugcuuucuagacugaugacaggacagggcgcuuguccguacccucccuucauggcggccgcugccgccgcugccagcgcggggcuccaguuugugaaccugccucccuaucgcggaccguucucccugagcaacucuggcccugggcggggccaacacuggccgccccuuccuaaauuugaucccuccguuccuccgcccggauacaugccuagacaggaggacccccauaaggcuaccgucgauggcgugcuccuggugguccugaaagagcucaaggccaucaugaaacgggaccugaaucgcaagaugguggaaguuguggccuucagagcuuuugacgaguggugggauaagaaagaacggauggccaaggcgagccuuacaccugucaaaucuggggagcacaaggacgaagauagacccaaaccuaaggaccgcauugcuuccugccugcucgagagcuggggaaagggcgaggggcugggauacgaaggccugggccuugggaucggacuccggggcgccauuagacugccgucuuucaaagugaagcgcaaagagcccccugauaccaccuccagcggggaccagaagagacugcggcccuccacaagcguugaugaagaggacgaagagucugagcgcgaaagagaucgggacauggccgauacgccuugugagcucgcuaaacgcgaccccaagggagugggcgucagacggcgcccggccagaccucuggaacuugauagcgggggagaggaggacgaaaaagagucccugucugaggaacaggaaagcaccgaggaggaagaggaagcugaggaagaggaggaagaggaagacgaugacgaugacgauuccgacgaucgggacgagucugaaaacgaugacgaggauacagcccucagcgaggcguccgaaaaggacgagggcgacucugaugaagaggagaccgugagcaucguuacauccaaggccgaagcuaccuccucuagcgagagcucugaauccagcgaguuugaauccucuagcgaguccagccccucuuccagcgaggacgaagaggaaguggucgcccgcgaggaagaggaggaagaggaagaggaagagaugguggcugaggaaucuauggccagcgccggccccgaggauuucgaacaggacggggaggaggcugcgcuggccccuggagcucccgccguggauucccugggcauggaagaggaagucgacauugagacggaagccguugcuccugaggagagaccgucuaugcuugaugaacccccucuccccguggggguggaggaaccugccgacagccgggagcccccggaggaaccuggacugucccaggagggcgcgaugcugcucucucccgaaccucccgcuaaagaggucgaagccagaccgccucugagccccgagcgcgcccccgaacaugaucuugagguggagccugaacccccuaugaugcugccgcucccccugcagccuccccugccucccccucggccgcccagaccucccuccccucccccggagccugaaacaaccgacgcuagccaccccucuguucccccugagccccuugccgaggaucauccuccgcacacccccgggcugugcggaucccucgccaagagccaauccacagaaaccgugccugcuacacccggcggcgagccuccccugucugggggaagcuccggccucucucugagcuccccgcaggucccugggagccccuuuucuuauccugcccccuccccuagccuuucuuccggaggccugccccgcacgccggggcgggacuucagcuuuacccccacauucucugaaccuagcggaccccuccugcugccuguguguccgcuucccaccggcagacgcgaugagcgguccggcccucuggccucucccguucuccuggaaacagggcucccucugccccuuccucugccccucccgcugccucuggcccuucccgccgugcugagagcucaggcccgcgcgccuacaccccucccgccucugcuccccgcgccccuggcuagcugcccucccccuaugaaacggaagccgggaagaccccggcgcuccccucccagcaugcuuucccuggacggcccucuggucagacccccggccggggcugcccucggacgggagcugcuucugcucccuggccagccccaaacgccuguguuucccucuacccacgacccucgcacaguuacccuggauuucagaaaugccgggauccccgcuccgcccccuccccucccuccccagccuccgcccccucccccucccccgccuguggagcccacaaaacugccuuucaaggaacuugacaaccaguggcccagcgaggcgaucccgccuggaccccggggcagagaugaagucaccgaggaauacauggagcuggccaagucccgcggccccuggcggagaccucccaaaaagcgccaugaggaccuggugccuccggcugggucucccgaacucagcccuccccagccucuguuucggcccagauccgaguucgaagagaugacaauucuuuaugauaucuggaauggaggcauugacgaagaggauauccgcuuucugugugugaccuacgagcggcuccugcaacaggacaacgggauggauuggcucaaugacacgcugugggucuaucacccuucuacaagccuuuccagcgccaaaaagaaaaagagagaugacggcauuagagaacauguuaccggcugcgccagaucugagggguucuacaccaucgauaagaaagacaagcugcgguaucugaacuccagccgcgcuucuacagacgaaccgcccgccgauacccagggaauguccaucccugcgcaaccccacgcuagcacgagagccggcucugagcggcgcuccgagcagagacggcuccugagcuccuuuacaggcagcugcgacucugaucuucugaaauucaaucagcucaaguuucgcaaaaagaagcugaaauucuguaagagccauauucacgacugggggcucuuugccauggaaccuaucgcugccgaugagauggugauugaauacgugggacagaacauccgccaagucauugcggacaugcgggagaaaagauacgaagaugagggcaucggguccucuuauauguuccgcguggaccacgauaccauuaucgacgccacaaagugcggaaauuuugcucgguucaucaaccauagcuguaaucccaacugcuacgccaaaguuauuaccguggagucccagaagaaaaucgucauuuauucuaagcagcacaucaaugugaacgaagagauuacauacgauuauaaguucccgaucgaagacguuaaaauccccugucugugcggcagcgagaacuguagagggacccuuaauuga

SEQ ID NO: 75435 - RNA, 7695 nt, Artificial Sequence
  derived and/or modified sequence opt5 from SETD2__Homo_sapiens__NP_054878
augaagcagcugcaaccccagccuccgcccaaaaugggcgacuucuacgauccugagcaccccaccccugaagaggaagagaacgaagccaagaucgagaaugugcagaaaaccggguuuauuaagggacccauguucaaaggcgucgcuagcuccagauuucugccuaaggggacgaagaccaaaguuaaccuggaggaacagggacggcaaaaggugucuuucagcuuuucccuuaccaagaagacccugcagaaucgcuuccucacagcccugggcaacgagaaacagucugacaccccgaaucccccugccgugccccuucaggucgauagcacaccuaagaugaagauggaaaucggggacacccuguccacggcugaggagucuuccccucccaaauccagaguggaacucggaaagauucacuuuaaaaagcaucugcugcauguuaccagccggccucuccuggccacaaccacagccguggcuucucccccuacccacgccgcuccccuucccgccgucaucgcggaguccacgacaguggauagcccuccgucuucucccccucccccucccccgccugcccaagcuaccacacugagcagccccgccccuguuaccgaacccguggcucucccucauacccccauuacaguccugauggccgccccggugccucuucccguggacgucgccguucgcucccugaaagagcccccuaucaucauugugccggaaagccucgaggcugauacgaagcaggacaccaucuccaacucucuggaggaacacgugacacagauucugaaugagcaggccgauaucagcuccaaaaaggaagacagccacauuggcaaggaugaggaaauccccgacucuuccaaaauuagccucucuugcaagaaaaccggcagcaagaaaaaguccucucaaagcgaggggaucuuccugggauccgagagcgaugaagacucugucagaacauccagcucucagcggucccaugaccuuaaguuuagcgcuuccaucgagaaagaacgcgauuucaagaaaucuagcgccccucugaaguccgaggaccucggcaaacccucuagaagcaagaccgaucgggacgauaaguauuuuuccuacagcaaacuggaacgcgacacgagauaugugucuucccggugucgcagcgagagagagcggcgcagaucucggucccacagcagaucugaacgcgggagccggacaaaccuuuccuacagcagaucugagcgcucccauuauuacgauagcgaccggagauaucaccgcuccucuccuuaccgggaaagaacccgcuacagccggcccuauaccgauaauagagcccgcgaguccucugacagcgaggaagaguacaagaaaacauauucccggagaaccucuagccacuccagcucuuaccgggaucugcgcacauccagcuauucuaaguccgacagagacugcaaaacggaaaccagcuaccucgagauggaacggagaggaaaguauucuuccaagcuggagcgcgagagcaaacggacauccgaaaacgaggcuauuaagagauguugcagcccucccaaugaacugggcuuccgcagagggucuagcuacuccaaacaugauucuagcgcgucccgguacaagucuacccucagcaaaccgaucccuaaguccgacaaauuuaagaacucuuucuguugcacagagcugaaugaagagauuaagcagagccacuccuucagccuucaaacccccuguucuaaaggauccgagcugcgcaugaucaacaagaauccugaaagagagaaagccggcagccccgcuccgucuaaccggcucaacgauuccccuacgcugaagaaacuugacgaacugcccauuuuuaagagcgaguucaucacccaugauucccacgacucuaucaaggaacucgauagccuguccaaaguuaagaaugaccagcugcgcagcuuuugcccuauugagcucaacaucaauggcucucccggggccgaguccgaucuggccacauucuguaccagcaaaacagacgcugugcuuaugaccucugaugacagcgucacgggauccgaacugucuccccucgugaaggccugcaugcugagcuccaacggcuuucagaauauuucuagauguaaagagaaggaucuggacgacacaugcaugcuucauaagaaaagcgaauccccuuuccgggagaccgagccgcucguuagcccccaccaggauaagcugaugucuaugccugugaugacagucgacuauuccaaaaccguggucaaggaacccguggauacccgcguuagcugcuguaaaacaaaggacuccgauaucuacugcacgcugaacgacucuaauccuagccucuguaacuccgaggcggaaaauauugagcccucugugaugaagaucagcuccaacagcuuuaugaauguccaccuggaaucuaaaccugugaucugcgauuccagaaaccuuaccgaccauagcaaguucgcuugugaggaguauaaacaaucuauuggguccacaagcucugccagcguuaaucacuuugaugaccuguaccagccgaucggauccucuggcauugccagcucccuccagagccugcccccugggaucaagguggauucccugacccuucucaaaugcggagaaaacacaucucccguccuggacgcugugcugaaguccaaaaaguccucugaguuccucaagcaugccggcaaagaaaccauuguggagguuggcagcgaucugccugacuccgggaagggauuugcuucucgggaaaaucgcagaaacaacggccuuagcgggaaaugucugcaggaggcccaagaggaaggaaauuccauccuccccgagcggagaggccgcccggaaauuagccuggacgagagaggggaaggcggacacguccacacgucugaugacuccgaggugguguucagcucuugcgaucugaaccuuacaauggaggacuccgauggcgucaccuaugcgcucaagugugacagcucugggcaugccccugaaaucguguccaccguucacgaggauuacagcggauccagcgaaucuagcaaugacgaguccgauucugaggacacagauagcgacgacuccucuauccccagaaaccgccugcagagcguggucgugguucccaaaaauuccacccugccuauggaagagacaucucccugcagcucccggagcucucaguccuauagacauuacagcgaucacugggaagacgagcgccucgaaucucggagacaucuguacgaggagaaguuugaauccauugcuagcaaggccuguccucagacggauaaauucuuccuucacaagggcaccgagaaaaacccggaaaucuccuuuacacaaucuagccgcaagcagauugacaaucggcugcccgagcucucccacccucagagcgaugggguggacucuaccucccauacagaugucaaaagcgacccccugggacacccuaacucugaagagaccgugaaggcuaagauccccagcagacagcaagaggaacugccgauuuauuccucugauuucgaggacguuccuaauaaaagcuggcagcagacgaccuuucaaaaccggcccgauucccgccuuggcaagacagaacucucuuucagcuccagcugcgagaucccucauguggacgggcugcacucuuccgaagaacugagaaaucucggcugggauuuuagccaggagaaacccuccaccacauaccagcagccugacucuagcuauggagccugcggcgggcauaaguaccaacagaacgcggaacaguauggaggcacccgggacuacuggcaggggaauggauauugggauccccgcuccggcagaccgccugggacaggcgucguguacgaccggacccaaggacaggugcccgauucucugacggacgauagagaggaagaggagaacugggaccagcaggauggcagccacuucuccgaccaaagcgauaaauuucuucugucucuccagaaggacaagggguccguccaggcccccgaaaucagcucuaauuccauuaaagauacacuggcuguuaacgagaagaaagacuucagcaagaaccuggagaaaaaugauaucaaggaccgcggaccucuuaagaaacggagacaagagauugaaucugacuccgagagcgauggcgagcugcaggaccgcaagaaagugcggguggaagucgagcagggggaaaccucugugccgcccggaagcgcccucguuggcccuuccugugugauggaugacuuuagagauccccagcgcuggaaggagugcgcuaaacaagggaagaugccuuguuacuucgaccugaucgaagagaacgucuaucucaccgagcggaaaaagaauaagagccacagagauauuaaacgcaugcagugcgaauguacaccccuguccaaggacgagagagcccagggcgaaaucgccugcggagaggauugucuuaaccggcugcucaugaucgaaugcucuagccgcuguccuaauggcgacuacugcuccaacagacgguuucagcgcaaacaacaugcugauguggagguuauucugaccgagaagaaaggguggggacugagagcggccaaggaccuuccgucuaauacguucgugcuggaauauuguggcgagguccucgaccacaaggaauuuaaagcucgggugaaggaguacgccagaaacaaaaauauccauuauuacuucauggcccugaagaacgaugagauuaucgacgcuacacagaaagggaauugcagccgcuucaugaaccacuccugcgaacccaauugugagacccagaaguggacaguuaacggacagcuccgggugggcuuuuucaccacaaagcuggucccuucuggcagcgaacuuaccuuugauuaucaauuccagagauacgggaaagaggcccagaagugcuuuuguggauccgcgaauugccgcggcuaccucgggggagaaaaccgggugagcauuagagcugccggcgggaaaaugaagaaagagcggucucgcaagaaggacuccguggauggagagcucgaagcccugauggagaacggcgaaggccugagcgacaaaaaucagguccuuucucuguccagacucaugguucggaucgagacgcuggaacaaaagcucaccugucuggagcuuauccagaacacacacagccagucuugccugaaauccuuccuggagcgccaugggcucagccugcuuuggauuuggauggcugaacugggagauggcagagagucuaaucaaaagcuccaggaagagaucauuaaaacccuggaacaccuccccaucccuacaaagaacaugcuggaggaguccaaagugcuucccauuauccagcgguggagccagaccaagacggccgugccgccucugagcgaaggggacggauauuccucugagaauacaagccgcgcgcauacaccccugaacacacccgauccuuccaccaagcucucuaccgaagcugacacagauacgcccaaaaagcugauguuuagacggcuuaaaauuaucagcgaaaauuccauggacucugccaucagcgaugccaccuccgagcuggaaggcaaggacgggaaagaggaccucgaucaacuggaaaacgucccuguggaggaagaggaggaacuccagagccagcagcugcuuccgcaacagcugcccgaguguaagguugacucugaaacaaauauugaggcuuccaagcugccuaccagcgaacccgaggccgaugcugagaucgaaccuaaagagucuaacggaacaaagcucgaggaacccauuaaugaagagaccccgucccaggacgaggaagagggcgugagcgaugucgaauccgagcgcucucaggagcaaccugacaaaacgguggauaucagcgaccuggccacaaaacuucuggauuccuggaaagaccucaaggaaguuuaccggauucccaagaaaucucagaccgagaaggaaaacaccacaaccgagcggggcagagaugcggugggguuccgcgaccagacacccgcccccaaaacgccuaaucggagcagagaacgcgaccccgauaagcaaacccagaacaaagagaagcggaagagacgcuccagccugucuccgccuuccagcgcuuaugagcggggaacaaaaagacccgacgaucgcuacgacacccccacaucuaagaaaaagguccggaucaaagauagaaauaagcucagcaccgaggagcgccggaaacuguuugaacaggagguggcccagagagaagcucaaaagcagcagcagcaaaugcagaaccuuggcaugacguccccucugccguaugacucucugggguacaaugcgccccaccauccuuucgccggauaucccccuggcuaccccaugcaggcuuacgucgauccuagcaaccccaacgcggggaaggugcuccugccgaccccuuccauggaccccguuugcagcccugcccccuaugaucacgcucagccgcuugugggacacucuacagagccucuguccgcgccgcccccuguccccgugguuccucauguggccgcuccggucgaggugagcuccucucaauacguggcccagagcgacggcguuguccaccaggauuccucuguggcggugcuccccgucccugcucccggcccugugcaggggcaaaauuauagcguuugggacuccaaccagcagucugugagcguccaacagcaguacucccccgcccagagccaagccaccaucuauuaccagggacagacauguccuaccguguauggcguuacaucuccguacucccagacgacacccccuauugugcaaagcuacgcucagcccucucugcaguauauccaggggcaacagauuuuuacagcccauccucagggagucgugguucaacccgcggcugccgugaccaccaucgucgccccgggccagccucagccccugcagcccuccgaaaugguggugacaaauaaccuccuugaucugccucccccuagcccgcccaaaccuaagacgauuguccugcccccuaauuggaaaaccgcucgcgaccccgaggggaagaucuacuauuaccacguuaucacaagacaaacccagugggacccgccuacaugggaaucucccggagaugacgccagccucgagcacgaagcugagauggaucugggcaccccuacguaugacgagaaccccaugaaagccuccaagaagccgaaaacagcggaagccgauaccagcuccgagcuugcuaagaaaucuaaggaaguguuccggaaagagaugagccaguucauugugcagugccugaauccuuaccgcaagcccgacuguaaggucggcagaaucaccacaaccgaggauuuuaaacaucucgcccggaagcugacacacggggugaugaacaaagaacugaaguauugcaaaaaucccgaggaccucgaaugcaacgagaauguuaagcauaagaccaaagaauacauuaagaaauacaugcaaaaguucggagcuguguauaaaccuaaggaggauacggagcuugaauga

SEQ ID NO: 75436 - RNA, 1950 nt, Artificial Sequence
  derived and/or modified sequence opt5 from SETD3__Homo_sapiens__XP_011535533
auggagugcagaggccccaccagcucccggugugugcugcgcagacaccaggccacagggggagcugaacgggucggcugccucucuacgaacgggaagaaagccgagcugagcaaggaagaacgcgcggcugcccuucugccugccagaccggcuguucggaaaaugggaaagaaaucccgcgugaagacccaaaagucuggcacaggggccaccgcuacagugagccccaaagaaauccucaaucugaccuccgagcuucugcagaaguguucuagcccugcccccggaccuggcaaagagugggaagaguacguccagauuagaacacucguggaaaagauccggaaaaagcagaagggccuguccguuaccuucgacgggaaacgcgaggauuauuuucccgaccugaugaagugggcgagcgagaacggagccucuguggaaggcuucgagauggucaauuuuaaagaagagggguucggacucagagcuacgcgggauauuaaggccgaggagcuguuucuuugggugccucgcaaacugcucaugaccguugaguccgcuaagaacagcgugcugggcccgcuuuacucucaagacagaauccugcaggccauggggaauauugcgcucgccuuccaucugcugugcgaacgggcuucccccaacagcuuuuggcagccuuauauccagacacuccccucugaguacgauaccccucuguauuucgaagaggacgaaguccgcuaccuucaauccacacaggccauccacgauguguuuagccaguauaaaaauaccgcuagacaguacgccuacuucuauaaggugauucaaacgcauccccacgccaacaagcugccgcucaaagacuccuuuacauacgaggauuaucggugggcugucucuagcguuaugaccagacagaaucagaucccuacagaggacggaucccgcgugacccuggcgcuuauuccccugugggauauguguaaccauaccaauggccucaucacaacgggcuacaaccuggaagacgaucggugcgaguguguggcccugcaagacuucagagcuggggaacagauuuauaucuuuuacggaacccgcagcaaugccgaguucgucauucacucuggcuucuuuuucgacaacaauucccacgaucgggugaagaucaaacucgggguuagcaagucugacagacuguaugccaugaaagcugaagugcuugcccgcgcgggaaucccuacaagcuccgucuuugcucugcauuucaccgagccucccauuucugcccagcuccuggccuuucuucggguguucugcaugacagaggaggaacugaaggaacaccuccugggcgauagcgcuaucgacagaauuuuuacccuggggaacuccgaguuccccguuagcugggauaacgaggugaagcucuggacguuucuggaagaccgcgccucucuucugcucaaaacauacaagaccaccaucgaggaagauaaauccguccugaagaaucaugaccugagcgugcgggcuaaaauggccauuaaacuuagacucggagagaaggaaauccuggagaaggcggucaagucugccgcugugaaccgcgaguacuaucggcagcaaauggaagagaaagccccgcugcccaaguacgaagaguccaaucucggccugcuugaaagcuccguuggcgauucuagacugccucucgugcugcggaaccuggaggaggaagcugggguccaggacgcccuuaauauccgcgaggcgauuagcaaagccaaggcuacagaaaacggacucgugaauggcgagaacuccauccccaaugggaccagaucugaaaacgagagccugaaucaggaguccaagcgggccguugaagaugcuaaaggaucuagcuccgacagcacagccggcgugaaggaguga

SEQ ID NO: 75437 - RNA, 4329 nt, Artificial Sequence
  derived and/or modified sequence opt5 from SETD5__Homo_sapiens__NP_001073986
augagcaucgccauuccccugggcgugaccacauccgacacgucuuacagcgauauggcugccggguccgacccugagucugucgaagcgagcccggcuguuaacgagaaguccguguauucuacccacaauuacggaacaacccagagacauggcugccgggggcuccccuaugccacaaucauuccucgcagcgaucugaacggacuucccuccccuguggaagagagauguggcgacagccccaauucugaaggggagaccgucccuacauggugcccguguggacugucccaagauggcuuccuccugaacugcgacaaaugucggggcaugagccgcgggaaggugaucagacuucaccggcgcaaacaggauaauauuucuggaggcgacuccagcgccaccgagucuugggaugaggagcugucccccagcacgguucucuacaccgcuacacagcauaccccuacauccaucacccugacggugagacggacaaagcccaaaaagcgcaagaaaucuccugaaaaggggagagccgcucccaaaaccaagaaaaucaagaacagcccguccgaggcccagaaucuggacgagaacacaaccgaaggaugggagaaucggauucgccucuggaccgaucaauaugaagaggcguuuacaaaccaguacagcgccgacguccagaaugcucuggaacagcaccuucauucuuccaaggaguucgugggcaaaccuacgauccuggauaccauuaacaagacagagcucgccugcaauaacaccguuaucgggagccaaaugcagcugcagcuuggaagagugacacggguccagaaacaccgcaagauucugagagcugcccgggaccucgcgcuggacacccugaucauugaauauagaggcaaagugaugcuccgccaacaguuugaggugaauggccacuucuuuaagaaacccuacccuuucguccuguuuuacucuaaguucaacgggguugaaauguguguggaugcccggacguuuggaaacgacgcuagauucauccgccggagcugcacacccaaugccgaggugagacauaugaucgcugauggcaugauucaccuuuguaucuaugccgucuccgccauuaccaaggacgcugaagugaccaucgcguuugauuacgaguauucuaacugcaauuacaaaguugacugugccugccauaaggggaaccgcaauugccccauucagaaacggaacccuaaugcuacagagcugccgcuccugcccccucccccuagccuucccaccaucggagccgaaacaagacgccggaaggccagacgcaaagagcuggaaauggagcaacagaacgaggcuuccgaagagaauaacgaucagcagagccaagaagugccggagaaggucacggugucuuccgaccacgaagagguugauaauccugaggaaaagcccgaggaagagaaagaagaggugaucgacgaucaggagaaccucgcccacagccggagaacccgggaagaccgcaaggucgaggcgauuaugcaugcuuucgaaaaucuggagaaaagaaagaaacggagagaccagccucuggaacagucuaacuccgauguggagaucacaaccacaaccagcgagacgcccgucggcgaagagaccaagacagaagccccugaguccgaagugucuaauagcguuuccaacgugaccauucccucuacaccgcaaagcgucggggugaacacccgccgguccagccaggccggagacaucgcugccgagaagcucguuccuaaaccgcccccugcuaagccgucuagaccccgcccuaaauccagaauuagccgguaucgcacgucuuccgcccagagacugaagcggcagaaacaagcgaaugcccagcaggcugagcuuagccaggccgcucuggaagagggcggcucuaacagccucgugacacccaccgaagccgggucccuggauagcucuggagagaaucgcccucuuacaggcuccgaccccaccgucgugagcaucaccgggucccacgugaacagagcggccucuaaguacccuaagaccaaaaaguaucugguuacggaguggcucaaugauaaagcugaaaagcaagagugucccgucgaaugcccgcugcggaucaccacagacccuaccgugcuggccacaacccucaacaugcugcccggacuuauucauagcccucugaucuguacgacacccaaacacuacauucgcuuuggcuccccguucaucccugagagacggcgcagaccccuccugccugaugggaccuucucuagcugcaagaaacgguggauuaagcaggcucuggaagagggcaugacccagacauccucugugccccaagagaccagaacacagcaucuuuaccagagcaaugaaaacuccuccucuuccagcaucuguaaggacaaugccgaucuccugucuccccugaaaaaguggaaaucccgcuaucucauggagcagaacgucacgaagcugcuucggccucugagcccggugacacccccucccccuaauucuggauccaaaagcccccaacucgccacaccuggcuccagccacccgggggaagaggaaugcagaaacggauacucucugauguuuagccccguuaccucccugacaaccgcuucucgcuguaauacgccucuucaguucgagcucugccaccggaaggaccuggaucuggcgaaggugggcuaucucgacagcaacaccaauuccugugccgauagacccucucugcuuaacagcgggcauuccgaccuggcuccucaccccucucucggaccgacaagcgagaccggcuuuccuucccgcagcggggacggccaucagacacugguccggaacucugaucaggccuucagaaccgaauuuaaucugauguacgccuauagcccccuuaacgcuaugccccgcgccgacggacucuaccggggcagcccucuggugggggauagaaaaccccugcaccucgacggaggcuauugcucuccugcggagggguucuccagccgguacgaacacggacugaugaaggaucuuucccgcggcucucugagccccgggggcgagagagcuugugaaggaguucccuccgccccucaaaaucccccucagcggaaaaaggugagccuccuggaguaccgcaaaagaaagcaggaggccaaggaaaacucugcuggcgggggaggcgacuccgcccagagcaaaucuaagagcgcgggggcuggacaaggcuccucuaauagcgucuccgauacaggggcccauggcgugcagggaucuagcgcccggacccccuccagcccgcacaaaaaguuuucuccuucccauagcuccaugucucaccuggaggcuguuagccccuccgacucuagaggcacgagcuccagccauugccgcccucaggaaaacauuucuucccgguggauggugcccacaagcgucgagagacuucgcgaagggggaucuaucccuaaagugcuccgguccagcgugagagucgcccaaaagggcgaacccucuccgaccugggagagcaauaucaccgaaaaggauuccgacccugcugauggggagggacccgaaacacugucuagcgcccuguccaaaggcgcgaccguuuauagccccucccgcuacucuuaucagcuccugcagugcgacagcccucggacggagucccagucucuucugcaacagagcuccucuccguucagaggccaccccacacagagcccuggguacuccuaucgcaccacagcccucagacccggaaacccucccagccacgggucuuccgagagcucucuguccagcaccucuuacuccagcccugcucauccgguguccacagauagccuggcccccuuuaccggcacgccuggauauuucucuagccagccccacuccggcaauucuaccgggagcaaccuuccucggcgcuccugucccucuagcgcugccuccccgacacugcaaggaccuucugacagccccaccuccgacagcgugucucaguccagcacaggcacccucucuuccacgagcuuuccccaaaauuccagaucuagccugccuuccgaucuccggacaauuagccugcccucugccggccaguccgcugucuaccaggcgagccgcgugucugccguuagcaacucccagcauuacccucacagagggucuggaggcgugcaucaguaucggcuucagccgcugcaagggagcggagucaagacccagacaggccucuccuga

SEQ ID NO: 75438 - RNA, 1101 nt, Artificial Sequence
  derived and/or modified sequence opt5 from SETD7__Homo_sapiens__NP_085151
auggacagcgaugacgagaugguggaagaggccgucgaaggccaccuggaugacgaugggcucccccauggauucugcaccguuacauacuccucuacggacagauuugagggcaacuucgugcacggggaaaagaauggacggggcaaauuuuucuuuuucgaugggagcacccuggagggauauuacguggacgaugcccuucagggccaaggcgucuauacauacgaggacgggggagugcugcagggcaccuauguugauggggaacucaacggaccugcucaggaguacgacacagauggccgccugaucuuuaaggggcaguauaaagacaauauuagacauggaguguguuggaucuacuacccggacggcggcucccuugucggggaagugaacgaggauggagagaugaccggcgaaaagauugcguauguuuaccccgacgagcggacagcucuguaugggaaauucaucgauggagaaaugauugagggcaagcucgccacccugaugucuacggaagaggggcgcccucacuuugagcugaugcccggaaauagcguguaccauuucgacaaguccaccucuagcugcaucuccacaaacgcccuccugccugaucccuaugaaagcgagagagucuacguggcugaaucucuuaucuccagcgccggcgagggccuguuuucuaaaguggcugucgggccuaauaccguuauguccuucuauaacggagugcggauuacacaccaagaaguggacagccgcgauugggcccucaauggcaacacccugucucuugacgaggagacggucaucgaugugccggaacccuacaaucacguuuccaaguacugugcgagccuggggcauaaagccaaccacuccuuuacaccuaauugcauuuaugacauguucgugcaucccagauucggaccuaucaaguguauucggacccuccgcgcugucgaggccgaugaggaacugacaguggcuuacggcuaugaccacucucccccggggaaaagcggcccugaagcccccgagugguaccagguugagcugaaggcguuucaggccacccagcaaaaguga

SEQ ID NO: 75439 - RNA, 1059 nt, Artificial Sequence
  derived and/or modified sequence opt5 from SETD8__Homo_sapiens__NP_065115
auggccagaggccggaagaugagcaaaccccgcgcuguggaggccgcggcugccgccgcugccgucgcugccaccgcgccugggccggaaaugguugagagacggggacccggccgcccuagaacagacggggaaaacguguucacgggacaguccaagaucuacucuuauaugagccccaauaaaugcuccggcaugcgguuuccucugcaagaggaaaacucugugacccaccaugaggucaagugucaggggaaaccccucgccggaauuuaccgcaagagagaggaaaagcggaaugcuggcaacgccgugcgcagcgcuaugaaauccgaggaacagaagaucaaagaugccagaaagggcccucugguuccguuccccaaucagaaaucugaggcggccgagccucccaagacaccucccagcuccugcgacagcaccaacgcugccauugcuaagcaagcccuuaaaaagccgaucaaagggaagcaggccccucggaaaaaggcucagggaaaaacacagcaaaaucgcaagcugaccgauuuuuaucccgugagacggucuucccgcaagagcaaagcggaacuccagucugaggaaagaaagcggauugacgagcugaucgaauccggcaaagaggaggggaugaagaucgaucuuauugacggaaaaggcagaggggucaucgccacaaagcaguucagccgcggagauuuugugguugaauaccacggcgaccugauugagaucaccgaugcuaagaaacgggaagcccucuaugcccaggacccuucuacgggcuguuacauguauuacuuccaauaccuguccaagaccuauugcguggaugcuacaagagagaccaaccgccuggggcggcucauuaaucauagcaaauguggaaacugccagacaaagcugcacgacaucgauggcgucccccaucuuauucugaucgccuccagagacaucgcggcuggggaggaacuccuguacgacuauggagaucgcucuaaagccagcauugaggcccaccccuggcuuaagcacuga

SEQ ID NO: 75440 - RNA, 2124 nt, Artificial Sequence
  derived and/or modified sequence opt5 from SETDB2__Homo_sapiens__NP_001153780
augggcgagaagaacggggacgccaaaaccuucuggauggaacuggaggaugacggaaagguggauuuuaucuucgaacagguccaaaauguucuccagagccugaaacagaagauuaaagacggcuccgcuacaaacaaggaguacauccaggccaugauucuugugaaugaagcgacgaucauuaacucuagcaccuccaucaaggaucccaugccugugacacaaaaagagcaggagaauaagucuaacgcuuuuccgagcaccuccugcgaaaauucuuuccccgaggacuguacauuucugaccacagaaaacaaagagauccucagccuggaggauaaggucguggacuucagagaaaaagauuccagcucuaaucuuuccuaucagagccacgacugcucuggggccugucugaugaagaugccucucaaccugaagggagagaauccccugcagcucccuauuaaaugccauuuucaacggcgccacgccaagaccaacucccauagcucugcucugcacguuuccuacaaaacgcccuguggcagaagccuucggaauguggaagaggucuuccgcuaucugcucgaaaccgagugcaacuuucuguucacagauaauuuuuccuucaacaccuacgugcagcuugccagaaacuauccuaagcagaaagagguugugucugacgucgauaucagcaaugggguggaauccgugccgauuagcuuuuguaacgagaucgacucucggaagcugccccaguucaaauaccgcaagacagucuggccuagagcuuauaaucucaccaacuucuccagcauguuuacggacucuugcgauuguagcgaaggaugcauugacaucacaaagugugccugccugcaacugaccgcgcggaaugccaaaacaucuccccucuccagcgauaagauuaccaccggcuacaaauacaagcgccugcagagacagaucccuacaggcaucuaugagugcucccuucuguguaaaugcaaccggcaacucugucagaaucgcguugugcagcaugggccccaggugagacugcaagucuucaagacggaacagaagggauggggcgugcggugccuugacgauauugaccgcgggaccuuuguuuguaucuacagcggaagacugcucucucgggcuaacacagagaaauccuauggcauugaugagaaugggagagacgaaaacaccaugaagaauaucuucagcaaaaagcgcaaacuggagguggccugcucugauugugaagucgaggugcugccgcucggacuggaaacacacccucggaccgcuaagacggagaagugucccccuaaauuuuccaacaaucccaaggagcuuacaguugaaaccaaauacgacaacauuagcagaauccaguaucacuccgugauccgcgaucccgagucuaagaccgccauuuuccagcauaauggcaaaaagauggaauuugucagcuccgagucugugacaccugaggacaacgacggcuucaagccgccccgggaacaccugaacagcaaaaccaagggggcgcaaaaagauuccagcucuaaucaugucgacgaguuugaagauaaccuccugaucgaguccgacgugauugauaucacaaaguacagagaagagacgccuccccgcagccggugcaaucaggccaccacacuugacaaccagaauauuaaaaaggcuaucgagguucagauccaaaaaccucaggaaggaagaucuaccgccugccagcgccagcaaguguucugugaugaggaacugcucuccgagacaaagaacaccagcucugacagccugacgaaguuuaauaaaggcaacgucuuccugcucgaugcuaccaaggaagggaaugugggacgguuucugaaccacuccugcugccccaaucuucugguucagaacguguucgucgagacacacaauagaaacuucccgcucguggccuuuuucaccaaucgcuaugugaaagcccggacagagcugaccugggacuacggcuacgaagcugggacgguuccugagaaggaaaucuuuugucagugcggagucaacaaauguagaaagaagauucuguga

SEQ ID NO: 75441 - RNA, 807 nt, Artificial Sequence
  derived and/or modified sequence opt5 from SET__Homo_sapiens__NP_001234929
augggcugcagagaccugcuccccagccugaagccuacccuucuggagaaagaacagcaagaggccaucgaacacauugaugaggugcagaacgaaaucgaccggcucaaugagcaggcuuccgaggaaauucugaaggucgagcagaaauacaacaaacuucgccaaccguucuuucagaagagaucugaacugaucgccaagauucccaauuucuggguuacaacguuugugaaccauccucaggugagcgcgcuccugggggaggaggaugaagaggcucugcacuaucucacccgggucgaagugacagaguucgaagacaucaaguccggauaccgcaucgauuuuuauuucgacgagaaucccuacuuugagaacaaaguucugucuaaggaguuccaucuuaaugaaagcggcgauccuuccucuaaaagcaccgaaauuaaguggaaauccgggaaggaccugacaaagagaagcucucagacccaaaacaaagccucccggaagcgccagcacgaggaacccgagagcuuuuucacaugguuuaccgaucauucugacgccggagcugaugagcucggcgaagugaucaaagacgauauuuggccuaauccgcugcaguauuaccuuguccccgacauggacgaugaggaaggggagggagaagaggacgaugacgaugacgaggaagaggaaggccuggaggauaucgacgaggaaggcgaugaggacgaaggggaggaagaugaggacgacgaugagggagaagagggcgaagaggacgaaggggaggaugacuga

SEQ ID NO: 75442 - RNA, 1098 nt, Artificial Sequence
  derived and/or modified sequence opt5 from SETMAR__Homo_sapiens__NP_001263254
auguucgccgaggcugccaagaccacaagacccugcggcauggcggaauuuaaagagaagccugaagcuccgacggagcagcuggacguggccugugggcaagaaaaccuccccgucggagccuggccucccggcgcugccccugcucccuuccaguacaccccugaucacguuguggggccgggagccgacaucgaucccacacagauuaccuuuccuggcugcaucugugugaaaacacccugccugccugggaccuguagcugccuucggcauggagagaauuaugacgauaacuccugucugcgcgacauuggcucuggcgggaaguacgcggagcccgucuucgaaugcaaugugcucuguagaugcagcgaucacugucggaaccgcguugugcagaaaggacugcaauuucauuuccaggucuuuaagacacacaagaaaggcugggggcuuagaacccuggaguucaucccgaagggacgguuugugugcgaauaugccggcgagguucucggguucuccgaggugcagcgccggauucaucugcagacgaaaucugacagcaauuacaucaucgcuauuagagaacacgucuauaacggacaagugauggagaccuuuguggauccuacauacaucggcaauauuggccgcuuccugaaccacuccugcgaacccaaucuccugaugaucccugucagaauugacucuaugguucccaaacuugcccuguuugcugccaaggauaucgugcccgaggaggaacucagcuaugacuacuccgggcgguaccugaaccuuaccgugagcgaggauaaggaacgccuggaccauggaaagcucagaaaaccuuguuauugcggcgcgaagucuuguacagccuuccugccguucgacuccagccuguacugccccgucgagaaaucuaauauuuccugugggaacgaaaaggagccuagcaugugcggaucugcucccuccguguuuccuagcuguaaacggcucacccuggaaguuucccuuuucucugauaagcagcuggcucccccguauagcggccgccaguggcucgccuccuuuacgagcgccuga

SEQ ID NO: 75443 - RNA, 8034 nt, Artificial Sequence
  derived and/or modified sequence opt5 from SETX__Homo_sapiens__NP_055861
augagcacaugcuguuggugcacccccggcggggccuccacgaucgacuuccugaagcgguacgcuucuaacaccccuagcggagaauuucaaacagccgaugaagaccucuguuauugccuggaguguguggcggaauaccacaaagcucgggaugagcuuccguuccugcaugaaguccucugggagcuggagacccuucgccugauuaaucacuuugaaaaguccaugaaagccgagaucggcgacgaugacgaacucuauauuguugauaacaauggggagaugccccuguucgacaucacaggacaagauuuugagaacaagcugagagugccucuccuggaaauucuuaaauaccccuaucugcuccugcaugagcgggugaaugaacuuugcgucgaggcccugugucgcauggaacaggcuaacugcucuuuccagguguuugacaagcacccuggcaucuaccucuuccugguucaucccaaugagauggugagacggugggccauccugaccgcucgcaaccucgggaaggucgauagagacgauuauuacgaccugcaggaggugcuucugugucucuuuaaaguuauugaacugggacuucuggagagcccugacaucuacacauccucugugcucgaaaagggcaaacugauucugcucccgagccacauguaugauaccacgaauuacaaguccuauuggcugggcaucugcaugcuucugaccauucucgaggaacaagccauggacagccugcuucuggggucugauaaacagaacgacuucaugcaguccauccuccacacaauggagcgggaggcggaugacgauagcgucgaccccuuuuggccugcccugcauuguuucauggugauucuggaucgccucggaucuaagguguggggccagcugauggaccccaucgucgcuuuucaaaccaucauuaauaacgccuccuacaauagagaaauccggcacauucgcaacagcucuguuagaacaaaacuugagccugaauccuaucuggaugacauggugaccugcagccagaucguguacaauuauaaccccgagaaaacgaagaaagacuccggguggcggacagcuauuugcccggauuacuguccuaacauguacgaagagauggagacccucgccucuguccugcagagcgacaucggacaggauaugcgcgugcauaauuccacauuccugugguucauccccuuuguucaaagccuuauggaccucaaggaucugggcguggcguauauugcccaggucgugaaccaccuguacucugaaguuaaagaggugcucaaucagaccgacgcugucugcgauaaggugaccgaguucuuucugcuuauccuggucuccgugauugagcuccacagaaacaaaaagugucugcaucugcuuuggguuagcucucaacaguggguggaggccgucgugaagugcgcuaaacucccuacaacggccuucacccggagcuccgaaaagucuagcgggaauuguuccaaaggaacagccaugaucagcucucugucccugcacagcaugcccucuaacuccguucagcucgcuuaugugcagcugauuagaagccuucugaaggagggcuaccaacucggccagcagucccugugcaaacgcuuuugggacaagcugaaucuuuuccuccgggggaaccugucucugggauggcagcucaccagccaagaaacacaugagcugcaguccugucuuaagcagaucaucagaaauauuaaauuuaaggcgcccccuugcaacaccuucgucgaucugacgucugccuguaaaaucagcccggcuuccuauaauaaggaagagagcgagcagaugggcaaaacaucucgcaaggacaugcacugccucgaagccuccagccccaccuuuucuaaggagccuaugaaagugcaagauuccgugcugauuaaggccgacaacaccaucgaaggggauaauaacgagcagaauuacauuaaagacguuaagcuggaagaccaucuucucgcuggaagcugucugaaacagucuagcaagaacaucuucacagagcgggccgaggaucagauuaagaucuccaccagaaaacaaaagagcgucaaagaaaucucuuccuauacacccaaggacugcacgagccgcaacggcccugagcgggggugcgauagaggaauuaucguguccacccgccugcucacagacucuagcaccgaugcgcuggaaaaaguguccacaucuaaugaggacuuuagccuuaaggaugacgcucuggccaaaaccuccaagcggaagacgaaaguccagaaggaugaaauuugugccaaacucucucacgugaucaagaaacagcacagaaagagcacccugguugacaacacaauuaaucuggaugagaaccuuaccguguccaauaucgagagcuucuacucucgcaaggacacaggcguccaaaaaggcgauggguuuauccauaaccugucccucgaccccagcggagugcuggacgauaagaauggcgaacagaaaucucagaacaauguucucccgaaggagaaacagcugaagaacgaagaacuugugauuuucuccuuccacgagaauaacugcaagauccaagaauuucaugucgacgggaaagagcugauuccuuucaccgaaaugacgaaugcuagcgagaagaaaucuucccccuuuaaggaucucaugacagugccugaaagccgggacgaggagauguccaacagcaccucuguuaucuacagcaaucugacaagagaacaggcccccgauauuuccccuaaaucugacacccugaccgauagccagaucgaccgggaucuucacaagcugucccuccuggcucaggccucugugaucacauuccccagcgacuccccgcaaaacucuagccagcuccagcgcaaggucaaagaggauaagagauguuuuacggcgaaccagaauaacgugggagacaccucccggggccaagugauuaucauuagcgacucugaugacgaugacgaugaaagaauccugucccuugagaaacugacaaagcaggacaaaauuugccucgaacgcgagcacccugagcagcaugucagcaccguuaauucuaaggaagagaaaaaccccgugaaggaagagaagacagaaacccuguuccaauuugaggaguccgauagccaguguuucgaauuugaguccucuagcgaaguguucuccgucuggcaggaccaccccgaugacaauaacagcgugcaggauggggagaaaaagugccuggccccuaucgcuaauacgacaaacggccaaggauguaccgacuauguuucugagguggucaaaaagggcgccgaagggaucgaggaacauacccggccgagauccauuagcguggaggaauuuugcgagaucgagguuaaaaagcccaagcgcaaaagaucugaaaagccuauggcugaggaucccgugcggccuagcuccucuguccgcaaugaaggacagagcgacacaaacaaaagagaccuugugggcaaugauuucaaguccauugaccggcgcaccucuacacccaacagcagaauccagcgggccacgaccguuucccagaaaaagagcucuaagcuguguacaugcaccgagccuauucgcaaagugcccgucuccaagacaccgaaaaagacccacagcgaugcgaaaaaggggcaaaauagauccucuaacuaccucagcugucggacgaccccugccaucgugcccccuaagaaauuucgccagugccccgaaccgacauccaccgcugagaagcugggacucaaaaagggcccuagaaaagccuaugagcugucucagcggagccuugacuacguggcucagcugagagaucaugggaagacagucggcguuguggacacccgcaagaaaacaaagcugauuagcccccaaaaucucagcgugcggaacaacaaaaagcugcuuaccucucaggaacugcagaugcagagacaaauccgcccuaaaucccagaagaaucggagacgccucagcgauugcgagucuacggacgucaaacgggccggaucccacacagcccagaacagcgauaucuucgugcccgaaucugacagaagcgauuauaauuguaccggcgggaccgagguucuggcuaacuccaaucgcaagcaacucauuaagugcaugcccucugaaccugagacaaucaaagcgaagcacggaagcccggccaccgacgaugcuuguccccugaaccagugcgacuccgugguccuuaauggcacggugccuacaaacgagguuauugugagcaccuccgaagacccccucgggggcggcgauccuacagcccggcauaucgagauggccgcucugaaagaaggggagcccgacucuagcuccgaugccgaggaagacaaucucuuccugacccagaacgauccugaggacauggaucuuuguucucagauggaaaaugacaacuacaagcugauugagcucauccacggcaaagauacagucgaaguggaggaggacagcgucuccagaccgcaacuggaaucucucagcggaaccaagugcaaguauaaagauugucuggagacgaccaagaaucagggcgaauacugccccaaacauuccgaggugaaggcggcugacgaagacguuuuucggaaaccugggcuucccccucccgccagcaagccgcugcgcccuacaaccaagaucuucucuuccaaaagcacaucuagaauugccggacuguccaagagccucgagaccucuuccgcucugagccccucccuuaaaaacaagagcaaaggcauccagucuauucugaaggugccccagccugucccccucaucgcccaaaagccugugggggagaugaaaaauagcuguaacguucugcacccgcagucccccaauaacucuaaccggcagggaugcaaggugccuuuuggcgaaagcaaauacuuccccuccucuagcccugucaauauucuccuguccucucagagcguguccgauacguuugugaaggagguucuuaaauggaaguaugaaauguuccugaacuuugggcaauguggacccccggcgagccugugccagucuaucucccgcccuguccccgugagauuccauaauuacggagacuauuuuaacguguucuuuccucucaugguccugaauacauucgagaccguggcucaggaauggcuuaacagccccaaucgggagaacuucuaccaacugcagguuagaaaauuuccugccgauuauaucaaguacugggaguucgccguguaucucgaagagugcgaacuggcuaagcagcuguaccccaaagagaaugaccucgucuuucuugccccggagcgcauuaacgaagagaagaaagauacagaacggaaugacauccaggaucugcacgaguaccacucuggcuaugugcauaaguucagacgcaccuccguuaugcggaacgggaaaaccgaauguuaccugagcauucaaacacaggagaauuuuccugcuaaccucaaugagcuggugaacugcaucgucauuuccucucuugugacgacccagagaaagcugaaggccaugagccuccugggaucccgcaaccagcuggcgcgggccguucucaaucccaaccccauggacuucuguacaaaagaucuucugaccacaaccagcgaaagaaucauugcuuaucugcgcgacuuuaaugaggaucaaaagaaagccaucgaaacggcuuacgccauggugaagcacucuccuuccgucgccaaaaucugccucauucauggcccgcccgggacaggaaagagcaagaccaucgugggccugcuuuauagacugcucaccgagaaccagcggaaaggccacucugacgaaaauagcaacgcuaagauuaaacagaaucgcgugcuggucugugcgccuuccaacgccgcuguugaugagcugaugaagaaaaucauucucgaguucaaggaaaagugcaaagacaagaaaaauccccuugggaacuguggagacaucaaucuggugagacugggcccugagaagucuaucaacagcgaagugcucaaauuuucccuggauucucaggucaaucaccggaugaagaaagagcuucccagccaugugcaagccaugcacaagcgcaaggaguuccuggacuaccagcucgaugagcuguccagacagcgggcccugugcagagggggacgcgagauucagcggcaagaacucgacgagaacaucagcaaaguuucuaaggaaagacaggagcuugcuuccaaaauuaaggaggugcagggccgcccucagaagacccagagcaucauuauccuggaaucccauaucauuuguugcacccugucuacaagcgggggacuccugcuugaguccgccuuucggggccagggcggggucccguucucuugugugaucguugaugaagcgggacagagcugcgagauugaaacgcugacaccccucauccacagaugcaauaagcugauucuggugggcgacccuaagcaacugcccccuacagucaucuccaugaaagcucaggaguauggguacgaucagagcaugauggcccgguuuugucgccuucuggaggaaaacguggagcauaacaugauuucuagacugcccauccuccagcugaccguccaauaccggaugcacccggacaucugccuuuucccuuccaauuauguguacaaccgcaaucugaagacaaacagacagaccgaagccauucgguguagcucugauuggcccuuccagcccuaucucguuuuugacgugggagauggcuccgagcgcagagacaaugacagcuacaucaacgugcaggaaauuaaacuggucauggagaucauuaagcugaucaaagauaagcggaaggacguuucuuuccgcaauaucgggauuaucacgcacuauaaagcucaaaagaccaugauucagaaagaucucgacaaggaguuugauagaaaaggaccugccgaaguggacacaguggaugcguuccagggccggcaaaaggacugcgucaucgugaccuguguuagagcuaacuccauucagggcagcaucggguuucuugccucucugcagcgccugaaugugacaaucacccgggccaaguacagccucuucauucugggacaucuuagaacacugauggagaaccagcacuggaaucaacucauccaggaugcucagaaacgcggcgccauuaucaagacgugcgacaaaaacuaucggcaugaugcugucaagauucugaaacugaagcccgugcuccagagaucccuuacccacccuccgacaaucgcccccgaagggagccgcccucaaggaggccugcccuccucuaagcuggacagcggguuugcgaaaaccuccgucgccgcuucucucuaccacaccccuagcgauuccaaggagauuacacugacggugaccucuaaagaccccgaacggccgccuguucaugaccagcuucaggaucccagacugcucaagcgcaugggaaucgaggugaaaggcggcaucuuccugugggacccucagcccagcuccccucaacaccccggggccacaccgccuaccggagagcccggcuuucccgucgugcaucaggaucugagccacauucagcaaccugcugccguuguggccgcucucucuucccauaagccgcccgucagaggggaaccucccgcggccagcccugaggcuucuacaugucaguccaaaugcgacgaucccgaagaggagcuuugucacagacgcgaagcccgggccuucagcgagggagaacaggagaagugcggcucugaaacccaccauacgagacgcaauuccagaugggacaagcggacacuggagcaggaggauuccucuuccaaaaagcgcaaacugcucuga

SEQ ID NO: 75444 - RNA, 2982 nt, Artificial Sequence
  derived and/or modified sequence opt5 from SEZ6__Homo_sapiens__NP_001092105
augagacccguggcccugcuccugcuuccuagccugcucgcucugcuugcccacggccugucccucgaggcgccgaccgucgggaagggacaggcucccggcaucgaagagacagacggggaacugacggccgccccuacccccgagcaaccugaacggggaguucauuucgugacaaccgcucccacacugaaacuccugaaccaccauccucuucuggaggaguuucuccaggaaggccuggagaagggggaugaggaacuucgcccggcccugcccuuccagccugaucccccugcucccuuuaccccgucuccucuccccagacuggccaaucaggacagccggccuguguucacaucccccacccccgcgauggccgcugucccuacgcaaccgcagucuaaagagggacccuggagcccugaauccgagucucccaugcugcgcauuaccgccccucugcccccgggcccuagcauggcugugcccacacugggcccuggggaaaucgccuccaccacacccccuagcagagcguggacccccacgcaggagggaccgggcgacauggggcggccuuggguugccgaaguggucucucagggagcuggcauugggauccaaggaacaauuaccuccagcacagccucuggcgaugacgaggagaccaccacaacgaccacaaucaucaccacaaccauuacgacagugcagacccccggccccugcuccuggaacuuuagcgggccugaaggaucucuugauuccccgaccgaccugagcucccccacagauguuggccucgacuguuucuuuuacaucucuguguauccuggguacggagucgagauuaaggugcagaauaucagccugcgcgaaggcgagaccgugacagucgaagggcuuggaggccccgauccucugccccucgcuaaccaguccuuccugcugagaggccaaguuauucggagcccuacgcaccaggccgcccuccgcuuucagucucugcccccgccugcugggcccggaaccuuccauuuucacuaucaagcguaccuucuguccugccacuucccuagacggcccgccuauggcgacgugacagugaccagccuccaucccgggggaucugcucgcuuucacugugccacaggcuaccagcugaaaggggccagacaucuuaccugccugaaugcuacgcagccuuucugggauagcaaggagcccgucuguaucgccgcgugcggcggagugauucggaacgcuaccacaggccgcaucguuuccccuggguuccccggaaauuauucuaacaaucucaccugucacuggcugcuggaggcccccgaaggccagagacuccaccuccauuuugagaaggugagccuugccgaagacgacgaucggcugaucauuagaaacggggacaaugucgaggcuccuccgguguacgauuccuacgaaguugaguaucuccccaucgagggacugcugagcucuggcaaacacuucuuuguggaacuuuccacagacagcucuggggccgcugccggcauggcgcuccgcuacgaggccuuccaacagggacauugcuaugaaccuuuugucaaguacggcaacuucuccagcuccacccccacguauccuguggggacaaccgucgaguuuucuugugaucccggauacacacuggagcagggcagcauuaucauugaaugcguggacccucacgauccgcaguggaaugagaccgaacccgcuugucgggccguuugcuccggggagaucaccgacucugcuggagugguccugagcccuaacuggcccgaaccuuauggcagagggcaagauugcaucuggggcgugcauguugaggaggacaaacgcauuaugcucgauauccgggugcugagaauuggacccggcgacguccuuacauucuacgacggggaugaccugacggcccgcgugcucggacaguacuccggcccgcggagccacuuuaagcuguucaccucuauggcggaugugacaauccaguuucaguccgacccugggaccagcguucugggauaucaacagggcuucgucauucacuuuuucgaagugcccagaaaugauacaugucccgagcuuccugaaauccccaacggguggaaaucuccuucccagccggagcucgugcauggcaccgucgugacguaccagugcuaucccggauaccaaguugugggcagcucuguccugaugugucagugggaccugacauggagcgaagaucucccuuccugccagcgcgugaccagcugucacgaccccggggauguugagcauucucggagacugaucuccagcccuaaguuccccgugggagccaccguccaauauauuugcgaccagggcuuugugcuuaugggguccucuauccugacaugucacgaucgccaggcuggaagcccgaagugguccgaccgggccccuaaaugccuccuggagcagcugaagcccugucacggccuuucugcuccugaaaacggcgccagaagccccgagaaacaacuccauccugccggggcuaccauucacuucuccugcgcgcccggauacguucugaagggccaggccucuaucaaaugugugccggggcauccuagccacugguccgauccgcccccuauuugccgggcugccagccuggacggauuuuauaauucucgcucccucgacgucgccaaggcuccggccgcgagcucuacacuggaugcugcccauaucgccgcugccauuuuccuuccccugguggcgauggugcuccuggucggcgggguuuacuuuuacuucuccagacugcagggaaaaagcucucuucagcucccucggcccagaccucgccccuauaaccggaucacgaucgaauccgcuuuugacaauccuaccuacgagacaggcgaaaccagagaguaugaggugagcauuuga

SEQ ID NO: 75445 - RNA, 2430 nt, Artificial Sequence
  derived and/or modified sequence opt5 from SEZ6L2__Homo_sapiens__NP_001107572
augggcacccccagagcccagcacccuccgcccccucaacugcuguuccugauccuucugagcugccccuggauucaggggcucccucugaaggaggaagagauccuucccgaaccuggauccgagacaccgacgguggcuucugaagcccuggcggagcuccugcauggcgcucugcuccggcgcgggcccgagaugggauaccugccuggcagcgacagagaucccacccuugccacaccucccgccgggcagacccuggcugucccgucccucccucgggccacagaacccggaaccggcccucugacaaccgcuguuacgcccaacggcgugcgcggggccggacccaccgcgccugagcuucugacaccgcccccuggcaccacagcucccccucccccgucuccugccagccccgggccuccccucggaccugaaggcggggaggaggaaaccacgacaaccauuaucacaaccaccacagugacgaccacagucaccucccccgccuaucugcugucuuguggauuuccgccuagacccgcucacggcgacgugagcguuacagaucuccaucccggcgggaccgccacguuccacugcgacuccggauaccagcugcaaggcgaggaaacacuuauuugucugaaugggacccggccuagcuggaacggagagaccccgucuugcauggcguccuguggcgggacaauccauaaugccacccucggacgcaucgugagccccgaaccuggcggcgcugucgggcccaaccugacaugcagaugggugauugaggccgcugagggacggcgccuucaccuccacuuugaaagaguuucucucgaugaggacaaugaucggcugauggugcgcuccggcgggagcccucugucucccgucaucuaugacuccgauauggacgaugugccugaaagaggacucauuagcgacgcccagucccuguacguggagcuucugucugaaacgcccgccaacccgcuccugcuuagccugcgguucgaggcuuuugaggaagaucgcuguuucgcgccuuuucucgcccauggcaaugucaccacaaccgaccccgaguauagaccuggggcucuggccacauucuccugccugcccggcuacgcccucgaaccgccuggacccccuaacgcuaucgaguguguugaccccaccgaaccccacuggaaugauacggagccugccugcaaagcgauguguggcggggagcugagcgaaccggcuggaguggugcuuucucccgacuggccucaguccuauagccccggccaggauugcgucuggggcgugcauguucaagaggaaaagcggauucugcuccagguggagauccugaacgucagagagggagacaugcugacccuuuuugauggcgacgggccuucugcccgcgugcucgcccagcugcggggcccccagccuagacgccggcugcucagcuccggaccggaucugacacuucaauuccaggcucccccugggcccccuaaucccgggcugggacagggcuuuguucuccacuucaaagaagugccgagaaacgauaccugcccugagcugcccccucccgaauggggguggcgcacagccucucacggagaccugauucggggcaccguccuuacguaccaaugugagcccggguacgaacuccugggcagcgacauccugacaugccagugggaucucuccuggagcgcugccccuccggcgugucagaagaucaugaccugcgccgaccccggagagauugcuaauggccauagaacagccucugacgcuggguuuccugugggaucccacguccaguaucgcugucugcccggcuacagccuugagggggccgcgaugcugaccugcuauucucgggauaccggaacaccuaaaugguccgacagagugcccaagugugcccucaaguacgaaccgugccugaacccuggcguucccgagaauggguaucaaacgcuguacaaacaucacuaucaggcuggcgaaagccuucgcuucuucuguuacgagggauuugaacucaucggcgaggugaccauuacaugcgucccugggcaucccucccaguggaccucucagccuccccuguguaagguggccuacgaggaacugcucgauaaccggaaacuggagguuacacaaaccacggacccgagcagacagcuugaaggaggcaaccuggcucucgccauccugcugccucuugggcucgugauuguccugggauccggcguguauaucuacuauacaaagcugcagggcaaaucucucuucggguuuagcggaucccacagcuacucucccaucaccguggaguccgauuucagcaauccccuguaugaagccggcgacacccgggaguacgagguuucuauuuga

SEQ ID NO: 75446 - RNA, 3072 nt, Artificial Sequence
  derived and/or modified sequence opt5 from SEZ6L__Homo_sapiens__NP_001171702
augcccgccgcuagaccuccggccgcgggccugcgggggaucagccucuuccuggcccuucugcucggaucccccgcugccgcucuggagcgcgacgcccuuccugaaggcgaugcuucuccccuggggccuuaccuccugcccagcggagccccugagagaggcuccccggggaaggaacaccccgaggaacggguggucaccgcgccucccucuagcucccagucugccgagguucugggagagcucgugcuggacggcacagcuccuagcgcccaucacgauauucccgcucuuuccccgcugcucccugaagaggcccgccccaaacaugcgcugccucccaagaaaaagcuccccagccugaaacaagugaacucugccagaaagcagcuccggccuaaggcuacguccgccgcuaccguccagcgcgccggcagccagccggccucucaagggcuggaccugcucuccagcucuacagaaaaacccggaccucccggcgauccugaccccaucguggcuuccgaggaggcgagcgaaguuccgcuguggcuugauagaaaggaguccgccgugccuaccacacccgcuccucugcagauuucucccuuuaccagccagccuuaugucgcccacacacucccccagcggccggaaccuggggagcccggacccgacauggcccaagaagcuccucaggaggauaccuccccgauggcccugauggacaaaggcgagaaugaacuuacggggagcgcgucugaggaaucccaggagaccacaaccagcacaaucauuaccacgacagugaucaccacagaacaggcucccgcccugugcucuguuagcuucuccaacccugagggauacaucgauucuagcgacuauccccuccugccucugaauaacuuucucgaguguaccuacaaugugaccgucuauacaggcuacggcguggaacugcaagugaaguccgucaaccuuagcgauggggagcugcucucuauucgcggaguugacggccccacgcugaccgugcuugccaaucagacacugcucguggaagggcaggucaucagauccccuaccaacacaauuagcguguauuuccggaccuuucaagacgauggacugggcacguuccagcugcauuaccaggcuuuuaugcucucuugcaauuucccccgcagaccggacuccggggauguuacagugauggaccugcacagcggaggcgucgcccacuuucauugucaccuuggcuacgagcugcagggggcuaaaaugcuuaccugcaucaacgccuccaagccucauuggucuagccaagaacccauuuguuccgcgccuugcggaggcgccgugcacaaugcuaccaucgggcggguucugucucccagcuauccggagaacacaaauggaucccaguucuguauuuggaccaucgaggccccugaaggccagaagcugcaccuucauuuugagcgccuccugcugcacgauaaagacagaaugacagugcauagcgggcagacgaacaagucugcucuccuguacgauucccuucaaaccgaaagcguccccuucgagggccugcucucugagggaaauacaauccggauugaauuuaccuccgaccaggccagagcggccagcacauucaacauccgcuucgaggcuuuugaaaaaggccacugcuaugagccuuacauucagaacgggaauuucaccacgucugaucccaccuauaacaucggaacaauuguggaauuuaccugugaccccggccauagccuggagcaggggccugccaucaucgagugcauuaauguccgggauccguacuggaacgacacagaaccccuguguagagcuaugugcggaggcgagcuuuccgccguggccgggguugugcucagcccuaauuggcccgaaccuuaugucgagggcgaagacugcaucuggaagauucacgugggagaggagaaacgcaucuuccuggauauucaauuucugaaccucucuaauuccgacauccugaccaucuacgauggcgacgaaguuaugccccacauucuugggcaguaccugggaaacagcggcccucagaagcucuauuccucuacgccggaucugacaauccaguuccauagcgaccccgcugggcugauuuuuggaaaaggccaaggguucaucaugaauuacauugaggugucccggaacgauucuuguagcgaccuuccugaaauccagaauggcuggaagaccacaucccacaccgagcucgucagaggagcgcgcauuaccuaucagugcgaucccggcuacgacaucguggggucugauacacugacgugucaaugggaccugagcugguccagcgauccucccuuuugcgaaaagaucauguauuguaccgacccgggagagguggaccauucuacacggcucauuuccgauccuguucugcuugucggcaccacaauccaguauaccugcaaccccggguucgugcuggagggaagcucucuccugacguguuacuccagagaaacaggcacccccauuuggaccagccgccugccucacugcgugucugaggaaucccuugccugugacaaucccgggcucccugagaacggcuaccagauccuguacaaacggcuguaucucccgggagagagccugacauuuaugugcuacgaaggcuucgagcuuaugggggaagucaccauuagauguauccugggacagcccucccacuggaauggcccucuccccgugugcaagguuaaccaagauagcuuugagcaugcucuggaagccgaggccgcugccgagacaucucuggaagggggaaacauggcgcuugcuaucuucauuccugugcugaucauuagccuccugcucggcggcgccuauaucuacauuacgcgcugccgguauuacuccaaucugagacuuccccugauguauucucacccguacagccagaucaccgucgagacagaguucgacaacccuaucuacgaaaccggggaaacacgggaguaugagguguccauuuga

SEQ ID NO: 75447 - RNA, 2022 nt, Artificial Sequence
  derived and/or modified sequence opt5 from SF1__Homo_sapiens__NP_001171501
auggccaccggcgcuaacgccacaccccuggggaagcucggaccuccgggccugcccccucuucccgggccuaaaggaggcuucgagcccgggccuccgcccgcgccuggacccggcgcuggccugcucgccccugggcccccgccucccccucccgugggaagcaugggcgcccugacggcugccuuucccuucgcugcccuuccuccgcccccucccccucccccgccucccccuccccagcaaccucccccgccucccccucccccgucccccggggcgucuuacccucccccucagcccccucccccgccuccccuguaucagagagucagcccuccccagccgccucccccucaaccuccccggaaggaccagcagcccggaccggccggcgggggaggcgauuuucccuccaaaaagcgcaaaagaucucgguggaaucaggacaccauggaacaaaagacaguuaucccuggcaugcccaccgugauuccucccgggcucacacgcgagcaggaaagagcuuacaucgugcagcugcagauugaggaucugacccggaagcuccgcacaggagaccugggcaucccuccgaaccccgaagauagaagcccuucccccgagccuauuuauaauucugaggggaaacggcuuaacacccgcgaguucagaacgcggaagaaacuggaagaggaacgccacaaucucaucaccgagauggucgcccugaaccccgacuuuaagccgccugcugauuacaaaccucccgccacaagagugagcgacaagguuaugaucccccaagaugaauaucccgagauuaauuucgugggacuucugaucggcccucgggggaacacccucaagaauauugaaaaagagugcaacgcgaagaucaugauucgcggaaaaggcuccgucaaggaaggcaaaguggggagaaaggacggacagaugcugccgggcgaggaugagccccugcaugcccucguuacagcuaauaccauggaaaacgugaaaaaggccgucgagcagauccggaauauucugaagcaagggaucgaaacgccugaggaccagaacgaucuuagaaaaaugcagcugcgcgaacucgcucggcugaauggaacacuuagagaggacgacaaccgcauccugcggcccuggcagagcucugagaccagauccauuacaaacaccaccguguguacaaagugcggcggggccggccacaucgccagcgauuguaaauuucaacgcccuggagacccccagucugcucaggauaaggcgcggauggacaaagaauaccucucccugauggccgagcugggcgaagcuccggugccugccagcgucgggucuacguccggacccgccaccacaccucucgcuagcgcccccagaccugcggcucccgccaauaacccgccuccucccucccugaugucuaccacacagagccggcccccguggaugaacuccggccccagcgagucucgcccuuaucaugggaugcacggaggcgggcccggcggaccuggcgggggaccccauuccuucccucacccgcuucccagccugaccggcgggcacggaggccauccuaugcaacacaaucccaaugggccucccccgccuuggaugcagcccccucccccucccaugaaccagggcccgcaucccccuggacaccacgggcccccucccauggaucaguaccucggcucuacgccgguuggaagcggcguguacagacugcaucaagggaagggaaugaugccucccccucccaugggcaugaugccucccccgccucccccucccuccgggcagccgcccccucccccuucuggcccccuuccucccuggcagcagcaacagcagcaaccgccucccccucccccgccuagcuccagcauggccucuuccacaccccugcccuggcagcagcgcagccucccugcugccgcuauggcccgggcgaugagagugcggaccuuucgcgcccacugguga

SEQ ID NO: 75448 - RNA, 2382 nt, Artificial Sequence
  derived and/or modified sequence opt5 from SF3A1__Homo_sapiens__NP_005868
augcccgccggcccugugcaggcugucccgcccccucccccuguucccaccgagccuaagcaaccgacagaagaggaagccagcuccaaagaggacucugcgcccagcaagccugugguggggaucauuuaucccccucccgaagucagaaacaucguggauaaaacggcuuccuucguugcccggaauggaccggaguuugaggcccgcauuagacagaacgaaaucaauaacccuaaguucaauuuucugaaccccaaugacccuuaccacgcuuacuaucggcauaaagugucugaguucaaggaaggcaaggcccaggagcccagcgcugccauucccaaagucaugcagcaacagcagcagaccacacaacagcagcucccucagaaggugcaagcgcagguuauccaggagaccaucgugccgaaagaacccccucccgaguuugaguucauugccgauccucccuccaucucugcuuuugaccuggaugucgugaaacuuacagcccaauucguggcucgcaacgggagacaguuucugacccagcucaugcagaaagaacaacggaauuaccaguucgacuuucugcgcccgcagcacagccuuuucaacuauuuuacaaagcuggucgaacaguacaccaagauucucaucccucccaaaggacuguucuccaagcugaaaaaggaggccgagaauccuagagaaguucucgaucaagugugcuaucggguggagugggcgaaauuccaggaacgcgagagaaagaaagaagaggaggaaaaggagaaggaacgggucgccuacgcucagauugacuggcaugauuuugugguuguggagacggucgacuuccagcccaacgaacaaggcaauuuuccucccccgaccacaccugaggagcugggggcccgcauccuuauucaggaaagauacgagaaauucggagaaagcgaggagguggaaauggagguugaaucugaugaggaagacgauaagcaggagaaagcugaggaaccucccucccagcuggaccaagacacccaggugcaggauauggacgagggcagcgaugacgaagaggaaggccaaaaggucccuccgcccccugagacacccaugccucccccucucccgcccaccccugaucaggugaucguccggaaagacuaugaucccaaggccucuaagccucugcccccggccccugcucccgacgaguaccuuguguccccuaucacgggggaaaagauucccgcgagcaagaugcaggagcacaugcgcaucggacugcucgaucccagauggcuggaacagcgggacagaucuauucgcgagaaacaauccgaugacgaaguuuaugccccuggccuggacaucgagagcucccucaagcagcuggcugagcggagaacagauauuuuugggguggaagagaccgccaucggcaaaaagaucggagaagaggagauucagaagccggaagagaaagucacaugggacgggcauucuggaagcauggcccgcacccagcaagcugcccaggcgaacaucacccuucaggaacagauugaggcuauccacaaggccaaaggccuggugcccgaagaugacacaaaggagaaaauuggcccuuccaagcccaaugagaucccucaacagcccccuccgcccagcucugccacgaacaucccuuccagcgcucccccuauuaccucuguuccccggccgccuacaaugcccccucccgugagaaccacagucgugagcgccgugcccguuaugccccgcccgcccauggcuuccgucgugcggcucccucccgggucugugaucgccccuaugcccccgauuauccacgcgccuagaauuaacgucgugcccaugccucccagcgccccucccaucauggcuccgcgcccuccucccaugauuguucccaccgccuucgugccggcucccccugucgcccccgugccugcgcccgccccuaugccgcccguucauccucccccucccauggaagaugagccgacguccaagaaacugaagacagaagacagccuuaugccugaggaagaguuucugcggagaaauaaaggacccgugucuaucaagguccaggugcccaacaugcaagauaaaaccgaguggaagcucaauggccagguucugguguucacccugccucucacagaccaggucuccgugaucaaagugaagauucacgaagcuaccgggaugcccgccggaaagcagaaacugcaauacgagggcaucuuuauuaaggauagcaacucucuugcuuauuacaauauggccaacggggccgucauccaucuggcucucaaagaacgcggaggccggaagaaauga

SEQ ID NO: 75449 - RNA, 435 nt, Artificial Sequence
  derived and/or modified sequence opt5 from SF3B1__Homo_sapiens__NP_001005526
auggccaagaucgcuaaaacccacgaggacauugaagcccagaucagagagauucaaggcaagaaagcggcucuggaugaagcccagggggugggacucgacagcacaggcuacuaugaucaggagaucuacgggggauccgacucucgguucgccggcuaugucacgagcauugcugccaccgaacuggaggaugacgaugacgauuacuccucuagcacaucccuucuggggcagaagaaacccggauaucaugcuccuguugcccuccugaacgacaucccgcaaucuaccgagcaguacgaucccuuugcggaacaccgcccucccaagaucgccgacagagaggaugaauauaagaaacaucggcgcacaaugauuaucagcccugagagacuugaccccuucgcugacggcuuuuacuccgccgcuuga

SEQ ID NO: 75450 - RNA, 2688 nt, Artificial Sequence
  derived and/or modified sequence opt5 from SF3B2__Homo_sapiens__NP_006833
auggccaccgaacaccccgaaccuccgaaggcugagcugcagcugcccccucccccucccccuggccauuacggggccugggcggcucaagaacugcaggccaaacuugccgagaucggagcuccgauucagggcaacagagaggaacugguggagcggcuccagagcuauacacgccaaacggggaucguccugaauagacccguucuucggggagaagacggcgauaaggccgcuccucccccuauguccgcccagcugcccgggauuccgaugccucccccuccccucggacugcccccucugcagccgcccccucccccucccccgccucccccuggccucggccugggguuccccauggcgcacccucccaaccuuggaccgccuccuccccugcgcgugggcgagcccguggcccucucugaagaggagagacugaaacuugcucagcaacaggccgcucugcucaugcagcaggaggaacgggccaagcaacagggggaccauagccugaaagaacacgagcugcucgaacagcaaaagcgcgcggccguccugcuugagcaggagagacagcaggaaaucgcuaagaugggaaccccggugccccggccuccccaagauaugggccagauugggguucgcacaccucugggacccagaguggccgcuccugucggccccgugggcccgaccccuacaguucuccccaugggggccccugugccccggccgcgcggaccucccccuccucccggcgacgagaauagagaaauggaugaccccuccgucgggccgaaaaucccccaggcccuggagaagauccuucagcugaaagaaucucggcaagaggagaugaacagccagcaggaagaggaagagauggaaaccgaugcucgcuccucucucggacagagcgcguccgagacagaggaagacaccgugagcgugucuaagaaagagaagaauagaaagcggagaaaccgcaaaaagaaaaagaaaccucaacgggucagaggcguuuccagcgaaucuuccggggaucgcgagaaggacagcacgcggucuagaggauccgauagccccgccgcugacguggagauugaauacgugaccgaggaaccugagaucuaugaacccaauuuuauuuucuuuaaacgcaucuucgaggccuuuaagcugacagaugacgucaagaaagagaaggaaaaagagccugaaaagcuggacaaacucgagaacuccgccgcuccgaagaagaaaggcuucgaagaggagcauaaggauucugacgaugacagcuccgaugacgaacaggagaaaaagcccgaagccccuaaacugagcaagaagaaacuucggagaaugaaucgcuuuaccguggcggagcugaagcagcucguugcucggcccgauguggucgaaaugcacgacgugacagcccaggauccuaaacugcuuguucaccugaaggccaccagaaacucugugcccgucccgcgccauuggugcuucaaacggaaguaccuccaaggcaagagagggauugagaaaccucccuuugagcugcccgacuucaucaagcggacgggcauucaggaaaugcgcgaggcucugcaggaaaaagaggagcaaaagacaaugaaauccaagaugagagaaaaagugcggccuaagaugggaaagaucgauaucgacuaucagaaacuccacgacgccuuuuucaaguggcagaccaaacccaagcugacaauucauggggaucuuuacuaugagggaaaagaauuugagaccagacugaaggaaaagaaaccuggcgaccucagcgaugagcugcgcaucucucuggggaugccggucggccccaaugcucacaaggugccucccccuuggcuuauugccaugcagcgguacggacccccgccuagcuaccccaaccucaaaaucccuggccucaauucccccauuccugagucuuguagcuucggguaucacgcgggaggcugggggaagcccccgguugacgaaaccggaaaaccucuguacggcgauguguucgggacaaacgccgcugaguuucaaacgaagaccgaagaggaagagaucgacagaacacccuggggcgagcucgaacccuccgaugaggaaagcucugaggaagaggaggaagaggaauccgacgaggauaagccugacgagaccggauucaucacaccggccgauagcggccugauuacccccgggggauuuucuuccgucccugcuggcauggaaacgcccgagcuuaucgaacugcgcaaaaagaaaauugaggaagccauggacgggagcgagacaccucaacucuucaccgugcugcccgagaagagaaccgcgacaguuggaggcgccaugaugggguccacccauaucuaugauaugucuacagugaugagccggaaaggcccugcuccggaacugcagggagucgagguggcccuugcucccgaggaacucgaacuggacccuauggccaugacgcagaaguacgaggagcacgugcgcgaacaacaggcccagguugagaaggaagacuuuuccgauauggucgcugagcaugcggccaaacagaagcagaaaaagagaaaagcucagccccaggacucucggggcgggagcaagaaauauaaggaguucaaguuuuga

SEQ ID NO: 75451 - RNA, 378 nt, Artificial Sequence
  derived and/or modified sequence opt5 from SF3B6__Homo_sapiens__NP_057131
auggccaugcaggcugccaagagagcgaacauccggcugcccccugaggugaaucgcauucucuacaucagaaaccugccguauaaaauuaccgcugaagagauguacgacaucuucggcaaguaugggcccauucggcaaauccgcgucggaaauacaccugaaacgagaggcaccgccuacguuguguaugaggauaucuuugacgccaaaaacgcuugcgaucaccuuagcggguucaauguguguaaccgguaccuggucgugcucuauuacaaugccaaccgcgcuuuucagaagauggacaccaaaaagaaggaggaacagcugaaacuucugaaggagaaauacggaauuaauacagaucccccuaaguga

SEQ ID NO: 75452 - RNA, 3729 nt, Artificial Sequence
  derived and/or modified sequence opt5 from SFI1__Homo_sapiens__NP_001007468
augaagaaccugcucaccgagaaaugcaucagcucccacaauuuccaucagaaggugauuaaacaaagaauggaaaagaaagucgacucucgguacuuuaaggauggcgccguuaagaaacccuauagcgcuaagacacuguccaacaaaaagucuagcgccuccuucgggauccgcagagagcuuccuucuacgagccaccuggugcaguaccggggaacccauacauguacccgccagggcagacuccgggaacugcgcauuagaugcguggcgcggaaauuucuuuaucuguggauccgcaugacauucgggagagucuuuccguccaaggcucgguucuacuaugagcagcgccuccugagaaagguguuugaagaguggaaagaggaaugguggguuuuccaacacgaguggaagcugugugugcgggccgacugccauuaccgcuauuaccucuacaaucugauguuucagaccuggaaaacauaugucagacagcagcaagaaaugcggaacaaguacauuagagccgaggugcacgaugcuaaacagaagaugcgccaggccuggaaaagcuggcuuaucuauguugugguccggagaaccaagcugcagaugcaaacgaccgcucucgaguuccgccagcggaucauucugagagugugguggucuacauggcgccagcggcuuggacaagugagagucucccgcgcccugcacgcgagcgcccucaagcaucgggcucugucucugcagguucaggccuggucccaguggagagaacaacuccuguacgugcagaaagagaagcagaaaguggucagcgcugugaagcaccaucagcacuggcaaaaacgccgguuucuuaaggccuggcuggaauaucuccagguuagacgggugaagcgccagcagaaugagauggcggaaagauuccaccaugucaccgugcugcaaaucuacuuuugugacuggcagcaggccugggagcggagagagucucuuuaugcucaccaugcccagguugaaaaacuggcucgcaagauggcccuccggagagccuucacacacuggaaacauuacaugcugcugugcgcugaggaagcggcccaauucgagauggcugaagaacaccaccgccauucccagcucuacuuuuguuucagagcccugaaggauaacgugacccacgcccaucuucagcaaauucggcgcaaucuggcucaccagcagcacggcgucacgcuccugcauagauuuuggaaccuuuggcggagccagaucgagcagaaaaaggaacgcgagcugcucccccugcugcacgccgcgugggaccauuauagaauugcucuccugugcaaguguaucgaacuuuggcugcaauacacacagaaacggcgcuauaagcagcuccugcaagccagagccgaugggcacuuccagcagcgggcucugccugccgcuuuucauaccuggaaucgccuuuggagauggcggcaccaggagaacgugcucuccgccagagcgacacgcuuccaccgggaaacccuggagaaacaagucuuuucucuguggagacagaagauguuccagcaucgcgagaaucggcucgccgaaagaauggcuauucugcacgccgagcgccaacuucuguaccggagcugguuuauguggcaucagcaggcugccgcgagacaccaggaacaagaguggcagaccguggccugcgcucaucaccgccacggacggcucaaaaaggccuucugucuguggagagaguccgcucagggccugcggacagaacgcacgggcagaguucgggccgccgaguuucauauggcucagcuucuccgcugggcguggagccaauggagagaaugccuggcccugagaggggcugagcggcagaagcucaugcgcgccgaccugcaccaucagcacucugugcuucaccgggcccugcaggcuugggucaccuaucaaggaagagugcgcuccauccuccgggaaguugccgcgagagagagccagcauaaccgccagcugcugcggggcgcucuuagacgcuggaaagagaauacaauggccagaguggaugaagccaagaaaaccuuccaggcuucuacacacuaccggcgcaccaucugcagcaagguccucgugcaauggagagaggccguguccguucagauguauuaccggcagcaagaagacugugcgauuugggaggcucagaaaguccuggaucgcgggugccugagaacgugguuucagcgguggugggacuguucuagacgcagcgcccagcaacggcuccagcuggaaagagccgugcagcaucaccaucgccagcuucugcucgagggacuggcucgguggaagacacaccaccuucaaugcgugagaaaacggcuucuccaucgccaguccacccagcugcuggcccagagacucagccggaccuguuuccgccaauggagacagcagcuggcugcccggcgccaagagcagagagcgacaguccgggcccuuugguucugggcuuuuucucugcaggccaaggugugggcuaccuggcucgccuucguucuggaacgcagacggaagaaagccagacugcagugggcucugcaagcguaccagggccagcugcuccaggagggggccacacgccugcuccgguuugcugccuccaugaaggccagcagacaacagcugcaggcucagcaacaggugcaggccgcgcacucucuucaucgcgcuguccggagaugcgccacgcuguggaaacagaaggugcucggacgcggcggcaaaccccaaccucuggccgcuaucgcccccucccggaagguuaccuucgaagggccucugcuuaacagaauugcggcuggagccggcgaugggacacuggagaccaagcgcccgcaggccagccggccccucggagcucugggcagacucgccgcugaggagccucacgcccuggagcuuaauacagcgcacuccgcccgcaaacagccccggagaccucauuuucugcucgaacccgcucaaucucagcgcccgcagaagccucaggagcacgggcugggaauggcccaacccgcugccccuagccugaccagacccuuccuugccgaagcucccacggcgcuggugccucauuccccgcuccccggcgcccugucuagcgcuccuggccccaaacagccucccaccgccuccacagggccggagcuccugcuucugccucugagcucuuuuaugcccuguggagccgcugccccugcgcgggucuccgcucagcgcgccacccccagagacaagccucccgugccgagcucucucgccuccguuccugacccccaucugcuucugcccggcgauuucagcgcuacacgggccgggccuggacucucuaccgcgggcagccuggaccucgaggccgaacuggaggaaauccagcaacagcuucugcacuaucagacgacaaaacagaaccugugguccugcagacggcaagcuagcucucuccgcagauggcuggagcuuaaccgggaggagccggggcccgaggaucaggaaguggagcagcaaguccagaaggaacuggaacagguggaaaugcagauucaacuccuggccgaggagcuccaggcucagcgccagccuaucggcgccuguguggcuagaauccaagcccugcggcaggcgcuuugcuga

SEQ ID NO: 75453 - RNA, 2601 nt, Artificial Sequence
  derived and/or modified sequence opt5 from SFMBT1__Homo_sapiens__NP_057413
augaacggcgagcagcaacuggacgccgaugcugggagcggaauggaagagguggaacucuccugggaggacuaccuggaagagaccggcucuacagccguccccuaugggagcuucaagcacguugauacgagacuucagaauggauuugcgccuggcaugaaacuggagguggcugugcggaccgacccggaaacauacugggucgccaccgugaucacaaccugcgagcagcuccugcuucugcgcuaugauggguacggagaagacagacgggccgauuucuggugugacauucgcaaggcugaucucuaucccaucggcuggugcgagcagaacaaaaagacacuggaggccccugaaggcauuagagacaaaguuuccgauugggacgaguuucugcggcaaacccucaucggggcuuguucucccccugugccccugcuugaaggacugcgcaauggcagaaacccucucgaucugauugccccggggagccggcuugagugccaggcguuccaggacucccugucuacguggaucgucaccgugguugaaaauaucggaggccgccucaagcugagauacgaggggcuggagagcuccgacaacuaugaacauuggcucuacuaccuggaucccuuucuucaccaugugggaugggccgcucagcaaggcuaugagcugcagccucccagcgccauucggcaccucaagaaugaagcugaguggcaggaaauccuggccaaagucaaggaggaggaagaggaaccucuucccucuuaccuguucaaagacaaacaggugauuggcauccauacauuuuccgugaacaugaagcucgaggcggucgauccguggagcccuuucgggauuucucccgccaccguugugaagguguuugacgaaaaguauuuccuggucgagauggaugaccugcgcccugagaaucacgcuagacgguccuuugugugucacgccgauagccccggaaucuuccccguucaauggucucucaaaaacggccugcauauuuccccuccgcccggguacccuagccaggacuuugauugggcugacuaucuuaagcagugcggagccgaagccgcuccccaacgcuguuucccuccccugaucuccgagcacgaguucaaagaaaauaugaagcucgaggcggugaacccgauccugccugaagaggucugcguggccacaauuaccgcuguuagaggcucuuaccuuuggcugcagcucgaagggagcaaaaagcccaucccugaguguauuguguccgucgaaagcauggauaucuuuccccugggauggugcgagacgaauggccauccucugucuacaccccggagagcccgcguguauaaacagcggaagauugccgucgugcagccggagaagcaaguuccuuccagcagaaccgugcacgaaggccuccgcaaccaggagcuuaauucuacagaaagcgucaugaucaacgggaaauacuguugccccaagaucuacuucaaccaccggugcuuuuccggacccuaucuuaauaaaggcagaauugcugagcugccucaguguguggggccgggaaacugcguucucgugcugcgcgaaguccugacccuucucaucaaugccgcguacaagcccucucgggugcugagagagcugcagcucgacaaagacagcguguggcauggcuguggggagguucugaaggcuaaguauaaaggcaaguccuaccgcgccaccgucgaaauugugaaaacagccgaucgggugacggaguucugcagacaaaccuguaucaagcuggaaugcuguccuaaccuguuuggaccccgcaugguccucgacaaaugcagcgagaauuguucugugcugacaaagaccaaguauacacacuacuauggcaaaaagaaaaacaagcggauugggagaccucccggaggccauuccaaucuggcuugcgcccuuaaaaaggcuagcaagcggcgcaaaagacggaagaacguuuucgugcacaaaaagaaaagaucuuccgccagcgucgauaauaccccugcggggucuccccagggauccggcggggaagacgaggaugacccggaugagggcgacgaugacagccucuccgaaggaucuacgagcgagcagcaggaugaacugcaagaggaguccgaaaugagcgagaagaaaucuuguuccagcucuccuacacaguccgaaaucagcaccucucugcccccugaccgccagcggagaaagcgcgagcucagaaccuuuagcuucuccgaugacgaaaacaagcccccgagcccuaaagagauccggauugagguggccgaacgccugcaucuugacucuaauccccugaagugguccguugcugauguggucagauuuauccggagcacagacugcgccccucucgcucgcauuuuccuggaucaggagaucgacggccaagcccugcuucuccugacccugcccacagugcaggaaugcauggaucucaaacuggggcccgcgauuaaacuuugucaccacaucgagagaauuaaguuugccuucuacgaacaguuugcuaacuga

SEQ ID NO: 75454 - RNA, 2685 nt, Artificial Sequence
  derived and/or modified sequence opt5 from SFMBT2__Homo_sapiens__NP_001018049
auggagagcacccuguccgccucuaacaugcaggaccccagcuccucuccucucgaaaagugccugggcagcgcuaaugggaacggagaucuugacuccgaggaaggcucuagccuggaggaaacaggguucaauuggggagaguaccucgaggaaacgggcgccuccgcggcuccgcacaccagcuuuaaacauguggagaucucuauucaauccaacuuccagcccgggaugaagcuggaagucgccaauaaaaacaauccugauacauauuggguugccaccaucauuacaaccuguggacagcuucugcuccugagauacugcggcuauggcgaggaccggcgcgcugauuuuuggugugacguggugaucgccgaucugcaccccgucggguggugcacacagaacaauaaggugcucaugccucccgacgcuauuaaagagaaguacaccgauuggacggaguuccugaucagagaccuuaccggaagccggacagccccugcgaaccugcucgaaggcccgcugcgcgggaagggacccaucgaucuuauuaccguuggcucucugaucgaacuccaagacucccagaauccuuuucaguauuggauugugagcgucaucgagaacguugggggaagacugcggcugcgcuacgugggccucgaagauacagagucuuaugaccaguggcuguucuaccuugacuacagacugcggcccgugggcuggugucaagagaauaaauaucgcauggauccucccuccgaaauuuacccgcucaagauggccagcgaguggaaaugcacccuggaaaagucccuuaucgacgcugccaaauuuccucugcccauggaggucuucaaggaucaugcugaccucagaucucacuuuuucacgguggggaugaagcuggaaacagugaacaugugugagccuuuuuauauuagccccgccuccgucaccaaaguuuucaauaaccacuuuuuccaggugacaaucgaugaccugcggcccgagccuagcaagcucucuaugcugugccaugcggauucccuuggaauccugccggugcaguggugucucaaaaacggcgucagccugacacccccuaagggguacucuggacaggacuucgauugggccgacuaucacaaacaacauggcgcucaggaagcucccccuuuuugcuuccgcaauaccagcuuuuccagaggguucaccaagaacaugaaacuugaggccgugaauccccggaacccgggagaacuguguguugccucuguggucagcgugaagggccgccucauguggcugcaccuggagggccuccagacgccuguucccgaagugauugucgauguggaguccauggacaucuuuccugucggguggugcgaggccaauagcuacccccugaccgcuccucauaagacagugucucagaaaaagagaaaaauugcgguugugcaacccgaaaagcagcuuccgccuaccguccccgugaaaaagaucccccacgaccugugccucuucccucaccuggauacaaccggaacgguuaacggcaaguauuguugcccgcagcuguuuauuaaucaucgguguuucuccgggcccuaccuuaacaaaggaagaaucgccgagcucccucaaagcgugggccccgggaagugcguccuggugcugaaagaagugcucucuaugaucauuaaugcugccuacaagccuggccgcguucugcgggagcuucagcuggucgaggacccccacuggaacuuucaggaagagacacucaaagccaaguauagaggaaagaccuaccgcgcuguggugaaaaucguccggaccuccgaucagguggccaauuucuguagacgcguuugcgcgaagcuggaauguugcccuaaccuguuuagccccgugcuuauuuccgagaauuguccggaaaacugcucuauccauacaaaaaccaaguauacauacuauuacggcaaacggaagaagauuagcaaaccucccaucggggaguccaauccugacucuggacaccccaagccggcuagacgccggaaaagacgcaagagcaucuucguccagaaaaagcggagauccagcgccguggauuuuacggccggcucuggggaggaauccgaggaagaggacgcugaugccauggacgaugacaccgcuagcgaagagacaggaucugagcuccgggaugaccaaaccgauacauccagcgccgaaguuccuucugcgcgccccagacgggccgugacccugagaagcggcuccgagccuguccgccggccuccgcccgaaagaacgcgcagagggcggggcgcucccgccgcuagcucugccgaggaaggagagaaaugucccccuaccaagcccgagggcacagaagacaccaagcaggaggaagaggagcgccuggugcucgaauccaacccucuggaguggacaguuaccgacguggucagauucauuaaacuuacggauugcgcgccccuggccaagaucuuccaggaacaagacauugaugggcaggcucuccugcugcuuacacucccuaccgugcaggagugcauggaacugaaacugggaccggccaucaagcucugucaucagauugagcgggugaaagucgcuuuuuaugcccaauacgccaacuga

SEQ ID NO: 75455 - RNA, 738 nt, Artificial Sequence
  derived and/or modified sequence opt5 from SFR1__Homo_sapiens__NP_001002759
auggccgagggcgaaaagaaccaggacuucaccuuuaagauggagagccccuccgauucugcugugguccugccuagcacaccgcaagccuccgcgaaucccucuagcccuuacacgaacuccucuagaaagcagcccaugagcgcuacccuccgggaacgccugagaaaaacacgguucuccuuuaauagcucuuauaacguugugaagcgccuuaaaguggaguccgaagagaaugaccagaccuucagcgagaagccugccucuuccacagaagagaacugccuggaauuucaggagagcuucaagcacaucgauucugaguuugaagagaauaccaaccucaaaaauacacugaagaaccuuaaugucugugaaucccaaagccuggacuccgggucuugcagcgcccuccagaacgaguucguguccgaaaaacugcccaagcagagacugaaugcugagaaagccaagcucguuaaacaggugcaagagaaggaagaucugcuucggcgccugaagcucgucaaaauguacagaagcaagaacgaccugucucagcuucagcugcucauuaaaaaguggcgguccuguagccagcugcugcucuaugagcugcaaucugcugugagcgaagagaauaaaaagcugucccuuacccagcucaucgaucauuacggacuggacgauaaacuucugcacuauaaccgcucugaagaggaguuuauugacguuuga

SEQ ID NO: 75456 - RNA, 945 nt, Artificial Sequence
  derived and/or modified sequence opt5 from SFRP1__Homo_sapiens__NP_003003
augggcaucgggagaagcgagggaggccggcgcggggccgcucugggagugcuccuggcccuuggcgcggcucugcucgccgucggguccgccucugaauacgacuauguuagcuuccaguccgauauuggacccuaccaaucuggcagauuuuauaccaagccuccgcagugcguggacauccccgcugaucugcggcuuugucacaacgugggcuacaaaaagaugguccugccuaaucuccuggagcaugaaacaauggccgaggugaaacagcaggcuagcuccuggguuccccugcucaacaagaauugccacgccgggacgcaaguguuccuguguucucuuuuugcgccugucugccuggaccgccccauuuauccuuguagauggcucugcgaagccgugcgggauagcugugagccgguuaugcaguucuuuggauucuacuggcccgagaugcugaaaugcgacaaguuuccugaaggcgauguguguaucgcuaugacacccccuaacgccaccgaggcuuccaagccccaggggaccacagucugcccgccuugugacaaugaacuuaaaagcgaggccauuaucgagcaucugugcgcgucugaguucgcccuccgcaugaagaucaaagaagugaagaaagaaaacggagauaagaagauugugcccaaaaagaaaaagccucugaaacugggccccaucaagaaaaaggaccucaagaaacugguccuuuaucugaagaauggggcugauugccccugucaccagcucgacaaccugucccaucacuuucuuauuaugggaagaaaaguuaagagccaauaccugcucaccgccauccacaaaugggauaagaagaauaaagaguucaagaacuuuaugaaaaagaugaaaaaucaugaaugcccuacauuccagucuguguuuaaguga

SEQ ID NO: 75457 - RNA, 888 nt, Artificial Sequence
  derived and/or modified sequence opt5 from SFRP2__Homo_sapiens__NP_003004
augcugcagggccccgggagccuccugcuucuguuccucgccucccacugcugucugggaucugcuagaggccuuuuucuguucgggcaaccugacuuuagcuacaagcgguccaacugcaagccgauccccgccaaucuccagcugugucauggaauugaguaucagaacaugcgccugccuaaucuccugggccacgaaaccaugaaggaggugcuugaacaggcgggggcuuggaucccccuggucaugaaacaaugccauccugauacaaagaaauuccucuguucucuguuugcccccguuugccuugacgaucuggacgagacgauucagccuugucacagccucugcguccaggugaaggauagaugugccccggugauguccgcuuucggauuucccuggccugacaugcuggaaugcgaucgguucccccaggacaacgaucuguguaucccucucgccucuagcgaccaucugcuucccgcuaccgaggaggccccgaaggugugcgaagcgugcaaaaauaagaacgaugacgauaaugacauuauggagacacuguguaaaaacgacuuugcccucaagaucaaaguuaaggaaaucaccuacauuaaucgcgauacaaagaucauucuggagaccaaauccaagacaaucuauaaacuuaacggcgugagcgagagagaccugaagaaaucuguccucuggcugaaggauucccugcaaugcaccugugaagagaugaaugacauuaacgcuccuuaccucgugaugggccagaaacaagggggagaacugguuaucacgagcgugaagcgguggcagaagggccagcgcgaguucaaaagaauuucucgguccauccgcaaacuucagugcuga

SEQ ID NO: 75458 - RNA, 1041 nt, Artificial Sequence
  derived and/or modified sequence opt5 from SFRP4__Homo_sapiens__NP_003005
auguuccugagcauccucguggcccugugccuuuggcugcaccucgcucugggcgucagaggggcccccugugaggcgguucggauuccuaugugccgccauaugccguggaacaucaccagaaugcccaaucaccuucaucacuccacacaagaaaacgcuauucuggccaucgagcaauacgaagaacucguggacgugaauuguucugccguccugcgguuuuuccugugcgcuauguaugccccuauuuguacgcucgaauuucugcaugaucccaucaagccuugcaaaagcgugugucagcgcgcuagagacgauugcgagccccuuaugaagauguacaaccacuccuggccugagucucuggccugugacgaacucccgguuuaugaucggggagugugcaucagccccgaggcgauugucaccgaccugccugaagaugugaaauggaucgacauuacacccgauaugaugguucaggagcgcccucuugacguggauuguaagagacugucccccgaccggugcaaaugcaagaaggucaaaccgacccucgccacauaccugucuaagaauuauagcuacgugauccacgcuaaaauuaaggccgugcagcgcuccggcuguaacgaggucaccacaguuguggaugugaaagaaaucuucaagucuagcuccccuauucccagaacccaagucccucugaucacgaauagcucuugccaguguccccauauccucccccaccaggacgugcugauuaugugcuaugaguggcggucccgcaugaugcuucuggaaaacugucucguugagaaguggagagaccagcugagcaaacggucuauccaaugggaggagcgccuucaggagcagagacggaccgugcaggauaagaaaaagacagcugggagaaccucccgcagcaauccuccgaaacccaagggaaaaccucccgccccuaagcccgcguccccgaagaaaaacauuaagacacggucugcccagaaaagaaccaauccuaagcgcgucuga

SEQ ID NO: 75459 - RNA, 954 nt, Artificial Sequence
  derived and/or modified sequence opt5 from SFRP5__Homo_sapiens__NP_003006
augagagccgcugccgcgggcgggggagugcggaccgcugcccuggcccuccugcuuggcgcucugcacugggcccccgcucgcugcgaggaauacgacuauuacggguggcaggccgagccucuccauggaagaagcuauuccaagccgccccaaugucuggauaucccugcggaccuuccccugugccacacagucggcuacaaacggaugcgccucccuaaccugcuggaacaugagucucucgccgaaguuaagcagcaggcuagcuccuggcugccccuucuggccaaaagaugucacucugauacccagguguuccucugcagccuguuugcuccugugugucuugaccggccgauuuaucccugccgcucccugugugaggccgucagagcggggugcgccccucucauggaggcuuacggauuccccuggccugaaaugcugcauugucacaaguuuccccuggauaaugaccucugcaucgccgugcaauucggccaucugccggcuacggccccucccguuacaaaaauuugugcccagugcgagauggaacacucugcugauggccuuauggagcagaugugcagcuccgacuuuguggucaagaugcggaucaaggagauuaaaaucgaaaacggggaucgcaagcugaucggagcgcagaaaaagaaaaagcuccugaagccuggcccccuuaaaagaaaggacaccaaacggcuggugcuccacaugaagaauggggccggaugucccugcccucaacuggauagccuggcuggcucuuuccucguuauggggcgcaaaguggacggacagcugcuucugauggccgucuauagaugggauaagaaaaacaaggagaugaaguuugccgugaaauucauguuuuccuacccguguagccucuacuaucccuucuuuuacggcgcugccgaaccucauuga

SEQ ID NO: 75460 - RNA, 3012 nt, Artificial Sequence
  derived and/or modified sequence opt5 from SFSWAP__Homo_sapiens__NP_001248340
auguacggcgccagcgggggcagagcuaagcccgagcggaaauccggagccaaggaagaggcggggccuggaggcgcugggggaggcggcucucgcguggaacugcucgucuucggguaugccugcaaacuguuuagagacgaugagcgggcccuugcucaggaacaaggacagcaccugaucccguggaugggcgaccauaagauucucaucgaucgcuacgacgggagaggacaucugcacgaucuuagcgaguaugacgccgaguacuccaccuggaaccgggauuaucagcugucugaagaggaagcucgcauugaggcccucugugacgaggaaagauaccuggcgcugcacacagaucuccuggaggaagaggcccggcaggaagaggaguauaaacgccuuagcgaagcucuggccgaggacggcuccuacaaugcuguuggguucacguacggaucugauuauuacgaccccagcgaaccuaccgaggaagaggagcccuccaagcaaagagaaaagaacgaggccgaaaaucucgaggaaaacgaggagccuuuuguggcgccccugggccuuagcgugccuucugaugucgaacugccgcccacagccaaaaugcaugcuaucauugagcggaccgccuccuucgugugccgccagggcgcucaguuugaaaucaugcucaaggccaaacaggccagaaauagccaauucgacuuucugcgguucgaccacuaucugaacccuuacuauaaguuuauccagaaagcuaugaaggaggggcgcuacacaguucucgcggagaauaagucugaugaaaagaagaaauccggagugagcucugacaacgaggaugacgaugacgaagaggauggcaauuaucugcaccccucccuuuucgccagcaagaaauguaacagacuggaggaacucaugaagccucugaaagucguggaccccgaucauccgcuugcugcccugguucggaaggcccaggcugacuccucuaccccuacaccccacaaugccgauggggcgccugugcagcccagccaagucgaguacaccgcugacuccacgguggccgccauguacuauagcuacuauaugcuccccgacggaaccuacugccuggcuccuccgcccccuggcauugaugugacaaccuauuacucuacacugcccgccggggucaccguuuccaacagcccuggagugacgacaaccgcucccccgccucccggcacaaccccucuucccccucccaccacagccgaaacgucuagcggcgcgaccuccacaaccacaaccacgucugcccuggcuccgguggccgcuaucauuccucccccucccgacguccagccggugaucgauaagcucgccgaguauguugcgagaaaugggcugaaauuugaaacaagcgugcgcgccaagaacgaccagcgguucgaguuucuccaacccuggcaucaguacaaugcuuacuaugaguucaaaaagcaguucuuucugcagaaagaaggaggcgauuccaugcaagccgucagcgcuccugaggaagcccccaccgacucugccccugagaagcccuccgaugcuggggaagacggagcgccugaggaugccgcugaagugggcgccagagccgggagcggcggaaagaaagaggcuucuuccagcaagaccguucccgacggcaaacuugugaaggccuccuucgcgccgauuucuuuugcuaucaaagccaaggagaacgaucugcucccucuggaaaagaaccgcgucaaacuggacgaugacagcgacgaugacgaggaauccaaggaggggcaggagucuagcuccagcgccgcuaauacaaaccccgccguggcgccucccugugucgugguugaagagaaaaagccgcagcucacccaggaggaacuggaagcuaaacaagccaagcagaaacuugaggaucggcuggccgcugccgcuagagagaaacucgcccaggcgucuaaggaauccaaagagaagcagcugcaagccgaacgcaaacggaaggcugcccuguuccuucagacacucaaaaauccucugcccgaggcugaagccggaaagauugaggagagcccuuuuucuguggaagaguccagcacgacccccugcccccugcucacaggcgggagaccucugccgacccuugaagucaagcccccugaccgccccucuagcaaauccaaggauccuccccgggaggaagagaaagagaagaaaaagaagaaacacaagaaaagaagccgcacacggucuagauccccuaaguaccacagcuccucuaaaagccggucccgcucucauagcaaggccaagcacucccugccgucugcuuauagaaccgugcggagaagccgcguuacggcgucccccggaacccuccgggccgaaccuugucagagcucugcuuccgugacagccgccgcugagcccggcagcuaccaggccgcgucuaccacaaccagauucgacuccgcuagcucuuuugaagggaaaccuggcaagacgucccgcagcagaucccggagcccccgcagacgggcccauucuccggagcgcagacgggaggaacgcagcgucccuacagccuauagagugucccggucucccggagcuagccgcaaaagaacccgguccagaucuccccacgagaagaaaaagaagcgccggagcagaucccgcacaaaaucuaaggcccggagccaauccgugagcccuucuaaacaggcggcucccagaccugccgccccggcugcccauuccgcucacagcgccucuguuucccccgucgaaagccgcggcuccucucaggagcggagcagaggggugucccaagaaaaggaggcgcagaucagcucugccaucguguccagcguccagucuaaaauuacccaggaucugauggcuaaggugcgcgccaugcuggcugccagcaaaaaccuucaaaccuccgccucuuga

SEQ ID NO: 75461 - RNA, 483 nt, Artificial Sequence
  derived and/or modified sequence opt5 from SFT2D2__Homo_sapiens__NP_955376
auggacaagcugaaaaaggugcucagcggccaggauaccgaggacagauccgggcugucugaagucguugaggccagcucccuuucuuggagcacacggaucaaaggauucauugcuugcuuugccaucggcauucuguguucccuccuggggacggugcuucugugggugccccgcaagggacuccaccuguucgcggucuuuuacaccuucggcaacaucgcuucuauugggagcacaaucuuucugaugggaccugugaaacaacucaagagaauguucgaaccgacccggcugaucgccacaauuaugguucuucugugcuuugcccucacccuguguuccgcuuucugguggcauaauaagggccuugcccugaucuuuugcauucuccagagccuggcucugacaugguauucucucuccuucauccccuuugcccgcgaugcggugaaaaaguguuucgccgucugccuggcuuga

SEQ ID NO: 75462 - RNA, 648 nt, Artificial Sequence
  derived and/or modified sequence opt5 from SFT2D3__Homo_sapiens__NP_116129
auggccgaccugcaccggcagcuccaagaguaccuggcucagggcaaggccgggggacccgcggcugccgaaccucuucuggccgcugagaaagccgaggaaccgggcgaucggcccgcugaagaguggcucgggcgcgccggacugagauggaccugggcgcggagcccugccgaguccgcugccgcuggccuuacaugccugcccucugugacgcgcgggcagagacucgccgcgggaggcggcugucugcugcucgccgcucugugcuucgggcuugccgcucuguaugccccuguccuccugcuucgggcccgcaaguuugcucugcucuggagccugggauccgcgcuggcccucgcuggcucugcccugcuuagagggggagccgcuuguggccggcugcuccgcugcgaagaggcccccagcagaccugcgcugcuuuacauggcugcccugggggccacccucuucgcugcccugggacugcgguccacacuccugaccguucuuggcgcuggcgcccagguggcggcccugcucgcugcccugguggggcuucugccguggggaggcgggacagcucuccgccuggcccugggaagacucggcagaggggcgggacuggccaaaguccuucccguguga

SEQ ID NO: 75463 - RNA, 237 nt, Artificial Sequence
  derived and/or modified sequence opt5 from SFTA2__Homo_sapiens__NP_995326
augggcagcgggcugccccucgugcugcuucugacccuccugggauccucucacggcacagggccuggaaugacgcuucagcugaagcucaaggagagcuuccugaccaacuccucuuacgaaagcuccuuucuggagcuccuggaaaaacuuugccugcuccugcaucuuccgucuggcacaagcgucacccugcaccaugccagaucccaacaccauguuguguguaauacauga

SEQ ID NO: 75464 - RNA, 285 nt, Artificial Sequence
  derived and/or modified sequence opt5 from SFTA3__Homo_sapiens__NP_001094811
augagagccggcuucagcgacuuucagcugauccgggaucaaguccucuuccugcaggaccaggcucagcgccuuaccgaguggcugcaacucuccggguuugaaaaccccgugucugagagcacaacgcugugccuuagagaacgggagaagcgcauuccuaccuguguugccgugugcgugccgucccccggaacaguccacaccgcgcugcuccauccuacaacccugucucagagcagauccucuagcgaagcuaaaaugcugaucauucacacagccuga

SEQ ID NO: 75465 - RNA, 645 nt, Artificial Sequence
  derived and/or modified sequence opt5 from SFTPA1__Homo_sapiens__NP_001158117
augagacccugccaggugccuggcgccgcuaccgggccgcgggccauguggcuguguccccucgcgcugaaccuuauccugauggcugccagcggagccgucugcgagguuaaggacgugugugugggcacaccugggauucccggagaaugcggcgagaaaggggaaccuggagagcgcgggcccccuggccucccggcucaccuggaugaggaacuucaagccacgcugcaugacuucagacaccagauccuccagacccggggcgcucugucccugcagggaucuauuaugacagucggcgagaagguguuuagcuccaaugggcaaucuaucaccuucgaugccauucaggaagcgugugcccgcgcuggaggcagaaucgccguuccccggaacccugaggaaaaugaggcuaucgccagcuuugugaaaaaguacaacacauaugcguacgucgggcucaccgagggacccuccccuggcgacuuccgcuauucugauggcacacccgugaauuacaccaacugguauagaggggaaccggccggacggggcaaagagcagugcguugaaauguacacggacgggcaguggaaugaucgcaacugucuguauagcagacuuaccauuugcgaguuuuga

SEQ ID NO: 75466 - RNA, 798 nt, Artificial Sequence
  derived and/or modified sequence opt5 from SFTPA2__Homo_sapiens__XP_005270185
augagagaccgguggagcgaguccgugcgcgccgcuaccggccccagagccauguggcugugcccucucgcgcugacacuuauccugauggcugccucuggggccgcuugugaagucaaggauguuugcgugggaagcccgggcauucccgggacgccuggaucccacggccuccccgggcgggacggacgcgauggcgugaaaggcgacccugggcccccuggaccgauggggcccccuggcgagacccccuguccucccggaaacaauggccugccgggggccccuggaguccccggcgaaagaggcgagaagggggaagcuggagagcggggcccucccgggcuucccgcccaucuggaugaggaacuccaggcgacacugcacgacuuccgccaucaaauccugcagaccagaggagcccucucucugcagggcagcauuaugacagugggggagaaaguguuuuccucuaacggacagagcaucaccuucgaugcuauucaagaagccugcgcucgggccggcggccgcaucgcgguuccuagaaauccggaggagaacgaagccaucgcuuccuuugucaagaaauacaauacauaugccuacguggggcuuaccgagggacccagcccuggcgacuuccgguauucugaugggacgcccguuaacuacaccaauugguaucgcggagaaccugcuggcagagggaaggagcaguguguggaaauguacacagacggccaguggaacgaucggaauugccuguauucccgccucaccauuugugaguuuuga

SEQ ID NO: 75467 - RNA, 1182 nt, Artificial Sequence
  derived and/or modified sequence opt5 from SFTPB__Homo_sapiens__XP_005264544
augcaccaggccggcuaccccgggugcagaggagcuauggccgagagccaucugcuccaauggcugcuucugcuccugccuacccuuuguggcccggggacagcggcuuggacgaccuccucucuggccugcgcccagggacccgaguucuggugucagagccucgaacaggcucugcaaugccgggcccugggccacugucuccaggaagugugggggcaugucggagcugacgaucugugccaggagugugaagacaucguucacauucuuaacaagauggccaaagaggcgaucuuucaggauacaaugcgcaaguuccuggagcaagaaugcaaugugcucccucugaaacuucugaugccccaguguaaccaggugcucgacgauuauuuuccucuggucauugacuacuuccagaaucaaaccgauuccaacggcaucugcaugcaucugggccucuguaagucuagacagcccgagccugaacaggagccggggaugagcgacccccugccuaaaccccuucgggauccucugcccgacccgcuccuggauaaacuugugcugccuguucuccccggagcccugcaagcucgcccuggcccccacacacaggaccuguccgagcagcaguuucccauuccucucccguauugcuggcugugcagagcccuuaucaagcggauccaagcuaugauucccaagggggcccuggcgguggccgucgcucaggugugucgcguugugccucucgucgccggaggcaucugccagugucuggcugaaagauacucugugauucuucuggauacccuccuggggcggaugcugccccagcucgugugccgccugguccuuagauguagcauggacgacuccgccggaccucggagccccacaggcgaguggcugccgcgcgauucugaaugccaccucuguauguccguuaccacgcaagccggcaauagcucugagcaggcuaucccucaggcgaugcugcaggccugcgugggguccuggcuggacagagaaaaguguaaacaauucguggagcagcauacaccccagcuucucacccuggucccucggggaugggaugcucacaccacaugccaggcccugggcgugugugggaccaugagcucuccccuccaaugcauucauuccccugaccuguga

SEQ ID NO: 75468 - RNA, 576 nt, Artificial Sequence
  derived and/or modified sequence opt5 from SFTPC__Homo_sapiens__NP_001165828
auggacgugggcagcaaggagguccugauggaaucucccccugauuacuccgccgcuccgagagggcgguucggaauccccugcuguccuguucaccucaaacgccugcuuauugugguggucgugguugugcugaucgucgugguuauugugggcgcccuccugauggggcuucauaugagccagaagcacaccgagaugguccuggaaauguccaucggagcgcccgaggcucaacagagacucgcccugucugaacaucuggugacaacggccaccuuuagcauuggcuccacagggcucguggucuaugacuaccagcagcugcuuaucgcuuauaaaccugcccccggaaccugcuguuacaucaugaagauugcuccugagucuaucccgagccuggaggcccucacacggaaaguucacaacuuccaagcgaagcccgccgugccuaccuccaagcugggccaggcugaaggccgcgaugccgggagcgcucccucuggaggcgacccugccuuucuugggauggcgguguccacacugugcggagaggucccccucuauuacauuuga

SEQ ID NO: 75469 - RNA, 1128 nt, Artificial Sequence
  derived and/or modified sequence opt5 from SFTPD__Homo_sapiens__NP_003010
augcuccuguuccugcuuagcgcccuggugcuccugacccagccccuuggcuaccuggaggcugaaaugaagacauauucccacagaacgaugccuucugccugcacccucgucauguguagcuccguugagucugggcugccgggacgggacggccgcgaugggagagaaggaccccggggcgagaaaggggacccuggacugcccggcgcggcuggccaagccgggaugccuggacaggccggccccguggggccuaagggagauaacggcagcgugggggaaccgggacccaaaggcgacacaggcccuuccgggcccccuggacccccgggcgucccugggcccgcuggacgcgagggcccucucgggaagcagggaaauaucggcccccagggcaaacccgggccuaagggagaggccggcccgaagggggaagugggagcucccggcaugcaagggucugccggcgcgagaggacuggccggcccuaaaggggagcggggaguucccggcgaacgcggggugccuggaaacaccggcgcugccgggagcgcuggcgccaugggaccccagggcuccccgggggcgagaggaccucccggccuuaagggggauaaagggauuccuggcgacaagggggccaaaggcgagagcggacugcccgaugucgcuucucuccggcaacagguggaggcccugcagggccagguucagcaucuucaggcugccuuuucccaauacaagaagguggaacuguucccuaaugggcagagcgucggagagaaaaucuuuaagacagccggcuucgugaaacccuuuaccgaagcucagcuccugugcacacaagcgggaggacagcuggccucuccgcgcuccgcugccgagaacgccgcucuccagcagcugguggucgccaagaaugaagcggcuuuccuuagcaugaccgacucuaaaacggagggcaaguuuaccuauccuacaggggagucccugguuuacagcaacugggcccccggcgaacccaaugaugacggaggcuccgaggauuguguggaaauuuucaccaacgggaaauggaaugacagagccugcggagagaagcggcucguggucugugaauuuuga

SEQ ID NO: 75470 - RNA, 969 nt, Artificial Sequence
  derived and/or modified sequence opt5 from SFXN1__Homo_sapiens__NP_073591
augagcggcgagcugcccccuaacaucaauauuaaggaaccgagaugggaccaguccaccuucaucgggcgggccaaccacuuuuucacagugacggauccccgcaauauucuccugaccaacgagcaacuugaaucugcuagaaaaaucguccaugacuaccggcagggaauuguuccucccggccugacagagaaugaacucuggcgcgccaaguauaucuacgauagcgcguuucacccugacaccggggagaaaaugauccugauuggaagaauguccgcucaggugcccaugaacaugacaaucaccggcugcaugaugacauucuaucggaccacgccugccgugcuguuuuggcaguggauuaaucaaucuuucaacgccgucgugaauuacaccaaccgcagcggggaugcuccgcuuacaguuaaugagcucggaaccgccuauguguccgcuacaaccggcgccgucgcgacggcccugggccugaacgcucucacaaagcaugugucuccccugaucgggagauuuguuccuuucgccgcuguggccgcggccaauuguauuaacaucccccuuaugcggcagcgcgaacugaaagucggcauuccugugaccgacgagaauggaaacagacucggggaaagcgcuaacgccgcuaagcaggccaucacacagguggucguuucccggauccugauggccgcucccggaauggcgauuccgccuuuuaucaugaauacccuugagaagaaagccuuccugaagcgcuuucccuggaugagcgcuccuauucaagugggccucgugggguucugccuggucuuugccacaccccuguguugcgcccucuucccccagaaaucuuccaugagcgugaccucucuggaggcugaacuucaggccaagauccaggagucccacccugaacugagacggguuuacuucaacaaaggacucuga

SEQ ID NO: 75471 - RNA, 969 nt, Artificial Sequence
  derived and/or modified sequence opt5 from SFXN2__Homo_sapiens__NP_849189
auggaggccgaccugagcggcuucaacaucgaugcucccagaugggaccagcggaccuuucucgggcgcgugaagcacuuccugaauauuacagauccuagaacggucuuuguuuccgaacgggagcuugacugggccaaagugaugguggaaaagucucgcaugggagucgugccgcccggcacccaaguugagcagcugcucuacgcgaaaaagcuguaugauagcgcuuuccauccugacacaggggaaaagaugaacgugaucggaagaauguccuuucagcuucccggcgggaugauuaucaccggauucaugcugcaguuuuaccggacaaugccugccgucauuuucuggcaaugggugaaucagucuuuuaacgcccucguuaauuauaccaaccgcaaugcugccagccccacauccgugagacagauggcucugucuuacuucaccgccacgaccacagcggucgccaccgcugugggcaugaacaugcugacaaagaaggccccuccgcucgugggccgguggguccccuuugcugccguugcggccgcuaauugcgugaacaucccuaugaugcgccagcaagagcugaucaaagggauuugugugaaggauagaaaugagaacgaaaucggacacagccggcgcgccgcugccauuggcaucacccaggucgugauuuccagaaucacgaugagcgcccccgggaugauucuucugccuguuaucauggagcggcucgaaaaacugcauuucaugcagaaggugaaaguccuucacgcuccccuccaggugaugcugucuggaugcuuucugaucuucaugguuccgguggcguguggccuguucccucaaaagugcgagcuccccgucuccuaucuggagccuaaacuucaggacacaauuaaagccaaguacggggaacuggagcccuauguguacuuuaauaaaggacucuga

SEQ ID NO: 75472 - RNA, 1014 nt, Artificial Sequence
  derived and/or modified sequence opt5 from SFXN4__Homo_sapiens__NP_998814
augagccuggagcaggaagaggaaacccaacccggcagacuccuggggcggcgcgacgccgugccugcuuucaucgagccgaacgucagauuuuggauuacagaacggcaguccuucauccgcagauuucuucaguggacggagcugcucgaucccaccaauguuuucauuucuguggagagcaucgaaaacucccggcagcugcuuugcacaaaugaggacgugucuagcccugccuccgcggaucaacgcauucaggaggcuuggaagagaucucuggccaccguccaccccgacagcuccaaccucaucccuaaacuguuucggcccgccgcuuuccugccuuuuauggccccgacaguguuccucagcaugacaccccugaagggaaucaaaucuguuauucuuccucagguguuucugugugcuuacauggccgcguucaauuccaucaacggcaaucgcagcuauaccugcaagccccucgaaagaucucugcuuauggccggggcugucgccuccagcaccuuucugggagugauuccucaguucguucaaaugaaauacggccucacggggcccuggaucaagcggcugcugccggugauuuuucucguccaggcuucuggaaugaacguguauaugucccgcagccuggaguccaucaagggcauugccgugauggauaaagaaggcaauguccuugggcauucuagaaucgcgggaaccaaggccguucgggagacacuggcuagccgcaucguccucuucggcaccuccgcccugauuccugaaguguucacauacuuuuucaaaagaacccaguauuuucggaagaaccccgggagccuuuggauccugaaacucucuuguacggugcuggcuaugggacugauggugccuuucuccuuuagcauuuucccccagaucggccaaauucaguacugcucucucgaggaaaagauccagagccccacagaggagaccgaaaucuuuuaucacagagggguuuga

SEQ ID NO: 75473 - RNA, 1164 nt, Artificial Sequence
  derived and/or modified sequence opt5 from SGCA__Homo_sapiens__NP_000014
auggccgagacccuguucuggacaccccuccuggugguccuucuggcuggccucggggacacggaagcccagcaaaccacacugcacccucuuguuggaagaguguuugugcauacccuggaucacgagacauuccucagccugccggaacaugucgcggugcccccugcuguucacaucaccuaccaugcccaucugcagggccaccccgaccucccucgguggcugcgcuauacacagagauccccucaccaccccggguuucuuuacggaucugccaccccggaggaucggggccuccaggugauugaagucacggcuuauaaccgcgacagcuucgauaccacaagacaacggcuggugcuggagaucggggaccccgagggaccucuucugcccuaccaggccgaauuucucguucgcucccaugaugcugaggaagugcugccuucuacccccgccagcagauuccuguccgcgcucggcggccugugggagccgggggagcuucagcugcucaaugucacaucugcccuggaccggggaggccgcgugccucuucccauugaagggagaaaggagggaguguauaucaaagucggcagcgcuuccccuuuuucuaccugccugaagaugguugccagccccgauucccacgcucggugugcccaggggcaacccccucuccugagcugcuacgacacgcuggcgccgcacuuccgcguggauugguguaacgugacacucgucgacaaaucugugcccgaaccugccgaugagguucccaccccuggagacggcauucuggaacaugaccccuuuuucugcccgccuacagaggcucccgauagagacuuucuuguggaugcccuggucacccuccuggugccucuucugguugcucuccugcugacccuccugcuugccuaugugauguguugccggcgcgagggcagacugaagcgggaccucgccacauccgauauccagaugguccaccauuguacgauccacgggaauaccgaggaacugagacagauggcugcgagccgcgaagugccccggccucugucuacacuucccauguucaacguccauaccggagagagacucccgccucgcguggacuccgcccagguuccccugauucuggaucaacacuga

SEQ ID NO: 75474 - RNA, 957 nt, Artificial Sequence
  derived and/or modified sequence opt5 from SGCB__Homo_sapiens__NP_000223
auggccgcugccgcggcugccgccgcugagcagcaaagcuccaacggccccgugaagaaaucuaugagagaaaaggccgucgagcggcgcagcguuaauaaagaacacaacuccaauuucaaggcuggguacaucccuauugacgaggauagacugcauaaaaccggacuccggggccgcaaggggaaccuggccaucugcgugauuauccuucuguuuauucucgcggugaucaaucugaucauuacacuugucaucugggccgugauuagaaucggaccgaacggcugugacucuauggaguuccacgaaagcgggcugcuccgguuuaagcagguuuccgauaugggagugauucauccccuguauaaaucuacggucggcggccgcagaaaugagaaccuggugaucaccgggaauaaccagccuauuguuuuccagcaaggaacaaccaagcucagcguggaaaauaacaaaacauccaucaccagcgacaucggcaugcaguuuuucgauccccggacacagaauauucuguuuucuaccgacuacgagacgcacgaguuccaucuuccuuccggggucaagagccugaacgugcagaaggcuucuaccgaacgcaucacauccaaugccaccagcgaucucaacauuaaaguggacggcagagcuaucguccggggaaacgaggggguuuuuauuaugggaaagacaaucgaguuccacaugggcggcaauauggaacugaaagccgaaaacucuaucauucuuaauggguccgugauggugagcaccacgcgccugcccuccucuagcuccggagaucaacucggcagcggggacugggucagauauaagcugugcaugugugcggauggaacacuguuuaaagugcagguuaccucucagaacaugggcugccagaucuccgacaauccuugugggaacacacacuga

SEQ ID NO: 75475 - RNA, 771 nt, Artificial Sequence
  derived and/or modified sequence opt5 from SGCD__Homo_sapiens__NP_758447
augaugccccaggagcaauacacccaccauagaagcacaaugccuggcuccguggggccgcaggucuauaagguuggaaucuacggcuggcggaaacgcugccuguauuucuuugugcuccugcuuaugauucugauccucgugaaccuggccaugacgauuuggauccuuaaggucaugaauuucaccauugacgggaugggaaaccugagaaucacagaaaaaggccucaagcuggagggggauucugaauuucugcagccccucuacgcuaaagagauccagagccggccuggaaaugcccuguauuucaaguccgcgcgcaacgugaccguuaauauucuuaacgaccaaacaaaggugcugacccagcucaucacaggccccaaagcugucgaagccuacggcaagaaauuugaggugaagaccguuucugggaaacugcuuuucagcgccgauaauaacgagguggucgugggagcugaaagacugcgggugcucggcgccgaggggacggucuuuccuaaguccauugaaacccccaauguucgcgcugacccuuucaaggagcugagacuggagucuccgacacggagccucgugauggaagcccccaaaggaguggagaucaacgcggaagccggcaauauggaggcuaccugucgcacagaacugagacuugaguccaaggauggggagguccgggacgaaaaagaucgcagcucuaaguccuauagcuuuaacagaccuacccugcccauuacgggauga

SEQ ID NO: 75476 - RNA, 1356 nt, Artificial Sequence
  derived and/or modified sequence opt5 from SGCE__Homo_sapiens__NP_001092870
augcagcugcccagauggugggagcucggcgacccuugcgccuggaccgggcaaggacggggcacacgcagaaugagcccggcuacgaccgggacauuccugcuuaccguguacuccaucuuuucuaagguccacagcgaucggaacguuuaucccuccgccggagugcuguucgugcauguccucgaacgcgaguacuuuaaaggcgaguucccucccuauccuaagcccggggaaauuucuaaugacccuaucacauuuaacaccaaucugaugggauacccggauagacccggcuggcuucgguauauucagcgcacaccuuacagcgacggcgugcuguaugggucccccaccgcggaaaacguuggaaaaccuacgaucauugagaucaccgcuuacaauagacggacauucgagaccgcccgccacaaccucaucauuaauaucaugucugccgaagauuuuccccugccguaccaggcugaguucuuuauuaagaacaugaauguggaagagaugcuggccagcgagguccucggcgacuuccugggggcugugaaaaacguuuggcagccugaaagacuuaaugccaucaacauuacauccgcgcuggaucggggaggccgcgugccccucccuaucaaugaccugaaggagggggucuaugugauggugggagccgauguccccuuuagcucuugucuuagagaaguugagaacccccaaaaucagcugcggugcucccaggaaauggagccugugauuaccugugacaagaaauuccgcacgcaguuuuacaucgauuggugcaagaucagccucguggacaaaacaaagcaagucucuaccuaucaggaggugauuagaggcgaaggcauccugccggaugggggagaguacaaacccccuuccgacagccugaagucucgggacuauuacacagauuuccucauuacccuggcuguucccuccgccguggcucuuguccuguuccucauccuggccuauauuauguguugcagacgcgaaggcgugauccagcuuguucaucacagcgcgauccagaaguccaccaaagagcugcgggacaugucuaagaacagagaaauugccuggccucucagcacacugcccguguuucauccggucacgggggagaucauuccuccccugcacaccgauaacuacgacuccacaaauaugccucucaugcaaacccagcagaaccugccccaccaaacacagaucccucagcagcaaaccacgggagauuuccgccuuacaaccuuucagcgguucgaggugaauggcauucccgaagagagaaaacugaccgaagcuaugaaccucuga

SEQ ID NO: 75477 - RNA, 876 nt, Artificial Sequence
  derived and/or modified sequence opt5 from SGCG__Homo_sapiens__XP_005266562
auggugagagagcaguacaccacagccacggaaggcaucugcauugagcggcccgaaaaccaauaugucuacaagaucgggauuuauggauggcgcaaaagaugucuguaccucuucguucugcuucugcucaucauucugguggugaaucuugcucugaccaucuggauccucaaggucaugugguuuagcccugccggcauggggcaccugugcgugacaaaagacggacugcggcucgagggcgaauccgaguuccuguuuccgcuuuaugcgaaggagauucauucucgcguugauagcucccugcuccugcagucuacccagaacgugacagucaaugcuagaaacagcgaaggggaggugaccggacggcuuaaaguuggccccaagaugguggaaguccagaaucaacaguuccagaucaacuccaaugacggcaagccucuguuuacaguggaugagaaagagguggucguugggaccgacaagcuccgcgugacgggacccgaaggcgcccuguucgagcacucuguggaaaccccucuggucagagccgaucccuuucaggaccuccggcuggagagcccuacacgcucccuuagcauggaugcuccgagaggggugcauauucaagcccacgcuggaaaaaucgaagcccugucucagauggacauucucuuccauuccagcgauggcaugcugguucuugacgcggagaccgugugucugcccaagcucguccaggggacauggggaccuucuggcuccagccagucucuguacgagaucugcgugugucccgauggcaaacuguaucucuccguugccggggugagcaccacgugccaagaacacaaccacauuugucuguga

SEQ ID NO: 75478 - RNA, 939 nt, Artificial Sequence
  derived and/or modified sequence opt5 from SGCZ__Homo_sapiens__NP_631906
auggacagaagcaccaaccuggauaucgaggaacucaagaugacacgggagcaguacauucuggccacgcaacagaauaaccuuccccgcaccgaaaaugcucagcuguauccugugggcaucuacggguggagaaaacggugccucuauuucuuuguccugcuucugcucguuacaaugauugugaaccuggccaugaccaucuggauucugaaggugaugaauuucacagucgacggaaugggcaaccuccgcgugaccaaaaaggggaucagacuggagggaaucuccgaauuucuucugccgcucuacguuaaagagauucacucucggaaggauagcccccuggugcuucaguccgaccgcaaugucacagugaacgcgagaaaucauaugggccaacugaccgggcagcucacgaucggagcugaugccguugaggcccaguguaagcgguucgaagugcgcgcuucugaggacggcagaguccuguuuagcgccgaugaagacgagauuaccaucggcgcugagaaacugaaggugacagggaccgaaggagccguguucggccacuccgucgagacaccucauauucgggcggaacccucucaggaucuccgccuggagagcccuaccagaucccuuaucauggaagcuccccgcgggguucaagugagcgccgccgcuggagacuuuaaagccacgugccggaaggagcugcaccuccagucuacagagggcgaaauuuuccugaacgcggagaccaucaaacuugggaaucugccuacaggauccuuuagcagcuccagcccgucuuccagcuccucuagacagaccguguaugaacucugugucugccccaacggcaagcuguaccugagcccugccggcgugggguccaccugucagucuucuuccaauaucugccucuggagcuga

SEQ ID NO: 75479 - RNA, 1830 nt, Artificial Sequence
  derived and/or modified sequence opt5 from SGIP1__Homo_sapiens__XP_011540595
augauggagggccugaagaaaagaacccggaaggccuucgggauccgcaaaaaggaaaaagacacagauagcacgggaucccccgacagagauggcauuaagaagucuaacggggcuccuaauggauuuuacgccgagaucgacugggaacgguauaacagcccggagcucgaugaagagggcuacuccauucgccccgaggaaccugggucuaccaaaggaaagcacuucuauagcuccucugagagcgaagaggaggaagagucccauaaaaaguuuaauaucaaaauuaagccccugcagagcaaggacauccuuaaaaacgcggcuacaguggaugaacugaaggccucuaucggcaauauugcccucuccccuagccccgucggcgcuaucaaaagaaaccugucuuccgaggaaguugcccggccucgcagaagcaccccgacacccgagcuuauuucuaagaaaccucccgacgauaccacagcucuggccccucucuucgggcccccgcuggaguccgcguuugacgaacaaaagaccgaggugcugcucgaucagccugaaaucuggggaagcggccagcccauuaauccuuccauggagucucccaaacugacgcggcccuucccuaccgggacaccgcccccucuucccccuaagaacgugcccgccaccccgccucgcacaggaagcccccugaccaucggcccuggggcuuccagccccgccagaccugcuacgccccucgucccgugccggucuacaaccccucccccucccccgccccgcccucccuccagaccuaagcugcccccuggaaaacccggcgugggcgacguuagccggccguuuucuccucccauucacagcuccucuccucccccgaucgccccucuugcgcgcgccgaaagcacauccagcaucucuuccaccaauagccugucugcugccaccacacccacggugggguccagcagaggaccuucuccccucaccaugggcgcucaggauacacugcccgucgccgccgcuuucaccgagacagugaacgcguacuuuaagggggccgacccuuccaaauguauuguuaagaucaccggagagauggugcugagcuucccggcuggcauuacgcggcauuuugccaauaaccccuccccugccgcucucacauucagagucaucaauuuuucucgccuggaacacgugcuucccaacccucaacugcucugcugugacaauacccagaacgaugccaacaccaaagaguucugggugaauaugcccaaccugaugacacaucuuaagaaggucagcgaacagaaaccucaggcgaccuauuacaauguugacaugcugaaguaucaaguguccgcucaggggauucagagcacaccgcucaaccuggccgugaauuggcggugcgagcccucuuccacggaucugagaaucgacuacaaauacaacaccgaugccaugacaaccgcugucgcccucaauaacgugcaguuccugguuccuaucgacggaggcgugacaaaacuucaagcuguccugcccccugccguguggaaugcggaacagcagcgcauucucuggaagauccccgauauuagccaaaagucugagaacggcgggguuggaucccugcuugcccgguuucagcugagcgagggcccgucuaagccuagcccccucgugguccaguucaccuccgaagggagcacgcugucuggaugugacaucgagcuggugggcgcuggguauagauuuucccucauuaaaaagcgcuucgccgcuggcaaauaccuggccgauaauuga

SEQ ID NO: 75480 - RNA, 1581 nt, Artificial Sequence
  derived and/or modified sequence opt5 from SGK1__Homo_sapiens__NP_001137148
auggugaacaaggacaugaauggcuuccccgucaaaaagugcagcgccuuucaguucuuuaaaaagagaguucggcgcuggaucaaauccccuauggugucuguggauaagcaccaaagcccgucccugaaguacaccgggucuagcaugguccauauucccccuggagagcccgacuucgaauccucucucugucagacaugccugggcgagcacgcuuuucagagaggggugcuuccucaggaaaacgagagcuguuccugggaaacgcaaagcggaugcgagguucgggagcccuguaaucaugccaacauccugaccaaaccugauccgcgcacauucuggaccaaugacgaucccgcguuuaugaagcagagacggaugggccucaacgacuucauucagaaaaucgcuaauaacucuuaugccugcaagcacccugaagugcaguccauucugaaaaucagccaaccccaggagccugaacuuaugaaugccaaccccucuccgccucccuccccuagccagcagaucaaucuggggcccucuuccaacccccaugcuaagccuagcgauuuucacuuccucaaggucauuggaaaaggcuccuuuggcaaggugcugcuggcccgccacaaagcugaggagguuuucuacgccgugaagguccuccaaaagaaggcgauccugaaaaagaaggaagagaaacauauuaugucugaaagaaaugugcuucugaagaacgugaaacacccguuucucgucgggcugcauuucagcuuccagacagccgacaaacuuuauuuuguucuggauuacaucaauggaggcgagcuguucuaucaccuccagcgggaacgcuguuuucuggagcccagagcucgguucuacgccgcugagauugccuccgcgcucggguaucugcacagccuuaacaucguguaccgcgaccugaaaccugaaaacauucuccuggauucucaaggacauaucgugcuuaccgacuuuggccugugcaaggagaauaucgaacacaacuccacaaccagcacguucugugggacccccgaguaccucgccccugaaguccugcauaagcagcccuaugauagaacaguggacugguggugccugggagcuguucucuacgagaugcuguauggccuuccgccuuuuuacucucggaauaccgccgagauguaugacaacauucugaauaaaccccuccagcugaagccuaacaucacaaauagcgcucgccaccuucuggaaggccuccugcagaaagauagaaccaagcggcugggggccaaagacgauuucauggagauuaagucccauguguuuuucucucucaucaacugggacgaucugauuaauaagaaaaucacgcccccuuuuaaccccaaugucagcggaccgaacgaccuuagacacuucgauccugaauuuacagaggaacccgugcccaauuccaucggcaagagcccugacucuguucuggugaccgccuccgucaaagaggcugcggaggccuuccucggguucagcuacgcuccgcccacagauucuuuucuguga

SEQ ID NO: 75481 - RNA, 4221 nt, Artificial Sequence
  derived and/or modified sequence opt5 from SGK223__Homo_sapiens__XP_005272427
augcaccagacccugugccucaaccccgagagccugaagauguccgccuguucugacuucguggaacauaucuggaaaccuggcagcugcaagaauuguuuuugccuuagauccgaucaccaacuggucgcugggccgccccagccucgggccggaucucuucccccucccccucgccugccgcccagaccugagaacugucggcuugaagacgagggcguuaauagcucccccuacucuaaaccuacaauugcggugaagcccacgaugaugagcuccgaagcuagcgauguguggaccgaggccaaccugucugccgaggucucccaggugaucuggcgcagagcuccggggaaacucccucugcccaagcaggaagacgccccuguuguguaucugggcagcuuccggggcguccaaaagcccgcugggcccucuacauccccugauggaaauagccgcugcccgcccgccuacaccauggugggccuccauaaccuggagccuagaggcgaacggaauauugcguuucaccccguuucuuucccugaggagaaagccgugcauaaggaaaaacccuccuuuccguaucaggaccgcccuagcacacaggaguccuucagacagaagcucgcugccuuugcugggaccacaucuggaugucaccaaggccccgggccucugcgggaaagccuccccuccgaggaugacagcgaucagcgcugcucuccuuccggagacagcgaaggcggggaguacuguucuauccuggauugcugucccggaagcccggucgccaaagcggccucccagaccgcuggcucuagaggccggcacgggggacgcgacugcagcccuacgugcugggagcagggcaaguguuccgggcccgccgaacaagagaagagaggacccagcuucccuaaagaaugcuguucucagggcccgaccgcucaucccuccugccuugggccuaagaaacugagccucacaucugaggccgccauuuccagcgauggacuguccuguggcucuggcagcggguccggaucuggcgcuagcucccccuuugugccucaccuggaaagcgacuauugcucucucaugaaggagcccgcgccugagaaacagcaagaccccggguguccgggagugaccccuucccggugccugggccuuacaggggaaccccagccucccgcccauccgagagaggcuacccagccugaacccaucuacgccgagagcacgaagcgcaaaaaggccgcuccuguccccucuaagucccaggccaaaaucgaacacgcggcugccgcccaaggccagggacagguuuguacaggcaacgcuugggcccagaaggcugccagcggguggggacgggauucucccgacccuaccccgcaagugagcgcgacaauuaccgugauggccgcucaccccgaggaggaucauagaaccaucuaucuguccagcccugacucugccgucggcgugcaguggccccgcgggccuguuucccagaauagcgaagugggagaggaagagacauccgcuggccaggggcucucuagccgggagucccacgcccauucugcgagcgaauccaaacccaaggagagaccugccauuccgcccaaacugucuaagagcuccccugucggcagccccgugucuccuuccgcuggaggacccccgguuagcccucuugccgaucugucugacggguccagcggagggucuuccaucgggccccaacccccuagccagggacccgcugauccugccccguccugccgcacgaacggcguggccauuagcgaccccucucgguguccucagcccgcugcgagcuccgccucugaacagagacgcccucgguuccaagcugggaccuggagcagacagugccgcaucgaggaagaggaggaagucgagcaggaacuccugucccacucuuggggccgggagacaaagaauggacccaccgaucauagcaacuccacaaccuggcacagacugcacccgacggacggcucuagcgggcaaaauuccaaagugggaacaggcaugagcaagucugccuccuuugccuucgaauuuccuaaagaucggagcgggauugagaccuucucucccccucccccucccccgaagucccgccaucuccugaaaaugaacaagagcuccucugaccuugagaaggucagccagggauccgcugaaagccugucuccuuccuucagaggcgugcacguuagcuuuaccacagggucuaccgacagccucgccuccgauucucggacaugcagcgacggcggacccuccucugagcuggcgcauagccccaccaauuccggcaaaaagcuguucgcuccugugccguuucccagcgggucuacggaagaugucuccccuagcggaccccagcagccucccccucuuccgcagaaaaagaucguguccagagccgccucuagccccgacggcuucuuuuggacacaaggguccccuaaacccggaaccgcuucuccuaagcucaaccugagccacuccgagacaaacguucacgaugaaagccauuucucuuacucccugagccccggcaaucgccaccauccgguguuuucuuccagcgacccucucgagaaggccuucaaaggcucugggcacuggcugcccgcggcuggacuugccggcaacagagggggauguggcagccccgggcugcagugcaagggagccccuuccgcuucuagcucccagcucagcgucuccucucaagccagcaccggcuccacgcagcugcagcugcauggccuucucucuaauaucagcuccaaagaggggaccuacgcuaagcugggaggccuguauacacagucucucgcccggcugguggcgaaaugugaagaucuuuuuaugggcggacaaaagaaagagcugcacuucaacgaaaauaacuggagccucuuuaagcugaccugcaauaagcccuguugcgacuccggcgaugccauuuacuauugugcuacaugcagcgaggacccugggucuaccuacgccgugaaaaucuguaaggcuccggagcccaaaacgguuuccuauugcagcccuucuguccccgugcacuucaacauucagcaggauuguggacauuuuguggccuccgucccuagcucuaugcuguccagccccgacgccccgaaggauccugugcccgcccuuccuacacaucccccugcgcaagaacaggacugcguuguggucaucacccgcgaggugccccaccagacagccuccgacuucguuagagauagcgcugccucucaccaggccgaaccggaggcuuacgaacggcgcgugugcuuccuccugcugcaacucuguaauggccuggagcaucuuaaagagcacggcauuauccacagagaccugugccucgaaaaccugcugcuuguccauuguacccuccaggccgggccuggacccgcgcccgcuccugccccggcccccgcuccugccgcggcugcucccccuugcagcuccgccgcucccccugccggcgggacccugucucccgcugccggaccggcgagcccugagggcccccgggaaaagcagcugccucgccucaucauuuccaauuuucugaaggccaaacagaagcccgggggaacaccgaaccuucaacagaaaaagucucaggcuagacuggccccugagaucgugagcgcuucccaguaucggaaauucgaugaauuucaaacgggcauucucaucuacgagcugcugcaccagcccaaucccuucgagguucgcgcccagcuuagagaacgggacuaccgccaggaggaucucccuccccugccugcccugucucucuauagcccgggccugcaacagcuugcucaucugcuccuggaagcggaccccauuaagagaauccggaucggggaggccaagagagugcugcagugucuucuguggggaccucgccgggaacucguccaacagcccggcaccuccgaggaggcucugugcgggacacuccacaacuggauugauaugaaaagagcccugaugaugaugaaguuugccgaaaaagcuguggaccgccggagaggaguggagcuugaagauuggcuguguugccaguaccucgccagcgcggagccuggcgcucugcugcagucucuuaagcugcuccaacugcucuga

SEQ ID NO: 75482 - RNA, 1104 nt, Artificial Sequence
  derived and/or modified sequence opt5 from SGK2__Homo_sapiens__NP_001186193
augaacagcucccccgccggcaccccuucuccgcagcccagcagagcuaaugggaacaucaaucugggaccuuccgccaaccccaaugcgcaaccuacagacuucgauuuucucaaggugauuggcaaagggaacuacggaaagguccugcuugcuaaacggaagucugacggcgccuucuaugccguuaaagugcugcagaaaaagagcauccucaagaagaaagagcagucccacauuauggcugaacgcucugugcugcuuaagaaugucagacaucccuuucugguggggcuccgguacagcuuccagacgccugagaaacuguauuuuguucuggauuacgugaacggaggcgaacucuucuuucaucugcaacgcgagagacgguuccuugaaccgcgcgccagauuuuaugcugccgaggucgcguccgccaucggcuaccugcacagccucaauauuaucuaucgggaccugaagcccgagaacauccuucuggauugccaggggcacgugguucucaccgacuucggacuguguaaggaaggcguggagccugaagauacaaccucuacauuuugcgggacccccgaguaccuggcuccugagguccuccgcaaagaacccuacgacagagccguggauugguggugucugggagcugugcuuuaugagaugcugcauggccucccgccuuucuacucccaggacgucagccagauguaugaaaauauucugcaccaaccccuucagaucccugggggacggacaguugccgcgugcgaucugcuccagucucugcugcacaaggaccagcgccaaagacucggcuccaaagccgauuuucuggagauuaagaaccauguguucuucagccccaucaauugggacgaccuuuaccacaaacggcugacgcccccuuuuaacccgaaugugaccggccccgcugaucucaagcauuucgacccugaauuuacccaggaggccgucucuaaauccauuggguguacacccgauaccguggcuagcuccucuggagccagcuccgccuuccugggcuuuagcuaugcuccugaggacgaugacauccuugauugcuga

SEQ ID NO: 75483 - RNA, 1491 nt, Artificial Sequence
  derived and/or modified sequence opt5 from SGK3__Homo_sapiens__NP_001028750
augcagagagaccacaccauggauuacaaggagagcugccccuccgugucuaucccuagcuccgacgaacaucgggagaaaaagaaacgcuucacagucuauaagguucuggugucugugggcagaagcgaaugguuugucuuccggcgcuacgccgaguuugauaaacucuauaacacgcugaagaagcaauucccggcuauggcccuuaaaauucccgcgaagagaaucuuuggggacaauuucgauccugacuuuauuaaacagcggcgcgcuggacugaacgaguucauccagaaucucgugagauaccccgaacuguauaaccacccugauguucgggccuuucuucagauggacucccccaagcaucaaucugauccuagcgaggacgaagaugagcgcuccagccagaaacugcacucuaccucccagaauauuaaccucggcccgagcgggaauccccaugccaagccuacagacuucgauuuucugaaggugaucggaaaaggcucuuucgggaagguccugcucgcuaaaagaaagcuggacggaaaauuuuacgccgugaagguucuucagaaaaagaucgugcugaaccggaaggaacaaaaacacauuauggcugagcgcaauguccuccugaagaacgugaaacaccccuuccuugugggccugcauuauuccuuccagaccacagagaagcucuacuuuguccuggacuucguuaauggcggggaacuguuuuuccaccuccagagagagcggagcuuuccugaacaucgcgccagauucuacgcggccgagaucgcuucugcccugggauaucuucacuccauuaaaaucguguaccgggaucugaagcccgaaaacauucuccuggacagcgugggccacgucgugcuuaccgauuuugggcuguguaaggagggaaucgcuauuuccgacacaaccacgaccuucugcggcacaccggaguaucucgccccugaaguuaucagaaaacagcccuacgauaauaccguggacugguggugucugggggcgguccuguaugagaugcucuacggacugccucccuuuuauugccgcgauguggccgaaauguacgacaacauccuucauaagccccugucucuccggccuggcguuagccugacagcuugguccauucuugaggaacugcucgagaaagauagacaaaaucgccugggcgccaaggaggacuuccuggaaauccagaaccacccguuuuucgagagccucucuugggcugaucuggugcagaaaaagauucccccucccuuuaacccuaaugucgccgggcccgacgacauccggaacuucgauaccgccuucacggaagagacagugccguacuccgucugugugagcucugacuauagcauuguuaaugcuuccgugcuugaagcggaugacgccuuugucggauucucuuacgcuccucccagcgaggaucuguuucucuga

SEQ ID NO: 75484 - RNA, 1242 nt, Artificial Sequence
  derived and/or modified sequence opt5 from SGMS1__Homo_sapiens__XP_011537885
augaaggagguggucuacuggagccccaaaaagguugccgacuggcugcucgaaaacgcuaugccugaguauugcgaaccgcuggagcacuucaccggccaggaucuuaucaaucugacacaagaagacuuuaaaaagcccccucucuguagaguguccucugauaacgggcagcggcugcuugacaugauugagacgcugaaaauggagcaucaccucgaagcccauaagaauggacacgcgaacggccaucugaauaucgggguggauauucccaccccugacggcagcuucuccaucaagauuaaacccaacggaaugccuaauggguaccgcaaggagaugaucaaaaucccgaugcccgaacuggagagaucucaguauccuauggaguggggaaagacauuucucgcuuuccuguacgcccuuagcugcuuuguccugaccacagugaugauuuccguugugcacgaacgggugcccccuaaagagguccagcccccgcucccugauaccuucuuugaccacuucaaccgcguucaaugggccuuuucuaucugugaaauuaauggcaugauccuggugggccuuuggcugauucaguggcuccugcugaaguauaagagcaucauuuccagacgguucuuuugcaucgucgggacacucuaccuguaucgcuguaucaccauguacgugacgacccuucccgugccuggaaugcauuucaacugcagccccaaacuguuuggcgauugggaggcucagcucagacggauuaugaagcugaucgccgggggaggccuuucuauuacagggucccacaauauguguggagacuaccuguauagcggccauaccgucaugcucacacugaccuaccuguucaucaaagaauauucuccccgcagacucuggugguaccacuggauuugcuggcugcuuuccguugugggcaucuucuguauccugcucgcucacgaucauuauacgguggacgucgugguugccuacuauauuacaacccggcuguuuuggugguaccacacaauggcgaaccagcaagugcuuaaggaggccagccagaugaaucugcucgcucgcgucuggugguacagaccuuuccaguauuuugagaaaaacgugcaggggaucguuccgcggucuuaccauuggcccuucccuuggcccgugguccaccugucccgccaagugaaguauagcagacuggucaaugauaccuga

SEQ ID NO: 75485 - RNA, 1098 nt, Artificial Sequence
  derived and/or modified sequence opt5 from SGMS2__Homo_sapiens__NP_001129730
auggacaucauugagaccgccaagcuggaggaacaccucgaaaaccagcccagcgauccuacaaauacguacgcuagaccggccgagcccguggaagaggagaacaaaaauggcaacgggaagccuaaaucccugucuagcggacuucggaagggcaccaaaaaguaucccgacuacauccaaauugcgaugccuacagaaucccgcaauaaguucccccuggagugguggaaaaccgggaucgcuuuuauuuaugccgucuucaaccucguucugacaaccgugaugaucacagugguccaugaaagagugccuccgaaggagcuuucucccccucugcccgauaaauuuuucgacuacaucgaucggguuaagugggccuuuagcguguccgagauuaauggaaucauucucgucggccuguggaucacccaguggcuguuccuccgcuauaaaucuauuguggggagacgguuuugcuucaucauuggaacgcuguaccuuuaucgcuguaucaccauguacguuacaacccugccugugcccggcaugcacuuucagugcgcuccgaagcucaacggcgacagccaggccaagguccaaagaauccugcggcuuauuuccgggggaggccugagcaucacagggucucauauucucuguggagauuuccuguuuuccggccacaccgugacgcugacacucaccuaccuguucaucaaagaauauagcccucgccauuuuuggugguaccaccuuauuugcuggcugcucucugcugccgggaucaucuguauucugguggcgcacgagcauuauacaaucgacgucauuaucgccuacuauauuaccaccagacuuuucuggugguaccacuccauggcuaaugaaaagaaccugaaaguuagcucucagacaaauuuccucucccgggccuggugguuucccaucuucuacuuuuucgagaagaacgugcagggaagcaucccuugcuguuuuuccuggccccugucuuggcccccuggcugcuucaaaagcuccuguaagaaauauagccgcgugcagaagauuggcgaagauaaugagaagucuacguga

SEQ ID NO: 75486 - RNA, 1584 nt, Artificial Sequence
  derived and/or modified sequence opt5 from SGOL1__Homo_sapiens__NP_001012409
auggccaaggagagaugccugaaaaagagcuuccaggacucccucgaagauaucaaaaagcggaugaaagagaagcgcaacaagaaucuggcugaaauuggcaaaagacggucuuuuaucgccgcgcccugucaaauuaucaccaacacaagcacgcuucugaagaauuaccaggacaacaauaaaaugcucgugcuggcucuugagaacgaaaaguccaaagucaaggaggcccaggauauuauccugcagcuccgcaaggagugcuauuaccugaccugucaacuguaugcccucaaagggaagcugacaucucagcagaccguugaaccugcucagaaucaagagaucugcagcuccggaauggacccgaacucugaugacagcuccagaaaucuuuucgugaaagaucugccccagauuccucucgaagagacagagcugcccggccagggggagagcuuucagaucgaagaccaaauuccuaccaucccccaggauacacuuggaguggacuucgauucuggcgaagccaaguccaccgacaacguccugccucggacggugagcguucgcagcucccucaaaaagcacuguaauagcauuugccaguuugauucucuggacgacuucgagaccucccaucuggcugggaaaucuuuugaguucgaaagagugggauuucucgauccgcuggucaacaugcacauccccgagaaugugcaacauaacgccugucagugguccaaggaccagguuaaucuuucuccuaagcugauucagcccggcacauucaccaaaacaaaggaagauauccucgagagcaaauccgaacaaaccaagagcaaacagcgggacacgcaggagcgcaagagagaagagaagcggaaagcgaaccgcagaaagucuaaacggauguccaaguacaaagagaacaagagcgaaaauaagaaaacagugccucagaagaaaaugcacaagucugucagcuccaacgaugccuauaauuuuaaccuggaggaaggcgugcaucuuacccccuuccgccaaaaagugucuaaugacagcaacagagaggaaaauaacgaguccgaggucagccugugcgaaucuuccgggagcggagaugacucugaugaccucuaccugccgacauguaaguauauccagaauccuaccuccaacagcgaucggcccguuaccagaccucuggcuaagcgcgcccucaaauacacagacgagaaggaaacggagggcuccaaacccaccaagacacccaccacaaccccuccggagacgcagcagucuccccaccugagccuuaaagacauuacaaaugugucccuguacccuguggucaagauccggagacucucucugagccccaaaaagaacaaggcuuccccugccguggcgcuucccaaacgccggugcaccgccagcguuaauuauaaggaaccgacccuggcuucuaaacucagacgcggggauccuuuuacagaccuguguuuccugaacucccccauuuucaagcagaaaaaggaucuccggagaagcaagaaaucuaugaagcaaauccaguga

SEQ ID NO: 75487 - RNA, 1707 nt, Artificial Sequence
  derived and/or modified sequence opt5 from SGPL1__Homo_sapiens__XP_011538619
augcccagcaccgaccugcucaugcugaaggccuucgagccuuaccuugaaauccuggagguguauuccacaaaagcuaagaacuacgucaauggccacugcacgaaauaugaaccguggcagcucauugccuggucuguuguguggacccugcuuaucguguggggguacgaguuugucuuccaacccgaaagccugugguccagauuuaagaaaaaguguuucaagcucacacggaaaaugccuauuaucggacgcaagauucaggauaaacugaacaagaccaaagacgauaucucuaagaauaugagcuuucugaagguggacaaagaguauguuaaggcgcuccccucccagggccugucuagcuccgcugugcuugagaaacugaaggaauacagcucuauggaugccuucuggcaggaggggagagccuccggaacagucuauagcggcgaagagaaacucaccgagcugcuugugaaggcuuacggggacuuugccuggucuaacccucugcaucccgauaucuucccuggacuccggaaaauugaagcugagaucguucgcauugccugcucccuguuuaauggcggcccggacagcugugggugcgugacaucuggaggcaccgaauccauccugauggcguguaaggccuacagagaucucgcuuucgagaaggggauuaaaacgcccgaaaucgucgccccucaaagcgcucacgccgcguuuaacaaggccgcuuccuauuucggaaugaaaauugugcgggugccccugaccaagaugauggaggucgacguucgcgccaugagacgggcuaucucucgcaauacagccaugcuugugugcagcaccccucaguuuccccauggcgugaucgauccggucccugagguggccaaacuggcuguuaaguacaagauuccccuccacguggacgcgugucuugggggauuccugaucgucuucauggaaaaagccggcuauccucuggagcaucccuuugauuucagagugaagggcguuacauccauuagcgcugacacccacaaauacggguaugcccccaagggaucuucccucgugcuguacagcgacaaaaaguaucggaacuaccaguuuuucgucgauacggacuggcagggcgggaucuacgccucuccuacaauugcuggaagccgcccgggcgggaucuccgccgcgugcugggcugcccugaugcacuuuggagaaaauggcuauguggaggccaccaagcaaaucauuaaaacagcuagauuccucaagucugaacuggagaacaucaaaggcauuuuugucuucgggaauccccagcuuagcgugaucgcccugggaucccgggauuuugacauuuaccgccucagcaaccugaugaccgcuaagggcuggaaucuuaaccagcugcaguucccucccucuauccauuuuuguaucacccuccugcacgccagaaaacggguugcgauucaauuccugaaggauaucagagaguccgugacacagauuaugaagaauccuaaagccaagacgaccgggaugggagcuaucuauggcauggcccagacaaccgucgaccgcaacaugguggcugaacucagcucuguuuuucuggauucccuuuacagcacagacaccgugacgcaagggucccagaugaacggcucucccaaaccgcauuga

SEQ ID NO: 75488 - RNA, 1326 nt, Artificial Sequence
  derived and/or modified sequence opt5 from SGPP1__Homo_sapiens__NP_110418
augagccugagacagcggcucgcccaacuggugggccgccuucaggacccccagaaggucgcuagauuccagcggcugugcgggguugaggccccuccgcgcagauccgcggaucggcgcgaagacgagaaagcugaagcuccccucgccggagauccuagacugcggggccgccaacccggggccccuggaggcccccagccuccggggucugacagaaaccagugucccgccaagccugauggaggcggcgcucccaauggggugcggaacggacuugccgcggagcugggcccugccagcccccgcagagcuggggcccuccggcgcaauucccugaccggagaagagggccagcuggcuagagugucuaacuggccgcucuacugccuguuuuguuucgggacagagcuuggaaaugaacuguuuuauauccucuucuuuccuuucuggauuuggaaccuggacccccuugucggccggagacuggugguuaucugggugcucgucauguaccugggccaaugcacgaaagauauuauccgcuggccucggcccgccagcccucccgugguuaagcuggagguguuuuauaauuccgaauacucuaugccgagcacccacgcgauguccgggacagccauucccaucagcaugguccuccugaccuauggaagauggcaguacccucuuaucuauggccugauucucauccccuguuggugcucucuggugugucuuucccgcauuuacauggggaugcauagcauccuggacauuaucgcuggauuccucuacacaauucugauccuggccguguuuuauccuuucgucgaucucaucgacaacuuuaaucagacccacaaauacgcucccuucauuaucauuggccugcaucuugcccuggggaucuuuucuuucacacucgauaccugguccacgagccggggagacaccgccgagauucugggcucuggcgcugggaucgcgugcggaucccacguuacauauaacaugggccuugugcuggauccgagccucgacacccugccucuggccgggcccccuaucacagugacccucuucggaaaggcuauucugagaauccuuauuggcauggucuuugugcugaucauucgcgacguuaugaagaaaaucacgaucccccucgccuguaagauuuucaauaucccuugcgaugacauucggaaagccagacagcauauggagguggaacugcccuaccgcuauaucacauacgggauggucggcuuuuccauuaccuucuuugugccguauaucuucuuuuucauuggaaucucuuga

SEQ ID NO: 75489 - RNA, 1200 nt, Artificial Sequence
  derived and/or modified sequence opt5 from SGPP2__Homo_sapiens__NP_689599
auggccgagcugcucagaagccugcaggacucccaacuuguggcucgguuccagcgcagaugcggccuguuucccgccccugaugaagggccgcgggagaacggagcggaccccaccgaacgcgcugccagagucccuggcguugagcaccuccccgccgcuaaugggaagggaggcgaagccccugcuaacgggcugcggcgcgccgcggcccccgaggcuuacgugcagaaauauguggucaagaauuacuucuauuacuaucuuuuucaguucucugccgcucugggacaagagguguuuuacaucacauuccucccuuuuacgcauuggaacauugauccguaucugagcagacggcugaucauuaucuggguucucgugauguacauuggccaggucgccaaagacgugcugaaguggccccgcccuuccucucccccuguugugaaacuugaaaagagacugaucgcggaguacggcaugcccagcacccacgccauggcugccacagcuaucgccuucacccuccugauuuccacaauggaucgguaucaguacccguuuguccuugggcuggugauggccguggucuucucuacccucguuugucugagccgccuguauacaggaaugcauaccgugcucgacgugcugggcgggguccuuaucacggcucugcucauugugcugaccuacccugcguggacauuuaucgauugccuugacuccgccagcccccuguucccuguuugugugauugucgugcccuuuuuccucugcuauaauuaccccguuucugauuauuacuccccuaccagagcugacacaaccacgauccuggccgccggagcuggcgugacaauuggguucuggaucaaccacuuuuuccagcuggucagcaagccggccgaaucucuccccgugauccaaaauauuccuccccugaccacauacaugcuuguccugggacucaccaaauuugcggugggcaucguucugauucuucuggugcggcagcucguccagaaccugucccuccaggugcuguauagcugguucaagguugugacccgcaauaaagaggcuagacggagacuggagaucgaagucccuuacaaguuugugacauauacgucugugggcauuugugccaccacauucguucccaugcuucaucgcuuucuggggcucccguga

SEQ ID NO: 75490 - RNA, 1509 nt, Artificial Sequence
  derived and/or modified sequence opt5 from SGSH__Homo_sapiens__NP_000190
augagcugccccgugccugccuguugcgcucugcuccugguccuuggccuguguagagcccggccgcgcaacgcgcuccugcuucuggcugacgaugggggauucgaguccggcgccuacaauaacucugccaucgcuacaccccaccucgacgcccuggcuagacggagccugcucuuucgcaaugccuucaccuccguuucuagcugcuccccuucuagagcgagccugcuuacggggcugccccagcaucaaaacggaauguauggccuccaccaggaugugcaucacuuuaauuccuucgacaaggugcggagccugccucuucugcucucucaggccgggguccgcaccggaauuaucggcaagaagcaugugggccccgaaacaguuuacccuuuugauuucgcuuauaccgaggaaaacggguccgugcugcaggucggaagaaauauuacacggaucaaacugcucgugcgcaaguuucugcaaacccaggacgauagaccguucuuucuuuacguugccuuccacgacccccaccgguguggccauagccagccucaguaugggacauuuugcgagaaauucggaaacggcgaaucugggaugggacgcauucccgauuggaccccucaggcuuacgacccccuggaugugcucgucccguauuuugugccuaauacgcccgccgcgagagccgaccuggcugcccaauacaccacagugggccggauggaucagggcgucgggcuuguucugcaggagcuccgcgacgcuggagugcugaacgacacccuggugaucuucacauccgauaauggcaucccuuuccccagcgggagaaccaaccucuacuggcccggaacggccgagccucugcuugucucuuccccggaacaccccaagcgguggggccaagugagcgaggccuauguuucccugcucgaccugacaccuaccauucuugauugguuuucuauccccuacccuagcuaugcuauuuucggguccaagacaauccaucugaccggaagaagccuccugcccgcgcuggaagccgagccgcucugggcuaccguguuuggcucucagucccaccacgaggucacaaugagcuacccuaugcgcucugugcagcaucggcacuucagacugguucauaaucuuaacuuuaaaaugcccuucccuauugaccaagauuuuuaugugagccccacguuccaggaccugcucaaucgcaccacagccggccagccuaccgggugguacaaggaucugcggcacuauuacuacagagcccgcugggaacuguaugaccgguccagagauccccaugagacacagaaccuugcuaccgacccgcgcuuugcccaacuccuggaaaugcugcgggaucagcucgcgaaauggcagugggagacgcacgacccuugggucugugcucccgacggagugcuggaagagaaacuuucuccccagugccaaccucugcacaacgagcucuga

SEQ ID NO: 75491 - RNA, 3021 nt, Artificial Sequence
  derived and/or modified sequence opt5 from SGSM2__Homo_sapiens__NP_001091979
augggcagcgccgaggacgcugugaaggaaaaacugcucuggaacgucaagaaagagguuaagcagaucauggaagaggccgugaccagaaaauucgugcacgaagauuccucucauauuaucgcgcugugcggggcugucgaggccugucuucugcaccaacuccggcgcagagccgcuggauuucugcggagcgacaagauggccgcucuuuucacaaaggugggcaaaacgugccccguugccggggagauuugucauaaggugcaggaacugcagcagcaagcggagggacgcaaaccuuccggcgucucucaggaagcccucagacggcaggggagcgcuuccggaaaggccccggcucugucuccccaggcccugaaacacguguggguucgcaccgcgcucaucgagaaggugcuggauaaggucgugcaauaccuugccgagaauugcagcaaauauuacgaaaaggaggcucugcucgccgacccuguguuuggccccauucuggcuucccuucuggucggcccuugugcccucgaauauacaaaacugaagaccgccgaucauuacuggacagaccccagcgcugaugagcugguucagagacaccggauccgcgggccuccgaccagacaggacucucccgcgaaacggccugcccucggaauccgcaagagacacuccagcggcucugcuuccgaagaucggcuggccgccugcgcucgcgaguguguggagagccuucaucagaacucuagaacacggcugcucuaugggaaaaaucacgugcugguccaacccaaggaagacauggaggccgugccuggauaccuuucccugcaucagagcgcggaaucccucacccugaaguggacgcccaaccagcugaugaauggcacccucggggauucugagcuggaaaaaucuguuuauugggacuacgcucuuguggucccguucucccaagugguuugcauucacugucaccagcaaaagagcggaggcacacuggugcucgucucucaggauggcauccagagaccuccccugcauuuuccucaagggggacaccuucuguccuuccucagcugccuggagaacggccugcucccccgcgggcagcuggagcccccucuuuggacccagcagggaaaaggcaagguguuuccgaaacugcggaagagaucuagcauucgcuccgucgacauggaagagauggggacaggacgggccaccgacuacguguucagaaucauuuaucccggccaucgccacgaacauaaugccggcgauaugaucgagaugcagggguuuggaccuucucuccccgcuuggcaccuggaaccucuguguagccagggcuccagcugccuuucuugcuccagcagcuccagcccccacgccacgccgucccauuguucuugcauuccugaccggcucccccugagacugcucugugagagcaugaagcgccagaucguuucccgggcuuucuacggguggcuggcccacugcagacaucuuucuacagugcgcacccaccugagcgcgcucguccaccauuccgugaucccucccgaucggccucccggagccagcgcuggccugacaaaagacguuuggucuaaguaucaaaaagauaagaaaaacuacaaggagcuggaacuucucagacagguguauuacgggggcauugagcacgaaauccggaaggacgucuggccguuucugcugggacauuauaaauucggcauguccaagaaagagauggaacagguggaugccgugguugcugcccgcuaccagcaaguccucgcggaauggaaggccugugaggugguggucagacagcgggaaagagaggcucacccugccacccgcaccaaauuuagcucuggguccagcauugacucucaugugcagcggcugauccacagagauagcacaauuuccaaugacguuuucaucagcguggaugaccuugaaccucccgagccccaagacccggaggauucucgccccaagccugaacaggaggcuggacccggcacgccugggaccgccgucguggaacagcagcacuccguugaguucgacagccccgauuccggacugccuucuagcagaaacuacuccguggccucuggcauccaaagcucccucgacgaagggcagucugucggcuuugaggaggaagauggaggcggggaggaaggaagcuccggccccgggccggcugcgcauacacugcgggagccucaggaccccagccaggaaaagccucaagccggagagcuggaggcuggcgaggagcuugccgccgugugcgcugccgcguauaccauugaacuccuggauacaguugcucugaaucuccaccgcaucgacaaagaugugcagagaugugaccggaacuacugguauuucacgcccccgaaucuggagcgccuuagagaugucaugugcucuuacgugugggagcaucuggacgugggguauguccagggcaugugugaucuccuggccccucugcuuguuacccucgacaacgaccagcuggccuacuccugcuuuagccaccugaugaagcggaugucucaaaauuuccccaacggaggcgcuauggauacacauuuugccaacaugcgcucccucauucagauccuggacagcgaacuuuucgagcugaugcaccagaauggggauuauacccacuuuuacuucuguuacagaugguuucuccuggacuucaaacgggaacugcuuuaugaggauguguuugcggugugggaagucauuugggcugcccgccauaucucuuccgagcacuucgugcuguuuaucgcccucgcucugguugaggccuacagagaaauuauccgggacaacaauauggauuucaccgacauuaucaaguucuuuaacgagagagcugaacaucacgaugcccaagagauucuccgcaucgcgcgggaccuggugcacaaaguccagaugcuuauugaaaauaaguga

SEQ ID NO: 75492 - RNA, 2250 nt, Artificial Sequence
  derived and/or modified sequence opt5 from SGSM3__Homo_sapiens__NP_056520
augagcggcucccacacccccgccugcgggccuuucucugcucugacaccgagcaucuggccccaggagauucucgccaaguacacgcaaaaagaagaguccgcggaacagccugaguuuuauuacgacgaguucggauuuagaguguauaaggaggagggcgaugaacccgggucuagccugcuugcuaacuccccucugauggaggacgcuccccagcggcuccgcuggcaggcccaucuggaguucacccacaaucaugaugucggagaccuuacaugggauaaaaucgcuguuucucugccuagaagcgaaaagcuccggucccuggugcuggccggcauuccgcacgggaugcgcccccaacucuggaugagacugagcggagcccuucagaaaaagcggaacucugagcuguccuaccgcgaaaucgugaagaauagcucuaacgacgagaccauugccgcgaaacagaucgaaaaggaucuccugagaacaaugccuuccaaugccuguuuugcuagcaugggcucuaucggcgucccccggcuucgcagagugcugcgggcccucgcuuggcuguauccugagauuggguacugccagggaaccggcaugguugccgcgugucugcuccuguuccuugaagaggaggacgccuuuuggaugauguccgcuaucauugaagaucugcuccccgccagcuauuucuccacaacccugcuuggggugcaaacggaccagcgcguccugagacaucucaucgugcaguaccugccgcggcuggauaaacuccugcaggagcacgacauugaacuuucucugaucacccuccacugguuucugacagcuuucgccagcguuguggauauuaaacuucugcuccgcaucugggaccuguuuuucuacgagggauccagaguccuguuucaacucacccugggcaugcuucaucugaaggaagaggagcucauccagagcgaaaacucugccuccauuuucaauacacugagcgacaucccuucucagauggaggaugcugaacugcuucucgggguggcgaugcggcuggccggaagccugaccgacguggcugucgagacgcaaagacgcaagcaccucgccuaucugauugccgaucagggccagcuucugggcgcugggacacucaccaaccugucccagguugugcggagacgcacacaacggagaaagucuaccaucaccgcccugcuuuucggagaagacgaucucgaggcgcugaaagcuaagaauauuaaacagacagagcugguggccgaccuccgcgaagccauccugcgggucgcuagacauuuucagugcacggaucccaagaacuguagcguggagcuuaccccugacuacuccauggaaagccaccagcgcgaucacgagaauuauguugccugcucucggucccauagacgccgggcuaaagcccugcucgacuucgagagacacgaugacgacgaacugggcuuucggaagaacgauaucauuacaaucgugagccaaaaagacgagcauuguugggucggggaacugaauggacuucgcggcugguuccccgcgaaguuuguggagguucucgaugaaagaucuaaggaguacuccauugccggggacgauagcgugaccgagggagucacagaccuggugcggggcacccugugccccgcucucaaagcccuguucgaacacggccuuaagaaaccuucccugcucgggggagcuugucauccguggcuguuuaucgaggaagccgcgggcagagaggucgaacgcgauuucgccucuguguauagccggcugguucuuugcaagacguuuagacucgacgaggaugggaaagugcugacacccgaggaacugcucuaccgcgcuguccaguccgugaacguuacccacgacgccgugcacgcucagauggaugucaagcugagaucucuuauuugugugggacugaaugaacaggugcuccaucuguggcuggaaguucuuugcagcucccugccuaccgucgagaagugguaucaacccuggagcuuccuccggucuccuggcugggugcagaucaaaugcgaacugcgcgugcucuguugcuuugccuucucccugagccaggacugggagcuucccgccaagagagaggcucagcaaccgcugaaagaagggguccgggauaugcucgugaagcaccaucuguuuucuugggacguugacggcuga

SEQ ID NO: 75493 - RNA, 942 nt, Artificial Sequence
  derived and/or modified sequence opt5 from SGTA__Homo_sapiens__XP_011526480
auggacaacaagaaaagacuggccuacgcuaucauucaguuccuccacgaucaacugcggcauggcgggcuuagcuccgacgcccaggagucucuggaaguggcgauccagugccucgagaccgcuuuuggagucacaguugaagauagcgaccuggcccuuccccagacgcugccugagauuuucgaagccgcugccaccggcaaggagaugccgcaagaucuccgcucccccgcuagaacaccucccucugaggaagacagcgccgaggcggaacggcugaaaaccgaggggaaugagcagaugaagguggaaaacuuugaggccgcugugcacuucuauggaaaagccaucgaacugaauccugcuaacgccgucuacuuuuguaaucgcgcggccgcuuauuccaagcucggcaacuacgccggggcugugcaggauugcgagagagccauuuguaucgaccccgccuauucuaaggcuuacggacggaugggccuggcgcuuagcucccugaauaaacauguugaagccguggcuuauuacaagaaagcccucgagcuggauccugacaacgagacauacaagagcaaucuuaaaaucgccgaacugaagcuccgcgaggcuccgucucccaccggcggggucggauccuucgauauugccggccugcugaacaauccuggguuuaugagcauggcgucuaaccucaugaauaacccccagauccaacagcugauguccggaaugauuagcggcgggaauaacccucuuggaacacccggcaccucuccgucccagaacgaccuggcuagccucauccaggccggccaacaguucgcccagcaaaugcagcagcagaauccugaacugauugagcaacuuagaucccagauccggucucgcacgcccagcgcuuccaacgaugaccagcaggaauga

SEQ ID NO: 75494 - RNA, 2271 nt, Artificial Sequence
  derived and/or modified sequence opt5 from SH2B1__Homo_sapiens__NP_001139267
augaacggcgcccccagcccugaggacggggcuuccccgucuagcccuccccugcccccucccccuccgcccuccuggagagaguucugcgagucucacgcccgggcggcugcccucgauuuugcccgcagauuccggcuguaccuugcuagccauccucaguaugccggacccggcgcugaagccgcguuuucccgcagauucgccgagcuguuucuccaacacuucgaagcugagguggcccgggcuucugggagccuguccccucccauccuugccccgcugagcccuggagcggagauuucuccccaugaccucucccuggaaagcugucgcgucggcgggccucuggccguucucggacccucuagauccagcgaggaucuggcuggcccccuuccuucuuccgugagcuccucuagcaccacauccagcaagccgaaacugaagaaacgguuuucucuccgcuccgugggcagaagcguccgggggucugugcgcggaauccugcaguggagaggcacgguugaucccccuagcuccgccgggccccuugaaaccucuagcggaccucccgugcugggcggcaauuccaacagcaauucuuccggaggcgcuggcacagucgggcggggacucgugagcgacggcaccucuccgggggagcgcuggacacacagauucgagcggcugagacugucccgcggaggcggggcccucaaggacggagccggcaugguucagcgggaagaacugcuuagcuuuaugggcgcugaagaggcggccccugaucccgcuggggugggaagaggcgggggagucgccggcccucccuccgggggcggaggccagccucaauggcagaaaugccgccugcuccugcggucugaaggggagggaggcgggggaagcagacuugaguucuuugugcccccgaaggccucccgcccucggcugucuauucccuguagcuccaucaccgacgugagaacaaccacggcucucgaaaugcccgaucgcgagaacaccuucgucguuaagguggaaggcccuagcgaguacauuauggaaacaguggacgcccagcaugucaaagcgugggugucugauauccaggagugccuguccccggggcccuguccugcuaccagcccccggccuaugacacugccccucgccccuggcaccucuuuucugacgagagagaauacagacucccuugaacugagcugccucaaccacucugagagccugcccucccaagaucuucugcucggaccgagcgaaucuaaugaccgccugucccagggcgccuaugggggacugagcgaccggccuuccgcuucuaucagccccuccucugccagcauugcugccucccacuucgauucuauggagcuccugccucccgaacuuccgccuagaauccccauugaggagggcccucccaccgggacaguucauccccugagcgcgccuuacccgccccucgacaccccugaaaccgccacaggauccuuccuguuucagggcgagcccgaagggggcgagggagaucagccucugagcggcuaucccugguuccacgggaugcuuucucggcucaaggcugcccaacuggugcugacgggaggcaccgggucccauggagucuuucucgugcgccagagcgagacaagacggggcgaauacguucugaccuucaacuuucaggggaaagcuaagcaccuuagacugucucucaaugaggaaggccaaugucgcgugcagcaccugugguuccaguccaucuuugacaugcuggagcauuuccggguccacccuauuccgcuugaaagcggagggucuuccgaugugguccucgugagcuauguucccuccagccagagacaacaggagccuacaaccucucaugacccuccccagcccccggagccucccagcuggacggaucccccucagcccggggccgaagaggcgucccgcgccccugaaguggcugccgcugccgccgcugcggccaaagagagacaagaaaaggagaaggcuggaggcgggggagucccggaggaacuggugcccguuguggagcuggucccugugguggaacucgaggaagccaucgcccccggcucugaggcucagggcgccgggagcggaggcgacgcggggguuccucccaugguccagcugcagcaauccccgcuuggaggcgauggggaggaaggaggccacccucgggcuauuaacaaucaguacucuuuuguguga

SEQ ID NO: 75495 - RNA, 2028 nt, Artificial Sequence
  derived and/or modified sequence opt5 from SH2B2__Homo_sapiens__NP_066189
auggaccccagcuacugcccugcccacggcuucccgucccaggauccccuguggccucucucuagccaacagugguccucugcucauuauagcgagcccgccgccgggggaugcgacggcaccgaagcuaugaacggggccggaccuggccccgccgcugccgcuccugugccgguccccguuccugugcccgauuggagacaguuuugcgagcugcacgcccaggcggccgcuguggacuucgcccauaaguuuugucgguuccuucgcgauaauccugcuuacgacacacccgaugccggggcguccuuuucuagacacuucgccgcuaacuuucuggacgucuucggagaagaggugcggcgcguucucguggccggcccgacgaccagaggcgcugccgucagcgccgaagcuauggagccugagcuggcggauacauccgcccuuaaagcugcccccuaugggcauagccggucuuccgaagacgugagcacccacgccgcuacaaaggcccgcguuagaaaaggauuuucucugcggaauaugucccucugcguggucgauggcgugcgcgacauguggcacagacgggcgagcccugagcccgaugcugccgccgcuccccgcaccgccgaaccuagagacaaguggacacggcgccugagacugucucggacccucgcugccaaaguggagcuggucgacauccaaagagagggggcgcuucgcuucaugguugccgaugacgcugccgcuggauccggcgggagcgcccaguggcagaagugucggcugcuccugagacgcgcgguggccgaagaacgguuuagacuugaguucuuugugccgcccaaggcuucccgcccuaaagucucuauuccccugagcgccaucauugaggugcggacgaccaugccucucgaaaugcccgagaaggauaacacauucguucugaaaguggagaauggagcugaauacauccuggagaccauugacucccuccagaagcauagcugggucgccgauauccaaggcugcguggacccgggcgauucugaagaggacacagaacuguccuguaccagagggggaugccuugccagccgcguugcuucuuguagcugcgagcugcucacggaugcgguggaccugccucggcccccugagacaaccgccgucggcgcuguggucacagcgccccacuccagagggcgcgaugccgugcgggaaucucuuauccauguuccucuggagaccuuccuccagacccuggaaagccccggaggcuccgggagcgacucuaacaauacaggagagcagggcgcugaaacggacccggaggccgagccugaacuggagcucuccgauuaucccugguuucacggcacccugagcagagugaaagcggcucagcuuguccuggccgggggaccccggaaccacggccucuucgugauucgccaaucugaaacaagaccuggggaguacguucugaccuuuaauuuccagggaaaggccaagcaucuucggcugucccucaacggccacgggcagugucaugugcaacaccugugguuucagagcguccuggacaugcucagacauuuccacacacacccgaucccccuggaguccggcggaucugcugauauuacccuucgcagcuaugugcgggcccaggacccucccccugaacccggcccuacgcccccggcggcuccugccucccccgccugcuggucugauagcccugggcagcauuacuuuuccagccuggcugccgcugccugucccccggcgucuccuuccgacgccgcuggagccucuagcuccagcgcuucuagcuccagcgccgccucuggccccgcuccucccagacccguggaggggcaacucuccgcgcgcagcagauccaauucugccgaacggcugcuggaggcuguugccgccacagcugccgaggaaccuccggaggcggcucccggacgcgccagagccgucgaaaaccaguacagcuucuauuga

SEQ ID NO: 75496 - RNA, 1122 nt, Artificial Sequence
  derived and/or modified sequence opt5 from SH2B3__Homo_sapiens__NP_001278353
augggcuuccccgugcugugcagaggguggcggcgcaccuggccuggaugugccagcuggcucggcgcuccgcccccucagaagccccugcuuuccccucugcuccugaaccacagaucuagcaaauccucucggcccaagcugcaagccgcgugcagcuccauccaggagguccgcugguguaccagacuggaaaugccugacaaucucuacacguuuguucugaaagugaaggaucggaccgacauuaucuucgaggugggggaugaacagcagcugaacucuuggauggcugagcucagcgaaugcacaggacgcggccuggaguccaccgaggccgaaaugcauauuccgagcgcccuugagcccucuacauccagcucuccuagaggguccaccgacagccugaaucaaggagcuucucccggcggccuccuggauccugccugucagaaaacagaccacuuucuuuccugcuaucccugguuccaugggccgaucagccgggucaaggcugcccagcuggugcagcuccaaggaccugaugcgcacggcguuuuucuggugcgccaguccgaaaccagacgcggggaguacguccugacguucaacuuucagggaauugccaagcaucuccggcugucucuuaccgagagaggccagugucgggugcaacaccuucacuuccccagcguuguggacaugcuccaucacuuucagcgcuccccuaucccccuggaaugcggggcugccugugaugucagacuuagcucuuaugugguggucguuucccagcccccuggaagcugcaauacagugcuguucccguuuucucucccccauugggacagcgagucccugccucacuggggcucugaacugggccucccccaccugagcuccagcggguguccucggggacuuucucccgagggccugccggggagauccagcccucccgaacaaaucuuccaucucgugccuucucccgaggagcuggcuaacucccuucagcaccuggaacaugagccugucaaucgcgcccgggauagcgacuacgaaauggauuccucuagcagaucccaccuccgcgcgauugacaaccaguauacaccccuguga

SEQ ID NO: 75497 - RNA, 378 nt, Artificial Sequence
  derived and/or modified sequence opt5 from SH2D1A__Homo_sapiens__NP_001108409
auggacgccguggcugucuaccacggcaagaucagcagagagaccggggaaaaacugcuccuggccacaggacuugauggcuccuaucugcuccgggacucugagagcguucccgggguguacugccugugugugcuuuaucauggauacauuuauacguaccgcgucucccagaccgaaacaggcucuuggagcgcggagaccgcuccuggggugcacaagagauauuuccggaaaaucaagaaccugauuuccgccuuucaaaaaccggaucagggaaucguuauuccccuccaguacccuguggaaaagaagucuagcgcccgcuccacacagggcaucagagaggaccccgaugucugccugaaagcuccuuga

SEQ ID NO: 75498 - RNA, 1200 nt, Artificial Sequence
  derived and/or modified sequence opt5 from SH2D2A__Homo_sapiens__NP_001154913
auggaguucccccuggcccagaucugcccucaaggcagccacgaagcuccgauucccaccuuuuccacauuccagaucacggacaugaccagacggucuugucagaaccucggguacacagccgcgagcccucaggcucccgaggccgccuccaauaccggaaacgcugaacgcgccgaggaagugccuggcgaggggucucuguuucuucaagcugagacaagagccugguuccagaagacccaggcgcauuggcugcuccagcacggagccgcucccgccugguuucauggcuucauuacacggcgcgucagaccuccgcugagcguuacccaccgggaagcugagcgccuucuggaacccaaaccucaagggugcuaucucgugagauuuuccgagucugccgugacguucguccugaccuaccggagccgcacauguugcagacauuuucugcucgcgcagcugcgggauggacgccacgugguucuuggcgaggacuccgcccacgcuagacugcaggaucuccugcuucauuauaccgcccacccccugagcccuuacggcgaaacacucaccgagccccuggcucggcagacgccggaaccugccgggcugucucuccgcacagaggaauccaauuucggaagcaagucucaagaccccaacccucaguauucccccaucauuaaacagggccaagcccccgugccuaugcagaaggagggggcuggagagaaagaaccgagccagcugcuuagacccaagccucccaucccugcgaagccccagcugccgccugaggucuacaccauccccgugccucggcauagacccgccccucgccccaaaccgucuaauccuauuuauaacgaacccgaugagcccaucgcuuuuuacgccaugggccggggguccccuggagaagccccgagcaauauuuacguugagguggaggacgaaggccuccccgcuacacugggccacccuguccuuagaaaguccuggucucgccccgugccugggggacaaaacaccggcgggagccagcugcacuccgagaauagcgugaucggacaggggcccccucucccccaucagccgccucccgccuggcggcacacccugccucauaaccugucuagacaaguccuccaggaucgcggccaggcguggcugccccuuggaccgccucaguga

SEQ ID NO: 75499 - RNA, 1731 nt, Artificial Sequence
  derived and/or modified sequence opt5 from SH2D3A__Homo_sapiens__NP_005481
augcaagugccccaggacggcgaggaucuggccgggcagccuugguaccacggacuccugagcagacagaaggcugaagcccuucugcagcaaaacggcgacuuccucguccgggcguccgggucucgcggaggcaauccgguuaucagcugcagauggcggggguccgcucugcauuuugagguguuccgcguggcccuuagaccccggccuggacgccccaccgcccuguuucagcucgaagaugagcaguucccuucuauucccgcucugguccacagcuauaugacaggcagacggccucugucccaggccacgggcgcugugguuucucgcccggugaccuggcaagggccccucagacggagcuuuuccgaagacacacugauggauggaccugcccgcaucgagccccuuagagcgcggaaauggagcaacucucagccugccgaccuggcucauaugggccgcuccagagaggaucccgccgggauggaagcuagcaccaugccgauuucugcccucccucggacauccagcgaccccguccugcuuaaggcgccugcuccccugggaaccguggccgauucucucagagccuccgacggccagcugcaggcuaaagcccccacaaagccuccgcgcacccccagcuucgagcugccugaugccuccgaacggcccccuacguacugugagcucguucccagagugccgucuguccaagggaccagcccuucccagagcugccccgagccugaagcucccuggugggaggcggaagaggacgaagaggaggaaaaucgcuguuuuacacggccucaggccgagaucucuuucugcccccacgaugcuccguccugucugcuuggaccucaaaacagaccccuggaaccccaggugcuccauacccugcgcggccuuuuucuggagcaccacccuggcagcacagcccuccaucugcugcucguggacugccaggccaccgggcugcuuggagucacgcgggaccagagaggcaauauggggguuucuagcggacuggaacuccugacacuuccgcacggccaucaucugcgccucgagcugcuggagcggcaccaaacccucgcucuggccggggcgcuugcugugcugggauguuccggcccccucgaagagagagccgccgcucugcgcggccugguggaacuugcccucgcucugcggccuggggccgcgggagaucugcccggccucgccgcugucaugggggcccugcuuaugccucaggugucuagacuggagcacacauggcggcagcuccgcagaagccacaccgaagcugcccuggcguucgagcaggagcugaaaccccuuaugcgggcccucgacgaaggagcuggcccuugcgaucccggggagguugcccugccgcauguggcuccuauggucagacugcucgaaggcgaggagguggccggaccccuggacgaauccugugagcgccuucugcggacccuccacggcgccagacauaugguucgcgaugcuccuaaguuuagaaagguggcggcccaacggcugcgcggguucagacccaacccggaacugcgggaggcucuuacaacgggauuuguccgcagacuccuguggggcagccgcggggccggagccccucgggcugaaagauucgagaaauuccagcgggugcugggcguccucucucagcgccuggagcccgacagauga

SEQ ID NO: 75500 - RNA, 2109 nt, Artificial Sequence
  derived and/or modified sequence opt5 from SH2D3C__Homo_sapiens__NP_001136005
augaccgagagaugcagccugugguccgcccucucugcugccgcguguugcuucuaccggggcagcuuugugcagguccaauucuccaaggaaaaauauauccuggacucuagccccgagaaacuucacaaggaacuggaggaggaacucaagcuguccucuacagaucuucgcagccaugcuugguaccacgggcggauuccuagagagguuuccgaaacgcuggugcagcgcaacggagacuuucucaucagagauagccugaccucucugggcgacuaugugcucacaugucgguggcgcaaucaggcccugcauuucaaaauuaacaaggucgugguuaaggccggggaguccuacacccacauccaguaucuuuuugaacaagagagcuucgaucaugugccggcucuggucagauaccacgugggaucucggaaagccguuuccgagcagagcggcgcuauuaucuauugccccgugaaucgcacauuuccucucagauaccuggaagccucuuacgggcuuggacagggcuccagcaagcccgcguccccugucucucccagcggcccuaaagggucccacaugaagcggcgcagcgugaccaugacagacggacugaccgccgauaaagugacgagaucugacggcuguccgaccuccacaagccucccccggccucgcgauucuaucagaagcugcgcucuguccauggaccagauucccgaucugcauucuccuaugagccccaucuccgagagcccgucuuccccugccuauagcaccgucacacggguucacgcugcccccgcggccccuucugcuaccgcccuccccgcuucccccguggccagacgcagcuccgaaccucaacuguguccggggucugcccccaagacgcauggagagagcgacaagggcccucacacaucccccucucacacccuugggaaagcuagcccuucccccagccugucuuccuacagcgauccggacucuggacauuauugccagcuccagccucccgugcggggcuccagagaaugggcggccacagagaccagcucucagcaagcucgcagcuacggcgagcggcugaaggaacuuuccgagaacggggccccugaaggagacuggggcaaaaccuucacaguccccauuguggagguuacgagcucuuuuaauccugccaccuuccagucccugcucauccccagagauaaccgcccgcuggaaguggggcugcuccggaaggucaaagagcugcuugcugagguggacgccagaacacuggcgcgccacguuaccaagguggauugucucgucgcucggauucugggagugacaaaagaaaugcagacccuuaugggcgucagaugggggauggagcugcucacgcugccucauggacgccaacugcggcucgaccugcuugaaagauuucacacaaugagcaucaugcuggccguggauauucucggcugcaccggcuccgccgaggaacgggcugcccugcugcauaagaccauccagcuugcugccgagcuccgcgggacaaugggaaauauguucucuuuugcggccguuaugggcgcucuggacauggcccagaucagcagacuggagcagaccugggugacacuccggcaaagacacacggaaggggcuauucuguaugagaagaaacuuaagcccuuccugaaaucccucaacgaaggaaaggaggggcccccucugucuaauaccacauucccgcacguccugccccuuaucacccuccuggagugugauagcgccccucccgaaggcccugagcccuggggcuccacagaacauggaguggagguugugcuggcgcaccucgaagccgcucgcaccgucgcccaucacggcgggcuguaccacacgaacgcugaggugaaacuucagggauuucaggcccggccugagcugcucgaaguguucucuaccgaguuucagaugagacugcuguggggcagccaaggggccuccagcucucaggcucgcagauaugaaaaguucgacaagguucuuacagcgcucucccauaaacuggagcccgccguccggagcucugaacuguga

SEQ ID NO: 75501 - RNA, 1365 nt, Artificial Sequence
  derived and/or modified sequence opt5 from SH2D4A__Homo_sapiens__NP_001167630
augcugaagcagauccucagcgagauguacauugaccccgaucugcuugccgaacuguccgaggaacaaaaacagauccucuucuuuaagaugagagaggaacagauucggcgcuggaaagagagagaggcugccauggaacggaaggagucucugccugugaaaccgcgccccaagaaggaaaacggcaaaagcguccacuggaaacuuggggcggacaaggagguuugggugugggugaugggagagcaucaccuggauaagccuuaugacguccucugcaaugaaaucauugcugagagagcccggcugaaagccgaacaggaggcugaagaaccccgcaagacccauuccgaggaguucacaaacucucugaagacgaaaagccaauaccacgaucuccaggccccugacaaucagcagaccaaggauaucuggaaaaagguggcugagaaagaagaacuggaacaaggcuccagacccgccccuacacuugaggaggaaaagauccggucucugagcuccagcucucgcaacauucagcagaugcucgcggacuccaucaauagaaugaaagccuaugcuuuucaucagaagaaggagagcaugaaaaagaaacaagaugaagagauuaaccagaucgaagaggagcggaccaagcagauuuguaaaucuuggaaggaagacuccgaguggcaagccagccugcgcaagucuaaagcugccgaugaaaagagacggucccuugcgaaacaggcccgcgaggacuacaagagacugagccucggggcucagaaaggacggggcggggagagacugcaguccccgcugcgcguuccccaaaagccugaacggcccccucugcccccgaagccucaguuccucaauucuggagccuauccccagaaaccucuuagaaaccagggcgugguccgcacacugagcuccagcgcucaagaggauaucauucggugguuuaaggaggagcagcucccccugagagccggcuaccagaaaaccucugacacaaucgcccccugguuccacgggauccuuacccugaagaaagcuaaugaacuccugcuguccacgggaaugccuggcagcuuucucauucgcgugucugagcggaucaagggguaugcgcugagcuaccuuuccgaggacggaugcaagcacuuccugauugaugccucugcugacgccuacagcuuucucggcguugaucagcugcaacaugccacccuugcugaccugguggaauaucacaaagaggaaccgaucacaucccucgggaaggagcugcugcucuaccccuguggacagcaggaucagcugccugacuaucuugaacuguucgaguga

SEQ ID NO: 75502 - RNA, 930 nt, Artificial Sequence
  derived and/or modified sequence opt5 from SH2D4B__Homo_sapiens__NP_001139191
augcugcccgaggacagcggcggguccccugaugccgcugccucugacaagcacauccaguggcuccugggagcggauggcgaagugugggucuggauuaugggggagggaccgggcgacaaacccuacgaagagaucagcgaagaacuuauugcugagagagcccggcugcaagcccagcgcgaagcugaggaacucuggagacagaaggaggccgagaucaccaaaaaguuccgggaugcucuggccaacgaaaaagcgcgcauucuugccgagaaguggaagguugaaauggaggacagaaaagcugccaaggugcuggaagaacggauccaugaggaauuuaaacgcaaggaggaagaggaaagaaaacgcggggaggagcagauccggcuccaagaagaacagagagcuaaggaacuguauuggacacugaagcaggcccagcuccacugccaagcguccgagaaagaggagcgggagugggaggagcagcugcgcagaucuaaggccgcugaugaggagcggagccgcagagcccagcgggcuagagacgaguaccgccaucacucccuucgggccauucagaaaggaacgguggccggccugucuagcauguucagagaacucggccaaucccaugagcaggaagcucgccuguaucaccaccuuccugaucccgggcugccucagccccucgcgcugccugucagccggaccugggagagaccgcugcgccccgugucucgggacguuaucgugagaugguuuaaggaggaacaacucccucgccgggccggauucgagagaaauacaaaauuuauugcucccugguuccauggcgggaacuaccacuguuuucgccggagagucaccuccggaacacugcggaccgaaggccagccuacacgccuucccagcgugguuuga

SEQ ID NO: 75503 - RNA, 387 nt, Artificial Sequence
  derived and/or modified sequence opt5 from SH3BGR__Homo_sapiens__NP_001001713
augagagagaacgugcccggcgaaaagaaaccucagaaugggaucccgcugcccccucaaauuuucaacgaggaacaguacugcggagacuuugauagcuucuuuuccgccaaggaggaaaauaucauuuauucuuuccucggccuggcucccccucccgacagcaaaggguccgagaaggccgaggaaggaggcgagaccgaagcgcagaaagaggggucugaggaugucggaaaccuuccugaagcucaggagaagaaugaagaggaaggcgagacagccacggaggaaaccgaggaaaucgccauggagggcgcugaaggggaggccgaggaagaggaagagacagcugaaggagaggagccgggcgaagacgaggauagcuga

SEQ ID NO: 75504 - RNA, 324 nt, Artificial Sequence
  derived and/or modified sequence opt5 from SH3BGRL2__Homo_sapiens__NP_113657
augguuaucagagucuucauugccagcuccucuggcuuuguugcuaucaagaaaaagcagcaagacguggugcgguuccuggaggccaacaaaauugaauuugaggaagucgauaucaccaugagcgaggaacagcgccaguggauguacaagaaugugcccccugagaaaaagccgacacaggggaacccccucccuccccaaauuuucaauggagacagauauugcggcgauuacgacuccuuuuucgagucuaaggaaagcaacacgguguuuuccuuccuggggcuuaaaccucggcuggcgucuaaggcugagcccuga

SEQ ID NO: 75505 - RNA, 345 nt, Artificial Sequence
  derived and/or modified sequence opt5 from SH3BGRL__Homo_sapiens__NP_003013
auggugaucagagucuacauugccagcuccucuggcagcaccgcuaucaagaaaaagcagcaagacguucugggguuccucgaggccaacaaaauuggauuugaagagaaggauaucgcggcuaaugaagagaaccggaaauggaugcgcgaaaaugugcccgagaacuccagaccugccacaggcuauccgcugcccccucagauuuucaaugagucucaguaccgcggggacuaugaugccuuuuucgaagcucgggagaacaaugccguguacgcuuuucuuggacugacggcgcccccuggcagcaaggaagccgagguccaggccaagcaacaggcuuga

SEQ ID NO: 75506 - RNA, 2106 nt, Artificial Sequence
  derived and/or modified sequence opt5 from SH3BP1__Homo_sapiens__NP_061830
augaugaagagacagcugcaccggaugcgccaacucgcccagaccggcagccuggggagaacacccgagacggcugaguuccuuggagaggaccugcuccagguggaacagcggcuggagccugccaaacgcgcggcucauaacauccacaagagacuucaagccugccugcagggccaguccggggccgauauggacaaacgggucaagaaacucccgcugauggcucugucuaccacaauggccgagagcuuuaaggaacucgaucccgacuccucuaugggaaaggcucuggagaugagcugugccauucagaaucaacuugcgcgcauccuggccgaguucgaaaugacccucgaaagagauguucugcagccucuuucccggcugucugaggaggaacuccccgcuauucugaaacauaagaaaagccugcagaagcucguguccgacuggaacacacugaaaagccgccuuucucaggccaccaaaaauuccggcagcucucaagggcugggaggcuccccuggcagccacucucauacaaccauggcuaacaagguggagacgcucaaggaagaggaagaggagcugaagagaaaagucgaacagugccgggaugaguaccuugccgaccuguaucacuuugugaccaaggaagauuccuacgcgaauuauuucauccgccuccuggagauucaggccgacuaccacagacggagccuguccucucucgauacagcucuggccgaacuucgcgagaaccaugggcaagcugaccacagccccuccaugaccgccacacauuuuccuagaguuuauggagugagccuggccacccaccuccaggagcugggccgggaaaucgcgcuuccgaucgaggcuugugucaugaugcugcucucugaagggaugaaagaggaaggacuguucagacuggccgcuggcgccuccgugcucaagcgccugaaacagacgauggccagcgauccccacucucuugaggaguuuugcagcgacccucaugcuguugccggggcgcugaaguccuaccuccgggaacugcccgagccucugaugacauucgaccuuuaugaugacuggaugagagcugccucucucaaggaacccggagcccgccugcaggcucugcaagagguguguagccggcucccgccugagaaucuguccaaccuuagauaccugaugaaauuucucgcccgccuggcugaggaacaggaagucaauaagaugacccccagcaacauugccaucgugcugggcccuaaucuucucuggccucccgagaaagaaggcgaucaggcgcagcuggacgccgcuucuguguccagcauucaagucguuggggugguggaggcccugauccagucugcugauacacucuuccccggagacauuaacuuuaaugucuccggccuguucagcgccgugacccuucaggauaccguuuccgaccggcuggcgucugaggaacucccgagcacagccgugcccacgccugcuaccacacccgccccugcucccgccccggccccugcucccgcgccugcccuggcuuccgccgccaccaaggagagaacagaaucugaggugcccccucgccccgcuagcccgaaagucacccgguccccucccgaaacggccgcgcccguugaggauauggcuagacgcacaaagcggccugccccggccagacccaccaugccucccccucaggugagcgggucucgguccucucccccugcucccccgcugccucccggaagcggcuccccugggacaccccaagcccuuccgcgcagacucgucggaagcucucugcgggcgccuaccgugcccccuccccugcccccuaccccgccccagccugcuagacgccagagccggagaucccccgccagcccuucucccgccuccccuggcccggcuagccccuccccugucucucucagcaaccccgcccagguggaccugggcgcugccacagcggaagggggagccccugaagcuaucuccggcguucccacgccgccugccauuccuccccaaccccgccccagaucucuugcuagcgagaccaauuga

SEQ ID NO: 75507 - RNA, 1770 nt, Artificial Sequence
  derived and/or modified sequence opt5 from SH3BP2__Homo_sapiens__NP_001139327
auggccagccugggccccagaaccccugcuccgucccggucucgcgggagacgggccaugugcugggugagcacaaucuccuucauggcggcugaggaaaugcacuggcccgucccuaugaaggccauuggagcccagaaccuccugacgaugcccggcgggguugcuaaagccggauaccuucauaagaaaggcgggacccaacugcagcuccugaaguggccucuucgcuuugugaucauucacaaaagauguguguauuacuucaagucuagcacauccgcuucuccccagggagccuuuagccuguccggcuauaaucgggucaugcgcgcggccgaggaaaccacaagcaacaauguguucccuuuuaagaucauucauaucucuaaaaagcacagaaccugguucuuuuccgcuagcucugaggaggaacggaaauccuggauggcccuccugcgcagagagaucggccauuuccacgaaaagaaagaccugccgcucgauacaagcgacucuuccagcgauaccgacuccuuuuacggggcuguugagcggcccguggauauuucucugagcccuuaucccacggacaacgaagauuacgagcacgacgaugaggacgauuccuaucuugaaccugacagccccgagccgggacgccuggaagaugcccucaugcauccucccgcguacccucccccucccgucccgacccccagaaagccugccuucucugacaugccccgggcucacuccuuuacaagcaagggcccugggccccugcuuccgccucccccucccaaacauggacugccugacgugggccucgccgcugaggauucuaagcgcgacccccugugcccgagacgggccgaaccuugucccagaguucccgccaccccucgccggaugagcgauccgccccuguccacaaugccuaccgcucccgggcucagaaaaccucccugcuuccgcgagucugcgagcccuucccccgagccguggacgccuggacacggcgccuguagcacaucuuccgcugccaucauggccaccgcuacaagccggaauugcgacaagcugaaaucuuuucaccuuucccccagaggcccucccaccagcgaaccgccucccgugccugccaacaagcccaaauuccugaagauugcggaggaagaucccccucgcgaggcugccaugccgggacucuucgugcccccuguggcuccccggccucccgcccugaaacuuccugugccggaagccauggcuagacccgccguccugccucgccccgagaagccucagcucccccaucugcaacgguccccgccugacgggcagucuuuucggagcuucuccuuugagaagccccgccagcccucucaggcggauaccggcggggacgauagcgacgaagauuacgagaaaguuccucugcccaauuccguguucgugaacacaacggaaagcugugaggucgaacggcucuuuaaggccaccucuccuagaggagagccgcaagacggccuguauugcaucagaaauuccagcacaaaaucugggaaggugcuuguugugugggacgagaccuccaacaagguccgcaauuacagaauuuucgaaaaagauagcaaguuuuaucuggagggagaaguccucuucguuucugugggcagcauggucgagcacuaccauacacacgugcugcccucccaucagagccuucugcuccggcacccuuauggcuacaccgggcccagauga

SEQ ID NO: 75508 - RNA, 2892 nt, Artificial Sequence
  derived and/or modified sequence opt5 from SH3BP4__Homo_sapiens__XP_011509196
auggccgcucagagaauccgggccgcgaacagcaauggccugccccgcugcaaguccgaggggacccucauugaccugucugaaggauucagcgagacauccuuuaacgauaucaaagugccuucuccgagcgcccuucuggucgacaaucccacgccuuucggcaacgcuaaggaaguuauugccaucaaagauuacugucccaccaauuuuacaacccucaaguucuccaaaggggaccaccuguaugugcuugauacaucuggaggcgaguggugguacgcucauaacaccacagaaaugggguauauuccuagcuccuacgugcaaccccugaauuauagaaacagcacccucucugacuccggaaugaucgauaaucugccugacagcccggaugaggucgccaaggagcuggaacuccugggcggcuggacggacgauaagaaagugcccgggcggauguacucuaacaauccuuuuuggaacggaguucagaccaaucccuuccuuaacggcaaugugccugucaugcccucccuggacgagcucaaccccaagagcacaguggaucugcuucuguuugacgcugggaccucuuccuucacagaaagcuccucugccaccacgaacagcacaggaaauaucuuugacgagcucccuguuaccaacggccugcacgcggagcccccugugcgcagagauaaucccuucuuucgguccaaacgcagcuauucucuguccgaacucagcguccugcaggccaagucugacgcucccacaagcuccucuuucuuuaccgggcuuaaaagcccugccccggagcaguuccaauccagagaagauuuccggaccgcuuggcugaaccaucgcaagcucgccagaagcugccacgaccuggaucuucugggacagucucccggcuggggccagacacaggcgguggagacgaauauuguguguaagcucgacuccagcgggggagccguccaacugccugauaccucuaucuccauucauguucccgaaggccacguggcuccuggggagacacagcagaucagcaugaaagcccugcucgacccgccgcuggagcuuaacuccgaucggucuugcagcauuuccccugugcuggaagucaagcucucuaaucuggaggugaaaaccagcaucauucuugaaaugaagguuuccgcugagaucaaaaacgaccuguuuagcaagucuacagugggacuccagugucugcgcuccgauagcaaagaaggccccuacgucucugugccucugaauugcuccuguggggacaccguucaagcccagcuccacaaccuggagcccugcauguacguggccgucguggcucauggaccuagcauccuuuaucccucuacggucugggacuucauuaauaagaaggugacaguuggccuguacggcccgaaacacauccauccuagcuuuaagaccguggucaccauuuucgggcacgauugugcgcccaaaacacuccugguguccgagguuaccagacaggcccccaacccugcuccgguggcccugcaacuuuggggaaagcaccaguuuguccucagccggccccaggaccugaaagugugcauguucucuaauaugacaaacuaugaagugaaggccuccgagcaggcuaagguuguccgcggcuuucaacugaaacucgggaaggugagcagacugaucuucccuauuacgucccagaaucccaacgaacuuucugauuuuacccugcgggugcaggucaaagacgaucaggaggccauccucacacaauucugugugcagaccccucagcccccucccaagagcgcgaucaaaccguccggacagagacgcuuucugaagaagaacgaaguuggcaaaauuauccugucuccuuucgcuacaaccacgaaguaccccaccuuucaagaccggccugugagcucccuuaaauucgggaagcuccugaaaacagucgugagacagaauaagaaccauuaucugcucgaguacaagaaaggcgauggaauugcccugcuuucugaggaacgcguucggcugagaggccagcucuggaccaaggagugguauaucggguacuaccagggacgcgugggccugguccacacaaagaaugugcugguuguggggcgggccagacccagccuuugcuccggaccggaacucagcaccucuguccugcuggagcaaauucuccgcccuugcaaguuccugacguauaucuacgcuuccgugcggacacuucugauggagaacaucagcucuuggagauccuuugccgacgcucucggcuaugugaaucugccccugaccuucuuuugucgcgccgaacuugauagcgagccugaacgggucgcgucuguucucgagaaacugaaggaagacugcaacaauacagagaacaaagagagaaaguccuuccagaaggaacuggugauggcccuccugaaaauggauugucaggggcuugugguccggcugauucaagacuuugugcuccugaccaccgcuguugagguggcccagcgcuggagagaacuggcugagaaacuugccaaagucagcaagcagcagauggaugcguacgaaagcccccaucgggacagaaauggcgugguugacuccgaggccauguggaaacccgcuuaugauuuccugcucacauggucucaccaaaucggagacagcuaccgcgaugugauucaggagcugcaucucggccuggacaagaugaagaacccuaucacgaaacgguggaagcaccuuaccgggacacugauucucgucaauucccuggaugugcugagagccgcugccuuuucuccggccgaccaggaugacuucguuaucuga

SEQ ID NO: 75509 - RNA, 897 nt, Artificial Sequence
  derived and/or modified sequence opt5 from SH3BP5__Homo_sapiens__NP_001018009
augcugaaccacgccacccagagagugauggaggcugaacaaacaaagacgcggagcgagcucguccauaaagaaaccgccgcgcgcuacaaugcugccaugggcagaaugcggcagcuggagaagaaacuuaagcgcgccaucaacaaauccaagcccuauuucgaacugaaggcuaaauacuauguucagcucgagcagcugaagaaaacaguggacgaucuucaagccaagcugacccucgcuaaaggggaguacaagauggcccugaagaaucuggaaaugauuucugacgagauccacgaaagacggcgcagcuccgcgaugggaccuagaggcugcggggugggagccgagggcucuagcacauccgucgaggaucucccggggucuaaacccgaaccugacgcuauuagcguggccuccgaggcuuuugaagaugacagcuguucuaacuucguuuccgaggaugacagcgaaacccagucuguguccagcuuuucuuccggacccacaagcccuuccgagaugcccgaucaguucccugccgucgugcggccgggcucucuggaccuucccagcccuguuucccugagcgaguuuggcaugauguuccccgugcucgggccucgcucugaaugcuccggagcgagcucucccgagugugaagucgagagaggcgaucgggccgaaggggcugagaauaagaccagcgacaaagccaacaauaaccgcggacuguccucuagcuccggcagcgggggaucuuccaagagccagucuuccacgagcccggagggccaagcucuugaaaauagaaugaaacagcugucccuccagugcucuaagggccgggaugggaucauugccgacaucaaaauggugcagaucggauga

SEQ ID NO: 75510 - RNA, 2373 nt, Artificial Sequence
  derived and/or modified sequence opt5 from SH3D19__Homo_sapiens__NP_001009555
augaacaucaugaauaccgagcagagccaaaacuccauugugucuagaaucaaggucuucgaaggccagacaaauauugagacgagcgggcugcccaaaaagccugaaaucaccccgcggucccugcccccuaaacccacaguuucuagcggaaagccuuccguggcccccaaaccugcugccaaccgcgcgucuggcgagugggacagcgggaccgaaaauagacucaaggugacauccaaggagggacuuaccccguaucccccucugcaggaggcuggcagcauucccgucacaaaaccugaacuccccaagaaaccgaacccugggcugauccggucugugaaucccgagaucccuggacgcggcccccuugccgaauccagcgauucuggcaagaaaguucccaccccugccccgagaccccugcuccugaagaaguccgugagcucugagaacccuacguaccccuccgcuccucugaaacccgucaccgugccgccucggcucgccggggcuagccaggccaaggcguacaaaucccugggagaggggcccccugccaaucccccuguucccgugcuucaaucuaagccgcuggucgacauugaucucaucagcuuugacgaugacgugcugccuacacccuccgggaaccuugcugaagagagcgugggaucugaaaugguccuggaucccuuccagcucccugccaaaaccgagccgauuaaggaacgcgcuguucagcccgccccuacaagaaaacccaccgugauccggauuccugcgaagcccggcaagugccugcacgaggacccucaguccccgcccccucugcccgccgagaaaccuaucgggaauacguuuagcacagugucuggaaagcucagcaacgucgaacgcaccagaaaucuggaguccaaccaucccggccaaacaggcggguucgugcggguuccgccucgccuucccccuagacccgugaauggaaaaaccauucccacccagcagccuccgacaaaggugcccccugaacggcccccucccccuaaacugucugcuacgcgcagaagcaacaagaagcucccguuuaaccgguccagcucugauauggaccugcagaaaaagcaauccaaucuugccaccggccugagcaaagcuaagucucaggucuucaaaaaccaggaucccguucucccucccagaccuaagcccgggcacccgcuguauuccaaguacaugcugagcgugccucauggaaucgccaaugaggacaucgucucccaaaaccccggcgaacucucuuguaaacgcggggaugugcuggucaugcuuaagcagacagagaauaacuaucuggagugccagaaaggagaagacaccggccgggugcaccucagccagaugaagauuaucacaccccuggacgagcaucuuagaucccgcccuaaugaucccucucacgcccaaaaaccuguugacagcggcgcuccgcacgcggugguccugcaugauuuucccgccgaacagguggacgaucucaaccugaccuccggggagauuguuuaccugcucgaaaagaucgacacggauugguaucggggaaauuguagaaaccagauuggcaucuucccugcuaauuacgugaaggucaucauugacauccccgagggcggaaacggcaaacgcgagugcgugagcucucacugugugaaggggucccggugcguugccagauuugaauacauuggcgagcagaaagaugaacugagcuucucugagggagagaucauuauccuuaaggaauaugucaaugaggaaugggcccgcggcgaggugcgggggagaacaggaaucuuuccucugaacuucguggaacccgucgaggacuacccgaccuccggcgcuaaugugcucagcaccaaaguuccucugaagaccaaaaaggaggauucugggagcaacucccaagugaacagccugcccgccgaauggugugaggcgcuucauucuuuuacagcugaaacauccgacgaccucagcuucaagcgcggagaucggauucagauccuggagagacuggacuccgauuggugccggggccgccuccaggacagagaagggauuuucccugccgucuuugugcggcccuguccugccgaggcuaaaucuaugcuggccaucguucccaagggcagaaaagcuaaggcccuuuaugauuuccgcggagagaaugaagacgagcugagcuuuaaagcgggcgauauuaucacggaacucgaguccguggacgaugacuggaugucuggggaacugaugggaaagagcggcauuuucccgaagaacuacauccaguuucugcaaaucuccuga

SEQ ID NO: 75511 - RNA, 963 nt, Artificial Sequence
  derived and/or modified sequence opt5 from SH3GL1__Homo_sapiens__NP_001186872
augagcguggccggccugaagaaacaguucuacaaggcuucccaacucgucucugagaaaguugggggagccgaaggcaccaagcuggacgaugacuuuaaagagauggaaaagaagguggaugugacaagcaaagcggucacggaggugcuugcuagaaccaucgaauaucugcagcccaacccuggggacgcccuccuggaugccggagaguccaugaagcggcuugcugagguuaaagacucucuggauauugaagugaagcagaauuucaucgacccgcuccagaaccugugcgagaaagaucugaaggaaauucaacaccaucucaagaaacuggagggccgcagacuugacuuugauuacaagaaaaagcggcaggggaaaauccccgacgaggaacugcgccaggcccucgagaaguucgaagagagcaaagaagucgcugagacauccaugcacaaucugcuugagaccgauauugaacaggugucucaacugagcgcccucguugacgcgcagcuggacuaucauagacaggccgugcagauccuggaugagcucgcugaaaagcugaagcggcgcaugagagaggccuccagccggccuaaacgcgaauacaagcccaaaccuagagagcccuuugaccuuggagagccugaacaaucuaacggcggcuucccguguacaaccgcucccaagaucgccgcguccagcucuuuucgguccagcgauaaaccuauucgcacacccucuagauccaugccuccccuggaccagccgagcugcaaggcccucuaugauuucgagccugaaaaugacggggagcugggauuucacgaaggcgaugucaucacccuuacgaaccagauugacgagaauugguacgaggggaugcuggauggacaauccggcuucuuuccccucucuuauguggaagugcuggucccucugccccaguga

SEQ ID NO: 75512 - RNA, 1059 nt, Artificial Sequence
  derived and/or modified sequence opt5 from SH3GL2__Homo_sapiens__NP_003017
augagcguggccggccugaagaaacaguuccacaaggcuacccaaaaagucuccgagaagguugggggagccgaaggcacaaaacucgacgaugacuuuaaggagauggaaagaaagguggaugugacgucucgggcggucauggagaucaugaccaaaacaauugaauaccugcagcccaacccugcuagccgcgccaaacuuuccaugaucaauaccaugucuaagauuagagggcaggagaagggaccgggcuauccccaggccgaggcucugcucgccgaagcuaugcugaaauucgggcgggagcuuggagacgauugcaacuuuggcccugcccugggcgaagugggggaggcgaugcgcgagcucagcgaaguuaaggacucccuggauaucgaggugaagcaaaauuucauugacccccugcagaaccuccaugauaaagaccugagagaaauccagcaccaucuuaagaaacuggagggacggcgccucgauuuugacuacaagaaaaagagacagggcaaaaucccugaugaagaacugcggcaagcccuugagaaguucgacgaaucuaaggagauugcugaaagcuccauguuuaaucugcucgagauggacaucgaacaggucagccagcugucugcccuggugcaggcucaacucgaguaucacaaacaggccguucagauucugcaacaggugacaguccgccuugaggaaagaauccggcaggcguccagccagccccgcagagaguaccaaccuaagccgcggaugucucuggaguuccccaccggggauuccacacagccuaacggaggccucagccauaccgggacgcccaaaccuucuggagugcagauggaccagcccuguugccgcgcccuguaugauuuugagccggaaaaugagggcgagcuuggcuucaaggaaggggacauuaucacccugacaaaccaaauugaugagaauugguacgaaggaaugcuccacggccacuccggguuuuucccuaucaacuauguggagauccuggucgcucugccccauuga

SEQ ID NO: 75513 - RNA, 1068 nt, Artificial Sequence
  derived and/or modified sequence opt5 from SH3GL3__Homo_sapiens__NP_001288038
auggacggcaucuucgccgggauuaucugcaaccaggcuaauagaugucugaccuggacaagccaacagcucuuuuccgagaagauuucuggagccgaaggcacgaaacuggaugacgaguuccuugauauggaacggaagaucgacgugaccaacaaagucguugcggagauucugagcaagacaaccgaauaccuccagcccaauccugcuuaucgcgccaaacuggggaugcuuaacacaguguccaagaucagaggacaggugaagaccacaggcuacccgcaaaccgaggggcugcucggagauugcaugcugaaauauggcaaggagcugggcgaagacucuacguuugggaaugcccucaucgaggucggagaaagcaugaaacugauggcugaggugaaggauucccuugacauuaacguuaaacagaccuucaucgauccccugcagcuccugcaggacaaggaucuuaaggagauuggccaccaucugaaaaagcucgaagggcggcgccuggacuacgauuauaaaaagaaaagagugggaaagaucccugacgaggaaguccggcaagccguggagaaauuugaagagucuaaggagcuggcugaacgcagcauguucaauuuucucgagaacgacguugaacaggugucccagcuggccgucuucauugaggcggcccuugauuaccacagacagagcacagaaauccugcaagagcuccagucuaagcugcagaugcggauuuccgcugccagcucugugccccgcagagaguauaaaccucggcccgugaagcgcuccagcucugaacuuaauggcgucuccaccacaagcguugugaaaaccacgggguccaacaucccuauggaccaaccguguugcagaggacuguacgauuuugagcccgaaaaucagggcgagcucggcuucaaggaaggggacaucauuacacugaccaaccagaucgaugagaauugguacgagggaaugauucauggcgaaucuggguuuuucccuaucaacuauguggaggucauugugccccugccucaguga

SEQ ID NO: 75514 - RNA, 1887 nt, Artificial Sequence
  derived and/or modified sequence opt5 from SH3KBP1__Homo_sapiens__NP_001019837
auggaggugagcgccgcuaaggcccccuccgcggcugaccugucugaaaucgagauuaaaaaggaaaugaaaaaggauccucucaccaacaaagccccggagaagccccugcacgaagucccuagcggcaauucccuucugucuagcgagacaauccucagaacgaacaagcgcggggagcggagacggcgcagaugccagguugccuucuccuaccugccccaaaaugacgaugaacuugagcugaaagugggagacauuaucgaaguggucggcgagguggaggaaggguggugggagggaguucucaacggcaagaccgggauguuuccuucuaauuucauuaaagaacugagcggagaguccgaugaacugggcaucagccaggacgagcagcucucuaaguccagccugcgggagacaaccggcucugaauccgaugggggagacagcagcuccacaaaaagcgagggcgcuaacgggaccguggccacagcugccauccagcccaagaaggucaaaggagugggcuuuggggauauuuucaaggacaaaccuaucaaacuucgcccgagauccauugaaguugagaaugauuuucugcccguggaaaagaccaucggaaagaaacucccugcgacgaccgccacacccgacucuagcaagaccgagauggauucccggacaaagagcaaagacuauuguaaggucauuuucccuuacgaggcucaaaacgacgaugaacugaccaucaaagagggcgacauugugacgcuuaucaauaaggauugcaucgacgugggcuggugggaaggggagcugaacggacgcagaggcgucuuucccgauaauuucguuaaacuccugccgccugacuuugaaaaggaggggaaccggcccaagaaaccucccccucccucugccccggugauuaagcagggagcuggcacaaccgagcgcaaacaugaaaucaagaaaauucccccugagagacccgaaaugcugccuaaucggacagaggagaaggaacgccccgagagagaaccgaagcucgaucugcagaaaccuuccgugcccgccaucccucccaagaaaccucggcccccgaagaccaacagccuuucuagaccuggggcgcugccuccccgccggcccgagagaccggucggaccccucacccacacacgcggcgacagcccuaaaauugaucuggccggcuccucucuuagcgggauccuggacaaggaucucuccgaccggagcaaugacaucgaucuggaaggauucgacucugugguuuccagcacggagaagcugucucaucccaccacauccagaccuaaagcuaccggccgccggcccccuagccagucccucacaucuagcucccugucuagccccgauauuuuugacuccccgagcccugaggaagauaaggaggaacacaucucucuugcccauagagggguggacgcuuccaaaaagaccagcaaaacggucacaauuucucaaguguccgauaacaaggccagccugcccccuaaacccggaaccauggccgcuggcgggggcggaccggcgccucucucuagcgccgcucccuccccucugucuucuucccuuggcaccgccgggcaccgcgccaacagccccucccuguucggaacagagggcaagcccaagauggaaccugcugccucuagccaggcggcuguugaggagcuccggacccaggugagagaacugcgcuccaucauugagacaaugaaagaccagcaaaagcgggaaaucaaacagcugcucucugagcuggaugaagagaagaaaaucagacuucggcugcagauggaggucaaugacauuaagaaggcccuccaaagcaaauga

SEQ ID NO: 75515 - RNA, 3318 nt, Artificial Sequence
  derived and/or modified sequence opt5 from SH3PXD2A__Homo_sapiens__NP_055446
augcuggccuacugcgugcaggacgcuaccgucguugauguggagaagagacggaaccccagcaaacacuauguguacaucauuaaugucacaugguccgacucuacgagccaaaccaucuaucgcagauacuccaaguucuuugaucuccagaugcagcugcuugacaaauucccuauugaaggcgggcagaaggauccgaaacaacggaucauucccuuucugccuggaaagauccucuuccgcagaucucauauccgggacguggccguuaagcgccugaaacccauugaugaguauuguagagcgcuugugcggcugccuccccacaucagccagugcgacgaagucuuucgcuucuuugaggcuagaccugaagaugugaacccgcccaaggaggacuacggcuccucuaaaagaaagagcguuuggcucuccagcugggccgagucuccuaaaaaggaugugacaggggccgacgcuaccgccgaacccaugauucuggagcaguaugucgugguguccaauuacaagaaacaggaaaacagcgagcugucucuccaagcuggagaggucguugaugugaucgaaaagaaugaguccggcuggugguucgugagcacaucugaggaacaggggugggucccugccaccuaccuggaagcgcagaacggaacacgcgacgacuccgauauuaauaccagcaaaacgggcgaggaggaaaaguaugugaccguucagcccuacacaucccaaucuaaagacgagaucggcuuugaaaagggggugaccgucgaggugauucggaaaaaccuugaaggauggugguauauccgguaccugggcaaggaggggugggccccggcuagcuaucucaagaaagccaaggaugaccugccuacacgcaaaaagaaucuugcuggacccguugagaucauuggcaacaucauggaaauuuccaaucugcucaacaaaaaggccagcggggauaaggagaccccucccgcggaaggagagggccaugaagcccccaucgcuaaaaaggagauuucucugccuauccuguguaaugccuccaacggcagcgcugugggggucccggacagaacggugucucggcucgcccagggaagccccgccgucgcuagaaucgcgccucagcgcgcccaaauuuccucucccaaucugcggacaagaccucccccgcgccgggagagcucccuuggcuuccagcugccuaaacccccugaacccccuagcguggagguugaauacuauaccaucgcugaguuucagucuugcauuuccgaugggaucagcuucagaggaggccagaaggccgaggugauugacaaaaacucugggggauggugguacguccaaaucggcgaaaaggagggcugggcccccgcuuccuacaucgauaagcgcaaaaagccgaaccucagccggagaacauccacccugacccgcccuaaagugcccccucccgccccgcccucuaagccuaaagaagcggaggaagggcccacaggagcuagcgagucccaggacucuccucggaaacuuaaguaugaggaacccgaguacgauauuccugccuuuggcuucgacagcgaacccgagcuguccgaggaaccgguugaggacagagccagcggggaacgccggccugcucagccccacagaccuucucccgccuccagccuccagcgggcucgcuucaaagugggagagucuuccgaagaugucgcccuggaggaagagacgaucuaugagaaugaaggcuuuagaccguacgcggaggacacccugagcgcccgggggucuagcggcgauuccgacagcccuggaucuuccagccucucccugacaagaaagaacucucccaaaagcggcuccccuaagucuagcucccuucugaaacucaaggcugaaaagaaugcccaagcugagauggggaagaaccauucuagcgccuccuucucuagcuccauuaccaucaauacaaccuguugcucuagcuccucuagcuccagcuccagccugucuaagacgagcggagaucuuaaaccccgcuccgcgucugacgccggcauucgggggacacccaaggugagagcuaaaaaggaugccgacgcuaacgccggacugaccagcuguccucgcgccaaaccguccgugagacccaagccuuuucucaaucgggcugagucucagagccaggaaaagauggauaucuccacccugcgcagacagcugcggcccacaggccaacuccgcgggggccugaaaggaucuaagagcgaggacuccgaacuuccuccccagaccgcgagcgaggccccuucugaaggcuccagacggucuagcuccgaucugauuacacucccggcuacgacacccccuugccccaccaaaaaggagugggaggggccugccaccagcuauaugacauguuccgccuaccagaaaguucaggacucugaaaucagcuuccccgcuggagucgaggugcaagugcuggaaaagcaggaguccggcuggugguauguccgcuuuggggaacuggagggaugggccccgagccacuaccuugugcucgaugagaacgaacagccugaccccucuggcaaggagcuggacaccguucccgcgaaagggagacaaaaugaaggcaaguccgauagccuggagaaaaucgaacggcgcgugcaggcucucaacacggucaaucagucuaagaaagccaccccucccauuccuagcaagccgcccggaggcuucgggaagacauccggaaccccugccgugaaaaugagaaacggcguuagacagguggcuguccggccccaaucuguguuuguuagcccucccccgaaggacaauaaccuguccugcgcccuucgccggaaugagucucugacagcgaccgaugggcucagaggagugcgccggaacagcuccuucagcacggcuagaucugccgccgcugaggccaaaggccgccuggcugaacgggccgcgucccaggggagcgacuccccucugcuucccgcccagagaaacucuaucccugucagccccgugcgcccuaagcccauugagaaaucccaguuuauccacaauaaccucaaggauguguacgucucuauugcugacuaugaaggcgaugaggagacagccggauuccaagaaggcguuagcauggaggugcuggaacggaauccgaacggguggugguacugucagauccuggacggagugaaaccuuuuaagggcuggguccccuccaauuaucucgagaagaaaaacuga

SEQ ID NO: 75516 - RNA, 2736 nt, Artificial Sequence
  derived and/or modified sequence opt5 from SH3PXD2B__Homo_sapiens__NP_001017995
augcccccuagacggagcaucguggaggucaagguucuggacgugcagaaacgcagagugccgaacaagcacuacgucuauauuauccgggugaccugguccucuggcagcacagaagccauuuaccgcagauauuccaaauucuuugaucuccaaaugcagaugcuggacaaguuccccauggaagggggacagaaagauccuaagcagcggaucauucccuuucuuccuggcaagauccuguuccgcagaucucauauccgggacguugcugugaaacgccucauucccaucgaugaauacugcaaggcccugauucaacuuccuccguauaucagccagugugacgagguccugcaguuuuucgaaacgagacccgaggaucucaauccucccaaagaggaacacauugggaagaaaaaguccggaggcgaccagaccucuguggauccuaugguucuggagcaauacguggucguggcgaacuaucagaagcaggaaagcuccgagaucagccugucuguggggcaggucguugacauuaucgagaaaaaugaauccggauggugguuugugagcacagcugaggaacaaggcugggugcccgcuaccugccucgagggccaggaugggguccaggacgaguucucucugcaaccggaggaggaagagaaguacacagugaucuacccuuauaccgcccgggaucaggacgaaaugaaccuugagcgcggagccguuguggaagucauucagaaaaaucuggagggcugguggaagaucagauaccaggggaaagagggaugggcccccgcuuccuaucucaagaaaaacagcggcgaaccucugccucccaagcccgggccgggaucucccucccauccuggcgcccuugaccuggauggcgugagccggcaacagaaugcgguugggcgcgagaaggaacuccuguccucucagagagacggacgguuugagggcagacccgugccugauggggacgccaaacagcgcagccccaagaugcggcaaagaccgccuccccgccgggauaugacaauuccuagaggacugaaccuccccaaaccucccaucccgccucaggucgaagaggaguacuauaccauugcugaguuccagacgaccauccccgacggcaucuccuuucaggccgggcugaagguggaagucauugaaaagaaucuuagcggauggugguacauccaaauugaggauaaggagggcugggcucccgccacauucaucgacaaguauaaaaagaccucuaacgcgucccgcccuaauuuucuggccccgcucccccacgaagugacacagcugcggcuuggcgaggcugccgcucuggaaaacaauaccgggagcgaggccacgggaccuucuagaccccucccugaugcuccccauggcguuauggacagcgggcugccuugguccaaagauuggaagggaucuaaagacgugcugcgcaaggccagcuccgacaugagcgcgucugccggcuacgaagagauuuccgaucccgacauggaggaaaagccgagccucccuccccggaaagagucuaucaucaaguccgaaggggagcugcuugaaagagagcgcgagcggcagagaacagaacagcugcggggcccuacccccaaaccgccuggagucauucuccccaugaugccugcuaagcacaucccucccgcccgcgauagcagacggcccgagccgaaacccgacaaguccagacuguuccaacuuaagaacgauaugggccuggaaugugggcacaaagugcucgccaaggagguuaaaaagccuaaucugcgccccauuucuaaaagcaagacagaccugccugaagagaaacccgaugcuaccccucagaacccguuccucaagucccggccccaggugagaccuaagcccgccccuucucccaaaaccgagccgccucaaggagaagaccaggucgauaucugcaaccugcgcagcaaacuuagacccgcgaaaucccaggacaagagccugcucgauggcgaggggccccaggcugugggaggccaagacguggccuuuucucgguccuuccugccuggggaaggccccggacgcgcccaggauagaacaggcaaacaggacgggcugagcccuaaggagauuucuugucgggcuccgccccgcccugccaagacgaccgaccccguuuccaaaagcgucccugugccccuucaggaggcuccgcaacagagaccuguggugcccccucggagacccccucccccgaagaaaacaucuagcuccagccgcccucuccccgaaguccggggaccccagugcgagggccaugaaucucgcgccgcgccuaccccggggagagcccugcugguucccccuaaggcuaaacccuuucucuccaauagccugggaggccaggaugacacacgggggaagggcucccuuggaccuuggggcaccgggaagaucggagagaacagagaaaaagccgcugccgcgucugugcccaaugccgauggccugaaggacagccucuacgucgcuguggccgauuucgagggggacaaagauacguccucuuuucaagagggaacaguuuucgaagugcgcgagaagaacagcuccggcuggugguuuugucagguccugucuggggcuccuagcugggaaggcuggauuccguccaauuaucugcggaaaaagcccuga

SEQ ID NO: 75517 - RNA, 2667 nt, Artificial Sequence
  derived and/or modified sequence opt5 from SH3RF1__Homo_sapiens__NP_065921
auggacgagagcgcccugcucgaucugcuugaaugccccgugugucuggagagacucgacgcuuccgccaagguccugccuugccagcacaccuucuguaaacggugccuucugggcaucguugggucucgcaacgaacucagauguccggagugccggacacuggugggaagcggcguggaagaacugcccuccaauauucuccugguccgccuucuggaugggaucaagcaaagaccuuggaaacccggaccuggcgggggaucuggcacgaacuguaccaaugcgcuccggagccaguccucuacaguggcuaacugcagcuccaaggaccugcagagcucucagggcgggcaacagccccgcguucaguccuggagcccuccggugagaggcauuccccagcuuccuugugccaaagcccuguacaauuaugagggaaaggaacccggggaucucaaguuuucuaaaggagacaucauuauccugcggcgccaagucgaugagaacugguaccauggcgaagugaaugggauccacggauucuuuccuaccaacuucguucagauuaucaagccccugccgcagccucccccucagugcaaagcucucuaugacuuugaggugaaggauaaagaggccgacaaggauugucugcccuucgcuaaggacgauguccuuacagugauuagacggguggacgaaaauugggccgagggcaugcuggcggacaaaaucggcauuuuucccaucuccuacgucgaguucaacagcgccgcuaagcaacucauugagugggauaaaccuccgguucccgggguggacgccggagaauguucuuccgcugccgcgcagagcuccaccgccccuaagcauucugauacaaagaaaaauaccaaaaagcgccacagcuuuacgucccugaccauggcuaacaagagcucucaggccucccaaaauagacauagcauggagaucucucccccugugcuuaucagcuccucuaaccccacagcugccgcccggauuagcgagcuguccggccucagcugcucugcuccgucccagguccacaucagcaccacagggcugauugugaccccucccccuucuucccccguuacgacaggaccuagcuucaccuuucccuccgacgugccguaucaggcggcccugggcacacucaauccuccccugcccccuccgccccuucuggcugccaccguccucgccucuaccccucccggggcuacagccgcggcugccgccgcuggaaugggcccucgccccauggccggcagcacggaucagaucgcucaccugagaccucaaacccggcccuccguguacguugccauuuauccguacacaccuagaaaagaagacgagcuugaacugcgcaagggggagauguuccucguguuugaacggugccaggauggaugguucaaaggcaccucuaugcauacaagcaagaucggggucuuccccggaaacuacguggcgccugucaccagagccgugacgaacgcuucccaggccaaaguucccaugagcacagcuggccagaccucucgcggggugaccauggucuccccgagcacagccggcggaccugcgcaaaagcugcagggcaaugggguggccggaucucccuccguugugccugcugccgucgugagcgcugcccacauccagaccucuccccaggccaaggugcugcuccauaugacaggccaaaugacgguuaaccaggcucggaaugcggucagaaccguggccgcucacaaccaggagcgccccacagccgccgugaccccuauucagguccaaaaugcugccgggcugagcccggcguccgugggacuuagccaccauucucuggcuagcccccagccugcuccccucaugccuggcagcgccacacacaccgccgccaucuccauuucucgggcgagcgcuccccuggccugcgccgcugccgcuccucugacguccccgucuaucaccagcgccucccuugaggcggaacccucugggagaauuguuacagugcucccuggccugcccaccagcccugacuccgccagcucugcuuguggaaacuccagcgccacaaaacccgauaaggacucuaaaaaggagaaaaagggccugcucaagcugcuuuccggggcuagcaccaaacgcaagccgcgggucucuccucccgccucccccacgcuggaaguggagcucggaagcgccgaacugccucugcagggcgcuguugggcccgagcuuccuccgggaggcgggcauggcagagcgggauccugccccguggauggcgacgggccugucacaaccgccguggcuggagccgcccucgcucaagacgccuuucaccgcaaagcgagcucucuggauagcgcuguucccaucgccccucccccgcggcaggccuguuccucucugggcccugugcucaaugagagcagacccgucgugugcgaacggcaucgcguggucguuuccuauccuccccagucugaggcugaacuggagcuuaaggagggggacaucguguucgugcacaaaaagagagaagauggaugguuuaagggcacacugcagcggaacgggaaaaccggccucuucccuggauccuuugucgagaauauuuga

SEQ ID NO: 75518 - RNA, 2649 nt, Artificial Sequence
  derived and/or modified sequence opt5 from SH3RF3__Homo_sapiens__NP_001092759
augcugcucggcgccagcuggcugugcgcuuccaaggccgcggcugccgccgcucagucugagggggacgaagauagacccggagagcggcgcagacggcgcgccgcugccaccgcggccggcgcuggggaagacauggaugagagcucccuucuggaccuccuggaauguucugugugccuugagagacuggauacaacggccaaaguccucccuugucaacacaccuucugccggcgcugucuggagagcaucguuugcuccagacaugaacugcgguguccggagugccgcauucucgugggauguggcguggacgaacugcccgcuaacauccuucuggucagacuccuggaugggauucggcagcgcccuagagccggaacaucucccggcggcagcccucccgcgcggccuaucccggggcaguccgccgcucccacccuugccggaggcgggggaggcgcugccgggagcacaccuggaucucccguguuucuguccgccgcugcgggcagcaccgccggcucucuccgcgagcuggcuacauccagaaccgccccugccgcuaagaaucccugccugcucccguacgggaaagcccuguauagcuacgagggaaaggaaccuggcgaccuuaaauucaacaagggggauauuaucguucugcggagaaagguggacgagcagugguaucacggagaacuccauggcacgcaaggguuucugcccgcgucuuacauccaguguauucagccucuuccccacgcucccccucagggaaaagcccuguaugauuucgagaugaaggacaaagaucaagacaaggacugccucaccuuuacaaaagaugaaauccugaccguccugcgccggguggacgagaauugggccgagggcaugcucggcgauaagauugggaucuucccgcugcuuuacguugaacugaacgacuccgcuaagcagcucauugagauggauaaacccugcccugccgcugccagcuccuguaaugcgucucugcccagcgacuccggagccguggcuagcgucgccccuucucccacacuuuccagcucuggcgcugugagcgccuuucagagacgcguggaugggaagaaaaacaccaagaaacggcauuccuucacggcgcugucugucacacacagaagcucccaggccgcuagccaccgccauucuauggaaaucuccgccccgguucucauuucuagcuccgacccucgggcugccgccagaaucggagaucuggcucaccugagcugcgcggcccccacccaagacguguccucuagcgcuggcuccacaccuaccgccgugccccgcgccgcuucugucagcggggagcagggcaccccucccaaggugcagcucccgcugaauguuuaucuugcccuguacgcguacaaaccucaaaaguccgaugaacucgagcugcauaagggagagauguaucgggugcuggaaaaaugucaggacggcugguuuaagggggcuagccuuagaacaggagucucuggcguguuccccgggaacuacguuacgcccgugucccgcgucccugccggaggcgccgggccgccccggaauaacguggucggcggaagcccucucgcuaaaggcaucaccacaaccaugcaccccgggucuggaucccugagcucucuggccacagcgaccagaccugcucuccccauuacgacaccucaggcccacgcccagcaucccaccgcuagcccgccuaccggcuccugccugcggcacagcgcccaacccacagcuucucaggcccgcuccaccaucagcacagcggcccauuccgcugcccaggcucaggacagaccuacggccaccgugucuccccuucggacacaaaauagcccguccagacugccugccaccucucuccgcccccacagcguuguguccccucagcauucucaccagccucccguccagauguguccccggccggcuauuccccugacaagcgcggccuccgcuaucaccccucccaacgugagcgccgccaaucugaacggggaggcuggaggcgggccuauuggcguucuuucuacguccagccccaccaauacaggaugcaagcucgaugagaaaaagucugaaaagaaagaaaagaaauccggccugcugaagcuccuggccggggcgagcaccaaaaagaagucuagauccccuccgagcgugucccccacacacgacccucaagucgcuguggaugcccuucugcagggagccgugggccccgagguuagcucucucagcauccaugggcgcgcuggauccuguccuaucgagucugaaaugcagggcgccauggggauggagccccugcacagaaaagcgggcagccuggaccuuaacuuuaccuccccgucucggcaggcuccucucagcauggccgccauucgccccgaacccaagcugcugccuagagagcgguaucgcgucgugguguccuaucccccucaaucugaggcugaaaucgagcucaaagaaggagauauugucuucgugcauaagaaaagagaggacggcugguacaaggggacgcugcagcggaacggacgcacaggccuuuuuccggggagcuucguugaauccuucuga

SEQ ID NO: 75519 - RNA, 3867 nt, Artificial Sequence
  derived and/or modified sequence opt5 from SH3TC2__Homo_sapiens__NP_078853
augggcgggugcuucuguauccccagagagcggagccugacccgcggaccuggcaaggaaacaccguccaaagaccccacggugucuagcgagugcauugccuccucugaauacaaggagaaauguuuucucccucagaacaucaaucccgaucugacccuuagcuucugcgucaaguccagaucucggcgcuguguuaacgggccucugcaagaagcugccagacggcgccucugggcgcuggagaaugaggaccaggaagugagaaugcuuuuuaaagaucugagcgcucggcucguguccauucagagccagcgcgcccaauuccugaucacauuuaagaccauggaggaaauuuggaaguucucuacauaucugaaccucggauacgucuccaugugccuggagcaccuucuguuugaccauaaauauuggcucaauuguauccugguggaggauaccgaaauccagguuagcguggacgauaagcaccuugagacaauuuaccugggccuccugauccaggaagggcauuucuuuugcagagcccuguguucugucacgcccccugcugagaaagaaggagagugccucacccuguguaagaacgagcuuauuuccgugaaaauggccgaagcuggcagcgagcuggaaggcguuucucucgugaccgggcagcggggacugguccuuguguccgcccuggagccgcucccccugccuuuccaccaaugguuucugaagaauuaucccggcagcugcgggcucucccgcaagagagacuggacaggaucuuaccagaucggccgggggcgcugcaaagcgcugaccggauaugaaccuggcgagaaggaugagcuuaacuucuaccagggcgaaagcauugagaucauuggguuugugauccccggacugcagugguucaucggcaaauccacaagcucugggcaagucggauucguuccgaccagaaauauugacccugauuccuacagccccaugucucggaacagcgccuuucucuccgacgaagagagauguucucugcuugcucugggcagcgauaagcagacggaaugcuccagcuuccuccauacacuggcccgcaccgacaucacaucuguguaucggcuguccggguuugagagcauucagaauccucccaacgaccucucugcuucccaacccgagggauucaaagaagugagaccuggccgcgccugggaggaacaccaggcggucggcagccggcaguccucuagcuccgaggauucuagccuggaggaagaacuucuguccgccaccagcgacucuuacagacucccggaacccgaugaccuggaugacccugagcugcuuauggaucucuccaccgggcaggaagaggaggcugaaaauuuugcccccauccuggcuuuccuggaccacgagggauaugccgaucauuuuaagagccucuacgacuucucuuuuuccuuccugacaagcucuuuuuauagcuucuccgaagaggaugaauuuguggccuaccuugaggcuagccgcaaaugggcgaagaagucucacaugacgugggcccaugcucggcuguguuuccuccugggcagacuguccauucgcaaaguuaaacuuagccaagcccggguguauuucgaggaagccauccacauccucaacggggcuuuugaggaccugucccuggucgccacccucuacauuaaucuggcggcuaucuaccuuaagcagagacugcgccacaagggaucugcccuccuggaaaaagccggcgcucugcuugccugccucccugaccgggagagcuccgcuaagcaugaacuggaugugguugccuaugugcugagacaggggauugucgugggcucuagcccccucgaggcgcgggccuguuuccuggcuauccgccuucugcucucccugggaagacacgaggaaguccugccguuugccgagcggcuucagcuccugucuggccauccucccgcuagcgaagccguggcguccguucugagcuuccucuacgacaagaaauaucugccucaccuugccguggcuucuguccaacagcaugggauucaguccgcccagggaaugagccugcccaucuggcaagugcaccucguucugcagaacacaaccaagcugcuuggcuuuccuucucccggguggggagagguguccgcucuggccugcccgaugcucagacaggcccuggcugcgugugaggaacucgccgaucgcagcacacagcgggcucugugccuuauccugucuaaagucuaccucgagcacagauccccugacggcgccauucauuaucugagccaagcccuggugcuugggcagcugcucggcgaacaggaguccuucgaaagcucucugugucucgcuugggccuaccugcuugcgagccaagcuaagaaagcccuggaugugcucgagccccugcugugcucccuuaaggagaccgaaucucugacgcagcgcggaguuaucuauaaccuccugggccucgcccugcagggggagggaagagucaaucgggcugccaagagcuaccuucgcgcgcugaacagagcucaggaagugggcgacgugcacaaucaagccgucgccauggcuaaccuggggcaucucucccugaaaucuugggcccagcaccccgcucggaauuaccuucugcaggccgugcgccucuauugugagcugcaggcgagcaaggaaacagauauggagcucguucaaguguuucuguggcuugcccagguccugguguccggacaccagcugacccauggccuccugugcuacgagauggcccuucuguucgggcucagacaccggcaucugaaaucucagcuccaagcuaccaagagccugugccacuuuuauuccagcguuucuccuaacccggaggcuuguauuacauaccaugagcacuggcuugcccuggcccagcagcugcgcgacagagaaauggagggccggcuccuggaaucccuuggacaacuguaucgcaaucucaacaccgcuagaagccugcggagaucucucacaugcaucaaagagucccugcgcauuuucaucgaucuuggcgagacggacaaggcggccgaggcuuggcugggggccggacggcugcacuaccucaugcaggaagaugaacugguggagcuuugucugcaggccgcuauucagaccgcccucaagagcgaggaaccccugcuggcgcucaaacuuuaugaggaagcuggcgacgucuuuuucaaugggacaagacaucgccaccaugccguggaguacuaccgggccggagcuguuccucuggccagacgccugaaggcggugcggaccgaacucagaaucuuuaacaaacugacagagcuucaaaucucccuggagggcuaugaaaaggcucucgaguucgccacccuggccgcucgccugucuacggucaccggggaucagcggcaggaacucguggccuuccacagacuugcuacaguguacuauagccugcauauguacgagauggccgaagacugcuaucugaaaacccucucccugugucccccuuggcuucagagccccaaggaggcgcuguacuaugccaaagucuacuaccggcucggccgccugacauuuugccaacugaaggacgcucacgaugccaccgaguauuuccuccuugcucuggccgccgcuguucugcucggagacgaggaacugcaggauacgauuagaucucggcuugacaauaucugucaguccccucuguggcacagccgccccucuggcugcagcuccgaaagagcgcgguggcucucugggggaggccuggcccuguga

SEQ ID NO: 75520 - RNA, 972 nt, Artificial Sequence
  derived and/or modified sequence opt5 from SH3YL1__Homo_sapiens__NP_001153069
augaacaaucccaucccuagcaaccugaaguccgaggccaaaaaggcugccaaaauucucagagaguucaccgaaaucacaucucggaauggcccggacaagauuauccccgcgcacgugauugcuaaagccaaggggcuggccauccuuagcgucaucaaggcuggauuucugguuacggcccgcggcggguccggaauugugguggcuagacucccugauggcaaauggucugcccccagcgcgaucgggauugccggacugggcggcggguucgaaaucggaauugaggucuccgaccuugugaucauucugaacuacgaucgggcuguugaagccuuugcuaagggcgggaaucucacccugggaggcaaccugacaguggccgucgggccucucggacgcaaucuggagggcaacguggcgcuuagaucuagcgccgcuguuuucaccuauugcaaaucccggggccuguuugccggggugagccucgagggaucuugucugaucgaacgcaaggagacaaauagaaaauucuacugccaggacauccgggcuuaugauauucuuuuuggcgacacaccccgcccugcccaagccgaagaucuguacgagauccucgacuccuucaccgagaaguaugaaaacgaggggcagagaauuaaugcucggaaggcggcccgcgaacagagaaaaagcucugcuaaggagcugccgcccaaaccucugucccggccccagcaaagcucugccccuguccagcucaacuccggaagccaguccaaucugaaccagcccaucgaagugaccgcccuuuacucuuuugagggccaacagccgggggaucugaauuuccaggcuggagaccgcauuacggugaucagcaagaccgauucccauuuugacuggugggagggcaaacucagaggccagacagggaucuucccugccaacuaugucaccaugaacuga

SEQ ID NO: 75521 - RNA, 6486 nt, Artificial Sequence
  derived and/or modified sequence opt5 from SHANK1__Homo_sapiens__XP_006723296
augacccacagccccgccaccuccgaggacgaagagagacauucugcuagcgaaugcccugagggcggguccgaaucugauagcucccccgacggacccggccgggggccuagaggaacgagaggccaggggucuggagcccccggcagccuggccuccgugcggggccuucaagggcgcagcaugucugucccugaugacgcucacuucuccaugaugguuuuuagaaucggcauucccgaucugcaucagaccaagugucuucgguucaacccugacgccacaaucuggaccgccaaacaacagguccugugcgcucucagcgagucucugcaagaugugcuuaauuacggccuguuucagccggccacauccgggcgcgacgcuaacuuccucgaggaagagagacugcugcgggaauacccccagagcuuugagaagggagucccuuaccucgaguuccgcuauaaaaccagaguguacaagcagacaaaucuggaugaaaaacaacuugccaagcugcacaccaagacgggccucaaaaaguuucuggaguauguucagcuugggaccucugacaaaguggcgcggcugcucgauaagggacuggaccccaacuaccaugauuccgacagcggcgaaacaccucugacccucgccgcucagacagagggcuccgucgaagugauucgcacccugugucuugggggagcccacaucgacuucagagcucgggauggcaugacggcccugcacaaagcggccugcgcucgccauugucucgcccugacagcccuucucgaccucgggggaucucccaauuauaaggauagacggggccugacaccccuguuucacaccgcuaugguugggggagacccuagaugcugugagcuccugcuuuucaaccgcgcccagcugggcauugcugaugagaauggcuggcaagaaauccaucaggcgugccagcgggggcacagccaacaccucgagcaucugcucuuuuacggagccgaacccggcgcucagaacgccuccgggaauaccgcccugcacaucugugcucucuacaacaaggagaccugcgcccgcauucugcuguaucgcggagcggacaaagaugugaagaauaacaauggccagacaccuuuccaggucgcugugaucgccgggaacuuugaacucggcgagcugauucggaaucauagagagcaagacgugguccccuuccaggaaagccccaaauacgccgcucgccggagaggaccuccgggcacggggcuuaccguucccccugcccugcuccgcgcuaacucugauacauccauggcccugcccgacuggaugguguucagcgcgccuggagccgcuucuagcggcgcccccgggccgaccuccggaucucagggccagagccaaccuuccgcucccacaaccaagcugagcucugggacgcuucgguccgccagcucuccuagaggcgcgcgcgcccggucccccagcagaggacggcacccugaggaugcuaaacgccagcccagaggccggccguccucuagcgggacaccuagagaaggacccgccggcgggaccggaggcuccgggggccccggaggcucucucgggagccgcggacggagacgcaagcuguauuccgcugugccuggcagauccuuuauggccgucaaaucuuaccaggcccaggcugagggggaaaucucccugagcaagggagagaagauuaaagugcucucuaucggcgaagggggcuucugggaaggacaaguuaagggccggguggggugguuuccguccgacugucuggaggaagucgcgaaccgcagccaggagucuaaacaggagagcagauccgacaaggccaaacggcuuuuccgccauuauaccgugggaagcuacgauucuuuugacgcucccucccugauggauggcauugggccuggaagcgacuauaucaucaaggaaaagacaguucuccugcagaaaaaggauuccgagggcuucggcuuugugcugagaggggccaaagcccaaacccccauugaagaguucacaccuacgcccgcuuuuccugcccuucaguaccucgaaucugucgacgagggaggcguggcguggcgggcugggcugcgcaugggagauuuccugaucgaggucaauggccagaacgugguuaagguggggcacagacaagucgugaauaugauucggcagggaggcaacacccucaugguuaaaguggucauggugacacgccaccccgacauggaugaagccgugcauaagaaggccccgcagcaggcuaaaagacugccucccccuaccaucagccuucgguccaagucuaugacaagcgagcuggaagagauggaauacgagcaacagcccgccccgguuccuuccauggagaaaaagagaaccgucuaucagauggcgcucaauaaacuggacgaaauucuggcugccgcccagcaaacgaucucugcuagcgagucccccggcccugggggacuugccagccucggcaagcaccgccccaagggguuuuucgcuaccgaaucuuccuuugauccccaucaccgggcccagccuagcuacgagagaccgucuuuccugcccccuggacccggccugaugcuccgccagaaauccaucggggcggccgaagacgaucggccuuaucuggcucccccugccaugaaguucagcagaucucuuuccgugccgggaagcgaggacauucccccucccccuacaaccagcccucccgagccucccuacagcacaccucccgugcccucuagcuccggccgccugacccccucuccgcggggcgggcccuuuaacccuggaagcggcgggccccucccugcuuccucucccgccagcuucgacggaccguccccucccgauacgagagucggcucucgcgagaaaucccuguaucacuccgggccucugcccccugcccaucaccaucccccgcaccaucaccaccaucacgcuccuccgccccagccucaucaccaucacgcgcacccgccccauccucccgagauggaaacaggaggcagcccugacgaucccccuccgcggcuugcccucggcccccaaccuucucugagaggguggcggggaggcgggcccuccccuacccccggagcuccgagcccuucucaccauggcuccgccgggggaggcggcgggagcucccagggacccgcccugcgcuacuuucagcugcccccuagagcugccucugcggcuauguaugugcccgcccggagcggccgcgggagaaagggaccucucguuaaacaaacaaagguggagggcgagccgcagaaagggggaggccuucccccugcccccuccccuaccagccccgcuucuccgcagccucccccugccgucgcggcucccuccgaaaagaauagcaucccuauucccaccaucauuaucaaggccccgucuacaagcuccucuggccggagcucccaggggucuagcacggaggccgaaccucccacccaacccgagccuacaggaggcgggggaggcgggggauccagcccgucucccgcuccugccaugucccccgugccucccagcccuucccccguuccgaccccugcuucucccagcggcccugccacacuggacuucaccucccaguuuggcgcggcccucgugggggcugccagacgcgaaggaggcuggcagaacgaggcucggagacgcucuacgcuguuccugagcacagaugccggggacgaggauggaggcgacgggggccuuggaaccggcgccgcucccgggccgcggcugagacacuccaaaagcaucgaugaaggaauguuuucugcggagccuuaccuccgccuggaauccgccggcagcggggcuggauacggcggguauggcgccggaucucgggccuacggcgggggaggcggguccagcgcuuucaccucuuuucugccgcccagaccucugguccacccccuuacaggaaaggcccuggacccugcgagcccgcucggccuggcucuggccgcccgcgagagagcucuuaaagaauccucugaagggggcggagcgccccagccucccccucggcccccuagcccgcgcuaugaggcgcccccucccaccccucaucaccauagcccccacgcccaucacgaaccggugcugagacucuggggcgcuagcccucccgaucccgcccggcgcgagcugggguacagagcuggacucggcucccaagaaaagucucugccugccucucccccugcugcccggagaucccuucugcaccgccucccgcccacagcgccugggguuggaccccugcugcuucagcugggcacggagccucccgccccgcauccuggcguguccaaacccuggcggagcgcugccccugaggagcccgagagacucccgcugcacguccgcuuccucgaaaauugccagccucgggcucccgugaccuccgggagaggacccccuucugaggacggccccggggugccuccgcccagcccucggcgcuccgugcccccuagccccacaucuccuagagccuccgaagagaacggacugccgcuucugguucugcccccucccgccccuagcguggauguggaggacggcgaauuucucuucgucgagccccugccgccuccccuugaauuuucuaauuccuucgagaagcccgaaagcccucugacccccgggccuccgcauccccucccugacacacccgcuccugcgacaccccugccgccugugcccccucccgccguugcugccgccccucccacgcucgauucuaccgcuuccagccugacauccuaugacagcgagguggccacccuuacacagggagcgucugccgcuccgggcgauccccacccucccggcccuccggcccccgcugccccugcgcccgccgcuccucaacccgggccugaucccccgccuggaaccgacagcggcauugaggaagucgacucccggucuagcuccgaucacccccuggagacaaucucuagcgccuccacccugucuagccucuccgcugaagggggaggcagcgccgggggaggcggcggggcuggagccggcguggcgucugggccugagcugcuugacacguacguugccuaucuggauggacaggcuuucggcggguccagcacacccggaccgccuuauccgccccagcucaugaccccuucuaagcugcgcggcagagcccucggcgcuuccgggggacugcggcccggcccuagcgggggacuucgcgacccggugacccccacauccccuaccgucucugugacgggcgccgggacagauggacugcuggcccucagagcgugcagcggacccccuaccgcuggcguugccgggggacccguggcugucgaaccggaggugccucccgugccucugcccacagccuccagccuuccucggaaacugcuccccugggaggaaggcccggggcccccucccccuccccugccuggaccgcucgcccagccccaggcuucugcccuggcgaccgucaaggccuccauuaucagcgagcuuucuagcaaacugcagcaguuuggcggguccucugcugccggaggcgcucugccuugggcccgcggcgggagcggaggcgggggagacucccaucacggcggggcgucuuacguucccgaaagaacaagcucccuccaacggcagagacugagcgacgauucucaguccagccuucuguccaagccugugucuagccucuuccagaacuggcccaaaccgccucugcccccucugcccaccggaacgggcguguccccgaccgccgcugccgcuccuggcgccacaucucccagcgcuuccagcucuagcaccagcacacgccaucuccaaggggucgaguuugaaaugcggcccccucuucugagacgcgcccccucuccuucccugcucccggcgagcgagcacaaggugucucccgccccucggcccuccagccugccuauucuucccucuggaccucuguauccgggccucuucgacaucagagggagccccaccggaggcgcugggggcuccgccgauccuuuugcucccguuuucgugccuccccauccgggaauuagcggcgggcugggaggcgcccuguccggggccucucgcagccucucccccacgcggcuucugucucugccucccgacaagccuuuuggagcgaaaccccucggcuucuggacaaaguuugaugucgcugacuggcuggaguggcuugggcuggccgaacacagagcccaguuccucgaucacgagaucgacggcagccaucugccugcucugaccaaagaagauuacguggaccucggaguuacacgcgugggccaccggaugaauaucgauagagcccuuaaguuuuuccuggagcgcuga

SEQ ID NO: 75522 - RNA, 5550 nt, Artificial Sequence
  derived and/or modified sequence opt5 from SHANK2__Homo_sapiens__NP_036441
augcccagauccccuaccuccucugaggacgaaauggcccagagcuucuccgauuacucugugggcagcgaguccgacucuagcaaggaagagaccaucuaugauacgauucgggcuaccgccgaaaaacccgggggagcgcgcaccgaggagucccaaggcaacacccucgugaucagaguugugauucacgaccuccagcagacaaagugcauccgguuuaaucccgaugcuaccgugugggucgccaaacagcgcauucuguguacacuuacccaaagccugaaggacgugcucaacuacgggcuguuccagccugccucuaauggaagagauggcaaauuucuugacgaagaacggcugcuccgcgaauauccccagccuguuggggagggagugcccucccuggaguucagauacaagaagcgggucuauaaacaggcuagccuggaugaaaagcaacucgccaaacugcauacgaagaccaaccuuaaaaagugcauggaccacauccagcaucgccugguggagaagaucacaaaaaugcucgauagaggccuggacccuaauuuucacgauccggaaaccggcgagacaccccuuacccuggcugcccagcucgacgacucuguugaagugauuaaggcgcugaaaaacgggggagcccaucuggauuuccgggcuaaggacggcaugacggcccuccacaaagcugcccgcgcgagaaaucaggucgcccugaagacacuucuggagcucggggcuuccccugauuacaaagacagcuauggacugacaccgcuuuaccacacagccaucgugggcggggauccuuacuguugcgagcugcuccugcaugaacacgcuaccguguguugcaaggacgagaacggauggcaugaaauucaccaagccugucgguauggccacguccagcaucuggagcaccuccuguuuuacggcgccgauaugucugcucagaaugcguccgggaacaccgcccuucauaucugcgcucuguauaaucaagacagcugugcccgcguucuccuguucagaggaggcaacaaggaacuuaaaaauuacaacucccagacacccuuucagguggccauuaucgcugggaauuucgagcuggccgaguauauuaagaaccacaaagaaacggauaucgugccguuucgggaggcgccugcuuacucuaacagacgccggagacccccuaauacccucgccgcccccagaguccugcugcggagcaacuccgacaauaaccucaaugcuagcgcccccgauugggcugugugcucuacagccaccucccauagaagccugucuccucagcuucugcaacagaugccgagcaagcccgaaggagcggccaaaacaaucggcuccuauguuccugggccccgcucucggagcccuucccucaacagacugggaggcgcuggcgaggacgggaagcgcccccagccgcuguggcacgugggaagcccuuucgcccuuggcgcuaauaaggacucucucuccgccuuugaauaccccgggccuaaacggaagcuguacagcgcgguccccggaagacuguucguggccguuaaaccuuaucagccccaaguggauggcgagauuccgcuccaccgcggggaccgggucaaggugcugucuaucggcgagggaggcuucugggaaggguccgcuagaggacauauuggcugguuuccugccgagugugucgaagaggugcagugcaaaccccgggauagccaggcugagacccgcgccgacagauccaagaaacuuuuccggcacuacacgguugggucuuaugauagcuuugacacauccucugauugcaucauugaagagaaaaccgugguccugcagaagaaagacaacgaaggauucggcuuugugcucagaggggccaaggcugauacccccaucgaggaguucacaccuaccccggcguuucccgcccugcaauaccuggagagcguugacgagggcggaguggcuuggcaggccggccuucgcacaggggauuuccucaucgaagucaauaacgagaauguggugaaaguuggacaucggcaggucgugaacaugauuagacagggcgggaaucaccuggugcugaaggucgugacgguuacccgcaaccucgacccugaugacacagccagaaagaaagcucccccucccccuaagcgggcccccaccacagcgcugacccuucgcuccaaaagcaugacgucugaacuggaggaacucguggacaaggcuuccguccgcaagaagaaagauaagccggaggagaucgugccugccagcaagcccucucgggccgcugaaaauauggccguugagccucgcguggcgaccauuaaacaaagacccuccagccgguguuuuccggcuggaucugacaugaacagcgucuaugaacgccagggcaucgccgugaugacaccuaccguucccggguccccuaaggcccccuuccugggcauucccagaggaacaaugcggcgccagaaaagcaucgauucuagaaucuuucuguccggcauuaccgaggaggaacggcaauuccuugcuccuccgaugcucaaguuuacgagaagccuguccaugcccgacacaucugaggauaucccucccccuccccagagcgugccuccgucucccccucccccuagccccaccacauacaacugcccgaaaagcccuacaccccgcgucuaugggaccauuaagcccgccuucaaucagaacuccgcugccaaggugucuccugcgacacggagcgacacgguggccaccaugaugagagaaaaaggaauguacuuccgccgggagcuggauagauacucccucgacagcgaagaucuguauucucgcaaugcuggcccccaggccaacuuucggaauaagagagggcaaaugccugagaacccguacuccgaggucggaaaaaucgcuagcaaggccguuuaugugcccgccaaaccugcucgccggaagggcaugcuugugaagcagucuaaugucgaagacucccccgagaaaacauguagcauuccuauccccaccauuaucgugaaggaaccgucuacauccagcuccgggaaaagcucucagggcagcuccauggagaucgauccucaggcgcccgaaccucccucucaacugagaccugacgagagccucaccguuuccucucccuucgccgcugccauugccggagcugugcgggaucgcgagaagagacuggaagcccggcgcaacagcccggcguuucuguccacggaccuuggcgacgaggaugucgggcucggaccucccgcucccagaacacggccuucuauguucccggaagagggcgacuuugccgaugaagacagcgccgagcagcuguccagccccaugccuucugcuacccccagagagccugaaaaucacuucgucgggggagccgaggcguccgcucccggcgaagccggccgcccucugaacagcaccucuaaagcccaggggccggaguccagccccgcuguuccuuccgccucuagcggaacagcuggccccgggaauuacgugcauccucucaccggacggcugcuugaucccuccagcccgcuggcccucgcgcugucugccagagaccgcgcuaugaaggaaucccagcaaggcccuaagggggaggcccccaaagcugaucugaacaagccccuuuauaucgacacaaaaaugcggccuagccuggaugccggauuucccacggucaccagacagaauacacgcggcccucuccggagacaggagaccgaaaacaaguacgagacagaccugggccgcgauagaaaaggggacgacaagaaaaauaugcucauugauaucauggacaccucucaacaaaagagcgccggacugcuuauggugcacacgguugaugcuaccaagcuggacaacgcgcuccaggaagaggaugagaaagccgaaguggagaugaagccggacuccucucccagcgaagucccugagggcguguccgaaacagagggggcucugcagauuucugccgcccccgagccuaccacagugcccggacggaccaucgucgcuguuggcagcauggaagaggccgugauccugccguuccgcauuccucccccuccccuugcguccguggaucuggacgaagauuuuaucuucacagagccucugcccccgccucuggaauuugcuaacagcuucgacauucccgaugacagagccgccucuguccccgcucucuccgaucuggugaaacagaagaaaagcgacaccccucaguccccgucucuuaauagcucccagcccacgaacucugccgacagcaagaagccugcgucccugagcaauugccuccccgccucuuuucugccucccccugaguccuucgaugcuguugccgacagcgggaucgaggaaguggauucucgguccagcucugaccaucaccuggagacaaccagcaccauuuccacagucucuagcaucuccacccuuagcuccgaaggaggcgagaacguggauacguguacaguuuaugcugacggccaggccuucaugguggauaaacccccggucccucccaagccuaaaaugaagcccaucauucauaaaucuaaugcucuguaccaagacgcccucguggaagaggaugucgacagcuuugugaucccgccucccgcgcccccucccccuccgggguccgcccagcccggaauggcuaagguucugcagccucgcaccucuaagcucuggggcgaugugacagagauuaaaagccccauccuguccgggccuaaggccaacgucauuucugaacuuaauagcauccugcagcaaaugaacagagagaaacuggcuaagcccggagaaggccucgacuccccuaugggggccaaaagcgccucucuggcuccgcggucccccgagaucaugagcaccauuucuggaacaagauccaccacggugaccuucacaguucgcccuggcaccagccagcccaucacacuucagucucggccucccgauuacgaguccagaaccagcggcacgcgccgggcgccguccccuguggucagccccacagaaaugaauaaggagacccugcccgccccucucucugcugccacagccagccccuccccugcucugucugacguguuuagccucccgucccagcccccuucuggggaccuguucggacuuaaccccgccggcagaagccgguccccuucucccagcauucugcaacagccgaucuccaauaagccuuuuaccaccaaacccgugcaccuguggacaaagccugauguugcggacuggcucgaaagccugaaccuuggggagcacaaagaagccuucauggauaaugagauugacggaucucaucugcccaaccuccagaaggaggaucugaucgaccucggcgucacgcgcguggggcacagaaugaauauugaacgggcucugaaacaacuucuggaucgcuga

SEQ ID NO: 75523 - RNA, 5196 nt, Artificial Sequence
  derived and/or modified sequence opt5 from SHANK3__Homo_sapiens__NP_277052
auggacggccccggggccagcgcuguggucguucgggugggaaucccugaucugcagcaaaccaagugccuccggcuggaccccgccgcgcccgugugggcugccaagcagcgcguccuuugugcccugaaccacucccuccaggaugcucugaauuacggccuuuuccagccucccucuagagggcgggccggaaaguuucuggacgaggaacgccuccugcaagaguauccucccaaccuggauaccccucuccccuaccuggaguucagauauaagcggcgcguguacgcucagaaucuuaucgacgauaagcaguuugccaaacugcauacgaaggccaaccucaagaaauucauggacuauguucagcugcacagcaccgauaagguggccagacuucuggacaaaggccucgaucccaauuuucaugacccugauuccggggagugcccccugucucuggcugcccaacucgacaacgcuacagaccugcuuaagguccugaaaaauggaggcgcccaccucgauuuccggacccgcgacggccugacagccgugcauugugccaccagacagcggaacgcugccgcucuuacaacccugcucgaucugggggccagcccugacuacaaggauucccgcggacugacgccccucuaucacucugcccugggcgggggagacgcucuuugcugugaacugcuccugcacgaucaugcgcagcuuggcaucaccgacgagaauggguggcaggagauucaccaagccugcagauuuggacauguucagcaccuggaacaccuccuguucuacggcgcugauaugggcgcccagaacgccagcgggaauacagcucugcauaucugugcccucuacaaccaagaguccugcgcgcgggugcugcuuuuucgcggagcuaauagagacguccggaacuauaauagccagaccgccuuccagguggccauuaucgcuggcaacuuugaacuggccgaggugaucaagacacacaaagauucugacgucguucccuucagagagaccccuuccuacgcuaagcgccggagacucgccgggcccagcggacuggcgucuccucgcccccugcagcgguccgccagcgacauuaaccuuaaaggcgaagcucaacccgccgcuucuccugggccgucccucagaagccugccccaucagcugcuccugcagcgccuucaggaggaaaaggaucgggacagagaugccgaccaagaguccaauaucucuggaccucuggcgggccgcgccggccagagcaaaauuucccccagcgggccuggaggccccgggccggcuccuggacccggcccugcgcccccugcucccccggccccuccgccccgggggccuaagagaaaacucuauucugccgugccgggccgcaaguuuaucgcugugaaggcgcacagcccccagggagaaggcgagauuccucugcauagaggggaagccgucaaagugcugagcaucggagaaggcggguucugggagggaacgguuaagggcagaacagggugguuccccgcugauuguguggaagagguccagaugcggcaacacgacacccgcccugaaacaagagaggaucggaccaaaagacuuuuucgccacuacaccgugggcucuuaugacagccucacaucccauucugauuacguuauugacgauaagguggccguccugcagaaacgggaccacgagggauucggcuuugugcugagaggggccaaggcugaaacgcccaucgaggaguucaccccuacacccgccuuuccggcgcuccaguaucuggagagcgucgauguggaaggaguugcuuggcgcgccggccuuagaaccggggacuuccugaucgaggugaacggagucaaugugguuaaggugggccauaaacaggucguggcccucauucggcaagggggcaaccgccuggugaugaagguugucuccgugacaagaaaaccugaggaagacggagcucggcgcagagcgcccccucccccgaagcgggcgccuagcaccacgcugacacuucgcucuaaauccaugaccgcugagcucgaagaacuggccagcaucagacggcgcaagggcgagaagcuggaugaaaugcucgccgcugccgcugagcccacccugagaccugacauugccgaugcggacucucgggccgcuacagugaaacagagacccaccucccgccggaucacacccgccgaaauuagcucccuuuuugagagacaggggcugccuggaccggaaaagcuccccggcucucugcgcaaagggaucccucggacgaaguccgucggagaggaugagaaacuggcuucccuucucgaaggcagauucccccgcucuaccagcaugcaagacccugugcgggaggggagaggcauucccccuccgccccagacagccccucccccucccccggccccuuacuacuuugauuccggaccgcccccugcuuucucucccccuccgcccccuggccgcgcguaugacaccguucgguccuccuuuaagcccgggcuggaagccagacugggagcuggcgccgccgggcucuacgagccuggagcugcccugggcccccuuccguauccugaacggcagaagcgcgcgagaagcaugauuauccugcaggauucugcucccgaguccggcgacgccccucggcccccucccgccgcuacaccgccugagcgccccaaaagacggcccagaccuccggggcccgauagcccuuacgccaaucucggagcguucucugcuagccuguuugcccccuccaagccucaacgccggaaaagcccccuggugaagcagcuucaggucgaagacgcccaggagagagcugcccuggcugugggcucuccugggccgggaggcggguccuucgcccgcgaacccagcccuacccaccggggacccagaccuggcggccucgauuauggggcgggagacggccccgggcuggccuucggaggcccggggccugcuaaagaccgccggcucgaggaaagacgcagauccacgguuuuucugucugugggagccauugagggcagcgcucccggcgccgaucuucccucccugcaaccuucucggagcaucgacgagcgccuccuggggaccggacccacagccggcagagaucugcuucugccuuccccggucucugcucucaagccccuggugagcgggccuucccucggacccagcggcucuaccuucauucacccucugacagggaaaccccuugacccguccagcccucuggcgcucgcccuggcugcccgggaacgcgcccuggcuucucaggcccccuccagaagcccuacccccguucauucuccugaugcggaccggcccggaccgcuuuuuguggauguccaggcuagagacccugagcgcggcucccuggccagccccgccuucagcccccggagcccugcuuggaucccggugcccgccagacgcgaagcggagaaggugccucgggaggaaagaaagucucccgaggauaaaaagagcaugauccucuccguccuggacacgucucuccagcggccugccggccugauuguugugcacgcuacaagcaacgggcaagaacccucccgccuuggaggcgccgaggaagagagaccugggacccccgagcuggcuccggccccuaugcagucugcugccguggcggaaccccugccuagcccccgggcccagccgccuggaggcacacccgcugaugccgggcccggacaaggcuccucugaggaggaaccugaacucgucuuugcugugaaucugcccccugcccagcuuagcuccagcgacgaggagacccgcgaggaacuggccagaaucggccucguuccgcccccugaagaguucgcuaacggggugcugcucgcgacaccccuggccggaccuggccccucuccuacaacggucccgucccccgcuagcgggaaaccuucuuccgaacccccucccgccccggagagcgccgcugacuccggaguggaggaagccgauacccggucuagcuccgacccucaucuugagacaaccagcacaauuucuaccguuuccagcaugucuacgcugagcuccgaaucuggcgagcugacagauacccacaccagcuuugcggacgggcauacauuccuccuggagaagccgcccgugccucccaaaccuaaacuuaaguccccgcugggaaaaggccccgucaccuuucgcgauccucuccugaagcagucuagcgacuccgaacucauggcccagcaacaccacgcugccagcgcuggccuggccucugcggccgggcccgcuagaccucgguaccuuuuccagcgcagauccaaacuguggggagaucccguggagagccggggccugccggggccugaagacgauaagcccacaguuaucuccgagcucucuagcagacugcagcagcuuaauaaagacacgcgcucccugggagaggaaccugugggcgggcucggaucucugcucgaucccgccaaaaagagcccgauugcugccgcucggcuguuuuccagccuuggcgagcugucuuccaucagcgcccaaagaucuccuggcgggcccggaggcggggcguccuauagcguccgccccucuggacgguacccuguggccagacgcgcucccagcccugugaaaccggccucccuggaacgggucgagggccucggggcuggcgccggaggcgccgggagacccuucggacugaccccucccacaauucuuaagucuagcucccugagcaucccucaugaacccaaagagguucgcuuuguggugcgguccgucucugcgagaagccgcuccccuucuccgagcccccucccuucccccgcuucuggcccugggcccggagccccgggcccucggagacccuuccagcagaagccccugcagcuguggagcaaauucgacgugggggauuggcucgaauccauccaccuuggcgagcaucgcgacagauuugaggaccacgaaauugagggagcucaucugccugcccugaccaaggaugacuucguugaacucggcgugacacgggucgggcaccgcaugaacaucgagagagcccugcggcaacuugauggaagcuga

SEQ ID NO: 75524 - RNA, 1164 nt, Artificial Sequence
  derived and/or modified sequence opt5 from SHARPIN__Homo_sapiens__NP_112236
auggcucccccugccggcggggccgcggcugccgccagcgaccugggauccgcugccgugcuccuggcuguccacgccgcgguuagaccgcuuggcgccgggcccgaugcugaggcccagcugcggcgccuccaacugucugcugacccugaaagacccggacgguuccgccuugagcugcucggcgccgggccuggagcggugaaccuggaauggccccuggagagcguguccuacaccaucagaggcccuacacagcaugaacuccagccgcccccuggcgggcccggaacgcugucucuucacuuucugaauccucaggaggcccaacggugggcuguccucgugcgcggcgccaccguugaggggcagaacggaagcaaguccaauucucccccggcucugggcccugaagccugccccgugagccuuccuuccccucccgaggccagcacacugaaagggcccccgcccgaagcugaucucccuagaucucccggaaaccugaccgagcgggaggaacuggcgggcucccucgcccgcgcuauugccggcggggacgagaagggagccgcucaggucgccgcggugcuggcucagcauagaguugcccuuagcgugcaacugcaggaagccuguuucccucccggcccgauccggcuccaggucacacuggaggaugcugccucugcugccuccgcggccagcucugcucacguggcccuucaggugcauccucacugcaccgucgcugcccugcaagaacagguuuucuccgagcucggguuucccccugcggugcagcgcugggugauuggaagaugucugugcguccccgagcggagccuggccuccuauggcgugcgccaagacggggauccugcuuuucucuaccugcuuucugcccccagagaagcuccggccacaggaccuagcccccagcacccccagaaaauggacggcgagcugggcagacucuucccuccgucccuggggcuucccccuggaccccagccugccgcuagcucucugcccuccccucuccaacccagcuggucuuguccgagcugcaccuuuaucaaugcgccugaucggcccggcugugaaaugugcuccacgcagcgcccuuguaccugggacccccuggccgcugccucuacauga

SEQ ID NO: 75525 - RNA, 1155 nt, Artificial Sequence
  derived and/or modified sequence opt5 from SHBG__Homo_sapiens__NP_001139751
auggagagcagaggcccccuggccaccucccggcuccugcuucugcuccugcuucugcuccugcgccacacaagacaggggugggcucugcggccugugcucccgacgcaaucugcccaugaucccccugcgguccaccugagcaacggacccggccaggaaccuaucgcuguuaugaccuucgaccuuacaaagauuaccaaaacauccucuagcuuugaggugcgcaccugggaccccgaaggggugaucuucuacggagauacaaauccuaaggacgauugguuuaugcugggccucagagacgggcggccggagauucagcugcauaaccacugggcccagcuuaccgucggagccggcccccgccuggaugacggcagauggcaucaaguggaaguuaaaauggagggggauuccgugcuccuggaggucgacggagaagaggugcugcggcuccgccagguuucuggcccucugacgagcaagagacaccccaucaugcggauugcucuugggggacuccucuucccugccuccaaucugcgccuucccgcugaaaucagcgccucugcgccgaccucccugagaagcugcgauguggagucuaacccuggcaucuuucugcccccugggacacaggccgaguucaaucugcgggacauuccccagccccacgcugaaccuugggccuuuucccuggaucucggacugaaacaagcugccggcagcggccaucuucuggcgcucgggaccccggagaaccccucuuggcugucccuucaccuccaggaccagaaggucgugcucagcuccggaucuggcccugggcuggaccugccccucgugcugggacuuccucugcagcucaagcugagcaugucccgcgucguucugagccaaggcucuaaaaugaaggcccuugcucugcccccgcuggggcuggccccucuccugaaucuuugggcuaaaccccagggaagacuguuccucggcgcccugccuggcgaagauuccagcacaucuuuuugucugaacgggcuuugggcccagggacaacggcucgacguggaucaggcucugaauagaagccaugagaucuggacccacuccugcccccagucuccuggcaacgggacggacgcgagccacuga

SEQ ID NO: 75526 - RNA, 1530 nt, Artificial Sequence
  derived and/or modified sequence opt5 from SHB__Homo_sapiens__NP_003019
auggccaaguggcugaacaaauacuucagccucggcaauuccaagaccaaaucucccccucagccgcccagaccugacuaucgggagcagcgcagacggggagaacgccccagccagccuccccaggcugugccucaggccuccucugcggcuagcgccuccugcggaccggccacagcuucuuguuuuagcgccuccagcggcucucugcccgaugacuccgggagcacgucugaucuuaucagagcuuaccgggcccaaaaggagcgcgacuucgaagauccuuauaacggacccggcuccagccugagaaaacuccgggcgaugugccgccuggacuacugugggggaucuggcgagccuggcgggguccagagagccuuuuccgcuagcuccgccucuggagcugccggcugcuguugcgcgagcuccggggccggagcugccgcuuccucuuccagcucuagcggcagcccccaccuuuaucggucuagcuccgaacgcagaccggccaccccugccgagguucgguacauuagccccaagcaucgccugaucaagguggagucugcugcgggaggaggcgccggcgauccucucgggggagcuugugccggcgggagaacauggucccccaccgccugcggaggcaaaaagcugcugaauaaaugugcugccagcgcggcugaagagucuggggccggaaagaaagacaaggugacaauugccgaugacuauuccgaucccuucgacgcuaagaacgaucucaaaagcaaggccggcaaaggcgaauccgcuggguacauggagccuuacgaggcccagcggaucaugaccgaauuucagagacaagagucuguccgcagccagcacaaggggauucagcuguaugacacaccguacgaacccgagggccaguccguggacucugauagcgaauccaccguuagcccucggcuuagagagucuaaacugccccaagacgaugaccgcccugcggaugaguaugaccagcccugggaauggaaucgggugacgaucccggcccucgcugcccaguucaacgggaaugagaagagacaauccagcccuucucccucccgcgaucggagacgccagcugcgggcuccuggaggcggguuuaaacccaucaagcauggcagcccugaguucugcgggauucuuggcgaaagagucgaccccgccgugccgcuggaaaagcagaucugguaccacggggcgauuucucgcggagaugccgagaaccuccugcggcuguguaaagagugcagcuaucucguuagaaauucccagaccagcaagcaugacuacucucugucccuucggagcaaccaaggcuuuaugcacaugaaacuggcuaagacaaaagaaaaguaugugcucgggcaaaauuccccucccuucgauucuguccccgaggugauccacuacuacaccacacgcaagcugccuauuaaaggagccgaacaucuuagccugcucuauccgguggcugucagaacccuguga

SEQ ID NO: 75527 - RNA, 1755 nt, Artificial Sequence
  derived and/or modified sequence opt5 from SHC1__Homo_sapiens__NP_001123512
auggaccugcugcccccuaagccgaaauacaacccccugagaaaugagagccuuuccucucuggaagagggcgccagcggguccaccccucccgaggagcucccuucucccagcgcuuccucucugggaccuauccuuccgccccugccuggcgaugacagccccacaacgcucugcuccuucuuuccucggaugagcaaccugcgccuggccaaucccgcgggcggaagaccgggcucuaagggggaaccuggacgggcugccgaugacggcgagggcauugugggggccgcuaugcccgauuccggaccucucccccugcuucaggacaugaacaaacugagcggcgggggaggccgcagaacccgggucgaagggggacaacucggcggcgaagaguggacacgccacgggucuuucguuaauaagcccaccagaggauggcugcauccuaacgauaaagugaugggcccggggguguccuaucuuguccgguacaugggauguguggaaguucugcagagcaugcgcgcccucgacuuuaauacaagaacccaggugacacgggaggcuaucucucuggucugcgaggccgugcccggcgcgaagggggccacccgcagacggaagccuuguucccgcccccugagcuccauucucggaagaucuaaccugaaauucgcuggcaugccuaucacgcuuaccguuagcacauccagccugaaucucauggccgcugauugcaagcagauuaucgccaaccaccauaugcaaucuaucuccuuugcgagcggcggggaccccgauaccgccgaauauguggcuuacgucgccaaagacccggugaaucagcgggcuugucacauucuggagugcccugaaggacuugcccaggaugugaucucuacaauuggccaggccuucgagcugagauuuaagcaauaucuccgcaaucccccuaaacuggucacgccccaugaccggauggcuggguucgacggaagcgcgugggaugaagaggaggaggaaccucccgaccaccaguacuauaacgauuuuccgggcaaggaaccuccccucgggggcguuguggacaugagacuccgcgagggagccgcucccggcgccgcccggccuaccgcuccgaacgcccagacacccucccaccugggggcgacccuuccugugggacagcccgucggcggggauccugaagugagaaagcaaaugcccccucccccgccuugucccgcuggacgcgagcuguucgacgauccuucuuacguuaaugugcagaaccucgacaaagcccggcaggccgucggcggggcugggcccccgaacccugccaucaauggaagcgcucccagagaucuguuugacaugaagccuuucgaggaugcccuucgcgugcccccucccccgcaauccguuagcauggcggaacagcugcggggcgagcccugguuucaugggaaacucucuagacgcgaagccgaggcucugcugcagcucaacggagacuuccuggugcgggaauccacaaccaccccuggccaguacguccuuacagggcugcaaagcggacagcccaagcaccuccugcugguggacccugagggcgucgugagaacgaaagaucaucgguucgagucuguuucccaccuuauuagcuaucacauggacaaucaucuccccaucauuuccgccgggucugaacugugccugcagcagccuguggagcgcaagcucuga

SEQ ID NO: 75528 - RNA, 1749 nt, Artificial Sequence
  derived and/or modified sequence opt5 from SHC2__Homo_sapiens__NP_036567
augacccagggccccgggggacgggccccuccggcucccccugcgcccccugagcccgaagccccuacaacguucugcgcucugcucccgagaaugccccaauggaaguuugccgccccuggcggguuccugggacgcggccccgcugccgcuagagccgcgggggccagcggaggcgcugacccucagcccgagccggccggcccugggggagugcccgcucuugccgcggccguccugggcgcuugugaaccucggugcgccgcucccuguccccucccugcccugucccgcugcagaggggccggaucucggggcagccgcgggggaagaggcgcugcgggcuccggggaugccgcugccgccgcugaguggauccggaaaggaucuuuuauucacaagccggcccauggcuggcuucaccccgacgcgcgcguucuggggccuggagugagcuacguggucagauauaugggcuguaucgaagugcuccgguccaugcgcucucuggauuucaacaccagaacacagguuacccgggaggcuauuaaucgccugcaugaggccgugcccggggucagaggaagcuggaaaaagaaagccccuaacaaggcucucgccuccgugcugggcaagagcaaucuucgguuugcuggcaugucuaucuccauucacaucagcacagacgggcugucucucuccguucccgccaccagacaggugaucgcgaaccaucacaugccgagcauuucuuucgccuccggaggcgauacagacaugaccgauuacgucgcuuauguggccaaagacccuaucaaucaacgcgcuugccacauucuggaauguugcgaggggcuugcccagagcaucauuuccacggugggacaggcguuugaacugcgguucaagcaguaccuccauucucccccuaaagucgcccugcccccugagagacuggcuggccccgaggaaagcgccuggggcgaugaggaagacucccucgagcacaacuauuacaauagcaucccggggaaggaaccuccccugggaggccuuguugauucucgccuggcucucacccaacccugugcccugacagcccuugaccaggggccuuccccgagccugcgggaugcuugcucucuccccugggacgugggaagcaccggcacagcgccucccggggacggauaugugcaggccgaugcuagaggcccucccgaccaugaggagcaccuguacgucaacacccaggggcuggaugccccugaacccgaggacuccccgaaaaaggaucucuuugacaugcgcccuuucgaagaugcccugaagcugcacgaguguucuguggcugccggcguuacggcggcuccccugccucucgaagaccaauggcccagcccgccuacacggagagcccccguggccccuaccgaggagcagcugcgccaggaacccugguaccauggacggauguccagacgcgcugccgagcggaugcuuagagcggauggcgacuuucugguccgggauagcgugacaaaucccgggcaauauguucucaccggaaugcacgcuggccagccuaaacaucugcugcucguggacccggaaggggucgugcgcaccaaggacguccuguucgagucuauuucccaccuuaucgaucaucaccuucagaacggacagcccaucguggccgccgaaagcgagcuccaccugagaggcguugugucucgggagccuuga

SEQ ID NO: 75529 - RNA, 1785 nt, Artificial Sequence
  derived and/or modified sequence opt5 from SHC3__Homo_sapiens__NP_058544
augcugcccagaaccaaguacaaccgguuccgcaaugacagcgugacauccgucgaugaccuccugcacucucuuagcguuuccggcgggggaggcaaagugucugccgcuagagccacgccugcggcugccccguaucuggugagcggggaggcccuccggaaggcucccgaugacggaccuggcucccuggggcaucuucugcacaaagucucucaucucaagcugagcuccagcggacugcgcggccucucuuccgccgcuagagaacgggccggcgcgcgccugagcgggucuugcuccgcccccagccuugcugccccugauggaucugcucccuccgccccuagagcgccggccaugagcgcugcccggaaaggccgccccggggacgagccucugcccagaccuccccggggagcuccgcacgccuccgaucaggugcucggcccugggguuaccuacguggucaaguaucugggauguaucgaagugcuucgcucuaugagaagccuggacuuuuccacacggacccaaauuacacgcgaggccaucagcagaguuugcgaagcugugcccggcgcgaagggcgccuucaaaaagcggaaaccucccucuaagaugcucuccagcauucuggggaaaucuaaccugcaguuugcuggaaugagcaucucccucaccauuucuacagccagccugaaucuuagaacccccgauuccaagcagaucaucgccaaccaucacaugcgcagcauuucuuucgcuuccggcggggacccugauacgaccgacuacgucgccuauguggcgaaggauccggugaaucggagagcuugucacauccuggagugcugugacggacucgcccaggacgucauuggcagcaucgggcaagccuuugagcugcgcuucaaacaguaccuucagugccccacaaagauuccugcucugcaugaucggaugcagucucucgacgaacccuggaccgaggaagagggagauggcuccgaccacccuuauuacaacagcauccccuccaaaaugccgccucccggcggguuucuggauacaagacugaagccucgcccccaugccccugacaccgcucaauucgccggaaaagagcagacguacuaucagggccggcaccucggggauacauuuggagaagacuggcagcaaacaccccugagacagggcucuagcgauauuuacuccaccccggaggggaaacuucacguugcgccuaccggcgaagcccccaccuaugugaauacacagcaaauucccccucaggcuuggccggccgcugugucuagcgccgaguccagcccccgcaaggaccuguucgauaugaagccuuuugaagacgcgcucaagaaccagccccugggaccuguccuuucuaaagccgcuuccguggaguguaucagccccguuucuccucgggcccccgacgcuaagaugcuggaggaacuccaggccgagacgugguaccaaggcgaaauguccagaaaagaggccgaagggcugcuggagaaggauggagacuuccucgugcgcaaaagcaccacaaauccgggcucuuuuguccugaccgggaugcauaacggacaggcuaagcaccuucugcucguggauccugagggcacaauccggaccaaggacagaguuuucgauagcaucucccaucugauuaaucaccaucuggaaagcucucuucccaucguguccgcggggagcgagcucugccugcagcagccugucgaacggaaacaauga

SEQ ID NO: 75530 - RNA, 1893 nt, Artificial Sequence
  derived and/or modified sequence opt5 from SHC4__Homo_sapiens__NP_976224
augagagagcggggccaggacagccuggccgggcucgugcuguacgucggacuuuucggccaccccgggaugcugcaucgcgcuaaguauuccagauuucggaacgaaucuaucaccagccucgaugagggauccucuggcgggagcguuggaaauaaaggcuccccucaaccgccccacccugcccuggcgccccaucuuccuacagaagacgcuacgcugcccucucaggagagcccuaccccgcucugcacacugauuccccgcauggccuccaugaagcuggccaacccugcuacccuccugagccuuaaaaauuucugucugggcacaaaggaagugcccagacucaaacugcaggagucucgggauccuggguccagcggacccucuuccccggagaccagccuuucucgcuccggcacagccccucccccucagcaagaccugguggggcacagagcuaccgcccucacgcccgauagcugcccccugccuggaccgggcgaacccacccugcggucccgccaggacagacauuuucuccagcaucugcuugggaugggaaugaacuacuguguccgguauaugggcugcguggagguucugcagucuaugcgcagccucgauuucggcaugagaacacaagugacccgggaagcgaucucccgccugugugaggccgucccuggggcuaauggagccauuaagaagagaaaacccccugugaaguuucuuagcacaguucugggcaaaucuaaccuccaguucuccgggaugaauaucaagcugaccauuagcacgugcucucugacacucaugaaccuggacaaucagcagaucaucgcuaaccaccacaugcaaagcauuuccuuugccucuggaggcgaucccgacaccacagauuacguggcguaugucgccaaagacccggugaaucagcgggcuugucacauccuugagugccauaacgggauggcccaggaugugauuagcaccaucggacaggcuuucgaacugagauuuaagcaguaccucaagaauccuucccugaacaccagcugugagucugaagagguccacauugacucccacgccgaggaacgcgaggaccaugaauauuacaaugagauccccggcaaacagccucccguuggcggggugagcgauaugcggauuaaggugcaggccacagaacaaauggcuuacugcccuauccagugugagaaacuuugcuaucugcccggaaacucuaagugcuccagcgucuacgaaaacugucucgagcaguccagagcgaucggcaaugugcacccgcgcgggguucagucucaacgggacacgagccugcugaaacauaccugcagaguggaucucuucgacgauccuuguuauauuaacacacaggcccugcaguccacccccggaucugcuggcaaucagcgcagcgcccaaccccuuggguccccuuggcacugcggcaaggccccggagacaguccagcccggagcuaccgcccagccugcgagcucucauucccugccccacaucaaacagcaacucuggagcgaagaguguuaccacggcaagcugucucggaaggcugccgaaucccugcuugugaaagacggggauuuucucguuagagagagcgccacgucuccuggacaguaugugcugagcggccugcaagggggacaagcuaagcaucuccugcuugucgaccccgaaggcaaagugcgcacaaaggaucacgucuucgacaacguggggcaucugauucgguaccacauggauaauucccucccuaucauuagcucuggcuccgagguuagccugaaacagcccgugagaaaggacaacaauccggcccugcuucacuccaacaaguga

SEQ ID NO: 75531 - RNA, 2019 nt, Artificial Sequence
  derived and/or modified sequence opt5 from SHCBP1__Homo_sapiens__NP_079021
auggccgacggcagccugaccgggggaggccucgaggcugccgcgauggcucccgaaagaacagggugggccguggagcaggaacuggccucccuugagaagggacuguuccaagaugaagacucuugcagcgauuguuccuaccgggacaaaccuggcucuagccuccaguccuuuaugccggaggggaagacguucuuucccgagaucuuccagaccaaccagcugcuguuuuaugaacgcuucagagcuuaccaagauuauauucuugccgacugcaaggcuucugagguccaggaauuuacagccgaguuccucgagaagguucuggaaccuagcggauggcgggcgguguggcacaccaauguguuuaaaguccugguggagaucacagauguugacuucgccgcucucaaggccgugguccgccuggcugaacccuaccuuugugauucccaggugagcaccuuuacaauggagugcaugaaggaacugcucgaccugaaagagcauagacuuccucugcaggagcucuggguuguguucgaugacucuggcgucuuugaucaaaccgcccuggcgauugaacacgugcgguucuucuaucagaacaucuggcgcuccugggacgaggaagaggaagacgaguacgauuauuuugugagaugugucgagccccggcugcgccuccauuacgacauucuggaagauagaguuccuagcggccuuaucguggacuaccacaaucugcucucucagugcgaggaauccuaucggaaguuccugaaccuucgcagcucucuguccaauuguaacagcgauuccgagcaggaaaauaucucuaugguggaggggcucaaacuguacagcgagauggaacaacugaagcagaaacucaagcugauugagaacccgcuucugagauaugucuuuggauaccagaaaaauuccaacauccaagccaaaggcgugcggagcucugggcagaagauuacgcauguuguguccagcaccaugauggcuggacuccugcgcucucuucugacagacagacucugccaggaacccggcgaggaggaacgggagauccaguuccacagcgauccucuguccgccauuaaugcuuguuuugaaggggacaccgucaucgugugccccggacacuauguugugcauggcacauucucuauugccgauagcaucgagcuggaaggcuacgggcucccugacgauaucgucauugagaaaagaggaaagggcgacaccuuuguggacuguacgggggccgauaucaaaauuuccggaaucaaguucguccaacacgacgcuguggagggcauucugaucguucaucgcgggaaaacaacccuugaaaacugcgugcugcagugcgagacaaccggagucaccgugcggacaagcgcggaauuucucaugaaaaauucugaucuguauggcgccaagggcgcugggaucgagauuuaccccggaucccaguguacgcugagcgacaacggcauccaccacugcaaggaagggauucuuaucaaggauuuccucgacgagcauuacgauauuccgaaaaucucuaugguuaauaacaucauucacaacaaugagggauauggcgugguccuggugaagccuaccaucuuuuccgaccugcaggaaaacgccgaggaugggacagaagagaauaaagcccucaagauucaaaccagcggcgaacccgacguggcugagagaguugaucuggaggaacuuaucgagugugccacaggaaagauggaacugugcgcgcgcaccgacccuuccgagcaggucgagggcaacugugaaauugugaaugagcucaucgcugccucuacgcagaaagggcagauuaagaaaaagcggcugagcgaacugggaaucacacaagccgaugacaaccuuaugucccaggagauguucgugggcaucgucgggaaucaguuuaaauggaacggaaagggcucuuucgggaccuuccucuuuuga

SEQ ID NO: 75532 - RNA, 1326 nt, Artificial Sequence
  derived and/or modified sequence opt5 from SHF__Homo_sapiens__NP_001288097
augcugcucagcggcgcucccccugcuggguccagaccgggaccccggacccagggcucugccgggggaggcccugggggaagccgcagaggcgcgggcggggcuggagccggccccgggggaggcggguccggaggcguggccaaguggcugcgggagcaccuuggcuuccgcgggggaggcgggggaggcgggggaucuaaaccugcucccccugaaccggacuacagacccccugcccccagcccugcugcgcccccggccccucccccugauauccuggccgcuuaucggcuccaacgcgagagagacuuugaagaucccuacuccggcggcucuagcggguccgccgcucuggccacacccgucgcgccuggaccgacgcccccuccccggcauggcagcccuccccaccgccuuauuagaguugagaccccggggccucccgccccucccgcugacgaacggaucucuggaccucccgccuccagcgaucgccuggcuauucucgaggacuaugccgauccguucgacgugcaggagacaggcgaagggucugccggcgcuuccggagcgccugagaaggugcccgaaaacgauggcuacauggagcccuaugaggcccagaaaaugauggcugaaaucagagggagcaaggagaccgccacacagccucugccgcuguacgacacccccuaugaaccugaggaagauggagccacacccgagggcgagggggcuccuuggccccgggaaucucgccucccugaggacgaugaaagacccccggaggaauacgaccaaccuugggaguggaaaaaggagcggauuuccaaggccuuugcggcucaguucgaaggacccgagaaaagcugccuguccccuggcagagaagagaaggggcgccuucccccgcggcugucugccggcaauccuaaaagcgccaagccccucuccauggaaccuagcucuccccugggagaguggaccgaccccgcccuuccucuggagaaccaggucugguaccauggcgccaucuccagaacggaugcugaaaaucuccugcgccuguguaaagaggccagcuaucucgugcggaacucugaaaccagcaagaaugacuuuucccugucucuuaagagcucccagggguucaugcacaugaaacugagcagaacaaaggagcauaaauacguucucggacaaaacucuccgcccuuuuccagcgugccugagaucguccaccacuaugcgucucgcaagcugcccauuaaaggcgccgaacauaugucccuucuguacccuguggcuauccggacccucuga

SEQ ID NO: 75533 - RNA, 213 nt, Artificial Sequence
  derived and/or modified sequence opt5 from SHFM1__Homo_sapiens__NP_006295
augagcgagaagaaacagcccguggaccugggccuccuggaagaggaugacgaguucgaagaauuuccugccgaggauugggcugggcuugacgaggaugaagacgcccacgucugggaggauaacugggacgaugacaauguugaagaugacuucuccaaccaacugagagcggagcucgagaagcauggauacaaaauggaaaccucuuga

SEQ ID NO: 75534 - RNA, 1389 nt, Artificial Sequence
  derived and/or modified sequence opt5 from SHH__Homo_sapiens__NP_000184
augcugcuccuggccagaugccuucugcucgugcuggucagcucccuucugguuuguucuggccucgcuugcgggcccggacggggcuucgggaagcgcagacacccuaaaaagcugaccccgcuggccuacaaacaguuuauccccaacguggcggagaagacacucggagcuagcggccgguaugaagggaaaauuucccgcaauucugagagauucaaggaacugacgccuaacuacaaucccgacaucauuuuuaaggaugaggaaaacaccggagccgaccggcuuaugacacaacgcuguaaagauaagcugaaugcccucgcuaucagcgugaugaaccaguggccuggcgucaaacugagagugaccgagggcugggacgaggaugggcaucacuccgaagagucucuucauuaugaaggacgggccguugacauuacaaccagcgaucgcgacagauccaaguacggcaugcuggcucggcucgccguggaggcgggguucgauugggucuauuacgagagcaaagcccacauccauugcucugugaaggcugaaaauuccguugccgcuaagagcggaggcuguuuucccgggucugccacagugcaccuggagcagggaggcaccaaacuggucaaggaccucuccccuggcgaucgcgugcuggcggccgacgaucaggggagacuucuguauagcgacuuccucacguuucuggaccgggaugacggagcuaaaaagguguucuacgucaucgaaacccgcgagccgagagaacggcuucugcucacagccgcucaucugcuguuuguugcuccccacaacgauucugccaccggcgagccugaggccuccagcggguccggacccccuucuggcggggcgcucggacccagagcccuguucgcuagccgcgugcggccgggccaaagaguguacgucguggccgaacgcgacggcgaucggagacuucugccugccgcuguucacuccgugacacucagcgaggaagccgcgggggcuuaugcuccccugaccgcccagggaacgauucuuaucaaucgcguccuggccucuugcuacgccgugauugaggaacauuccugggcucaccgggccuuugcgccuuucagacucgcccacgcucugcuggccgcucucgcccccgcgcgcacagaccggggcggggauagcggaggcggggacagaggcggaggcgggggacgcguugcccugaccgcucccggcgccgcugaugccccuggggccggagcuacagcgggcauccauugguauucucagcuucuguaccagauugggaccuggcuccuggacagcgaggcccugcacccgcuuggcauggcugugaaauccucuuga

SEQ ID NO: 75535 - RNA, 888 nt, Artificial Sequence
  derived and/or modified sequence opt5 from SHISA2__Homo_sapiens__NP_001007539
auguggggcgccagacggagcuccgugucuagcuccuggaacgcugccucucugcuccagcugcuucuggcggcucuccuggccgccggggcucgcgccagcggagaguacugccacggcuggcuugacgcucaaggggucuggagaaucggauuccagugucccgaacgguuugauggcggggacgccaccauuugcuguggauccugcgcgcugcgcuauuguugcucuagcgccgaggcuagacucgaucagggcggcugugacaaugaucggcagcaaggggccggagaaccuggccgcgcugacaaggaugggccggacggauccgccguucccaucuacgugccuuuccugauugugggcagcgucuuuguggcguucaucauucuggggucucucguugccgcuugcuguugcagaugucugcggcccaaacaggauccucagcagucccgcgcccccggaggcaacagacuuauggagacaaucccuaugaucccgagcgcuucuacgucccggggcucuagcucccgccaaagcuccaccgccgccucuagcuccagcucugcuaauuccggggcgagagcucccccuacacggagccagaccaacugcugccugcccgaaggaacaaugaauaacguguaugucaauaugccuaccaacuuuucugugcucaauugucagcaggccacacaaauuguuccccaucagggccaguaccugcacccgccuuaugugggguacaccguccaacaugacagcgugcccaugacggccgugccucccuucauggauggacuucagcccggcuaucgccagauccaguccccuuuuccgcacaccaacucugagcaaaagauguaccccgccgucacaguuuga

SEQ ID NO: 75536 - RNA, 717 nt, Artificial Sequence
  derived and/or modified sequence opt5 from SHISA3__Homo_sapiens__NP_001073974
augagagcccugcucgcucugugccuucugcucggcuggcugcggugggggcccgccggagcgcagcaaagcggcgaguacugucacggguggguggacguccagggaaacuaucaugaaggcuuccagugcccugaggauuuugacacccuugaugcuacaaucuguugcggguccugugcccugcgcuacugcugugccgcugccgacgcuagacucgaacagggaggcugcacgaaugaucggcgcgagcuggaacacccgggcauuaccgcccaacccguuuaugugccuuuccugaucguggggucuauuuuuaucgcguucauuauccucggaagcgucguggccaucuacuguugcacaugucugagacccaaggagccuucccagcagcccauucgguuuucucuucgcagcuaucagaccgagacacugccuaugauccucaccuccacaucuccgagagcucccagccggcaauccagcaccgccacgucuuccagcucuaccggcggguccauucgcagauucagcuuugcucgggccgaaccuggaugccugguucccucuccucccccgccuuacacaaccucccauagcauccaccuugcgcagcccuccggcuuccuggugucuccucaguauuuugccuacccccuccagcaagagcccccucugccggggaaaagcugccccgacuucuccagcucuuga

SEQ ID NO: 75537 - RNA, 1503 nt, Artificial Sequence
  derived and/or modified sequence opt5 from SHISA6__Homo_sapiens__NP_001166932
auggcccugagacggcuccugcuucugcuccugcuuagccuggagucccucgaccugcugcccucugugcacggcgcucgcgggagagccgcgaaccggacccucagcgcuggaggcgccgccgucgggggacgcagagcuggcggggcccuggcucggggaggccgcgaacuuaauggcacagccagagcgccugggaucccggaggccggaucccggcgcggccagcccgcugccgcuguugccgcggccgcuucugccgcugugacguacgaaaccugcuggggguauuacgaugugagcggacaauaugacaaggaguucgaauguaacaauuccgagucuggcuaccuguauugcugugggacaugcuacuauagauuuuguugcaaaaagcggcaugagaaacucgaucagcgccaguguaccaacuaccagagcccugucugggugcaaacacccuccaccaagguugugagcccuggacccgaaaauaaauacgacccugagaaggauaagacaaacuucaccgucuauauuacgugcggcgugaucgccuuuguuauuguggccggcgucuucgcuaaagugucuuacgacaaggcgcacagaccgccccgggaaaugaauauccaucgcgcccuggcugauauucuuagacagcaggggccuauccccaucgcccacugugagcgggagaccauuuccgccaucgacacaagcccuaaagaaaacacccccgugagaucuuccagcaagaaucauuauacaccgguccgcaccgcuaaacagacgccugagaagccccggaugaacaauauucugacaucugccaccgaaccuuacgaucucuccuuuagcagauccuuccaaaaccuggcgcaucugccucccucuuaugagagcgcuguuaagacaaaucccuccaaauacagcucucucaagcgccugaccgacaaagaagccgaugaguauuacaugcggagacgccaccuuccggaccuggccgcucggggaacccucccccugaacgugauccagaugucccagcagaagccucuucccagagagcgcccucggagacccauucgcgccaugagccaagaucgggugcugucuccggacagaggccucccugacgaauuuagcaugcccuacgaucggauccuguccgacgagcagcugcucucuacagaacgccugcacagccaggauccucuucugucccccgagagaacggcuuucccugaacaaagccucucucgggccauuucccacaccgacgucuuugugagcacacccguucuggauagauaucgcaugucuaaaaugcauucccacccgagcgcguccaauaacucuuacgccacccuugggcagagccagacagcugccaagcggcacgcuuucgccuccagacgccauaacaccguggagcagcugcacuauaucccuggacaucacacgugcuacacagcgucuaaaaccgaggucaccguguga

SEQ ID NO: 75538 - RNA, 1275 nt, Artificial Sequence
  derived and/or modified sequence opt5 from SHISA9__Homo_sapiens__NP_001138676
augagacgggugcugcgccuccugcuuggcugcuuccugaccgagcucugugccagagucugccgggcucaggaacgcgccgggcacggacaacuggcgcagcuuggcgggguucugcuccuggcuggaggcaacagaagcggggccgccuccggagaggcuucugaaggcgccgaggcuagcgacgcgcccccuacacgggccccgacgcccgauuuuugucgcggcuacuucgacgugauggggcagugggauccucccuuuaauugcuccucuggagacuucaucuuuuguugcggcaccuguggguucagauuuugcuguacauucaagaaacggcgccugaaccagucuaccugcacaaauuaugauaccccucucuggcugaacacaggaaagcccccugccagaaaagacgauccgcuucaugaccccaccaaggauaaaacgaaucugauuguguacaucauuuguggcgucguggcuguuauggugcucgucgggaucuuuaccaagcugggacuugaaaaggcccaccggccucaacgcgagcauauguccagagcucuggccgacgugaugcggccccagggccacugcaacacagaucauauggagcgcgaccucaauauuguugugcacguccagcacuaugaaaacauggauaccagaacaccuaucaauaaccugcaugcgacccagaugaauaacgccgugcccacgucuccgcugcuccaacagaugggccacccucauagcuaccccaaucuggggcagaucuccaacccuuaugagcagcaaccucccggaaaagaacuuaauaaguacgcuagccugaaagccgugggcagcuccgacggggacugggcugucagcacacucaagucucccaaagccgauaagguuaacgacgauuucuauaccaagcggagacaccuggccgagcuugcugcgaaaggaaaccugccgcuccaccccgugcgcguggaggacgaaccucgggccuuuucccccgagcauggcccugcuaagcagaaugggcagaaaagcagaacaaacaagaugcccccgcacccucuggccuacaccucuaccacaaauuucaaaggaugggaucccaacgaacaaucccugcgccggcaggccuacagcaauaagggcaaacucggcacggcugagaccggguccucugacccucugggaacaagaccccagcauuauccucccccgcagccuuacuuuauuaccaacagcaagacagaagucaccguguga

SEQ ID NO: 75539 - RNA, 1038 nt, Artificial Sequence
  derived and/or modified sequence opt5 from SHMT1__Homo_sapiens__NP_001268715
augggccuggaccuccccgaugggggacaccugacccauggcuucaugacagacaagaaaaagaucagcgccacguccauuuucuucgagucuaugccuuacaaagugaacccggauaccggguauaucaauuacgaccagcuugaagagaacgcuagacuguuucaccccaagcucauuaucgccggaacaagcugcuauucccggaaucuggaauacgcgcgccuuagaaaaauugcugaugagaacggcgccuaucugauggccgacauggcucauaucucugggcucgucgccgcuggaguugugccuagccccuucgaacacugucauguggucaccacaaccacacacaagacccugcggggcugccgcgccggcaugaucuuuuacagaaagggggugaaauccguugauccuaagacgggaaaagagauucuguauaaucucgagucucugaucaacagcgcgguguuccccggccuucaagggggaccucacaaucaugccauugcuggcgucgccguggcucugaagcaggccaugacccucgaauuuaaaguuuaccagcaccagguggucgcgaacugucgggcccuguccgaggcucuuacagaacugggguacaagaucgugaccggaggcagcgacaaucaucucauucugguggaucugcgcucuaagggcacagacgggggcagagccgagaaaguccucgaggcuugcuccaucgccuguaacaagaauaccugcccgggagaucggagcgcccugcgccccucugggcuuagacugggaacgccugcucucacaucccggggccugcuugaaaaagacuuccaaaagguugcgcacuuuauucaccgcgggaucgagcugacccuccagauccagagcgauacaggagugagagccacccugaaagaauuuaaggagcggcuggcuggcgacaaauaucaggccgccgugcaagcucuccgcgaagaggucgagucuuuugccucccuguucccccuuccuggccugcccgacuuuuga

SEQ ID NO: 75540 - RNA, 1485 nt, Artificial Sequence
  derived and/or modified sequence opt5 from SHMT2__Homo_sapiens__NP_001159828
augcuguacuucagccucuuuugggccgcuagaccccugcagcggugcggccaacuugugcgcauggccaucagagcgcagcacuccaacgcugcccagacccagacaggggaggccaaucggggauggacgggccaagaaucucugagcgacuccgauccugagaugugggaacuccugcagcgcgagaaggacagacagugucgggggcuugaacugauugcuucugagaacuucugcagccgcgccgcucucgaggcccugggauccugucugaauaacaaauauucugaaggcuacccggggaagagauauuacggaggcgcggaggucguugaugaaaucgagcuccugugccagcggcgcgcccuugaggcuuuugaccuggaucccgcccaauggggcgugaaugugcagccuuauagcgggucccccgcuaaccucgccgucuacaccgcgcugcuucagccucaugacagaauuaugggacuggaucuccccgacggcgggcaccugacacauggauauaugagcgaugugaaacggaucucugccaccuccauuuucuuugaaagcaugccuuacaagcugaaucucgcucugacagcccgccuuuucagaccgcggcugaucaucgcuggcaccucugccuacgcccgccucauugacuaugcuagaaugcgggagguuugugaugaagugaaagcgcaucugcuugccgacauggcucacaucuccgggcuggucgccgccaaggugauucccagcccuuuuaagcacgcugauaucguuacaaccacgacccacaaaacacucagaggagcccgcucuggccugauuuucuaccggaagggcgugaaagcggucgaccccaagaccgggagagagaucccuuauacauuugaagaccgcauuaacuucgcuguguuucccucccugcagggaggcccgcauaaucacgccaucgccgcuguggccgucgcucucaaacaagccugcaccccuauguuccgggaguacagccugcagguucuuaagaacgcgagagccauggcugaugcccugcucgagcgcggguauucccuggugucuggaggcacggacaaucaucuugugcuggucgaucuccggcccaaggggcuggacggagcuagagccgaacgcgugcuggagcucguuagcaucacagcgaacaaaaauaccuguccuggcgaucgguccgccauuacacccggcgggcugagacuuggagcucccgcccugaccagccgccaguuucgggaagacgauuucagacggguggucgacuucaucgaugagggcgugaacauugggcucgaaguuaagucuaaaaccgcuaagcugcaagacuuuaaauccuuccugcuuaaggauagcgagacaucucagcgccucgccaaucugagacagcggguggagcaguuugccagagcuuucccuaugccgggauuugacgaacacuga

SEQ ID NO: 75541 - RNA, 1611 nt, Artificial Sequence
  derived and/or modified sequence opt5 from SHOC2__Homo_sapiens__NP_001255968
augagcuccucucugggcaaggagaaagacagcaaggaaaaagaucccaaggugccuuccgccaaagagagagaaaaggaggcuaaggccucugggggauucggcaaagaaagcaaggagaaagagccgaagaccaaagggaaggacgcgaaggauggaaagaaggacuccucugcugcccagcccggcgucgccuuuagcguugauaacacaaucaaacggccuaaucccgcuccugggacgcgcaagaaauccagcaacgccgaagugauuaaggagcucaauaaaugcagagaagagaacucuaugcggcuggaccuuuccaagcgcagcauccacauucugcccucuuccaucaaggagcucacccaacugacagaacuuuaccuguauagcaauaaacuccagucucugccugcugaggugggaugucuggucaaccucaugacccuggcccuuuccgaaaauagccugacaucccucccggauucucuggacaaccuuaagaaacugagaaugcucgaucugcggcauaauaagcugcgcgagauucccagcgugguuuacagacucgacucccugaccacacuuuaucugcgguucaaccgcaucaccacgguggaaaaagauaucaagaaucucagcaagcugucuaugcuuuccauuagagagaacaaaaucaagcagcugccugcggagauuggcaaucucagcucucugagccggcugggccuccgcuacaacagacuguccgccaucccccggucucuugcuaaaugcagcgcccuggaggaacucaaucuggaaaacaacaauauuuccacccuuccugagagccugcucucuucccuggucaagcugaacagccucacacuggcucgcaauuguuuucagcuuuaucccguugggggaccgucucaauucuccaccaucuacagccugaacauggaacacaauagaauuaacaaaaucccuuuuggcaucuucucccgggccaaggugcucucuaagcugaauaugaaagacaaccagcugacaagccuuccccucgauuuugggaccuggacguccaugguggagcugaaucuggcgacaaaccagcucaccaagauuccugaggacgucucuggacuggugagccuugaagugcugauccucuccaauaaccugcugaaaaagcugccccauggccucgggaaucugagaaaacugcgcgagcucgaccuggaagagaacaaacuugaaagccugcccaaugagauugccuaucucaaggaucugcagaaacugguccuuacaaacaaccaacucaccacccugccucggggaaucggccaccugacaaaucucacgcaucugggccuuggggagaaccugcucacccaccuuccggaagagauuggaacacuggaaaaucuugaggagcucuaccugaacgacaaucccaaccugcacucucucccuuucgaacuggcucuuugcuccaagcugagcaucaugucuaucgagaauuguccccucucccaucugccuccccagauuguugccggcgggccgagcuuuaucauucaguuccugaaaaugcagggaccuuacagagcuaugguguga

SEQ ID NO: 75542 - RNA, 960 nt, Artificial Sequence
  derived and/or modified sequence opt5 from SHOX2__Homo_sapiens__NP_001157150
auggaggaacugaccgccuucgugagcaaguccuuugaccagaaagucaaggagaaaaaggaagcuaucacauacagagagguucucgaaucuggcccccugcgcggggccaaagagccuacgggaugcaccgaggcgggccgggaugacagaagcuccccggcugugcgggccgccgggggaggcgggggaggcggcgggggaggcgggggaggcgggggaggcggcggggugggaggcgggggagcuggcgggggagccggcggcgggcgcucucccgucagagaacuugauaugggagcugccgagcggagccgcgaaccuggcucccccagacugacagaggugucuccugagcucaaggaccggaaggaagaugcgaaagggauggaggacgaaggacaaaccaagauuaaacagcgcagaagccggacaaacuucacccuggagcagcuuaaugaacuggagcgccucuuugaugagacacacuaucccgacgccuucaugagagaggaacugucccagcggcugggccucagcgaagcucgcguucaagugugguuucagaacagacgggccaaguguagaaaacaggagaaucagcugcauaaggggguccuuaucggcgcugccucucaauucgaagcgugccgcguggccccuuacguuaacgugggagcucugcggaugccguuucagcagguccaggcccaacuccagcuggauuccgcuguggcccacgcccaucaccaucuucacccccaccuggcugcgcaugccccuuauaugauguuccccgcuccucccuuuggccucccgcuggccacccuggccgcugacagcgccucugcggcuuccguggucgccgccgcugccgcugccaagacgaccagcaaaaauucuuccauugcggaucucagacugaaggccaaaaagcacgcugccgcucuugggcuguga

SEQ ID NO: 75543 - RNA, 879 nt, Artificial Sequence
  derived and/or modified sequence opt5 from SHOX__Homo_sapiens__NP_000442
auggaggaacugaccgccuucgugagcaaguccuuugaccagaaaucuaaggauggcaacgggggaggcgggggaggcgggggaaagaaggacagcaucacauacagagagguccucgaauccggccuggcucggucucgcgagcuuggcacgagcgauuccucucugcaagacauuaccgaagggggaggccacugccccguucaucucuucaaagaucacguggacaaugauaaggagaagcugaaagaguuugggacagccagaguggcggaaggaaucuaugaguguaaggaaaaacgggaggacgucaagagcgaggaugaagacggccagaccaaacuuaagcagcgcagaucccggacaaacuucacccuggagcagcucaaugaacuggagcgccuguuugaugaaacacauuacccugacgcuuucaugagagaggagcucagccaacggcuggggcuuucugaagcccgcgugcagguuugguuucagaacagacgggccaagugccgcaaacaggagaaucaaaugcacaagggagugauucugggcaccgcuaaccaucucgaugccuguagagucgcuccguaugugaauaugggcgcccugcggaugcccuuccagcagguucaggcgcaacuucagcuggaagggguggcccacgcucacccucaucuccacccccaucuggccgcucacgccccuuaccugauguuucccccuccgcccuucggacucccuaucgcgucccuggccgagagcgcuucugccgcugccgucguggccgcugcggccaaauccaacagcaaaaauucuuccauugcugaccuucgccugaaagccagaaagcacgccgaagcucucggccuguga

SEQ ID NO: 75544 - RNA, 1437 nt, Artificial Sequence
  derived and/or modified sequence opt5 from SHPK__Homo_sapiens__NP_037408
auggccgcuagacccaucacccugggcauugaccucgggacaacgagcgugaaggccgcgcugcuucgggcugccccugaugacccguccggauucgccguccuggcuucuugcgcccgcgcugccagagcggaggccgcuguugaaagcgccguggcuggcccccaggggcgggagcaagaugugucccgcauccuccaggcccugcacgaaugucuugcggcccugccuagaccccagcuccggucugucgugggaauuggcguuagcgggcagaugcauggaguggucuuuuggaaaaccggccaaggcugcgaguggacagaagggggaaucaccccuguguucgagccccgcgcuguuucccaccuggugacauggcaggacggcagauguucuagcgaguuucuggccucccucccucagcccaagagccaucugucugucgcuaccggguucggaugcgccacaauuuucuggcuucugaaauaccggccggaauuucucaaguccuaugaugccgcuggcaccauccacgacuacgugguggcgaugcugugugggcuuccucgcccccugaugagcgaucagaacgccgcuucuuggggauauuuuaauacgcaaucccagagcuggaacgucgagacccucagaucuuccggcuucccuguucaucugcugcccgacaucgccgaaccgggcagcguggccgggcggacaucccacaugugguuugagauuccuaaaggaacccaggugggcgucgcucucggggaucugcaggccucuguguacagcugcauggcgcaacgcacagacgcuguucuuaauaucuccaccagcgugcagcuggccgccucuaugcccuccggauuccagccugcucaaacgcccgaucccacagccccugucgcuuauuuuccguacuucaacagaaccuaucucggcguggccgcgagccugaaugggggaaacguucuugccacauuugugcacaugcugguccaguggauggcugaccucggccuggagguggaagagucuaccgucuacagccggaugauucaggccgcugugcagcaacgcgauacccaucugacaaucacgcccaccguucucggcgaaagacaucugccugaccagcuugccuccgugacacggauuucuagcuccgaccugagccucgggcacgucaccagagcgcugugucgcggaaucgugcagaaucuucacucuaugcugcccauucagcaacuccaggaguggggcguugaacgggugaugggguccggaagcgcccugucuagaaacgauguccugaagcaggaggugcagcgcgcuuucccucuccccauguccuucggccaagacguggaugccgcuguuggggccgcccuggucaugcuucggagacaccugaaucagaaggagagcuga

SEQ ID NO: 75545 - RNA, 5052 nt, Artificial Sequence
  derived and/or modified sequence opt5 from SHPRH__Homo_sapiens__NP_001036148
augagcuccagacggaagcgcgcccccccugugagagucgacgaggaaaaacggcagcaacugcacuggaacaugcaugaggaucgcagaaaugaaccgaucauuaucucugacgaugacgagcagcccugcccuggcagcgauaccuccucugcucacuacauuauccucagcgacucccugaaggaagagguugcccaucgggauaaaaagcgcuguucuaaaguggugagcuucuccaagcccauugagaaggaagagacagucgggaucuuuagcccucuuucugugaaacugaacaucguuauuucccccuaucacuucgacaauagcuggaaggcguuucucggagaacugacgcuucagcugcucccugcucagucucugaucgagaacuucuccgagagaagcauuacccugaugucuuccgaaagcuccaaucaauuucucaucuacgugcauucuaaaggcgaggaugucgaaaagcagaaaaaggagccgaugagcauuugcgacaaggggauccugguggaauccagcuucucuggagagaugcuugaggaucugggcuggcuccagaaaaagcggcgcauuaaacuguaucagaagcccgaagggaaccacaucaucaaaguuggaauuuaccuucuggaggccggccucgccaagcuggacuuucuguccgaugcuaauagcagaaugaaaaaguucaaccaacucaugaagaaagugauggaaaagcugcacaauucuaucauuccugacguccuugaggaagacgaggaugaccccgagagcgaaccugagggccaggauaucgacgaacuguaucauuuugugaaacagacacaccagcaagagacccaguccauucagguggauguccaacaucccgcccucaucccgguucugcggccuuaccagcgcgaagcugugaacuggaugcuucagcaggaguguuucagaucuagccccgccacagaguccgcgcugcacuuucucuggcgggaaaucgugaccagcgaggggcugaagcuguauuacaauccuuacacaggaugcauuauccgcgaauaucccaacucuggcccccaacuccuggggggaauucuugccgacgagaugggccuggggaaaaccgucgaggugcucgcucugauccuuacgcacaccagacaggauguuaagcaggacgcccugacacucccugaaggaaagguggucaauuacuucauuccgucccauuauuuuggcggcaaacugaagaaaaccgagauccagaacaucgaauucgagcccaaggaaaaagugcaauguccucccacacggguuaugauucugaccgcugugaaggagaugaaugggaagaaaggagucagcauccucucuauuuacaaguauguguccagcaucuacagauaugauguccagcgcaaccggucccugcuuaaaagaaugcugaagugccucauuuucgagggccuggugaaacagaucaaggggcacggauuuucuggcacguucacacuggggaagaacuacaaagaagaggacauuugugauaagaccaaaaagcaggccguuggaagcccucgcaaaauccaaaaggaaacacggaaauccggcaauaaggacaccgacucugaguaccuucccagcgauaccuccgacgaugacgaugacccguauuacuauuacuauaagagcagacgcaaccggucuaaacucagaaagaaacuggugccuuccacaaagaaaggcaagagccagcccuuuaucaauccugauucucaggggcauugccccgcgacguccgacagcggaauuaccgaugucgccaugucuaagagcacauguaucuccgaauucaaccaggagcacgagaccgaagacugcgcugagagccugaaucaugccgauucugacgugccucccuccaacacaaugagcccguuuaauaccuccgauuaccgcuucgaauguauuugcggcgagcucgaccaaaucgaccggaaaccuagaguucagugccugaagugucaccuuuggcagcacgcuaaaugcgugaacuaugaugaaaagaaucugaaaauuaagcccuuuuacuguccccauugccucgucgccauggagccugugucuacgcgcgccacacugaucaucagcccguccucuauuugucaccaauggguggacgagaucaaccggcauguuagaagcuccucucugcggguccuuguguaccagggggugaagaaagauggauuccuccagccccacuuucuggcugaacaggacauugucaucauuaccuaugaugugcugcgcagcgagcucaauuacguugacaucccucacuccaacagcgaagauggcagacggcugagaaaucaaaagcgcuauauggcgauccccucuccucuuguggccgucgagugguggcggauuugccuggacgaggcucagaugguggaaugucccaccguuaaagccgccgagauggcucagagacucuccgggaucaaccgcuggugcauuagcggcacaccugugcagagaggacuggaagaucuguucggccuugucguguuucucgggaucgagcccuacuguguuaagcauuggugggugcggcugcuguaucgcccguacugcaaaaagaauccucaacaccucuauucuuucauugccaagauccuguggagauccgcgaaaaaggacgucaucgaucagauucagauccccccucagaccgaagagauucauuggcuucacuuuagccccguggagcggcauuucuaccaccgccaacacgaaguguguugccaggacgucguugugaaacugagaaagaucucugauugggcucucaaacuguccagccuggaccggcgcacagugacguccauucuuuacccgcuccugagacugcggcaggccugcugucauccucaagccguccgcggagaguuccucccccugcagaagagcaccaugacaauggaagagcuucugaccucucuccagaaaaagugcggcacagaaugugaggaggcucacagacagcuggugugcgcccugaacgggcuugcuggaauccauauuaucaagggcgaauaugcccuggcggccgagcucuaccgggaaguucugagaagcuccgaggaacacaaagggaagcucaaaaccgacucucugcaacgccuucaugcuacgcacaaccugauggagcuccugaucgcccggcacccuggcauuccccccacccugagagauggacgccuugaggaagaggcuaagcagcugcgggaacauuauaugagcaaauguaauacagagguggccgaggcgcagcaggcccucuacccuguccaacagaccauccacgaacugcagagaaagauucauuccaacucuccgugguggcucaaugugauccaccgcgcuauugaguuuacaaucgacgaagagcugguucagcgggugagaaacgaaaucaccagcaauuauaagcaacagacgggcaaacuuuccaugucugagaaguuccgcgauugccgggggcugcaguuucuccugacaacccagauggaggaacugaacaaaugucaaaagcuugucagagaggccgugaaaaaucuggaaggacccccuagccggaacguuauugaguccgcuacagugugccaccuccgccccgccagacugccucucaauuguugcgucuucuguaaggccgacgaacuguuuaccgaguacgagagcaagcuuuucucuaacaccgugaaaggccagacagcuaucuuugaagagaugauugaagaugaggaagggcugguggacgaucgggcgcccacgaccacacgcggacugugggccaucuccgagaccgagagaagcaugaaggcuauucucucuuucgccaaaucccaucgguuugacgucgaauucguugaugagggcagcacauccauggaccuguuugaagccuggaagaaagaguauaagcuucugcacgaguacuggauggcucucagaaaucgcgugucugccguggaugaacuggcgauggcuaccgagcggcucagaguccgcgacccucgggaaccgaagcccaacccucccgugcugcauaucaucgagccucacgaaguugagcagaauagaauuaaacuucugaacgacaaggccguggccacgagccaacugcagaaaaagcucgggcagcugcuuuaccugacaaaucucgagaaaucccaggauaagaccagcggcggagucaaccccgaaccgugcccuaucugcgcucgccaacugggcaagcagugggccgugcucaccugugggcauugcuucuguaacgagugcauuucuaucauuaucgaacaguauuccguuggaagccaccggucuagcauuaaaugugcgaucugcagacagacaaccucccacaaggagaucucuuacguguuuacaagcgaaaaagcuaaucaagaggaggacauucccgucaagggcucccauucuacgaaaguggaagccgucgugcgcacccugaugaagauccagcuuagagaucccggggccaaagcucugguuuucagcacauggcaggacgugcuggauauuaucuccaaggcccucaccgacaacaauauggaguucgcucagauuagccgggucaagacauuucaagaaaaccugucugccuucaaacgcgauccucagaucaauauccuucugcucccccugcacaccggauccaacggccucacgauuaucgaggcgacccaugugcugcuuguugaaccuauucugaauccggcccacgagcugcaggcuaucgggagagugcaccggauuggccaaacaaagcccaccaucguccaucgcuuucucaucaaagccacaauugaggaaagaaugcaggcuaugcugaagaccgccgagcggagccacacaaacuccucugccaaacauagcgaagcuuccgugcuuaccguggcggaccuggccgaucucuucacgaaggagacagaggaacuggaguga

SEQ ID NO: 75546 - RNA, 1734 nt, Artificial Sequence
  derived and/or modified sequence opt5 from SHQ1__Homo_sapiens__NP_060600
augcugacccccgccuucgaccucagccaggauccugacuuucugacaaucgcuauuagagugccguacgcccgggucuccgaguucgauguuuauuuugaaggcucugacuucaaguuuuacgcgaaacccuauuuccuucgccugacgcucccugggagaaucguggagaacggaagcgaacaaggcuccuacgaugcugacaaggggauuuuuaccauccggcugcccaaagagacaccuggacagcacuucgaaggccuuaauaugcugaccgcccuccuggccccucgcaagucuagaacagcuaaaccucugguggaggagauuggggccagcgaaaucccggaggaagucguggaugacgaggaguuugauugggaaaucgagcagacccccugcgaagagguuuccgaaucugcucucaacccucagugucauuauggauucggcaaucugcggagcggcgugcuucaacgccugcaggacgagcucuccgaugucauugacaucaaggaucccgacuuuacacccgccgcggagagacggcagaagcgccuggccgcugaacuugccaaauucgaccccgaucacuaccuggcugacuuuuucgaggaugaagccauugagcagauccucaaguauaacccgugguggaccgacaaauacagcaagaugauggcguuccuggaaaaaucucaagagcaggagaaucaugccacgcugguguccuuuagcgaagaggaaaaguaccagcucagaaaguucguuaacaaaucuuaucugcuugauaagcgggcuugccgccagguguguuacucccugauugacauccuccuggccuauugcuacgagaccagagucacagaaggggagaaaaauguggagagcgcuuggaacauucggaaacuuucuccuacccuguguugguuugaaacauggaccaaugugcacgauaucauggucuccuucggacgcagaguucucugcuauccccuguaccggcauuuuaagcuggugaugaaggccuauagagacacgaucaaaauucuccaacugggcaagagcgccgugcuuaagugucugcucgauauccacaaaauuuuccaggagaacgacccugcuuacauccugaaugaucuuuacauuuccgacuauugcgucuggauccagaaggugaaaucuaagaaacuggcggcccucgcugaagcccugaaggagguuagccugacaaaggcccaacucgggcuggagcuugaggaacuggaagcugccgcgcuccuggugcaggaggaagagaccgcucugaaagccgcccacuccgucagcggacagcagacacuuuguucuuccagcgaggcuucugacagcgaagauuccgacucuagcguguccagcggcaacgaggauucuggguccgacagcgaacaagaugagcucaaggacucucccuccgaaaccguuagcucccugcagggacccuuucuggaggagucuagcgccuuccucaucguggauggcggcguccgccggaauaccgcuauucaggaauccgacgccucucaggggaaaccucuggcgagcuccuggccgcuuggagugagcggcccccugaucgaggaacucggggagcaacugaagacaacgguccaggugucugaaccuaaaggaaccacagccguuaacagauccaauauucaggagcgcgauggcugccagacccccaacaacuga

SEQ ID NO: 75547 - RNA, 4851 nt, Artificial Sequence
  derived and/or modified sequence opt5 from SHROOM2__Homo_sapiens__NP_001640
auggagggcgccgaacccagagcucggccugagcgccuggccgaagcggagaccagagcugccgacgggggacggcucguggaaguccagcugagcggcggggccccguggggauucacacuuaagggcgggcgcgagcacggagagccccugguuaucacgaaaauugaagagggcuccaaggcugccgcuguggauaaacuccuggccggcgacgaaaucguggggauuaacgauaucggacuuucuggcuuuagacaagaggcgauuugccuggucaaggggagccauaaaacccucaagcuggugguuaagcggcgcuccgagcugggauggagaccucacucuuggcaugccacaaaauucagcgacucccaccccgaacucgcugccucuccuuuuaccagcacauccggcugucccagcuggucugggcggcaucacgcuuccagcucuucccacgaucugagcucuuccugggagcagaccaaucuucagcgcacacuggaccauuucagcucccucggaucuguggauagccuggaccacccuuccagcagacuuucugucgccaaguccaacagcucuaucgaucaucugggcagccacuccaaacgggacucugcguacggcagcuuuuccaccagcucuuccacgccggaucacacccucagcaaggccgacacaucuuccgcugaaaauauccuguauaccguggggcugugggaggccccccgccagggaggcagacaagcucaggccgccggggauccucagggaagcgaagagaaacucuccugcuuccccccucggguucccggcgacucugggaagggaccgcgcccugaguacaacgcugaacccaagcuggcggccccuggcagaagcaauuuuggccccgugugguauguccccgacaaaaagaaagcuccuuccucuccgcccccucccccucccccgcuucggagcgauuccuucgccgccacaaagagccaugagaaagcucaggggccuguguuuucugaagccgcggcugcccaacacuucaccgcccuggcucaggcccagcccagaggagaccgccggccugagcucacggauagacccuggcgcuccgcucauccuggcagccuggggaagggaucuggcgggcccggcuguccgcaggaagcccacgcggacggauccuggccucccagcaaagauggcgccucuagccggcuucaagcuucccugagcucuuccgacgugagauuuccccagagcccucauuccgggcgccacccgccccucuacucugaucacagcccucugugcgccgacucccugggacaggagcccggcgcugccucuuuccaaaacgauagcccuccccagguccgggggcucuccucuugugaccagaagcugggaagcggcuggcaggggccuagacccugcguucaaggcgaucuucaggcggcccagcugugggcuggauguuggccguccgacacagcccucggcgcucuggagagccuuccucccccuaccguggggcagucuccccgccaucaccugccgcaaccugaaggacccccugacgcccgggagacaggcagaugcuauccccucgauaagggggccgaaggauguuccgcuggcgcgcaggagcccccucgcgccagccgggcugaaaaagccucucagagacuggccgcuuccauuaccugggccgacggggagagcucucggaucugcccgcaggagaccccccugcuccauucccugacacaagaaggcaagcgcagaccugagagcucccccgaagauagcgcgacgcggccucccccuuuugacgcucacgugggaaaaccgaccagacgcucugaucgguucgccacaacccuuagaaaugagauucagaugcaccgcgccaagcugcagaaaagcagauccacagucgcucucaccgccgcgggcgaggcugaagacgggacgggacgguggcgcgccggccuggggggaggcacacaggaggggccccuggccggcaccuacaaggaucaucuuaaggaagcucaagccagagugcuccgggcuaccucuuucaaacgcagagaccuggauccuaaccccggagaccuguauccugagagccucgaacaccggaugggcgaucccgacacaguuccgcauuuuugggaggccgggcuggcgcagccucccuccucuaccagcggaggcccccacccuccccgcaucgggggaagacggcgcuucacagccgagcagaagcuuaaauccuacucugaaccugagaagaugaaugaagugggccugacgagaggcuacagcccgcaucaacacccccggaccuccgaggauacagucgggaccuuugcugacagauggaaauucuuugaagagacaagcaagccugugccccagcgcccugcccagaagcaggcucuccacggaauuccccgggacaaaccggagagaccucgcaccgccggccggacgugugaagggaccgagcccuggucuagaacaaccucccugggagauagccugaacgcccauucugcugcggaaaaggccggcacauccgaccuuccucgccggcucgggaccuucgcugaguaucaagccagcuggaaagaacagagaaagccccuggaggcccgcuccucuggacggugccacagcgcugaugacauccuggauguuucccucgacccucaggagagaccccagcaugugcacggccggagccgcucuuccccgagcacggaucauuacaaacaagaagccucugucgagcugagacggcaggcgggcgacccuggggaaccccgcgaggagcuucccagcgcugugagagccgaagagggacaguccacaccucggcaggccgaugcucaaugcagagaaggcucuccggggagccagcagcaccccccuucccaaaaggcccccaauccucccaccuuuucugagcugagccacugucgcggagcgccugaacucccgcgggagggcagagggcgcgcuggaacacugccccgggacuauagauacuccgaggaaagcaccccugccgaucugggcccccgcgcccagucuccuggcuccccccuucaugcucgggggcaggacagcuggccggucuccucugcccuccugagcaagagaccugcuccccagcgccccccucccccuaaaagagagccgcggcgcuauagagccaccgauggagcgcccgccgacgcuccugugggcguucuggggcggcccuucccuacacccuccccggccucucucgacguguacgucgcucgccugagccuuucccacagcccuucuguguuuuccagcgcccaaccccaggauacgccuaaggccaccguuugcgaaagaggaucucagcauguguccggcgacgcuagccggccccugccugaggcgcuccugcccccgaaacagcaacaccugagacuucagacagccaccauggaaacaucucgcagcccuuccccccaguucgcuccccagaagcucaccgauaaaccuccgcugcugauucaagacgaggauucuacgcggaucgagagagucauggacaacaauacaaccgugaagauggugcccaucaaaauuguucacagcgaaucccagccugagaaggaaagccgccagucccucgccugucccgccgagccucccgcucugccucaugggcuugaaaaggaucagaucaaaacccugucuacaagcgagcaauuuuauucccgguucugccucuacaccagacagggagccgagcccgaagcgccgcaccgggcucagccugccgagccccaaccucugggcacacagguccccccggaaaaggaccgcuguacgucuccucccggccugagcuacaugaaagccaaggagaaaaccguggaggaucuuaaguccgaagagcuggcuagagaaauuguggggaaggacaaaucucucgccgauauccuggaccccagcgucaagauuaaaacaaccauggaccucauggagggaaucuuuccuaaggaugaacaucugcuugaggaggcgcagcagcggcgcaaacugcuccccaagaucccuuccccgagaagcacagaagagcggaaggaagagcccucugugccugccgcuguuucccuggccaccaacagcacguauuacucuaccuccgcucccaaagccgaacugcuuauuaagaugaaagaccugcaagagcagcaggagcacgaagaggauagcggcucugaccucgaucaugaccuguccgugaagaaacaggaacucaucgagagcauuucccgcaagcugcaaguccuuagagaagcucgggagagccugcucgaggaugugcaggccaauacaguucugggggcggaaguggaggccaucgucaagggagugugcaaaccuucugaauucgacaaguuccgcauguuuauuggcgaucuggacaaaguugugaaccuucugcucagccuguccgggagacucgcucgggucgagaacgcccugaauaaccuugaugacggagcuucucccggcgauagacagagccugcuggagaagcagcgcgugcucauccaacagcacgaagacgccaaagagcugaaggaaaaucuugaccggagagagcgcaucguguucgauauucuggccaacuaucucuccgaagagucucuggcugacuacgagcacuuugucaaaaugaagagcgcgcucaucauugaacagcgggagcuggaagauaagauccaucuuggcgaggaacaacugaaaugucugcucgacucccugcagccugagagagggaaguga

SEQ ID NO: 75548 - RNA, 5991 nt, Artificial Sequence
  derived and/or modified sequence opt5 from SHROOM3__Homo_sapiens__NP_065910
augaugagaaccacagaggacuuccacaagcccuccgccacgcucaacuccaauaccgcuacaaagggccgguacaucuaucucgaagccuuccuggaaggcggggccccuuggggguucacccuuaaagggggacuggaacauggcgagccgcucauuaucucuaagguggaagaagggggaaaggcugauacacugagcuccaaacuucaggccggcgacgaggugguucacauuaacgaagugacccugucuagcucccgcaaggaggccgugucucucgucaagggcagcuacaaaacacugagacuggugguucggcgcgaugugugcaccgaccccgggcaugcugauacgggagccuccaauuuugucagcccugaacaccucaccucuggcccccaacauagaaaggcugccugguccgggggagugaaacugcggcuuaagcaccgcagaagcgagccugcgggccggccccacucuuggcauacaaccaaauccggggagaagcagccugacgccagcaugaugcagaucucucagggaaugauuggcccucccuggcaccaguccuaucauagcuccucuagcacauccgaucugagcaacuacgaccacgcuuaucuccgcagaucucccgaucaguguuccagccagggcucuauggaaagccuggagcccuccggggccuacccucccugccaccuuucuccggcuaagagcaccggauccaucgaccagcugagccauuuccacaauaaacgggauucugccuauuccagcuuuucuacguccagcuccauccucgaauacccucaucccggcauuucugggcgcgagagaagcggauccauggacaacacaucugcgcggggcgggcugcuggaaggaaugcgccaagccgauaucagauacguuaagaccguguaugacacacggagaggcgucagcgcugaguacgaggucaauuccagcgcccuccugcuucagggccgcgaagcucgggccucugccaacgggcagggauaugacaaaugguccaauauuccuagaggcaagggggugccgcccccuagcuggucucagcaauguccguccagccuggagaccgcuaccgauaaccugcccccuaaagucggagcgccccugccucccgcccgcucugacagcuacgcugccuuccggcacagagaacgcccguccagcuggucuucccuugaucagaagcggcugugcagaccucaggccaauagccucggcucccugaaaucucccuuuaucgaggaacaacugcauacaguucucgaaaagagcccugagaacagcccucccgugaagcccaaacacaauuauacgcagaaggcucagccggggcagccucugcuucccaccucuauuuaccccgugccuagccuggaaccgcacuucgcccaagucccccagccuuccgugucuagcaacggcaugcucuaucccgcgcuggcuaaagaguccggauacaucgccccucagggcgccuguaauaagauggcuacaauugacgaaaacgggaaccagaauggaagcggccgccccggguuugccuucugccaaccucuugagcaugaucugcucucucccguugagaagaagccggaggcuaccgccaaguacgugccuuccaaaguccacuuuuguagcgugcccgagaacgaagaggacgcgucucugaagcggcaucugacaccuccccagggaaauuccccgcacagcaacgaaagaaaaucuacccacuccaauaagccuagcucccauccccacagccucaaaugcccucaggcccaggcuuggcaagccggcgaggauaagcgcucuagccggcuguccgagcccugggaaggggacuuccaggaggaucauaacgcuaaucuuuggagacggcuggaacgcgagggccucggacagucucugagcggcaacuuugggaagacgaaauccgccuucucuagccugcagaauauccccgaaucccuuagacggcacucuagccucgagcugggaagaggcacacaagagggguauccuggaggccgcccgaccugugcgguuaacaccaaggccgaagaccccgggcggaaagcugccccugaucugggcucccaucucgacagacaggugagcuacccccgcccugagggaagaacaggcgcuucugccuccuucaauagcaccgaccccucuccugaggagccucccgcccccucccacccccacacaagcucccuggggcggcgcggaccuggccccgggucugcuagcgcgcuucagggauuucaauauggcaagccgcauugcuccguccuggaaaaagugagcaaguucgagcagagagagcaggggucucagcggccuuccgucggcggaagcggcuuugggcacaacuaccgcccccauagaacggugucuaccagcuccacaucuggaaaugauuucgaagagaccaaggcccacauccgguuuagcgaauccgcugagccccucggcaacggggaacaacauuucaaaaauggagagcugaagcuggaggaagccucucgccagccuuguggccagcagcuuagcggcggggccuccgacagcggaagaggcccccaacggccugaugcucgccuccugagaucucaguccacauuucagcugagcuccgagccggaacgggagcccgaguggagagaccgcccugggucucccgaaagcccucuccuggaugcccccuucucccgggcguauagaaacucuauuaaagacgcucagagccgcguucuuggagccaccuccuuucggagacgcgaucuggagcucggcgccccgguggcuagccggucuuggagaccucgccccuccagcgcccacgucgggcugcggucuccugaagcguccgcuagcgccucuccccacacgccuagagagcggcauagcgugacccccgccgaaggagaccuggcucgcccgguuccucccgccgcuagacggggcgcccgcagacggcuuacacccgagcaaaagaaaagauccuacucugagccugaaaagaugaacgaggugggcaucgucgaagaggcggaaccggcgccccucgggccucagcgcaauggaaugcgguuccccgagagcuccguggcugauagacgccggcuguuugagagagacggcaaagccugcagcacccugucccucucugggccugaacugaagcaguuccaacagagcgcucuugccgauuauauucagcgcaagacaggaaaacggcccaccuccgccgcuggcugcucucugcaggagccugggccgcucagagaacgcgcgcaaagcgccuaccugcagcccggaccugcugcccuggagggcuccggccuugccucugcuagcucccucagcucucugagagaacccucccugcagccucggcgcgaggccacgcuccugcccgcgacaguggcugagacccagcaagccccgagagaccgguccucuuccuuugccgggggacgcagacuuggcgaacggagacgcggggaucugcucagcggagcuaacggcgggacacggggaacccagagaggcgacgagaccccucgcgaacccucuuccuggggcgcccgggcgggaaagagcauguccgcugaggaccugcuggagagaagcgauguucuugccggacccguccacgugcggucucgcagcuccccugccacagcugacaaaagacaggaugugcugcucggccaggacucuggguucggacuggucaaggaucccuguuaccucgccggcccugggagccggucccugucuugcagcgaacgcggacaagaggaaaugcuuccgcuguuccaucaccucacgcccagauggggcggcuccggguguaaagcuaucggagacucuagcgugccuuccgagugccccggcacccuggaucaccagcggcaggccagccgcacaccuugucccagaccgccucuggcggggacccagggacuuguuacagacacccgggccgcuccccugacgccuauuggcacaccccucccuucugccauccccuccggguauugcagccaagauggacagaccggccgccagccgcugccucccuacacccccgcuaugaugcauagaucuaauggccacacacucacccaaccuccggggccccggggaugugaaggcgacgggccugagcauggaguggaggaaggcacaagaaagcgcgucucccugccccaguggccucccccuagccgggccaagugggcccacgcugcgagagaggauucccuucccgaagagucuagcgccccggacuuugcuaaccugaaacauuaucagaagcagcaaucccucccuagccugugcucuacguccgaucccgacaccccucugggggcccccagcacaccgggacgcaucucucuucggauuagcgaauccgugcugagagacucuccuccgccccacgaggauuacgaggacgaaguuuucgugcgcgauccucaccccaaagccaccagcuccccuacauuugagccgcugcccccucccccucccccuccgcccucucaggaaaccccugucuauagcauggacgauuuucccccucccccgccucauacggugugugaggcucagcuggacuccgaagaucccgagggcccccggccuagcuuuaauaagcucucuaaaguuaccaucgccagagagcgccacaugcccggcgcggcucauguggucgggucccagacacuggccagccggcuucaaaccuccauuaagggaucugaagccgagagcacaccuccguccuucaugucugugcacgcucagcuggccggcagccucgggggacagcccgcgccuauccagacccaaucccugagccacgaccccgugucuggcacacaggggcuggaaaagaaagucuccccugauccccaaaagagcucugaggacauuagaaccgaggcccuugcuaaagaaaucguucaucaagauaagucccuggccgacauccucgacccggauagccgccugaaaacgacaauggaccucauggagggccuguuuccucgggaugugaaccuucugaaggaaaauucugugaagagaaaagcuauucagcgcaccgucuccagcucuggaugcgagggcaagagaaacgaagacaaagaggccgugagcaugcugguuaauugucccgcuuacuauuccgugagcgccccuaaggcggagcuccugaacaaaaucaaggaaaugcccgccgaggucaaugaagaggaggagcaggcugaugugaacgagaaaaaggccgaacuuauugggucccugacccacaagcucgagacacugcaggaagcuaaaggaucucuccugaccgacaucaaacuuaauaacgcccugggcgaggaaguugaggcccugauuagcgagcucugcaaaccgaaugaguucgauaaguaccggauguuuaucggggaccuggauaaaguggucaaccuucugcucucccugucuggacgccucgcuagaguggagaacguucugagcggccuuggggaagacgcguccaaugaggagcggucuagccuguacgaaaagagaaagauucuggccggccaacaugaggaugcucgggaacucaaagagaaccuggaccgcagagaacgggugguccuuggaauccuggccaauuaucucuccgaggagcagcugcaggauuaccagcacuucgugaagaugaaaagcacgcugcucaucgaacaacgcaaacuugacgacaaaauuaagcugggccaggaacaggugaagugccugcucgaaucucugccuuccgauuuuauccccaaagccggggcucuugcccugcccccuaaccucacaagcgagcccauuccugcgggaggcuguaccuucucugggaucuuuccgacacugaccagcccccucuga

SEQ ID NO: 75549 - RNA, 4482 nt, Artificial Sequence
  derived and/or modified sequence opt5 from SHROOM4__Homo_sapiens__NP_065768
auggagaacagacccggcagcuuccaguacgugccuguccaacugcaagggggagccccguggggcuuuacccucaaagggggacuggaacacugcgagccccuuacaguuuccaaaaucgaagacggcgggaaggcugcccugucucagaaaaugcggacgggagaugagcucgugaauauuaacggcaccccucuguauggcagccgccaggaagcgcuuauccugauuaagggguccuucagaauccucaaacugauugugcggcgcagaaaugcucccgucucucggccucauagcuggcacguggccaagcugcucgagggaugucccgaggccgcuacaaccaugcauuuuccuuccgaagccuucucucugagcuggcacuccggcugcaacacaagcgacguuugugugcaguggugcccgcuuucucgccauuguuccaccgagaagucuagcuccaucgggagcauggaaucucuggagcagcccggacaggcuacauacgagucccaccuccugccuaucgaucagaauauguaucccaaccaaagagacagcgccuacuccucuuuuagcgcguccagcaaugccucugauugcgcucuuucccugcggccugaggaacccgccagcaccgacuguauuaugcagggcccggggccuacgaaagcucccucuggacgcccuaacgucgccgaaaccagcggcggcuccagacggacaaaugggggacaccucacccccucuagccagauguccagccgcccccaggagggcuaucaaucugggccugcgaaggccgugagaggaccgccccagccucccguucggcgcgauucccugcaggcuagcagagcccaacugcucaacggcgaacagcggagagcuucugagccuguggucccccugccgcagaaagagaaacuuucccuggaaccugugcuccccgcccgcaauccuaaccgguucugcugucugagcgggcaugaccaggugacauccgagggacaccaaaauugcgaauuuucucagcccccugagagcucccagcagggcucugaacaucuucugaugcaagccagcaccaaggcugucggcucccccaaggcgugugauagagccagcucuguugacuccaacccgcucaaugaggcuagcgccgagcuggccaaggcuucuuucgggcgcccuccccaccugaucggacccacgggccaccggcauuccgccccugaacagcuccuggcgagccaccuucagcaugugcaccuggauacaagagggucuaaaggaauggagcucccgcccgugcaggacggccaucaauggacccugagcccucuucacuccagccacaaggggaaaaagucucccugcccucccacaggcggaacccaugaucaguccagcaaagaacgcaagacccggcaggucgacgacagaucccuggugcucggccaccagucucaaagcuccccuccccauggggaggcugauggacacccgucugaaaaaggcuuucuggacccuaaccgcacaagccgggccgccuccgagcuggcuaaccagcagcccucugccagcgggucccucguucaacaggcuacggauugcagcucuaccacaaaggccgcguccggaaccgaggccggcgaagagggggacagcgaaccuaaggaguguucuagaaugggcggacgccgguccggcgggacaagaggacggagcauucagaaucgcagaaaaucugagcgguucgcuaccaaccugagaaaugaaauccagcgccggaaggcccaacuucagaaauccaagggcccccugagccagcucugcgauacgaaagagccgguggaagagacacaggaaccucccgaguccccuccccugaccgcuagcaacaccucucugcuuagcuccuguaagaagcccccuucuccgagagacaaacucuuuaauaagagcaugaugcugcgcgccagauccucugagugccugagccaagcgcccgaaucccacgagucucggacagggcucgaaggacgcauuagcccuggccagagacccgggcaguccagccugggccuuaacaccugguggaaagccccugaucccucuuccagcgacccugagaaggcucaugcccacuguggaguccggggcgggcauuggcgcuggucuccggaacacaauucccagccccugguggcugccgccauggagggaccuagcaaccccggcgauaauaaagagcucaaggcuuccacagcgcaagccggggaagacgcuauccugcugccuuucgccgauagacggaaguuuuucgaggaaucuagcaaaucccuuagcacgucucaucuccccggacugaccacacacuccaacaagaccuucacacagcgcccgaaaccuauugaccagaauuuucaacccaugagcucuagcugcagagagcugcggcgccaccccauggaccaguccuaccauucugccgaucagccuuaucacgcuaccgaccagagcuaccauuccaugucuccccuccaaagcgaaacgccuaccuacuccgaguguuucgccagcaagggccuggagaacucuaugugcuguaaaccgcuucacugcggggauuuugacuaucauagaacauguuccuacagcugcuccguucagggcgcgcuggugcacgaucccugcaucuauuguucuggagaaaucugcccugcucuccugaagcggaauaugaugcccaacuguuacaauugcagaugucaccaucaccagugcauucgcuguagcgucugcuaucauaacccucagcacuccgcccuggaggacucuagccuugcccccggcaacaccuggaagccgcggaaacucacagugcaagaguucccuggggauaaguggaaucccaucaccggaaacagaaaaacgucccagagcggccgcgaaauggcucacucuaagacauccuuuagcugggccaccccuuuccaucccugucuggagaauccugcgcuggaccucucuuccuaccgggcuauuagcucucuggaucuucugggggacuuuaaacacgcccucaagaaaagcgaagagacauccgucuaugaagagggaucuagccuggccuccaugccccauccgcugagaagccgcgcuuucuccgaaucucacaucagccuugccccucaguccacccgggcuuggggccagcauagacgcgagcucuuuucuaagggcgaugagacccaaagcgaccugcugggggcccggaagaaagcguucccuccgcccagacccccuccucccaacugggaaaaguaccggcucuuucgcgccgcucagcagcagaaacaacagcagcaacagcagaagcagcaagaggaagaggaagaggaggaagaggaagaggaagaggaggaagaggaagaggaggaagaggccgaagaggaagaggaggaacugccuccccaguacuucuccucugagacaagcggauccugcgcucuuaaucccgaagaggugcuggaacagccgcagccccucagcuuuggccaccuggaggggucuagacaaggaucccagagcguuccugccgagcaggaaucuuucgcccugcacuccagcgauuuccuucccccuauucggggccaucuggggucucagcccgagcaagcucagccgccuuguuauuacggaaucggcggccucuggcgcacguccgggcaggaagcgaccgagagcgccaaacaagaauuucagcacuucuccccucccagcggagcucccggcauccccacaucuuauagcgccuacuauaacauuuccguggccaaggcugagcugcucaauaagcugaaagaccagccugagauggccgaaaucgggcuuggagaggaagaggucgaccaugagcuggcgcagaagaaaauucaacucaucgaaucuauuagcagaaagcuguccgugcugcgggaggcucagagaggccuucuggaagauaucaacgccaauucugcccucggggaggaaguugaggcuaaccugaaagccgugugcaagagcaaugaguuugaaaaguaccaccucuucgucggagaccuggauaaaguggugaaccuucugcucucccugucuggccgccuggcgcggguugagaaugcucuuaacagcaucgacuccgaagccaaucaggagaagcugguccucauugagaaaaagcagcaacugaccggccagcucgccgaugcuaaagaacugaaggagcacguggacagacgcgaaaaacuuguguuugggauggucagccgguaucugccgcaggaucagcugcaagacuaccagcauuucgugaagaugaagucugcccucaucauugagcagagagaacuggaggaaaagaucaaacuuggagaggagcagcugaagugccuccgcgaaucccugcuccugggccccagcaacuuuuga

SEQ ID NO: 75550 - RNA, 1467 nt, Artificial Sequence
  derived and/or modified sequence opt5 from SIAE__Homo_sapiens__NP_001186851
auggugcugcagaaggagcccgccggcgcugucaucuggggguucggaaccccuggcgccacaguuacggugacccucagacaagggcaggaaacaauuaugaaaaaggugaccagcgucaaagcgcacuccgacacauggauggugguucuggauccgaugaagcccggaggcccuuuugaggugauggcucagcagacccuugagaaaaucaacuucacacugcggguccaugacgugcucuuuggggauguuuggcugugcucuggacaaagcaauaugcagaugaccgugcuucagauuuucaacgccacgcgcgaacuguccaauaccgccgcuuaccagucugucagaauccucagcgugucccccauucaagccgaacaggagcuggaggaccugguggcugucgaucuccaguggucuaagccuacaagcgaaaaccugggccacggcuauuuuaaguacauguccgccguuuguuggcuuuucgggcggcaucuguaugacacccuccaguaccccaucggacugaucgcgagcucuuggggcgggacaccuauugaggccugguccagcggacgcucucuuaaggcuugcggcgugccgaaacaaggguccauccccuaugauagcgugaccggaccuucuaaacacuccguccuguggaaugccaugauucauccccucuguaacaugacgcugaagggcgugguuugguaccagggcgaaagcaauaucaacuauaauacagaccuguacaacugcaccuuuccugcucucauugaggauuggagagagacauuccaccgggggucccagggacaaaccgaacgcuuuuuccccuuuggccuggugcagcuuucuagcgaccuguccaaaaagagcucugaugacggguucccgcagaucagauggcaccagaccgccgauuuuggauacgucccuaaucccaagaugccuaacacauucauggcgguggccauggaccucugugaccgggauucccccuucggcagcauucauccccgcgacaaacaaacgguugcuuauagacugcaccuuggggcccgggcucuggccuacggagagaagaaucucaccuuugaaggcccucugccggagaaaaucgaacugcucgcccauaagggccugcuuaaccugacauauuaccagcagauccaggugcagaaaaaggauaauaaaauuuucgagaucucuugcuguagcgaccaccgcugcaaguggcuccccgcuuccaugaacaccgucucuacacaaagccugacccuugcgauugauuccugucacgggacgguggucgcccugagauaugcuuggacaaccuggccuugcgaguacaagcaguguccccucuaucauccuagcucugcccugcccgccccgccuuuuaucgcuuucauuaccgaccagggacccggccaccaauccaacguggccaaauga

SEQ ID NO: 75551 - RNA, 942 nt, Artificial Sequence
  derived and/or modified sequence opt5 from SIAH1__Homo_sapiens__NP_001006611
augaccggcaaggccacacccccuagccuguacuccuggagaggggugcuuuucacgugccugccggcugcccggacccgcaaaagaaaggagaugucucggcagacagcgaccgcucuccccacaggaaccagcaaauguccucccucccaacgcgucccugcccugacaggcaccacggccucuaacaaugaccucgcuagccuguuugaaugccccguuuguuucgauuaugugcuuccuccgauccugcagugccaguccgggcaccucguguguucuaacugcagacccaagcugaccuguugcccuacaugucggggaccccugggcagcauucgcaaucucgccauggagaaagucgcuaacuccgugcuguuuccuugcaaguacgccagcucugggugugaaaucacccuuccccauacagagaaggcggaccacgaggaacugugcgaguucagaccguauuccugcccuugucccggagccagcugcaaauggcagggcucucucgaugcuguuaugccucaucugaugcaccaacauaaguccauuaccacgcuucagggcgaagacaucguguuucuggccacagauauuaaucuccccggggcugucgacugggugaugaugcagagcuguuucggauuucacuucaugcugguucuggagaaacaggaaaaguacgauggccaccaacaguuuuucgccaucgugcagcucaucgggacccggaaacaggcggagaacuuugccuaucgccuggagcuuaauggacauagacggcgccugacaugggaagcuacccccagaucuauucacgagggcaucgccaccgcuauuaugaacuccgacugccucgucuucgauacaagcaucgcccaacuguuugccgaaaaugggaaccuuggaauuaaugugacgaucuccauguguuga

SEQ ID NO: 75552 - RNA, 975 nt, Artificial Sequence
  derived and/or modified sequence opt5 from SIAH2__Homo_sapiens__NP_005058
augagcagacccuccucuaccggcccuagcgccaacaagccgugcuccaaacagcccccuccccaaccucagcacacccccucuccugcugccccgcccgcggcugccacgaucagcgccgcugggccuggauccucugccgugcccgcugccgcggccgucauuagcggcccugggggaggcgggggagcuggccccguuuccccgcagcaucacgagcugaccagccucuucgaauguccugugugcuuugacuacgugcugcccccuauccuucagugucaagccggccaucuggucugcaaucagugucggcagaagcucucuugcugucccacaugccgcggggcucugacccccuccauuagaaaccuugccauggagaaaguggcgagcgccguucuguucccuuguaaguaugcuacaaccggaugcucucucacacugcaccauaccgaaaaaccggagcacgaagauaucugugaguaccggcccuauuccugcccuugccccggcgccagcuguaaguggcaggggucucuggaggcugugaugucccaccucaugcaugcccacaagagcauuacgacccugcaaggagaagacaucgucuuucuugccacagauaucaaucugccuggcgcuguggacuggguuaugaugcaguccugcuucgggcaucacuuuaugcucgugcuggagaaacaggaaaaguacgagggacaccagcaauucuuugcgauuguccuucugaucggcacccgcaaacaggccgagaacuucgcuuauagacucgaacugaauggcaaccggcgcagacugacaugggaggccacgccccggucuauucaugaugggguggccgcugccaucaugaauagcgacugucucguguuugauaccgcgauugcucaccuguucgccgacaacggaaaucuuggcaucaacgucacaauuuccacaugcuguccguga

SEQ ID NO: 75553 - RNA, 2484 nt, Artificial Sequence
  derived and/or modified sequence opt5 from SIDT1__Homo_sapiens__NP_060169
augagaggcugccugcggcucgcccugcuuugugcucugcccuggcuccugcuugccgcgagcccugggcacccggcuaagagcccccgccagccucccgccccuagacgggaccccuucgaugccgcucgcggagccgacuuugaucauguguacucuggcgucguuaaccugagcaccgagaauaucuauuccuucaacuacacaucucaaccugaccaggugacggcugugagagucuaugugaauagcuccucugaaaaccucaauuacccgguucugguggucgugcggcagcagaaagagguucugagcuggcaagugccccuccuguuucaggggcuuuaucagcgcuccuacaacuaucaggaagucagcagaacccugugcccuucugaggccacaaaugaaaccggaccccuccaacagcugauuuucguggauguggcguccauggccccucuuggcgcucaguacaagcugcucgucacaaaacugaagcacuuucagcugcggaccaacguugccuuccauuuuacagcuagccccucucaaccgcaguacuuccucuauaaauuuccuaaggacguggauuccgugaucauuaaggucgugagcgagauggccuaccccuguucuguuguguccguccagaauaucaugugcccuguguaugaccuggaucacaacguugaguucaaugggguguaccaaagcaugaccaaaaaggcggccauuacgcuucagaaaaaggacuuucccggagaacaguucuuugucguguucgucaucaaacccgaggauuaugcuuguggcggcuccuucuuuauccaggaaaaggagaaccaaaccuggaaucugcagcgcaagaaaaaccucgaggugacaauuguuccuucuaucaaggaaagcguguacgucaaauccagccuguucucuguguuuauuuuccuuuccuuuuaucuggggugccuccugguuggauucgugcauuaccugagauuucagcgcaagagcaucgacggcucuuucgggagcaaugauggauccggcaacauggucgccucucacccgauugcugccagcacccccgagggguccaacuacggaacaaucgacgaauccucuuccagcccuggccggcagaugucuuccagcgacggcgggcccccuggacaauccgauaccgacucuagcguggaggaauccgauuuugacacgaugcccgauauugagucugacaaaaauaucaucagaacaaagauguuccucuaucugagcgaucuuucccggaaagaccgcagaauugugagcaagaaguacaaaaucuauuuuuggaacauuaucaccauugccguuuucuacgcucugccggucauccagcucgugaucacauaucagaccguggucaaugugaccggcaaccaggauauuuguuacuauaauuuucugugcgcgcacccucuugggguucugucugccuucaacaauauccucuccaaccugggacaugugcugcucggcuuccuguuucuucugauuguccuccggagagacauccugcaccgccgggcucuggaggccaaggauauuuucgccguggaauacgggauccccaaacauuuuggacuuuucuacgcuaugggcaucgcccucaugauggagggcguucugagcgcguguuaucacgugugcccuaauuacucuaacuuucaauucgacacauccuuuauguauaugauugcugggcuguguaugcucaagcuguaccagacgagacaccccgacaucaaugccagcgccuauucugcuuacgccagcuucgcugucgugauuaugguuaccgugcuuggagucguguuuggcaaaaacgaugugugguucugggucaucuuuuccgccauucauguucuggcgagccucgcccugucuacacagaucuauuacauggggcgcuucaagauugaccugggaaucuuucggagagcugccaugguguucuacaccgauugcauccagcaaugcucccgcccucuuuauauggaccggauggugcuccuggucgugggcaaucugguuaacuggagcuucgcucucuuugggcugauuuacagaccccgcgauuucgccuccuauaugcuuggcaucuuuauuuguaaucugcuccuguaccuggcguucuauaucauuaugaagcuccggucuagcgaaaaagugcucccggucccucuguuuugcaucguggccacagcuguuaugugggccgcugcccuguacuucuuuuuccagaaccucuccucuugggagggaacccccgccgaaagcagagagaagaaccgcgaguguauccugcuugacuuuuucgaugaccacgauauuuggcauuuucuguccgcuacggcgcuuuucuucucuuuucuggugcugcuuacacucgacgaugaccuggaugucgugcggagagaccagauccccguuuucuga

SEQ ID NO: 75554 - RNA, 1233 nt, Artificial Sequence
  derived and/or modified sequence opt5 from SIGIRR__Homo_sapiens__NP_001128526
augcccggcgugugcgacagagccccugauuuccugagcccguccgaggaccagguccuccggcccgcucuggggucuagcguugcccuuaacuguaccgcgugggugguguccggaccucacugcucucugcccagcguccaauggcucaaggauggccugccucuugggaucggaggccauuacucccugcacgaauauucuugggugaaagcuaaucucagcgagguucugguguccagcguccugggggugaacguuacaucuacggaaguguacggagccuuuaccuguuccauucagaauaucagcuucucuuccuuuacacuccagcgcgccggccccaccagccaugucgcugccgugcuggcuucucuucuggugcuccuggcccuucugcucgcggcccugcuguaugucaagugcagacucaacguucugcuuugguaccaggacgcuuauggcgagguggaaauuaaugaugggaaacuguacgacgccuauguguccuacagcgauuguccugaggaccggaaguucgucaacuuuauccucaaaccgcaacuggagcgcagacggggauacaaacuuuuccuggaugaccgcgaucuccugcccagagcugaaccuuccgccgaccugcucgugaaucugucucggugccgcagacuuauuguugugcugagcgaugcguuucucucccgggccugguguagccacucuuuccgcgagggccugugcagacuucuggaacucacacggcgccccaucuuuaucaccuucgaggggcagagacgggacccugcucaucccgcccugagacugcuccgccagcaccggcaccuggucacacuucugcucuggagaccgggauccgugaccccuagcucugacuuuuggaaggagguucagcuggcucugccccgcaaggugcaauaucggccugucgaaggcgauccccagacgcagcuucaggacgauaaggaccccaugcucauucugagagggcgcgugccugagggacgggcccuggauagcgaagucgacccggaucccgagggcgaccucggcgugagagggccuguuuucggagaacccuccgccccuccccauaccucuggcgugagccugggggagucccgcagcucugaggucgauguguccgaccuuggaagccggaacuacucugcuagaacagauuuuuauugucugguuuccaaagacgacauguga

SEQ ID NO: 75555 - RNA, 1809 nt, Artificial Sequence
  derived and/or modified sequence opt5 from SIGLEC11__Homo_sapiens__NP_001128635
auggugcccggccaggcccaaccucagagcccggagaugcugcuccugccccuucugcucccuguccugggggcuggaucccuuaacaaggaccccucuuacagccugcagguucagagacaagugccugugcccgaaggccucugcgucaucguguccuguaaucugucuuauccucgggaugggugggacgagagcaccgccgcguacggauauugguucaaaggccgcacauccccgaagacgggggcucccguugccaccaacaaucagucuagagaaguggagaugagcacacgggaucgcuuucagcugaccggagacccuggcaaaggcuccugcagccucgucauuagagaugcccagcgggaagacgaggcuugguacuucuuucgcguggagagagggucucggguucgccacuccuuccugagcaacgccuuuuuccuuaaggugacagcucugaccaaaaagcccgaugucuauaucccugaaacacucgagcccggacaaccggugaccgugauuugugucuuuaauugggccuucaagaaaugcccugcgcccucuuuuuccuggacgggcgccgcucugagcccuagacggacccgccccucuacaucccauuucagcguucuuuccuuuacccccucuccucaggaccacgauacagaccugaccugucauguggauuucagcagaaaggggguguccgcccagcggacgguccgccucagaguggcuuacgccccgaaagaccugaucauuagcaucucucacgauaacacauccgcgcuggaacuccagggaaauguuaucuaucuggaggugcaaaagggccaguuucuucggcugcucugcgccgcugacagccagcccccugccacccugucuuggguccuucaagacagagugcugagcuccucucaucccugggggccucgcacacucggacuggagcugcggggcguuagagcuggcgauagcgggcgcuacaccugucgggccgaaaacagacucggaucccagcagcaggcccuggaccuuagcgugcaauaucccccggagaaucugcgcgucauggugucucaggcuaaccggaccguccucgaaaaucugggcaacgggacaucccuuccugugcuggagggacagagccucagacugguuugcgugacgcacucuuccccucccgcgcgccugagcuggacccgguggggccagacagucgggcccucccaaccuucugaucccggagugcucgaacugccgccuauucagauggagcacgagggcgaguucaccugucaugcccagcacccccuuggcagccagcauguuucccugucucucagcgugcacuggaaacuggaacacgggggaggccuggggcuuggagcugcccucggcgccggggucgcugcccugcuggcguucugcuccugucucgugguguuuagaguuaagaucugccgcaaggaagcucggaaaagagccgccgcugagcaagacguccccagcacacugggcccuauuucucagggacaucagcacgaaugcuccgccggcagcucucaggaucauccgcccccuggggcugccaccuacacgcccggaaagggcgaggagcaagaacuucacuacgcgucccugagcuuccaggggcuccggcugugggagccugccgaccaggaagcucccucuacaaccgaguauagcgaaaucaaaauucauaccggacaaccucugcgcggccccggguuuggccuucagcucgagagagagauguccggaauggugccgaaguga

SEQ ID NO: 75556 - RNA, 1191 nt, Artificial Sequence
  derived and/or modified sequence opt5 from SIGLEC14__Homo_sapiens__NP_001092082
augcugccccuccugcuucugccucuccuguggggcgggagccuucaggagaagccgguguacgaacugcaaguccagaaauccguuaccgugcaggagggacucugcgugcugguccccuguucuuucagcuauccuuggagauccugguacucuagcccuccccuguauguguacugguuucgggacggcgaaauccccuauuacgccgagguuguggcuacaaacaauccugaucgcagagucaagccggaaacgcaggggcgguuccgccuccugggagacgugcagaaaaagaacugcucccuuucuauuggcgaugccagaauggaggacaccgggagcuacuuuuuccggguugagcgcggaagagaugugaaauauuccuaccaacagaauaagcugaaccucgaagucacagcgcugaucgagaagcccgacauucacuuucuugaaccucuggagagcggccggcccacccgccucucuuguucccugccuggcagcugcgaggcugggcccccgcugacauucucuuggaccggaaaugcccucuccccucuggaucccgaaacaaccagaagcucugagcuuacgcugaccccucggcccgaagaccauggcacaaaccucaccugucaggugaaacgccaaggggcccaggugacaaccgagagaacgguccagcugaauguuuccuaugcuccccagaaccuugccaucagcaucuuuuuccggaauggaacaggcaccgcucugcgcauucucuccaacgggaugucugugccuauccaagaaggacagagccuguuucuggccugcacaguggauuccaauccgcccgcgagccucucuugguucagagagggcaaggcccugaacccuucccagaccagcaugucuggcacccuugagcugcccaauauuggggcucgggaaggaggcgaguuuacauguagaguccaacacccucucgggagccagcaucuguccuucauccuuucugugcagcgcagcuccagcucuugcauuuguguuacggaaaaacagcaaggauccuggccccuggugcucacccugauccggggcgcccugaugggggcuggauuucuccugacauacggccuuaccuggauuuauuacacaagaugcggcgggccgcagcagagccgcgccgagcggccuggauga

SEQ ID NO: 75557 - RNA, 5130 nt, Artificial Sequence
  derived and/or modified sequence opt5 from SIGLEC1__Homo_sapiens__XP_011527630
augggauuccugcccaagcuccugcuucuggccagcuuuuucccugcugggcaggccagcuggggagugucuagcccgcaagacguccagggcguuaagggguccugccuccugauucccuguaucuuuucuuucccugccgacguggaggugcccgacggaaucaccgcuauuugguacuaugauuacagcggccagagacaggucgugucccacucugccgacccuaaacuuguugaagcccgguuucgcgggagaacagaguucaugggaaaccccgaacaccgggugugcaaucugcuccugaaagaucugcaaccugaggacagcggcuccuauaacuuucgcuucgaaaucagcgaggucaauagauggucugaugugaagggcacgcucguuaccgugacagaggaaccgcggguccccaccauugcuuccccuguggagcugcuugaagggacagagguggacuuuaacuguagcacccccuacgucugccugcaggagcagguucgccuccaguggcaaggacaggauccugccagaucugugacauucaauucccagaaauuugaacccaccggcguggggcaccuggagacgcuucacauggcuaugagcuggcaggaccacggacggauccugcgcugucaacucucugucgccaaccauagagcgcaguccgaaauccaccuccaggugaaguaugccccgaagggcguuaaaauucugcugagcccuuccgggcggaauauccugcccggagagcuugugacccugacaugccaagucaacucuagcuacccugcuguguccagcauuaaguggcucaaagauggcguucgccugcagaccaagacaggcgugcuucaucugccccaggccgcuuggucugacgccggggucuauaccugucaggcggaaaauggagugggcucccucgucucucccccuaucucccugcauauuuucauggccgaggugcaaguuagcccggcugggcccauccuggagaaccagacggugacacucgucugcaauaccccuaacgaagcccccuccgaucugagauacucuugguacaaaaaucacgugcuucuggaggacgcucauagccacacacuccggcugcaccuugccacccgcgccgacaccggauuuuauuucugugaaguucagaacgugcauggcuccgagagaagcgggccugucucuguggugguuaaucaucccccgcugacaccuguccucacggcuuuccuggaaacccaggcgggacuggugggcauucuccauugcuccguggucagcgagccccuggccacacuugugcugucucacggcgggcauauccucgcuuccaccagcggagauuccgaccacucuccucgguuuagcggcacauccgggcccaacucucugagacuggagauccgcgaucuugaagagaccgacagcggagaauacaaguguuccgccacgaacagccucggcaaugccacaucuacccuggauuuccacgcuaacgccgcgcggcugcucauuuccccugcugccgagguuguggaagggcaagccgucacccugagcugcagaucuggccuuucccccacaccggacgcucgcuuuagcugguaucugaauggagcccuccugcaugagggcccugggucuagccugcuucuccccgcugccuccagcaccgaugcgggaucuuaccacugccgggccagagacggccauuccgcuagcgggcccuccucuccugccgugcugacaguucuguauccgccccgccagccuacguucaccacacggcucgaucuggacgcugccggagcgggcgccgggagacgcggccuucugcucugucggguggauagcgaucccccugcuagacugcagcugcuucacaaggaccgcgucguggccaccucccuccccucuggaggcgggugcagcacauguggaggcugcuccccucggaugaaaguuaccaaggcucccaaccugcugagaguggagauccacaauccgcuccuggaagaggaagggcuuuaccugugugaggccucuaacgcccucggaaaugcuagcacguccgcgaccuuuaacggccaggccacaguccuggcuauugccccuagccauacccugcaagaggggacagaagccaaucuuaccugcaacgugucucgggaggcugccggcucccccgcgaauuucagcugguuucgcaacggagugcucugggcucagggcccucuggaaacggucacacugcuccccguugccagaaccgaugccgcucuguaugccugucggauccuuacagaggcgggggcucagcugucuaccccggugcuccuguccgugcuguacccucccgacagaccuaaacuuagcgcccugcucgauaugggacagggccacauggcccuguucauuugcaccgucgacucucgcccccucgcucugcuugcccuguuucauggggaacaccuccuggcuacaucccugggaccccaagugccuagccauggccgguuccaggccaaggcggaggccaauucccuuaaacuggagguuagagaacucgggcugggcgauagcggaucuuaccgcugugaggcuacgaacgugcucggcagcuccaauaccucucuguuuuuccaggucagaggggccugggugcaaguuagcccgucccccgaacuucaggagggacaggcugugguccugucuugccaggugcacacaggcguuccugaagggaccagcuaucggugguaccgcgacggacaaccccuccaggaguccacaucugccacccugagauuugccgcuaucacgcugacacaggcgggcgccuaucacugucaggcucaagccccuggcagcgccaccaccucccuugcugcccccaucagccugcaugugucuuacgcgccucggcacgucacacucaccacacugauggauacggggccgggacgccucggccugcuucugugcagaguggacuccgaucccccugcucagcugcggcuccugcauggggaccgccuuguggccagcacccugcagggagucggcgggcccgagggaucuuccccuagacuccacguugccguggcucccaacacacugcggcucgaaauucauggcgccaugcuggaggaugaaggcguguauaucugcgaggcgagcaacacccuugggcaggcuuccgccucugccgacuucgaugcucaagccgucaaugugcagguuuggccgggagcuacagugcgcgaaggccagcuggucaaccugaccugucucguguggacgacccacccugcccaacugacauacaccugguaucaggacgggcagcagagacuugacgcgcacagcauuccccugcccaauguuacagugcgggaugccaccuccuacagaugcggagucggcccucccgggcgcgcuccucggcucagcagaccgaucacacuggacgugcucuacgcgccccgcaaccugcggcuuaccuaucugcuggagucucauggaggccaacucgcucugguccuuuguacgguggauuccagaccucccgcccagcuggcccucagccacgcuggccgccugcucgcgucuagcacagccgcuuccguuccuaauacccugcggcuugagcugagagggccccagccgcgcgacgaaggauucuacucuugcagcgcccgguccccucugggccaggccaacaccucucucgagcugagacuugaaggggugcgggucauucuggcucccgaggccgcggugccugagggagcucccaucacaguuaccugugccgauccugccgcucaugcccccacgcucuauacaugguaccacaauggccgcuggcugcaagaagggccggcggccagccuguccuuucucguggcuaccagagcccacgcuggagccuauagcugccaggcucaggacgcccagggcacacggucuucccgcccugcggcccuucaaguccuguacgcuccccaggaugccgugcugagcuccuucagagacucucgggcuagaagcauggccgugauccaguguaccguugauuccgagcccccugccgaacucgcucugucucaugacggcaagguccuugcgacaagcuccggggugcacagccuggccucuggaaccggccaugugcaggucgcucgcaacgcccuccggcugcaagugcaggauguuccggccggggacgauacguaugugugcaccgcucagaaucugcucggauccauuagcacaaucggcagacuucaagucgagggggcccgcgugguugcggaacccggacuggacgugccugagggcgccgcucugaaccucucuugucggcugcuuggcgggcccggaccugucggcaauuccaccuuugccugguucuggaacgacagacgccugcacgcugagcccgugccuacacucgccuuuacccauguugcgcgggcccaggcugggauguaccacugccuggccgaacugccgacgggagcugccgcuagcgcccccgugaugcucagaguccuuuacccucccaaaacaccuaccaugaugguguucguggagcccgaaggcgggcugcgcggcauucuggauuguagagucgacucugagccgcucgcgagccugacacuucaccugggcucccggcucguugccucuagccagccucagggcgcucccgccgaaccccauauccacgugcuggcuuccccuaaugcccugcgcguggauauugaggcccucagacccagcgaccaaggggaguauaucugcuccgcgucuaacguccuuggaagcgcuuccaccucuaccuacuuuggcgugcgggcccugcaucgccugcaccaguuccagcagcuccuguggguucuugggcugcucgugggacugcugcuccuucugcugggccucggggcuugcuauacauggagacggagacgcgucuguaagcaaagcaugggagaaaauuccguggagauggccuuucagaaggaaacgacccagcugauugauccugacgccgcuacaugcgagaccucuacaugugccccgccccuuggcuga

SEQ ID NO: 75558 - RNA, 1656 nt, Artificial Sequence
  derived and/or modified sequence opt5 from SIGLEC5__Homo_sapiens__NP_003821
augcugccccuccugcuucugccucuccuguggggcgggagccuucaggagaagccgguguacgaacugcaaguccagaaauccguuaccgugcaggagggacucugcgugcugguccccuguucuuucagcuauccuuggagauccugguacucuucucccccucuguauguguacugguuucgggacggcgaaauccccuauuacgccgagguuguggcuacaaacaauccugaucgcagagucaagccggaaacgcaggggcgguuccgccuccugggagacgugcagaaaaagaacugcucccuuucuauuggcgaugccagaauggaggacaccgggagcuacuuuuuccggguugagcgcggaagagaugugaaauauuccuaccaacagaauaagcugaaccucgaagucacagcgcugaucgagaagcccgacauucacuuucuugaaccucuggagagcggccggcccacccgccucucuuguucccugccuggcagcugcgaggcugggcccccgcugacauucucuuggaccggaaaugcccucuccccucuggaucccgaaacaaccagaagcucugagcuuacgcugaccccucggcccgaagaccauggcacaaaccucaccugucagaugaaacgccaaggggcccaggugacaaccgagagaacggugcagcugaaugucuccuaugcuccccagacaaucaccauuuuucggaacggaaucgcccuugaaauccugcaaaauacaagcuaccucccuguucuggagggccaggcucugcgccuccugugcgaugccccguccaaucccccugcgcaccuuucuugguuccaggggagccccgcccugaacgcuaccccuauuuccaacaccggaauccucgagcugagacgggugagaagcgccgaagagggcggcuuuacaugucgcgcucaacauccccuuggguuccugcagauuuuucucaaucugucuguguauucccugccgcagcuccugggaccuagcugcucuugggaagccgagggccuucacugucggugcagcuucagagcgcgccccgccccuucccuguguuggcggcucgaagagaagccccuggaggggaacucuagccagggauccuuuaaagucaauagcagcuccgcuggcccuugggccaacagcucucugauccuucaugggggacucuccagcgaccugaagguguccugcaaggcuuggaacauuuacggcucucaaagcggcuccguucugcuccugcaggggagaucuaaucuuggaacgggcgugguccccgccgcccucgggggagcuggcgugauggcgcugcugugcaucugucugugccuuauuuucuuccucaucguuaaagcccgccggaagcaggcugccgggagaccggagaaaauggaugacgaagauccuaucaugggcaccauuacaagcggaucccgcaagaaacccuggcccgacagcccuggcgaccaggccucuccgcccggggaugcuccuccccuggaggaacaaaaggaacugcacuaugccucccucagcuuuucugagaugaaaucccgggagccuaaggaccaggaagcgcccagcaccacagaguacucugaaaucaaaaccagcaaguga

SEQ ID NO: 75559 - RNA, 438 nt, Artificial Sequence
  derived and/or modified sequence opt5 from SIGLEC7__Homo_sapiens__NP_001264130
augcugcuccugcuucugcucccccugcuuuggggcagagagcggguggaagggcaaaagagcaaccgcaaagacuacucccugaccaugcagucuagcgucacaguucaggagggaaugugcgugcacgugagauguuccuucucuuauccugucgauagccagacggacuccgauccggugcauggcuacugguuucgggccgggaaugacaucucuuggaaggcucccguugccaccaacaauccugcgugggcugugcaggaagagacacgcgauagauuccaccuccugggagacccccaaaccaaaaacugcacacugagcauucgggaugcccgcauguccgacgccggcagauacuuuuuccggauggaaaaggggaauaucaaauggaacuauaaguaugaucagcucagcgucaaugugaccggauga

SEQ ID NO: 75560 - RNA, 1500 nt, Artificial Sequence
  derived and/or modified sequence opt5 from SIGLEC8__Homo_sapiens__NP_055257
augcugcuccugcuucugcuccugccccuucuguggggcaccaaggggauggagggagacagacaguacggcgauggguaucuccugcaagugcaggaacuggucacaguucaggagggacucugcgugcacgugccuuguagcuucuccuacccgcaggacggcuggacggauucugaccccguccauggguauugguuucgggccggagaucgcccuuaccaagacgcucccguggccaccaacaauccugauagagaaguucaggcggagacacagggccgguuccagcugcuuggcgacaucuggagcaacgauugcucccugucuauucgcgacgcuagaaaacgggauaaggggagcuacuuuuuccgccucgaaagaggauccaugaaauggucuuauaagagccaacugaauuauaaaaccaagcagcuuuccguguuugucacagcccugacccaccggcccgacauccucauucugggcacacuggagagcgggcauucucgcaaccucaccuguuccgugccuugggccugcaagcagggaacgccgcccaugaucagcuggauuggcgcuucuguuuccagcccugggcccaccacagccagaucuuccgugcugacccuuacaccuaaaccccaggaucacggaaccagccugacgugucaagucacacucccgggcaccggcgugacaaccaccuccacagugcggcuggacgucucuuacccucccuggaaucuuacgaugaccguuuuccagggggacgcuacagccagcaccgcgcugggaaacggcuccagccucucugugcuggaggggcagucccugcgccucgugugcgccgucaauagcaacccucccgcuagacugucuuggacacggggaagccuuacccugugucccucccgcucuagcaauccuggccuccuggaacuuccgagagugcauguucgggaugagggggaauuuacgugcagagcccaaaacgcucagggaucccagcacaucagccugucucucucccugcagaaugagggcacaggcaccagccgccccgugucucaagucacccuggccgcgguugggggagccggcgcuacagcccucgcuuuccuguccuuuuguaucauuuucaucauugugcggagcugcagaaagaaauccgcccgcccugccgcuggggugggagacaccggcauggaggaugcgaaggccauccgggggucugcuagccagggcccccuuacagaauccuggaaagacggaaacccucugaagaagcccccgccugccgucgcccccucuagcggcgaggaaggggagcuccacuacgcuacgcuguccuuucauaaagugaagccucaggauccccagggacaagaagccaccgacagcgaguauucugagauuaaaauccacaagagagaaacagcggagacccaggcuugucugcgcaaucauaacccuuccagcaaagaaguccggggcuga

SEQ ID NO: 75561 - RNA, 1440 nt, Artificial Sequence
  derived and/or modified sequence opt5 from SIGLEC9__Homo_sapiens__NP_001185487
augcugcuccugcuucugccccuccuguggggcagagagcgggccgaagggcagaccagcaaacuucugacaaugcaauccucugugacgguccaggagggacucugcguucacgugccuuguagcuucuccuacccgucucauggcuggaucuaucccgggccugugguccacggauacugguuucgcgaaggcgcuaacaccgaccaggaugcccccguggcgacaaauaacccugcuagagccguuugggaggaaacccgggaccgcuuccaucugcugggggauccccacacaaagaauugcacccucagcauuagagacgcccggcgcuccgaugcuggaagauauuucuuccggauggagaagggcucuaucaaauggaacuacaagcaucaccgccugagcgugaaugucacagcccuuacccacagaccuaacauucugaucccgggcacgcucgaguccggguguccccagaaucugaccugcagcgugccuugggcuugugaacaaggaacacccccuaugauuucuuggaucggcaccuccguuagcccccuugacccgucuacaacccgguccagcgugcugacgcucaucccucagccccaggaucaugggacaucucugaccugccaggucacauuuccuggagccuccgugaccaccaacaaaacagugcaccugaaugucagcuauccuccccaaaaccucacgaugaccguuuuccagggcgacgggacaguguccaccgugcugggaaauggcucuagccuuucccugcccgagggccagagccuccgccuggucugugcgguggaugccguugacucuaacccgcccgcuagacuuucccugagcuggcgggggcucacacugugcccuucucagcccagcaauccuggagugcuggaacuccccuggguccaucugcgcgaugccgcugaguuuaccuguagagcccaaaacccgcuuggcucccaacagguguaccugaauguuucucuccagagcaaggcgacguccggggugacacagggagucgugggcggggccggagcuaccgcccuggucuuccuuagcuuuugcgugauuuucguugugguccggucuuguagaaagaaauccgcucgcccugccgccggcgugggcgacaccgggaucgaggaugcuaacgcgguucggggaagcgccucucagauucugaaccacuuuaucggcuuccccacauuucucgggcugggauucgaauuucugcucaaucugagagaccuuugcugccacccugacuccgaguuuuauguguaccauuucagccacuuucgccugauuaagaacaucgcuggcgaaauugucuggucccucgaggggaaaauccuguggcugcuugaugugucugacuucuuucauugguucuuucucaucugugugggcuga

SEQ ID NO: 75562 - RNA, 612 nt, Artificial Sequence
  derived and/or modified sequence opt5 from SIGMAR1__Homo_sapiens__NP_001269136
augcagugggccgugggcagacggugggcuugggccgcgcugcuccuggcugucgccgccguucuuacccaagugguguggcuguggcucgggcuggaccacgagcuugcuuucagccgccugaucgucgaacucagacggcugcaucccggacacgugcugccugaugaggaacuccaguggguuuuugugaacgccggcggguggaugggagcuaugugccugcuucaugccucccugucugaguacguccuccuguucggcacagcgcuugggagccgcggacacuccggcagauauugggccgaaauuucugacacgaucauuagcggcaccuuucaucaguggcgggaggggacaaccaaguccgagguguucuacccgggagaaacaguugugcacggccccggggaggcuaccgccgucgaauggggaccuaauacauggaugguggaguauggccgcggggugauccccucuacccuggcuuuugcccucgcggauacggucuucagcacccaggacuuucugacacuguucuacacccucagauccuaugcccggggacugcgccuugagcugacaaccuaccucuuuggccaagauccuuga

SEQ ID NO: 75563 - RNA, 5484 nt, Artificial Sequence
  derived and/or modified sequence opt5 from SI__Homo_sapiens__NP_001032
auggccagaaagaaauucagcggacuggaaaucucccugauugugcuguuugucaucguuacaauuaucgcuauugcccuuaucguggugcuggcgacaaagacgcccgcugucgacgaaaucucugauagcaccuccaccccugccaccacacgggugaccacaaacccgucugacagcgggaaaugucccaauguucucaacgauccugugaauguccgcauuaacuguauccccgagcaguucccuaccgaaggaauuugcgcccaaagaggcuguugcuggcggcccuggaaugacucccugaucccuuggugcuuuuucguggauaaccacggguacaauguucaggacaugacgaccacaucuauuggaguggaggcuaaacuuaaccgcaucccgagccccacccuguuuggcaaugauauuaacuccguccucuucacaacccagaaucagacgccuaacagauuucgguucaaaaucacagaccccaauaaccgcagauaugaagugccucaucaauacgugaaggaguuuaccgggcccacagucagcgauacccuguaugacguuaagguggcccagaauccguucucuauccaggugauucggaaauccaacggaaagacccuguuugauacaagcaucggcccucucgucuacucugaccaguaucugcaaauuuccacgcgccuucccagcgauuacaucuauggcauuggggaacaggugcacaaaagauuccggcaugaccugucuuggaagaccuggccuaucuuuacacgcgaccagcuccccggagauaacaauaacaaucuguacggccaccagaccuucuucaugugcaucgaagacacauccggaaagagcuuugggguuuuccuuaugaacuccaaugcuauggagauuuuuauccaacccaccccuauugugacguacagagucacaggcgggauccuggauuucuauauucuccugggagacaccccggaacaggugguucagcaauaccagcagcuggugggccuccccgccaugccugcguauuggaaccugggcuuucagcuuucucgguggaauuacaagagccuggaugucgugaaggaggucgugcgcagaaaccgggaggccgggauccccuucgacacccaaguuacagauaucgacuauauggaagauaaaaaggacuuuaccuacgaucagguggcuuucaauggacucccucaguuuguccaggaccugcaugaccacggccaaaaauaugugauuauccuugaucccgccauuuccaucgggagacgcgcuaacggaacaacguacgccaccuacgagcggggcaauacacagcacguuuggauuaacgaaagcgacgggucuaccccgaucauuggagagguguggccuggccugacagucuaucccgauuucaccaauccuaacuguaucgacuggugggcgaaugaaugcuccaucuuucaucaggaggugcaguacgauggccucuggauugacaugaacgaggugagcucuuucauccaagggagcacgaagggauguaacguuaauaaacugaacuaucccccuuuuacccccgauauucuggacaagcucauguacuccaaaacaaucugcauggaugccguccagaauuggggcaagcaguaugacgugcacucucuguacggguauagcauggcuauugccaccgaacaggcugugcaaaaggucuucccgaacaaaagauccuucauccuuacacgcagcaccuuugccggaucuggccggcaugccgcucacuggcugggggauaauacggcguccugggagcagauggaauggagcaucacaggcaugcucgaguucucucuguuuggcauuccucuugugggcgccgacaucuguggguucguugcugaaaccacagaggagcugugcagacgcuggaugcagcucggagccuuuuaccccuucucccggaaccacaauagcgauggcuacgaacaucaagaccccgccuuuuucgggcagaacucccugcuggugaagucuagcagacaguaucucaccauucgcuacacccugcuuccuuuucuguauacacucuucuacaaagcucacgucuuuggagagacgguggcccggccgguucugcaugaguucuaugaggacaccaauuccuggaucgaagauacagaguuucuguggggccccgcgcuucucauuaccccugugcugaagcagggggcugacacagucucugccuacauccccgaugccaucugguaugacuacgagagcggcgcuaaaagaccuuggcgcaagcaacggguggauauguaccugcccgccgacaagauuggacuccaccugagaggcggguauaucauuccuauccaggaacccgauguuaccacgacagcuucccggaaaaacccgcuuggacugauuguggcccucggcgagaauaacaccgcgaagggggacuucuucugggaugacggagaaaccaaagauacaauccagaauggcaacuacauccuguauaccuuuagcgucucuaauaacacacuggacauugugugcacgcauuccagcuaccaggaggggaccacacuugccuuccaaaccgugaagauccucggccugacagauucugucaccgagguucgcguggcugaaaacaaucagccuaugaacgcccacuccaauuuuacguaugacgcuagcaaccaggugcugcucauugccgaccugaaacuuaaucugggaagaaacuucucuguccaguggaaucaaaucuuuagcgagaacgaacgguucaauuguuaccccgaugcggaccucgccaccgagcagaagugcacacagagaggcuguguguggcgcaccggguccagccugucuaaggcuccugaaugcuauuuuccccggcaagauaacuccuacagcguuaauuccgccagauacucuagcaugggaauuacagcugaccugcagcuuaacaccgccaaugcccgcaucaaacucccguccgauccuauuucuacacugagaguggaggucaaguaucacaaaaacgacaugcugcaguucaagaucuacgauccccagaaaaagcgguaugaggugccuguuccccucaauauccccaccacgccuauuagcacauacgaagaccgccuguaugauguggagaucaaggaaaacccguuuggcauucaaaucagacggcgcuccucugggagagucauuugggacagcuggcuucccggauucgcuuuuaacgaucaguucauccagaucuccacccggcugccuagcgaguacauuuauggcuucggggaaguggagcauaccgcguuuaaacgcgaccucaauuggaacacauggggcauguucaccagagaccagcccccuggauacaagcucaauucuuacggcuuucaccccuauuacauggcccuggaggaagaggggaacgcucauggaguuuuccuucucaauuccaacgccauggaugugacguuucaaccuacaccggcccugaccuaucggacagucggcgggauccuggacuucuacauguuucucggacccaccccugaaguggcuacaaaacaguaucacgaggugauuggccaccccgucaugccugccuacugggcgcugggcuuccagcuuugucgcuauggguacgcuaauaccagcgaaguuagagagcuguacgaugccaugguggccgcuaacauccccuaugacgugcaguacacggauauugacuauauggagcggcaacucgauuuuaccaucggagaagccuuccaggaccugccgcaguuugucgauaagaucagaggcgaggggaugcgcuacauuaucauucuggacccugcgaucucuggaaaugaaacaaaaaccuaucccgcuuucgagcggggccagcaaaacgauguguuuguuaaguggcccaauacaaacgacauuugcugggccaaaguguggccugaucuucccaauaucaccauugacaagacgcugacagaggacgaagccgucaacgcuuccagagcccauguggcuuucccugauuucuuucgcaccagcacagccgaguggugggcgcgggaaaucguugacuucuacaaugagaagaugaaauuugaugggcucuggaucgacaugaacgaaccgucuuccuucgugaauggaaccaccacaaaccaguguagaaacgaugagcugaauuaucccccuuacuuucccgagcucacgaagcgcaccgacggccugcacuuccggacaauuugcauggaagccgagcagauccuuagcgauggcaccuccguccugcauuacgacgugcacaaccucuauggguggagccaaaugaaaccuacacaugaugcucugcagaagaccacgggaaaaagaggcauugucaucucucgcagcacauaccccaccuccgggcgguggggaggccacuggcugggggacaauuaugccagaugggauaacauggacaagucuauuaucggaaugauggaauuuagccuuuucggcauguccuacaccggcgcugauaucuguggguuuuucaauaacucugaguaucaccugugcacacgguggaugcagcucggagccuuuuacccguauagccgcaaucauaacauugccaauaccagacggcaggacccugcuuccuggaacgaaacauucgcggagaugucucgcaauauccugaacauuagauacacgcuccugcccuacuuuuauacccaaaugcacgagauccaugccaauggcgggacagugauucggccucuucugcacgaguucuucgacgagaagcccaccugggauaucuuuaaacaguuccucuggggaccugcuuuuaugguuacacccgugcuggaaccguacguccagaccgugaacgccuauguuccuaaugccagaugguucgacuaccauacgggcaaggauaucggggugcgcggacaguuucaaaccuucaacgcuagcuaugacacaauuaaccugcacguccggggcggccacauccuucccugucaggagcccgcccagaauaccuuuuacuccagacagaaacauaugaagcugauuguggcggcugaugacaaccaaauggcccaggggagccucuucugggaugacggagaaucuaucgauacauaugagcgcgaccuguaccucuccgugcaguuuaaucugaaccaaaccacacuuacgagcaccauucugaaacggggcuacaucaauaagucugagacaagacuggggucccuccacguuuggggaaagggcaccaccccugucaacgccgugacacugacguauaaugggaacaaaaauagccuuccguucaacgaagauaccacaaauaugauucugcgcaucgaccucaccacacauaacgugacccuggaggaacccaucgagauuaauugguccuga

SEQ ID NO: 75564 - RNA, 2352 nt, Artificial Sequence
  derived and/or modified sequence opt5 from SIK1__Homo_sapiens__NP_775490
auggugaucaugagcgaguucuccgccgaccccgcuggccaggggcaaggacagcagaagccucugagagucggcuuuuacgauauugaacggacccucgggaaaggaaacuucgccguugugaagcuggcgcgccacagagugacaaaaacgcaggucgcuaucaagauuaucgacaaaacccggcuugauucuagcaaucuggagaagauuuaucgcgaagugcaacucaugaagcugcuuaaccauccgcacaucaucaaacuguaccagguuauggagacaaaggacaugcucuauauugugaccgaauuugccaaaaauggcgagauguucgauuaccugacauccaacgggcaucugucugagaaugaagccagaaagaaauuuuggcagauccucagcgcugucgaguauugccacgaccaucacauugugcaccgggaucugaagaccgaaaaccuucugcucgacggaaauauggauaucaagcuggccgacuucggcuuuggcaacuucuacaaauccggggagccccuuucuacaugguguggaagcccucccuaugcugccccugagguuuuugaaggcaaggaguacgaagggccccagcuggauauuuggucccucggagugguccuguacgugcuggugugcggcagccucccuuucgacgggccgaaucugcccacccuucgccaaagaguccuggagggacgguuucgcaucccuuucuuuaugucucaggauugugaaucccucauuagacggaugcugguuguggaccccgcgcgcagaaucacgaucgcccagauucggcagcaucgcuggaugagagcugagccuugccuucccggcccggccuguccugcuuucagcgcccacucuuauaccuccaaccugggcgacuacgaugagcaagcgcucgggaucaugcagacacugggaguggaccggcagagaaccgucgaaagccugcaaaauucuuccuauaaccauuucgccgcuauuuacuaucuccugcuugagcgccugaaagaauaccggaaugcccagugcgcuagacccggcccugcccgccagccccggcccagaagcuccgaucucucugggcuggaggugccucaggaaggacuuagcacagacccguuucgccccgcccugcucuguccucaaccccagacccugguucaguccgugcugcaggcugagauggauugcgagcuccaaagcucucugcaguggccucuuuucuuucccgucgacgcguccuguagcggcguguuccggccgagaccuguuucucccagcucccugcucgauacggccaucucugaagaggcucgccaggggccuggacuggaagaggaacaggacacacaagagagccugcccuccagcaccggccggagacacacacuugccgaggugucuacccgccucuccccucugaccgcccccugcauugucgugagcccgucuacaacggcuuccccugccgaaggcaccagcuccgauucuugucugacauuuagcgcguccaagucucccgcugggcucagcggaacccccgccacacagggccugcuuggggccugcuccccuguccggcuggcuagcccguuccucggaucucaguccgccacccccgugcugcaggcucaaggcgggcugggcggagccguucuucucccugugagcuuucaggagggcagacgggcgucugacacgucccugacacaggggcugaaagccuuccgccaacagcucagaaagaccacccggacaaaaggauuucugggccuuaacaagaucaaggggcuggcuagacaggucugccaggcccccgcuagccgcgccucucggggaggccucagcccuuuccacgcgcccgcccaauccccugggcugcauggcggagcugccggcagcagagaaggguggucucugcuugaggaggugcucgaacagcagcgccugcugcagcuccaacaccaucccgcugccgccccgggauguucccaggcuccucagcccgcgccugcccccuuuguuaucgcuccgugcgauggcccuggggccgcuccccugccuagcacccuucugacauccggacucccccugcugcccccuccgcuucuccagacgggcgccucucccguggccagcgcggcucaacugcuggacacccaccuccauauugggacaggcccuaccgcccugcccgccgucccucccccuagacuugcucggcuggccccgggaugugagccccucggccugcugcagggggacugcgaaauggaggaucuuaugccuuguucccugggaacauucgugcucgugcaguga

SEQ ID NO: 75565 - RNA, 2781 nt, Artificial Sequence
  derived and/or modified sequence opt5 from SIK2__Homo_sapiens__NP_056006
auggugauggccgacggccccagacaucugcagcgggggccuguccgcguuggauucuacgauaucgagggcacccucgggaagggaaacuuugcuguggugaaacugggcagacaccggauuacaaagacggaagucgccaucaaaauuaucgacaagagccaacuugaugcggugaaucuggagaaaauuuaucgcgaaguucagaucaugaagaugcucgaccacccgcauaucauuaagcuguaccaggugauggagaccaaauccaugcuuuaucuggucacagaauacgcuaagaacggggagaucuucgauuaucucgccaaucacggaagacugaacgagucugaagcccggcgcaaauuuuggcagauucugagcgcuguggacuacugccauggcagaaagaucguucaccgggaucucaaagccgagaaucugcuucuggacaacaauaugaacauuaagaucgcugauuucggcuuugggaauuucuuuaaguccggagaacuccuggccaccugguguggcucucccccuuaugcggcccccgagguguucgaggggcaacaguacgaaggaccucagcuugacauuuggagcaugggcgucgugcuguacgugcucgucugcggggcucugcccuuugauggaccuacacugccgauccuccgccagagaguucuggagggccgguuccgcauccccuauuuuauguccgaagacugugagcaccuuauuagacggaugcuggugcucgauccuucuaaacgccugaccaucgcccaaauuaaggaacauaaauggaugcuuaucgaggugcccguccagagaccugugcuguacccccaggagcaggaaaacgagccgagcauuggcgaguucaaugaacaaguucuccggcugaugcacucccuggggaucgaccagcagaagacaaucgaaagccuccaaaacaaaucuuauaaucauuuugcugccauuuacuuccugcuuguggagagacugaagucccaccgcagcucuuucccugucgagcagcggcucgacggaagacagcgccggcccuccaccaucgcggaacagacgguggccaaagcucaaaccguuggccugccugugacaaugcacagccccaacaugagacuucugcgcucugcccuccugccccaggcuuccaaugucgaggccuuuagcuucccugccuccgggugccaggcugaagcggccuuuauggaggaagaguguguggauaccccgaaggucaacggaugccugcucgaccccgugccucccguucuggugcggaagggcugucagucucuuccuagcaacaugauggagacauccauugaugaagggcuggagaccgaaggagaggcugaggaagaccccgcccaugccuucgaggcuuuucaaagcacgagaucuggccagcgccggcacacacucuccgaagucaccaaucagcuggugguuaugccgggcgccgggaaaaucuucagcaugaacgauucuccuagccuggacuccguggauucugaguaugacaugggaagcguccagagagaucuuaauuuucucgaagacaaccccucccugaaggauauuaugcuggcgaaucaaccuagcccccgcaugacaucuccuuucaucucccuccggcccaccaacccggcuaugcaggcccugagcucucagaaaagagaggugcauaaucgguccccugugagcuuucgcgagggcagacgggccuccgacaccucucuuacacaggggaucguugcuuucagacaacaucugcagaaccucgcccgcacgaagggcauucuggaacugaauaaaguccagcuucucuacgagcaaaucggacccgaagcugaccccaaccuggccccugcggccccgcagcugcaggaucucgcuagcuccugcccccaggaggaagugucucaacagcaggagagcguguccacccugccugccagcguccacccccagcuuucuccucggcaaucccuggagacacaguaucuccagcacagacugcagaagcccagccugcuuucuaaggcucaaaauaccugucagcucuacugcaaagaaccuccccgcucccuggagcagcaacugcaggaacacagacuccagcagaagcggcuguuucuucaaaaacagagccagcugcaggccuacuucaaccaaaugcagauugcggagucuagcuauccgcagccuucccagcaacucccccugccucgccaggaaacacccccgccuagccagcaggcucccccuuuuucucugacccaaccccuuucccccgugcucgagccuagcuccgagcagaugcaguacucuccguuccugagccaauaucaggaaaugcagcugcagccccucccuuccacgucugggcccagagccgccccuccccugccuacacaacuucagcagcagcaaccgcccccucccccucccccgccuccuccccggcagcccggcgcugcccccgccccucugcaguucagcuaccagaccugugagcucccguccgcugcgucucccgccccugacuaucccaccccuugccaauaccccguugauggagcucagcagagcgaccugacaggcccggauugcccucgcucccccgggcugcaagaagccccuagcucuuaugacccccuugcccuguccgagcucccuggacuguuugauugugagaugcucgacgcuguggauccccagcauaauggcuacguccuggugaacuga

SEQ ID NO: 75566 - RNA, 3786 nt, Artificial Sequence
  derived and/or modified sequence opt5 from SIK3__Homo_sapiens__NP_001268678
auggccgcugccgcggcuagcggcgccgggggagccgcuggcgccgggaccggaggcgcugggcccgccggaagacugcucccuccgcccgcgccuggcucccccgccgcuccugccgcugugucucccgccgcgggccagccucggccgcccgccccugcuagccgcgggcccaugccugccagaaucggauacuaugagauugaccggacaaucggcaaggggaacuucgcugucguuaaacgcgccacgcaccuggugaccaaggccaaaguggcuauuaagaucauugauaaaacacaacuugacgaagagaaucugaagaagaucuuuagagaaguccagaucaugaaaaugcucugccauccccacauuauccggcuguaccaggugauggagaccgaacgcaugauuuaucuuguuacagaguacgcguccggaggcgagaucuucgaucaucugguggcccacgggagaauggcugaaaaggaggcccggcgcaaauuuaagcagauugucaccgccguguauuucugucauugcagaaacaucguucaccgggaccucaaagcugaaaaucugcugcucgaugccaaccugaauauuaagaucgcggacuuuggauucucuaaccuuuuuacaccgggccaacugcucaagaccugguguggcagcccucccuacgcugccccugagcuguucgaggggaaagaauaugauggacccaagguggacaucuggucccuuggcgucgugcuguacgugcucgucugcggggcccugcccuuugauggaucuacgcugcagaaucuccgcgcuagaguucugagcggcaaauuccggauucccuuuuucauguccaccgagugugaacaccuuauccgccauaugcuggugcucgacccgaacaagagacugagcauggagcagauuugcaaacacaaguggaugaaacuuggggaugccgaccccaauuuugaucggcugaucgcugaaugucagcaacucaaggaggagagacagguggacccucugaacgaagacguccugcucgccauggaggauaugggacuggacaaggaacagacacuucaggcggagcaagccggcaccgcuaugaauauuucugugccccagguucagcugaucaacccugaaaaucaaaucguggagcccgauggcacacucaaccuggacuccgaugagggggaggaaccgagcccugaagcccuuguccgcuaccugucuaugcggagacauaccgugggaguugcugacccccgcacggaggugauggaagaucuccagaaacugcugccuggcuuccccggggucaauccucaggcccccuuccuccagguggcgccgaacgucaacuuuaugcacaaucugcuuccuaugcaaaaccugcagcccacaggacagcucgaguauaaggagcagucccugcugcaacccccuacccuucagcuccugaauggcauggggccgcugggccggagagccagcgacggaggcgcuaacauucagcuccacgcccagcaacugcuuaaacgcccccgggggccuucuccccuggugacaaugaccccugcuguucccgccgugaccccugucgaugaagaguccagcgacggagaacccgaucaggaggccgugcagagauaccucgcuaaucgcuccaagcggcauacacuggcgaugacgaacccgaccgccgagaucccucccgaccugcagagacaacuuggccagcagccuuuccgcucucggguuuggcccccgcaccucgugccugaccaacauagaagcacauauaaagauuccaauacccugcaucugcccacagaacgguuuagcccuguccgcagauucucugacggggcugccuccauucaggccuuuaaggcucaccucgagaagaugggaaacaauagcucuaucaaacagcugcagcaagaaugcgagcagcuucagaagauguacggcgggcagauugaugaacggacccuggagaaaacgcaacagcagcacaugcucuaucagcaagagcagcaccaucagauccugcaacagcagauccaggacagcauuuguccuccccaaccuuccccgccccugcaggccgcgugcgaaaaccagccugcccuucucacacaccagcugcaaagacugcgcauccagcccucuagcccucccccuaaucauccgaacaaucaccucuuccggcagcccuccaacagcccucccccuaugucuuccgcuaugauucagccccacggcgccgcuucuagcucccaauuucagggacugccgagcagauccgccaucuuccagcagcaaccugagaauuguucuagcccucccaacguggcgcuuaccugccugggcaugcagcagcccgcucaaucccaacaggugaccauucagguucaggaacccgucgauaugcucucuaacaugccugggacagccgccggaagcuccggccgcgggaucagcauuucuccguccgcuggacagaugcagaugcagcauagaaccaaucugauggccacacugagcuacggccaccggccccuuucuaagcaacucuccgcugacagcgccgaggcgcauucugcccaccagcagccuccccauuauacgaccagcgcucugcagcaagcccugcucuccccuacacccccggauuacacccgccaccaacaggugccucacauccugcaggggcuucugagccccagacauucucucacaggccacuccgacauccggcugccucccaccgaauuugcucagcugauuaaacgccagcagcaacagagacagcagcaacagcagcagcaacagcagcaggaguaccaagagcuuuuccggcauaugaaccagggagaugccggcagccuggccccuucccucgggggacagucuaugacggaacgccaagcucugagcuaucagaaugcggacuccuaccaccaucacaccucuccccagcaccuccugcagaucagagcccaagagugcgugagccaggcuuccucuccgacaccuccccauggcuaugcccaccagcccgcccuuaugcauagcgaauccauggaggaagauuguagcugcgagggggcuaaggacggauuucaggauucuaaguccagcucuacccugacaaaaggcugucacgacuccccucuccugcugagcaccgggggcccgggagaccccgagucucuucugggcacggucucccacgcccaagaacucgggauucauccuuacggacaccagcccacagcggcuuucagcaagaacaaagugccuucccgggagcccguuaucggcaauugcauggaucgcagcucuccugggcaggccguggaacugccggaccauaacggacucggcuaucccgccagaccuagcguccacgagcaucaccggcccagagcucugcagcgccaccauaccauucaaaauuccgaugacgccuacgugcagcuugauaaccugccuggcaugucucucguugcggggaaggcucugagcuccgcccggaugucugacgccgugcugagccaguccucucuuaugggaagccaacaguuucaggauggcgagaaugaagaguguggggcuucccugggaggccacgaacaucccgaccucagcgaugggucucagcaccugaacuccagcugcuauccgucuacauguaucaccgacauccuccuguccuacaaacacccugaggucagcuucuccauggaacaagccggaguguga

SEQ ID NO: 75567 - RNA, 1386 nt, Artificial Sequence
  derived and/or modified sequence opt5 from SIL1__Homo_sapiens__NP_071909
auggcuccccagagccugccuuccucuagaauggccccgcucggcaugcugcuugggcugcucauggccgcgugcuucaccuuuugucugagccaccaaaaccuuaaggaguucgcucugacaaaucccgaaaaauccucuacgaaggagaccgaacggaaagagacaaaggccgaagaggagcucgacgccgaagugcuggaggucuuucauccuacccacgaauggcaggcucugcagcccggacaggccguuccugcuggcagccaugugcgccucaaccugcaaacaggggagagagaggccaaacuucaguacgaagauaaguuccggaauaaccugaagggaaaacgccucgacaucaauaccaacacauauaccucccaggaucugaagucugcgcuugccaaauuuaaggagggcgcugaaauggagagcuccaaagaagacaaggccagacaggcugaggugaagcggcuguuccgccccauugaggaacucaaaaaggauuuugacgagcugaaugucgugaucgaaacggauaugcaaauuaugguuagacugaucaacaaauucaauucuagcuccagcucucucgaggaaaagauugccgcgcuguuugaccuugaguacuaugugcaccagauggauaacgcccaggaccugcucuccuucgggggacugcaggucgugaucaauggccuuaacagcaccgagccucugguuaaagaauacgcugccuuugugcucggcgcugccuucucuuccaauccgaagguccaaguggaggccaucgaagggggagcucugcagaaacugcucgugauucuggcgacagagcagccccuuaccgccaagaagaaaguccuguuugcucucugcagccugcuucggcauuucccuuaugcccaacgccaguuccugaagcucggcgggcugcagguucugagaacacucgugcaggaaaaaggaaccgaggugcuggccguccgggugguuacgcuucuguacgaucucgugacagagaagauguuugcugaagaggaagccgagcugacccaagagaugucccccgaaaaacugcagcaguaucgccagguccaccuucucccuggccugugggagcaaggguggugugaaaucacagcgcaucugcucgcucugcccgagcacgacgccagagaaaaggugcuucagacccugggaguucuccugaccacaugccgggaucgcuacagacaggacccgcagcugggccggacgcuugccucucuccaagcugaguaccaggugcuggccagccuggagcuccaggacggcgaagaugagggguauuuccaggaacugcuuggauccgucaacagccugcucaaggagcugagauga

SEQ ID NO: 75568 - RNA, 2301 nt, Artificial Sequence
  derived and/or modified sequence opt5 from SIM1__Homo_sapiens__XP_005267157
augaaggagaaaagcaagaacgccgcuagaacccggcgcgaaaaagaaaauuccgaguucuacgagcuggccaagcuccugccccuuccuucugcgaucacaagccagcuggacaaggcuuccauuaucagacucacgaccucuuaucugaaaaugcggguggucuuuccggaaggccuuggggaggccuggggacacagcucccgcacaucuccccuggauaacguuggcagagagcucgggagccaucugcugcaaacccucgacggauucauuuuugugguggccccugauggcaagaucauguacauuuccgaaacagcuagcguccaccuggggcuuucucagguggagcugaccggaaauuccaucuaugaauacauccaucccgccgaccacgaugagaugacagcuguucucaccgcccaucagccuuaucacagccacuucgugcaggaguacgaaauugagcgguccuuuuuccugcgcaugaaaugcguccuugcgaagagaaacgccggccugacguguggcggguauaaagugauccauugcuccggauaccucaagauucggcaauacagccuggacaugucucccuuugauggcuguuaucagaauguugggcugguggcugucggacacucccucccuccgagcgccgugaccgaaaucaaacugcauuccaacauguucauguuucgcgcuucucuugacaugaagcugauuuuccucgauagcagaguggccgagcugacaggcuacgaaccccaggaccuuaucgagaagacccuguaucaccacguccaugggugcgauacauuucaccuccggugugcgcaucaucugcugcucguuaaaggacaggugaccacgaaguacuaucgcuuccuggccaaacacggcggcuggguguggguccaauccuacgcuacaauugugcacaauagcagaucuucccggccucacugcaucguuagcgugaacuauguccuuaccgacacagaguacaaggggcugcagcucucucuggaucagaucagcgccuccaaacccgcuuuuucuuacaccagcuccagcaccccuacaaugacggacaaucgcaagggagccaaaucuagacuuuccagcucuaaguccaagagccggaccucccccuauccgcaguacucuggcuuccauacagaaagaagcgaguccgaccacgauucucaauggggaggaagcccucugaccgacacagccucuccccagcuccuggauccugcugaccgccccggcagccagcaugaugcgucuugugccuaucggcaauucuccgacagaagcucucugugcuacggguuugcucucgaucacucccgccugguggaggaacggcacuuccauacccaggccugugaaggaggcagaugcgaggccggccgcuauuuucuugggacgccccaggcuggacgggagccuugguggggcagcagagccgcgcugccgcucacaaaggcuucucccgaaagccgcgaggccuacgaaaacuccaugccucacauugccagcguucaucggauccacgggagaggacauugggacgaggauucuguggucuccagccccgacccuggcuccgcuucugaaagcggggaucgcuaucggaccgagcaguaccaauccucuccccacgagccgagcaaaauugaaacccugaucagagccacacagcagaugauuaaagaggaagagaaucggcugcagcuucgcaaggcuccuuccgaccaacucgccucuaucaacggcgcggggaaaaagcacagccuguguuucgccaauuaccagcagcccccucccaccggcgaggugugccauggguccgcucuggccaacacaagcccuugcgaccacauccagcaaagagaaggaaagaugcucucuccccaugagaaugauuaugacaacuccccgacggcucugagccggauuucuuccccuaacagcgauagaaucucuaaauccagccuuauucuggccaaggacuaccuccacuccgauaucagcccccaucagaccgcgggcgaccaccccacagucucuccuaauuguuuugggagccaccgccaguauuucgauaaacaugccuacacccugacaggauaugcucuggaacaccuuuacgacuccgagaccauucggaacuauucucucggcugcaaugggagccauuuugaugugacgucccaccugagaaugcagccggaccccgcccaaggccacaagggaaccucuguuaucaucacaaacggcagcuga

SEQ ID NO: 75569 - RNA, 2004 nt, Artificial Sequence
  derived and/or modified sequence opt5 from SIM2__Homo_sapiens__NP_005060
augaaggagaaaagcaagaacgccgcuaaaaccagacgggaaaaggagaauggcgaguucuacgaacuggccaaacuccugccccuuccuuccgcgaucacaucucagcuggacaaggcuagcauuauccgccucacgaccuccuaucugaagaugagagccguguuuccggaagggcuuggagaugccuggggccaacccucucgggcugggccucuggacggagucgccaaagagcucggcagccaucugcugcagacacucgauggguucguuuuugugguggcuuccgacggaaagauuauguacaucucugagaccgccagcguccaccugggccuuucccagguggaacugacaggcaacagcauuuaugaguacauccaccccucugaucaugacgaaaugaccgcgguucucacagcccaccagccucugcaucaccaccuucugcaagaguaugagaucgaacgcuccuucuuucucagaaugaaaugcgugcuggcuaagcggaaugccgggcugaccuguagcggauacaaagucauucauugcucuggcuaucucaagauccgccaguacaugcuggauaugucccuuuacgacagcuguuaucagauuguggggcugguugcugugggacagucucuucccccuuccgccaucacggagauuaagcuguacagcaacauguucauguuuagagcgucccuugaucugaaacucaucuuccuggacucucgggucaccgaagugacaggcuaugagccgcaagaucugauugaaaagacccucuaccaccaugugcacgggugcgacgucuuucaucugcgcuaugcccaccaccuucugcucguuaaaggacaggugacaaccaaguacuauagacugcuuagcaaacggggcggcuggguguggguccaguccuacgcuacggugguucauaauagcagaucuucccgcccccacuguaucgugagcgucaacuacgugcugacagagaucgaguauaaggaacuccagcugucucuggagcaaguuagcaccgccaaaucccaggauucuuggcggacagcucucagcaccucccaggaaacccgcaagcuggugaagccuaaaaauacaaagaugaaaacgaagcucagaaccaaccccuacccuccccaacaguauagcucuuuccagauggacaaacuggagugcgggcagcucggaaauuggcgggccuccccgccugccagcgcugcggcucccccugaacugcaaccccauucugaguccagcgaccugcuuuacacacccuccuauucucucccuuuuagcuaccacuauggccacuucccgcuggauucccaugucuuuucuagcaagaagcccaugcugccugccaaauucgggcagccccagggauccccuugugagguggccagauucuuucucagcacccugcccgccucuggcgaaugccaguggcacuacgcuaacccgcuugucccuuccuccucuucccccgccaagaauccucccgagccucccgcgaacacagcucgccauagccuggugccgucuuacgaagccccugccgcugccguucggagauucggggaggacaccgcuccucccagcuuucccuccuguggacacuaucgcgaggaaccggcccucggccccgcgaaagccgcucggcaagccgcuagagauggcgcccgccuggcgcuggcccgggcugccccugagugcugugcucccccuacgcccgaagccccuggggcccccgcucagcuuccguucgugcuccugaauuaccacagaguccuggcgcgccggggaccucucggcggggccgcucccgccgccagcggacuggcuugcgccccuggcgggcccgaggcggcuacaggcgcccuuagacugcgccauccgucuccugccgcuaccagcccucccggagcgccccucccccacuaucugggcgccagcgugauuaucaccaacgggcgguga

SEQ ID NO: 75570 - RNA, 3822 nt, Artificial Sequence
  derived and/or modified sequence opt5 from SIN3A__Homo_sapiens__XP_006720530
augaagagacggcuggacgaucaggagagccccguguacgccgcucaacagcgcagaaucccuggcuccaccgaagccuucccgcaccagcaucggguccucgcgcccgcuccucccguuuaugaggccgugucugaaacaaugcagagcgccacggggauucaauacuccgugaccccuucuuaucaggucagcgcuaugccccaguccucuggaagccacggcccugccaucgcugccgugcauuccagccaccaucacccgacagcgguucagccccacgggggacaagugguccagucucaugcccacccugcucccccuguggcccccguucagggccagcaacaguuucagcgccugaaaguggaggacgcucuuuccuaccuggaucaagucaagcuccaguucgggagccagccccagguguauaacgacuuucuggauauuaugaaagaguucaagucucaauccaucgacaccccuggagugauuagcagagucucucagcuuuuuaaaggccaucccgaucugaucaugggcuucaauacauuucucccucccggguacaagaucgagguucagaccaacgacauggugaaugugacaacccccggacagguccaccaaauuccuacgcacggcauccagccgcagccccagccucccccucaacaucccucccagccgagcgcccaguccgcgccugcccccgcucagccugccccgcaaccucccccggcuaaggugucuaaaccuagccagcugcaggcccacacccccgccucccaacagacacccccucugccgcccuaugcuagcccucggucucccccuguucagccccauaccccugugacaauuucccucgggaccgcgcccagccugcagaacaaucaaccggucgaguucaaccacgccaucaauuacgugaacaagauuaaaaaucgcuuucagggacagccugauaucuacaaggcuuuccuugaaauucugcauacguaucagaaagagcaaagaaacgccaaggaagccggcgggaauuacacacccgcucucaccgagcaggagguuuaugcccagguggcgcggcuguuuaagaaccaggaagaccuucugucugaguucggacaauuucucccugaugcuaauagcuccguccugcugucuaaaacaaccgccgaaaagguggacagcguccgcaacgaucacggcggcaccgugaaaaagccccagcucaauaacaaaccgcagagaccuucccaaaacgggugccagauccggcgccaccccacaggaacgaccccucccguuaagaaaaagcccaagcugcuuaaucugaaagacagcucuauggccgacgcuuccaagcauggcgggggaacagagagccucuucuucgauaaagugagaaaggcccugcggucugcugaagccuacgagaacuuucuucgcugucuggucaucuucaaucaggaggugauuuccagagcggaacucguucagcuggugagcccuuuucugggcaaauucccggagcucuuuaacugguucaagaauuuucugggguauaaggaauccguccaccuugagaccuaccccaaagaacgggccacagagggaaucgcuauggagauugacuaugccucuugcaagagacugggcagcuccuaccgcgcucucccuaaaucuuaccaacagcccaaguguaccggccggacgccucugugcaaagaagugcuuaacgauacaugggugagcuuccccuccuggagcgaggacucuaccuuuguuuccagcaagaagacccaguaugaagaacauaucuacagaugugaagaugagcgcuucgagcuggacgucgugcucgaaacaaaucuggccaccauucgggugcuggaggcgauccagaaaaagcucucuagacuguccgccgaggaacaagcuaaauuucgccuugauaacacacucgggggaacgagcgaggucauccaccggaaggcccugcagagaauuuaugcugacaaagccgccgauaucauugacggccugcgcaagaauccuucuaucgcugugccgauuguucugaagcggcuuaaaaugaaggaagaggaauggagagaggcgcagcgcggguucaacaaaguguggcgggaacagaaugagaaguacuaucucaaaagccuggaucaccaaggaaucaacuuuaagcagaaugacaccaaaguccugagauccaagagccuccugaacgagaucgaaucuauuuacgacgagcggcaggaacaggccacagaggaaaaugcuggcgugcccguugggccucaucuuucccuggccuaugaggauaagcaaauccucgaggacgccgcugcccugauuauccaccaugugaaacgccagaccggcauucagaaggaagauaaauacaagaucaaacaaauuaugcaccauuucauccccgaccugcuuuucgcgcagagaggagaucucagcgacgucgaggaagaggaagaggaggaaauggauguggacgaggcuacaggcgccguuaagaagcacaacggggugggaggcuccccucccaaaucuaagcugcuguuuagcaacaccgccgcucagaaacuccgggggauggaugaagucuacaaucuguucuaugugaacaauaacugguacaucuuuaugagacuucaccagauucugugccuccgccugcugcggaucuguucccaagccgagagacagauugaggaagagaaucgcgaaagagagugggaacgggaggugcuuggaaucaagcgcgacaaaucugauagcccggcgauucagcucagacugaaggagccuauggacgucgauguugaagacuauuaccccgcuuuccuggacauggugcggucccuccuggauggcaacaucgacucuagccaguaugaggauucccuucgcgaaauguuuacgauccaugccuacauugccuucaccauggacaagcugauccaaagcauugugagacagcuccagcacaucgucucugaugagauuugcgugcagguuacagaccuguaucuggcugaaaauaacaauggggccaccggcggacaacuuaacacacaaaauucccggagccuccuggagucuaccuaccagcgcaaagcugagcagcugauguccgaugaaaacuguuuuaagcucauguucauccagagccagggccaggugcaacugacgaucgagcuucuggacacagaagaggaaaauucugaugaccccgucgaggccgagagaugguccgauuacguggaacgguauaugaacagcgacaccacauccccugagcuccgcgaacaucuggcgcagaaacccguuuuucugccuagaaaucuucggcgcauuagaaagugccagcgggggagagagcagcaagagaaagaaggaaaggagggcaacagcaagaaaaccauggaaaacguggauucucuggacaagcucgagugucgcuucaaacugaauagcuacaagauggucuaugugaucaaauccgaagacuacauguaucggagaaccgcccuccugcgcgcucaccagucucaugagcggguuagcaagagacuucaccagcgcuuucaggccuggguggauaaauggacaaaggagcacgucccgcgggaaauggcugccgagacguccaaguggcugaugggggaaggacucgagggccuggugcccugcaccacaaccugcgacacagaaacccugcauuucgugucuauuaacaaauacagagucaaguaugggacgguuuuuaaagccccuuga

SEQ ID NO: 75571 - RNA, 3393 nt, Artificial Sequence
  derived and/or modified sequence opt5 from SIN3B__Homo_sapiens__NP_001284524
auggcccacgcuggcgggggaagcggcggguccggagccggcgggcccgcgggaagaggccugucuggcgcucggugggggcgcagcggauccgccggccaugagaagcucccugugcacgucgaagacgcccugaccuaccuugaucagguuaaaaucagauucgggucugacccggcuacauauaacggauuucuggagauuaugaaggaguucaaaagccaauccaucgauacgcccggcgugauucggcgcgugucucagcucuuucaugagcacccugaccugaucgucggguucaaugccuuucuuccccugggauacagaauugauaucccuaagaacggcaaacucaauauccagagcccccugaccucccaggaaaacagccauaaucacggcgacggggcugaggauuucaagcaacaggugccuuauaaggaggacaaaccgcagguuccccuggaaucugauuccguggaguuuaacaaugccauuagcuacgucaacaagaucaaaacacgguuccucgaccacccugaaauuuaucgcucuuuucuggagauccuucauaccuaccagaaggagcaacugaauacaagaggacggcccuuccgcggcauguccgaagaggaaguguuuaccgagguugcgaaccucuucagagggcaggaagaucugcuuagcgaguuuggacaguuccugccugaggccaaacggucucucuucacaggcaaugggcccugcgaaaugcacuccgugcagaagaacgagcaugacaagaccccggaacacagccgcaaaagaucccggccuucucugcugcgccccgucagcgcuccugccaagaaaaagaugaaacucagaggaacgaaggaucuguccauugcugccgugggcaaauauggcacccuucaagaguuuagcuucuuugacaaggugcggagaguccugaagucucaggaaguuuacgagaauuuccuccgcuguaucgcgcuguuuaaccaggagcuuguguccgggagcgaacugcuccaacuggugucucccuuccugggaaaauuucccgaacucuucgcccaguuuaagagcuuccugggcgucaaagaacuuuccuuugcuccuccgaugucugaccggagcggggauggaauuuccagagagaucgacuacgccagcugcaagcgcaucgggucuuccuaucgggcucugcccaaaacauaccagcagccuaaguguagcggcagaaccgccauuugcaaggaagugcucaaugauacauggguuucuuuccccuccuggagcgaggacuccaccuuugugucuagcaaaaagacgccuuaugaggaacaacugcaccgcugugaggaugaacgguucgagcuugacgucgugcuggagacaaaccucgccaccaucagaguucuggaauccgugcagaaaaagcugucucgcauggcucccgaggaucaggaaaaauuccggcucgacgauagccugggcggaacauccgaggucauucagagacgcgcgaucuaccggauuuauggcgacaaggccccggaaaucaucgagagccuuaagaaaaacccugugaccgcuguccccgugguucugaagagacucaaagccaaggaggaagaguggcgggaagcccaacagggguuuaauaaaauuuggcgcgagcaguacgaaaaggcuuaucugaagucucuggaucaucaggccgugaacuucaaacaaaaugacaccaaggcgcuuagauccaaaagccuccugaacgagaucgagucugucuacgacgaacaccaggagcagcauuccgaaggacggagcgcuccuucuagcgagccccaccugauuuuuguguacgaagauagacagauccucgaggacgccgccgcucugauuuccuauuacguuaagcgccaaccugccauccagaaagaggaucagggcacaauccaucaacuucugcaccaguucgugcccagccucuuuuucucucagcagcuggaccugggggcuuccgaagagagcgccgaugaagaccgggauuccccgcaaggacagacgaccgacccuucugagagaaagaaacccgcgcccggcccucacagcuccccgcccgaggaaaagggggccuuuggcgaugcuccugccacagagcagcccccucuucccccucccgcuccgcauaagccucucgacgaugucuauucucuguucuuugccaauaacaauugguacuucuuucugcgccuccaccagacccugugcagcagacuucugaaaauuuaucggcaagcgcagaagcagcuccuggaauaccgcacagagaaagaaagagagaagcugcuuugugagggacggcgcgaaaaaggcuccgaccccgccauggagcucagacugaagcagccuucugaaguggagcuggaagaguauuaccccgcuuuccucgauauggugcggagccugcuugagggguccaucgacccgacccaauacgaagacacgcugcgcgagauguuuacaauucaugccuauguuggauucaccauggauaagcucguccagaacaucgcuagacagcugcaccaccuggugagcgacgaugugugccuuaaagucguggaacucuaccugaaugagaagaaacggggcgccgccgggggaaaccugucuucccgcuguguuagagcugcgcgggaaaccagcuaucaauggaaggccgagagaugcauggcugacgagaauuguuucaaagugauguuucuccagcgcaagggccaggucauuaugacaaucgaacugcuugauaccgaggaagcccagacagaggacccuguggagguucaacaucuggcccgguacguggaacaguaugucgggacggagggcgcuucuuccagccccaccgaaggauuccuccugaagccuguguuucugcagagaaaccuuaaaaaguuccgccggagauggcagucugagcaagcccgcgcgcugcggggcgaagcuagauccagcuggaaacgccucguugggguggaguccgccugcgaugucgacugccgguuuaagcugagcacacacaaaaugguguucauugugaacucugaggauuacauguauagacggggaacccucugucgcgccaagcagguccagccccugguucuucugagacaucaccagcauuuugaagaguggcacagccgguggcucgaagacaaugugacaguggaggcugccucccugguccaagauuggcugaugggcgaagaggacgaggauauggugcccugcaagacccuuugugaaacgguucacgugcaugggcugccugucacccgcuacagagugcaguacucucggagaccggcgagccccuga

SEQ ID NO: 75572 - RNA, 3129 nt, Artificial Sequence
  derived and/or modified sequence opt5 from SIPA1__Homo_sapiens__NP_694985
augcccaugugggccggcggggugggaagcccuagacggggcauggcuccggccuccaccgacgaucuguucgcgcgcaagcucagacagcccgcucggccuccccugacaccucacacguuugagccccgcccugucagagggccgcuucugcggucuggaagcgacgccggcgaagccagacccccuacccccgcuuccccucgcgcccgggcucauucucacgaggaagccagccgccccgcggccacauccaccagacucuucacagauccgcuggcccuucuggggcucccugcugaggaacccgagccugcuuuuccucccguucuggagccccggugguucgcccauuacgacgugcaaucucugcucuuugauugggcgccgcgcagccagggaaugggcucccacagcgaagccucuuccggcacccuggcuagcgccgaggaccaggcugccucuuccgaucuucugcauggggcccccggauucgugugcgaacucggcggggagggagagcugggccuugggggaccugcuucucccccugugcccccggcgcugccuaacgccgcugucagcauccucgaggaaccccagaauagaacauccgccuauagccuggaacacgccgaccugggcgcuggcuacuaucggaaauacuuuuaugggaaggagcaccaaaacuucuuuggaauggaugaaucccucggcccuguugccgugucucugcgcagagaggagaaagaagggagcggaggcgggacccuucauuccuaccgggucauugugagaacgacccagcugcgcacacuccggggaaccaucagcgaggacgcgcugcccccuggacccccgagaggccuuucuccucgcaagcugcucgaacacguugcuccccagcugucccccagcugucugcggcucgggucugccagcccuaaagugccgagaacacugcuuacccuggaugagcagguccucuccuuccaacgcaaggugggcauucuguauugccgggccggccaggggucugaagaggagauguacaauaaccaggaagcuggacccgccuuuaugcaguuccuuacgcugcucggcgacguggucagacugaagggguuugagagcuaccgcgcucaacuggauacaaaaaccgacuccacaggcacccauagccucuauaccacauaccaggaccacgaaaucauguuccacguuucuacgaugcugccuuauacccccaauaaccagcaacagcuucugcggaagagacauauuggaaaugauaucgugacaaucguguuccaggagccuggcuccaaacccuuuuguccuaccacaauucgcagccacuuccagcaugucuuucucgugguucgggcccacacccccugcacgccgcauacaaccuacagaguggcggucucucggacccaagacaccccugccuucgggcccgcucugccugccggaggcgggcccuuugcugccaacgcggauuuccgcgccuuucugcuugcuaaggcccucaauggagaacaggcugccggccacgccagacaguuccacgcuauggcgacacggacaagacagcaauaucugcaggaccuggccacgaacgaggugaccacaaccucccucgauagcgcuucccgcuuugggcugccgucucuuggcggacggagacgcgccgccccuagaggccccggggcugagcugcaggccgcgggaagccucguuuggggcgugcgggcugccccuggggcccgcgucgcugccggagcgcaggcuuccggccccgaagggaucgaggugcccugucugcugggcauuucugccgaagcccuuguccucguggcuccuagagacggacggguuguguucaauugcgccugucgcgauguccuggcuuggacauuuagcgagcaacagcuggaccucuaccauggcagaggggaggccaucacccugcgguucgauggauccccgggccaggcggugggggaaguuguggcccgccuucagcuggucagcagaggaugcgagacgcgggaacucgcucugccccgcgacggccaagggagacugggcuuugagguggaugccgaaggauucgugacccacguugagcgguucacauuugcugagaccgccggccuuagaccuggggcccgccuccugcgggucuguggacagacacugcccucucucagaccugaagcugcggcccagcugcuucgcuccgcucccaaagugugcgugaccguccugccuccggacgagagcggccggcccagacgcucuuucuccgaacucuauacgcugagccugcaagagccuucucggagaggggcccccgacccugugcaggaugaaguucagggagugacacuucuccccaccacaaagcagcugcugcaucucugucugcaagacggcggcagcccgccugggcccggagaucuugccgaggagcgcaccgaauuucugcacucccagaacagccucucuccccgguccagccuguccgacgaggcuccuguccugcccaauaccacaccugaucuucugcucgccacgaccgcgaagccgucugugcccagcgcugacuccgaaacaccucugacccaggauagacccggcucuccuagcggguccgaggacaaaggaaaccccgccccggaacuccgggccucuuuccugccucgcacacuuagccugagaaauuccauuagccggaucaugucugaggcuggcuccgggacccucgaggaugaauggcaggccauuagcgagaucgcgucuacgugcaacacaauccuggaaucccugagccgcgagggacaacccauuccugagucuggcgaccccaagggcaccccuaaauccgaugcugaacccgagccggggaaccuuagcgaaaagguuucccaccuggagagcaugcucagaaaacugcaggaagaccuccagaaggagaaagccgaucgggccgcucuggaggaagaggugagaucucuucgccauaauaaccggagacugcaggccgaaagcgaguccgcugccacccgccuccugcuggcgucuaagcaacuuggaagcccuacagccgaccuggcuuga

SEQ ID NO: 75573 - RNA, 5169 nt, Artificial Sequence
  derived and/or modified sequence opt5 from SIPA1L2__Homo_sapiens__NP_065859
augagcgaccccagacagucccaagaggaaaagcacaagcugggccgggcuucuagcaaguucaaagauccucccagaaucaugcaguccgacgauuacuuugcuagaaaguucaaagcuauuaaugggaauaugggacccacaacaucucucaacgcgagcaauuccaacgagacgggcgggggaggcccugcuaaugggacccccgccgugccuaagaugggaguccgggcccgcguuucugaauggcccccuaagaaagacugcagcaaggagcugacauguaaagcucuuugggaauccagaagccagaccucuuaugaguccaucacaagcgugcugcagaacggccaaucugaucaguccgagggccagcaggacgaacaacucgaucuggacuuuguggaggccaaguacaccauuggggauaucuucguccauagcccgcagcggggacuucaccccauucgccagagaucuaauuccgacgugacaaucagcgauaucgacgcugaagauguucuggaccagaacgccgugaauccuaacaccggcgcggcccuccaucgggaguauggguccacgucuagcauugaccgccaaggacuguccggcgagaacuuuuucgcuaugcugagaggguaccgggucgaaaacuaugaucacaaagccauggugcccuuuggauucccugaguuuuuccgcugcgaccccgcuaucagcccgucucuccaugccgcggcccagauuuccagaggcgaauuuguucggaucagcggccuggauuacguggacucugcccuucucauggggcgcgauagagacaagccuuucaagcggagacucaaaagcgaguccgucgaaaccucucuguuucgcaaacuucggacagugaaaagcgagcacgagaccuucaaguucacauccgaacuggaggaaagcagacucgagcgcggcauucggcccuggaauugucagagaugcuuugcucacuaugaugugcaaucuauccuguucaacauuaaugaagcuauggccacccgcgccaacgucggcaaacggaagaacaucacgacaggggcuuccgcggccagccagacccagaugccuacaggacagaccggcaauugugagucuccccugggguccaaagaggaccucaacagcaaggaaaaucuggaugcugacgagggagauggcaaguccaacgaccuuguucugucuugccccuacuuuagaaaugaaaccggcggggagggagaccgccggaucgcccucagcagagccaacuccucuagcuucuccagcggcgaaucuuguuccuuugagagcucucuguccagccauugcacaaaugcuggggugucugugcuugaggucccucgcgaaaaccaaccgauucaccgggagaaagugaagagauacaucauugaacauaucgaucugggagccuauuacuaucggaaauucuuuuacggcaaggagcaccagaauuauuucgggauugacgagaaccucggccccguugcggugagcauccgcagagaaaaagucgaggaugcuaaggaaaaggagggaucccaguuuaauuaccggguggccuucagaacgagcgaacugaccacacugcgcggcgccauccucgaggacgcuauuccuucuaccgcccggcacgggacagcuagaggacugccccuuaaagagguucuggaauaugugaucccugagcucuccauucagugucugcgccaagccagcaacucccccaaggucucugaacagcuucugaaacucgaugagcagggccugagcuuucagcauaagaucgggauucuguacugcaaagcgggacaauccaccgaagaggagauguacaauaacgaaacggccggcccggcuuucgaggaauuucucgaccugcuugggcagagagugcggcugaagggcuucucuaaguaucgcgcccagcucgauaauaaaacagacagcaccggaacccacucccuguacacaaccuauaaggauuacgagcugauguuccaugucucuacacuucucccuuauaugcccaacaacagacagcaacugcugcggaaacgccacaucggcaaugacaucgugacgauuguuuuucaggaaccuggggcucuccccuucaccccuaagagcaucagaucccauuuucagcacguguucgucauugugaaaguucacaaccccuguacagagaaugugugcuacagcgucggagugucucgguccaaggaugugccgccuuuuggaccgcccaucccuaaggggguuaccuucccgaaaagcgccgucuuucgcgacuuccugcuugcgaaggugauuaacgccgagaaugcugcccauaaaucugaaaaguuuagagcuauggccacacggacccgccaagaguaucugaaagaucucgccgaaaacuucgugacgaccgcuacagucgacaccuccgugaaguuuagcuucaucacacugggagcgaaaaagaaggagaaaguuaagcccagaaaagacgcccaccuguuuucuauuggcgcuaucauguggcaugugaucgcccgggauuucgggcaguccgccgacauugagugccuucucggcaucagcaaugaguucauuaugcugaucgaaaaggauuccaaaaacgucguguuuaauuguagcugcagagacguuauuggauggaccucuggccuggugagcaucaaggucuucuacgaacgcggggagugugugcuccuguccucuguugauaacugcgcugaagacauccgggagauugugcagagacuugucaucgugacgcgcggaugugagacaguggaaaugacccugcggagaaauggccucgggcagcugggauuucacgucaacuucgagggcauuguugccgauguggaaccuuuuggguucgcguggaaggcuggccugcgccaaggaagccggcuuguggagaucugcaaagucgccguggccacacucacccacgaacagaugauugaccugcugagaaccuccguuacagugaaggucgugaucauccagccccaugaugacggcucuccucgccggggguguagcgagcucugccgcauucccaugguugaguacaaacuggauuccgaaggaacgccuugugaguauaagacccccuuucggcgcaauacaaccuggcacagagugccgaccccugcccuucagccccugucucgggccagcccuauccccggcaccccggaccgccucccuugccaacagcugcugcagcaggcgcaagcugccauucccagauccacgagcuucgaucggaaacuuccugacgggacaagaucuucccccagcaaccagucuuccagcuccgaccccggaccuggcggcucugggccguggcgcccccaggucggauacgauggcugucaaagcccucuccugcuggaacaucagggguccggaccccucgagugcgacggcgcccgggaaagagaggauaccauggaggcuagccgccacccugaaaccaaguggcaugggcccccuucuaaggugcugggauccuauaaagagcgggcccuucagaaggacggcagcugcaaagauucuccgaauaagcugagccacaucggcgacaaauccuguucuagccacuccucuagcaacacacucuccagcaacaccucuuccaauagcgaugacaagcauuuuggguccggagaucugauggaccccgaacugcuuggccugacauacauuaagggggcuucuacggauagcggaaucgacaccgccccuugcaugcccgcgacaauccucggcccuguucaccuggccggguccagaucucucauucauagccgcgcugagcagugggccgacgcugccgauguguccggacccgacgaugagccggccaaacuguauagcguccacggcuacgcuucuaccaucuccgcgggcagcgccgcugaagggucuaugggagaccuuuccgagauuagcucucauagcuccggcucucaccacagcggguccccuagcgcccauuguuccaagucuagcggaucccuggauucuagcaaaguguauaucgugucccacucuagcggccaacagguccccggguccaugagcaagcccuaccaucggcagggagccguuaacaaauacgugauuggcuggaagaaaucugaaggcuccccucccccugaggaaccggaggugacagagugccccgggauguauagcgaaauggacgucaugucuaccgcuacgcagcaccaaaccgugguuggagaugccguggcggagacacagcacguccucuccaaggaagacuuccugaagcugaugcuuccugauagcccccugguggaggaaggcagacgcaaauuuucuuucuacgggaaucucuccccuagacggagccuguaucgcacccucuccgacgagagcaucuguucuaacagacggggaagcuccuucggcucuagccgcuccucuguucuggaucaggcccuucccaaugacauucuguuuagcacaaccccgccuuaccauuccacacugcccccuagagcccaccccgccccuucuauggggagccugcggaacgaguucugguuuuccgauggaagccugucugacaaguccaaaugcgcugaccccggccuuaugccgcugccugauaccgccacgggccucgacuggacacaucugguggaugcggcuagagccuucgaagggcucgacagcgaugaggaacugggacuucugugucaccauaccucuuaucuggaccagcgcgucgccuccuuuugcacccucacagauaugcaacacggccaggaccuggagggggcucaggaacuuccccuguguguggaucccggaagcggcaaggaguucauggacaccacgggggagcgguccccuucuccgcucacaggaaaagucaaucagcuggaacucauccugagacaacuucagaccgaucugcgcaaggagaagcaggacaaagccgugcugcaagcugaaguucagcaccuccggcaggauaacaugagacugcaggaggagagccaaacagccaccgcgcagcuucggaaguuuacagaaugguucuuuaccacgaucgacaaaaaguccuga

SEQ ID NO: 75574 - RNA, 5346 nt, Artificial Sequence
  derived and/or modified sequence opt5 from SIPA1L3__Homo_sapiens__NP_055888
augaccacauacagagccauccccagcgacggcguggaucuggcugccuccugcggggcgcgggucggagacguucugccuggcccgcacacgggggauuaugcuccccugggauucugggcccagaacggcucuaugagccaaccucuuggggaaucccccgccaccgcuacagccaccgcuacagccaccacaagaccuucucccaccacgccugcgaugccgaaaaugggagugagagcccggguggcugacuggcccccuaaacgcgaagcccugagagagcauagcaaucccuccccuucucaggauaccgacggcacaaaggcuaccaaaauggcccacagcaugcgguccauucagaacggccagcccccgacaagcaccccugcgucuuccgggagcaaggccuuucaucgccucucuagacggcgcuccaaagaugucgaguuccaagacggauggcccagaagcccuggccgggcuuuucugccccuucgccacagaucuuccagcgagaucacgcuguccgaaugugaugccgaggacgcuggggagccccggggagcccgccauacaggcgcccucccucuguucagagaauacgggucuaccagcuccauugaugugcagggaaugccggagcagagcuuuuucgacauccugaaugaauuucggucugagcagcccgaugcuagaggcugccaagcgcucacagagcugcuucgcgccgacccuggcccccaccugaugggagggggcgggggagcuaagggcgacucccacaacgggcagccugccaaggauagccuccugccccuucagccgaccaaagaaaaggagaaagcccggaagaaaccugcuagaggacugggcggcggggacaccguugauucuagcauuuuccgcaagcuccgguccucuaagcccgaaggagaggccggcagaagcccuggggaagcggacgagggacgcagcccucccgaggcuagccggcccugggugugucagaaaucuuuugcccauuucgauguccaauccaugcuguuugaccugaaugaagccgcugccaacagagugagcguuucucagcgccggaauacaacgaccggcgcuuccgccgcgagcgccgcuuccgccauggcuucucucacagccagcagagcgcacucccucgggggccuugauccggccuucaccucuacagaggaccugaacugcaaggaaaaucucgagcaggaucugggagacgauaacagcaaugaccuucugcucuccuguccucauuuucgcaacgaaaucggcggggagugcgagcggaaugugagcuucucuagagcuuccgucggaagccccucuuccggcgaagggcaccuggccgagcccgcucugagcgccuaucggaccaacgccucuaucagcgugcucgaagugccuaaagagcaacagcgcacgcaguccagaccgcggcaguacagcauugaacacgucgaccugggagcuagauauuaccaagauuauuucguuggcaaggagcaugcgaauuacuuugggguggacgagaaacuuggccccguggccgucucuaucaagcgcgaaaaacuggaggaucacaaggaacauggaccucaguaccaguaucggauuaucuucagaacacgcgagcucauuacccugagaggcuccauccuugaggacgcuacccccacagccaccaagcacgggacaggacggggccugccucucaaagaugcccuggaauacgugauucccgagcugaacauccauugucuccgccuggcucuuaacacgccuaagguuaccgaacagcugcucaaacuggacgagcaagggcugugcagaaagcacaaagugggaauccuuuauuguaaggccggccagagcuccgaagaggagauguacaauaacgaagaggcggggcccgcuuuugaagaguuccucucucugauuggcgaaaaggucugccugaaaggauuuacaaaguaugccgcccagcucgaugugaaaaccgacagcacaggcacccacucccuguacacgauguaucaggauuacgagaucauguuccauguuucuacccuucugccguacacaccuaauaaccggcaacagcuccugcgcaagagacacauugggaaugacaucgugaccauuaucuuucaggagcccggagcucugccuuucacacccaaaaacauccggagccauuuucagcacgucuucauuaucgugcgcguccacaauccguguaccgauaacgugugcuauuccauggccguuacgagaucuaaggacgcgccucccuuuggcccucccauucccagcgggacaaccuuccggaaguccgauguguuucgcgacuuccuucucgcuaaagucaucaaugccgaaaacgccgcucauaagagcgacaaauuccacacaauggccaccagaacccggcaagaguaccugaaggaucuggcugaaaauugcgugucuaacacaccuauugacuccacgggaaaauuuaaucucaucagccugaccucuaagaagaaagagaagacaaaagccagagcgggcgccgaacagcauuccgcuggggccaucgcuuggcgcguuguggcccaggauuaugcccaaggcgucgagauugacuguauccuuggaauuagcaacgaguucguggugcugcucgaucugcggaccaaggaaguugucuuuaauugcuacuguggcgacgugaucggguggacaccggauucuuccacccugaaaauuuucuauggaagaggcgaccacaucuuucuucaggcuacggaggggagcguggaagauauucgcgagaucguccagcggcucaaggugaugacauccggaugggagaccguugacaugacccugagacgcaacggccugggccagcucggguuccaugugaaauacgauggaacagucgcggaaguggaggacuauggcuuugccuggcaagcugggcugcggcagggaagcagacuuguugaaaucugcaagguggccgucgugacccugacacacgaucagaugauugaccuccugcgcacgucuguuaccgugaaggucgugaucauucccccuuucgaggacggcacaccccggagaggguggccugaaaccuacgauaugaacacaagcgagcccaaaaccgagcaggaauccaucacgccuggaggccggccgcccuaccgcucuaaugccccuuggcaauggagcggccccgcuucccacaacucucugccugccagcaagugggcgacccccacaaccccggggcaugcucagucccuuucuagaccucucaaacagacacccauugugcccuuucgggagagccagccucugcacuccaagcgccccgucagcuucccugaaaccccguauacaguuucucccgccggagccgacagagugccucccuaccggcaaccuuccggcagcuuuucuacccccggguccgcuacguaugugagauacaaaccgagcccugagcgcuauacagccgcgccccauccucugcucucccuggauccccacuucucucaugacggaaccagcuccggcgauagcucuagcgggggacuuaccagccaggaaucuacaauggagcggcagaagccugagccccuguggcacgucccggcucaagccagacucagcgccaucgcuggcuccucuggcaauaagcacccuagccgccaggacgccgcugggaaagauucccccaaccggcauucuaagggagaaccccaguacagcucccacuccucuuccaauacccugagcuccaacgccucuagcucccauucugacgauagaugguuugacccucuggauccgcuugagcccgaacaggacccucugagcaaaggcggguccagcgacucuggaaucgauacgacacucuauaccuccagccccucuuguaugucccuggcgaaggccccucgccccgcuaaaccucacaagccgcccggcagcauggggcucugcggaggcggccgggaggccgcugggagaucucaccaugccgaccgcagacgggaagugagcccugcccccgcuguugcgggacaauccaagggcuaccgcccuaaacuguacucuagcggguccagcacacccaccggacuugccggcggguccagagauccgccucggcagcccucugacaugggaagccgcgugggcuaucccgcucaggucuacaagacagccuccgccgagaccccuagacccucucagcuggcucaaccuagcccguuccagcucuccgccucugugcccaagagcuucuuuuccaagcagccuguucggaauaaacaccccacgggcuggaagagaaccgaggaaccucccccgcgcccucugcccuucagcgauccuaagaaacagguggacacaaacaccaagaaugucuuugggcaaccccggcugagagcgucucuucgcgaucugcgguccccucgcaaaaacuauaagagcacaauugaggacgaucucaaaaagcugaucauuauggacaaucucggacccgaacaggagcgggauaccggccagucuccgcagaaagggcugcaacgcacgcuuuccgacgagagccuguguucuggaagacgggaaccuuccuucgcuagccccgccggccucgagcccgggcugccuuccgaugugcuguuuacaucuaccugcgccuucccguccagcacacuucccgcucgcagacagcaucagcacccucaucccccuguuggacccggcgccaccccugcggccggcuccggguuucccgaaaagaagucuaccaucagcgcuuccgagcugucucucgccgacggacgggaccgcccgcugagacggcucgauccuggccugaugccccuuccugacacagcugccgggcuggaauggagcucccuggugaacgcugccaaagcguacgagguccaacgcgccgugucucucuucagccugaaugaucccgcucuuuccccggacauuccucccgcccacagccccgugcacucucaucugucccucgagagaggaccucccacgccucggaccacaccgaccaugagcgaagaacccccucuggaucucacaggcaaggucuaucagcuggaaguuaugcuuaaacagcugcacaccgaccugcagaaggagaaacaagauaagguggugcuccagucugaagucgcuucccugagacagaacaaucagcgccuucaagaggagagccaggccgccuccgaacagcugcggaaguuugcugagaucuucuguagagagaagaaagagcucuga

SEQ ID NO: 75575 - RNA, 1515 nt, Artificial Sequence
  derived and/or modified sequence opt5 from SIRPA__Homo_sapiens__NP_542970
auggagcccgccggcccugcuccggggagacugggaccccuccugugccuucugcucgccgcgagcugugcuugguccggcguggccggggaagaggaacugcaggucauccaaccugacaagucuguucuuguggccgcuggagagaccgccacacugcggugcacggcuaccagccucauucccgugggcccuauccagugguuccgcggggccggacccggcagagaacugauuuacaaccagaaagagggccacuuuccucgggucacaaccguguccgaucugacaaagcgcaauaacauggacuucucuaucagaauugggaauaucaccccggcggaugccggaacauauuacuguguuaaauuucggaagggcagccccgacgauguggaguucaaauccggggcuggaaccgaacucucuguccgcgccaagccuagcgcucccgugguuuccggcccugccgcgagagccacgccccagcauaccgugagcuuuacaugcgagucucacggguucuccccgcgggacaucacccugaagugguuuaaaaacggaaaugaacuuagcgauuuccaaacaaacgucgacccugugggcgagucuguguccuauagcauucauucuaccgcuaaggucguucugacgcgcgaggaugugcacucccaggugaucugugaagucgcccaugugacacuccagggcgacccccugagagggaccgcuaaucuuagcgagacaauucggguuccucccacccuggaagugacccagcaacccguccgcgccgagaaccaggugaauguuacaugccaggugagaaaauuuuacccucagcggcuccaacugacguggcuggaaaacggaaaugucucccgcaccgagacagccucuaccgugacagagaacaaggauggcaccuauaauuggaugagcuggcuccuggucaacguguccgcucacagagacgauguuaaacuuacgugucagguggaacacgacgggcagccggcggucagcaagucucaugaccugaagguguccgcccaccccaaagagcaaggaagcaauacagcugccgaaaacaccggcucuaacgagcggaauaucuacauuguugugggggucgugugcacccuccugguggcccuucugauggcugcccucuaucugguuagaauccgccagaagaaagcgcagggaagcacauccucuacccggcugcaugaaccugagaagaacgcuagagagauuacacaggauacgaaugacaucaccuacgccgaucucaaccugcccaaaggcaagaaaccugcuccccaagccgccgaaccgaauaaccacacagaguacgcuagcauccagaccuccccucagcccgccagcgaagacacacuuaccuaugcggaucuggacaugguccaccucaaucgcacgccuaagcagcccgccccuaagcccgagccgucuuucuccgaauacgcuagcgugcaagugccucggaaauga

SEQ ID NO: 75576 - RNA, 546 nt, Artificial Sequence
  derived and/or modified sequence opt5 from SIRPB1__Homo_sapiens__NP_001077379
augcccgugccugccagcuggccgcaucugcccuccccuuuccuccugaugacccuucugcucggcagacugacaggggucgcuggagaggacgaacuucagguuauccaacccgagaagucugugagcguggccgcgggcgaauccgcuacgcugcggugcgccaugaccucucucauuccugucgggcccaucaugugguuucgcggagccggcgcugggagagagcugauuuacaaccagaaagaaggacacuucccucgggugacaaccguuagcgagcugacaaagcgcaauaaccucgauuuuuccaucucuauuagcaauaucaccccggccgacgcuggcacauauuacugugugaaauucagaaagggcucccccgaugacgucgaguuuaaaagcggggccggaaccgaacugucugugcgggaggcggcccuugcuccuacggcuccccugcucguugcccugcuucugggcccuaagcuccugcugguggucgggguguccgccaucuauauuugcuggaagcagaaagcguga

SEQ ID NO: 75577 - RNA, 831 nt, Artificial Sequence
  derived and/or modified sequence opt5 from SIRPG__Homo_sapiens__NP_001034597
augcccgugccugccagcuggccgcaucccccuggccccuuccugcuccugacccuucugcucgggcugacagaggucgcuggagaagaggaacuucagaugauccaaccugagaagcugcuccugguuacggugggcaaaaccgccacacugcacugcaccgugacaucccuccugcccgucgggccugugcuuugguuuagaggaguuggcccggggcgggaacugauuuacaaccagaaggagggacacuucccccgcgugaccacagucucugaccucaccaaaagaaauaacauggauuuuagcauccggauuuccucuaucacgccugcggacgugggcaccuauuacuguguuaaguuccgcaaaggcagccccgagaauguggaauuuaaguccgggccuggaacagagauggcucugggcgccaagcccucugccccggucgugcuugggccugcugccagaaccacacccgaacauaccgugagcuucacgugcgagucccacggauuuagcccucgggauauuacacugaaaugguucaagaacggcaaugagcucucugacuuucagaccaacgucgaucccacagggcaguccguugcuuauagcauccgcucuaccgccagaguggugcuggaccccugggauguccggucccaagugaucugugaaguugcgcaugugacccugcagggagacccucuccgcggcacagccaaucugagcgaggcuauuagaggcccggccucuucccuuacggcucugcuccugaucgccguccuucuggggcccauuuacgugccuuggaaacagaagaccuga

SEQ ID NO: 75578 - RNA, 1359 nt, Artificial Sequence
  derived and/or modified sequence opt5 from SIRT1__Homo_sapiens__NP_001135970
auguucgacaucgaguacuuuagaaaggauccccggccuuucuuuaaauucgccaaggaaauuuauccgggccaguuucaacccagccugugccacaaauucaucgcucucuccgacaaggaggggaaacugcuucgcaacuacacccagaauauugauacacuggaacagguggccggaauccagagaauuauccaaugucauggcucuuuugcgacggcuagcugccucaucuguaaguauaaggucgacugcgaggccguucgcggggauauuuucaaccagguggugccucggugucccagaugcccugccgacgaaccccuggcuaucaugaaaccugagauugucuuuuucggagagaaucuuccggaacaguuucaccgggccaugaaguacgauaaagacgagguggaucugcucaucguuauuggcuccucucugaaggugcgccccgucgcucugaucccuagcuccauuccccaugaagugccucagauccucaucaacagagagccccugccgcaccuucauuucgacguugagcugcucggggauugugacgugauuaucaaugaacugugccaccggcuuggaggcgaguaugccaaacuguguugcaacccugucaagcucucugaaauuaccgagaagcccccucgcacacaaaaagaacuggcguaccugagcgagcucccucccacaccccugcacguguccgaggauucuagcuccccggaaagaaccucucccccugacagcuccgugaucgucacccuucuggaccaggccgcuaagagcaaugaugaccucgauguuucugaguccaaaggcuguauggaagagaagccccaggaagugcagacaagccggaacguggaguccauugccgagcaaauggaaaauccugaccugaaaaacgucgggucuagcaccggagagaagaaugaacgcacguccguggcuggcaccguuagaaaaugcuggcccaaccggguggccaaggagcagaucagccgcagacuugaugggaaucaguaucuguuucucccgccuaaccgguacaucuuccauggagcggaagucuacucugacuccgaggaugacgugcugagcucuagcuccugcggcucuaauagcgauuccgggacaugucaaagccccucucuggaggaaccuauggaggacgaauccgagauugaggaguucuauaacggacucgaagaugaacccgacguuccugagagagccggcggcgcuggguuuggaaccgacggcgaugaccaggaagccaucaacgaggcuauuagcgugaagcaggaggucacagauaugaauuaccccucuaacaaauccuga

SEQ ID NO: 75579 - RNA, 705 nt, Artificial Sequence
  derived and/or modified sequence opt5 from SIRT2__Homo_sapiens__NP_001180215
auggacuuccugagaaaccucuuuagccagacccugucccuuggcucucaaaaggagcggcugcucgaugaacugacacuugaggggguggcccgcuacaugcagagcgaaagaugccggcgcgucaucugucugguuggagcuggcauuuccacgucugccgggauccccgacuucagaagcccuuccaccggacucuaugauaaucuggagaaauaccaucugccguaucccgaagcgauuuuugagaucucuuacuucaagaaacacccugagcccuuuuucgcucucgccaaggaacuguauccuggccaguuuaaacccacaauuugccacuacuucaugcggcuucugaaggacaaggggcuccugcuucgcuguuauacccagaacaucgauacacuggagagaaucgccggacucgaacaagaggaccugguggaggcucauggcaccuuuuacacaagccacugcguguccgccagcugucggcaugaauacccucugucuuggaugaaagagaagauuuucuccgaagucaccccgaaaugcgaggauugucagagccucgugaagcccgacaucguguuuuucggcgaaucucugccugcucgcuuuuucuccugcaugcagagcgauuuccuuaaaguugaccugcuccuggucauggggacgucucuucagggaagaggccuggccggguga

SEQ ID NO: 75580 - RNA, 774 nt, Artificial Sequence
  derived and/or modified sequence opt5 from SIRT3__Homo_sapiens__NP_001017524
auggugggcgccgggaucagcacccccuccggcauuccugacuucagaucuccgggaagcgggcuguacuccaaccuccagcaauaugaucugcccuacccugaggcuaucuuugaacuucccuucuuuuuccacaauccuaagcccuuuuucacacuggccaaagagcucuauccuggaaacuacaagccgaaugucacgcauuauuuucugcggcuucugcacgacaaaggccuccugcugcgccucuacacccagaacauugaugggcuggaaagaguuucuggaauccccgcgagcaaacuuguggaggcucauggcacauucgccuccgcuaccugcacagugugucagcggccuuuucccggcgaagacauucgcgccgaugucauggccgacagagugccucggugccccguuuguaccgggguggucaagccggauaucguguucuuuggagagccucugccccagcgcuuccuccugcacguuguggacuuuccuauggcugaucuucugcucauccugggcacaucucuggaggucgaacccuucgccagccucaccgaggcggugagauccagcgugccccggcugcuuauuaaucgcgaccuggucgggccucucgccuggcauccgagaucucgggauguugcucaacugggagacguggugcacggcgucgaaucccuuguggagcugcucggguggacggaggaaaugcgcgaucugguucagagagagaccggaaagcuggacggccccgacaaguga

SEQ ID NO: 75581 - RNA, 945 nt, Artificial Sequence
  derived and/or modified sequence opt5 from SIRT4__Homo_sapiens__NP_036372
augaagaugagcuucgcccugaccuuuagauccgcuaaaggccgguggaucgccaaccccucucagccuugcagcaaggcguccauuggacucuucgugccggcuucucccccucuggaccccgagaaagucaaggaacuucaacgcuuuaucacacugagcaaaagacuccugguuaugacgggggccggcauuuccaccgagucugggaucccugauuaccggagcgaaaaggugggacuuuaugcccgcacagacagacggcccauucagcacggcgauuucgugcgcuccgcuccuaucagacagcgguacugggcccgcaauuuugucggguggccgcaguucagcucucaucaacccaacccugcucacugggcccuguccaccugggagaagcucggaaaacuguauuggcuggugacacagaauguugacgcgcuccauaccaaggccggcagcagacggcugacagaacuucacggcuguauggaucgcgugcugugccucgacuguggggagcagacccccagaggaguccugcaggagcgguuucaagugcuuaacccuacguggucugcugaagcccauggccuggcucccgauggggacguuuuccucuccgaggaacaggugcgcagcuuucaggucccgaccugcgugcaguguggaggccaccugaaaccugauguggucuucuuuggggacacaguuaaucccgauaagguggacuucgugcacaaaagagucaaggaggccgauucucugcucgugguuggauccagccugcaaguguacuccggcuaucgguuuauccuuaccgcgugggagaagaaacugccuauugccauccucaacauuggccccacaagaucugacgaccuggcuugccuuaagcugaauagccgcuguggggaacuccugccccugaucgauccuugcuga

SEQ ID NO: 75582 - RNA, 879 nt, Artificial Sequence
  derived and/or modified sequence opt5 from SIRT5__Homo_sapiens__NP_001180196
augagaccccugcagaucgugccuagccggcucauuucccaacuguacugcggccuuaagccgcccgccucuacccgcaaccagaucugucugaaaauggcuagaccuagcuccucuauggccgacuuccggaaguuuuucgcgaaagcuaagcacauugucaucauuagcggggccggaguuuccgccgagucuggcgugcccacauuucgcggggcuggaggcuauuggagaaaauggcaggcccaggaucucgcuacgccucuggccuucgcgcauaaucccagccgggugugggaauuuuaccacuaucgcagagaggucaugggguccaaggaaccuaacgccggacaucgggcuaucgccgagugcgaaacccgccuuggcaagcaaggcagacgggugguugugaucacacagaauauugacgagcugcaccgcaaagcugggaccaagaaccuccuggagauccauggaagccuguucaaaacaagauguaccucuugcggcgucguggccgaaaauuacaaguccccgauuugucccgcgcucagcgggaaaggaugcgaggaagccggcugugggggacugcuucggccucacguugugugguuuggcgagaaccuggaucccgcuauccucgaggaagucgaccgcgagcuggcccacugcgaucuuugucugguggugggcacaucuuccgucguuuauccugcugccauguucgcuccccagguggccgcgagaggggugccggucgccgaauuuaauaccgagacgaccccugcuacaaaccgguucagauuucauuuccagggacccugcggcaccacacucccugaagcccuggccugucacgagaaugagaccgugagcuga

SEQ ID NO: 75583 - RNA, 987 nt, Artificial Sequence
  derived and/or modified sequence opt5 from SIRT6__Homo_sapiens__NP_001180214
augagcgugaacuacgccgcuggccugucccccuaugccgacaaggggaaaugcggacucccugagaucuucgauccgcccgaggaacuggaaagaaaggucugggagcuugcgcggcugguuuggcagucuagcuccgugguguuucacaccggcgcugggauuucuacagccagcggaaucccugacuuccgcggcccccauggggucuggacgauggaagagagaggacucgccccuaaauuugauaccacauucgaguccgcucggcccacccaaacacacauggcccuggugcagcuugaacgcguuggccugcucagauuucuggugucucagaaugucgacggccugcaugugcggagcggguucccucgcgauaagcucgcugagcugcacggaaacauguuuguugaagagugugccaaaugcaagacccaguacgugagagacacagucgugggcaccauggggcuuaaggcgacgggacggcuguguaccguggccaaagcucgcggccucagagccugccggaaugcugaucuguccauuacacuugggaccagccugcaaauccgcccgucuggaaaccucccccuggccacaaagagacggggcggccgccuggucauuguuaaucuccagccuaccaaacaugacagacacgcggaucugcggauccacggguauguggacgaggugaugacgagacuuaugaagcaucugggacucgaaauccccgccugggauggcccucgcguccuggagcgggcccuucccccgcugccuagacccccuacacccaaacucgaacccaaggaggaauccccuacccgcauuaacgggagcaucccggcuggacccaagcaggagccuugugcucagcacaauggcucugagcccgccuccccuaaacgggaaagacccacaagcccggccccucaucggcccccuaagcgcgugaaagcuaaggcgguucccucuuga

SEQ ID NO: 75584 - RNA, 1203 nt, Artificial Sequence
  derived and/or modified sequence opt5 from SIRT7__Homo_sapiens__NP_057622
auggccgcuggcgggcugagcagauccgagcggaaggccgcggaacgcgugagacggcuccgcgaggaacagcaaagagagcggcugcgccaggucucuagaauccuucggaaagcugccgccgaacgcagcgcugaggagggaagacugcucgccgaauccgcugaccugguuaccgagcuucagggccggucucgcagacgggaagggcugaagcgcagacaggaggaggugugcgaugaccccgaggaacuccggggaaaagugagagaacuggccagcgcgguccgcaacgccaaguaccuggugguuuauacaggcgcugggauuuccacggccgcuucuaucccugauuaccggggaccgaauggcguguggacccuccugcaaaaaggcagaagcgucuccgccgcggaccuuagcgaggccgaacccacacugacccacaugucuauuacacgccuccaugagcagaagcuggugcagcacguugugucccagaacugugaugggcuucaucugcggagcggacucccuagaaccgcuaucucugagcugcacggcaauauguauauugaagucugcacauccugugugcccaaccgcgaguacgugcgggucuucgacguuaccgaaagaacggcccugcaucgccaccaaaccgggcggacaugccacaaguguggaacccagcucagagauacaaucgugcauuuuggcgagcgcgggacccugggacagccucuuaauugggaagcugccacggaggccgcuagccgggcggacacaauccugugccucgggucuucccugaaagugcuuaagaaauaucccagacugugguguaugaccaagccuccgagccggcgccccaaacucuacauugucaaccugcaguggacaccuaaggaugacugggccgcucugaagcuccacggcaaaugcgaugacgugaugagacugcuuauggccgagcugggccucgaaauccccgccuauucccgguggcaagauccuauuuucucucuggcuacaccccuuagagccggagaggaaggcagccauucccgcaagagccugugucggucuagagaggaagcgccgccuggggaccgcggagcuccccucuccagcgccccuauccugggcgggugguuuggaagaggcugcaccaaacggaccaagcgcaaaaagguuacguga

SEQ ID NO: 75585 - RNA, 591 nt, Artificial Sequence
  derived and/or modified sequence opt5 from SIT1__Homo_sapiens__NP_055265
augaaccaggccgaccccagacugcgggcugugugccucuggacccugacaagcgccgcgaugucccgcggcgauaauuguacggaccuucuggcucucgggaucccuucuauuacccaagccuggggacuguggguccuucugggcgccguuacacuccuguuccugaucagccucgcugcccaccugucccaguggaccagagggcggucucgcagccauccgggacagggcagauccggggagucuguggaagaggugccccuuuacggaaaccugcacuaucuccagacaggccggcugagccaagauccugaacccgaccagcaggauccuacccuuggcgggcccgcucgcgccgcggaggaagucaugugcuacacaucccugcagcucagaccuccgcaaggacggauucccggcccugggacccccgugaaguauagcgagguugugcuggacucugagccuaaaucccaggccagcggacccgaaccggagcuguacgcuucugucugugcccagacgcgcagagcucgggccuccuuuccugaucaggcguaugccaauagccaacccgcugccucuuga

SEQ ID NO: 75586 - RNA, 528 nt, Artificial Sequence
  derived and/or modified sequence opt5 from SIVA1__Homo_sapiens__NP_006418
augcccaagagaagcugcccuuucgccgacguggcuccgcugcagcucaaaguccggguuucccaacgcgagcugucuagaggcgugugugccgaacgguacagccaggagguguuugaaaagaccaaacgccuucuguuccucggggcgcaggcuuaucuggaucacgucugggacgagggaugcgccgugguucaucuucccgaauccccuaagcccggcccuacaggggcccccagagcugcccggggacagaugcugaucggcccugaugggcgccucauuagaucucugggacaagcuagcgaggccgacccguccggcguggcgucuaucgccuguagcuccugcguccgggcuguggauggcaaagccguuugugggcagugcgagcgcgcucuguguggacagugcgugagaacguguuggggcugcgggagcgucgccuguacccucugcggacugguggacugcucugauauguacgaaaaggugcuuuguacauccugcgcgauguuugagaccuga

SEQ ID NO: 75587 - RNA, 855 nt, Artificial Sequence
  derived and/or modified sequence opt5 from SIX1__Homo_sapiens__NP_005973
augagcaugcugcccuccuucggcuuuacccaggagcaaguggccugcgucugugaaguucuccagcaagggggaaaccuggagagacuuggccgguuccuguggucucucccugcuugcgaccaucugcacaagaaugaaagcgugcuuaaagccaaggcgguggucgcuuuucaccgcgggaacuucagagagcuguacaaaauccucgaaucccaucaguuuucuccgcacaaucaucccaagcugcagcagcuguggcucaaagcccacuauguggaggccgagaagcugcggggacgcccucuuggcgcuguugggaaguacagagugcggcgcaaauucccccugccuagaacaauuugggauggagaagagacgagcuauuguuuuaaggaaaaaucccggggcguccuccgcgagugguacgcccacaaccccuauccuucuccgagagagaagcgggaacuggcugaggccaccggccuuacaaccacacaggugagcaauugguucaaaaaccgcagacagcgggaccgcgcggccgaagcuaaggagagagaaaauaccgagaacaauaacuccagcucuaauaagcaaaaccagcugagcccccucgaagggggaaaaccucugauguccucuuccgaggaggaauuuucucccccucagagccccgaucaaaauuccguucugcuccugcagggcaacauggggcaugcccggagcuccaauuacucucuuccgggacugacagcuagccagccuucccacggccuccagacccaucaacaccagcugcaggacagccuucuggggccccucacgucuucccugguggaucugggaagcuga

SEQ ID NO: 75588 - RNA, 876 nt, Artificial Sequence
  derived and/or modified sequence opt5 from SIX2__Homo_sapiens__NP_058628
augagcaugcugcccaccuucggcuuuacacaggagcaaguggccugcgucugugaaguucuccagcaagggggaaacaucgagagacugggccgguuccuuuggucccugccugcuugcgaacaccuccauaagaaugagucugugcugaaagccaaggcgguggucgcuuuucaccgcgggaacuucagagaacuuuacaaaauucuggagagccaucaguuuuccccgcacaaucaugccaagcuccagcagcuguggcugaaagcccacuauaucgaggcugaaaagcuccggggacgcccccugggcgccguggggaaguacagaguucggcgcaaauucccucuucccagaucuauuugggacggagaggaaacgagcuauuguuuuaaggagaaaucccggucugugcugcgcgagugguacgcucacaacccuuaucccagcccuagagaaaagcgggagcucgccgaagcgaccggccugacaaccacacaggucuccaauugguucaaaaaccgcagacagcgggaucgcgccgcugaggccaaggaaagagagaauaacgagaauagcaacucuaauucccauaacccgcuuaauggcagcgggaagucugugcugggauccagcgaagacgagaaaacccccucuggcacaccugaucacuccagcuccucucccgcucuccugcugagcccucccccgccugggcuccccucccugcauagccuuggacacccucccggccccucugccguuccugugccgguccccgggggaggcggcgcggacccucugcaacaccaucacgggcuccaggauuccauccugaaccccaugagcgccaaucuuguggaccugggaucuuga

SEQ ID NO: 75589 - RNA, 999 nt, Artificial Sequence
  derived and/or modified sequence opt5 from SIX3__Homo_sapiens__NP_005404
augguguucagaagcccccuggaccucuacuccucucacuuucugcuuccuaacuucgccgauagccaucaccgguccauccugcucgcuucuagcggcgggggaaauggcgccgggggaggcgggggagcgggcggcggguccggaggcgggaacggagcuggcgggggaggcgccggcggggccggaggcgggggaggcgggggaucucgcgcuccgcccgaggaacugagcauguuucagcuuccuacccugaauuucucccccgagcaagucgccagcguuugcgaaacacucgaggaaacgggcgacauugagagacugggccgguuucuguggucucucccuguggcucccggggccugugaggcgaucaacaagcaugaauccauucugcgcgccagagcuguggucgccuuccacaccggaaauuuucgggaucuuuaucauauccuggagaaccacaaauucacaaaggaaagccacggcaaacuccaggcuauguggcuggaggcccauuaccaggaggcggaaaaacuucgcgggagaccucugggaccgguggacaaguaucggguucgcaagaaguuuccccucccuagaaccauuugggauggcgagcagaaaacacacugcuucaaggaacggacccgcucucugcugagagagugguaccuccaagaccccuauccuaaucccuccaaaaagcgggaacuggcccaggcuacagggcuuaccccgacccaggugggcaacugguuuaaaaaucgcagacagcgggauagagccgcugccgccaagaaccgccugcaacaucaggcuaucggaccuagcggcaugcggucucucgcggagcccggguguccuacgcacggauccgccgagagccccuccacagcugccucucccaccacaagcgucuccagccugaccgaaagagccgacacgggcacaucuauccuuuccgugaccagcucugauagcgagugcgacguuuga

SEQ ID NO: 75590 - RNA, 2346 nt, Artificial Sequence
  derived and/or modified sequence opt5 from SIX4__Homo_sapiens__NP_059116
augagcuccucuagccccaccggccagaucgccuccgcugccgacauuaagcaagagaacgggauggaaucugcgagcgagggacaggaagcucacagagagguggccggcggggccgcugucggacuguccccuccggcccccgcuccuuucccccucgaaccuggcgaugccgcgacagccgcugcccggguuucuggggaggagggagcuguggccgcggccgcugccggcgcugccgccgaccaggugcagcugcauagcgaacuucugggccgccaccaucacgcugcggccgcugccgcccaaacgccccucgcuuuuuccccugaucaugucgccugcgugugugaggcgcugcagcaagggggaaaucuugacagacuggcucgguuccucuggagccugccgcagucugaucugcuccgcggcaacgaaucccugcuuaaagccagagcccugguugcuuuucaccaggggaucuaccccgagcucuauagcauucuggagucucacuccuucgaaagcgccaaucauccucuucugcagcagcucugguacaaggcucgguauaccgaggccgaacgcgcgagaggacggccccugggcgccguggacaaauaccgccugagacggaaguuuccucucccccgcacaaucugggauggggaggaaaccgucuauugcuucaaagagaagucuagaaacgcucugaaggagcuuuacaaacagaaucgguauccguccccugccgaaaagcgccaccuggcuaaaauuacaggacucagccugacccaaguguccaacugguuuaagaauagacggcagagagaccgcaaccccucugagacacagagcaaauccgaaagcgauggcaauccuucuaccgaggacgaauccagcaagggccaugaggaucuuucuccccacccccugagcuccucuagcgacgggaucacgaaccucucccugagcucucacauggagccuguuuacaugcaacagaucggaaaugccaagauuucccugucuagcuccggcgugcuccugaacgggagccuugucccggcguccaccucucccguguuccugaauggaaacagcuuuauccagggcccuuccggggugauucucaauggacugaacgucggcaacacacaggccguugcucuuaaucccccuaaaaugucuagcaacaucguguccaauggcauuagcaugaccgauauccuggggucuacaucccaagacgugaaggaguucaaaguccuccagagcucugccaacuccgcuaccacgacaagcuacucucccagcgugccgguuuccuuuccuggacugauucccagcaccgaagugaagcgggaaggcauccagacagucgccucucaggacgggggauccgugguuaccuucaccacaccugugcaaaucaaucaguauggcauuguccagauccccaacagcggggccaauucccaguuucugaacggcucuauuggauucagcccucuccaacugcccccgguguccgucgcugcgucucagggcaauaucagcguguccucuagcacguccgaugggagcaccuucacaucugaguccaccacaguucagcagggaaaaguguuucuuagcucucuggccccuuccgcugucguguacaccguucccaacacgggccaaacaauugggagcgugaagcaggaaggacucgagagaucucuggucuucucccagcugaugcccgugaaucaaaacgcccaggugaaugccaaccuuagcuccgagaauaucagcggcucugggcuccauccucuggcuagcucccugguuaacgucucuccgacccacaacuuuagccucucccccucuacccugcuuaauccuacagaacugaaccgcgacaucgccgauagccagcccauguccgcgccuguggcuucuaaaagcaccgugacauccgucagcaauacgaacuaugccacccuccagaauuguucucugauuacaggccaagaccugcuuuccgugcccaugacccaggccgcucucggagagaucguuccuacagccgaagaucaggugggccaucccagcccggcgguccaccaggacuucgugcaagagcaucggcugguucugcagucuguggcuaacaugaaggagaauuuucucuccaacagcgaauccaaggccaccucuagccugaugaugcuugauuccaaaagcaaguacguccuggacgggaugguggauacgguuugcgaggaccucgaaaccgauaaaaaggagcuggccaaacugcagacagugcagcuugacgaagacaugcaagaucucuga

SEQ ID NO: 75591 - RNA, 2220 nt, Artificial Sequence
  derived and/or modified sequence opt5 from SIX5__Homo_sapiens__NP_787071
auggccacccugcccgcugagccuagcgccggcccggcggcugggggagaagccguggccgcugccgcugccacagaggaagaggaagaggaggcgagacagcuccugcaaacgcuucaggccgcugaaggcgaggccgcugccgcggccggggcuggagccggcgcugccgccgcuggggcggaaggacccggcuccccuggcguccccgggucuccucccgaggccgcuagcgagccuccgaccggacugcgguucucccccgaacagguugccugcgugugugaggcccuccugcaggcuggccacgccgggcgccuuucuagauuucugggagcgcucccucccgcugaacggcugcgcggcagcgacccugugcugagagcccgggcccucgucgcuuuccaacgcggggaguacgccgaacuguauagacuucuggagucccggcccuuuccggcugcccaucacgcguuccuccaggaucuguaccuucgcgccagauaucaugaggcugaacgggcccgcggcagagcucugggagccguggacaaguaccggcuccgcaaaaaguuuccucugcccaaaacaaucugggauggcgaggaaaccguuuauugcuucaaggagagaucucgggcggcccugaaggcuuguuacagagggaaccgcuauccuacacccgacgaaaaacggagacucgccacccugacaggacuuagccugacccagguguccaauugguuuaagaaccgccggcagagagaucgcacgggcgcugggggaggcgcccccugcaaaagcgagucugacgggaauccuaccacagaggaugaauccagccggucuccggaggaccucgaaagaggagccgcucccgucuccgcggaggccgcugcccaaggcagcauuuuccuggccggcaccgggccucccgcuccuugucccgccucuuccagcauccuugugaacggauccuuucuggcggcuucuggcagcccggccguucuccugaaugggggaccugugauuaucaacggccuggcccucggggaggcuuccagccugggcccccuucugcucacaggaggcgggggagccccucccccucagcccucuccgcagggcgcguccgagaccaagacgagccugguccuugauccucagacaggggaggugcgccuggaagaggcucaaucugaagcccccgagaccaaaggagcccagguggcugcccccggcccugcucucggggaggaaguccugggcccgcuggcccagguugugcccggaccucccacagcggccaccuucccucugcccccuggccccgugccggcugucgccgcuccucaagugguuccccucagcccucccccgggguacccuaccggacuuucccccacaucuccucugcucaaucugccccaggugguccccacgagccaggugguuacccugccucaggccgugggcccgcuucaacuccuggccgcugggcccggauccccugucaagguggcggccgcugccggccccgccaacguccaccugauuaauagcggggugggcguuacagcucuccagcugccuucugccaccgcgcccggaaacuuucuucuggcuaauccuguguccggcagcccgaucgucacagggguggccguucagcagggaaaaaucauucucaccgccacguuccccacaucuaugcuggugucccaaguccugccucccgcuccuggccuugcccucccccugaagccggagaccgcgaucagcgugccugaagggggacugcccguggcucccuccccugcccuccccgaggcccaugcucugggcacccuuucugcccagcagccuccgcccgcugccgcgacaaccagcuccacaucucugccuuuuagccccgacuccccugggcuccugcccaacuucccggccccucccccugaaggccugaugcuuagccccgcugccguuccugucuggucugcuggacucgagcuguccgccggcacggaggggcugcucgaagccgagaagggacugggcacccaggcuccccacacagugcuucggcugccggauccugaccccgaagggcuccugcugggagcgaccgccggcggcgagguggaugaagggcuugaggcugaggccaaaguccucacacaacugcagagcgugcccguugaagaaccucuggaacucuga

SEQ ID NO: 75592 - RNA, 741 nt, Artificial Sequence
  derived and/or modified sequence opt5 from SIX6__Homo_sapiens__NP_031400
auguuccagcugcccauccucaacuuuagcccucaacagguggccggcgucugcgagacccuggaagaguccggggacguugaaagacuuggacgguuccuguggucucucccgguggcucccgccgcgugugaggcucugaauaagaacgaaagcgugcuucgcgccagagccauugucgcuuuucacggcgggaauuaccgggagcuguaucauauccucgagaaccacaaauucacaaaggaaucccaugccaaacugcaggcucuguggcucgaggcccacuaccaggaagcggagaagcugcgcggaagaccucuuggccccguggauaaauaucggguucgcaagaaguuuccucugcccagaacgauuugggacggggagcagaaaacccauugcuucaaggaacggacacgccaccuccugagagagugguaccuucaagauccuuauccgaaucccucuaaaaagcgggaacuggcccaggcuaccggacucacaccuacccaggugggcaacugguuuaaaaaucgcagacaacgggaccgcgccgcugccgcgaagaacagacugcagcagcagguccugagccaaggcuccgggcgggcccucagagcugagggagauggcacacccgaagugcuggggguugccaccucuccugcugccagccuuuccagcaaggccgcuacgucugcgaucuccauuaccagcucugacuccgagugugauaucuga

SEQ ID NO: 75593 - RNA, 768 nt, Artificial Sequence
  derived and/or modified sequence opt5 from SKA1__Homo_sapiens__NP_001034624
auggccagcuccgaccuggagcagcucugcucucacgugaacgaaaagaucggcaauauuaaaaagacccugagccuuagaaacugugggcaagagcccacacugaaaacgguccucaauaagaucggagaugaaauuaucguuauuaacgagcugcuuaauaaacuggaacucgagauccaguaccaggagcagaccaacaauucccugaaggaacugugcgagucucucgaagaggacuauaaggauaucgagcaucugaaagaaaacgugccuagccaccuuccgcaagugacagucacccaguccugugugaagggcucugaccuggaucccgaggaaccuauuaaaguugaggaacccgagccugugaagaaacccccuaaggagcagcggagcaucaaggaaaugccguucauuacaugcgacgaguuuaaugggguccccuccuacaugaaaagccgccucaccuauaaccagaucaaugaugugauuaaggaaaucaacaaagcuguuauuucuaaguacaaaauccugcaucaaccuaagaaauccaugaauagcgugacaagaaaccuuuaucaccgguucaucgacgaggaaaccaaggauacgaagggacgcuacuuuauugucgaggccgacaucaaagaguucaccacacugaaggcggauaaaaaguuucaugugcuccugaauauucugagacacugucggcgccucucugaagugagaggcgggggacugacccgguaugucaucacauga

SEQ ID NO: 75594 - RNA, 228 nt, Artificial Sequence
  derived and/or modified sequence opt5 from SKA2__Homo_sapiens__NP_001094065
auggccagcgaagugggccacaaccuggaaucccccgagaccccugggggaggcggguggacaagagucgaguucccgcccccugcucccaagggagccgcgacgguuuggugccucaaucggcugggcucucgcaaacuuagccugaucuggauuaccuuuaacacaggguggaauaugaaguccagacucaucauucugauccagcaagugucuugucaucacuga

SEQ ID NO: 75595 - RNA, 1080 nt, Artificial Sequence
  derived and/or modified sequence opt5 from SKAP1__Homo_sapiens__NP_003717
augcaggccgcugcccugcccgaggaaaucagauggcuccuggaggacgcggaagaguuccuugcugaaggccugcggaacgagaaucucagcgccguggcccgcgaucacagagaccauauucugcggggguuucaacagaucaaggcucgcuacuauugggauuuccagccucagggaggcgacauugggcaagauuccucugacgauaaccacagcggaacccuuggccugucccucacaucugacgccccguuucugagcgauuaccaggacgaggggauggaagauaucgucaaaggagcucaggagcuggacaauguuauuaagcagggcuaucucgagaaaaaguccaaagaucauucuuucuuuggcagcgaguggcaaaagagauggugcguggugucccgggggcuguucuacuauuacgccaacgaaaagagcaaacagcccaagggaacguuucuuaucaaaggcuaugggguccgcauggcgccucaccugagacgggacucuaagaaagaauccuguuucgagcucaccagccaggaccgcagaucuuacgaauuuacagccaccucccccgcugaggcccgggauuggguggaccagaucagcuuccugcuuaaggaucugucuucccucacaauuccuuacgaagaggacgaggaagaggaagagaaggaagagaccuaugaugacaucgauggauuugacagccccuccugcggcucucaaugucgcccuacaauucugccggggagcguuggaaucaaagagcccaccgaagagaaggaagaggaagauauuuacgaggugcugccugacgaggaacaugaucucgaggaagacgaguccggcacgagacggaaaggcgucgacuaugcuagcuacuaucaggggcugugggauugccacggagaccagcccgaugagcuuucuuuccaacgcggcgaccugauccggauucucuccaaggaauacaauauguauggguggugggugggagagcugaacagccuuguuggcaucgugccuaaagaauaccugaccacagccuuugaggucgaagagagauga

SEQ ID NO: 75596 - RNA, 564 nt, Artificial Sequence
  derived and/or modified sequence opt5 from SKAP2__Homo_sapiens__NP_001290397
augaacaauacccugagaaaggacggcaaaaaggauugcuguuucgagaucagcgcccccgacaaacggauuuaccaguuuacagcugccuccccuaaggaugcggaagagugggugcaacagcucaaauucguccugcaggacauggaaucugauaucauuccggaggacuaugaugaacgcggggagcuuuacgacgauguugaccacccccugccuaucagcaacccccucacguccucucagccuauugaugacgagaucuaugaggaacugcccgaagaggaggaagauagcgcuccugugaagguggaggaacaaagaaagaugucccaggacucuguccaucacaccagcggagacaaauccacagauuacgccaauuuuuaucagggccuuugggacugcaccggggccuucagcgaugagcugucuuuuaagcggggagacgugaucuacauucucuccaaagaauauaaccgcuacggcugguggguuggggagaugaagggagcuaucggccuggugccgaaagccuacauuauggagauguaugauaucuga

SEQ ID NO: 75597 - RNA, 1917 nt, Artificial Sequence
  derived and/or modified sequence opt5 from SKIL__Homo_sapiens__NP_001138569
auggagaaccugcagaccaauuucagccucgugcaaggcuccacaaagaaacugaacgggaugggagacgauggcucucccccugccaagaaaaugaucacggacauucacgcuaaugggaagaccaucaacaaagucccgacaguuaagaaggaacaucuugaugacuacggagaggcccccguggaaaccgauggcgagcacgugaaaagaacaugcaccagcgucccugaaacacugcaucucaaucccucccugaagcacacccuugcgcaguuucaucugucuagccaguccucucucgggggaccugcugccuucagcgcccggcacucccaggagagcaugucucccacgguguuucugccucugccgagcccccaaguucucccuggcccccugcuuauuccuuccgacucuuccaccgagcugacacagaccgugcucgaaggcgagagcaucucuuguuuccaggucgggggagaaaaacgccugugccuuccccaggugcugaacuccguucucagagaguuuacacugcaacagauuaauaccgugugugaugagcuguauaucuacugcagccgguguacguccgaccagcuccacauccugaagguccuuggcauucugccguucaacgcuccuucuugcgggcucaucacacugaccgaugcccagcgccuuuguaaugcucugcucagaccccggacauuuccucaaaacggaagcgugcugcccgccaaauccagccuggcgcagcucaaggaaaccggcucugccuucgagguggaacaugagugccuggggaagugucagggacuuuuugcuccccaauucuauguccagccugacgccccgugcauucagugucuggaaugcugcggcauguuugcuccccagaccuucguuaugcacucccaucgcagcccugauaaaagaacaugucacuggggcuuugagucugccaaguggcacugcuaccuccaugugaaucaaaaauaucuggggacgcccgaggaaaagaaacuuaagaucauucuggaggaaaugaaagagaaguucagcaugcgguccggaaagcgcaaccagucuaaaaccgacgcgccuagcggcauggaacuccaguccugguaccccgugaucaagcaggagggggaucacgucagccaaacacauucuuuccugcacccguccuauuaccuguacaugugugacaaagugguugccccuaaugugagccucaccucugcugucucccagagcaaggagcugacaaaaaccgaagccaacgcuuccauuucuaauaacagcacguccaagagaaagucugagagcgccacaugcaaccuugugcgggacaucaauaaaguuggaaucggccugguggccgcugcguccagcccccuccuggucaaggaugugauuugugaagacgauaaagggaagaucauggaggaagucaugcgcaccuaucugaaacagcaggagaaacuuaaccucauucugcaaaagaagcagcagcugcagauggaggugaagaugcucucuuccagcaaaucuaugaaggaacugaccgaggaacaacagaaucuucagaaagagcuggagucccuccaaaacgaacaugcccagagaauggaggaauuuuacguugagcagaaggaccuggaaaagaaacuggagcagaucaugaagcaaaaaugcacaugugauagcaaucuugagaaggacaaagaagcugaguaugccggacagcucgccgaacugcggcagcgccuggaucacgcugaggccgacagacaggaacuccaagaugagcugcggcaggagagagaagcgcgccagaaacuugagaugaugauuaaggaacugaagcuccagauccugaagucuagcaaaaccgcuaaggaguga

SEQ ID NO: 75598 - RNA, 3129 nt, Artificial Sequence
  derived and/or modified sequence opt5 from SKIV2L2__Homo_sapiens__NP_056175
auggccgacgcuuucggcgaugagcuguuuagcguguucgaaggggacuccaccacagccgcgggaacgaagaaagauaaggagaaagacaagggcaaauggaaggggcccccuggaucugcugauaaggccggcaaaagauuugacgggaagcuccagagcgaauccaccaacaaugggaaaaacaagcgggaugucgacuucgagggcacagaugaaccgaucuuuggcaaaaagccccgcauugaggagucuaucaccgaagaccugagccuugccgaucugaugccuagaguuaaggugcaauccguggagacagucgaagggugcacccacgagguggcucuccccgccgaggaagacuaccugccucuuaaaccccggguuggaaaggcugccaaagaguauccuuucauucuggaugcguuucagcgcgaagccauccaguguguggacaauaaccagucuguccucgugagcgcucauacauccgccggcaagaccguuugcgcugaguacgccauugcgcuggcccugagagaaaaacaacgggugaucuucacgagcccgaucaaggcucucucuaaucagaaauaucgcgagauguacgaggaauuucaggacgucgggcugaugaccggagaugugacaauuaaccccaccgccuccugucuugugaugacaaccgagauccugagaagcaugcucuaucggggcucugaagucaugcgcgagguugcuugggugauuuucgacgaaauccacuacaugagagauuccgagcgcgggguggucugggaggaaacgauuauccugcuuccugacaaugugcauuauguuuuucugagcgccacaauucccaacgcccggcaguucgcugaguggaucugccaccuccauaagcaaccuugucacgugaucuacaccgauuacagacccacaccgcugcagcacuauauuuuuccugcgggaggcgacggccugcaucucgucguggaugaaaauggggacuuccgggaggauaacuucaauaccgccaugcagguucugcgcgacgcuggagaucuugccaagggcgaccagaaagggagaaagggaggcaccaaagggcccucuaacguguuuaagaucgucaaaaugauuauggaacggaauuuccaaccugugaucaucuuuuccuucagcaagaaggacugcgaggccuacgcucugcagaugacaaaacucgauuuuaacacggacgaggaaaagaaaauggucgaggaaguguucuccaaugccauugauugucugucugacgaggauaagaaacuuccccagguugagcacgugcugccccuccugaagagaggaaucggcauucaucacggcgggcugcucccuauccugaaggaaaccauugagauccuuuuuagcgaaggacugauuaaagcgcuguucgcuacagagaccuuugccaugggcaucaacaugccggcccgcacaguccuguucaccaacgcucggaaguuugacgggaaagauuucagauggaucuccagcggagaauauauucaaaugucuggccgcgccgggcggagaggcauggacgaucgcggaaucgugauucuuaugguugacgagaagaugucccccacgaucggcaaacagcugcucaaggggagcgcugauccucucaauucugccuuucaccugacauacaacauggugcucaaucugcuucgggucgaggaaauuaaccccgaguauaugcuggaaaagagcuucuaccaguuccagcauuauagagcgaucccuggagugguggagaaaguuaaaaauuccgaggaacaauacaacaagauugucauccccaaugaggaaucuguggugaucuacuauaagauucgccagcagcucgccaaacugggcaaggagaucgaagaguacauucacaaaccgaaguauugccugccuuuucuucagcccgggcggcucgucaaggugaaaaacgaaggagacgauuucggcuggggaguuguggucaauuuuagcaagaaauccaacgugaagccuaauagcggcgagcuggacccccuguacguuguggagguccuccugagauguucuaaagaaucccuuaagaacagcgcuaccgaggccgcuaagccugccaaacccgacgaaaagggagagaugcaagugguuccggugcugguccaucuccugucugcgaucuccagcgugcgccuguauauuccuaaagaucuucggcccguggacaauagacaguccguccucaagucuauccaggagguucagaaacgguuccccgauggcaucccucugcuggacccgauugaugacauggggauccaagaucagggacucaagaaggugauucagaaaguggaagccuuugagcaccgcauguacagccauccccugcacaacgacccuaaucuugaaaccgucuauacacugugcgagaagaaagcucagaucgccauugauaucaaguccgcuaaaagagaacucaagaaggcccggaccgugcugcaaauggacgagcugaaauguagaaagcgcguucuucggagacucggcuucgccacaucuagcgaugugaucgagaugaaagggcgcgucgcuugcgaaauuuccagcgcggacgagcugcugcucacggaaaugauguuuaacggacuguucaacgaucuuucugccgagcaggcuaccgcccugcucuccugcuuuguguuccaggaaaauagcucugagaugcccaagcugacagagcaacuggccggcccucuuagacagaugcaggaaugugcuaaacggaucgccaagguuuccgcggaggcuaaacucgaaauugacgaggaaaccuaccugagcucuuuuaagccccaccugauggacguggucuacacaugggccaccggggccacguucgcucauaucugcaagaugaccgauguguuugagggcagcauuauccgcuguaugagacggcucgaggaacugcuucgccagaugugccaagccgcgaaagcuaucggaaacacagagcuggaaaauaaguucgccgagggcauuaccaaaaucaagagagacauuguuuucgccgcuucccucuaucuguga

SEQ ID NO: 75599 - RNA, 3741 nt, Artificial Sequence
  derived and/or modified sequence opt5 from SKIV2L__Homo_sapiens__NP_008860
augauggagaccgaaagacuggugcuucccccuccggacccccuggaucuuccucugcgggccgucgagcucggcugcacagggcacugggaacugcuuaaccugcccggagcuccugagagcucccucccccauggccugccuccgugugcccccgaccugcagcaagaagcggagcaacucuuccugucuagcccugcuuggcuuccccugcacgggguugagcauuccgcccgcaaguggcagagaaaaacggauccuuggucucuccuggccgugcuuggagcucccgugccgagcgaccugcaggcccagcggcacccuaccacaggccagauccucggguacaaggaaguccugcuggagaauaccaaccucuccgcuacaaccucucugagccuucgcagacccccuggacccgccucccagagccuguggggcaaucccacacaguauccuuuuuggccgggcgggauggaugaacccaccauuacggaccucaacacccgggaggaggcggaagaggaaaucgauuucgagaaagaccugcuuacaauuccucccggauuuaagaaaggcauggauuucgccccuaaggacugccccaccccggcuccugggcugcucucucuguccuguaugcuggaaccccucgaucugggaggcggggacgaggaugagaaugaagccgugggacaaccuggcggcccccgcggggacacaguuagcgcuucuccuugcuccgcuccccuugcgagagccagcucucuggaggaccucgugcugaaggaggcuuccaccgccgucagcacgccggaagcuccugaaccucccucccaggagcagugggccauccccguggaugccacaucuccgguuggagacuuuuaccggcuuauuccccagccugcuuuccaaugggcguuugagcccgauguguuccagaaacaggccauccugcaucucgaacgccacgacagcgucuuuguggcugcccacaccuccgccggcaagacaguggucgcugaguaugccaucgcgcuggcucaaaaacauaugaccagaaccauuuacacaagcccuaucaaggcccugucuaaccagaaauuccgggauuuucgcaauacguucggggacguuggacuccugaccggcgaugugcagcuucaccccgaagccuccugucugauuaugacaaccgagauccucagaagcaugcuguauucugggagcgacgugauucgggaucuggaaugggucaucuuugacgaggugcauuacauuaacgauguugagcgcggaguggucugggaagaggugcuuaucaugcucccugaccacguuuccaucauucugcugucugcuacagugcccaaugcccucgaguucgcugacuggaucggcagacugaagcggagacagauuuaugucaucagcaccgugacgcgcccggucccucuugaacacuaccuguucacaggcaacuccagcaagacccaaggggagcucuuucugcugcuugauucucggggagccuuccauaccaaaggcuacuaugcggccguggaagcuaagaaagagagaauguccaagcacgcccagacauuuggggcuaaacagcccacccaucagggaggcccugcccaagaccgcgggguuuaccucagccugcuggcgucucuccggacaagagcccagcugcccguggucguguucacguuuucccgcggccggugcgaugaacaggcuagcggacuuaccucccuggaccucacaaccucuagcgagaaguccgaaauucaccuguuccugcagagaugucuugcccgccuccggggcucugauagacaacugccgcagguucugcauaugagcgagcuccugaaucgcgggcuuggagugcaccacuccggcauccugccuauccucaaagagauugucgaaaugcuguuuagccgggggcuggugaaggugcuuuucgcuacagagaccuuugccaugggaguuaacaugcccgccagaacggucguguucgacucuaugcggaagcaugauggcuccaccuuucgcgaccuccugccuggggaauaugugcagauggcuggcagagcgggacggagaggccuggaucccacagggaccgucauccuccugugcaaaggacgcgugcccgagauggccgaccuucaccggaugaugaugggcaagccuagccagcugcaaucucaguucagacucacauacaccaugauucugaaucugcuucgcguugaugcucugagaguggaagacaugaugaaacgguccuuuagcgaguucccgucucgcaaggauagcaaagcccaugagcaggcccucgcugaacugacgaagagacucggggcccuggaggaacccgacaugacaggacaacuugucgaccugccugaguauuacuccuggggcgaggaacucaccgagacacagcacaugauccagcggcgcauuauggaaagcgugaacgggcugaagucucuguccgcgggcagaguuguggucgugaaaaaucaggagcaccauaacgcucuuggaguuauccugcaagugagcuccaacucuaccagccgggucuucaccacacucgugcugugugauaagccccucucccaggacccucaggaucgcggccccgccacggccgaagugccuuauccggacgaucuggucggguuuaaacuuuuccugcccgagggaccuugcgaccacaccguugugaagcuccagcccggcgauauggcugccaucacaaccaaagugcugagagucaauggggagaagauucuggaagacuuuucuaagcggcaacagccuaaauucaagaaagaucccccgcuugcggcugugacaaccgccguucaggagcugcuccgccuggcccaggcucauccugccggaccucccacgcucgaccccgugaacgaucugcaacuuaaggacaugagcgucguggaaggcgggcugagagcucggaaacuggaggaacucauccagggcgcccaguguguucacucccccagauuuccugcgcaauaccugaagcuccgcgagcggaugcagauucagaaggagauggaaagacugcgcuuccuccugucugaucagagccuccugcuucugccggaguaccaucaacggguggaaguccugagaacacucggauauguggacgaggccggcaccguuaaacuggcugggcgcguggccugcgcuauguccagccacgaacuucugcucaccgagcugauguuugacaaugcccucucuacacugcggcccgaggaaaucgccgcccuucuguccggacuggucugccagagcccuggcgaugcgggggaccagcuccccaacacccugaagcagggaauugagagagugcgcgccguggcuaaacggaucggcgaaguccaaguugccuguggccuuaaucagacaguggaggaguucgugggggaacugaacuuuggacucgucgaggugguuuacgaaugggccagaggcaugccuuucucugagcuggcugggcucuccggaacgcccgaaggccuggugguccggugcauucagcgccuugccgagauguguagaagccugcgcggggcggcucggcuggugggagagccgguucucggcgccaagauggaaaccgccgcuacacugcuuagacgggauaucguguuugccgcgucucuguauacccaguga

SEQ ID NO: 75600 - RNA, 2607 nt, Artificial Sequence
  derived and/or modified sequence opt5 from SKOR1__Homo_sapiens__NP_001244953
augauccccaagagccuggugcaggccgcugagacccaaagaggccucugcgaaccugggggaaaaggccgggaggggcgcuccggaggcaagggggaaacaagaccgcggggagucggcacgcaggagggcaaagggaccauucccggaucuccucgcgaaaagagaggcgagcggggcgagggagaccccgcccugcuuccugcggaagaucuguggcgccuccccggcagcaaagacagacugcgguccucucuucugccuccgcccgggccucccagcuccgauucuggaccugggcccccgagcucccacagcggcaagacagcucaggggccucgcacccucaacugggccagaaagcagucugcccggacauccagcaaucugugugcuuggucucuggccauggcuaccaaaauggccgagauccccuccagcccuuacgaacccggacaacgcggcaugaaggacacacagagaggggaugcgccccagcggggaucuccugagccgcgcauucuccagcuggccagaguuggcaacguguaucuuaaagaggaauccagccgguccgggagacuggaggcuaagaaauggauccccaccaaguuccucgaaaaucugucugugccucaugucgaccuuggaggcaaccaacuguggagcggcgggauggaggcccucacgacccagcugggacccggccgcgaaggguccagcucuccuaauuccaagcaggagcugcagcccuacagcggaucuagcgcucucaaaccgaaccaagugggcgagacaucccuguaugggguuccuauugugucucuugucaucgauggccaggaacggcugugccucgcccagaucagcaauacccugcuuaagaacuacuccuauaaugagauucacaacagacgcguggcgcugggaaucacauguguucaaugcacccccgugcagcucgaaauucugcggagagccggcgcuaugccuaucagcucucgccggugugggaugauuacgaaaagagaggccgaacgccugugcaaguccuuucucggagagcauaaacccccuaagcugcccgagaauuucgcuuuugacgucgugcacgaaugugccuggggcagccgggggucuuucaucccggccagauacaacuccagccgcgcuaaaugcauuaaguguggauauugcuccauguacuuuucuccuaauaaguucaucuuucauagccaccggacacccgaugcgaaauacacccagcccgacgccgcuaacuucaauuccuggagacggcaccuuaagcugucugauaaaagcgccacagacgagcucucccaugccugggaagaucgcggccuggggcuugcuaccggcgccagcggaccugcgggccccgggggacccggcgggggagcuggcgugagaucuuauccugucauccccguuccuuccaagggguuuggccugcuccagaaacugcccccuccccuguucccgcacccuuacggauuucccaccgccuucggccucuguccuaagaaggacgaccccgugcugggggccggagagccgaaaggcgggagcuaugugucugcuuuucggccugucgugaaggauacagaauccauugccaaacuuuacggaagcgcuagagaggccuauggcgcggggcccgcccgcggcccuggacccggcgcugggucuggaggcuacguuagccccgacuuccuguccgaggggucuagcuccuauaacagcgccuccccugauguggacacggcugaugaaccggaggucgacguggaaucuaaccgguuccccgaugacgaggaugcccaagaggaaaccgagccuagcgcgcccuccgccggaggcggcccugacgcugggagacccgccuuuggagaucucgcugccgaagaccugguucgcagaccugagcggucuccgcccagcggcgggggaggcuacgaacugcgcgagccuugcgggccccuuggaggcccugcccccgcuaagguguucgcgccggagagagacgaacaugucaaauccgccgcuguggcccucggcccugccgcuucuuacgucugcacacccgaggcccacgaacccgauaaggaggacaaucacagcccugcggaugaccuggaaacccggaaguccuaucccgaucagcgcagcaucucucagccuuccccggcuaacacagacagaggggaggauggacugacccucgacgugacgggcacacaucugguugagaaagauauugaaaaucuugcccgggaggaacugcagaagcuccugcuggagcaaauggaacuucgcaaaaagcucgagagagaguuucagagccugaaagacaacuuccaggaucagaugaagcgggaacuggccuaccgcgaggaaauggugcaacagcuccagaucgucagagacacccuguguaaugagcuugaucaggagcggaaggcuagauaugccauucaacagaaacugaaggaagcgcacgacgcucuccaucacuuuucuugcaaaaugcugaccccgcgccauuguacagggaacugcuccuucaagccuccccugcuuccuuga

SEQ ID NO: 75601 - RNA, 891 nt, Artificial Sequence
  derived and/or modified sequence opt5 from SKOR2__Homo_sapiens__NP_001032891
auggccagcucuccccugccuggcccgaacgacauccuccuggcuucccccagcuccgccuuccagccugauacccuuucucaacccagaccugggcacgcgaaucugaagcccaaccaggugggacaggucauucucuacggcaucccuauuguuagccuggugaucgacgggcaggagcggcuuugccuggcucaaauuuccaauacacuccugaaaaacuuuucuuauaaugaaauccauaaccgcagaguggcccugggaaucacguguguccagugcaccccggugcagcucgagauucugcggcgcgccggcgcuaugcccaucagcuccagacggugugggaugauuacaaagcgcgaagccgagagacuuugcaagagcuuccugggagaaaaucggccucccaagcucccugauaacuuugcuuucgacguuucucacgagugugccuggggcugccgcggcuccuuuauccccgcgagauacaauagcucucgggccaaauguauuaagugcuccuauuguaacauguacuucagcccgaauaaguuuaucuuccauucucaccgcaccccugaugcuaaauauacacagcccgacgccgcuaacuuuaauuccuggagacggcaucugaaacuuaccgauaaaagcccucaagacgagcugguguucgccugggaagaugucaaggcgauguuuaacgggggaucccgcaaaagagcccucccccagcccggcgcucacccugccugccacccgcugucuagcauucggacaagauccaucgcuuucagcucucagacccugaugcuccuggaggaaaucuuuggggagaaggaccaggaggauuacaugcgcauuaaugaagacaacaucuggcuuuga

SEQ ID NO: 75602 - RNA, 483 nt, Artificial Sequence
  derived and/or modified sequence opt5 from SKP1__Homo_sapiens__NP_008861
augcccagcaucaagcugcaguccucugacggcgagauuuucgaaguggaugucgagaucgccaaacaaagcguuaccauuaagacaaugcucgaagaccuggggauggaugacgagggagaugacgauccugugccgcuucccaacgugaaugcugccauccugaaaaaggucauucaguggugcacgcaccauaaagacgauccucccccucccgaagacgaugagaacaaggagaagagaaccgacgauaucccugugugggaccaggaauuucucaaaguugaccagggcacacuguucgagcuuauccuggcggcuaauuaccucgauauuaaggggcugcuggacgugaccuguaaaacagucgccaacaugaucaagggaaaaaccccggaagagauucggaagacauuuaauaucaagaacgauuucaccgaggaagaggaagcccaagugggcuccacgcaguuuugccucuga

SEQ ID NO: 75603 - RNA, 633 nt, Artificial Sequence
  derived and/or modified sequence opt5 from SKP2__Homo_sapiens__NP_001230049
auggaccagccccuggccgagcacuucagcacccucgcuaagaacuccaaucuggugagacuuaaccugucuggcugcagcggguuuuccgaguucgcccuccaaacacugcuuucuagcuguucccggcuggaugaacucaaucugucuuggugcuuugacuucacggaaaaacauguccagguugcgguggcucacgugagcgagaccaucacacagcugaaccucuccggauaccgcaagaaucugcagaaaagcgaucuuucuacccuggucagacgguguccuaaccucgugcaucuggaccuuuccgauagcguuaugcugaagaaugacugcuuucaagaguucuuucagcucaacuaucugcagcaccugucucucucccgcuguuacgauauuaucccggaaacacugcuugagcugggcgaaauucccacccucaaaacacuucagguguucgggaucgucccugacggaacccugcaacugcucaaggaggcccugccccaucugcagauuaauugcagccacuuuacgaccaucgccagaccuacaaucggcaacaagaaaaaucaggaaauuugggggaucaagugucggcucacccugcagaaacccucuugccuuuga

SEQ ID NO: 75604 - RNA, 786 nt, Artificial Sequence
  derived and/or modified sequence opt5 from SLA2__Homo_sapiens__NP_115590
augggcagccugcccuccagacggaagucucucccuagcccgucccugucuagcuccgugcaggggcaaggacccgucaccauggaggccgaacgcucuaaagcuacagccguugcgcuuggcagcuucccugcugggggacccgccgagcugucccucagacugggcgaaccucuuacgaucgugagcgaggacggggauugguggaccgugcugucugaagucuccggacgggaguacaacauucccagcgugcacguugccaaggugucucauggcuggcucuaugagggccugucccgcgaaaaagcugaggaacugcuccugcuuccugggaauccgggaggcgccuuucugaucagagagagccagacacggcgcgggucuuacucccucagcgucagacugucccggcccgcuucuugggaccgcauuagacacuaucggauccauugccuugauaacggauggcuguacauuagcccucgccucaccuuccccucccugcaggcccugguggaccacuauagcgagcucgcggaugacaucuguugccugcuuaaggaaccuuguguucugcagagagccggcccccucccggggaaagauaucccucugcccgugacaguccaacggaccccucuuaauuggaaggagcuggacucuucccuccuguuuagcgaagcugccacaggagaggaaucucugcucagcgagggccugcgcgagucccuuucuuucuacauuagccugaacgaugaagcugugucccucgacgaugccuga

SEQ ID NO: 75605 - RNA, 831 nt, Artificial Sequence
  derived and/or modified sequence opt5 from SLA__Homo_sapiens__NP_001039021
augggcaacagcaugaaguccacccccgccccugcugagagaccgcugcccaauccugaagggcucgacucugauuuccuggccgugcuuagcgacuaccccuccccugauaucucucccccuauuuuucggcgcggagagaaacugagagucaucagcgacgaaggcgggugguggaaggcgauuucccucucuacaggacgggagagcuauaucccgggcauuugcguugcucgcguguaccacggguggcuguucgaaggacuuggcagagauaaagccgaggagcugcuccagcugcccgacacgaaggugggcuccuuuaugauccgggaaagcgagaccaaaaagggguucuauucucuguccguccgccauagacaagugaagcacuaccggaucuuucgccucccuaacaauugguauuacauuagccccagacugacauuccagugucuugaagaucugguuaaccauuauucugagguggccgacggacucugcuguguccugaccacaccuugccuuacccaguccacagcugcccccgcugugcgggccucuucuuccccgguuacccugcgccagaaaacgguggauuggagacgggucagccgccuccaagaggacccugaaggcaccgagaauccccuggggguggaugaaucccuguuuucuuacggacucagagagagcaucgcguccuaccugagccuuacaucugaagacaacaccuccuucgaucggaagaaaaagagcauuucucugauguauggcgggagcaaaagaaaguccagcuuuuucagcuccccucccuacuuugaggacuga

SEQ ID NO: 75606 - RNA, 1746 nt, Artificial Sequence
  derived and/or modified sequence opt5 from SLAIN2__Homo_sapiens__NP_065897
auggaggacgugaacagcaaugucaacgccgaucaggaaguuagaaagcugcaagagcucgugaaaaagcuggaaaaacagaaugagcagcuucggucccgcucuggcgcugugcagggggccggaagccugggccccggguccccugucagagcgggagcuucuaucccgagcuccggcgccgccucuccccggggguucccucucggacugagcgcuaaguccggcggcgggcccggaagcggcccucgcagaaccucuuccgaggaacuucgggacgccacaagccugcucgcugccggggagggaggccugcuggaugaaguggagccccuccgcccugacgaacuggagagacuuucugggugggaggaagaggaagaguccuggcuguacagcucuccgaaaaagaagcucacgcccaugcaaaaauccguuagcccucugguguggugccggcagguccuugauuaucccuccccugacguggaaugugcgaagaaaucucugauucacaagcucgaucagaccaugagcgcccugaaacgccagaaccuguacaauaaccccuuuaauuccaugagcuauacaucuccguacuccccuaacgcuagcucucccuauagcuccggauucaauucuccuagcuccacccccguuagacccccuaucgugaagcaacucauucugccgggcaacagcggcaaucuuaagucuuccgaccggaaucccccucugagcccccagucuuccaucgauagcgagcucuccgccucugagcuggacgaagauagcauuggguccaacuacaaacuuaacgacgucacagaugugcagauccuggcucgcaugcaggaggaaucucucagacaagaguaugccgcgaccacaagccggcgcuccagcggaucuuccugcaauagcaccagacggggcacguuuucugaccaggaacuggacgcccagucccuggaugacgaggaugacaacaugcaucacgcuguguacccugccgucaacagauucagccccucuccgcgcaauagcccucggcccuccccuaagcaaagccccagaaacucuccucgcucccggagccccgcuagagggaucgaguacucccgcguuucuccgcagccuaugauuagccggcuccagcagcccagacugucccuucaaggacaucccaccgaucugcagacaucuaaugugaaaaacgaagagaagcuccgccggagccugccuaaucuuuccagaaccucuaacacacagguggacagcgucaaauccagccgcucugauuccaauuuucaggugccgaacggcgggaucccccggaugcaaccucaggccagcgccauucccucuccuggaaaguucagaucccccgcugcgccuagcccccuggcccuccggcagccgguuaaggcuuuuucuaaucacggcuccggcagcccugggucccaggaaaucacccaacugacgcagacaaccagcucucccggaccucccauggugcagagcacagucuccgccaacccgccuucuaauauuaacagcgccacccugacccgccccgcuggcacaacggccaugagauccgggcucccucggcccucugcgcccagcgcuggaggcaucccugugccgagauccaaacuggcccagcccguucgccggucucuuccugcccccaagaccuaugggagcaugaaagacgauuccuggaaggacggcuguuacuga

SEQ ID NO: 75607 - RNA, 1008 nt, Artificial Sequence
  derived and/or modified sequence opt5 from SLAMF1__Homo_sapiens__NP_003028
auggaccccaagggccugcucagccugaccuucgugcuuuuucugucccucgccuucggggcuucuuacggaacaggcgggagaaugaugaacugcccuaaaauccugcggcagcuuggaagcaagguccugcucccgcugacguaugagcgcauuaauaaauccaugaacaagucuauccacauuguugugaccauggccaaaagccuggaaaauuccguggagaacaagaucgucucucucgaucccagcgaagcgggcccucccagauaccugggggaccgguauaaguuuuaccuugagaaucugacacucggcauucgcgaauccagaaaagaggaugagggaugguaucugaugacccuugaaaagaacgugagcguucaacgguucugucugcagcuccgccuguacgaacaggugucuacaccugagaucaaaguccugaauaagacccaggagaacggcacaugcacccucauccugggguguacgguggagaaaggagaccauguugcuuauuccuggagcgaaaaggccggcacccacccccuuaauccugccaacucuucccaucugcucagccugacacuugggccgcaacacgcugauaauauuuacaucugcaccgugucuaaccccauuuccaauaacagccagacauuuuccccuuggcccggauguagaaccgacccuucugagacgaagcccugggccgucuacgcuggccugcucgggggagugaucaugauucugaucaugguggucauucugcagcuccggcgcagaggcaaaacaaaucauuaucagaccacaguugaaaagaaaagccugaccaucuacgcccaagugcagaagccgggcccucuucagaaaaagcuggauuccuuccccgcgcaggacccuugcaccacaaucuauguggccgcuacggagcccguccccgaaagcgugcaagagaccaacucuauuacaguuuacgccuccgugacccucccugagagcuga

SEQ ID NO: 75608 - RNA, 999 nt, Artificial Sequence
  derived and/or modified sequence opt5 from SLAMF6__Homo_sapiens__NP_001171643
augcuguggcuguuccagagccuccuuuuuguguucugcuuuggccccgggaacgucguuucccaaucuagccugaccccucucauggugaauggaauccugggcgaguccgugacacuuccgcuggaguuccccgccggggaaaaggucaacuuuauuacguggcuguucaaugaaaccucucucgcuuuuaucgugccucacgagacaaaaagccccgaaauucauguuaccaacccuaagcagggaaaaagacugaauuucacacaguccuacucucuccagcugagcaaccuuaagauggaggacaccggcuccuaucgggcccaaaucagcacaaaaaccucugcgaagcuguccagcuacacgcuccgcauucugagacagcuucggaauauccaggugaccaaccacucucagcuguuucaaaauaugacaugugagcuccaucugaccugcuccgucgaagaugcugacgauaacgugagcuuccgcugggaggcccuggggaauacacucucuucccagcccaaccugaccguuagcugggacccuagaaucuccucugaacaggauuauacguguauugccgagaaugcugugagcaaccuuuccuuuagcgucucugcccagaagcugugcgaggacgugaaaauccaauacacagauaccaagaugauucucuucaugguguccggaaucuguauugucuuuggcuucaucauucugcuucugcucguucugcggaaacgcagagacagccugucucucagcacacagcggacccagggcccggcugaauccgcccgcaaucuggaguaugugucugugagccccaccaacaacacagucuacgcguccgugacgcacagcaauagagaaaccgagaucuggacaccucgggaaaacgauaccaucacaauuuauucuaccaucaaucauuccaaggagagcaaacccacguucucucgcgccacagcucuugacaacguuguguga

SEQ ID NO: 75609 - RNA, 498 nt, Artificial Sequence
  derived and/or modified sequence opt5 from SLAMF7__Homo_sapiens__NP_001269517
auggccggcagcccuaccugccugacacucaucuacauucuguggcagcuuacgggguccgcugccucuggacccgugaaggagcuggucggcagcguugggggagcggugaccuucccgcucaaauccaaggugaaacaagucgacucuaucguguggacauuuaacaccacaccccugguuaccauucagccugaaggcgggacaaucauugugacccagaauagaaaccgggagcgcgucgauuuccccgacggaggcuauagccuuaagcuguccaaacucaagaagaaugauucuggcaucuacuauguggggaucuacagcuccagccugcagcaaccuucuacgcaggaauauguucugcacguguacgagaacaaucccaaaggaagauccagcaaguauggccuccugcauugugggaacaccgaaaaagacggaaagucuccucuuacagcucacgaugcccggcauaccaaagccauuugccuguga

SEQ ID NO: 75610 - RNA, 858 nt, Artificial Sequence
  derived and/or modified sequence opt5 from SLAMF8__Homo_sapiens__NP_064510
auggugaugagaccccuguggagccuccugcuuugggaggcccugcucccuaucaccgucacaggcgcucagguucuguccaaggugggaggaucugugcuucuggucgccgcgcggccgcccggcuuccaagugcgcgaagcuauuuggagaagccucuggccuuccgaggaacugcuggccacguuuuuccgggggucucucgagacccuguaccacagccgcuuucuugggagagcccagcugcauuccaaccucucucuggaacuuggcccccuggagagcggggacuccggaaauuucagcguucucaugguggauacacggggccagccuuggacccagacacugcaacugaaagucuaugacgcugugccccgcccuguugugcaggucuuuaucgccguggagagagaugcucagccgucuaagaccugccagguguuccucuccuguugggcccccaacauuagcgaaaucacauacucuuggcggcgcgagaccacgauggacuuuggcauggaaccucacucccuguucaccgaugggcaaguccuuagcauuucucugggacccggcgacagagauguugcguauuccugcaucgugagcaauccuguguccugggaccucgccacagucacccccugggauucuugucaucacgaggcugccccggggaaagcuagcuacaaggacgugcugcuuguuguggucccugugucccugcuccugaugcugguuacacucuuuagcgccuggcauuggugccccuguucuggcaaaaagaagaaagaugugcacgcggaccgggucggaccugagaccgaaaacccccuggugcaggaucuucccuga

SEQ ID NO: 75611 - RNA, 813 nt, Artificial Sequence
  derived and/or modified sequence opt5 from SLBP__Homo_sapiens__NP_006518
auggccugcagaccccggagcccuccgcgccaccaguccagaugugacggcgaugcuucucccccuagccccgcccgguggucccuggggcgcaagagacgggcggacggacgcagauggcggccugaggaugcugaagaggccgaacaucgcggcgccgagagacggcccgaaucuuucaccacaccugaggggccgaaaccccgcagcagaugcuccgacugggcuucugccguggaggaagaugagaugcggacgcgcgucaacaaggaaauggcuagauacaaacggaagcuccugaucaaugacuuuggaagagagcgcaaaagcuccagcgggucuuccgauagcaaggagucuauguccaccguuccugccgacuucgaaacagaugagagcgugcuuaugcggagacaaaagcagauuaacuauggcaaaaauaccaucgcguacgaccgcuauauuaaggaagugccccggcaccugagacagccuggaauccaucccaaaacaccgaacaaguuuaaaaaguacucucgccgguccugggaucagcaaauuaagcucuggaaagucgcccugcacuucugggacccucccgcugaggaaggcugugaucuucaggagauccauccuguggaccuggagagcgccgaauccucuagcgagccccagaccuccagccaggacgauuuugacguuuauucuggcacacccaccaaggugagacacauggauucccaagucgaagacgaguucgaucucgaggcuugccugacggaaccucugcgcgacuuuagcgccaugucuuga

SEQ ID NO: 75612 - RNA, 1050 nt, Artificial Sequence
  derived and/or modified sequence opt5 from SLC10A1__Homo_sapiens__NP_003040
auggaggcccacaacgcuagcgcccccuucaauuuuacccugccuccgaacuucggcaagagacccacagaccucgcgcuguccgugauccuugucuuuaugcuguucuuuauuaugcucucucuggggugcacgauggaguucagcaaaaucaaggcucaucuuuggaaaccuaagggacuggccauugcccucguugcucaguacggcaucaugccccugaccgccuuugugcuggggaaaguguuccggcucaagaauauugaagcucuggccauccuugucuguggaugcuccccuggcgggaaccugucuaauguguuuagccucgcgaugaagggagauaugaaccuguccaucguuaugacaaccuguucuacauucugcgcccuuggcaugaugccccugcuccuguauauuuacagccgcggcaucuaugacggggaucugaaagacaaggugccuuacaaaggaauugucaucucccucgugcugguucuuauuccguguaccaucggcauugugcuuaagagcaaaagaccccaauauaugcgguacgucaucaaagggggaaugaucauuauccuccugugcucuguggcugugacaguccuuuccgccauuaauguuggcaagagcaucauguuugcuaugaccccucugcucauugccacgucuucccugaugcccuucaucggguuucugcucggauaugugcugagcgcgcuuuucugucugaacggccgcugcagacggaccgugucuauggaaacaggcugucagaauguccagcucugcuccaccauccugaacguggccuucccucccgagguuauugggccgcuguuuuucuuuccucugcucuacaugaucuuccagcugggagaaggccugcuccugauugcuaucuuuugguguuacgagaaguucaagacacccaaagauaagaccaaaaugauuuauacggccgcuacaaccgaggaaacaaucccuggggcccuuggaaauggcaccuacaagggggaggacugcagccccugcaccgccuga

SEQ ID NO: 75613 - RNA, 1047 nt, Artificial Sequence
  derived and/or modified sequence opt5 from SLC10A2__Homo_sapiens__NP_000443
augaacgaccccaauagcugcguggauaacgccaccgucuguuccggcgcuucuugcguugugccugagagcaauuucaacaauauccuguccgugguccucucuacagugcugacgauucuucuggcccucguuauguuuagcaugggguguaacguggaaaucaagaaauuccugggacacauuaagagaccguggggcaucugcgucggguuucuuugucaguucggaauuaugccccugaccggcuuuauccucuccguggcguucgacauccugccucugcaagcuguugugguccucauuaucgggugcugucccggaggcacagccucuaauauucuggccuacuggguggauggcgacauggaucuuagcguguccaugaccacaugcagcacccugcucgcucuggggaugaugccucuuugucugcucaucuauacaaaaaugugggucgacucuggauccauuguuauccccuacgauaacauuggcaccagccugguggcccugguggucccugugucuaucgggauguuuguuaaucauaaguggccgcagaaagcuaagaucauucucaagaucggauccauugccggcgcgauccugauugugcuuaucgccgucguugggggaauccuguaucagagcgcuuggauuaucgcccccaaacucuggauuaucggcacgauuuucccuguggcuggcuacucucugggguuucuucuggcccggaucgcgggacuccccugguaucgcugcagaaccguggccuucgagacaggcaugcagaacacccaacuguguuccacaaucguccagcugagcuuuaccccugaggaacucaauguggucuucacguuuccccugauuuacuccaucuuccagcuugcuuucgccgcuauuuuucugggguucuauguggccuacaagaaaugccacggaaagaacaaagccgaaaucccggagucuaaggagaauggcacagaaccugagagcuccuuuuacaaggcuaacgggggauuccagcccgacgaaaaauga

SEQ ID NO: 75614 - RNA, 1134 nt, Artificial Sequence
  derived and/or modified sequence opt5 from SLC10A6__Homo_sapiens__NP_932069
augagagccaacugcagcuccucuagcgcuugucccgccaauuccucugaggaggaacugccugugggccucgaaguccacgggaaccuggagcuuguuuucaccguggugagcacagucaugaugggacugcucauguuuucccugggcugcucuguggaaauccggaaacuuuggagccauauucgcagaccgugggggaucgcgguuggacugcucugucaguucggccugaugcccuuuacggcuuaccugcucgccauuuccuucagccugaagccugugcaagccaucgcuguccuuauuauggggugcugucccggaggcaccaucucuaauaucuuuacauucuggguggacggcgauauggaccuguccauuagcaugaccacaugcucuaccguugccgcucucgggaugaugccucuguguaucuaucuuuacacaugguccuggagccugcagcagaaccucaccauucccuaucagaauaucggaauuacgcuggugugccugaccaucccugucgccuuuggcguguacgugaacuaucgguggccgaagcaaucuaaaauuauccucaagaucggggcggucguuggaggcgugcugcuucugguggucgccguggcugggguugugcucgccaaaggauccuggaauagcgauauuacacugcuuaccaucuccuucauuuuuccccugaucggccacgucacaggcuuccuccuggcucuguuuacccaucagucuuggcagcgcuguagaacgauuagccucgagacaggggcccagaacauccaaaugugcaucaccaugcugcagcuuuccuucacagcggagcaccuggugcagaugcucagcuuuccucuggccuacggacuuuuccagcugauugacggcuuccucaucguugcugccuaucaaaccuacaagcggcgccugaagaauaaacaugggaagaaaaacucuggauguaccgaagugugccacacaagaaaguccacgagcucucgggagaccaaugcuuuucuggaagucaacgaggagggcgccauuacacccgggccucccggaccgauggauugccaccgcgcccucgaaccugugggccauaucaccagcugugaguga

SEQ ID NO: 75615 - RNA, 1023 nt, Artificial Sequence
  derived and/or modified sequence opt5 from SLC10A7__Homo_sapiens__NP_001025169
augagacugcucgagcggaugcgcaaggacugguucauggugggcaucguccuggccauugcuggggccaaacuugaacccagcaucggaguuaacggcgggccucugaagccggagauuaccguguccuacaucgcgguggcuacaaucuuuuucaauucuggacucagccugaaaacggaggaacuuaccuccgcccugguccaccucaagcugcaucuguuuauucagaucuucacacucgccuuuuuccccgcuaccauuuggcuguuucuucaacugcucucuaucacaccuauuaacgaauggcugcuuaaaggccugcagaccguggggugcaugcccccucccguuagcuccgccgugauccucacaaaggcugucggaggcaaugaggccgcggccauuuucaacucugcuuuuggcagcuuccuggggaucgugauuaccccucugcuccugcuucuguuucucggauccuccucuuccguuccguucacgagcaucuuuucucagcuguucaugaccguggucgugccccuuaucauuggccagaucgugagacgguauauuaaggauuggcuggagcgcaaaaagccucccuucggggccaucuccagcucuguccuccugaugauuaucuacacaaccuuuugugacacauucuccaauccuaacaucgaucuggacaaauuuagccucguucugauucuuuucaucauuuuuagcauccaacugucuuucaugcuccugaccuuuauuuucagcacgagaaauaacuccggauuuacacccgcugauaccguggccaucaucuucugcagcacacacaagucucuuacccugggcauuccgaugcucaaaaucguguuugcggggcaugaacaccugucccugauuagcgucccucuccugaucuaucaucccgcccagauucuucugggaucugugcucguuccuaccaucaagagcuggauggugucccggcagaagggcgucaaacugacacgccccacgguguga

SEQ ID NO: 75616 - RNA, 1653 nt, Artificial Sequence
  derived and/or modified sequence opt5 from SLC11A1__Homo_sapiens__NP_000569
augaccggcgacaaggggccccagagacugagcggauccucuuacggcagcaucuccucuccuacaagcccgacgucccccgggccucaacaggcucccccucgggagaccuaucucucugaaaagauucccaucccugauacaaagccgggaaccuucagccugcgcaaacuuugggccuuuacaggccccggguuccugauguccauugccuuucucgacccuggaaacaucgagagcgaucugcaggcgggcgcuguggccggcuucaaacuucuguggguccuccugugggccaccguucuggggcuccugugccagagacuugcugcccggcugggaguggugacaggcaaagaccucggggaagucugucaccuguacuaucccaaggugccucgcaccguucuuuggcugacgauugagcucgcuaucgugggaucugauaugcaagaagucaucggcaccgccauugcguuuaaucugcuguccgccgggagaaucccccucuggggaggcgugcugauuacaaucguugacaccuucuuuuuccuuuuucuggauaacuacggccuccggaagcuggaggcuuucuuugggcuucugauuacaaucauggcccucaccuucggauaugaguacguggucgcucgcccggaacagggcgcccugcugagagggcucuuucugccuagcugccccggauguggccauccugagcuucugcaggcgguggggauugugggagccaucaucaugccccacaauauuuaucuccauucugcucuggucaaaucccgggaaaucgaccgcgccagacgggcugauauucgcgaggccaacauguacuuccuuaucgaggccacgauugcucugagcguuucuuucaucaucaaucucuuugugauggcgguguucggccaggccuuuuaccaaaagacaaaccaggcugccuucaauauuugcgccaacuccagccugcacgacuaugcuaaaaucuuucccaugaauaacgccaccgucgcgguggauauuuaccagggcgggguuauccugggaugucucuucggcccugcugcccuguauauuugggccaucgggcuucuggcugccggacaguccucuacaaugaccggcaccuacgcugggcaauuugugauggaaggcuuccucagacugcgguggagccgcuuugccagaguccugcuuacacgguccugcgcgauccucccgacggugcugguugccguguucagagaccugcgcgaucucagcggacugaaugaccuucugaacguccuccagucucugcugcuucccuuugcugugcucccuauucugaccuucacauccaugcccacccugaugcaggaguuugccaauggccuccugaacaaggucgugacaagcucuaucaugguucuugugugugcuauuaaucuguauuucgucgugagcuaccucccuucccugccccauccggccuauuucgggcuggcggcccuucucgcugccgcuuaccugggacugucuaccuaccucguuuggacgugcugucuggcccacggcgccacauuucuugcucacagcucccaucaccauuuccuguaugggcuccuggaagaggaccaaaaaggagaaaccagcggcuga

SEQ ID NO: 75617 - RNA, 1686 nt, Artificial Sequence
  derived and/or modified sequence opt5 from SLC11A2__Homo_sapiens__NP_000608
auggugcugggccccgagcagaagaugagcgacgauuccgucucuggggaccacggagaaagcgccucccucggcaacaucaauccugcuuacucuaacccgagccugucccaaucucccggggauagcgaggaauauuucgccaccuacuuuaaugagaaaauuuccaucccugaagaggaguauagcugcuucucuuuuagaaagcugugggcguucacaggacccggcuuucuuauguccauugcuuaccucgacccugggaacaucgaaagcgaucugcagucuggagccguugccggcuucaaacuucuguggauucuccugcuggcuacgcucgugggccugcuucugcagcggcucgccgcucgccuggggguggucaccggacuucaucuggccgaggugugucacagacaguaucccaagguuccucgggugauccucuggcugauggucgaacuggcgaucauuggcuccgacaugcaagaggugaucgggagcgccauugcuaucaaucuccugucuguuggacgcauuccgcuuuggggcggggugcugaucacaauugccgauaccuuugucuuccucuuucuggacaaauacggacuuagaaagcuggaggcuuucuuuggcuuccucaucacaaucauggcccugaccuuuggcuaugaauacgugacagugaagcccucccagagccagguccugaaagggauguucguuccuuccugcucuggaugucggacgccccagauugagcaagcggugggcaucgugggggccgucauuaugccucauaacauguaccuccacagcgcucuggugaagucccgccagguuaauagaaacaauaaacaggaagugcgggaggccaacaaguauuucuuuaucgaaagcugcauugcucuuuucgucucuuuuaucaucaauguguucguuguguccgucuuugccgaggccuucuuuggaaaaaccaacgagcagguugucgaaguguguaccaauacaagcucuccccaugcuggccuguucccgaaggauaacagcacccucgcgguugacauuuacaaagggggagugguccugggcugcuauuuuggcccugccgcucuuuacaucugggccguggggauucuggccgcuggacaauccucuacaaugaccggcacguauagcgggcaguucguuauggagggauuucucaaucugaaguggucccgcuucgccagagugguccugacacggagcaucgcgauuauccccacccuccugguggcuguguuucaggauguugaacaccuuacaggcaugaacgacuuccugaacguccuccaaucucugcagcugccuuucgcccuuauccccauucucaccuuuaccucccugcgccccgugaugagcgauuucgccaaugggcugggcuggagaaucgcuggaggcauucucgugcugaucauuuguucuaucaacauguacuuugucgugguuuaugugcgggaccuugggcacgucgcccuguacgugguugcugccguggucuccguggcguaccucggauucguguuuuaucugggcuggcagugccugauugcccuugggaugagcuuccucgacuguggacauacaguguccaucucuaagggccugcugacggaggaagcuacccgcggguacgucaaauga

SEQ ID NO: 75618 - RNA, 3300 nt, Artificial Sequence
  derived and/or modified sequence opt5 from SLC12A1__Homo_sapiens__NP_000329
augagccugaacaauuccucuaacguguuccucgacagcguccccuccaauaccaacagauuucagguuucugugaucaaugagaaccacgaaagcuccgccgcugccgaugacaauacagauccuccgcauuacgaggaaacgucuuucggcgacgaggcgcaaaagcggcugcgcauuagcuuuagacccgggaaccaggaaugcuaugauaauuuccuucaguccggagagaccgcuaaaacagacgccagcuuucacgccuacgauucucauaccaacacauauuaccugcagaccuucggccacaauacaauggacgcugugccuaagaucgaguauuaccggaacaccggguccauuagcggacccaaagucaaucgcccuucucuccuggaaauccaugagcaacuugccaagaacguggcuguuacgcccuccagcgccgauagaguggcgaauggcgacgggauuccuggagaugaacaggccgagaacaaagaggacgaucaggcuggcgucgugaaguuuggcuggguuaagggggugcugguccgguguaugcucaacaucuggggagugaugcuguucauccgccugucuuggauugugggcgaagccgggaucggacucggcguccugauuauccuucuguccaccaugguuacaagcauuaccgggcucuccacaucugcuaucgccaccaauggauuugugagaggcggcggggcguauuaccugauuagccggucccuuggaccggaguucggcgggagcaucggacugaucuuugccuucgcuaacgccguggcugucgccauguacgugguuggcuuugccgaaacgguggucgaccuccugaaagagucugacuccaugaugguggaucccacaaaugacauucgcaucauugggagcaucaccguugugauucugcucggaaucucugucgcuggcauggaaugggaggcgaaggcccaggugauccugcuugucauucugcucaucgcuauugccaacuucuucaucggcacagugauuccuagcaauaacgagaaaaaguccagaggguuuuucaauuaucaagccucuaucuuugcugaaaacuucggaccccgguuuaccaaaggcgagggguucuuuagcguuuucgccaucuuuuucccugcggcuaccgggauucuggccggcgccaauaucuccggggaucuugaagacccccaggaugcuauuccgcgcggcacaaugcuggccaucuuuauuacgaccguggcuuaccucggagucgccaucugcgugggcgcguguguugugagagacgccacagggaacaugaaugauaccauuaucagcggaaugaacugcaauggcucugcugccugugggcugggauaugacuucucccggugccgccacgagccuugucaguacggccugaugaacaauuuucaggucaugagcauggugucuggguucggcccccucaucacagcuggaauuuucuccgccacccugagcuccgcgcuugccucucuggugagcgcuccuaagguuuuucaagcccucugcaaggauaacaucuauaaagcucugcaguucuuugccaagggcuacgggaaaaacaaugaaccccuuagaggauauauucugacguuccucaucgccauggcuuuuauucugaucgcggagcugaacacaaucgcccccauuaucuccaauuucuuucucgcuucuuacgcccugauuaacuucagcuguuuucacgccuccuacgcuaagagcccuggcuggcggccggccuaugggaucuacaauaugugggucucucuuuucggagcggugcugugcugugcugugauguuugucauuaacuggugggccgccgugaucaccuauguuaucgaguucuuucucuacguguaugugaccugcaaaaagcccgacgucaauuggggcuccagcacacaggcucugucuuacguuuccgcccuggauaacgcgcuugaacucaccacaguggaggaccaugucaaaaauuucagaccucaaugcauugugcugacgggaggccccaugacccgcccugcucugcucgacaucacacacgccuucaccaagaacagcggacuguguauuugcugugaaguuuuugugggcccccggaaacuuugcgucaaggagaugaacucugggauggccaagaaacaggcuuggcugaucaagaauaaaauuaaggccuucuaugcugccguggcggccgauuguuuuagagacggagugcgcagccuccugcaggcuuccggccuggggcggaugaagccgaauacacuugucaucggauacaaaaagaacuggagaaaagccccucucaccgaaaucgagaauuacguuggcauuauccaugaugcuuucgacuuugagauugggguggugaucguccgcauuagccagggcuucgauaucucucaagugcugcagguucaggaggaacuggaacggcucgagcaggagagacuggcccuugaagccacgauuaaggacaacgagugcgaagaggaauccggaggcauccgcgggcuguuuaaaaaggcuggaaagcucaacaucaccaaaacaacccccaagaaagauggcagcauuaauacaucccaaucuaugcacgugggggaguucaaccagaagcuggucgaggcgagcacccaguuuaaaaagaagcaggaaaaaggaacgaucgacgugugguggcuguucgaugacggcggccuuacacuccugauuccuuauauccugacccuccggaagaaauggaaggauuguaaacugagaauuuacguugggggaaagaucaaucgcaucgaggaagagaaaauugugauggccucccuucugucuaaguuucggaucaaguucgcugacauucacaucauuggcgauaucaacaucagacccaauaaagaaagcuggaaggucuucgaggagaugauugaaccuuaucggcuccaugaguccugcaaagaccugacaaccgccgaaaagcugaaacgcgagacccccuggaagaucacagacgccgaacuugaggcugugaaggagaaaucuuacagacaaguucggcucaacgaacugcugcaggagcacagcagagccgcgaaucucauugugcugucccuuccggucgcucgcaaggggagcaucucugaucugcucuauauggccuggcuggaaauucugacgaaaaaccuuccucccgugcugcucgugcggggaaaucauaagaacguccugaccuuuuacuccuga

SEQ ID NO: 75619 - RNA, 3591 nt, Artificial Sequence
  derived and/or modified sequence opt5 from SLC12A2__Homo_sapiens__NP_001243390
auggagcccagaccuaccgccccgagcuccggcgcucccgggcuggccggagugggcgaaacaccuucugcggcugcccucgccgcugcccgggucgagcugcccgggacggcuguuccuagcgugcccgaagacgccgcgccugccucccgcgauggaggcggggugagagacgagggaccggcugccgcuggcgauggccuugggcggccccugggaccuacccccucucagagccgcuuccaagucgaccucguguccgaaaacgccggcagagcggccgcugccgcugccgccgcugcggccgcugccgccgcugccggggcgggagcuggcgccaagcagaccccugccgauggggaggcuucuggagagagcgaacccgccaaaggcuccgaggaagcuaagggccgguuucgcguuaauuucguggacccggccgcgucuagcuccgccgaggauagccugucugacgcugccggggucggaguggauggcccuaacguuuccuuucagaaugggggagacacagugcuuagcgagggaucuucccugcacagcgggggaggcggcggguccggacaucaccagcauuacuauuacgauacacacaccaacacauauuaccucagaaccuucggccauaauacgauggacgcugucccccggaucgaucacuaucgccacaccgccgcgcaacugggggaaaaacugcucagaccuucucuggccgagcuucaugacgaacuggagaaggaacccuuugaggacggauucgcuaacggcgaggaaagcacacccacccgggaugccguggugacauacaccgcugaguccaaaggggucguuaaguuuggcuggauuaagggagugcucgugcgcugcaugcugaauaucuggggcgucaugcuuuucauuagacugagcuggaucguggggcaggccggaauuggccucucuguucuggugaucaugauggccacggucgugacaaccaucacagggcuguccaccagcgcuauugcgaccaacggauuuguucggggcgggggcgccuauuaccucaucucucgcagccugggaccugaguucggcggggcuauuggacuuaucuuugccuucgccaaugcuguggccgucgcgauguacguggucggcuuugcugagacagugguugaacugcucaaagagcacuccauucugaugaucgacgagauuaacgauaucagaaucauuggggccaucacgguggucauucuucugggaaucucuguggccggcauggaaugggaggcuaaggcccagauuguucuccuggugauccugcuccuggcgaucggggacuucgucauuggcaccuucaucccgcuugaaagcaaaaagcccaaaggauuuuucggcuauaaguccgagauuuuuaaugaaaacuucgggccugauuuucgggaggaggaaacauucuuuagcguguucgcuaucuuuuuccccgccgccaccggcauucuggcuggcgccaauaucucuggggaccucgcugauccucaguccgccauccccaagggaacacugcuugcgauucugaucaccacgcucguguacguuggcauugccgucagcguggggucuuguguggucagagacgcuacaggcaacgugaaugauaccaucguuaccgagcugacaaacugcaccuccgccgcuuguaaacugaacuuugacuucagcuccugcgaaucuagcccguguuccuauggacucaugaauaacuuucaagugaugucuauggucagcggcuucacaccucugauuuccgccgggaucuucagcgccacgcuuucuuccgcucuggcgagccucgugucugcccccaagauuuuucaggcucugugcaaagauaauaucuacccugccuuccagauguuugccaagggauauggcaaaaacaaugagccccugcgcggguacauccuuaccuuccucauugcucugggauuuauccugauugccgagcucaacguuaucgcgccuauuaucuccaauuucuuucuggcuagcuaugcccuuaucaacuucucuguguuucaugccagccuggcuaagucccccggcuggcggccggccuucaaauacuacaauauguggauuagccuccugggcgcgauccuguguugcauugucauguuugugaucaacuggugggcugcccuucucacauauguuauugugcuggggcuguacaucuaugucaccuacaagaagccugacgugaauuggggaucuuccacacaggcccucaccuaucugaacgcccuucaacacagcaucagacuguccggcguggaagaccacgucaaaaauuuccgcccccagugucucguuaugacgggggcucccaacucucggccugcucugcugcaucuugugcacgauuuuaccaagaaugugggacucaugauuugcggccauguccacauggggccgagacgccaggccaugaaagagaugagcaucgaccaagcgaaguaccagcgguggcugauuaaaaacaagaugaaggccuucuaugcucccgugcaugccgaugaccugagagaaggagcucaguaccucaugcaggccgccggccugggccgcaugaaaccuaacacacuuguucugggguucaagaaagauuggcuccaagcugacaugcgggauguggacauguacaucaaucuguuucacgaugcguucgacauucaguauggagucgugguuaucagacugaaggagggccuugauaucucccaccuccaggggcaggaagaacugcugucuagccaagagaaaucccccggaaccaaggacguggucgugucuguugaauacagcaagaaauccgaucucgacacaagcaagccucugucugagaaacccauuacccauaaggaauccaaaggcccuaucgugccccuuaacgucgccgaccagaagcugcucgaggcuagcacgcaguuucagaagaaacaagggaagaauacaauugaugugugguggcuguucgacgauggaggccugacccuucugaucccguaucuccugacaaccaaaaagaaauggaaggacuguaaaauucgcguguuuaucggcgggaagauuaaccggaucgaucacgacagacgggccauggccacccuccugucuaaguuccgcaucgauuuuuccgacauuaugguccuuggagauaucaauacaaaaccuaagaaagaaaacauuaucgcuuucgaggagauuaucgaacccuacagacugcaugaggacgauaaggaacaggacaucgccgauaaaaugaaggaggacgaaccuuggcggauuacggacaaugagcucgagcuguauaagaccaaaacauacagacagauccgccugaacgaacuucugaaggagcacagcucuaccgcgaauauuaucguuaugucccuccccguggcucggaaaggcgccgugagcuccgcccuguauauggcuuggcucgaagcccugagcaaggaucuuccgccuauucugcucgucagagggaaccaccagucugugcugacauuuuacagcuga

SEQ ID NO: 75620 - RNA, 3093 nt, Artificial Sequence
  derived and/or modified sequence opt5 from SLC12A3__Homo_sapiens__NP_000330
auggccgagcugcccaccacagaaacgccuggcgacgcuacccucugcagcgggagauucacaaucuccacccugcuuucuagcgaugagccgucucccccugccgcguacgacuccagccaccccucccaucugacacacucuagcaccuuuuguaugcggacauucggauauaacaccauugauguggucccuacguacgaacauuaugcuaauuccacccagcccggcgagccucgcaagguuagaccgacacucgccgaccugcacagcuuucuuaaacaagaagggcggcaucugcacgcccucgcuuucgauucucgccccucccacgagaugaccgacggacugguggagggcgaagccgggacaagcucugagaagaacccugaggaacccgugagauuuggaugggucaaaggcgugaugauccggugcaugcugaauauuuggggcguuauccucuaccugcgccuuccuuggauuaccgcucaggccgggaucgugcugacguggaucauuauccuccuguccgucacagugaccagcauuacaggacuuucuaucuccgcgauuagcaccaacggcaagguuaaauccgggggaaccuauuuccugaucucuagaagccucggccccgagcucgggggauccauuggccugaucuuugccuucgcuaaugccgugggcgucgcuaugcauacagugggguuugccgaaacggugcgggaucuccugcaggaguacggagcgccgaucgucgacccuauuaacgauauccgcauuaucggcguugugagcgugaccguccuucuggccauuucucucgcugggauggaaugggaguccaaggcccaggugcuguucuuucuuguuaucauggugagcuucgcuaauuaucuggucggaacacucauucccccuucugaagacaaggccagcaaaggcuuuuucuccuacagagccgauaucuucgugcaaaaccugguucccgacuggcgggggcccgauggaaccuuuuucggcauguuuucuaucuucuuuccuagcgcuacaggcauucuggcgggggccaauaucuccggagaccucaaggacccggcuauugccauccccaaaggcacccugauggccaucuucuggacgacaauuagcuaccuugcuaucucugccaccauuggguccugugugguccgcgaugcgagcggagugcugaacgacaccgucacaccuggcuggggcgcuugcgaggggcucgccuguucuuauggauggaauuuuaccgagugcacacagcagcacuccugucauuacggccugaucaacuauuaccagacgaugagcaugguguccggguucgcuccccuuauuaccgccggaaucuuuggcgccacacugucuagcgcucucgccugccugguuuccgcggccaagguguuccaaugucugugcgaagaucagcucuauccucugauuggguuuuucggaaaaggcuacgggaagaauaaggagcccgucagaggcuaucuucuggcuuacgccaucgcuguggccuuuaucauuaucgcggaacucaacaccauugccccgaucauuucuaauuucuuccuguguagcuacgcucugaucaacuuuuccugcuuccacgccagcaucacaaacucuccuggauggcggcccuccuuucaguauuacaauaaaugggcugcccuuuucggcgccauuaucagcguugugauuauguuucuccugaccuggugggcugcgcugaucgccauuggggucgugcuguuccugcuucuguaugugaucuacaagaaaccugagguuaacuggggaucuuccguccaggcuggcagcuauaaucucgcccugucuuacagcguggggcugaacgaaguggaggaccacaucaagaauuaucgcccccaaugccuuguccucacgggaccucccaacuuuagaccggcccugguggauuucguuggcaccuuuacacggaaucugucccucaugauuugugggcaugugcugaucggcccucacaaacagagaaugcccgagcuucagcugauugcuaacggacauaccaaguggcucaauaaacgcaagaucaaggccuucuacagcgacgucauugcggaagaucugcggagaggcgugcaaauccugaugcaggcugccgggcuuggacgcaugaaacccaacauccucguugugggcuuuaagaaaaauuggcagucugcccacccugcuacagucgaggacuacauugggauccugcaugaugccuucgacuuuaacuauggagugugcguuaugcggaugagagaaggccugaauguguccaagaugaugcaggcgcacauuaacccggucuucgaucccgcugaggacgggaaagaagccagcgcccgcggcgcucggccuuccgugucuggagcccucgaccccaaggcucuggugaaggaggagcaagccaccacgaucuuccagagcgaacagggcaaaaagacaauugauaucuacuggcuuuuugacgaugggggacugacccuccugauuccuuaucugcuuggcagaaaacgccggugguccaaguguaaaaucagagucuucguugggggacagaucaaucgcauggaccaagagcggaaggcgauuaucucucuccugagcaaguuuagacugggcuuccacgaagugcauauucuccccgauaucaaccagaacccucgggccgagcacacaaaacgcuuugaggacaugauugcucccuucagacugaaugauggcuuuaaggacgaagccaccgugaacgagaugcggagagauugcccguggaaaaucuccgacgaagagaucaccaagaaucgcgucaaaucucuuagacaggugcggcugaacgaaauuguucucgauuacagccgcgacgcugcccugaucgugauuacacugccuaucgggagaaagggaaagugucccuccagccuuuauauggccuggcuggagacgcucucucaggaucugcggccucccgucauucucauccgcggcaaucaagagaacgugcugaccuucuacugccaguga

SEQ ID NO: 75621 - RNA, 3240 nt, Artificial Sequence
  derived and/or modified sequence opt5 from SLC12A4__Homo_sapiens__NP_001139433
augccccacuucaccguggucccuguugacggcccgagacgcggggauuacgacaaccuggagggacucagcuggguggauuauggcgaacgggccgagcuggacgauuccgacgggcauggaaaucacagagaaucuagccccuuucuuuccccucuggaggcuucucggggcaucgauuacuaugaccgcaaccucgcccuguucgaagaggagcuugauauuagacccaaggugagcucccugcucgggaaacuggucucuuacacaaaucugacgcagggagcgaaggaacaugaggaagcugagagcggcgagggcacccggcgcagagccgccgaagcuccuuccauggggacacucaugggaguguaucugcccugccuucaaaacaucuuuggcguuauucuguuccuccggcugaccuggaugguggggacagccggaguccuucaggcucugcucaucgugcugauuuguugcuguugcacccugcucacagccaucagcaugucugcgaucgccaccaauggcguugugccugcugggggauccuacuuuaugauuagccgcucucugggcccggaguucggcggggccgucggacuuuguuuuuaucugggcacgaccuucgcugccgcgauguacauccucggggccauugaaauccugcuuacauacauugcucccccugccgcuaucuuuuaucccuccggagcccacgacaccagcaacgccacacugaauaacaugagaguguacggcaccauuuuccucacguuuaugacacugguggucuucguuggggugaaauaugugaauaaguuugcuucucuguuccucgcgugcgucaucaucuccauucugagcaucuacgccggaggcauuaaauccaucuucgauccucccguguuuccgguuuguaugcuuggcaaccggacccugucucgcgaccaguucgauauuugcgcuaagacagccguggucgacaaugagaccguggccacccagcucuggagcuuuuucugucauuccccuaaccugacaacggacagcugcgaucccuauuuuaugcuuaauaacguuaccgaaaucccugggauccccggagcugccgcgggcgugcugcaagagaaucucuggucugcuuaccuggagaagggggacauugucgaaaaacacggacugcccuccgccgaugccccuagccucaaggagucucugccgcuuuauguggucgcugacaucgccaccagcuucaccgugcugguuggcaucuuuuuccccuccgugacagggauuauggcuggcucuaacagaagcggagaucuccgggacgcccagaaauccauuccugucggcaccauccuggcgaucauuacgacaagccugguguacuuuucuuccguugugcuuuucggggccuguaucgaaggagucgugcuccgcgauaaguacggcgacggggugagcagaaaccugguugucggaacccuggcuuggcccucuccuugggugauugugaucggcuccuuuuucagcacaugcggggccggccuccagucccugacaggagcuccccggcuucugcaggccauugcgaaagauaauaucauuccguuucucagagucuucggccacgggaaggugaacggagagccuaccugggcccugcugcuuacagcucucaucgccgaacugggcauccugauugcuucucucgacaugguugcccccauccugagcauguucuuucuuaugugcuaucuguucgugaaucucgccugugcuguccaaacgcugcugcgcaccccuaacuggcggcccagauuuaaguacuaucauugggcgcuuuccuuccucgggaugucucugugccuggcccucauguuugugagcuccugguacuaugcucugguugccaugcuuauugccggaaugaucuacaaauauauugaguaccagggcgcugagaaggaauggggcgaugggauccgcggacugagccucucugccgcgcgguacgcucugcugagacuugaggaaggcccuccccacaccaaaaauuggcgcccgcagcuccuggugcugcucaagcuggacgaggaccuucaugucaaauauccucggcugcucacauucgccucccagcugaaggccgggaaaggacugacaaucgugggcagcguuauucaagggucuuuucuugaauccuacggagaggcucaggccgcggagcagaccaucaagaacaugauggaaauugagaaggugaaaggcuucugucaagucgugguggcuagcaaggucagagaagggcuggcccaccucauccagucuugcggccugggaggcaugcgccacaauagcguugugcucggguggcccuauggauggcggcaguccgaggaucccagagccuggaaaacguuuauugacaccgugcgcuguacaaccgcugcccaucuggcucugcuggucccuaagaacaucgccuucuacccgagcaaucacgagcgguaucucgaaggccauaucgaugugugguggauuguucacgacgggggaaugcugaugcugcuucccuuucugcucagacagcauaaaguguggcggaagugccgcaugagaaucuucacagucgcgcaaauggaugacaacucuauucagaugaagaaagaucuggccguguuucucuaccaccuucggcuugaggcugaacacaauuccgacaucagcgccuauaccuacgagagaacgcugaugauggaacagcgcucccagaugcuccggcaaaugagacugacaaagaccgagcgcgagagagaagcucagcugguuaaagaucggcauucugcccuucgccuggagagccucuacuccgacgaagaggaugaaucugccgugggcgcugacaagauucagaugacauggaccagagauaaauauaugaccgagacaugggacccuagccacgcgcccgacaacuuccgggagcugguccauaucaagccugaucaguccaaugugcgcagaaugcacacggccguuaagcucaacgaagugaucgucacccggucucacgacgcucgccuggugcuucugaauaugcccggcccucccagaaacagcgagggggaugaaaacuacauggaguuccuggaagugcucacagagggacuggagcggguccuucugguucgcggcgggggaagagaagugauuaccaucuauuccuga

SEQ ID NO: 75622 - RNA, 3420 nt, Artificial Sequence
  derived and/or modified sequence opt5 from SLC12A5__Homo_sapiens__NP_001128243
augagcagacgguucaccgugacaucccugcccccugccggcccggcucgcucucccgacccugagagcagacggcacuccgucgccgauccccgccaucucccuggggaagacguuaagggagauggcaaccccaaagagucuagcccuuuuaucaauuccacggacaccgaaaaggggaaagaguacgauggaaagaacauggcgcuguucgaagaggagauggacacaucuccgauggugagcucccuucugagcggccucgcuaauuauaccaaccugccccaggggucuagagaacacgaggaagccgagaauaacgagggaggcaaaaagaagccugugcaagcuccccggaugggcacauuuaugggggucuaccuuccuugccugcagaauauuuucggagugauccucuuucugcgccugaccuggguugugggcauugcugggaucauggaauccuucuguauggucuuuauuugcuguagcugcacaaugcucaccgccaucucuauguccgcuaucgccacgaacggagugguucccgcgggcgggagcuauuacaugauuucuagaucccugggaccggaguucggcggcgccguggggcuuuguuuuuaucugggaaccacauucgcuggcgccauguacauccucgggaccauugaaauccugcuugcuuaucuguuuccugccauggcgauuuucaaagccgaggaugcuagcggagaagccgcugccaugcucaauaacaugcgggucuacggcacaugcgugcugaccuguauggccacgguggucuuuguuggggugaaguacgugaauaaauucgcucuggucuuccucggaugcgugauccuguccauucuugcgaucuaugccggcguuaucaagucugcuuuugaucccccuaacuuccccauuugucugcucggcaaucgcacacugagcagacauggguuugacgugugcgccaaacuugccugggagggaaacgagaccgucacaacccggcuguggggccucuucuguuccagccgcuuucugaaugcuaccugcgacgaauacuucacaagaaacaacgugacggagauccaggggauucccggagccgcgucuggccugaucaaggaaaaucucugguccagcuaucugaccaaggggguuauuguggagcggucuggcaugacaagcgucggacuugcugauggcaccccuaucgacauggaucacccguacguguuuuccgacaugacaucuuauuucacccugcucgucgggaucuacuuucccagcgugacgggaauuauggccggcuccaaccgcagcggggaccugagagaugcccagaaaucuaucccuacaggaaccauucuugcuaucgccaccacauccgcuguuuauauuagcucugugguccuguucggcgccugcaucgaaggggugguucuccgggacaaguuuggcgaggcggugaauggaaaccuggucgugggcacccuggccuggcccuccccuugggugaucguuauugggagcuucuuuuccacauguggagcuggccuccaaucucugacgggggcccccagacuucugcaggcuaucagccgcgauggaauugucccguuccuccagguguucggccaugggaaagccaauggcgagccuaccugggcgcugcugcuuacagccugcaucugugaaauuggaauccucauugcuucccuggacgagguggcccccauccugucuauguuuuuccucaugugcuacauguuugucaaccuggcuugugccgugcagacccuucugcggacaccuaauuggagaccccgcuuccgguacuaucacuggacccucagcuuucugggcaugucccugugccuugcccucauguucaucuguagcugguacuaugcucugguugcgaugcugauugccgggcucaucuacaaguauauugaauacagaggagcugagaaagaauggggcgaugggauccgcggacugucucuuuccgccgcccgguaugcucugcucagacuggaggagggcccuccccacacgaagaacuggcgcccgcaacugcuugugcucguccggguggaccaggaucagaauguugugcauccucagcugcugagccucaccucucaacugaaagccgggaagggccuuacaauugucggauccgugcuggaaggcaccuuucucgagaaccacccccaggcgcagagagcugaagagagcauccgccggcugauggaggccgaaaagguuaaaggguucugccaaguggucaucucuagcaaucugagagacggagugucccaucuuauucagagcggcgggcucggaggccugcagcacaacacagugcuggucggcuggccccggaauuggcgccagaaggaggaucaccaaaccuggagaaacuuuaucgaacucguucgggagacgacagccgggcaucuggcccuucuggugaccaaaaaugugucuauguucccuggaaacccggaaagauuuuccgagggcagcauugacgucugguggaucgugcacgaugggggaaugcucaugcugcugcccuuccuucugcgccaucacaagguuuggcggaaauguaagaugagaauuuuuacaguggcccagauggacgacaacuccauccagaugaagaaagaucucaccaccuuccuguaccaucuccgcaucacagcggaggucgaagugguugagaugcacgaaucugacauuagcgcuuacacguaugagaagacccuggugauggaacagagaucccaaauccuuaaacagaugcaccugacaaagaaugagcgggagcgcgaaauucagucuaucaccgaugagagcagaggcuccauucggcgcaaaaacccugccaauacaagacuccggcugaacguccccgaagagaccgccggggacucugaagagaagccugaggaagaggugcagcugauccaugaucaaagcgcucccuccugcccuucuagcucccccagcccgggagaagaaccugagggcgaaggcgagacggaccccgaaaagguucaccuuacauggaccaaagauaagucuguggccgagaaaaauaaggggccuucccccgucagcucugaaggaaucaaagacuucuuuuccaugaagccggagugggagaaccugaaucagagcaacgugcgcagaaugcauaccgcugugcggcucaaugaagucauuguuaagaaaucccgcgaugccaagcuggugcuccugaacaugccugggcccccuagaaaucggaacggcgacgagaauuacauggaguuccuugaggugcugacagaacaccucgauagagucaugcuggugcgcggaggcgggcgggagguuaucaccauuuauagcuga

SEQ ID NO: 75623 - RNA, 3276 nt, Artificial Sequence
  derived and/or modified sequence opt5 from SLC12A6__Homo_sapiens__NP_001035960
augagcgagauguccggcgccaccacaucucuggcuacgguggcccucgaucccccuagcgacagaaccucccacccgcaggacgucaucgaagaucugucucaaaacagcauuacaggggagcauucccagcuucuggacgauggacacaagaaagcgcggaaugcuuaccucaacaauucuaacuaugaagagggcgacgaauacuucgauaagaaucuggcccuuuuugaggaggaaauggacacccgccccaaaguuagcucccugcucaacagaauggccaauuauacaaaccugacccagggggcuaaggagcaugaagaggccgagaauaucacagaaggcaaaaagaagccuaccaaaacgccccagaugggcaccuucauggggguguaccugccuugccuccaaaacauuuuuggagugauccuguuccuucggcugacaugggucgugggcaccgcuggcguucuccaggccuuugcgauugugcugaucuguugcuguugcacaaugcuuaccgccaucagcaugucugcuauugccacgaauggggucgugcccgcuggaggcuccuauuucaugaucagccgcgcccuggggccugaguuuggaggcgcgguugggcucuguuucuaccugggaacaaccuuugccgcugccauguauauucugggcgcuaucgaaauuuuccucguguacaucgucccgagagccgccauuuuucacucugaugacgcucugaaggaguccgcggccaugcuuaacaauaugcggguguacggcacagcuuuccuggugcucaugguccugguuguguuuaucggggugcgcuaugucaacaaauucgccagccuuuuccuggccugcgugaucguuucuauucucgcuaucuacgccggagcgauuaaguccagcuuugcucccccucauuuccccguguguaugcugggcaauagaacccuguccucucggcacaucgaugucugcagcaaaaccaaggaaauuaacaacaugacagugccuuccaagcucuggggguuuuucuguaauagcucucaguuuuucaacgccacgugcgacgaguauuuuguucacaauaacgugaccuccauccagggaauccccggccuggccagcgggauuaucacagagaaucuuuggucuaacuaccugccgaaaggagaaauuaucgagaagccuagcgcuaaauccucugauguccucggcagccugaaucaugaauaugugcuugucgacauuaccacauccuucacccugcucgugggcaucuuuuuccccagcguuacggggaucauggccggaucuaaccgcuccggcgaccugaaggaugcucagaaaagcauuccuaucgggacaauucuggccauccucaccaccucuuuuguguaccuguccaaugucgugcuuuucggagcguguauugagggcguugugcugagagacaaguuuggggaugccgucaaaggcaaccucguggugggaacacugagcuggcccucccccuggguuaucgucauuggcucuuucuucagcacaugcggggcuggacugcaaucccuuacaggcgccccucggcuccugcaggcuaucgccaaggacaauaucauuccguuucugcgcguguucgggcacucuaaggcgaacggagaacccacgugggcccuccugcuuaccgcugccaucgcugagcugggcauucucaucgccagccuggaucugguggccccuauucuuuccauguuuuuccucaugugcuaucuguuugucaaucuggcuugugcgcuccagacacugcuuagaacccccaacuggcggccucgcuucagauacuaccauugggcccugagcuuuauggggaugucuaucugccucgcucugauguucaucuccagcugguauuacgccauuguggccaugguuaucgcuggcaugauuuauaaauacaucgaguaucaaggagccgaaaaggaguggggcgacgggauucggggacugucucuuuccgcggcuagauuugcccuccugcgccuggaagagggacccccgcacaccaaaaauuggcggccucagcuccuggugcuucugaagcucgaugaagaccugcacgucaaacaucccagacugcuuaccuucgccagccagcucaaggcugggaagggacugacgaucgugggcucuguuaucguggggaacuuucuggagaacuacggcgaggcccucgcggcugaacaaaccauuaaacaccugauggaggccgaaaaggucaaaggauucugucagcuugugguugccgcuaagcugcgcgagggcaucagccaucucauucaguccugcgggcugggaggcaugaaacacaauacaguggucaugggguggccuaacggauggcggcagagcgaggaugccagagcuuggaagaccuuuaucggcacagugcgcgugaccacggccgcgcaucuggcccuucuggucgcuaagaauauuucuuucuuccccuccaacguugaacaauuuagcgaggggaauaucgacgugugguggaucgugcacgauggcggaaugcucaugcugcucccuuuccugcuuaaacagcacaaggucuggcggaaauguuccauuagaaucuuuacaguggcccagcuggaagacaacucuauucagaugaagaaagaccucgcuaccuuccuguaucaucugcgcaucgaggccgaaguugagguggucgagaugcacgauagcgacauuuccgccuacacauacgaacggacccuuaugauggagcaaagaucucagaugcugcgccauaugcggcucagcaagaccgaaagagaucgggaggcucagcuggugaaggaccgcaauuccaugcucagacugacaucuaucggcagcgaugaagacgaggagacggaaaccuaucaggagaaaguucacaugacauggaccaaggauaaauacauggcgucccgggggcaaaaggccaaaagcauggaaggauuucaggaccuucugaacaugagacccgaucagucuaaugugcgccggaugcacacagcugucaagcucaacgaggugauuguuaauaaaucccaugaagccaagcuggugcugcuuaacaugccgggcccucccagaaaucccgagggggacgagaacuauauggaguuccuggaaguccucaccgaaggacuggagcgcgugcuccuggugagaggcggcgggagcgaggucaucacgaucuacucuuga

SEQ ID NO: 75624 - RNA, 3252 nt, Artificial Sequence
  derived and/or modified sequence opt5 from SLC12A7__Homo_sapiens__NP_006589
augcccaccaacuucacaguggucccuguugaggcccacgcugacggcgggggagaugaaacggccgagagaaccgaagcgccgggcacacccgaggggccugaacccgagcggccuagccccggagacggcaauccucgcgagaacuccccguuucugaauaacguggaaguggagcaggaaucuuucuuugaggggaagaauauggcucucuucgaggaagagauggauagcaaccccauggucuccucucugcuuaauaaacuggccaacuacaccaaucucagccaaggagugguugaacaugaggaagacgaggaguccagacggcgcgaagccaaggcuccuagaaugggcacauuuaucggcguguaucugcccugccuucagaacauucugggggucauccucuuccugcggcugaccuggauugugggaguugccggcgugcucgagucuuuucugaucgucgcuauguguugcacauguaccaugcuuacggccauuagcauguccgcgaucgccaccaaugggguggugccugcuggaggcagcuacuauaugaucucucgcucccuggggcccgaauuuggaggcgccgucggccucugcuuuuaccuggggacaaccuucgcuggagccauguauauucuuggcacaaucgagauuuuucugaccuacaucagcccgggggcggccauuuuccaggcugaagccgcuggaggcgaggccgccgcuaugcuccacaacaugagaguuuaugggacguguacacuggugcugauggcgcucguggucuuugugggaguuaaauacgugaauaagcuggcccuugucuuccuggcuugcgugguucucucuauccuggccauuuacgccggcgugaucaaauccgcuuucgauccucccgacaucccugucugucuucugggcaaccggacccucagccgcagaucuuuugaugccugcgugaaggcguaugggauucauaauaacuccgcuacaagcgcccuguggggacuguucuguaacggcucccagcccucugccgcuugcgacgaguacuuuauccaaaauaacgucaccgaaauucaggggauccccggagccgcuagcggcguguuccucgagaaucugugguccaccuaugcccacgcgggggccuuuguugaaaagaaaggcgugccuagcgucccgguggcugaggaaucucgggccuccgcccuucccuacguucugacagauauugcugcgagcuucacgcuccuggugggaaucuauuuuccuucugucaccggcaucauggccgggagcaaccgcuccggagaccuuaaggaugcucagaaaucuauucccacaggcaccauccuggccauugugacaaccagcuucaucuaccucuccuguauugugcuguuuggggcuugcaucgagggaguuguccugagagacaaguucggcgaggcccuccaggggaaucuggugaucggcaugcuugccuggccuagccccugggugauugucaucggaucuuucuucuccacgugcggcgcugggcugcaaagccucacaggagcgccgcggcugcugcaggccauugcucgcgauggcaucgugccuuuucuucagguuuucgggcauggaaaagccaacggcgaacccaccugggcccuccugcugaccgugcucauuugugagacagggauccugauugcuucucuugacuccgucgccccuauccugagcauguucuuucucaugugcuaucuguucgugaaucuggcgugugcuguucagacccuucucagaacacccaacuggcggccuagauuuaaguucuaccacuggacgcuguccuuucugggcaugucucucugccuggcccuuauguucaucuguagcugguacuaugcccuguccgcuaugcucauugccggaugcaucuacaaguauauugaauaccgcggcgcggagaaagaguggggagacgggauccggggccugucucugaaugcugccagauaugcccuucuccgcguggaacacgggcccccgcauaccaagaacuggcggccucaaguccuggugaugcugaaucucgaugcugagcaggccguuaaacaccccagacugcuuagcuuuacaucccagcugaaggcuggaaaaggccucaccauuguggggagcguccuggaaggcacauaccuggacaagcauauggaggcccaacgcgcggaagagaacauccggucucuuauguccaccgagaaaacgaagggauucugucagcucguggugucuagcucccugagagauggcaugagccaccugauccagucugccgggcucggaggccugaagcacaauaccguccuuauggcuuggcccgccagcuggaaacaggaagacaacccuuuuuccuggaagaauuucguugauacagugcgcgacaccacagcugcccaucaagcccugcucguggcuaaaaacgucgauagcuuuccgcagaaccaggagcgguucgggggaggccacauugacgugugguggaucguucaugauggcgggaugcugaugcugcuucccuuucugcucagacagcacaagguguggcgcaaaugccggaugagaauuuucaccgucgcgcaaguggacgauaauucuauccagaugaagaaggaccugcagauguuccucuaucaucugcggauuuccgccgaaguugagguggucgaaaugguggagaacgacaucagcgcuuuuacguacgagcgcacacuuaugauggaacagagaucccaaaugcugaaacagaugcagcucucuaagaaugagcaggaacgggaggcccaacugauccacgauagaaacaccgccagccacacagcugccgcggcucgcacccaggccccucccaccccugacaaaguucagaugacauggacgcgggaaaagcugauugccgagaaauacagaucccgcgauaccucucuuagcggauucaaggaccuguuuuccaugaagcccgaucaaucuaaugugagacggaugcauacagcugucaaacucaacggcguggugcugaauaagagccaggacgcccagcucguccugcuuaacaugccugggcccccgaaaaaucgccagggagaugagaacuauauggaguuccuggaaguucucaccgaaggccugaauagagugcugcuugugcgcgggggaggccgggaggucaucacaauuuacuccuga

SEQ ID NO: 75625 - RNA, 2145 nt, Artificial Sequence
  derived and/or modified sequence opt5 from SLC12A8__Homo_sapiens__NP_001182412
augacccagaugagccaagugcaggagcuguuccacgaagccgcucagcaggacgcccucgcgcaaccccagccuugguggaagacacagcuguuuaugugggagccgguccuuuucggcacgugggaugggguuuuuaccuccugcaugaucaacauuuucggaguggugcuguuucucagaacaggcuggcuggucgggaauaccggagugcuucugggcauguuccucguuucuuuugugauccuggucgcucuggugacaguucucagcgggauuggagugggcgaacgguccucuaucggcagcgggggagucuacuccaugauuucuagcgugcugggcgggcagaccggaggcacaaucgggcuucuguauguguucggacaaugugucgccggcgccauguacaucaccggcuuugcugaguccauuagcgaccuccuggggcuuggaaacaucugggccguucgcggcauuucuguggcugugcugcucgcccugcuggggaucaaucucgcgggagucaaauggauuaucagacugcagcuucugcuccuguuccuucuggccguguccacgcucgauuuuguugugggcagcuucacccaucuggaccccgaacacggguuuauuggauauucuccugagcugcuccagaacaauacacugcccgauuacuccccuggcgagagcuucuucaccgucuuuggcguguucuuucccgcugccacagggguuauggcuggauucaacaugggcggggaccuucgggaaccugccgcgucuaucccgcugggaucccucgccgcugugggcaucagcugguuucuguauauugucuucguguuucuucugggggccaucugcacccgcgaggcucucagauacgauuuccugauugccgaaaaggucucccugaugggcuuucucuuccugcuuggacuguauaucucuagccucgccuccuguaugggcgggcuguacggagcuccccggauucugcagugcaucgcgcaagagaaagugaucccugcccuugcuugucucggccaggggaagggacccaauaaaacgccuguugccgccauuugccugacaagccuggugaccauggcuuuugucuucgugggccagguuaacgugcucgcccccaucgucacaauuaauuuuaugcugaccuacguggcgguggacuauucuuacuucucccuuagcauguguucuugcagccugaccccgguuccugagcccguccuccgcgaaggggcugagggccugcauuguuccgaacaucugcuucucgagaaggccccuucuuauggaagcgaaggccccgcccaaagagugcuggaggggacacugcucgaguucacgaaggauauggaccagcugcuucagcugacccggaaacucgaauccagccagccccgccaaggagagggcaacagaacaccugaaucucagaagcggaaauccaagaaagcuaccaagcagacacugcaggauagcuuucugcuugaccucaagucuccgcccuccuucccuguggagaucagcgaucgccugcccgccgcuuccugggaagggcaagagucuugcuggaauaaacagaccagcaaguccgagggaacgcagccugaaggcacauacggggagcagcugguccccgaacucuguaaccaaucugagagcuccggcgaagacuuuuuccugaaaagcagacuucaggagcaggacguguggcggcgcucuaccuccuuuuauacccacaugugcaauccguggguuagccugcucggagccgugggcucucugcugauuauguucgucauccaguggguguacacacuuguuaacauggggguggcggccaucgucuauuuuuacauuggcagagcuuccccuggacuccaccuggggagcgccucuaauuucagcuuuuuccgguggaugagaucccugcuccugcccagcugccgcucucuucgguccccucaagagcagaucauucuggcucccagccucgccaagguggauauggaaaugacccagcugacacaagagaacgcggacuuugccacgagagaucgcuaccaccauuccucucugguuaaccgggaacagcuuaugccucacuauuga

SEQ ID NO: 75626 - RNA, 1896 nt, Artificial Sequence
  derived and/or modified sequence opt5 from SLC12A9__Homo_sapiens__NP_001254741
auggccagcgaguccucuccccugcucgcuuacagacugcuuggcgaagaggggguggcccugccugcgaacggagcuggcgggccgggaggcgccagcgcccggaaacucuccaccuuccugggggucguugugcccacagugcuuucuauguuuagcaucgucguguuccugcgcauuggauuuguugugggccacgcuggccuccugcaggcccuggcuaugcuccuggucgccuauuucauccuugcgcugacggugcucuccguuugcgccauugcuaccaauggggccgugcaaggaggcggggcuuacuuuaugaucucuagaacacugggaccugaagucggcgggagcauuggacuuauguucuaucuggccaacguguguggcugcgcggugucccuccugggccuggucgagagcguucucgacguguuuggggccgaugcuaccggacccucuggccugcgggugcuuccucagggguacggauggaaucugcucuauggcucccugcuucuggggcucgucggaggcguguguacacugggcgccgggcuguacgcucgcgccagcuuccucaccuuucugcuuguuucuggaucccuggccagcgugcucaucucuuucgucgcugugggccccagagacauccggcugacaccucgcccggggcccaacggauccagccuuccucccagauuuggccauuucaccggguuuaauuccucuacgcugaaagauaaccucggcgcgggauaugccgaagacuacaccacaggcgcuguuaugaauuucgccagcguguucgccguccuguuuaacgggugcaccggaauuauggcuggcgccaauauguccggggagcugaaggauccuagccgggcgaucccccucggaacaauuguggcugucgccuacaccuucuuuguguauguucugcuuuucuuucugucuuccuucacgugugaccgcacacuccugcaggaggauuacggcuuuuucagagccaucagccuguggccgccucuugugcucauugggaucuaugcuaccgcccugucugcuagcauguccucucugauuggcgccagccggauccuccacgcgcuggcccgcgacgaucuuuuuggagucauccuggcucccgccaaagugguuuccagaggcgggaacccuugggcugccgugcucuacagcuggggacugguccagcuggugcuucucgcgggcaagcugaauacacuggccgcugugguuaccgucuucuaucucguggccuacgcugccguggaccugucuugccuuucccuggaaugggccagcgcucccaacuuucggcccaccuucucucucuuuuccuggcauacaugucugcugggggucgcgagcugccuucucaugauguuccugauuuccccuggagccgcuggcgggucucugcuccugaugggccuucuggccgcccuccugacggcucgcggaggcccgagcuccuggggguaugugucucaagcccugcuuuuccaccagguuagaaaauaccuccugcggcuggaugugagaaaggaccaugucaaguuuuggcgcccccagcuccugcuucuggugggaaauccucggggcgcgcucccccugcugagacuugcuaaccagcugaaaaagggagggcucuacguucugggccacgugacccucggggaucuggacagccuuccuuccgaccccguccaaccgcaguauggcgccuggcugagccucguggaucgcgcccagguuaaggcuuucguggaccugacacugucuccuuccguccggcagggagcccaacaccuucugagaaucagcggccucgagucugggacccugcuccccuggggauuucgcuccuga

SEQ ID NO: 75627 - RNA, 1788 nt, Artificial Sequence
  derived and/or modified sequence opt5 from SLC13A1__Homo_sapiens__NP_071889
augaaguucuuuagcuacauccugguguauagacgguuccucuuugucguuuucaccgugcuggugcuucugccccucccuauuguccugcacacaaaagaggccgaaugcgcuuacacgcuuuuugugguugccaccuucuggcugacagaggcgcucccgcuguccgugaccgcucugcuccccucucugaugcuuccuauguuuggcaucaugcccagcaagaaagucgccuccgccuauuucaaggacuuucaucugcuccugauuggggugaucugucuugcuacaucuauugaaaaauggaaccugcacaagcgcaucgcccucaagaugguuaugauggugggagucaauccugcuuggcugacccugggcuucaugagcuccacagccuuucucucuauguggcugagcaacaccuccacggcggccauggugaugcccaucgcugaggccgugguccagcaaauuaucaaugcugaagccgagguugaggcgacccagaugacauacuucaacgggagcaccaaucauggacuugaaauugaugagucugugaacggccacgaaaucaaugagagaaaagagaagacaaaaccugugccgggguauaacaaugacaccggaaagauuuccagcaaagucgaacuggagaagaacucuggcaugcggacgaaguaccgcaccaaaaagggccaugugacaagaaaacucacaugccuguguaucgccuauuccagcaccauugggggacuuaccacaaucacgggcaccucuacaaaucugaucuuugcugaauacuucaacacccgguaccccgauugccgcugucucaauuucggguccugguuuacauucagcuuuccugccgcucugauuauccugcuccuguccuggauuuggcuucaguggcuguuccucggauuuaacuucaaggagauguuuaaaugcggcaagaccaaaacgguucagcaaaaggccugugccgaagugaucaagcaggaguaucagaaacuggggcccauuagauaccaggagaucgucacacuugugcuguucaucauuauggcucuccugugguuuucucgggacccuggauucguucccggcuggagcgcgcuguuuuccgaauauccgggcuucgccaccgauagcaccguggcucuccugaucgggcuucuguuuuuccucauuccugccaagacacugaccaaaacaacgcccaccggagagaucgucgccuucgacuacucuccucugauuacauggaaggaauuucaauccuucaugcccugggauaucgcuauccuugugggcgggggauuugcccucgcggacggcugcgaggaaagcgggcugucuaaauggauuggaaauaagcugagcccccucggcucccugccugcuuggcuuaucauucugaucucuagccucauggucaccucccugacagagguggccagcaacccggccaccauuacgcuguuccuucccauccucucuccucuggcugaggccauucacguuaacccccuguauauccucaucccuuccacccuguguaccagcuuugcuuuccuucugcccguggccaauccgccuaacgcgauugucuuuucuuacggccaccucaaggugaucgauaugguuaaagccgggcugggagugaauauugucggcguggcugugguuaugcuggggaucugcacauggauuguccccauguucgaccuuuauacauacccuuccugggcccccgcuaugagcaacgaaaccaugccuuga

SEQ ID NO: 75628 - RNA, 1926 nt, Artificial Sequence
  derived and/or modified sequence opt5 from SLC13A2__Homo_sapiens__NP_001139447
auggcuaccugcuggcaggcccugugggccuacagaagcuaucucaucguguucuuuguccccauucugcuucugccucucccgauccugguucccuccaaggaggcguacugugcuuaugccauuauccuuauggcccuguucuggugcacagaagcucucccucuggccgugacggcucuguuuccccucauucuguucccuaugaugggcaucguggacgccucugagaucauucaacggcccuuuccuagcuccuucgaaucuccgggggagugucagagcgucggaauguccgugaccgcgucucacaaccuuggcgggacaguuggagauagccgcguguuucccccucugucccaugucucuaccugccagguggccguugaauaccucaaagacagcaaucugcuuuucuuuggcgggcugcucguggcuaucgccgucgagcacuggaaccugcauaagagaauugcucugcgggugcuccugaucgugggaguccgccccgccccucuuauucugggcuucaugcucguuacagcguuucuguccauguggaucagcaauaccgccacaucugcuaugauggugcccauugcccacgcugugcuugaucagcugcauuccagccaagccucuuccaacgucgaggaaggcagcaauaacccgaccuucgagcuccaggaaccuuccccucagaaagaggugacgaagcuggacaaugggcaggcccugcccguuaccucugcuagcuccgaggggagagcgcaccucagccaaaaacaucugcaccuuacacaguguaugucucugugcguguguuauuccgccagcaucggcgggaucgcuacccucacaggaaccgcccccaaccugguccuucagggccagauuaauucucuguuuccccaaaacgggaaugugguuaacuucgccagcugguucuccuuugcuuucccuacgauggugauccuccugcugcucgccuggcuguggcuucagauucuguuucucggauucaauuuucggaagaacuucggcaucggcgaaaagaugcaggagcaacagcaggcggcuuacugcgucauucagacagaacaccgccugcuggggccgaugaccuuugccgagaaagccaucucuauccuuuucgugauucucguccugcugugguuuacaagagaacccggauucuuucucggcugggggaaucuggcuuucccuaacgccaagggagagagcaugguguccgauggcaccguugcuaucuuuauugggaucauuauguucaucauccccagcaaauucccuggacuuacccaagaccccgagaacccgggcaagcugaaagccccucucggccugcuggauuggaagacagugaaucagaagaugcccuggaacauuguccuucuccugggaggaggcuaugcgcuggccaaagggucugaacgguccggacucagcgaguggcugggcaauaaacuuacgccucugcagucugugcccgcuccugccaucgcuauuauccucucccugcugguugccaccuuuacagaauguaccagcaacguggcgacaaccacgauuuuccuucccauccucgccuccauggcucaggccauuugccugcauccgcuguacgucaugcucccuuguacacuggcuaccucucuugccuuuaugcugcccguggccacacccccuaaugcuaucguguucagcuuuggggaccucaagguucuggauauggcgcgcgccggcuuccugcuuaacaucauuggaguccucaucauugcucuggccaucaauuccuggggcauuccgcuguuuucucuccacagcuuccccuccugggcccaaagcaacaccaccgcucagugccugccuucucuugccaauacaacgacccccuccccuuga

SEQ ID NO: 75629 - RNA, 1668 nt, Artificial Sequence
  derived and/or modified sequence opt5 from SLC13A3__Homo_sapiens__NP_001011554
auggccguguacuggugcaccgaggcucugccccucagcgucacagcccugcuuccuaucguucuguucccguuuaugggcauucuccccuccaacaagguguguccucaguauuuccuggacacgaauuuucuuuuccugucugggcucaucauggcgagcgcuauugaagaguggaaccugcacagacggaucgcccugaaaauucucaugcuggugggaguccaacccgcccgccuuauccugggcaugauggugaccacauccuuucucucuauguggcugagcaauaccgcuuccacagccaugaugcuuccuaucgcuaacgccauucugaagucucucuucgggcagaaagaaguuagaaaggaucccagccaggaguccgaagagaauaccgcggccgugcggcgcaacggacugcauacagucccuaccgagaugcaguuucuggcuagcacggaagccaaagaccacccgggcgagaccgaagugccccucgaucugccugcugacucuagaaaggaggaugaguaccggcgcaauaucuggaagggguuccuuauuuccauccccuauagcgccucuauuggaggcacagcgacccugacaggcaccgccccuaaccucauccugcuugggcaacugaaauccuuuuucccccagugcgacguugugaauuuuggaagcugguucauuuuugcuuucccgcucaugcugcuguuccuccuggccggcuggcuuuggaucucuuuucuguacgggggacucuccuucagaggcuggcggaagaacaaaagcgaaauccgcacgaaugcugaggauagagcccgggccgucauucgcgaagaguaucagaaccuggggccuaucaaguuugcugaacaggcgguguucauucuguuuuguauguucgccauccugcucuuuacaagagaccccaaauucauuccuggaugggcuucccuguuuaaucccggcuuccugucugaugccgugaccggcgucgccaucguuacaauccucuuuuucuuucccagccaacggccuucccugaaguggugguucgacuucaaggcuccgaacaccgagaccgagccccuucugacauggaaaaaggcccaggaaacggugccuuggaauauuauccuccugcuugggggaggcuuugcgauggcuaaagggugcgaggaaagcggacuuucuguguggauuggcgggcagcuccauccccuggagaacgucccucccgcccuggccgugcuccugaucaccguugugauugcuuucuuuacagaguucgccuccaacaccgcuacaaucaucauuuuucuuccgguccuggccgaacucgcgauccgccugagagugcacccucuguaccuuaugauucccggaaccguuggcuguagcuucgccuuuaugcucccugugucuacgcccccuaauagcaucgcuuucgccuccggccaucugcuggucaaggauauggugcggacagggcuccugaugaaccuuaugggaguccugcuccugucucuggcuaugaauaccugggcccagaccauuuuucaacuuggcacauuccccgacugggcggauauguauagcgugaacguuaccgcccucccgccuacacuggcuaaugacacguuuagaacccuguga

SEQ ID NO: 75630 - RNA, 1569 nt, Artificial Sequence
  derived and/or modified sequence opt5 from SLC13A5__Homo_sapiens__NP_001137310
auggccagcgcucuguccuacgugucuaaguucaagagcuuugucauccucuucguuacgccccugcuucugcucccucuggugauucuuaugccggccaaauuugugagaugcgcguaugucaucauucugauggcuaucuacugguguacagaggugauuccccucgccguuacgucccugaugccugugcuccuguucccccuguuucagauccuugacucucggcaagucugcgugcaguauaugaaagauaccaacaugcuguuccucggcgggcugaucguugccguggcugucgaacgcuggaaucuucacaagagaauugcccugcggacacuccugugggugggagcuaaaccugcccgccugaugcucggcuuuaugggggugaccgcgcugcuuagcauguggaucuccaacacagccaccacagcuaugaugguccccauuguugaggccauccugcagcagauggaagcuaccucugccgcgacggaggccggacucgaacugguggacaagggcaaggcuaaagagcuuccugggagccaagugauuuucgagggaccgacccugggccagcaggaagaucaggagagaaagcggcucuguaaagccaugacacugugcaucuguuacgcugccuccauuggcgggaccgccacacugaccggaacgggccccaaugucgugcuccuggggcaaaugaacgaacuuuuuccugacagcaaggaucugguuaauuucgcuucuugguuugcguucgccuuucccaacaugcucgugaugcugcuuuucgcuuggcuguggcuccaguucgucuauaugcgcuuuaauuucaaaaaguccuggggaugcggccuggagagcaagaaaaacgagaaggccgcccugaaagugcuccaggaagaguacagaaagcuggggccucuuucuuuugcugaaaucaauguucugaucuguuucuuucuccuggugauucugugguucucccgggaccccggauuuaugccgggcuggcuuacagucgccuggguggagggcgaaaccaaauaugucagcgaugcgacaguggcuaucuucguugccacccuccuguuuauugugccuucucagaagcccaaauucaacuuucgcucccaaaccgaggaggaaagaaagacaccuuucuacccuccgccccugcucgacuggaaggucacgcaggagaaagugcccugggggaucguucugcuucugggaggcggguuugcccucgcuaagggaagcgaagccuccggccugucuguguggauggggaaacagauggagccccugcaugcugucccucccgccgcgauuacccuuauccucagccugcugguggccguguucacagaaugcaccuccaauguugcuacaaccacccucuuccugccuaucuuugccagcauggucaagacaggagugauuaugaacaucauuggcguguucugugucuuucuugcugugaauaccuggggccgggccaucuucgaucuggaccacuuucccgauugggcgaacguuacccauauugagacauga

SEQ ID NO: 75631 - RNA, 1338 nt, Artificial Sequence
  derived and/or modified sequence opt5 from SLC14A1__Homo_sapiens__NP_001122060
augaacggcagaagccugaucgggggagccggcgacgcucggcacgggcccguguggaaggauccuuucggaaccaaagccggcgacgcggcucgcagagggauugcccggcucucccuggcccuugcugauggaucucaggagcaagaaccggaggaagagaucgccauggaagacagccccacaaugguccgcguugauuccccuacgauggugagaggcgagaaucaggugucucccugccagggccggcgcuguuuuccuaaggcucugggguacgucaccggagacaugaaagagcucgccaaccagcugaaggauaaacccgugguucuucaauucauugacuggauccugagaggcauuagccagguggucuuugugaauaacccuguuuccgggauccucauccuggugggacugcucguccagaauccguggugggcgcugacaggcuggcuugggaccguggugucuacacugauggcccuccugcuuagccaggaucggucccugauugcuagcggacucuauggcuacaacgccacccuggucggcguucugauggcuguguucucugacaagggggauuauuuuugguggcuccugcuucccgugugcgccauguccaugacauguccuaucuucagcucugcgcucaauuccaugcugagcaagugggaccugcccgucuuuacccuuccuuucaacauggcccugucuauguaccucuccgcuacgggacauuauaaucccuuuuucccggccaaacuggugauuccuaucaccacagcucccaacauuagcugguccgaucugucugcccucgaacugcuuaagagcaucccuguuggcguggggcaaauuuacggaugcgacaaucccuggaccggcgggaucuuucugggagccauccuccuguccagcccccuuaugugucugcacgcugcgauuggcucucuccugggcaucgccgcugggcugucccucagcgccccuuucgaggacauuuauuuuggacuguggggcuucaacucuagccuugccugcaucgcuaugggagggauguucauggcccugacauggcagacccaucuccuggcgcugggcugugcucuuuuuacggccuaccucggggucggcauggccaauuucauggcugaagugggacugccggccugcacauggcccuuuugucuggcuacccuccuguuccuuauuaugacaaccaaaaacuccaauaucuacaagaugccucugucuaaaguuaccuaucccgaggagaaccgcaucuuuuaccuccaggccaagaagagaaugguggaaagcccucuguga

SEQ ID NO: 75632 - RNA, 2763 nt, Artificial Sequence
  derived and/or modified sequence opt5 from SLC14A2__Homo_sapiens__XP_011524518
augagcgacccccacuccucuccucugcucccggagccccugagcuccagauacaagcuguaugaagccgaguucaccucuccuagcuggcccuccacaucuccugauacgcaucccgcucugccucuccuggaaaugccggaggaaaaagaccuucggagcuccaacgaggauagccacaucgugaagauugagaaacugaaugaacgcucuaagagaaaagacgauggcgucgcccaucgggacuccgcggggcagcgcugcaucugucucagcaaggcuguuggauaccugaccggcgauaugaaggaguauagaauuuggcugaaagacaagcaccucgcccugcaauuuaucgauugggugcuucgggggacagcccaggugauguucauuaacaauccccugucuggacucaucaucuuuauuggccugcuuauccagaacccuugguggaccauuacagggggacugggcaccgucguguccacacucaccgcucuggcccugggccaggaccgcagcgcuaucgccucugggcuccauggauacaauggcaugcugguugggcuucugauggcgguguucuccgaaaaacucgauuauuacugguggcugcuuuuucccgucacguucaccgccaugagcugcccugugcuguccucugcucucaacagcaucuuuuccaagugggaccugcccguuuucacacugccguuuaauauugccgugacccucuaucuggcugccacaggacacuacaaccuuuucuuuccuaccacgcuggucgagcccgugagcucugugccuaauauuacauggaccgagauggaaaugccccuccugcuucaagcgauccccgucggcguuggacagguguacgggugugauaacccuuggacaggcggcguguuccuggucgcccucuuuaucuccagcccgcugauuugccugcacgcugccaucgggucuauugugggacuccuggcugcccuuagcguugccacccccuucgagaccaucuauacaggccugugguccuacaauugugugcucucuugcauugcuaucgggggaauguucuaugcgcugacguggcagacccaucugcuugcccucaucugugcucuguuuugcgccuacauggaagccgcuauuagcaacaucauguccgucgugggcguuccucccgggacaugggccuucugucuggcgaccauuaucuuucuccugcuuacaaccaauaacccugcuauuuucagacugccccucagcaaagugacguauccggaggccaaucggaucuacuaucugacagucaagucuggagaagaggagaaggccccuuccggcggcgggggagaacaucccccuaccgcuggccccaaaguggaggaagggagcgaggccguccugucuaagcaccgcuccguguuucacaucgaauggagcuccauuagacggcgcucuaaaguuuucggaaagggcgagcaccaggagagacaaaacaaagacccuuuucccuaccgguaccgcaagccgaccguggaacuucucgaccuggauacaauggaggaaagcuccgagaucaaagucgaaaccaacauuucuaagacaagcuggaucagauccagcauggcugccucugggaagcggguguccaaagcgcugagcuauauuacgggcgagaugaaggagugcggagaaggccucaaagacaagucuccuguuuuccaguuuuucgauugggugcugagagggaccucccaggucauguuugugaauaacccccuuagcggaauccugauuauccucggccuguucauccagaaucccuggugggccauuucugggugucugggaacaaucaugagcacccuuacagcucucauucugucccaagacaaaagcgccaucgcugccggcuuucauggguacaacggcgugcugguuggacuccugauggcggucuucucugauaagggcgacuauuacugguggcuucugcucccugugauuaucauguccaugagcugcccgauccuguccucugcccuggggaccauuuucagcaagugggaucuucccguguuuacgcucccuuucaauaucaccgucacacuguaucuggcugccaccggacacuacaaccucuuuuuccccacaacccugcuucagccugcuuccgccaugcccaauauuacguggucugaggugcagguuccucugcuccugcgcgccauccccgugggcauugggcaagucuauggaugcgacaacccguggacaggcgggaucuuucugaucgcucuuuucauuagcuccccucugaucugucuccaugcggccauuggcucuaccaugggaaugcuggcugcccucacaaucgccacccccuuugauagcauuuacuucggccugugcggguuuaauuccacccuugcuuguaucgccaucggaggcauguucuacgugauuacauggcagacgcaccuucucgcgaucgcuugcgcccuguuugccgcuuaucugggggccgcgcuugcuaacaugcugagcguuuucggacucccucccuguaccuggccguuuugccugucugcccucacauuccugcuucugaccacaaauaacccugccauuuacaaacucccccuguccaaggugaccuauccugaagcuaaucggaucuacuaucugagccaggagagaaaccgccgggccucuauuaucacgaaauaccaggcuuaugacgucuccuga

SEQ ID NO: 75633 - RNA, 2127 nt, Artificial Sequence
  derived and/or modified sequence opt5 from SLC15A1__Homo_sapiens__NP_005064
augggcaugagcaagucccacucuuucuuuggguacccccugagcaucuucuuuauuguggucaacgaguucugcgaaagauuuuccuauuacggaaugcgggccauccucauucuguauuucaccaauuuuaucucuugggacgauaaccuuagcacagcuauuuaccauacguucguugcccuguguuaucucaccccuauccugggcgcgcuuaucgcugacuccuggcuggggaaauuuaagacaauugugucucucagcaucguguacaccauuggacaggccgucacauccgugagcucuaucaaugaucugaccgaccacaaccaugauggcacaccggacucccugcccguucacgugguccucagccugauugggcuugcccugaucgcucucggaaccggcggcauuaaaccuugcgugucugccuucgggggagaucaauuugaggaaggccaggagaagcagcgcaauagauucuuuuccaucuucuaucuggcuaucaacgccgggagccuucugucuacgauuaucacccccaugcuccggguucagcaauguggcauucauuccaaacaggcgugcuacccucuggccuucggagugcccgcugcccugauggcugucgcccucaucguguuugugcuggggagcggaauguacaagaaguucaaaccucagggcaauauuaugggcaaggucgcgaaauguaucggguuugccaucaagaaccgcuucagacaccgguccaaggcuuuuccgaaacgcgaacacuggcuugacugggccaaggagaaauaugaugagagacugauuucucagaucaagaugguuacacgggugauguuccucuacauuccccugccuauguuuugggcucuuuucgaccaacagggaagccgcuggacccugcaggccacaaccauguccggcaaaaucggggcccucgaaauucagcccgaucaaaugcagacggugaaugcuauccugaucgucauuauggugccuaucuuugacgcgguucuguauccccucauugccaagugcggauucaacuuuacaagccugaaaaagauggcugugggcaugguccuugccucuauggccuucgugguugcugccaucgugcaggucgagauugauaaaacccugccgguguuuccuaaggggaaugaaguccaaaucaaggugcucaacauuggaaauaacacaaugaauaucucccugcccggcgagaugguuacccuuggcccuaugagccagaccaacgcguucaugacauucgacgugaacaaacugacgagaaucaauauuucuagccccgggucccccgucaccgcugugacagacgauuuuaagcagggacagcggcauacccuccugguuugggccccuaaccacuaccaaguggucaaagacggccugaaucagaagccggagaaaggggaaaacggaauccgcuucgugaauacauuuaacgagcucauuaccaucacgaugucuggcaagguguaugccaauauuagcuccuacaacgcuagcacauaucaguucuuucccucugggaucaagggcuucaccaucuccagcaccgaaauuccuccccagugucaaccuaauuuuaacacauucuaccuggaguuuggaucugccuacaccuauaucguucagcggaaaaaugauuccugccccgaagucaagguguucgaggacauuagcgcuaacacagugaauauggcccuucagaucccgcaguacuuucugcucacguguggcgaggucguguucuccguuaccgggcuggaauuuucuuauagccaagcgccuuccaacaugaaaucugugcugcaggccggauggcuucucacagucgcugugggcaauauuaucguucugaucguggccggggcuggacaguucagcaagcagugggccgaguacauucuguucgcggcccuccugcuugucgugugcguuaucuuugcuauuauggccagauucuauaccuacaucaaccccgcugaaauugaggcccaauuugaugaagacgagaaaaagaaccgccuggagaaguccaauccuuauuucaugagcggcgccaacucucagaaacagauguga

SEQ ID NO: 75634 - RNA, 2097 nt, Artificial Sequence
  derived and/or modified sequence opt5 from SLC15A2__Homo_sapiens__NP_001139470
augaaccccuuccagaagaaugagagcaaagaaacccuguuuuccccugugucuaucgaggaagucccgcccagaccucccagcccucccaagaaaccuuccccgacaauuugcggcucuaacuacccccucagcaucgccuucauuguugugaaugaguuuugugaacgguucuccuauuacgggaugaaggcugugcugauccuuuauuuucuguacuuccuccacuggaacgaggacacgucuaccagcauuuaucaugccuuuuccagccugugcuacuucacaccuauccuuggagcggcuaucgccgauucuuggcugggcaaauuuaagguccucucccugauugggcugagccucaucgcccugggaaccggcgggauuaagcccuguguggcugccuucggaggcgaccaauuugaggaaaaacacgcugaggaacgcacaagauauuucucuguguuuuaccuuuccaucaaugccggcagccugauuucuaccuucaucacaccuaugcuccgcggggauguucagugcuucggagaggacuguuacgcgcuggccuuuggcguccccgggcuucugauggugauugcucucguuguguucgccaugggauccaagaucuauaacaaaccgccucccgagggcaauaucgucgcucagguguuuaagugcauuugguucgccaucagcaaccgguuuaaaaauagauccggggauauuccuaagcggcagcauuggcuggacugggcggccgaaaaguaccccaaacaacugaucauggaugugaaggcucucacccgcguccuguuccuuuauauuccccugccuauguuuugggcccuccuggaccagcagggaucuagauggacgcuucaggcuauccggaugaaccgcaaucugggcuucuuuguucuccaaccggaucagaugcaagugcugaacccccugcucgugcugaucuucauuccucuuuuugacuucgucaucuacagacuggugagcaaauguggcauuaauuuuuccagccuccggaagauggccguugggaugauccuggccugccuugcuuucgcgguggccgcugccgucgagauuaaaaucaacgaaauggcccccgcucagccuggaccccaagagguguuccugcagguucucaaucuggccgaugacgaagugaaggucaccguggucggcaacgagaacaauucucugcucaucgaguccauuaagagcuuucagaagacaccgcacuauucuaagcugcaucuuaaaaccaagagccaagauuuccacuuucaccugaaauaccauaaccucucccuguauacagaacacucugugcaggagaagaauugguacagccugguuauccgcgaagacgggaacuccauuagcucuaugauggugaaagacaccgaguccagaacgacaaauggaaugaccacaguccgguucgugaacacccuucauaaggauguuaauaucagccucucuaccgacacaucccugaacgugggcgaagauuacggggucagcgcguaucgcacggugcagagaggagaguacccugcugugcacugucggaccgaggacaagaauuuuucccugaaccucggccugcuugauuucggcgccgccuaucuguuuguuauuacaaauaacaccaaucaggggcuccaggcuuggaaaaucgaagacauucccgccaacaagaugucuaucgcuuggcagcugccucaguacgcccuggucacagcgggagaggugauguucagcgugaccggccuugaauuuuccuauucucaggcccccagcuccaugaaaagcguccuccaagcugccuggcugcugacgaucgcuguggggaauauuaucguucucguggucgcccaguucucuggacuggugcagugggcggaguuuauucuuuucuccugccugcuccugguuaucugucugauuuuuagcaucaugggcuacuauuacgugccugucaagacagaagauaugagagggcccgccgacaaacacaucccgcauauucagggcaacaugaucaaacuugagaccaagaaaaccaagcucuga

SEQ ID NO: 75635 - RNA, 1734 nt, Artificial Sequence
  derived and/or modified sequence opt5 from SLC15A4__Homo_sapiens__NP_663623
auggagggcagcgggggaggcgccggggaaagagcuccccugcucggagcccggcgcgcggcugccgccgcugccgcugccggcgcguucgccgggagacgggcugccugcggagcugugcugcuuaccgagcugcucgaacgcgccgcguuuuacggcaucacauccaaccugguccuuuuccugaauggcgccccuuuuuguugggagggggcucaggccucugaagcucuccugcuguucaugggacucacguaucugggcagcccguuugggggauggcuugccgacgccagacugggccgggcucgcgcgauucuccugucccuugcccuguaccuccuggggaugcuggcuuucccccuccuggccgccccugcuaccagagccgcgcuuugcggaucugcucggcugcucaacuguacagcccccggcccugaugccgcugcccgcugcuguagccccgcuaccuuugccggccugguucuuguggggcugggaguggcgacagucaaggccaauaucaccccuuucggcgcugaccaagugaaagauagagggccggaggccacacggcgcuuuuucaacugguuuuauugguccauuaaucucggagcuauccugucucugggcgggauugccuacauccagcagaacguuagcuucgugaccggauaugcgauccccacggucugcgugggccucgccuuuguuguguuccuguguggccaguccgucuucauuaccaagccucccgacgggagcgcuuuuacagauauguucaaaauccuuaccuacucuugcuguucccaaaagagaagcggagagcggcagucuaauggcgaagggauuggaguguuucagcaguccagcaaacaaucucuguucgacuccugcaagaugagccacggcgggccuuuuacagaggaaaagguggaggaugucaaagcccucguuaagaucgugcccguguuccuggcucuuauuccguauuggaccgucuacuuucagaugcagacgacauacgugcugcagucccuccaucugcgcaucccugagauuucuaacaucaccacaacaccccacacccugccugccgccuggcucaccauguucgacgcuguucugauccuucugcucauuccccugaaagauaagcugguggaccccauccuuagacggcauggccuccugccuagcucccugaaaagaauugcggucggaauguuuuucgugauguguagcgccuuugcugccggcauccucgaaucuaagcgccugaaucuuguuaaggagaaaacgauuaaccaaaccaucgggaauguggucuaucacgccgcugaucugucccucugguggcaagugccgcaguaccugcugaucggaauuagcgaaaucuucgccucuauugcgggccuugaguuugcuuauagcgccgcccccaaguccaugcagucugcuaucaugggacucuucuucuuuuucagcggggucggcuccuuuguggggagcggccugcuggcccucguuucuauuaaagcgaucggauggauguccagccauacagacuucggcaacaucaaugggugcuaccugaacuauuacuuuuuccuucuggcugccauucagggagccacccuccugcuguuucuuaucauuucugugaaguaugaucaccaccgggaccaucagagaucccgcgcuaauggcgucccuacaagccggagagccuga

SEQ ID NO: 75636 - RNA, 1548 nt, Artificial Sequence
  derived and/or modified sequence opt5 from SLC16A10__Homo_sapiens__NP_061063
auggugcugagccaggaggaacccgacuccgccagaggcaccucugaggcucaaccucucgggccggcccccacaggagcggcuccucccccuggccccgggccuagcgauuccccggaagccgccgucgagaagguugaaguggagcuggcuggacccgccacggcugagccucacgaacccccugagcccccggaaggcggguggggauggcuugugaugcuggccgcgauguggugcaacggcucugucuucggcauccagaaugccuguggggugcucuuuguuagcaugcuggagaccuucggauccaaagacgaugacaagaugguguuuaaaacagcuugggucggcucucuuagcauggggaugauuuucuuuugcuguccuaucguguccguuuucaccgaucuguuuggaugccggaagacagccguggucggcgcugccgugggguucgugggacucaugucuucuuccuuugucagcucuauugagccccuguaccugaccuauggcaucauuuucgcguguggcugcuccuuugccuaccagccuagccucguuauccuggggcauuauuucaaaaagcgccuuggacuggugaacggcaucgugacagcugggucuuccgucuuuaccauucuccugccccuucugcucagagugcugaucgacagcguuggacuguucuacacgcuccgggugcuguguauuuucauguuuguccuuuuccuggccggcuuuaccuaucgcccccucgcuacauccaccaaggauaaagaaucugggggaagcggcuccagccuguucucuagaaagaaauuuuccccuccgaagaaaaucuucaauuuugccauuuucaaggugacagccuacgcuguuugggcggugggcaucccccuugcccuguuuggguauuucgucccuuacgugcaccucaugaagcaugucaacgagcgguuucaggacgagaaaaauaaggaagugguucugaugugcauuggagugaccagcggcgucgggcgccuccuguucggaagaaucgcugauuacgugcccggcguuaaaaagguguaucugcaaguccuuagcuuuuucuucaucgggcugaugagcaugaugauuccucucuguuccaucuuuggcgcccugauugccgugugccuuaucaugggacuguucgacggcuguuuuauuucuaucauggcucccaucgccuucgaacucgugggggcgcaggauguuagccaggcuauuggauuucugcugggcuucauguccaucccgaugacggucgggccucccauugccggacuccugcgggacaaacuuggcagcuacgauguggccuuuuaucuggcuggggugccuccccucaucggcggagccguccugugcuucauuccuuggauccacucuaagaaacagcgcgagaucuccaagacaaccggcaaggagaaaauggaaaagaugcuggagaaccaaaauagccuucucucuuccagcuccgggauguuuaaaaaggaaucugacagcauuaucuga

SEQ ID NO: 75637 - RNA, 1416 nt, Artificial Sequence
  derived and/or modified sequence opt5 from SLC16A11__Homo_sapiens__NP_699188
augcccgccccucagagaaagcaccggcgcggcggguucagccauagaugcuuuccgacaccccaaaccgcuaugacgccucagcccgccggaccucccgacggcggguggggauggguggucgcggcugccgccuucgcuaucaacggccuguccuacgggcuccugcggucucuuggacuggccuuuccugaucucgcugagcacuucgaccgcagcgcccaggauaccgcguggauuuccgcccuggcucuugccguucagcaagcugccucuccggugggcagcgcgcuguccacaagauggggcgcccggcccguggucaugguugggggagugcucgcuucucugggcuuuguguucagcgccuuugcuuccgaccugcuccaucuguaucuugggcugggacuccuggccggcuucgggugggcccuugucuuugcuccugcgcugggaacccucagccgcuacuucucuagacggcgcgugcuggccguuggccuggcucucacaggcaauggggccuccagccugcuucuggcccccgcucuccagcugcuucuggauaccuuuggauggagaggcgcccuccugcugcucggggcgaucacacugcaccuuaccccuuguggagcucugcuccugccccuugugcugccgggcgacccucccgccccuccccggucuccccucgccgcucuggggcugucccucuucacgcgcagagccuuuagcauuuucgcucugggaaccgcccuugucggcggcggguauuucgugccuuacgugcaucuggcgccgcacgcccucgaucggggacugggcggguauggagcugcccuggucguugcuguggccgcgaugggcgacgccggggcucgccuugugugcggcuggcucgccgaucagggaugggucccccugccuagacugcucgcuguguuuggcgcccugacagggcuuggacuguggguugugggccucguccccgugguugggggagaagagucuuggggcgggccucugcuggccgcugcgguggccuacggccuuuccgcuggaagcuaugcuccccucgucuucggcgugcugccggggcuggucggagugggcgggguugugcaggccaccggacucgucaugaugcugaugucccuuggcgggcugcucggcccuccccugucuggauuucugcgggacgaaacaggcgauuucaccgccagcuuucuucucuccgggagccugauccugucuggauccuucauuuacaucggccucccuagagcccugcccagcugugggccugcgucucccccggcuacgccuccucccgagacaggagaacuucugcccgccccgcaagccgugcuccugagccccggcgggccuggcuccacccuggacacaaccugcuga

SEQ ID NO: 75638 - RNA, 1551 nt, Artificial Sequence
  derived and/or modified sequence opt5 from SLC16A12__Homo_sapiens__NP_998771
augcccagcggcucccacuggaccgccaacucuagcaagaucauuacauggcugcucgagcagccugggaaagaagagaagagaaaaacgauggcuaaggugaaucgggcccgcuccaccucuccgcccgacggaggcuggggguggaugaucgucgcgggaugcuuccugguuacaauuuguaccagagcugugacacggugcaucagcaucuuuuucguggaauuucaaaccuacuucacacaggauuaugcccagaccgccuggauucauuccaucgucgacugugugacgaugcuuugcgcuccucugggcucuguugugagcaaccaccucuccugucaggucgggauuaugcugggaggccuucuggccagcaccggccucauccugucuuccuuugcuacaagccugaaacaucucuaccugacccuuggggugcugacaggacucggcuucgcccugugcuauucucccgcgauugccaugguugggaaguacuuuucccgcagaaaggcucuugccuauggaaucgcuaugagcggcucugggauuggaaccuucauccuggccccugugguccaacuccugauugagcaguuuuccuggcggggcgcgcugcucauccugggcggguucgugcuuaaucugugugugugcggagcccucaugcgccccaucacgcugaaagaagaucacacaaccccugagcagaaccaugucuguagaacacagaaggaggacauuaaacggguuagcccguacuccucucuuaccaaggaaugggcucaaaccugccuguguugcugccuccagcaggaguauagcuuucugcugauguccgauuucguggugcucgccgucagcgugcuguuuauggcuuacggcuguucuccccuuuucguuuaccuggugccuuaugcccucuccgucggggugagccaccagcaagccgcuuuccugaugucuauccuuggaguuauugacaucauuggcaauaucacauuuggguggcugacggaucgcagaugccucaaaaacuaccaguauguguguuaccuguucgcggucggaauggacggccugugcuaucucugucugcccaugcuucagagccugccucuccuggugcccuuuuccugcaccuucggcuacuuugauggggccuaugucacacugaucccggugguuaccacagaaauugugggaaccacgucucuuagcuccgcucucggcgucguguacuuccugcacgccguuccuuaccuggugucucccccuaucgccgggcggcucgucgacacaaccggaagcuauaccgcugccuuucugcuuuguggcuucuccaugauuuuuagcucugugcugcucggguucgcgcgccugaucaagagaaugcggaagacacaacugcaguuuauugcuaaagaguccgaucccaaacuucagcucuggaccaauggcagcguggccuacuccguugcccgcgagcuggaccagaagcauggagaacccgucgcuacagccgugccuggcuauucucugacguga

SEQ ID NO: 75639 - RNA, 1281 nt, Artificial Sequence
  derived and/or modified sequence opt5 from SLC16A13__Homo_sapiens__NP_963860
auggccagacggaccgagcccccugacggcggguggggauggguggucguucugagcgcuuucuuucaguccgcccucguguucggcgugcugcgcucuuuuggggucuucuuuguggaguucguugcggcuuuugaagaacaagccgccagagugagcuggaucgcuuccauuggaaucgccguccagcaguucggcucuccgguggggagcgcucuuuccacaaaguuuggaccccggccuguugugaugacgggcggcauucuggccgcgcucgggaugcugcuugccucuuucgcuaccagccugacacaccucuaccuguccaucggacugcucagcggcucugggugggcccugaccuuugcucccacacuugccugccuguccuguuauuucagccgcagacggucucucgcgaccggacuggcccuuacaggcgucgggcuguccagcuuuaccuucgcuccuuucuuucaguggcuccugucucacuacgccuggcgcggaucccugcuccuggugagcgcucuuucccugcaccucguggccugcggcgcccugcuuagacccccuucucuggcugaggauccggcggucggcgggccccgggcccaacucacgagccugcugcaucacggaccuuuccuccgcuauaccguugcucugacacuuauuaacaccggcuacuuuauccccuaucugcaucucguggcccaucugcaggaccuugauugggacccucugcccgccgcuuuccuccuguccguggucgccaucagcgaucugguggggagaguugugucuggauggcucggcgacgcggucccggggccugugacacggcugcuuaugcuguggaccacgcucacaggaguuucccuggcucuguuucccguggcccaggccccuaccgcucuugucgcccucgcuguggccuacggcuucacaagcggcgcgcuggcuccccuggccuuuucuguccuccccgaacugauugggacccgcagaaucuauuguggacuuggccugcuccagaugauugagagcaucgggggacugcugggcccuccgcuuuccggguaccuccgggaugugaccggcaauuacacagccucuuucguuguggcuggagccuuucugcugagcggcuccgggauucuccugacgcuuccccacuucuuuugcuucagcaccacaaccucuggaccucaagaccuggucacagaggcgcucgauaccaaagugccccugccuaaggaaggccuggaggaagacuga

SEQ ID NO: 75640 - RNA, 1503 nt, Artificial Sequence
  derived and/or modified sequence opt5 from SLC16A1__Homo_sapiens__XP_011540329
augcccccugccgugggcgggccggucggauacacacccccugacggcggguggggaugggcuguugugaucggcgccuucauuagcaucggguuuuccuaugcguuccccaagucuauuaccguguuuuucaaagagaucgaaggaauuuuucacgcuacgaccagcgaggucuccuggaucucuagcaucaugcuggccgugauguacggcggcgggccuauuuccucuauccucguuaacaaguauggaagcagaauugugaugaucgucggcgggugccuguccggauguggccuuauugccgcuagcuucugcaauacagugcagcaacuguacguuuguaucggggugauuggaggccucggccuggccuuuaaccuuaaucccgcucugaccaugaucgggaaauauuucuacaagcggcgcccucucgccaacggacuggcgauggccggcucuccggucuuucugugcacacucgcuccccugaaucagguguucuuugggaucuucggauggagaggcuccuuucuuauucucgggggacugcugcuuaacuguugcguggccggcgcucugaugcggccuaucggccccaaaccuaccaaggccgggaaggauaaaagcaaggcgucucucgaaaaagccggaaaguccggcgucaaaaaggaccugcaugaugcuaauacagaccugauugggcgccaccccaagcaggagaaaagaagcguuuuccagaccaucaaccaauuccucgaucugacgcuuuuuacccaucggggauuccugcucuaucugucuggcaaugugauuauguuuuucgggcuuuuugccccgcugguguuccucuccagcuacggcaagucccagcacuacucuagcgaaaaauccgcuuuucugcugagcauccucgccuucgucgacaugguggcccgcccuucuaugggacugguugcuaacacaaagcccaucagaccucggauucaguacuuuuucgcggccuccguggucgcuaauggcgugugucauaugcuugcuccccugagcaccacauauguuggguuuugcguguaugccggauucuuuggcuucgccuucggguggcucucuagcguccuguuugagacccuuauggaucuggugggaccccagcgcuucuccucugccgucggccucgugacgaucguugaguguugcccugugcugcuggggccgccccuccugggcagacuuaacgacauguacggagauuauaaauacacauauugggcguguggcgucgugcugauuaucagcgggauuuaccucuuuaucggaaugggcaucaauuaccggcugcuggcuaaggaacaaaaagccaacgagcagaagaaggaauccaaagaggaggaaaccagcauugacguugccgggaagccuaaugaggugacaaaagcugccgaaucucccgaucagaaggacaccgauggaggcccuaaagaggaagagucccccgucuga

SEQ ID NO: 75641 - RNA, 1620 nt, Artificial Sequence
  derived and/or modified sequence opt5 from SLC16A2__Homo_sapiens__NP_006508
auggcccugcagagccaggcuuccgaggaagccaagggccccuggcaagaggcggaccaggaacagcaagagccuguggggucuccggaacccgagagcgagccugaacccgagccugaacccgagccugucccgguucccccucccgagccucagcccgaaccgcagccucuccccgauccugcuccccugcccgagcuugaguucgaguccgaaagagugcacgagccugagccgacccccacaguggaaacgcggggaaccgcccgcggcuuucagccucccgaagggggauucggcugggucgugguuuuugccgcuacauggugcaacgggucuaucuucggcauucauaauagcgugggaauccuguacuccaugcuccuggaagaggaaaaagagaagaacagacaagucgaguuucaggccgcuugggugggcgcccuugcgauggggaugauuuucuuuuguucuccuaucguuagcauuuucaccgaccggcugggaugccgcaucacagccaccgcuggcgccgcuguggccuuuaucgggcuccacacauccagcuucaccucuucccugagccugagauauuuuacguacggcauucucuucggaugugggugcucuuuugcguuccagcccucccuggucauccuuggacauuauuuccagcggcgccugggccucgccaauggcguggugagcgcugggucuuccauuuuuagcauguccuucccguuucugaucagaaugcuuggagauaaaauuaagcuggcccaaaccuuccagguccucucuacauuuauguucguucugaugcugcucagccugaccuaccggccucuucugcccuccagccaggacacaccuucuaaacgcggcgugagaacccuccaccaacgguuucuggcucagcuucgcaaguauuucaacaugagaguguuucggcagcgcacguacagaaucugggccuucgggauugccgcugcggcccugggauauuuuguccccuacgugcaucucaugaaguacguugaagaggaguucuccgaaaucaaagaaacaugggugcugcuggucuguaucggcgcuaccagcgggcucggacggcuggugucuggccacauuagcgauuccaucccuggccuuaagaaaauuuaucugcagguucucucuuuucugcuucuggggcucaugagcaugaugaucccccugugcagagacuucggaggccugauuguggucugucucuuccuggggcuuugcgauggauuuuucaucacaaucauggccccgauugccuuugagcuggugggcccuaugcaggcuucccaagccaucggguaccuccugggcaugauggcgcugcccaugauugcuggacccccuaucgccggccuucuccgcaauuguuucggggacuaucacgucgccuuuuacuucgcuggagugccgcccauuaucggcgccguuauccuguuuuucgugccucugaugcaucagcggauguuuaagaaagagcagagagauagcucuaaggacaagaugcucgcucccgauccugaccccaacggggaacugcuuccuggaucccccaauccggaggaaccuauuuga

SEQ ID NO: 75642 - RNA, 1398 nt, Artificial Sequence
  derived and/or modified sequence opt5 from SLC16A3__Homo_sapiens__XP_011521909
augggcggggccguggucgacgagggacccaccggcguuaaggcuccugaugggggauggggcugggccgugcuguucgggugcuuugugaucacaggauucagcuacgcguuuccgaaagcugucuccguguucuuuaaggaacucauucaggaguucggcaucggcuauucugacacggccuggauuagcuccauccugcuugccaugcuguacgggaccggaccccucuguucuguuugcgugaacagauuuggcugucggccugucaugcugguugggggacuuuucgcuagccugggcaugguugccgcuuccuuuugccgcucuauuauccaaguguaucucacaaccggggucaucacaggacugggccuggcccucaauuuccagcccagccugauuaugcuuaacagauacuuuuccaaacggcgcccuauggcgaauggccuggccgcugccgggagccccguguuccucugugcucugucuccucuuggacagcugcuccaggauagauauggcuggcgcgggggauuucugauccugggcgggcuccugcuuaacugcugugugugcgccgcgcugaugcggccgcucgucguuaccgcccaacccggauccggcccucccagaccuagccggcgccugcuugaccugucuguguucagagaucggggcuucgugcucuacgcugucgccgcuuccgugaugguucuggggcuguuugugcccccggucuucgugguuagcuaugccaaggaccucggagugccugauacaaaagccgcuuuucugcuuaccauucugggcuucaucgacauuuuugcgcgccccgccgcuggguucgucgccggacucggcaaggugagaccuuacucugucuaccuguuuuccuucagcauguuuuucaaugggcuugccgaucuggcuggcuccacggccggagacuauggcgggcucgugguguuuuguaucuucuuuggaauuucuuacggcauggugggggcgcugcaguucgaaguccugauggcuaucgugggaacccacaaguucagcuccgccaucggccucguucugcuuauggaggccguggcuguccugguggggccucccagcggcggaaaacuccuggaugccacacauguguauauguacguuuuuauucuggcuggcgccgaaguccuuaccucuucccucauccugcugcucgggaacuucuuuugcauucggaagaaacccaaggagccgcagcccgagguggcggccgcugaagaggaaaaacugcacaagccucccgccgacagcggaguggaucuucgcgaggucgagcauuuccugaaggcugaaccugagaaaaauggcgaagugguucacacacccgagaccucuguguga

SEQ ID NO: 75643 - RNA, 1572 nt, Artificial Sequence
  derived and/or modified sequence opt5 from SLC16A6__Homo_sapiens__NP_004685
augacccagaacaagcugaaacucugcagcaaggccaauguguacacagagguccccgacggcggguggggaugggcuguugccguguccuucuuuuucguggaagucuuuacguauggcaucauuaaaaccuucgggguguuuuucaacgaucugauggacucuuuuaaugagagcaacuccagaaucucuuggauuaucagcauuuguguuuucgugcuuacauuuuccgcgccucuggcuaccguccucucuaaucgguucggacaccgccuggugguuaugcuuggcgggcugcucgugagcacaggaauggucgccgccuccuuuagccaagaagugucucauauguacguggcuaucggcaucauuuccggccugggguauugcuucagcuuucugccgaccgucacaauccucucucaguacuucggaaagagacgguccauuguuaccgccguggcuagcacgggcgaguguuucgccguguuugcguucgcccccgcuaucauggcccugaaagaacgcauuggguggagauauucucuucuguuugucggacuccugcagcuuaacaucgugauuuucggcgcucugcuccggccuaucuuuauccgcgggcccgccuccccuaagauuguuauccaggagaauagaaaggaggcgcaauacaugcuggaaaacgagaaaacccggacaagcauugauuccaucgacucuggaguggaacugaccacaagccccaagaaugucccuacccacacgaaccucgagcuggagccgaaagccgauaugcaacaggugcuuguuaagacaagcccccgcccuuccgagaaaaaggcuccccugcucgacuucucuauucugaaggaaaaauccuuuaucugcuaugcccuuuucggccuguuugcuacccucggcuucuuugccccuagccuguacaucauuccccuggggaucucucucggaauugaucaggacagagccgcuuuccugcuuagcacaauggcgaucgccgaaguguuuggccggauuggggcuggauucguccugaaucgcgagccgaucagaaagaucuacauugaacucaucugugugauucugcuuaccgucucccuguucgccuuuaccuucgccacagaguuuuggggccucaugucuugcagcaucuucuuuggguucauggugggaacgauuggcggcacccauaucccucugcuggcugaggaugacguuguggggauugagaaaauguccagcgccgcgggagucuauaucuuuauccagucuauugcuggccucgccgggcccccucuggccggacuucugguggaucaguccaagaucuacagccgggcuuucuauucuugugccgcuggcauggcccucgcggccguuugccuggcucuggugcgccccuguaaaauggggcuuugccagcaccaucacuccggcgaaacaaaggucgugagccacagaggaaaaacccuccaggacauucccgaagauuuucuggagauggaccuggccaagaacgaacaucgggugcacguucaaauggagccugucuga

SEQ ID NO: 75644 - RNA, 1437 nt, Artificial Sequence
  derived and/or modified sequence opt5 from SLC16A7__Homo_sapiens__XP_005269288
augcccccuaugccgagcgcucccccugugcaucccccucccgacggcggguggggauggaucgucguuggcgccgccuucauuuccaucggguuuucuuacgcguucccuaaggcugugaccguguuuuucaaagagauucagcaaaucuuucacacaacguauagcgaaauugccuggaucuccucuaucaugcuggccgucauguacgcuggaggcccggugagcuccguucucgugaacaaguaugggucuagacccgucgugauugccggaggccugcuuugcugucugggcaugguucucgcuagcuucuccagcucugugguccagcuguaccuuaccaugggguuuaucacaggacugggccucgccuucaaucugcagccugcgcugaccauuaucgggaaauauuuuuaccggaagcgccccauggccaacggacucgcuauggccggcuccccuguguuccugagcucucuugcucccuuuaaucaguaucuguucaacacauuuggguggaaaggauccuuccucauucugggcagccuucugcucaaugccugcguggcgggcucucugaugagaccgcuggggccuaaccaaaccacauccaagagcaagaauaaaaccggaaagacggaggaugacuccucucccaaaaagaucaaaaccaaaaagagcacaugggaaaaagucaacaaguaccucgauuucucccuguuuaaacaccggggcuuccuuauuuaccugagcgggaauguuaucauguuucucggauucuuugccccuaucauuuuccuggcucccuaugccaaggaccagggcaucgaugaguacucugcugccuuucuucuguccgugauggccuucguggacauguuugcucgccccagcgucgggcucauugcgaacucuaaauauaucagaccucggauucaguacuucuuuagcuucgccaucauguuuaauggagugugucaucugcugugcccgcucgcucaggauuauaccucccugguucuuuacgccguguucuucggccugggcuuugggucugucagcuccguucucuucgaaacacugauggaccuugugggagcuccccgcuuuagcucugccgugggccuggucaccaucguggagugugggccuguccuccugggacccccucuggccggcaagcucguggaucugacgggggaguauaaauacauguacauguccugcggcgcgauuguuguggcugccagcgucuggcuucugaucggaaacgccauuaauuauagacuccuggcuaaggaacggaaggaggaaaacgcccgccaaaagacaagagagucugagccccuguccaagagcaaacacuccgaagacgugaauguuaaggugucuaacgcucagagcgucaccuccgagcgggaaacaaacaucuga

SEQ ID NO: 75645 - RNA, 1515 nt, Artificial Sequence
  derived and/or modified sequence opt5 from SLC16A8__Homo_sapiens__NP_037488
augggcgccgggggacccagacggggcgaggggccuccggacggaggcugggggugggugguccugggagcuugcuucguugugaccggcuuugccuacggcuuccccaaggcggugagcgucuuuuuccgcgcucucaugagagauuuugacgccggguauuccgauacagccugggugucuagcaucaugcuggcuaugcuuuacggaacgggcccuguuuccucuauucuggugacccgguucgggugucgccccgucaugcucgccggaggccugcuugcuagcgccgggaugauccuggcguccuuugccacaagacuccuggaacuguaucucaccgcuggagugcugacaggccuuggccuggcccucaacuuccagccuucucugauuaugcuugggcuguacuuugagcggcgcagaccccucgcuaauggacuggccgcggccggcagcccuguuuuccuguccgcucucagcccgcuggggcaacagcuucuggaacgguuuggauggcgcggcggguuccuccugcuuggaggccugcuccugcacugcugugccugcggcgcugugaugagacccccucccgggccuggaccccggccgcgcagagacucugccggcgaucgggccggggacgcuccuggagaggcggaagccgauggcgcugggcugcagcuccgcgaggccucccccagaguccggccuagacgccggcugcuugaccuggccguguguaccgauagagcuuuugccguguaugcggucacaaaauuccucauggcucugggccuuuucguucccgccauccugcucgugaacuacgccaaggacgcuggagugcccgauaccgacgccgcuuuucugcugagcauugucggcuucguggauaucguugcccgcccugcgugcggggcccucgcuggacuggcccggcuuagaccgcaugugcccuaucuguuuucucucgcucugcuggccaauggccuuacggaccucuccagcgcgcgcgcccggucuuacggggcucuggucgccuucuguguggcuuuuggacuguccuacggcaugguuggggcccuccaguucgaggugcugauggccgcugucggcgcgccuagauuucccagcgcccuuggacuggugcuccuggucgaagcugccgccgugcugaucggcccucccuccgcugggcgccuuguugacgugcucaaaaacuaugagauuaucuucuaccuggccggaucugaagucgcgcuggcuggcguguuuauggccguugccaccaauugcugucuccggugcgcuaaggccgcgccgagcgggccuggaacagagggcggggcuuccgauaccgaggacgccgaagccgagggcgauagcgaaccccugccuguggucgcugaggaacccggaaaccuugaggcccuggaggugcucucugcuagaggcgaaccuacagagcccgaaauugaggcccgcccgcggcuggcggccgaauccguguga

SEQ ID NO: 75646 - RNA, 1530 nt, Artificial Sequence
  derived and/or modified sequence opt5 from SLC16A9__Homo_sapiens__NP_919274
auggagcugaagaaaagccccgacggcggguggggaugggugaucgucuucguuuccuuucucacccaguuccugugcuacggcucuccucuugccgugggggugcuguauauugaauggcucgaugcuuuuggagagggcaaggggaaaacagccugggucggaagccuggcguccggcgugggccuucuggcuucuccgguuuguagccucugcguguccucuuucggggccagacccgucacgaucuuuagcggauucaugguggccggcgggcugaugcuguccagcuuugcuccuaacauuuacuuccucuuuuucucuuauggaaucguugugggccugggguguggacuucuguacaccgccacagucaccauuacaugccaauauuuugacgaucggcgcggccucgcucugggccuuaucuccaccgggagcucugugggacuguucaucuacgccgcgcuccagagaaugcugguggaauuuuauggccuggacgggugucuccugauugucggagcccuugcucugaauauccucgccugcggcucccugaugcggccccuucagagcucugauuguccucugcccaagaaaauugcuccugaggaccucccggauaaguacuccaucuacaacgaaaaggggaaaaaucuggaggagaacauuaauauccuggacaagagcuauuccucugaagagaaaugccgcauuacacucgccaacggagauuggaagcaggacagccugcuucacaaaaaucccaccguuacgcauaccaaggaaccugagacauacaagaaaaagguggcggagcaaaccuauuucuguaaacagcuggccaagagaaaauggcagcucuacaagaacuauugcggcgaaacaguggcucuguucaaaaauaaggucuuuuccgcccuuuucaucgcuauccugcucuuugauauuggcggguucccucccagccugcugauggaggacguggcccggucuuccaacguuaaggaagaggaauuuaucaugccccucauuagcaucauuggaaucaugaccgccgugggcaaacugcuucuggggauccucgcugauuucaaguggauuaauacgcuguaccuguaugucgcgacacuuaucauuaugggacucgcccugugugcuaucccguuugccaaaucuuacgugacccuggcccuccugagcggcauucuuggguuccugacaggcaacugguccaucuuuccuuacguuaccaccaagacagugggaaucgagaaacucgcucacgccuauggcauucugauguucuuugcggggcugggaaauucucuugggcccccuaucgucggcugguucuacgacuggacgcagaccuaugacauugcuuuuuacuucagcggauucugcgugcuccugggcggguuuauccugcuccuggccgcccuucccuccugggauacaugcaacaagcaacugcccaagccugcuccgaccacauuccucuauaaagucgccagcaauguguga

SEQ ID NO: 75647 - RNA, 1404 nt, Artificial Sequence
  derived and/or modified sequence opt5 from SLC17A1__Homo_sapiens__NP_005065
augcagauggacaacagacugcccccuaagaaagugccgggcuucugcagcuuucgguacgggcucuccuuccugguccacuguugcaauguuaucauuaccgcccaacgcgcuugucuuaaccugacaaugguggugauggucaauucuacggauccccauggacucccuaacaccagcacaaagaaacugcuugacaauaucaagaaccccauguauaauugguccccugauauucagggcaucauucugucuagcaccuccuacggggugaucaucauucagguucccgugggauauuuuucuggcaucuacagcacaaagaagaugauuggguucgcccucugccuguccagcguccugucucuccugaucccuccggcggcuggaauuggcguggccuggguuguggucuguagagccgugcagggcgcugcccaagggaucguggcuaccgcccaguuugagauuuaugucaagugggcgcccccucuugaacggggacgccugacauccaugagcaccucuggcuuccuccuggggcccuuuaucguucuucuggugacgggagugaucugcgagucccucggcuggccuauggucuucuacauuuuuggggccuguggaugcgcugugugucugcugugguucguucucuuuuaugacgaucccaaagaccacccgugcaucagcauuucugaaaaggaguacaucaccuccagccuggugcagcaggucuccucuagcagacaaucccuuccuauuaaagccauccugaaaagccuccccgugugggcuaucucuacaggcuccuucaccuuuuucuggagccauaacauuaugacacuguacaccccuauguucaucaauucuaugcuucacguuaacauuaaagaaaauggcuuucugagcucccuccccuaucuguucgccuggaucugugggaaccuggcgggacagcucucugacuuuuuccugacgcggaauauucuuagcgugaucgccguccgcaagcuguuuacagcugccggcuuccuccugcccgcuaucuuuggggugugccuuccuuaccuguccagcaccuucuauucuauugucaucuuucucauucuggccggagccacaggcuccuucugccucgggggaguguuuaucaacggccuggauauugcuccgagauacuucggcuuuaucaaggcguguagcacccugaccgggaugauuggaggccuuaucgccucuacacugacggggcucauccugaaacaggaucccgaguccgcuugguucaagaccuucauucugauggccgccaucaauguuacaggacuuaucuuuuaucucauuguggcuaccgccgagauucaggacugggcgaaagaaaagcaacauacacggcuguga

SEQ ID NO: 75648 - RNA, 1437 nt, Artificial Sequence
  derived and/or modified sequence opt5 from SLC17A2__Homo_sapiens__NP_001273052
auggacggcaagcccgccaccagaaaagggccugauuucugcagccugcgguacggacucgcucugaucaugcacuuuuccaacuucacaaugauuacgcagcgcgugucucuuagcaucgccauuaucgcgauggucaauaccacacaacagcagggccuguccaacgcuucuaccgaggggccgguugccgacgccuuuaauaacagcuccauuucuaucaaggaguucgauacaaaagcuagcguguaucaguggucccccgaaacccaaggaaucauuuuuagcucuaucaauuacggcauuauccucacacugauuccuuccggguaucuugccggaaucuucggcgcuaagaaaaugcugggcgccgggcuccugauuagcucucugcucacccuguuuacgccccuugcggccgacuucggagugauccuggucaucauggugagaaccguucagggcauggcucaggggauggccuggacaggacaguuuaccauuugggcuaagugggccccuccccucgaacgguccaagcugacaaccaucgcgggcagcgggucugccuucggauccuuuauuauccuuugugugggcggccugauuagccaagcucucuccuggccuuucaucuuuuacaucuucgggucuacgggaugcgucuguugccugcugugguucacagugauuuaugaugacccgaugcaucaccccuguaucagcguucgcgagaaagaacauauucucuccagccuggcccagcagccuucuucccccggcagagcugugccuaucaaggccauggugaccugccuuccccugugggccauuuuucucggguucuuuagccacuucuggcuguguacaaucauccuuaccuaccugccgaccuauauuucuacacuccugcaugucaacauccgggauagcggagugcuguccucucucccuuuuauugcugcggccagcugcacgauccugggcgggcagcuugcugacuuccugcucucccgcaaucugcuuagacugauuaccguccggaaacucuuuagcucucugggacugcuccugcccuccaucugugccguugcccuuccuuucguggcuagcucuuacgugauuacaaucauccugcucauucugauccccggcaccuccaaccugugcgauagcggcuuuauuaucaauacacuugacauugcgccccgcuacgccuccuuccucauggggaucucuagaggauuuggccugaucgcugggauuaucagcuccaccgccacgggauuccugauuucucaagauuuugagagcggcuggcggaacgucuucuuccucuccgccgcugugaauauguuugggcugguuuucuaucuuacauuuggccaggccgagcugcaggacugggcuaaggaacgcacccucaccagacuguga

SEQ ID NO: 75649 - RNA, 1497 nt, Artificial Sequence
  derived and/or modified sequence opt5 from SLC17A3__Homo_sapiens__NP_001091956
auggccaccaagacagagcugagccccacggcuagagaauccaaaaacgcccaggacaugcaaguggaugagacccucaucccucggaaggucccgucucugugcagcgcgcgcuacggcauugcucuuguucugcacuucuguaauuuuacaaccaucgcccagaacgugauuaugaauaucacaaugguggccauggucaacuccaccucuccccagagccagcucaaugacuccucugaagugcugccuguugauagcuucgggggacuuuccaaagcucccaagagccugccugccaaagcucccguguaugacuggucuccucaaauucagggcaucaucuuuggggccgucggauacggcgggauucucacaauggcgccguccggauaucuggccggcagagugggcaccaagcggguuguggggaucagccuguucgcuacgucuuuucucacccugugcauuccccuugccacagauuucggaaucguccugcucauugugacccgcaucgugcagggccugucccagagcucuauucuugggggacaauuugcuaucugggagaaguggggcccuccccaggaaagaucccggcuguguagcaucgcccucuccgggaugcugcugggaugcuucacagcgauucucaucggcggcuuuauuucugagacccugggguggccuuucgucuuuuacaucuucggaggcguugggugugugugcugucuucugugguuuguggucauuuaugacgaucccgugagcuacccguggaucuccacgagcgagaaagaauauaucauuucuucccucaagcagcagguuggaagcucuaaacaaccucugcccaucaaggccaugcuucgcagccugccuauuugguccaucugccucggcuguuucucucaucaguggcuggugagcacaauggucguguacauucccaccuacaucuccagcguuuaucacgugaacaucagagacaaugggcugcucucugcucugcccuucauugucgccugggugaucggaauggucggcggcuaccuugcugauuuucugcucaccaaaaaguuccggcugauuacagugcgcaagaucgccaccauucuugggucccugccuagcucugcccucaucguuucccugccguaucugaacagcggauacauuacagcuacggcgcuccugacccuuuccugcggccugucuacacucugucagagcgggaucuauaucaaugugcuggacauugcccccagauacuccucuuuucugaugggagcuagccggggcuucuccagcaucgccccugucauugugcccaccguuucuggguuucuucucucccaagauccugaguucggcuggcgcaacguguuuuuccugcuguuugccgucaaucuccugggacuucuguucuaucucaucuuuggcgaagcugacgugcaggagugggccaaagagagaaagcugacacggcuguga

SEQ ID NO: 75650 - RNA, 1494 nt, Artificial Sequence
  derived and/or modified sequence opt5 from SLC17A4__Homo_sapiens__NP_005486
augagcaccggccccgacgugaaggccacagucggggauaucuccucugacggaaaccugaauguugcucaggaggaaugcagcagaaaaggcuucuguuccgugcggcacgggcucgcccugauucuucaacugugcaacuuuucuaucuacacgcagcagaugaaucucagcauugcgaucccugcuauggugaacaauaccgccccgcccucccagccuaacgccucuacagagcgccccagcaccgauucccaaggauauuggaaugaaacacugaaggaguucaaagcuauggccccugcuuacgacuggagccccgaaauucagggcaucauccuuucuucccugaacuaugggagcuuucucgccccuauuccgucuggauacgucgcgggcaucuucggcgccaaguaugugguuggggcuggacuguuuauuuccagcuuccugacccucuuuaucccccuggccgcuaaugccggcguggcgcuucugauuguccucagaaucgugcaggggauugcccagguuauggugcugacaggacaauacucuaucugggucaaaugggcuccuccccuugagcggucccagcugaccacgaucgccggcagcggguccaugcucggaucuuucauugugcugcuggcuggcggccuccugugucagaccaucggguggccuuauguguuuuacauuuucggaggcaucgggugcgccuguugcccccuuugguuuccgcugauuuacgaugacccugucaaccaucccuucaucagcgccggagagaagcgcuauaucguuuguucccucgcucagcaagauugcagcccuggcuggucucugcccauuagagcgaugaucaagucccuuccccugugggccauucucgugagcuacuuuugugaauauuggcuguucuacacaaucauggcuuauaccccuacauacauuucuagcgugcugcaggccaaucuccgggacuccgggauccugucugcccuuccguucgucgugggaugcaucuguauuauccugggcggccuccuggcugauuuucuucugagccgcaaaauucucagacugaucaccauucggaagcuguucacggccaucgggguucucuuucccuccgugauucuggucagccuuccuugggugcgcuccucucacagcaugacaaugaccuuccugguucucucuuccgcgaucagcuccuuuugcgagucuggagcucuggugaacuuccuggacaucgcccccagauauacaggcuuucuuaaagggcuccugcaggucuucgcccauauugcuggagccaucagcccuaccgcugccggcuuuuucauuucccaagauucugaauuuggguggcggaauguguuccugcucagcgcggccgucaacaucuccggccugguguuuuaccuuauuuucggacgcgcugacguucaggauugggccaaggagcagaccuucacacaccuguga

SEQ ID NO: 75651 - RNA, 1488 nt, Artificial Sequence
  derived and/or modified sequence opt5 from SLC17A5__Homo_sapiens__NP_036566
augagaagccccgugcgggaccuggcccgcaacgauggcgaggaauccaccgacagaacaccucuccugccgggggcuccccgggccgaggcggcuccugucugcuguucugcccgcuacaaucuugccauucuggcuuucuuuggauucuuuauuguuuaugcccucagagugaaccugagcguggcucuugucgauaugguggacuccaauacgacccuggaagauaaccggacaucuaaggccugccccgagcacagcgcgccuaucaaaguucaucacaaucagaccggcaagaaauaccaaugggacgccgaaacacagggguggauucucggauccuucuuuuauggcuacaucauuacccagauccccgggggauauguggcuucuaagaucggcggcaaaaugcugcugggguucgggauucucggcacagccguccugacccuuuuuacgccuaucgcugccgaucugggggugggaccgcucauuguucugcgcgcgcuugagggccugggggagggagugaccuuccccgccaugcaugcuauguggagcuccugggccccuccccucgaaagaagcaagcugcugucuaucuccuacgcuggcgcccagcucggcacagucauuagccugccucuuucugggaucauuuguuauuacaugaacuggaccuacguguuuuauuucuuuggaacaaucggcaucuucugguuucugcucuggauuuggcugguguccgacacgccccaaaagcacaaacggaucagccauuacgagaaggaauauauucuuucuucccugcgcaaucagcucagcucccagaaaucugucccguggguuccuauccucaagagccugccccugugggccauugugguggcucacuucuccuacaacuggaccuucuauacacugcuuacccugcucccuacauacaugaaagagauccugagauuuaauguccaggagaacggguuccuuagcucucugcccuaucucggauccuggcugugcaugauccugagcggccaagcggccgauaaucuccgggcuaaguggaacuuuucuacccugugugugcgcagaauuuucagccuuaucgggaugauuggacccgccguuuuucugguggccgcuggcuucaucggcugcgacuacucccucgccgucgcguuucugaccauuucuacaacgcugggaggauucuguagcuccggcuuuagcaucaaucaccuugauaucgcuccuucuuacgccgggauucuccugggaaucaccaacacauucgccaccauuccgggcaugguggggcccguuaucgcuaagucccugacaccugacaauaccgugggcgaauggcagacggucuuuuauauugccgcugccaucaacguguucggagcgaucuuuuucacacucuucgccaaaggcgagguccagaacugggcucugaaugaucaucacgggcaucggcacuga

SEQ ID NO: 75652 - RNA, 1749 nt, Artificial Sequence
  derived and/or modified sequence opt5 from SLC17A6__Homo_sapiens__NP_065079
auggagagcgugaagcagagaauccuggcccccggcaaagaagggcucaagaacuucgcuggaaaaucccugggccaaauuuaccggguccuugagaagaaacaggacaccggggaaacaaucgagcugacggaagauggaaagccucucgagguuccggagcgcaaggcgccccugugcgacuguaccugcuuuggccuuccuagacgguauauuaucgccauuaugucugggcugggauucuguaucagcuuuggcauccgcugcaaucucggcguggcuauuguggauauggucaacaauuccacaauccacagagggggaaaagugauuaaggaaaaagccaaguucaacugggaccccgagaccguuggcaugauccaugggagcuuuuucuggggauacauuaucacacagauuccuggcggguauaucgccucucggcuggcugccaaucgcguguuuggagcugccauccugcucaccuccacacugaacaugcuuauucccucugcggccagaguccacuacggcugugugaucuucguucggauucugcagggccucguggaaggggucaccuauccugcuugccauggaaucuggagcaaaugggccccgccccuggagcgcuccagacuugcuacgaccagcuuuuguggcucuuacgccggggcggugauugccaugccucuggcuggaauccucgugcaauauacaggcugguccagcgucuucuacguuuacgggucuuuuggaauggugugguauauguucuggcugcugguguccuacgagagccccgccaagcacccuaccaucacagaugaggaacggcgcuauauugaagagucuaucggcgaauccgcuaaucuccugggcgccauggagaaguuuaaaacccccuggagaaaguucuucacgagcaugccggucuacgccauuaucguggcuaacuuuugccgguccuggacauucuaucuucugcucauuucucagccugcguacuuugaggaaguuuucggguuugagaucagcaaagugggaaugcuguccgccgucccccaucuugugaugaccaucauuguuccuaucggcgggcagauugcugacuuccugcgcagcaagcagauccucucuacaaccaccgugagaaaaauuaugaauuguggaggcuuugggauggaagccacacugcugcucgucgugggcuauucccacacgcggggagucgccaucagcuuccuggugcuugcuguuggcuuuucuggguucgccauuagcggauuuaacgugaaucaccuggauaucgcgcccagauacgcuuccauccucaugggcauuucuaacggggucggaacccugagcggcauggugugccccaucauuguuggggccaugacaaagaauaaaucccgcgaggaauggcaauacguguuccuuaucgccgcucugguccauuauggcggagugaucuuuuacgccauuuucgcuagcggcgagaagcagccuugggccgacccggaggaaaccucugaggaaaaguguggguucauccacgaggaugaacucgacgaggagacaggagauauuacccagaacuauaucaauuacggcacgacaaaauccuauggggcgaccacccaggccaacggaggcuggcccagcgggugggaaaagaaagaggaauuugugcaaggcgagguucaggacucucauuccuacaaggaucgggucgacuauagcuga

SEQ ID NO: 75653 - RNA, 1683 nt, Artificial Sequence
  derived and/or modified sequence opt5 from SLC17A7__Homo_sapiens__NP_064705
auggaguucagacaggaagaguuucggaagcuggccggccgcgcucucgggaaacugcacagacuucuggaaaagcggcaagagggagccgaaacccucgagcugagcgcggacggccgccccgugacaacgcagaccagagauccuccggucguugacugcacauguuucgggcuuccccggcgcuacaucauugcuaucauguccggacugggcuuuugcauuucuuucgggaucagauguaaccucggaguggccauugugagcauggucaauaacuccaccacacaucggggcggccacgugguugugcagaaagcccaguuuucuugggauccugagaccgucgggcugauccauggcagcuucuuuuggggauauaucgugacacaaauucccgggggauucaucugccagaaguuugcugccaaucgcguuuucggcuuugcuauuguggccaccuccacgcugaacaugcucaucccuucugcggccagaguccacuacgggugugugauuuucgugcggauccugcagggacuugucgaaggcguuaccuaucccgcuugccauggcauuuggagcaaaugggccccuccgcuggagcgcuccagacucgcuacaaccgccuuuugugggagcuacgcgggagccgugguggcuaugccccuggccggcguccuugugcaguauucugggugguccagcguuuucuacguguauggaucuuucggcaucuuuugguaccuguucuggcuccuggucuccuacgaaagcccugcucugcaccccucuaucuccgaggaggaacggaaguauauugaggacgccaucggggaaagcgccaagcucaugaauccucugacaaaauuuuccacccccuggcgcagauucuuuacgucuaugccgguguacgcuauuaucguugcgaacuucugccggagcuggacauuuuaucuucugcucauuucccaaccugccuacuucgaggaaguguuuggauucgagaucagcaaggucggccuggugucugcccuuccccaccuggucaugaccaucauugugccuaucggcgggcagauugccgauuuucucagaucccgccggaucaugagcacaaccaauguuagaaaacugaugaacuguggaggcuucgggauggaggccacccugcuccugguggucggauauucucauagcaagggcguggcuauuuccuuucuuguucuggccgugggguucucuggcuucgcgaucagcggauuuaaugucaaccaccucgacaucgcuccccgcuacgccuccauucugaugggcaucagcaauggggugggaacacuuucuggcauggugugccccauuaucguuggggccaugacgaaacauaagacccgggaagaguggcaguaugucuuccugauugcuucccucgugcacuacggaggcgugaucuuuuacggggucuucgccagcggcgaaaagcagccuugggcugagccggaagagaugucugaggaaaaauguggauuugugggccacgaucaacuggccggguccgacgauagcgagauggaagacgaggcggaacccccuggagcucccccugcucccccgccuuccuauggcgccacacauucuaccuuccagcccccuagacccccucccccgguucgcgauuacuga

SEQ ID NO: 75654 - RNA, 1620 nt, Artificial Sequence
  derived and/or modified sequence opt5 from SLC17A8__Homo_sapiens__NP_001138760
augcccuucaaggccuuugacaccuucaaagagaagauccugaaaccuggcaaggaaggggugaaaaacgcugucggagauagccucggcauucugcagagaaagaucgacgggacaacggaggaagaggauaauauugaacuuaacgaggagggacggccgguucaaaccucccgccccucuccuccccugugcgacugucacugcuguggccucccuaagagauacaucauugccaucaugagcgggcugggauuuugcaucuccuucggcauucgguguaaucuuggcguggcgaucguggaaauggucaacaauucuacaguguauguugaugggaaacccgagauucagaccgcucaguuuaacugggacccugaaacagugggacugauccauggcagcuucuuuuggggguacauuaugacccagaucccgggaggcuucauuuccaauaaguuugccgccaaccgcgucuucggggcugccaucuuucucacaucuacccugaauauguucauccccagcgcugccagagugcacuauggaugcguuaugugugugcggauucugcaaggccucgucgagggcgugacguacccugcgugccaugggaugugguccaaaugggcucccccucuggagcgcagcagacuugccaccacaucuuuuuguggauccuaugccggcgcuguggucgccaugccccuggcggggguucucgugcaguacaucggauggagcucuguguucuauauuuacggcauguucgggaucauuugguacauguuuuggcugcuucaggccuaugaaugcccggcugcccacccuaccaucuccaacgaggaaaagacauacaucgagaccagcauuggagaaggcgcuaaugucgugucucuguccguuggccuccugagcgccgugccccauauggucaugacgaucgugguuccuauugggggacagcuggccgauuaucuccggucccgccaaauccugacaaccacagcugugagaaaaauuaugaacuguggcggguucggaauggaggcgacccuucugcucgucgugggcuuuucucacaccaagggggucgccaucagcuuccuggugcuugcuguuggcuuuuccggauucgccaucagcggcuuuaaugugaaccaccuggacauugcuccccgguacgccucuauccucauggggauuuccaauggagucggcacacugagcgggauggugugcccccugaucguuggagccaugacgcgccauaagaccagagaggaauggcagaacguguuccucauugcggcucugguccacuauucuggcgugaucuuuuacgggguguucgccagcggcgagaaacaggaaugggccgauccugagaaccuuuccgaagagaagugcggaauuaucgaccaggaugagcuggcugaagagaucgaacucaaucaugagucuuuugccagcccgaaaaagaaaauguccuauggcgcuacaagccaaaacugugaaguucagaagaaagaguggaaggggcagcggggagccacccuggacgaggaagaacuuacaucuuaccaaaaugaggagcgcaacuucuccaccauuagcuga

SEQ ID NO: 75655 - RNA, 1578 nt, Artificial Sequence
  derived and/or modified sequence opt5 from SLC18A1__Homo_sapiens__XP_011542926
augcugagaaccauccucgacgcuccccagcggcugcuuaaggagggccgcgcuagcagacaacuggugcucgucguuguguucguggcccugcuucuggauaacaugcucuuuacagucgugguuccuauugugccgacguuccuguacgacauggaauuuaaagaggucaauuccucucugcaccucgggcaugcgggaagcucuccccacgcucuggccuccccugccuucagcaccaucuuuuccuucuuuaacaauaacacaguggcuguugaagagucugugcccagcggcauugccuggaugaaugauaccgcuuccacaaucccucccccugccaccgaagcgauuagcgcccauaagaacaauugccuucaggggacaggauuccuggaggaggaaaucacccgggucggcgugcucuuugcuucuaaagccgugaugcagcugcuugucaacccguucguugggccccugacgaaucgcaucggauaucacauuccuauguuugcuggcuucgugaucauguuucucuccaccgugauguucgccuucagcggcacauacacccugcuguuugucgcgagaacacuccaggggauuggaucuuccuucagcucuguggccggccuggggaugcuugcuuccguuuauaccgacgaucaugagcggggacgcgccaugggcacggcucucgggggacuggcccugggccuucuggugggcgcccccuuugggagcgucauguacgaguucgugggaaaguccgcuccuuuucucauccuggcguuccuggcccuccuggacggcgcccuucaacuguguauucuccagcccucuaaaguuagcccggaauccgccaaggggacaccucuguuuaugcuucugaaggaucccuauauccucguggccgcuggaagcauuugcuucgccaacaugggcgucgcgauccuggagccuacccugcccaucuggaugaugcagacaauguguucucccaaauggcagcucgggcuggcuuuucuuccugccuccgugagcuaccugauuggaaccaaucucuucggcguccuggccaacaagaugggcagauggcugugcucucuuaucgggaugcucgugguuggaaccagccugcugugugugccgcucgcucacaauauuuuuggccugaucgggcccaacgccggacuuggccuggcuauugggauggucgacuccucuaugaugccuaucaugggccaccucguggaucugcggcauacaagcguuuauggauccguguacgccaucgcggacgucgccuucugcaugggcuuugcuauugggcccagcacgggaggcgccaucgugaaagcuauuggguucccuuggcugauggugaucaccggaguuauuaauaucgucuacgcgccccuuuguuauuaccuccgcucuccgccugccaaggaagagaaacuggccauccugucccaagauugccccauggaaacaagaauguaugcuacccagaagccuacaaaggaguucccccucggcgaagacagcgaugaggagccugaccacgaagaguga

SEQ ID NO: 75656 - RNA, 1545 nt, Artificial Sequence
  derived and/or modified sequence opt5 from SLC18A2__Homo_sapiens__NP_003045
auggcccugagcgagcucgcucuggugagauggcuucaggaaucccggcgcucuagaaagcugauccucuucauugucuuucuggcccuucugcucgacaacaugcugcugaccguuguggugcccaucauuccuagcuaccucuauuccaucaaacacgagaagaaugcgacagaaauucaaacggcucggccgguccauaccgccucuaucagcgauuccuuccagucuaucuuuagcuacuaugacaacuccacaauggugaccggcaaugccacacgcgaucugacccuucaccagacagcuacccagcauaugguuacgaacgccagcgcugugcccucugacugcccuuccgaggauaaagaccugcucaaugaaaacguccaaguggggcugcuuuucgccagcaaggcgaccguucagcugauuacaaaucccuuuaucggacuccugaccaacagaauuggcuacccuauccccauuuucgccggguuuuguaucauguucgugucuacaauuauguuugcuuucuccagcucuuaugccuuucugcucaucgcucggucccugcagggaaucggcagcuccugcucuagcgucgccgggaugggaaugcuugcguccguguacaccgaugacgaggagcgcggcaaugugaugggcauugcccucgggggacuggcuaugggcguccugguugggccuccguucggaagcgugcuuuaugaauuugugggcaaaacggcccccuuccugguccucgcugcccuggugcugcucgauggggccauccagcuguucguucuucaaccuucuagagugcagcccgagucccagaagggaacaccucugaccacacuccugaaggaccccuacauucuuaucgcugcgggcagcauuuguuuugccaacaugggcaucgcuaugcuggaaccggcccucccuaucuggaugauggagaccaugugcucucggaaauggcagcugggggucgccuuccugcccgcuagcauuuccuaccucaucggaaccaauauuuuuggcauccuggcccacaagauggggcgcuggcuuugugcgcugcucggaaugauuaucgugggcguuucuauccugugcauuccuuucgcuaaaaacaucuaugggcugauugcccccaauuuuggagugggcuucgccaucggcauggucgauagcuccaugaugcccauuaugggguaccuuguggaccucagacaugucagcguguauggaucuguuuacgcuaucgccgauguggcuuuuuguaugggcuaugccauugggccuuccgcgggaggcgccaucgcuaaggccaucggguucccguggcugaugacaauuaucggcauuaucgacauucuguuugcuccccucugcuucuuucugcggagcccucccgccaaagaggaaaagauggcgauccuuauggaccacaacuguccuaucaagacgaaaauguacacccaaaauaacauucagucuuaucccaucggagaggaugaagaguccgaaagcgacuga

SEQ ID NO: 75657 - RNA, 1599 nt, Artificial Sequence
  derived and/or modified sequence opt5 from SLC18A3__Homo_sapiens__NP_003046
auggagagcgccgaacccgcuggccaggccagagcggcugccaccaagcuguccgaggccgugggggcugcccuccaagaaccucggcgccagagacggcugguccuuguuaucgugugcguggcucugcuccuggacaacaugcuuuacauggucauugugccgaucguucccgauuauauugcccacaugcgcggaggcggggagggaccuacaagaacgcccgaagugugggagccuacccugccccucccuacaccggcgaaugccucugcuuacaccgccaacacaagcgcuucccccaccgccgcguggccugccggcucugcucugcggccccgcuauccuacagagagcgaagacgucaaaaucggggugcuguucgccuccaaggcuauucuccagcugcuuguuaauccccugucuggaccguuuaucgauagaaugagcuacgacgugccucuccugaucggccuuggcgucauguucgccuccaccgugcuguuugccuucgcugaggauuaugcgacgcucuuugccgcucggagccugcaggggcugggaucugccuucgccgacaccuccggcauugcuaugaucgccgauaaauaccccgaagaaccugagcgcagcagagcgcucgggguggcucuggccuuuauuucuuucggaucccuugucgccccucccuuuggcgggauccuguaugaguucgcuggaaagcggguucccuuucucgugcuggccgcugugagccuuuucgacgcccugcuccugcuggcggucgccaaaccguuuucugcugccgcucgcgccagagcgaaccuccccgugggcacaccuauucaucggcugaugcuugaucccuacaucgccguuguggcuggcgcccugaccacauguaauauuccucucgcuuuccuggagcccaccaucgccacguggaugaagcacacaauggccgcuuccgaaugggagauggggauggcguggcuuccggccuucgucccucaugugcugggaguuuaccucaccgugcgccuggcugccagauauccccaucugcaauggcucuacggcgcccuggggcuugcugucaucggagccagcuccugcauugugccugcgugucggucuuuugcuccccuggucgugagccucugcggccuguguuucgggaucgcccugguugacacagcccuucucccuacccuggcuuuucugguggaugucagacacguguccguuuauggaagcguguacgccauugcggacaucucuuauuccgucgcuuacgcccucggccccauuguggccggccacaucgugcacagccugggguucgaacagcuuucucugggaaugggccucgcuaaccugcuguaugccccgguucuucuccugcugcgcaaugucgggcuccugacccggagcagauccgagcgcgaugugcuucuggacgagccuccccagggacucuacgacgcugugcggcugagagaacgccccgucucuggccaggauggggagccucggagcccgcccggcccuuuugacgccugcgaagaugacuacaacuauuacuauacaagauccuga

SEQ ID NO: 75658 - RNA, 1470 nt, Artificial Sequence
  derived and/or modified sequence opt5 from SLC19A1__Homo_sapiens__NP_001192135
auggugcccagcuccccugccgucgagaagcagguuccgguggaacccggcccugaccccgagcugagaucuuggcggcaccucgugugcuaccuguguuucuauggguuuauggcucaaauccgcccuggagagagcuucauuacccccuaccuucugggcccugauaaaaacuuuacaagagagcaggucacgaaugaaaucaccccggugcucuccuauucuuaccuggccguucuugugcccgucuuccugcucacagacuaucugcgguacaccccugugcugcuccugcaggggcuuagcuuuguuuccguguggcugcuccugcuucugggacauucugucgcgcacaugcagcucauggagcuguucuauagcgugacaauggcugcccgcauugccuacuccagcuacaucuuuucucuggugagacccgcucgguaucaacgcgucgccggcuacuccagagcugccguucuccuggggguguucaccagcucugugcuuggacagcugcucgucacagugggccggguuuccuuuagcacccugaacuauauuucucuugcguuccugacguuuuccgugguccucgcccuguuccugaagcgcccuaaaagaagccucuuuuucaaucgggaugaccgcggcagaugcgagaccuccgcuucugaacuggagcggaugaaccccgggccgggaggcaaacuugggcaugcccugcgcguggcuuguggagauagcguucucgccagaaugcugcgggaacuuggcgacucccugagacgcccucagcuccggcuguggagccugugguggguguucaauucugcgggguacuaucucgucguguacuauguccacauccuguggaacgagguggaucccacaaccaauuccgccagaguuuacaacggagcugccgacgcugccagcacacuucugggcgccaucaccucuuuugcugcgggcuucgugaagauucgcugggcccgguggagcaagcuccugaucgcuggggucacggccacacaggccggacugguguuucuucucgcucauaccagacacccuuccucuauuuggcugugcuacgccgcguucguucuguuucgcggcagcuaucaauuccucgugcccaucgcuacauuucagauugccuccagccugucuaaggagcuuugugcccuggucuucggggugaauaccuuuuucgcuaccaucgugaaaacaauuaucacguuuaucguuuccgauguccggggacucggccugcccgugagaaagcagaacgaagaacugcacguggccagccuuucucucuggaaaucccaucugcgccuggcugccgacacccucagcuccgaagggucuagcggauccggcccucggucuugguuccugagcccgacacuuagagcggcccugcacggccccgucugcccuuccgaggugugucccagcuga

SEQ ID NO: 75659 - RNA, 1494 nt, Artificial Sequence
  derived and/or modified sequence opt5 from SLC19A2__Homo_sapiens__NP_008927
auggacgugcccggcccugucagcagacgggccgcugccgcggcugccaccguucugcuccgcacagccagagugcggcgcgagugcugguuccugccgacggcucugcugugugccuacggguuuuucgcuucccucagacccucugaaccuuuucugacccccuaucuucugggaccugauaagaaccucacagagcgggaaguguucaaugagaucuaccccgucuggaccuauagcuaccuggugcugcucuuuccuguuuuccuggccacagacuaucuucgcuacaaaccggugguccugcuccagggccugucccuuauugugaccugguuuaugcugcucuaugcgcaagggcugcuggccauccaguuccucgaauuuuucuacggaauugcuacagccaccgagaucgcuuacuauucuuacauuuauagcguuguggaucugggcauguaccagaaggucacguccuauugcagaucugccacccuugugggguuuacagugggaagcguccugggccagauccucguuuccguggcgggcuggagccuguucucucuuaacgugaucucccugaccugugucagcguggccuuugcuguugccugguuccuccccaugccucaaaaaucucuguucuuucaccauauucccuccacaugccagcgggugaaugggaucaagguccagaacggaggcauugugaccgacacgccugcuagcaaucaccuucccgggugggaggauaucgaaucuaaaauuccgcucaacauggaggaaccucccguugaggagccugaacccaagcccgaccgccugcuugugcugaagguccucuggaaugauuuccugauguguuacuccagcagaccucuucugugcugguccguguggugggcccucucuacauguggauauuuucaggucgugaacuacacccaaggccugugggagaaaguuaugccgagccgguacgccgcuaucuauaaugggggaguggaagcggucuccacacugcucggcgccguggcuguuuucgccgugggcuacauuaagaucagcuggucuaccuggggagagaugacccugucccuuuuuagccugcucaucgccgcugccgucuauauuauggacacaguggggaacaucugggugugcuacgcgucuuauguugucuuccgcauuaucuacaugcugcugauuacgaucgcuaccuuucagaucgccgccaaucuuagcauggaaagauaugcucucguguucggcgugaacacauuuauugcccuggcucugcagacccuccugacacuuaucgucguggaugccuccgggcugggacucgagauuaccacgcaguuccugaucuacgcgucuuacuuugcccugauugcuguuguguuccuugccagcggcgcugucuccgugaugaaaaagugucggaaacucgaggacccccaaucuagcucccagguuacaaccagcuga

SEQ ID NO: 75660 - RNA, 1479 nt, Artificial Sequence
  derived and/or modified sequence opt5 from SLC19A3__Homo_sapiens__XP_005246931
augaacccccugggcagcgccuccagagcuaccguggaccagcucacagaucugccuucuaaggagcaacuuagcugcgucguuuucgcccuguggccgcccgcguuuuccucuaaucucagcgacccuggggugaagaucacgaacgaaauuuuccccguguggaccuacuccuaucugguccuucugcucccuguguuuguucugacagauuacgugcgguauaagcccgucaucauucugcagggaaucucuuucauuaucaccuggcuccugcuucuguuuggccagggggugaaaacaaugcagguuguggaguucuuuuacggaauggucaccgcugccgaaguggccuauuacgcuuauaucuacagcguggucuccccugagcacuaccaacgcguuagcggcuauuguagaucugugacacucgccgcuuacaccgccggguccgugcuggcgcagcuucuggucagccucgccaauaugucuuauuucuaccugaacgugauuucccuggcuagcguuucuguggccuuucucuucucccuguuucuuccgaugcccaagaaaagcauguucuuucaugcuaagccuucccgggaaaucaagaaaucuagcuccgucaaucccgugcuggaggagacgcacgaaggagaggccccuggcugcgaggaacagaagcccaccagcgagauucucucuacauccggcaaacugaacaaggggcagcuuaauagccugaaaccgucuaacguuaccguggacgucuucgugcaaugguuccaggaucucaaggaauguuauagcuccaagcgccuguuuuacuggucucuguggugggcguucgccacagcuggauuuaaucagguccucaacuaugugcagauccugugggacuacaaagccccuagccaagauuccagcauuuacaauggcgcuguugaggccaucgccaccuucgggggagcuguggcggccuuugcugucggcuaugugaagguuaacugggaccuucugggggaacucgcccugguggucuucucuguggugaaugccggaucccuuuuucugaugcauuacacggcuaacauuugggccugcuaugcgggcuaccucaucuucaaaagcucuuauaugcugcugaucacaauugcuguuuuucagaucgccgucaaucucaacguggagagauacgcccugguguucggcauuaacaccuuuaucgcucuugucauucagacaaucaugaccgugaucguuguggaucaacgggggcugaaucuccccgucuccauucaguuccugguguauggaagcuacuuugccguuaucgcuggcauuuuccugaugcgcuccauguacaucaccuauucuacaaagagccagaaagacgugcaguccccugcccccucugaaaaccccgaugucagccacccugaggaggaauccaauauuaucaugagcacgaaacuuuga

SEQ ID NO: 75661 - RNA, 1575 nt, Artificial Sequence
  derived and/or modified sequence opt5 from SLC1A1__Homo_sapiens__NP_004161
augggcaagcccgccagaaaagggugcgaguggaagcgguuccugaaaaacaauugggugcuccugagcaccgucgcugccguugugcuuggaaucacaacgggcgugcugguccgcgaacacuccaaccucucuacccuggagaaguuuuacuucgcguuuccuggggaaauucuuaugagaaugcugaaacucaucauucugccgcugaucauuagcuccaugaucacaggaguggcugcccucgacucuaauguuagcggcaagaucgggcugcgggccguggucuauuacuucuguaccacacuuauugcugugauccugggaauuguucucguggucuccaucaagcccggcgugacccagaaagugggcgagauugcccgcacagggucuaccccugaagucagcacgguugaugcuaugcuggaccuuaucagaaacauguuucccgagaaucuggugcaagccugcuuccagcaguauaagaccaaacgggaggaagugaagccucccuccgauccugagaugaacaugacagaagagagcuuuaccgcggucaugacaaccgccauuucuaaaaauaagacgaaggaguacaaaaucgugggaauguauuccgacggcaucaacguucucgggcugauuguguucugucuggucuuuggacucgugaucggcaagaugggggaaaaaggacagauucugguugauuucuuuaaugcucuuagcgacgccacaaugaagaucgugcaaauuaucaugugcuacaugccgcugggcauccucuuccugauugcuggcaaaaucauugaggucgaagauugggagaucuuucgcaaacuugggcuguauauggccaccgugcucacaggacuggcgauucauucuaucgucauccugccccucauuuacuucaucgugguuagaaagaacccuuuccgguuugccaugggcauggcucaggcccugcuuaccgcucugaugauuuccucuagcuccgccacccuccccgugacauuccgcugugccgaagagaauaaccaggucgacaagagaaucacgcgguuugugcugccuguuggggcuaccauuaauauggauggaacagcgcuuuacgaggccguggcugccgucuucaucgcccagcugaacgaccucgaucugggcauugggcaaaucaucaccauuagcaucacagcuaccuccgccucuauuggagcggcuggcgugccccaggccggccuggugacgaugguuaucguccucagcgccguggggcugccggcugaagacgugacacuuauuaucgccgucgauuggcugcucgaccgcuuuagaaccauggugaauguucugggagacgcuuucggcaccgggaucguggagaagcuguccaaaaaggaacuugagcagauggaugucagcucugaagugaacauuguuaacccuuuugcccucgaguccacaauccuggacaaugaggauagcgacaccaaaaagucuuaugugaacggaggcuucgcggucgauaaaagcgacacaauuuccuuuacgcagaccucucaauucuga

SEQ ID NO: 75662 - RNA, 1698 nt, Artificial Sequence
  derived and/or modified sequence opt5 from SLC1A2__Homo_sapiens__NP_001182657
augcccaaacagguggaggucagaaugcacgacagccaucugggcuccgaagaaccuaaacaccggcaucucgggcugcgccuuugcgauaagcugggaaagaaccuccugcuuacccugacaguuuucggcgugauccucggggccguguguggaggccugcugagacucgcuucuccgauucaccccgacgucgugaugcugaucgccuuuccuggggauauucuuaugcggaugcugaagaugcucauccugccccuuauuaucagcucccugaucacgggacucucuggccuggacgcgaaagcuagcggccgccuggggaccagagccaugguuuacuauauguccacaaccauuaucgccgcugugcucggagucauucuggugcuugccauccauccuggcaaucccaagcugaagaaacaacucgggccuggaaagaaaaacgaugaaguuucuagccuggacgcuuuccuugaucugauucggaaucucuuuccggagaaccuggugcaggccugcuuccagcagauccaaacagucaccaagaaagugcugguggcgcccccucccgacgaagaggccaaugcuacauccgccgucguuagccuccugaacgagaccgugacggaagugccugaggaaaccaagauggucauuaagaaaggccuugaguuuaaggaugggaugaaugugcugggacucaucggcuucuuuaucgcuuucggcauugccauggggaaaaugggagaccaggcgaagcugaugguugacuuuuucaacauccuuaaugagauugugaugaaacuggucaucaugauuaugugguacucuccccucggcaucgccugucugaucugcgggaagauuaucgcuauuaaagaucuggaagugguugcccgccagcucggaauguauauggugacagucaucauuggccugaucauccacgggggaauuuuucuuccgcugaucuacuucguggucaccagaaagaacccuuuuuccuucuucgcuggcauuuuucaggccuggaucacagcccucggcaccgcuagcucugcggggacgcugcccgugacauuccggugucuggaggaaaaucuuggaauugauaagcgcguuaccagauuugugcucccugucggcgccacaaucaacauggacgggaccgcucuguaugaggccguggccgcuauuuucaucgcccaaaugaauggaguugugcuggacggcgggcagaucgucaccgugucccucacagcgacgcuggcuagcgugggcgccgccucuauucccuccgcuggacuuguuaccaugcugcucauccugacagccgucggccugcccaccgaagauauuagccuucucguggcuguggacuggcugcuggaucggaugcgcacauccgucaacgugguuggggacucuuuuggagccggcaucguguaccaccucagcaaauccgagcuggauaccauugacagccagcauagaguccacgaggauaucgaaaugacgaagacacagucuaucuaugacgauaugaaaaaucaucgggaguccaacagcaaccaaugcguguacgcggcccacaauucuguuauuguggacgaauguaaggucacccuugcugccaacgggaaaagcgcugauugcuccguggaggaggagccuuggaagcgcgagaaguga

SEQ ID NO: 75663 - RNA, 1494 nt, Artificial Sequence
  derived and/or modified sequence opt5 from SLC1A3__Homo_sapiens__NP_001160167
augaccaagagcaacggcgaggaacccaaaaugggagggagaauggagcgguuccagcaaggcgugcgcaagagaacacugcucgccaaaaagaaaguccagaauaucacgaaggaagacguuaaguccuaccuguuucggaacgcuuucgugcuucugaccgugacagccgucauuguggggaccauccucggauuuacacugcgcccuuauagaaugucuuaccgggagguuaaauauuucagcuuuccgggcgaacuucugaugcgcaugcuccagaugcuggugcugccccucauuaucuccucucuggucaccgggauggcggcucuugauagcaaggccuccggaaaaaugggcaugagagccgugguuuacuauaugacaaccacgauuaucgcuguggucaucggcauuaucauugugaucauuauccacccugggaagggaaccaaagagaauaugcaucgggagggcaagauugugcgcgucacagccgcugacgccuuccuggaucucaucagaaacauguuucccccuaaucugguugaagcgugcuucaagcaguuuaaaaccaacuacgagaagcggucuuucaaagugcccauccaagccaaugaaacacuugugggggcugucauuaacaaugugagcgaggccauggagacccugacgcgcaucacagaggaacucguuccugugccgggauccgucaacggcgugaaugcucuggggcugguuguguuuagcauguguuucggauuugucauuggcaacaugaaggaacagggccaggcccucagagaguucuucgacucucugaaugaagcgaucaugcggcuuguggccgucauuaugugguaugcucccguggggauccuguuucucaucgccggaaaaauuguugagauggaggauaugggcgugaucgggggacagcuggcuauguacaccgucacagugauuguuggccuucugauccacgccgugauuguccucccucugcuguacuuccucgugacccgcaagaaccccuggguguuuaucgggggacugcuucaagcccugaucaccgcucucggcacauccucuagcuccgcgacgcugccuauuaccuucaaaugccuugaagagaauaacggcguugacaagagagucacacgguuugugcugcccgugggggccaccaucaacauggauggaacagcucucuaugaagcccuggccgcuauuuucaucgcccaggucaauaacuuugagcugaauuucggccagauuaucaccauuagagaccgccuccggacgacaaccaacgugcugggggauagccuuggagcgggcaucguugaacaucugucuagacacgagcucaagaaucgcgacguggagauggggaacuccgucaucgaagagaaugaaaugaaaaagccguaccagcugauugcucaagauaacgagaccgaaaaaccuaucgacagcgagacaaagauguga

SEQ ID NO: 75664 - RNA, 705 nt, Artificial Sequence
  derived and/or modified sequence opt5 from SLC1A4__Homo_sapiens__NP_001180422
augaacauccugggccucgugcuguucgcccuuguccuggggguugcucucaagaaacugggaagcgagggcgaagaccuuauuagauuuuucaauucccugaacgaggccaccauggugcucgugucuuggaucaugugcagcgcgacacugcccuccaugaugaaguguauugaagagaauaacggggucgauaaacggaucucucgcuuuauucugccuaucggagcuacggugaauauggacggcgccgccaucuuccagugcguugcugccguguuuauugcucaacucaacaaugucgaacugaacgccgggcagaucuucaccauucuugugacagcgaccgccagcuccguuggagcugccggcgugccggcuggcgggguccugacaaucgccauuauccucgaggcgauuggacugcccacccacgaucuuccucugauccucgccguggacuggaucguggauagaacaaccacggucguuaauguggagggcgacgcucugggggccggcauucugcaucaccucaaccagaaggcuaccaaaaagggagaacaggagcuggccgaagugaaggucgaggccauccccaauuguaaaucugaggaagagacaagcccucuugugacccaucaaaaccccgcugggccuguugcguccgccccggaacuggagagcaaggaaucugugcucuga

SEQ ID NO: 75665 - RNA, 942 nt, Artificial Sequence
  derived and/or modified sequence opt5 from SLC1A5__Homo_sapiens__NP_001138616
augaacauccugggccucguggucuucgccauuguuuuugggguggcucugagaaaacuuggacccgagggcgaacugcucauccgguucuuuaauagcuucaacgaggccaccauggugcuggucuccuggauuaugugguacgcgccuguggggaucauguuucuuguugcuggaaaaauuguggaaauggaggacgucggccuccuguucgcccgccuggggaaguauauccugugcugucuccugggacacgccauccauggccuucuggugcucccgcugauuuacuuucuuuucacaagaaagaaucccuaucgguuucuguggggcaucguuacgccucucgcuaccgccuucgggacaucuagcuccucugcuacccugccccugaugaugaagugcguggaagagaacaauggagucgccaaacacauuagccgcuuuauccucccuauuggcgcgacagugaacauggauggggccgcucuguuccaguguguggccgcugucuuuaucgcccaacuuucccagcagucucuggacuucguuaagauuaucaccauccucgugacagcgaccgccagcuccgugggagcugccggcauucccgcugggggaguccugacgcuugccaucauucuggaggccgugaaucucccuguugaucauaucagccugauucuggcuguggacuggcucgucgauagaucuugcaccgugcugaacguugaaggcgacgcgcuuggcgccgggcugcuccagaauuacguggaucggacagagucccgcagcaccgaaccggagcugauccaagucaagucugagcuuccccuggacccucuccccgugccuacagaagagggaaacccccugcugaaacacuauagaggcccggcuggggaugccaccgucgccuccgaaaaggagagcgugauguga

SEQ ID NO: 75666 - RNA, 939 nt, Artificial Sequence
  derived and/or modified sequence opt5 from SLC1A6__Homo_sapiens__NP_001259017
augagcucccacggcaacucucuguuccucagagagagcgggcagcggcugggacgcgugggcuggcuucaaagacugcaggaaucccuccagcagcgggcccugcgcaccagacuucggcugcaaacaaugacgcucgagcauguccugcgcuuucugagacggaaugcuuucauccuccugaccguuucugccguggugauuggggucagccuugcguuugcucugcgccccuaccagcucacauauagacagaucaaguacuucuccuuuccuggagaacugcuuaugcggaugcugcagaugcucgugcugccgcugauuguuucuagccucgugaccggcauggccucccuggacaacaaagccacagggcgcaugggaaugagagcugccgucuauuacauggugaccacaaucauugcuguuuucaucggcauccuuauggugaccauuauccaccccggcaaggggagcaaagagggacugcaucgggaaggccgcauugagacgaucccuaccgccgaugcguuuauggaccucauuagaaauauguuucccccuaaccuggucgaggccugcuuuaagcaauucaaaacacaguauucuacccggguggugacaagaaccaugguccgcacggaaaauggguccgagcccggagcuagcaugccuccgcccuuuucuguugaaaacggcacauccuuccuugagaaugugacccgggcccuggggacacuccaggagaugcugagcuuugaagagaccgugccuguccccggaucugcuaacggcaucaaugcccugggccucgugguuuucuccguggcguucgggcuggucauuggaggcaugaagcacaaggggagagugcuucgcgauuucuucgacagccugaacgaagccaucaugcggcucguuggaaucauuaucugguga

SEQ ID NO: 75667 - RNA, 2040 nt, Artificial Sequence
  derived and/or modified sequence opt5 from SLC20A1__Homo_sapiens__NP_005406
auggccacccugaucacaagcacgaccgcugccacagcggcuuccggcccccucguggacuaccuguggaugcuuauucugggguucaucauugccuuuguccucgccuucucuguuggagcuaacgauguggccaauagcuuuggcaccgcugugggguccggagucgugacacugaagcaggccugcauccuugcgucuauuuucgagaccguuggcagcgugcugcucggggccaaagucuccgaaacaaucagaaagggacugaucgacguggagauguauaacucuacccaaggccugcucauggcuggcagcguuuccgccauguuugggagcgcuguguggcagcuggucgccucuuuccuuaaacugccuauuuccggaacgcacuguaucgugggcgcgaccauuggguuuagccucguggccaagggacaggaaggcgucaaauggucugagcugaucaagauuguuauguccugguucgugagcccgcuucugucugggaucauguccggcauucucuuuuuccuggugcgggcuuuuauccugcauaaggccgaucccgucccuaauggacuccgcgcucugcccguguucuacgccugcacaguuggcaucaaccuuuuuagcauuauguauaccggggccccucugcucggauucgacaaacugccccuuuggggcacaauccugauuuccguggggugugcugucuucugcgcgcucaucgugugguuuuucguuuguccuagaaugaagcggaaaauugaacgcgagaucaagugcucuccgagcgagagcccccugauggaaaagaaaaauucccugaaggaggaucacgaagagaccaaacucucugugggagacaucgagaacaagcauccugucuccgaagugggccccgccacggucccucugcaggcugugguugaggaaagaacagugagcuuuaaacuuggggaucuggaggaagcccccgagcgggagcgccucccgucugucgaccugaaggaagagaccagcauugauuccacagugaauggagccguucaacuuccuaacggcaaucuggugcaguucucucaggcugucagcaaccagaucaauuccagcggccacuaccaauaucauaccgugcacaaagacucugggcucuacaaggaacugcugcacaaacuccaucuggccaaggugggagauuguaugggcgacuccggggauaagccccuuagacggaacaauagcuauaccucuuacacaauggcgauuugcggaaugccucuggacuccuuucgcgcuaaagagggcgaacagaagggggaggagauggaaaaacucacguggcccaacgccgacagcaagaaaagaauccggauggauuccuacaccucuuauuguaaugccguuagcgaccugcacuccgcuucugagauugauaugagcgucaaggccgaaaugggccugggagaccgcaagggcuccaacgggagccuugaggaaugguacgaucaggacaaacccgaggugucucuccuguuccaguuucugcaaauccucacagcuugcuucggauccuuugcccauggcgggaacgaugugagcaaugcgaucggaccucuggucgcccuuuaucugguguacgacaccggcgauguuucuuccaagguggcuacaccgauuuggcuccugcuguaugggggcgucggaaucugugugggccuuuggguuugggggagacgggugauucagaccaugggaaaagaccucacgcccaucacaccuagcucuggcuucagcauugagcuggccuccgcucugaccgucgugaucgccagcaacauugggcuccccaucucuaccacacacugcaagguuggauccguggucagcgugggcuggcugcgcuccaaaaaggcgguggauuggagacuuuuucggaauaucuucauggccugguuugucaccguuccuauuucuggggugaucagcgcugccauuauggcuaucuucagauacgugauucugcgcauguga

SEQ ID NO: 75668 - RNA, 1959 nt, Artificial Sequence
  derived and/or modified sequence opt5 from SLC20A2__Homo_sapiens__XP_005273670
auggccauggacgaguaccuguggauggugauccucggcuucauuaucgcuuuuauucuggccuucagcgucggggcgaacgauguugcuaauuccuuuggaaccgccgugggcucugggguggucacacuuagacaggccugcauccuggcuagcauuuucgaaacgaccggauccgugcuccugggcgccaagguuggggagacaauccggaaaggaaucauugacgugaaccuuuauaaugaaaccgucgagacacugauggcuggcgaagugucugccaugguuggcagcgcgguguggcaacucaucgccuccuuucugcgccugcccauuucugggacccacuguaucgucggaagcacaauuggcuucucccucguggcuaucgggaccaagggagugcaguggauggagcuggucaaaauuguugccagcugguuuaucucuccucuucuguccggcuucaugagcgggcuccuguuugugcuuaucagaauuuucauccugaagaaagaggauccggugcccaacggacuccgggcucugccugucuuuuacgccgcgacgauugccaucaauguguucucuauuauguauaccggcgcucccguucugggccucgugcugccuaugugggccaucgcucuuaucuccuuuggggucgcccuucucuucgccuucuuuguguggcuguucguuugccccuggaugcgcagaaagauuacaggaaagcugcagaaagaaggcgcucugagccgggugucugacgagucccucagcaagguccaggaagcggaguccccuguguuuaaagagcugccgggggccaaggcuaacgaugacucuaccaucccccugacaggagccgccggcgaaacccucgggacgagcgagggaacauccgcuggcagccauccucgcgccgcguacggcagagcucugucuaugacccacggguccgucaaaagccccauuucuaauggaacauucggcuuugaugggcauacccggagcgacggacacguguaucauaccguucacaaggauuccggccuuuacaaggaccugcuccacaaaauccauauugaucgcgggccugaagagaagcccgcccaagaaucuaacuauagacugcuucggcgcaauaacagcuacacauguuacacggccgcuaucugcggccugccggugcacgccaccuucagagcugccgacuccagcgcgccugaggauucugagaaacucgucggagacacaguguccuauagcaagaaacggcugcgcuacgacucuuauuccagcuacuguaaugccguugcugaagccgagaucgaagcugaggaaggcgggguggagaugaagcuggccuccgagcucgcggaucccgaccagccuagagaagaucccgccgaggaagagaaagaagagaaggacgcucccgagguccaucugcuuuuucacuuccuccaggugcugaccgccugcuuuggaucuuucgcucacggcgggaacgaugugagcaaugccauuggaccucugguugcccuguggcuuaucuauaagcagggcggggucacacaagaagcugcgaccccgguguggcuccuguuuuacggcggagugggcauuuguacggggcugugggucuggggacggagagugauccagacaaugggcaaagaccucacccccauuaccccuuccucuggguucacaaucgagcuggccagcgcuuuuaccguugugauugccuccaacaucggacuucccgucagcacaacgcauugcaaggugggcucuguuguggccgucggguggauccgcucccggaaagcuguggauuggagacuguuccgcaauauuuucguugccugguuugugaccgucccuguggcgggccucuucagcgcugccgugauggcccugcugauguauggaauccuucccuacgucuga

SEQ ID NO: 75669 - RNA, 1653 nt, Artificial Sequence
  derived and/or modified sequence opt5 from SLC22A11__Homo_sapiens__NP_060954
auggccuucagcaagcugcucgagcaggcuggcggggugggacuguuucaaacccuucagguccugacauucauccuccccugccugaugauuccuucccagaugcuucuggaaaacuuuucugccgcgaucccgggccacagauguuggacgcauaugcucgacaaugggagcgcuguuuccaccaacaugacacccaaagcccugcugaccauuucuaucccucccggaccuaaucagggcccccaccaaugccggcgcuucagacagccucaguggcagcuccuggauccgaacgccacagcuaccagcugguccgaggccgacacagaacccuguguggauggguggguguacgaccggucugucuuuaccagcacgauuguggcuaagugggaucuuguuugcuccagccaaggacugaaaccucucucucaguccaucuucaugagcggcauccuggugggcucuuuuauuugggggcuucuguccuaucgcuucggaagaaagcccaugcucagcugguguugccugcagcuggccgucgcgggcaccucuacaaucuuugccccuaccuucgugauuuacugugggcuccgguuuguugcugccuucggaauggcuggcaucuuucuguccagccuuacacugaugguggaguggaccacgacaucccgcagagccgucaccaugacagugguggggugcgcguucucugccggacaggcugcccucggcggccuggcuuucgcccuucgggacuggcgcacccugcaacucgccgcuagcguccccuuuuucgcgauuucccugaucagcugguggcugccggaaucugccagauggcucauuaucaaagggaagccugaucaggcucugcaggagcuucggaagguugcccgcaucaauggacauaaagaggccaagaaccugaccauugaagugcucauguccagcgugaaagaggaagucgcuucugccaaggagcccagaagcgugcuggaccucuuuuguguuccugugcugcgguggcgcuccugcgcgaugcucgucgugaauuucucucugcugaucagcuauuacggccucguuuuugaucugcaaucccuugggagagacauuuuccugcuccaggcucuguuuggagccguggauuuccugggccgggccacaacggcccuucuccugagcuuucuggggagacgcaccauccaggcuggaucucaggcuauggccggccucgcgauucuggccaacaugcuugucccccaagaccugcagacacuccggguggucuucgcugugcugggcaaaggguguuuuggaaucucccugaccugccuuacaaucuauaaggccgagcuuuuccccaccccuguuagaaugacggcugauggcauucugcacacaguggggcgccugggagccaugaugggcccgcucauccugaugagccggcaggcgcuuccccugcucccuccccugcuguacggggucauuucuaucgccuccagccuugugguucucuuuuuccugccugaaacccagggccugccccucccggacaccauucaagaccuggagucccagaagucuacagcugcccagggaaauagacaggaagcugugaccgucgagagcacaucccuuuga

SEQ ID NO: 75670 - RNA, 1560 nt, Artificial Sequence
  derived and/or modified sequence opt5 from SLC22A12__Homo_sapiens__NP_001263255
auggccuucagcgagcugcucgaccuggugggcgggcuuggaagauuucagguccugcaaaccauggcucucaugguuuccaucauguggcugugcacacagucuaugcuugaaaacuucagcgccgcggugcccucccaccgguguugggcuccucugcucgauaauucuacggcccaggccagcauucugggcucccugucuccggaggcucuccuggccaucagcauucccccugggcccaaccagcgcccucaucaaugcagacgguuucgccagccccaguggcagcuucuggacccuaaugcuaccgccacauccuggagcgaagcggauaccgagccguguguggacggaugggucuacgauagaucuaucuucacauccaccauuguggccaaguggaaccucguuugcgacagccacgcucugaaacccauggcccaaucuaucuaucuugcuggcauccuggugggggccgcggccuguggaccugcuuccgaucgguuuggccgcagacucguccugacauggagcuaccugcagauggccgugaugguuauggaauggaccgcugcccgggcccgcccccucgugaugacgcuuaauucucugggcuucuccuuugggcauggacugaccgcugcggucgccuauggcgugagagacuggacacuccugcagcuuguggucagcguuccuuucuuucugugcuuccucuacuccugguggcuggcugagucugcccgguggcugcucaccacagggcgccuggauuggggacuucaggagcuguggagaguggccgcuauuaacggcaagggggccgugcaagacacccucacgcccgaaguccugcuuagcgcgaugcgggaggaacuguccaugggacagccgccugcuagccucggcacacugcugcgcaugcccggccucagauuucggaccuguaucucuacacugugcugguucgccuuuggguucaccuucuuuggacuugcccuggaucuccaggcucugggcuccaauauuuuccugcuucaaauguuuaucggggugguugacauuccugccaaaaugggagcucuccugcugcucagccaccugggcagacgccccacccuugccgcgucucugcuccuggccgggcuguguauccuugcuaacacacucgugccccaugagaugggagcccugcggagcgcucuggccguccucggccugggcggggugggagcggccuucacgugcauuaccaucuauuccucugagcuuuuuccuacaguucugagaaugaccgcugugggccucgggcagauggccgcucgcggaggcgccauccuggggccgcugguccggcuucucggcgugcacggacccuggcugccucugcucgucuacggcacagugcccguucugagcgggcuugccgcucugcuccugccugaaacccagucccugccccuuccggauacgauucaggacgugcaaaaucaggcggucaagaaagccacacacggaacccucggcaacagcgugcugaagucuacccaguucuga

SEQ ID NO: 75671 - RNA, 1656 nt, Artificial Sequence
  derived and/or modified sequence opt5 from SLC22A13__Homo_sapiens__NP_004247
auggcccaguucgugcaaguccuggcugagaucggcgacuuugggagauuccagauucagcuccugauccuucugugcguucucaacuuucugagccccuucuacuuuuucgcccacguguuuauggugcuugaugaaccucaucacugugcggucgcuugggugaagaaucauaccuucaaccuguccgccgccgagcagcucguucugucugugccgcuggacacagcuggacaccccgaaccuugccucauguuucggcccccucccgccaaugcuagccugcaagauauucuuucccaucgcuucaacgagacgcagccuugugacaugggcugggaauauccggagaauagacugcccucucucaaaaacgaguuuaaucuggucugcgaucggaagcaccuuaaagacaccacacagagcguguucauggccgggcugcucguuggaacccugauguuuggcccucugugugaucgcaucgggagaaaggcgacaauucucgcccagcugcuucuguucacccucaucggacuggcuacagccuucgugcccuccuuugaacuuuacauggcucugcgguucgccgucgcgaccgccguggcuggccucucuuuuagcaacgugacgcugcugaccgagugggucggcccuuccuggcgcacacaagccguugugcucgcucagugcaauuucagccuggggcagauggugcuugccggacuggccuauggcuuuagaaacuggcggcuccugcagaucaccgggacagcucccggacuucuucucuucuuuuacuucugggcgcugccggaaucugcccgcuggcugcucaccagaggccggauggacgaggcuauucaacugauccagaaagccgccuccgucaaucgcagaaagcugagcccugagcugaugaaccagcucgugcccgaaaagacggggccuucuggaaaugcucuggaucuguuucggcacccccaacuucgcaaaguuacacucauuaucuucugugugugguuugucgacucccugggcuauuacggccugagccuccaggugggggauuucggacuggacguuuaucuuacccagcugauuuuuggcgccguggagguccccgcgagauguucuuccaucuucaugaugcagcgguucgggagaaaguggagccaacucggaacacuggugcugggcgggcuuaugugcauuaucaucauuuuuaucccugcugaucucccggucgugguuaccaugcuggccguggucggaaaaauggccaccgcugccgcuuucacaauuuccuacguguacucugccgaacuguuucccacgauccuccgccagaccggcaugggccugguugggauuuucagccggaucggaggcauccuuacaccucuggugauucuccugggggaguaucaugcggcccugcccaugcuuaucuacggaucccucccuauugucgcuggccugcugugcacccuccugcccgaaacacacgggcagggccuuaaggacacccugcaggaccucgagcugggaccgcauccuagaagccccaaaucugugccuuccgagaaggaaacggaggccaagggccgcacaagcucucccgggguggcuuuuguuagcuccaccuauuucuga

SEQ ID NO: 75672 - RNA, 1785 nt, Artificial Sequence
  derived and/or modified sequence opt5 from SLC22A14__Homo_sapiens__NP_004794
auggccggcgaggaaaacuucaaggaggaacugagaagccaggacgcuucccggaaucucaaccaacacgagguggccgggcauccccacucuuggagccuggaaaugcuucugcgcagacuccgggcgguccauaccaaacaggaugacaaguuugcuaaucugcuugaugccguuggagaguucggcacauuucagcagcgccugguggcccucacguucaucccuuccauuaugucugccuuuuucauguuugcugaccacuucguguuuaccgcucaaaaaccguacugcaacacaagcuggauccuggccgucgggccccaucuguccaaggcggagcagcucaaucugaccauuccucaggcccccaacggaucuuuccuuacauguuuuauguaucugccugugcccuggaaucucgauagcaucauucaguucggccugaacgacaccgauacaugccaagacggguggaucuacccugaugcuaaaaagagaucccuuaucaaugaauuugaccugguuuguggaauggagaccaagaaagauacggcccagauuauguucauggcuggccucccgaucggcagccugauuuuccggcugaucaccgacaagauggggcgcuaucccgccauucuccugucucuucugggacucaucauuuuuggcuucgggacagcguuuaugaacuccuuccaccuguaccuguuuuucagauuuggaaucagccagucuguggucggcuaugccaucuccagcauuucucuugcuaccgaauggcucgugggggagcaccgggcccaugcuaucauucugggacacugcuucuuugccguuggcgccgugcugcucacaggcaucgcuuacucccugccucauuggcagcuucuguuccucgucgggggcauucuggugauccccuuuaucagcuauauuuggauccuuccugagucuccccgcuggcugaugaugaaaggaaaggugaaagaagcgaagcaaguccucuguuacgccgcuuccguuaauaagaaaaccauuccgagcaaccugcuggaugagcuccagcugccuagaaagaaagugacgcgggccuccgugcuugacuucugcaagaaucgccagcuguguaaagucacacucgugaugagcugcguuugguuuaccgugucuuacacauauuucacccugucccugagaaugcgggaacuuggggucagcgugcacuuccgccacguugugcccucuaucauggaggucccugccagacucuguugcauuuuucugcugcaacagaucggacggaaguggagccucgcugugacccugcuucaggccaucauuuggugucugcuccugcuguuccuucccgaaggcgaggacgggcucagacugaaauggccccgcugcccugcgacagagcugaaguccaugacgauccucguccugaugcuucgggaauuuucucuggcugccaccgugacaguuuucuuucucuacaccgccgagcugcugccgacagugcuuagagcuaccggacucggccuggucagccuggccuccguggcuggcgccauucucagccugacgaucauuucucagacacccucccuucugccuaucuuccucugcuguguucuggcgauuguggccuuuagccugucuucccuucuccccgaaacccgcgaucaaccucugagcgagucccugaaccauucuagccagauccggaauaaggucaaagacaugaagaccaaagaaacauccucugaugacguguga

SEQ ID NO: 75673 - RNA, 1734 nt, Artificial Sequence
  derived and/or modified sequence opt5 from SLC22A16__Homo_sapiens__NP_149116
augggcagcagacacuucgaggggaucuacgaccaugugggacacuuuggccgguuccagcgcguccuguauuuuauuugcgccuuccaaaacaucuccugugggauucauuaccucgcuucuguuuuuaugggagugacaccccaccaugugugcagaccuccgggcaaugucagccaggugguuuuccacaaccacuccaauuggucucuggaagauaccggggcccuucugagcuccggacagaaggacuaugugacgguccagcuccaaaacggcgagaucugggaacugucucgguguagccgcaauaaaagagagaacaccuccagccuuggcuacgaauauacagggucuaagaaagaguuucccugcguggauggauacauuuaugaccagaauaccuggaaguccacagcgguuacccaguggaaccuggugugugaucggaaauggcucgcuaugcugauccagccucuguucauguuuggcguccuccuggggagcgugacauucggauacuuuucugaccgccuuggcagacgggugguccugugggccaccuccagcucuauguuccucuuugggaucgccgcugccuucgcuguugauuacuauacguucauggccgcgcgcuuuuuccuggccaugguggcuuccggauaccuuguggucggcuuuguguauguuauggaguucauuggcaugaagucuagaaccugggccuccgugcaucugcacagcuuuuucgcugucgggacacuccugguggcccugaccggauaccucguucggacaugguggcuguaucaaaugauccuuagcaccgugacgguccccuuuauucugugcuguugggugcucccugaaacacccuucuggcugcuuuccgagggccgcuacgaagaggcgcagaagaucgucgacauuauggccaaauggaauagagcuagcucuugcaagcuguccgagcuccugagccuggaucuccaggggccugugucuaacagcccgaccgaaguucagaaacauaaucuguccuaucuguuuuacaacuggucuaucacaaagcggacccugaccguguggcucauuugguucacaggaagccugggcuuuuacuccuucagccuuaauucugucaaccuugggggaaaugaguaucucaaccuguuucugcucggcgugguugaaauccccgccuacacguucguguguaucgcuauggacaaagucggccgcagaaccgugcuggccuauucccuuuucugcagcgcccuggcuuguggggugguuauggucauuccucaaaagcacuacauccucggaguggugacagcgauggucggcaaguuugccauuggggcugccuucggacugaucuaucuguacaccgccgagcuuuaucccacaauugugcggucucucgcuguuggcuccgggagcauggugugcagacuggccuccauccuggcgccuuuuucugucgaucucagcuccaucuggauuuucaucccccagcuguuugugggcaccauggcccuucugucuggaguucucacgcugaaacugccggaaacacuuggcaagcgccucgcuaccaccugggaggaggccgcuaaacuggaaagcgagaacgaauccaagagcucuaaacugcuccugacaaccaauaacuccgggcuugagaagacagaagccauuacgccucgggacagcggacugggcgaguga

SEQ ID NO: 75674 - RNA, 1563 nt, Artificial Sequence
  derived and/or modified sequence opt5 from SLC22A17__Homo_sapiens__NP_057693
auggccagcgaccccaucuucacccuggcuccuccgcuccacugccauuacggcgccuuucccccuaacgcguccgggugggagcagcccccuaaugcuucuggagugagcgucgccuccgccgcucuggccgcuucugccgcgagcagaguugccacauccacggaucccucuuguagcggcuucgcuccuccggacuuuaaccacugccuuaaggauugggacuauaaugggcugcccgugcucaccacaaacgccauuggacaaugggaucuggugugugaccuuggcuggcaggucauccuggaacagauucucuucauccugggguuugcuuccggauaccuguuccucggcuauccugccgaucgguuuggccgcagagggauugugcugcuuacccugggacucguuggccccugcggggugggaggcgcggccgcugggagcucuacaggagucauggcccugcgguuccuucugggcuuucuccuggcuggcguggaccuggggguuuaccucaugcgccuggagcuuugugauccuacccagagacugcggguggcccucgccggagaacuggucggcgucgggggacauuuccuuuuucugggccucgcucugguguccaaagacuggcgcuuccugcaaagaaugaucacagcgcccugcauccucuuucuguucuauggguggccgggacuuuuccuggagagcgcccgguggcucauugugaagcgccagaucgaagaggcucagucuguucugcggauucuugccgagagaaaucgcccucacggccagaugcugggcgaagaggcccaagaagcucuccaggaucuggagaacaccuguccccugccugccacguccagcuuuucuuucgcgucccuccugaauuacagaaacaucuggaaaaaucuucugauucucggguuuaccaacuucaucgcucaugccauucggcacugcuaucagcccgugggaggcgggggaagccccuccgacuuuuaccuguguucucugcuugccagcggcacagcugcccucgcuugcguguuccugggggucaccguggaucgcuuuggcagacggggaauccugcuccuguccaugacacuuaccggcaucgccagccugguucuccuggggcugugggacuaccuuaaugaggcggccauuacgacauucucugugcucggacuguuuuccagccaggcugccgcuauccugucuacccuccuggccgcggaagucauuccuacaaccgugagaggccgcgggcuuggacugaucauggcccucggcgcucuugggggccugagcggaccggcccaacggcugcacaugggccauggggcuuuccuccagcacguugugcuggccgccugugcucugcucugcauucuguccaucaugcuucugcccgagaccaagagaaaacuccugccugaaguccugcgcgacggagagcuuugccggagacccucucuccugcgccagccucccccgacacggugugaucaugugccucugcucgcgacgcccaacccugcccuguga

SEQ ID NO: 75675 - RNA, 453 nt, Artificial Sequence
  derived and/or modified sequence opt5 from SLC22A18AS__Homo_sapiens__NP_001289791
augagaugcgccgagggcgcuuggugguucagccccgacgggccugccggauccgcggcuucuaucuggccggccgaaggcgccgaggggcugcccggacagcucggccgggaucgccuggaaguggucuacagcguuccugacaacgugcccgggcaaaauggauccagacggccucuuguguguaagauuaccggcaaaugccugucugucuguagcgaggaaaacgcuaaggccggcgggugcuccgcuuuuccccuccugcuuucucagcugggagcccgcaugacaggcagagagcacgcgcauaaagggccugagcucacgaccccggauagcggacugccccggccucccaauccugcccuggcuggcuuccgcgcccucgcucagcacuccccgccccuggggacaagcaccccuucugccgugcuucuguccgcggccacauga

SEQ ID NO: 75676 - RNA, 1275 nt, Artificial Sequence
  derived and/or modified sequence opt5 from SLC22A18__Homo_sapiens__NP_899056
augcagggcgccagagcuccccgggaccaagggcgcagcccuggaagaauguccgcccugggccggucuagcgugauccuccugaccuacguccuugcggcuacagagcugacgugccucuucaugcaguuuuccauuguuccguaucugucucgcaaacuugggcuggauagcaucgccuucggauaccuccagaccacauuuggcgugcugcagcugcucgggggacccguguucggcagauuugccgaccaacggggcgcucgcgccgcucugacccuuuccuuccuggccgcgcucgcccuguaucuucugcucgcugccgcuucuagcccugcccugcccggggucuaccugcucuuugcguccagacugccuggagcccuuaugcacacacugcccgcugcccagauggugauuaccgaucucagcgcuccugaggaacggccggccgcccugggccgccuugggcuguguuucggaguuggcgugauccucgggucucugcugggaggcacacucgucuccgcuuauggcauucagugccccgcgauccuggccgcucuugccacccugcucggggccgugcugagcuuuacguguaucccugcuucuaccaagggagccaagacagacgcgcaggcuccccuuccuggcgggcccagagccuccguuuucgaucugaaagccauugcuagccuccugcggcugccggacgugccucgcaucuuucucgucaagguggccucuaacugccccaccggacuguucauggugauguuuuccauuaucagcauggauuucuuccaacuugaagcugcccaggcgggcuaccugauguccuuuuucgggcuccugcagauggucacacagggacugguuauuggccaacuuucuagccauuuuuccgaggaagugcuccugagagccagcgugcuggucuucaucgugguuggccucgcuauggccuggaugucuuccguguuucacuucugucugcuugucccugggcugguguuuagccucugcacccugaauguugugacggacucuaugcugauuaaagcugucagcacauccgauaccggaacaaugcuuggccucugugccucugugcagccccugcugcggacccucgggcccaccgucggaggccugcuuuaucgcagcuucggggugccuguuuuuggccaugugcaggucgcgaucaacacacuggugcuccugguucuguggagaaagccgaugccccaacggaaggacaaagugagauga

SEQ ID NO: 75677 - RNA, 1665 nt, Artificial Sequence
  derived and/or modified sequence opt5 from SLC22A1__Homo_sapiens__NP_003048
augcccaccguggacgauauccuggagcaggucggcgaaagcgggugguuccaaaagcaggccuuucucauucugugccuucuguccgcugccuucgcgccuaucuguguuggaauuguguuucucggcuucacaccggaccaccauugccagucucccgggguggcugagcugagccagagauguggaugguccccugccgaagaacuuaacuacacgguccccggccuggggccugccggagaggcuuuucucggccaaugccggcgcuaugagguggauuggaaucagucugcccugagcuguguugacccccuggcuucccucgccaccaacagaucucaucugccucuuggcccgugccaggauggguggguguacgacacacccggaagcuccaucgucaccgaguucaaucuggugugugcggauagcuggaaacucgaccuguuucagucuugccuuaacgccggcuuccuguuugggucccucggaguuggcuauuucgcugaucgguuugggcgcaagcugugucugcucggaacagugcuggucaaugccgugagcggcgugcuuauggcuuucucuccuaacuacauguccaugcugcucuuuagacugcuucaaggccuggucagcaaagggaauuggauggccggauauacccucauuacagaguucguuggcucugggucccggcgcaccguggcgaucauguaccagauggccuucacggugggacuggucgcucugaccggccucgccuaugcucugccccacuggagauggcuucagcuggccgugagccucccuacauuucuguuccuucuguacuacuggugcguucccgaauccccgcgguggcuccugucucagaagcgcaacaccgaagccaucaaaauuauggaccacaucgcucaaaagaaugggaagcugccucccgcggaucucaaaaugcugagccuugaggaggacgugacagaaaagcuguccccuagcuuugccgaucucuucagaacgccccggcugcgcaaaagaaccuuuauucugauguaucuuugguucacagacucuguccucuaccagggacugauccugcauaugggcgcuaccuccggcaaccucuaucuggacuuucuuuacagcgcccugguggagauucccggggccuucaucgcucucauuacaaucgaucggguuggacgcaucuauccuauggccaugucuaaucugcuggcgggcgcugccugucuugugaugauuuuuaucagcccggaccuccacuggcugaacauuaucauuaugugcgucgggagaaugggaaucaccaucgccauucagaugaucugccuggugaaugcugaacucuaccccaccuucguccggaaccugggcgugaugguuuguuccucucuuugcgauauugggggcaucauuacaccuuuuaucguguucagacugcgcgaggucuggcaagcccucccccugauccuguuugcugugcuuggacuccuggccgcgggcguuacgcugcuccugccugaaaccaaggggguggcccuucccgagacaaugaaagacgcugagaaucugggacggaaggccaagccgaaagaaaacaccauuuaucucaagguccagacaagcgagccuuccggcaccuga

SEQ ID NO: 75678 - RNA, 1086 nt, Artificial Sequence
  derived and/or modified sequence opt5 from SLC22A23__Homo_sapiens__NP_001273385
auggccaucgacagacggcgcgaggcugccggcgggggacccggcagacagccugcgccggcugaagagaacgggagccugcccccuggagaugccgccgcuuccgcuccccucggcgggcgggccggaccuggcggcggggccgaaauucaaccccugccuccgcuucaccccggaggcgggccucaucccucuugcuguagcgcggccgcugccccuucccugcuccugcuugacuacgauggaucugugcugcccuuccucggcgggcugggaggcggcuaucagaagacccugguccuccugacauggaucccggcucuuuuuauuggguucagccaguuuuccgacucuuuccugcucgaucagccuaauuuuuggugccgcggagccggcaaagggacggagcuggcgggaguuaccacaaccggcagagggggagacaugggcaacuggacaagccuucccaccacaccuuucgccaccgcucccugggaagccgcuggcaaucgguccaacagcucuggggccgauggaggcgacacgcccccucugccguccccucccgauaagggggacaaugccagcaacugugauugccgcgcuugggacuacggaaucagagcgggccucgugcaaaauguggucucuaaaugggaucuggugugugacaacgccuggaagguucacauugcuaaauuuucccugcucguggggcugaucuucggcuaucuuaucaccggaugcauugccgacugggucggccggcgccccgugcugcucuuuagcaucauuuucauccugauuuuugggcuuacaguugcccugucugugaaugucaccauguucuccacacucagauuuuucgagggauucugucuggcuggcaucauucugacccucuacgcccugcggaucgagcuuugcccucccgggaagcgcuuuaugaucacgaugguggcgagcuucguggcuauggccggacaguuucugaugccgggccucgccgcucuguguagagauuggcagguccuucaggcccugauuaucugcccuuuccuccugaugcugcucuauugguccuga

SEQ ID NO: 75679 - RNA, 1659 nt, Artificial Sequence
  derived and/or modified sequence opt5 from SLC22A24__Homo_sapiens__NP_001129978
augggcuucgacgugcugcucgaucaggucgggggaaugggcagauuucaaaucugccugauugccuucuuuuguaucaccaacauucuucuguuccccaauaucguucucgagaacuuuacagcuuucacgccuagccaccggugcugggugccgcugcuugacaaugauaccguguccgacaacgauacagggacccugucuaaggacgaucuccugcgcauuagcaucccccuggacuccaaucucagaccucagaaaugucagcgguuuauccauccccaguggcaacugcuucaccugaacggaacauucccuaauaccaacgaacccgauacagagccuugcgucgacggcuggguguacgaucgcucuagcuuucucuccaccauuguuacggaaugggaccuggugugugagucucagagccuuaaguccaugguccagagccuguucauggccgggucucuccugggaggccugaucuauggccaucucuccgauagaguggggcggaaaauuaucugcaagcuguguuuucuucagcuggcgauuagcaauaccugcgcugccuucgccccgacauuucucguuuacuguauccugcgcuuccuugcuggauucucuaccaugacaauucugggcaacaccuuuauccucucccuggaauggacgcugcccagaagccggucuaugacaaucauggugcuccugugcuccuauagcgucgggcaaaugcuucugggaggccucgccuucgcuauucaggacuggcacauccugcagcuuaccguguccacaccuauuaucgugcuguuucucucuagcuggaaaauggucgaguccgcccgcuggcugauuaucaauaaccagcuggacgaggggcucaaggaacugagacggguugcgcauaucaauggaaagaaaaacaccgaggaaacccuuacaacggagcuggugcgcagcaccaugaagaaagagcucgaugccgugagaauuaagacaucuaucuucucccuguuucgggcucccaaacugcgcaugagagucuucggccuuuguuuugugcgguucgccauuaccguuccuuuuuacggccucauccugaaucugcaacaccucgggagcaacgugucucuguuccagauucuuugcggagcugucacauuuaccgccagaugcgugagccugcucacgcugaaccacaugggccgccggaucucccagauccuguucacauuucccguugggcuuuucauucucgugaauaccuuccugccgcaagaaaugcagauccugagagucgugcucgcgacccugggaauuggcucugucagcgccgcuuccaacagcgccucugugcaucacaaugagcuuguuccuacaauccugcgcuccaccguggcugggauuaacgccgucagcggacggacaggcgccgcucucgcgccccugcugaugacgcuuauggccuauucuccucaucuccccuggaucuccuacggcguguuucccauucuggcuguuccugugauccugcuccugccggaaaccagagaccuuccccugccuaauacaauccaggaugucgagaacgaccgcaaggauagccggaauauuaagcaggaagacaccuguaugaaagugacacaauucuga

SEQ ID NO: 75680 - RNA, 1668 nt, Artificial Sequence
  derived and/or modified sequence opt5 from SLC22A2__Homo_sapiens__NP_003049
augcccaccacaguggacgauguccuggagcacggcggggaauuucauuucuuccagaagcaaauguuuuuccuccuggcccuucugagcgcuacguuugccccuaucuacguuggaauuguguuccucggcuuuaccccggaccacagaugccggucccccgggguggcggagcugucucuucgcuguggauggagcccugcugaggaacugaacuauacaguccccggcccugggcccgccggagaagccuccccuagacagugccggcgcuacgagguggauuggaaucagucuaccuucgacuguguugauccgcucgcuagccuggacacaaacagaucccggcugccccucggcccuugccgcgauggcuggguguaugagacccccgggucuagcaucgucacagaauuuaaucuggugugugccaacuccuggaugcuugaccuguuccagagcucuguuaaugugggauuuuucauuggcuccaugagcaucggguacauugcugauagauuuggacggaaacucugccugcuuaccacgguccugaucaacgccgcggccggcgugcucauggcuaucucuccuaccuauacauggaugcugauuuuccgccugauccaagggcucguguccaaggccggauggcugauuggcuacauccuuauuaccgaguucgucggcagacgguaucgcagaacaguugggaucuuuuaccagguggcuuacaccgugggacugcucguccuggccggcguggcguaugcccuuccccauuggcgguggcugcaguucacgguuagccucccgaauuucuucuuucugcuguacuauugguguauuccugaaucuccccgcuggcucaucucccagaacaaaaaugcugaggccaugagaaucauuaagcacaucgcuaaaaagaacggaaagagccugccugccucccuucaacggcugagacucgaggaagagacagggaaaaagcugaaucccucuuuccuugaccuggugcgcacaccccagauucggaaacauaccaugauccucauguacaacugguuuaccagcuccguccuguaucagggccugauuaugcacauggggcucgccggagauaauaucuaccuggacuucuuuuauagcgcucuuguggaauuuccugcggccuuuaugaucauucugaccaucgauagaauuggccgccgguacccgugggcugccucuaacaugguugccggcgcugccugccucgcguccguguucauccccggggaccugcaguggcugaagauuaucaucagcugucuuggaagaaugggcauuacaauggcuuacgagaucgucugccucgugaaugccgaacuguauccuacguuuauucgcaaccuggggguccacaucuguucuagcaugugcgacauuggaggcaucauuacccccuuccucguguaccggcugacaaacaucuggcuugagcugccucucaugguuuucggggugcugggccuggucgccggaggccuugugcuccugcugcccgagaccaaagggaaggcucucccggaaacaaucgaggaagccgagaauaugcaaagaccucgcaagaacaaagaaaagaugauuuaucugcagguucagaaacuugauaucccccugaauuga

SEQ ID NO: 75681 - RNA, 1671 nt, Artificial Sequence
  derived and/or modified sequence opt5 from SLC22A3__Homo_sapiens__NP_068812
augcccagcuucgacgaggcccugcagagagugggcgaauuugggcgguuccaacgcagagucuuucuccugcuuugccugaccggaguuacauucgcuuuucucuucgugggcguggucuuucuggggacgcagccugaucacuacuggugucggggaccguccgccgcggcucuugccgagcgcugcggcuggucucccgaagaggaauggaacagaaccgccccugcuagccgggggcccgagccucccgagcgcagaggacggugucagcgcuaucugcucgaagccgcuaaugacuccgccucugcgacaagcgcccuguccugcgcugauccucuggccgcuuucccgaacagaucugcgccccucgugccuugucggggcggcuggcgcuacgcccaggcccauagcaccaucguuuccgaguuugaccuggugugcgucaaugcuuggaugcuugaucugacacaagccauucucaaccugggguuccuuaccggagcuuuuacacugggcuaugccgccgacagauacgggcggaucgugauuuaucuccugagcugucugggaguuggcgugaccggggucgugguggcuuucgcgcccaauuuuccugucuucguuaucuuccgcuuucuccagggaguguucggcaagggcacguggaugaccugcuacgugauugucacagaaaucguggggucuaaacagagacggaucguuggaauugugauccagauguuuuucacccugggcauuaucauucuucccgggaucgccuauuuuauuccgaacuggcaaggaauccagcuggcuaucacacucccuuccuuccuguuucuucuguacuacugggucgugcccgagagcccuagauggcucauuacccgcaagaaaggcgauaaggcccugcagauccugcggagaauugccaaauguaaugggaaguaucucucuuccaacuacagcgagaucacgguuacagacgaagaggugucuaaucccuccuuccuggaucuuguccgcacaccccagaugcggaagugcacccugauucucauguuugcuugguucaccagcgccguggucuaucaaggacuggugaugagacuuggcaucaucggcgggaaccuguacauugacuuuuucaucuccggaguuguggaacucccuggcgcgcugcugauucuccugaccaucgagcgccuugggcggagacugccguuugcugccucuaauauugucgccggaguggcuugucucguuacagccuuccugcccgaaggcaucgcuuggcugcgcacgaccguggccacacuugggcggcucggcaucaccauggcguucgagauugucuaucuggugaacagcgagcuguacccuacaacccucagaaauuuuggagugucccugugcagcggccuuugcgauuucgggggaaucauugcccccuuucuccuguuccgccuggcugccguuuggcuggaacuuccucucaucauuuuuggcauccuggcuucuauuugugggggacuggucaugcuccugcccgagacgaaaggcaucgcccuuccggaaacaguggacgauguggagaagcugggguccccucacagcugcaaauguggccggaacaagaaaacccccgucucuagaagccaucucuga

SEQ ID NO: 75682 - RNA, 1656 nt, Artificial Sequence
  derived and/or modified sequence opt5 from SLC22A4__Homo_sapiens__NP_003050
augagagacuacgaugaggugaucgccuuccugggcgaaugggggcccuuucagcggcucauuuucuuucugcuuagcgcuuccaucauuccuaacggauucaauggcaugucugucguuuuucuggccgggaccccggagcaccgcugcagagugcccgacgcggcuaaccucagcuccgccuggcggaauaacucugugccucugcgccuuagagauggacgggaagucccccauagcuguucccgcuauagacuggccacaaucgcuaauuucucugcccucggccuggagccugggcgggacguggaucugggacaacucgaacaggagagcugccuggacggcugggaguuuucccaggauguuuaccuuagcacgguggucaccgaauggaaccuggugugugaggacaauuggaagguuccccucacaaccucucuguucuuugugggcguccuucugggguccuucgugagcggacagcucucugaucgcuuuggccggaaaaacgugcuguucgcuacaauggccguccaaaccggguuuuccuuccugcagauuuucagcaucucuugggaaauguuuacaguucucuucgugaucgugggaaugggccagauuuccaauuaugucguggcguuuauccuggggaccgagauucuuggaaagagcguuagaaucauuuucuccacgcugggcgugugcaccuuuuucgccgucggcuacaugcuccugccucuuuuugcuuauuucauccgcgacuggagaaugcugcuccuggcccugacagugccggggguucucugugugccccuguggugguuuauuccugagucuccccgguggcuuaucagccagcgcagauuccgggaagcugaggauaucauucaaaaagccgcgaagaugaacaauaucgccgucccugcugugauuuuugacuccgucgaggaacugaacccccucaaacagcagaaggccuucauccuggaucuuuuuagaacccgcaauauugcuaucaugacaaucaugagccugcuccuguggaugcugaccucugugggauacuucgcccucucccuggacgccccgaaccuucacggcgacgcuuaucugaauugcuuccucagcgcgcugauugaaaucccugccuacauuacggcuuggcugcuucuccggacacugcccagacgcuacaucauugccgccguucuguuuuggggagggggcgugcuccuguucauccagcuugucccuguggauuauuacuuucugucuaucgggcucguuaugcugggaaaguucggcauuaccagcgcuuuuuccaugcuguauguguucacagccgagcuuuaccccacccucguccggaacauggcggugggcgugaccucuacagcuagcagaguuggguccaucauugcccccuauuuugucuaccugggagccuauaaccgcaugcugccuuacaucgugaugggcagccucacggugcugauugggauccuuacccuguucuuuccggagucucucggaaugacacugcccgaaacccuggagcaaaugcagaaagucaagugguuccgguccggcaaaaagacaagagacagcauggaaaccgaggaaaauccuaaagugcuuauuacggcuuuuuga

SEQ ID NO: 75683 - RNA, 1674 nt, Artificial Sequence
  derived and/or modified sequence opt5 from SLC22A5__Homo_sapiens__NP_003051
augagagacuacgaugaggugaccgccuuccugggcgaaugggggcccuuucagcggcucaucuucuuucugcuuagcgcuuccauuaucccuaacggauucacaggccugucuagcgucuuucucauugccacgccggagcaccgcugcagaguucccgacgcggcuaaucuguccucugccuggcggaaccauaccgugccucuucgccugagagaugggcgggaagugccccacagcugucgcagauaucggcucgccacaaucgcuaauuucuccgcccugggacuggagccuggccgcgacgucgaucucgggcaacuggaacaggagucuugccuugacggaugggaguuuagccaggauguguaccuguccaccauuguuacagaauggaaccucgugugugaggacgauuggaaggcuccccugaccaucagccuuuucuuugucggcgugcugcucggcucuuucaucuccgggcagcugagcgacagauuuggacggaaaaauguucuguucgugacaaugggcaugcaaaccggguuuucuuuccuccagauuuucuccaagaacuuugaaauguucgucgugcuguuugugcuugucggaaugggccagaucagcaauuauguugccgcguucgugcuggggacggagauucucggaaaaucugugcgcaucaucuuuuccacccugggcgucugcauuuucuacgccuuuggcuauauggugcuuccucuguucgcuuacuuuauuagagauuggcggaugcuccugguugcccugacaaugccgggggugcucugugucgcucuguggugguucauccccgagagcccucgcuggcuuaucucccagggaagauuugaagaggccgaagugauuauccggaaggcggccaaagcuaacggcauuguugugcccucuaccaucuucgacccuagcgagcugcaagaucucuccagcaagaagcagcagucucauaauauucuggaccuucugagaacauggaacauccgcauggucaccaucauguccauuaugcucuggaugacgaucagcgugggguauuuuggacugucucuggacacacccaaucuccacggcgauauuuucgucaacugcuuccugagcgccaugguggaaguuccggcuuacgugcuugccuggcugcuccugcaguaccugccucggagauauuccauggccaccgcucuuuuucucgggggaucuguccugcuguucaugcaacucgugcccccugaccuguacuaucuugcgacaguucuggugauggucggcaaauuuggcgugaccgccgcuuucagcaugguguacguuuauaccgccgagcucuaccccacagucgugcgcaauaugggggugggagucuccagcacggccucucggcugggcuccauccugagccccuauuuuguguaccuuggggcuuacgauagauuccucccuuauauucugaugggaucucugaccauccucacagccauccugacccuuuuucugccggaguccuucggcacaccccucccugacaccauugaucagaugcugcgcguuaaggggaugaaacaucggaagacgcccagccacacaagaaugcugaaagacggccaggaacgcccuaccauccuuaaguccaccgcguuuuga

SEQ ID NO: 75684 - RNA, 1692 nt, Artificial Sequence
  derived and/or modified sequence opt5 from SLC22A6__Homo_sapiens__NP_004781
auggccuucaacgaccugcuccagcaagugggcggggucggaagauuucagcagauccagguuacccugguggugcuuccccugcuccugauggcuagccacaauacacuucaaaacuucacggccgcgauuccuacccaucacugccggccgcccgcugaugccaaucuguccaagaacggcgggcucgaggucuggcugccucgcgacagacagggacagcccgaaucuugucugcgguuuacaagcccucaguggggccuccccuuccugaaugggaccgaggccaacggaacaggcgcuaccgaaccuugcacagauggcuggaucuacgacaauuccaccuuuccgucuacgauugugaccgagugggaucuuguuuguagccaucgcgcccugagacaacucgcucagucccuguauaugguggggguccuucugggagccaugguguucggcuaccucgcggaccggcuggggcgcagaaaaguucugauccucaacuaucugcagacagccgugucuggaaccugcgcugccuuugcucccaauuucccuauuuacugugccuuucggcuucugagcggcauggcgcucgccgggaucucccugaacugcaugacacuuaaugucgaauggaugcccauccacacccgcgcuugugugggaacgcugauuggcuauguguacagccucggccaguuccugcuggccggggucgcuuaugccguuccucauuggagacaccuccaacugcuugugucugcccccuuuuucgcuuucuucaucuacuccugguucuuuauugagagcgcgcgguggcacucuuccagcggacgccuggaucucacacugagagcccuucagcggguggcucgcaucaacggcaagagagaggaaggggccaaacugucuauggagguccuccgggccucccugcagaaggaacugaccaugggaaaaggccaagcuagcgccauggagcuccugagaugcccgacacuucgccaucuguuccucugucuguccaugcugugguuugcgaccucuuucgcuuacuaugggcuugugauggaccuccagggauuuggcguuagcauuuaccugauccaggugauuuucggcgccgucgaucugccugccaagcucgugggguuucugguuaucaauucccuuggacggagacccgcucagauggccgcucugcuccuggccggcaucugcauucugcuuaacggggugaucccucaagaccagagcauuguccgcaccucucucgcggugcugggaaagggcugucuggccgcuuccuucaauugcaucuuucucuauacaggggagcuguaccccacgaugauucggcagaccggcaugggaaugggcagcacaauggccagagucgggucuaucgugagcccccuuguuuccaugaccgcugaacuguauccuucuaugccgcucuuuaucuacggagccgugcccgucgcggccagcgcugugacaguucugcugccugagacccuuggccagccccucccugauacggugcaagaccuggaaucccgcugggcccccacacagaaagaggcugggauuuauccgcggaagggaaaacagaccagacagcaacaggaacaccagaaguacauggucccucugcaggccagcgcccaagagaaaaacggccucuga

SEQ ID NO: 75685 - RNA, 1641 nt, Artificial Sequence
  derived and/or modified sequence opt5 from SLC22A7__Homo_sapiens__NP_006663
augggcuucgaggaacugcucgagcaggucgggggauuuggccccuuccaacugagaaacguggcccuucuggcucucccucggguucugcuuccgcugcacuuucuccugcccaucuuccuggccgcggugccugcucaucgcugcgcccuccccggggccccugcuaauuuuagccaccaggacguguggcuggaagcccaucuucccagagagccugauggaacccuguccucuugucuccgguucgcuuacccgcaggcccugcccaacacaacgcuuggcgaggaacgccagagcagaggggagcuggaagacgagccugcgaccguccccugcucccaaggaugggaauaugaucacucugaguuuagcuccacaauugccaccgagugggaccucgugugugaacagaagggccugaaucgggcugccucuacauucuuuuucgcuggcguucuggugggggccgucgcguuuggauaccucagcgaucgcuucggcagacggcgccugcuucugguggccuauguuuccacccucgugcuggggcuugcuagcgccgcuucugucuccuacgugauguuugccaucacaagaacccugacgggaagcgcccucgcuggcuucaccauuaucgugaugccucuggagcuggaauggcucgacgucgagcaucggacaguugcgggggugcugucuuccaccuucuggacaggaggcgugaugcuucuggcccucgucggcuaucugauucgcgauuggagauggcuucugcucgcugugacccugcccugcgccccggggauccugagccucugguggguuccugaaucugcccgguggcugcuuacgcagggacacgugaaagaggcucaccgcuaccugcuccauugugccagacugaacggccggcccgucugcgaggacuccuuuagccaggaagcgguguccaagguugcugccggggagagagugguccgccggccuucuuaucuggaucuuuucagaacaccccgccuccggcacaucagccuguguugcguggucgugugguuuggaguuaauuucuccuacuacggccugagccucgacgugucugggcugggacuuaacgucuaucaaacccagcugcucuuuggcgccguggaacugcccuccaaacugcuuguuuaccucagcgugagauaugcuggccgccggcugacacaggccgggacccugcucggaaccgcucuggccuucggcacaagacuucuggucucuagcgauaugaaguccuggucuacggugcucgcggugauggggaaagccuuuagcgaggcugccuucaccacagcuuaccuguuuaccuccgaacuguauccuacaguucuucgccagaccggaaugggccucacggcccuggucgggcggcugggcggaagccucgcgccgcuggccgcucugcuugacggcguguggcucucucugcccaagcugacauacgggggaauugcccuucucgcugccggcaccgcccugcugcucccugagaccagacaagcucagcugcccgagacaauccaggauguggaacgcaaguccgcgccuaccagccuucaagaggaagagaugcccaugaaacagguccagaauuga

SEQ ID NO: 75686 - RNA, 1629 nt, Artificial Sequence
  derived and/or modified sequence opt5 from SLC22A8__Homo_sapiens__NP_001171661
augaccuucagcgagauccuggacagagugggcuccauggggcacuuucaguuccuccaugucgccauucugggacuucccauccugaacauggcuaaucacaaccuccugcaaauuuuuacagccgcgacgccuguucaucacugccggccgccccauaaugcuucuaccggcccuugggugcuucccauggggccuaacggaaaacccgaacgcugucugagauucgugcacccuccgaaugccagccuccccaacgauacacagcgggccauggagccuugccuggacggcugggucuacaauuccaccaaagauucuaucgugacagaaugggaccugguuuguaacagcaauaagcucaaagagauggcucaguccauuuuuauggccgggauccugaucggaggccuugugcugggcgaucucucugaccgcuucgggagacggcccauucugaccugcagcuaucuucugcucgcugccuccggaagcggcgcggccuuuucuccuacauuccccaucuacauggucuuucgcuuccuguguggguuuggaauuuccggcaucacccugagcacggugauucucaacguugaaugggugccgaccagaaugcgggcuaucaugucuacagcccugggguauugcuacaccuucggacaguuuauucuuccuggccuggcuuaugccaucccccaauggcgcuggcuccagcugacagucuccaucccuuucuucguguuuuuccuuagcucuugguggacccccgaguccauuagauggcuggugcucagcggcaaguccucuaaagcgcugaagauccugcggcgcgucgccguuuuuaaugggaagaaagaggaaggagagagacucagccuggaggaacuuaagcugaaccuccagaaagagauuucccuggcuaaggccaaauacacggcuagcgaucuuuuccggauccccaugcugcgcagaaugacauuuugucucucucuggccugguucgccaccggcuuugcuuauuacucccuggcgauggggguggaagaguucggagugaaucucuacauucugcagaucaucuuuggcggggucgacgugccugccaaguucauuacaauccuuagccugucuuaucucggacggcacaccacccaagcugccgcccugcugcuugcuggcggcgccauucucgcgcugacauuuguuccgcuggaucuccagacggugagaaccguccuggcuguguucgggaagggaugccuuagcuccucuuuuagcugucuguuccucuacacauccgaacuguaucccaccguuauccgccagacaggcaugggggugagcaaccuguggacccgggucggaucuaugguguccccucuugucaaaauuacgggcgaggugcagcccuucaucccuaauaucauuuacgggaucacagcccuccugggcggaagcgccgcucuguuucuccccgaaacccugaaccaaccgcuuccugagaccauugaggaccuggaaaacuggucucucagagccaagaaacccaagcaggagccugaaguugagaaggcuucccagcgcaucccccugcaaccucauggccccgggcugggaagcuccuga

SEQ ID NO: 75687 - RNA, 1797 nt, Artificial Sequence
  derived and/or modified sequence opt5 from SLC23A1__Homo_sapiens__NP_005838
augagagcccaggaggaccuggaaggccggacccaacacgagacaacgcgcgaucccagcaccccucucccgacagaacccaaguucgacaugcuguacaaaaucgaggaugugccucccugguaucuuugcauucugcucggguuucagcauuaccugaccuguuucuccggaacaaucgcugucccuuuucuucuggccgaagcgcucugcguuggccacgaccagcauauggugucucagcugauugggaccaucuucacaugugugggaauuaccacgcugauccaaaccacagucggcaucagacucccccuguuucaggcuagcgccuucgccuuucuugugccugcuaaggccauucuggcucucgagcgguggaaaugcccgcccgaggaagagaucuaugggaacuggucccugccucuuaauaccucucacauuuggcauccccgcaucagagaaguucagggagccauuauggugagcuccgucguggagguugugaucggccugcucggccugccuggggcgcugcucaacuacauuggaccccugacagucaccccgacggugucucuuaucggccugagcguguuccaggccgcuggggaucgggccggaucccacuggggcaucagcgcuuguucuauucuccugaucauucuuuuuagccaauaucugcgcaaucucacauuccugcugccugucuacagaugggggaagggacucacccugcuucggauccagauuuuuaaaauguuccccaucaugcuggccaucaugacaguuuggcuccugugcuaugugcuuacccugaccgacgugcucccuacagaucccaaggcguacggcuuucaggcccgcacggacgcuagaggcgauauuauggccaucgcucccuggauucggaucccuuacccgugucagugggggcugcccaccgucacagccgccgcugugcugggaauguucagcgcgacccucgccggcauuaucgagucuaucggggacuauuacgcuugcgcccgccuggccggagcuccucccccucccguucacgccauuaacagaggcaucuucacagaagggauuuguugcaucauugcgggacuucugggcaccggcaauggguccacguccucuuccccgaacaucggagugcucggcauuacaaaggucgggagccggcgcgugguucaauauggagcugccaucaugcuggugcugggcaccaucgggaaauuuaccgcccuuuucgcuucccucccugaucccauucugggcggaauguuuuguacacuguucggcaugaucaccgccgucgggcucucuaaucugcaguuuguggacaugaacagcuccagaaaucuuuucguccugggauuuagcauguucuuuggccucacacugccuaacuaccuggagucuaaucccggggcuauuaacacgggaauccuugaaguggaucagauucucaucguucugcugaccacagagauguucgugggcgggugccucgccuuuauccuggacaauaccgucccuggcucccccgaggaacggggacuuauucaauggaaggcgggcgcccaugcuaacagcgacaugucuagcucccugaaaucuuaugauuucccgaucgggaugggaauugugaagagaaucacauuucucaaauacauuccuaucugccccguuuucaagggcuucagcuccagcucuaaggaccagaucgccauucccgaggauaccccugaaaauacggagaccgcuuccguguguacaaaagucuga

SEQ ID NO: 75688 - RNA, 1953 nt, Artificial Sequence
  derived and/or modified sequence opt5 from SLC23A2__Homo_sapiens__NP_005107
augaugggcaucgggaagaacaccacaagcaaauccauggaggccggaucuagcacggaaggcaaguacgaggacgaagcuaaacaccccgccuucuuuacccugccuguggucauuaaugggggagcgacauccucuggcgagcaggauaacgaagacaccgagcucauggcuaucuauacaaccgagaaugggauugccgaaaagagcucccuggccgagacacuugauucuaccggaagccuggacccgcaaagauccgauaugaucuacacgauugaagacguucccccuugguaucucugcaucuuccugggccuucagcauuaccugaccuguuuuagcggcacaaucgcugugcccuuccuccuggccgaugcuaugugcgugggguaugaccagugggccaccucucagcugauuggaacaaucuuuuucugugucggcauuaccacgcuccugcaaacaaccuuugggugccggcuuccucuguuccaggcguccgccuuugcuuuccucgcccccgcucgcgccauccugagccuugauaaauggaaguguaacacaaccgacgugucuguugcgaauggaaccgccgagcugcuccacacagagcauauuugguacccuagaauccgggaaauucagggcgcuaucaucauguccagccugauugagguggucaucgggcugcucggacugccgggcgcccuucugaaguauauuggcccccucacgaucaccccuacaguggcucugauugggcuuucuggauuucaggccgccggcgaacgcgcugggaaacacuggggaaucgcgaugcugaccaucuuccucguucugcuguuuucccaauacgccagaaacgugaaguucccccucccuauuuacaaaagcaagaaaggcuggacagcuuauaagcugcagcuuuucaagauguuucccaucauucuggccauccucgucuccuggcugcuuugcuucauuuuuaccgugacggauguguucccgccugacucuacaaaauacggguuuuaugcccggaccgaugcucgccagggaguccugcucguugcccccugguucaaggugccuuaccccuuucaguggggccugcccaccgugagcgcggcuggcgucaucgggaugcuguccgccgugguugccagcaucauugagucuaucggagacuauuacgcuugugccagacucuccugcgcuccuccgcccccuauucaugccaucaaucggggcauuuucguggaagggcugagcuguguccuugacggaaucuuuggcacagggaacggcucuaccagcuccucucccaauauuggagugcugggcaucacaaaaguugggagccgcagagugauccaaugcggagcggcccucaugcuggcucugggcaugauugggaaguucuccgcccuuuuugcuagccucccugaucccguccugggagcccuguucuguacgcucuuuggcaugaucaccgcgguggggcugucuaaccuucaguucauugaccucaauuccagccggaaccuguucguccugggcuuuucuaucuucuuuggacuggugcuuccguccuaucuccgccagaauccucugguuacaggcauuaccgggaucgaucaagugcugaacguccuccugacaaccgccauguucgugggaggcugcguugcuuuuauccuugacaauacgauucccgggaccccugaggagagaggaauccggaaauggaagaaaggcguggggaagggcaacaagagccuggauggaauggaauccuacaaccuccccuucggcaugaauauuaucaaaaaguaccgcugcuuuucuuaucugccuauuagccccacauucgucggguacaccuggaaaggacugagaaaguccgacaacucucggagcuccgaugaggacagccaggccacaggcuga

SEQ ID NO: 75689 - RNA, 3300 nt, Artificial Sequence
  derived and/or modified sequence opt5 from SLC24A1__Homo_sapiens__NP_004718
augggcaagcugaucagaauggggccccaggagcgguggcuccugcgcaccaaaagacuucacuggagccggcuccucuuccugcuuggaaugcugauuaucggcuccacauaccaacaucuccgcagaccucgggggcugucuagccugugggccgcuguguccucucaccagccgauuaagcucgccagccgcgaccuguccucugaagagaugaugaugaugagcuccagccccucuaaaccuuccagcgaaaugggaggcaagaugcuugucccccaggcgucuguuggguccgaugaggcuacgcugagcaugaccguggaaaacaucccuucuaugcccaaaagaacagccaagaugauuccuaccacaaccaagaauaacuauuccccgacagccgcuggaaccgagcggcgcaaagaggacacgcccaccagcuccagaacacucaccuacuauacaucuaccagcucccggcagaucgugaagaaauacacgccuacaccccgcggcgaaaugaaaagcuauucuccuacccaagucagagagaaggugaaguacacacccuccccgcggggccgcagaguugggaccuaugugccuagcaccuuuaugacaauggaaacgucucaugccaucacaccccggacaaccgucaaggauagcgacauuacagcuaccuacaaaauccuggagacaaauucccuuaagagaauuauggaggaaacgaccccuaccacacugaaaggaauguucgauucuacccccacauuucucacgcacgagguggaagccaacguucugaccagcccccgcuccgugauggagaagaauaaccuguucccuccgcggagagucgaaagcaauucuuccgcgcaucccuggggccucguggggaaaagcaacccuaagacaccccagggaaccgugcugcuucacaccccugccaccucugagggccaggucacgaucuccaccaugacagggagcucccccgcugagaccaaagccuuuacagcugccuggucucugcgcaauccgagcccucggaccuccguuucugcgauuaagacggcccccgcuaucguguggagacucgccaagaaaccuagcacagcucccuccaccagcacaaccccuaccgugcgcgccaagcugacaaugcagguccaccauugcgugguugugaaacccacgccggccaugcuuaccacaccuucucccucccugaccacagcucuccugcccgaggaacugagcccuucuccguccguccugcccccuagccugcccgaccuucacccuaagggagaauaucccccugaucuguucucuguggaggaacggagacaaggcuggguugugcuccaugucuuuggcaugauguacguguucgucgcgcuggccauugugugugacgaguacuuuguucccgcucuuggggugaucaccgauaaacugcagaucagcgaggacgucgccggagccacguucauggcugccggcggguccgcgccggaacucuuuacaagccugauuggaguguucaucucucacuccaacguuggcauugggaccaucgugggaagcgcugucuuuaauauucuguucgugaucgggaccugcucccucuucucucgcgagauccugaaccuuacaugguggccucuguuucgggaugugagcuucuauauucucgaccugaucaugcugauucucuuuuuccuugauucccugaucgccuggugggaaucucugcuccugcuucuggccuacgcuuuuuauguuuucaccaugaaguggaauaagcacauugaggucugggugaaagaacagcucagcagacgccccguggccaaggucauggcucuggaggaccuguccaaaccuggcgacggcgccaucgcgguggaugagcuucaggacaacaagaaacucaagcugcccucucugcucacacggggaagcuccagcacgucucugcauaauuccaccaucagaagcacaauuuaccaacuuaugcugcacucucucgauccgcugcgggaaguucgccuggccaaggagaaagaagaggagucccuuaaccagggcgcuagagcccagccucaagcuaaggccgaaagcaaacccgaggaagaggaaccugcgaagcuccccgccgugaccgucacacccgcuccugugccggacaucaaaggggaucagaaggagaaccccggaggccaggaggacguugccgaagcugagucuaccggggaaaugccuggcgaggaaggagagacggccggcgagggggaaaccgaggaaaaguccggaggcgagacacagcccgaaggggagggagagaccgaaacacaaggcaaaggggaggaaugugaggaugagaaugaagccgagggcaagggagacaacgaaggcgaggaugaaggggagauucaugcugaggacggagaaaugaaaggcaaugagggggaaaccgagagccaggaacuguccgcggagaaccacggagaggccaagaaugaugaaaaaggcguggaggacgggggcggaagcgacggcggggauucugaagaggaagaggaggaagaggaggaacaggaggaagaggaagaggaagaggagcaggaagaggaagaggaagaggaggaagaggaagaggaaaagggaaacgaggagccucugagccucgacuggcccgaaacacggcaaaaacaggcuaucuaucuguuucuucugccuauugucuucccgcucuggcugaccgugcccgauguuagacgccaggagucccggaaguuuuucguguuuacguuccugggcucuaucauguggauugccauguuuagcuaccuuauggucuggugggcccaucaggugggggaaacaaucggaaucuccgaggagauuaugggccucaccauccuggcugccgggaccucuauuccugaccugaucacaagcgugauugucgcgagaaagggccucggagauauggcuguuuccucuagcgugggcuccaauaucuucgacaucaccguggggcugcccgucccuuggcuucuguucagccucauuaacggacugcaacccgugccgguuucuuccaauggccuguuuugcgccaucgugcuucuguuccucaugcugcucuuugucauuagcucuaucgccuccuguaaauggcgcaugaacaagauucugggguucacgauguuucuucuguacuucguguuucucaucaucagcguuaugcuggaagauagaauuaucuccugcccugugucugucuga

SEQ ID NO: 75690 - RNA, 1986 nt, Artificial Sequence
  derived and/or modified sequence opt5 from SLC24A2__Homo_sapiens__XP_005251482
auggaccugcagcaaagcaccacaaucacgucccucgagaaguggugccuggaugaaucucuuagcggcuguagacggcacuacuccgugaaaaagaaacugaagcucauucgcguccuggggcuuuucaugggacugguugccaucucuaccgugagcuuuuccauuucugcuuucagcgagacagacacccaguccacaggcgaagccagcguggucucugggcccagaguggcgcagggauaucaucagcggacccuccuggaucugaacgacaaaauccucgauuacacaccucaaccgccccuguccaaggagggcgaaagcgaaaauucuaccgaccacgcucagggggauuauccuaaggacauuuuuagccuugaggaacgcagaaaaggagccaucauccugcauguuauuggcaugaucuacauguucauugcccucgcuaucgugugcgaugaguuuuucguccccagccugacggugauuaccgaaaagcucggcaucucugacgauguugccggggcuacauuuauggccgcgggaggcuccgccccugagcuguucaccagccucauugggguguuuaucgcucacuccaacgucggaaucggcacaauuguggggucugccguguucaauauccuguuugucauuggaaugugugcucuguucagccgggagauccucaaccugaccugguggccccuuuuucgcgacguuuccuucuauauuguggaucugaucaugcucaucauuuucuuucuggacaaugugaucauguggugggaaagccuucugcuccugacggccuacuucugcuaugucguguuuaugaaauucaacguucagguggagaagugggucaaacagaugauuaauagaaacaaggugguuaaggugacagcgccugaagcccaagcuaaaccgucugccgcucgggacaaggaugagcccacccugccugccaaaccccgccuccagagaggcggcuccagcgccucucugcauaauagccuuaugcggaacuccaucuuucagcugaugauucacacacucgacccucuggcugaggagcuugggucuuacggaaagcugaaauacuaugauaccaugaccgaggaaggccgcuucagagagaaggcgagcauccuccacaaaaucgccaagaagaaaugucaugucgacgaaaaugagcggcagaacggggcugccaaucacguggaaaagauugagcugcccaacuccacaagcacggaugucgagaugaccccgucuuccgacgccagcgaaccugugcaaaauggaaaccugucucauaacaucgagggcgcugaagcccagacagcggaugaggaagaggaccagccccucucccuggcuuggccuagcgagacccgcaaacaaguuacauuucuuauuguguuccccaucgucuuuccccuguggauuacccucccugaugugagaaagccguccucucggaaauucuuucccaucacguucuuugggagcauuacauggaucgccguuuucuccuaccugaugguguggugggcccaccaggucggagaaaccaucggcauuucugaggaaaucaugggccugaccauucuugcugccgggacaagcaucccugaccucauuaccuccgugaucguggcuagaaagggacugggcgauauggccguuuccucuuccgucgggagcaauaucuucgacauuacagugggacugccccucccuuggcugcuuuauacggugauccaccgcuuucagcccgucgcggugucuuccaacggccuguucugcgccauuguucuccuguuuaucaugcugcuuuucgugauucucagcaucgcucuguguaaguggcggaugaauaaaauccugggguuuauuauguucggccucuacuuugucuuccuggugguuucugugcuucuggaggacagaauccuuaccugcccggucagcauuuga

SEQ ID NO: 75691 - RNA, 1935 nt, Artificial Sequence
  derived and/or modified sequence opt5 from SLC24A3__Homo_sapiens__NP_065740
augagacccagcggcgacgaggaucgggcccgcagacggcgcagacggcgcagacggcgcgaccugcuccugucccagcuuugcuuccuggcuucuguggcccuccugcuuuggagccuguccucucucagagaacaaaaggagcuggaucugauggaccucgucggggaagaucggaaauggaugauggcgcgcaagcugaugcagguuaacgacacccuuacaagcgaggaugcuggacugagaaauuccaaaaacuguacggaaccugcccuccacgaguuuccgaaugacaucuucaccaacgaggaucggcgccagggcgccguggugcugcauguccuuugcgcuauuuacauguuuuaugcccuggcuaucgugugugacgauuucuuuguucccucucucgaaaagauuugcgagagacugcaccugagcgaagacguggccggggcgacauucauggccgcuggauccagcgccccugagcucuuuaccucugucaucggcguguucauuacaaaaggggauguuggagugggcaccaucgucggcuccgcuguguuuaauauccuguguauuaucggggugugcggacuuuucgccggccaggucguugcgcugagcucuuggugucuccugcgggacuccauuuacuauacacuuagcgugaucgcccugauuguguuuaucuacgacgagaaggucucuuggugggaaucccucgugcugguucugauguaucucauuuacaucgugaucaugaaguauaacgcuugcauucaucaauguuucgagagacgcaccaaaggggccggaaauauggucaacggccuggcuaauaacgccgaaaucgaugacagcuccaauugcgaugccacggugguucuucugaagaaagcuaacuuucaccggaaggcgucugugauuauggucgacgagcuccugagcgccuacccccaucagcuuuccuucagcgaagcugggcugagaaucaugauuaccucucacuucccucccaaaacacgccucuccauggccagccggaugcugaucaaugagagacagcgccugaucaacucucgggccuacaccaauggagagagcgaaguggcuauuaagaucccuauuaagcacacagucgagaacggcaccggcccguccucugcccccgauagaggggugaacggaacgcgccgggacgauguuguggcggaagcuggcaaugagacagaaaacgagaaugaggacaacgaaaaugaugaggaagaggaagaggacgaggaugacgacgaagggccuuauacccccuuugauacaccuagcggaaaacucgagaccgucaagugggccuucaccuggccccuguccuuugugcuuuacuucacaguuccgaacuguaauaaaccuagaugggaaaagugguuuauggugacguucgccagcucuacccuguggaucgcugccuuuuccuauaugauggucuggauggugacaauuaucggcuacacccucgggauccccgacgugauuaugggaaucacauuccuggcugccggcaccagcguuccugauugcauggcgucucugauugucgcccgccagggcaugggggacauggcuguguccaacagcaucggauccaauguguuugauauucuuaucggccucgggcugcccugggcccugcaaacgcucgcugucgacuauggaucuuacauucggcugaacagcagaggccuuaucuauuccguggggcugcuccuggccucuguuuucgugacagucuuuggcgugcaucugaauaaauggcagcuugauaagaaacucggaugcggcugucugcugcucuacgggguuuuccugugcuuuagcaucaugaccgaguucaacguguucaccuuugucaaucuucccauguguggagaccacuga

SEQ ID NO: 75692 - RNA, 1869 nt, Artificial Sequence
  derived and/or modified sequence opt5 from SLC24A4__Homo_sapiens__NP_705932
auggcccugagaggcacccuccggccccugaaggugcgcagacggcgcgagaugcuuccucagcaagucggguucguuugcgcugugcuggcccucguguguugcgcgagcggacuguuuggcucccuugggcacaaaacagcuucugccagcaagagaguccugccggacacguggcggaaccgcaaacucauggcccccgugaauggaacccagacagcuaagaacuguaccgauccugccauccaugaguuccccacagaccuguuuuccaauaaagaaagacagcacggcgcuguucugcuccauauucugggggcccuuuacauguucuaugcgcuggccaucgugugcgaugacuuuuucgucccuucucucgaaaagauuugugagcggcugcaccuuagcgaagauguggcuggagccaccuuuauggcugccggcuccucuacacccgagcuguucgcgagcguuaucggcguguuuauuacccauggggacgucggagugggcacgaucgugggguccgccgucuucaacauccucugcauuaucggaguuuguggccuguuugcuggacagguggugcgccugaccuggugggccgucugcagagauagcguguacuauacaauuucuguuaucgugcucauugucuucaucuacgacgagcaaauuguguggugggaagggcugguucuuaucauccuguauguguuuuacauucucaucaugaaguauaaugucaaaaugcaggcuuucuucaccgugaagcagaaauccauugccaacggcaauccugucaacagcgagcuggaagccggcaaugauuuuuacgacgggucuuacgaugacccguccgugccccuucugggacagguuaaggagaaaccucaauauggcaagaaccccguggucaugguggaugagaucaugucuagcuccccucccaaguucacauuuccggaagcugggcuccggauuaugaucaccaauaaauucggaccucgcacgagacugcggauggcgagccgcaucauuaucaacgagagacagcggcugauuaauuccgccaacggcguuucuagcaagccccuccagaaugggagacacgaaaacaucgagaacggaaaugugccugucgaaaaccccgaggacccccagcaaaaucaggagcagcaaccuccgccccagccucccccucccgaaccggagccuguggaagcugacuuucugucccccuucagcgugccugaggcccgcggcgauaaaguuaagugggucuuuacauggccccuuauuuuccugcucugugugaccaucccuaacugcucuaaaccccggugggaaaaguuuuucauggugacauuuaucaccgccacccuguggauugcugucuucuccuacaucaugguguggcuuguuacaauuaucggcuauacgcuggggauuccggacgugaucaugggaauuaccuuucucgccgcgggcacaagcgucccugauuguauggcuucucugaucguggccagacaggggcugggagacauggccguuagcaauaccaucggcuccaacguguucgauauucucgucgggcugggcgugcccuggggacuucagacaaugguugugaauuacggcucuaccgucaaaaucaacagccgcgggcugguguauuccgugguccuccugcugggaagcguugcucuuacggugcucggcauucaccugaauaaguggcggcuggacagaaagcucgggguguacguccuggugcuuuaugccaucuuccugugcuuuucuauuaugaucgaguucaacguuuuuacauucgugaaucuccccaugugccgcgaggaugacuga

SEQ ID NO: 75693 - RNA, 1503 nt, Artificial Sequence
  derived and/or modified sequence opt5 from SLC24A5__Homo_sapiens__NP_995322
augcagaccaagggcgggcaaacaugggccagacgggcucugcuccugggaauccuuugggccacggcgcaucugccccucagcggcaccucccugccucagcgccuuccgagagcuacagggaacucuacccagugcgugauuagccccuccucugaguucccugaaggauuuuucacacggcaggagcgcagagacggcgggaucauuaucuacuuucugauuaucgucuauauguucauggccaucagcauuguuugugaugaauacuuucuccccucccuggagaucauuucugaaagccugggacucucccaagacguggccggcaccacauucauggcugccggcagcucugcuccugagcuggugaccgccuuucuuggggucuucaucacgaaaggagauauuggcaucuccaccauucuggggagcgcgaucuauaaucuccugggaaucugcgccgcuuguggccuucugucuaacacaguguccacccucagcugcuggccccuguuucgggacugugccgcuuacacaauuucugccgcggccguucuggggaucauuuaugauaaucagguguacugguaugagggagcucuccugcuucugaucuacggccucuacguccuggugcuuugcuucgacauuaagaucaaccaguauaucauuaaaaaguguuccccuugcugugccugccuggcuaaagccauggaacgcagcgagcagcaaccgcucaugggcugggaagaugaggggcagcccuuuaucagacggcagucccgcaccgacucuggaauuuucuacgaggauagcggcuauucccagcugagcaucucucugcacgggcucucccaaguuagcgaagacccucccucuguguuuaauaugccugaggccgaucugaagagaauuuucuggguccuuagccugcccaucaucacgcuccuguuccuuacaaccccggacugucggaagaaauuuuggaagaacuacuucgugauuacauuuuucauguccgcuaucuggauuucugcguuuaccuauauccugguguggauggucaccauuacaggagaaacgcucgagaucccugauaccguuaugggccugacacugcucgccgcugggaccagcauucccgacacaaucgccuccgugcugguggcccgcaaaggaaagggcgacauggcuaugagcaauaucgucggcucuaacguguucgauaugcuuugccuggggauuccuugguuuaucaaaaccgccuucauuaauggauccgcgcccgcugaaguuaacagcagaggccucacguacaucacaauuucucugaauaucuccaucauuuuucuguuccuugccgugcacuuuaacggguggaagcucgaccggaagcugggaaucgucugccugcucagcuaucugggccuugccacccuguccgugcucuacgagcuggggauuaucggcaauaacaaaauucgcggauguggcggguga

SEQ ID NO: 75694 - RNA, 891 nt, Artificial Sequence
  derived and/or modified sequence opt5 from SLC25A10__Homo_sapiens__NP_001257817
auggccgcugaggccagagugagccggugguacuucggcgggcuggcguccugcggagcugccuguugcacccacccccucgaccugcuuaagguccaucugcagacacaacaggaaguuaaacuccgcaugacgggcauggcccugagaguggugcggaccgaugggauccuugcucuguauucuggacucagcgccucccugugucgccagaugacauacucucugaccagauuugcuauuuaugagacaguccgggaccgcguggccaagggcagccaggggccucucccguuccacgaaaaaguucugcuuggauccgugucuggccuggcgggcggguuugucggaacccccgccgaucucgugaacguuagaaugcaaaaugacgugaagcugccucagggccagcggcgcaacuacgcucaugcccuugaugggcuguauagagucgcucgggaggaaggacuccgcagacuguucagcggcgccacaauggcguccagccgcggggcccuggugaccgugggacagcucucuugcuacgaccaagcuaaacagcugguccuuuccacgggcuaucugagcgauaauaucuuuacccacuucguugccucuuuuauugcugccgccggcgacgagcccccuccccaagggggaugugcuacauuccucugccagccucuggaugugcuuaagacccggcugaugaacuccaagggcgaguaccaggggguguuucauugugcggucgaaacagccaaacucggaccgcuggcuuucuacaagggccuggugcccgccgggaucagacucauuccucacaccguucugacguuuguguuccuugagcagcugcggaaaaauuuuggaaucaagguccccagcuga

SEQ ID NO: 75695 - RNA, 2037 nt, Artificial Sequence
  derived and/or modified sequence opt5 from SLC25A12__Homo_sapiens__NP_003696
auggccgugaagguccagaccacaaaaagaggcgacccccacgagcugcggaacaucuuccuccaauacgcuagcacggaaguugauggggagcgcuauaugaccccugaagacuuugugcagagauaccugggacuuuauaaugauccgaacuccaaucccaagauugugcagcugcucgccggcgucgcggaccagacaaaagaugggcugaucucuuaccaagaguuccuugcuuuugaaagcgugcugugcgccccugacuccauguucauuguugccuuucagcuguucgauaagucuggaaacggcgaggugaccuuugagaaugucaaagaaaucuucgggcagacaauuauccaucaccauauccccuuuaacugggacugugaguucauucggcugcacuuuggacauaaucgcaagaagcaccugaacuauaccgaguucacacaguuucuccaagaacugcagcuugagcacgcuagacaggccuucgcucugaaagauaagagcaaauccggcaugaucucuggccucgacuucagcgauauuauggugaccauccggucccauaugcugacgccuuuuguugaagagaaucuugugagcgccgccgggggaucuauuucccaccaggucagcuucucuuacuuuaacgcguucaauucccugcucaacaauauggaacuggugcgcaagaucuauagcacccuggcuggcacaagaaaagacguggaggucaccaaggaagaguuugcccaaucugcuauucgguacgggcagguuacaccccucgagaucgauauccuguaccagcuugccgaccuguauaacgcguccggacgccucacccuggccgacauugaaagaaucgcuccucuugccgagggcgcucugccguacaaucucgccgaacugcaacggcagcagagccccgggcugggacgcccuauuuggcuccagaucgccgaguccgcuuauagauucacgcugggcucuguggcgggcgccgugggggcuacagccgucuaccccauugaucuugugaagacccggaugcaaaaccagcgcggaagcggcuccguugugggggaacugauguauaaaaacagcuuugacugcuucaagaaaguccucagauacgagggauuuuucggccuguaucgggggcuuaucccucagcugaucggaguggcccccgagaaggcuauuaaacucacaguuaaugauuuugugagagacaaguucacccgccgggauggcucugucccgcugccugccgaagugcuggcgggcgggugugcuggaggcucccaggucaucuuuaccaacccccucgagauugugaaaaucagacugcaaguugccggggaaauuacaacgggaccucgcgugagcgcccuuaauguccugcgggaccucggcaucuucgggcuguacaagggcgcuaaggccugcuuccugagagauauccccuuuucugcuauuuacuuccccguguaugcccauuguaaacuucuccuggcggacgagaacggacacguuggcgggcugaaucuccuggccgcuggagccauggcuggcgugccugccgcgagccuugucaccccggccgaugugaucaagacacgccuccagguggcugcccgggcugggcagaccacauacuccggaguuauugacugcuuuagaaaaauccuccgcgaagagggccccucugccuucuggaaggggaccgccgcucgggucuuuagaagcuccccucaguucggcgugacgcuggugacauaugagcugcuucaacgcugguuuuacauugauuucggaggccucaaacccgcggggagcgaaccuacccccaagucucggaucgccgaccugccgccugcuaaccccgaccacauuggaggcuauagacuggccaccgccacauuugcugggaucgagaauaaguucggacucuaccugccuaaauuuaagucccccagcgucgccgugguucagccuaaagcggcuguggccgccacccaguga

SEQ ID NO: 75696 - RNA, 2031 nt, Artificial Sequence
  derived and/or modified sequence opt5 from SLC25A13__Homo_sapiens__NP_001153682
auggccgcugccaagguggcgcugaccaaaagagcugaccccgccgagcuccggacaaucuuccugaaguacgccagcauugagaaaaacggcgaauuuuucauguccccuaaugauuuugucacgcgcuaucuuaacaucuucggggaaucucagccgaaucccaagaccguugagcugcucagcggagugguggaccaaacaaaagauggccugauuuccuuucaggaguucgucgcuuuugaaucugugcuuugcgccccugacgcucuguucaugguugccuuucagcuguucgauaaggcggggaagggagaggugaccuuugaagacgucaaacagguguucggccaaacaaccauccaccagcauauucccuuuaacugggauagcgaguucguucagcugcacuucgggaaggaaagaaaacggcaucugacauacgccgaguuuacccaguuccuccuggagauccaacuugaacacgcuaagcaggccuuugugcagcgcgacaaugcuagaacgggacgggucaccgccaucgauuuccgcgacauuauggugacaaucagaccucaugugcugacccccuuugucgaggaaugucucguugcggccgcuggcggcacaaccucccaccaggugucuuucagcuauuuuaacggguucaauucccugcuuaacaauauggagcugauucggaaaaucuacagcacgcucgccggaacacgcaaggauguggaagucaccaaggaggaguuugugcuggcugcccaaaaauucggccagguuacaccuauggaaguggacauucuguuucagcucgccgaucuguaugagccgagagggcggaugacccuugcugacaucgaacgcauugcgccccuggaggaaggaacccucccuuucaaccuggccgaggcucaaagacagcagaaggccucuggcgacuccgcccggcccguccuucuccagguggcugagagcgccuaccgcuuugggcucggaucuguugcgggcgcugugggcgccacagccgucuauccuaucgaucuggugaaaacgagaaugcaaaaucagcgguccaccgggagcuucgucggagaacugauguacaagaacucuuucgacugcuuuaaaaaggugcucagauacgagggcuucuuugggcuguaucgcggacuucugccccagcuccugggcguugcuccggaaaaagccaucaaacuuacagugaaugauuucguccgggacaaguuuaugcacaaagauggguccgugccucuggcugccgagauucucgcgggaggcugugccggcgggagccagguuaucuucaccaacccccuggaaauugugaagaucagacugcaagucgcuggagagauuacaaccggcccucgcguguccgcccucucugugguucgggaccugggguuuuucggaaucuacaaaggcgcuaaggccugcuuucuuagagauauccccuucagcgcgauuuauuuucccuguuacgcccaugucaaggcuuccuucgccaaugaggacggccaggugagcccugggucucugcuccuggcuggagccaucgccggcaugccggcugcgucccuggugacgcccgccgaugucauuaagacacgccuucagguggcugcccgggccgggcagaccaccuauagcggaguuaucgacugcuuuagaaagauucuccgcgaagagggcccuaaagcucuguggaagggggccggagcgcggguguucagaucuagcccccaauucggcgucacacugcucaccuacgaacugcuucagcgcugguuuuauaucgauuucgggggcgugaaaccuaugggauccgagcccguuccgaagucucggaucaaccugccugcucccaacccugaccacgugggcggguacaaacucgccgucgccacauuugcuggaauugagaauaaguucggccuguaccugccccuuuuuaagccuagcguguccacgagcaaagccaucgggggaggccccuga

SEQ ID NO: 75697 - RNA, 978 nt, Artificial Sequence
  derived and/or modified sequence opt5 from SLC25A14__Homo_sapiens__NP_001269124
augggcaucuuccccgggauuauccugauuuuucucagagugaaguucgccaccgcugccgucaucguuagcggacaccagaaauccacaacggugucucaugagaugagcggccugaacuggaagccuuuuguguacgggggacuugcguccauugucgcugaguucggcaccuuuccgguggaccugacaaaaacccggcuccaaguucaggggcagucuaucgaugcccgcuucaaggaaaucaaauauagaggaauguuucacgcccuguuccggauuugcaaggaagagggcgugcuugcucuguacagcggcaucgcccccgcucuccugcgccaggccuccuaugggacaauuaagaucggaauuuaccaaucucugaaaagacucuuugucgaacggcuggaggacgagacccuucugaucaauaugauuuguggcgugguuagcggggugaucuccagcacaaucgcgaacccuaccgauguccucaagauucgcaugcaggcccagggaucucuguuccagggcuccaugaucgggagcuuuauugacaucuaucaacaggaaggaacgagaggccuuuggcggggcguggugcccaccgcucagcgcgccgcuauugucguugggguggagcugccuguguacgauaucaccaaaaagcaucucauccugucuggaaugaugggcgacacaauucugacacacuucgucuccagcuuuaccugcgggcucgccggagcgcuggccucuaaucccguggauguugugagaacgcggaugaugaaccagcgcgcuaucgucggccauguggaccuuuauaaagggacaguugauggcauucugaagauguggaagcacgaaggauucuucgcccucuacaaaggcuuuuggccuaauuggcugagacuugggccguggaacaucauuuucuuuaucaccuacgagcaacugaagcggcuccagaucuga

SEQ ID NO: 75698 - RNA, 906 nt, Artificial Sequence
  derived and/or modified sequence opt5 from SLC25A15__Homo_sapiens__NP_055067
augaaaagcaaccccgccauccaggcugccauugaccugaccgcgggcgcugccgggggaacagccugcgugcucacgggccaaccuuucgauaccaugaaggucaagaugcagacauuuccggaccuguacagagggcuuaccgauuguugccugaaaacauauucccagguuggauuccggggcuuuuacaaggggaccucucccgcucucaucgccaauauugcugagaacagcgugcuguucauguguuauggauuuugccagcaagugguccgcaaaguggccggccuugacaagcaggcgaagcuguccgaucuccagaaugccgcugccggcucuuucgcuagcgccuuugcggcccugguucuguguccuacagaacucgugaaaugcagacugcagaccauguacgagauggaaacguccgggaagaucgcuaaaucucaaaacaccgucuggagcgugauuaaguccauccuucggaaagacggaccccugggcuucuaucacgggcucagcucuacacugcuucgcgagguuccuggauacuuuuucuuuuucggcggguaugaacugucccggagcuuuuucgccucuggaagauccaaggaugagcucggccccgugccucugaugcugagcggcggggucggaggcaucugucucuggcuggcuguguacccgguggacugcauuaagucucgcauccagguccuuuccaugagcgggaaacaggccggauucauuagaaccuuuaucaauguugugaagaacgagggcauuacagcccuguacuccgggcucaaacccaccaugauccgggcuuucccugcgaauggagcccuguuucuugcuuaugaauacucucgcaagcugaugaugaaccagcucgaggccuauuga

SEQ ID NO: 75699 - RNA, 705 nt, Artificial Sequence
  derived and/or modified sequence opt5 from SLC25A16__Homo_sapiens__XP_006718050
augaugaucagaauuuuccccuacggcgccauccaguuuauggcuuucgagcacuauaagacccugauuacaacgaaacucgggaucagcggacaugugcaccggcugauggccggcuccauggcggggaugaccgcugucauuugcacauacccucuugacaugguucgcgugagacuggccuuucaagugaagggagaacauucuuauaccggcaucauccacgccuucaaaacaauuuacgcuaaggaagggggauuuuucggcuuuuaucggggccucaugccgaccauccuggggauggcccccuacgcuggagucagcuucuuuacauucggcacccuuaaauccguggggcugucucaugccccuacgcuccugggacgccccagcuccgauaacccuaauguucuggugcucaagacccacgucaaccugcuuuguggcgggguggcgggagccauugcucagacaaucucuuaucccuuugacguuaccagacggcgcaugcagcugggcacagugcucccugaguucgagaagugccugaccaugagagauacgaugaaauacgucuacggccaccaugggauucggaagggacuuuaucgcggccugagccucaauuacaucagauguauuccgucccaggccguggcuuuuacaaccuaugaacugaugaaacaauucuuccaccugaacuga

SEQ ID NO: 75700 - RNA, 948 nt, Artificial Sequence
  derived and/or modified sequence opt5 from SLC25A18__Homo_sapiens__NP_001290413
augacccaccaggaccugagcaucacagccaagcucauuaacggcgggguggcuggacuggucggcguuacgugcguguuccccaucgaucuugccaaaaccagacugcaaaaucagcaugggaaggcgauguacaaaggaaugauugacugucucaugaagacagcucgggccgagggcuuuuucgggauguaucgcggagccgcugugaaccugacccuugucacaccugaaaaagccaucaagcuggcugccaaugauuucuucagacggcuccugauggaggacggcaugcagcgcaaccugaagauggaaaugcucgcgggcugcggggccggaaugugucaggugguugugaccugcccgauggagaugcugaaaauucaacuucaggaugcuggcagacuggccguccaccaucagggguccgcuucugcccccagcacaucccggucuuacaccacgggaagcgcguccacccaccgcagaccuucugccacacucaucgcuugggaacugcuucggacccagggccuggccgggcucuaucgcggacugggcgcuacacugcucagagacauccccuuuagcauuaucuacuucccucuguuugccaaucuuaacaaucugggcuucaacgagcucgccgggaaggcuuccuuugcgcauagcuucgugucuggauguguugccggcuccauugcugccguggccgucacgccccuggaugugcuuaaaacccggauccaaacacugaagaaagggcucggagaggacauguauagcggcauuaccgauugcgcucgcaagcuguggauccaggaagggccuucugccuuuaugaagggagcgggcuguagagcucuggugauugccccgcucuuuggcaucgcccagggggucuacuuuaucggaauuggcgagcggauccugaaaugcuucgacuga

SEQ ID NO: 75701 - RNA, 963 nt, Artificial Sequence
  derived and/or modified sequence opt5 from SLC25A19__Homo_sapiens__XP_006722070
auggugggcuacgaccccaagccugaugggagaaacaauaccaaauuccaggucgccguugcuggaagcguguccggccuggugacacgggcccucaucucuccguuugacgucauuaagauccgcuuccaacugcagcacgagagacuuagccgguccgaucccucugcgaaauaucaugggauucugcaggcuagccgccagauccuccaagaagagggaccuacggccuuuuggaagggccacgugcccgcccagauucuguccaucggguacggagcuguucaguuccuuucuuuugaaaugcugaccgagcucgugcauagaggcagcgucuaugacgcccgggaguucuccgugcacuuuguuugcggcgggcuggcugccuguauggcgacacugaccgugcauccugucgaugugcuccgcacaagauucgccgcucagggagaacccaaaguguacaacacccugcggcacgccgucggcacaauguaucgcagcgaggggccucaaguguuuuacaagggacuugcuccgacccugaucgccauuuuccccuaugcgggccuccaguuuucuugcuacuccagccugaagcaccuuuacaaaugggccaucccugcugaagggaagaaaaaugagaaccugcagaaucuccuguguggaucuggcgccggcgugauuuccaagacgcugaccuauccccucgaccuguucaaaaagagacuucagguugggggauuugaacaugcucgggccgccuucggccaaguccgcagauacaaggggcugauggauugcgcuaaacaggugcuccagaaggagggagcgcugggcuucuuuaaagggcuuagcccuucucugcucaaggccgcucuguccacaggauucauguuuuucagcuaugaguuuuucuguaacguuuuucacugcaugaaucggaccgccucccaacgcuga

SEQ ID NO: 75702 - RNA, 957 nt, Artificial Sequence
  derived and/or modified sequence opt5 from SLC25A1__Homo_sapiens__NP_001243463
auguuccccgccgcucuggccagacggccucgcagacccaagagcggcaccggggagggacccgaacggcagcgcccuggcgggucccucagaucuggauuucccgugccugcgggcgggcuggcuggaggcaucgagauuugcaucacauuccccacggaauacgucaaaacccaacuucagcuggacgagcggagccacccuccgcgcuauagaggcauuggggauuguguucggcagacagugcgcucccauggagugcucggccuguacagagggcuuucuagccugcucuauggauccauccccaaggccgccguccgguuuggcauguucgaauuucugucuaaccacaugcgcgacgcucaggggagacuggauagcacccggggacuccugugcggccuuggcgccgggguggcugaggccguuguggucguguguccuauggagacaauuaaaguuaaguucauccaugaccaaaccucccccaauccuaaauaccgcggauuuuuccacggcgugagagaaaucguccgggagcaggggcugaagggaacauaucagggccucaccgcgacggugcugaagcaggggagcaaccaagccauuagauuuuucgugaugaccucucuucgcaauugguaccggggagauaaccccaauaaaccgaugaacccucugaucacaggcgucuuuggcgcuauugccggggcugccuccguuuucggaaauaccccgcucgacgugaucaagacaagaaugcagggccuggaagcgcauaaauaucgcaacaccugggauugcgggcugcagauucucaagaaagagggacugaaggccuuuuacaagggcacggugccucggcuugggagagucugucuggacguggcuaucguuuucgugauuuacgaugaggucgugaaacuccugaauaagguuuggaaaacagacuga

SEQ ID NO: 75703 - RNA, 906 nt, Artificial Sequence
  derived and/or modified sequence opt5 from SLC25A20__Homo_sapiens__NP_000378
auggccgaccagcccaagccuaucagcccgcugaaaaaccuccuggcuggcggguucggaggcgugugccuugucuuuguugggcacccccuggauaccgugaaggugagacuccaaacacagccucccucccugccuggacagcccccuauguacucuggcacguucgacuguuuucggaaaacccuuuuccgcgaggggauuacaggacuguauagaggcauggccgcgccgaucauuggcgucacccccauguuugcugugugcuucuuuggguucggacucggcaagaaacugcagcaaaagcauccugaagauguucugagcuacccccagcucuuugccgccgggaugcuguccggaguguucacaaccggcaucaugacaccuggggagcggauuaagugucuucugcagauccaggcuucuagcggagaauccaaauauaccggcacgcucgacugcgccaagaaacuguaccaagaguuuggcauccgcgggauuuauaagggaaccguccuuacacugaugagagaugugcccgcuucuggcauguacuucaugaccuaugaauggcucaaaaauaucuuuacaccggaggggaagcggguuagcgagcuguccgccccucgcauucugguggcgggaggcaucgccgggauuuucaacugggcugucgccauucccccugacgugcucaagagcagauuccagaccgcuccucccggaaaauaccccaauggcuuucgggaugugcugcgcgaacuuaucagagacgagggcgucacgucucuguacaagggguucaacgccguuaugauccgggcguuuccggccaaugcugccuguuuccucggauuugaaguggcuaugaaauuccugaacugggccacacccaaucuuuga

SEQ ID NO: 75704 - RNA, 897 nt, Artificial Sequence
  derived and/or modified sequence opt5 from SLC25A21__Homo_sapiens__NP_001164641
augagcgccaagcccgaggugucccuggucagagaggcuucucggcagaucguugccggcgggagcgcgggacucguggaaauuugccugaugcacccucuugacguggucaaaacccgcuuccaaauccagagaugugcuacagauccgaacuccuacaagucucugguggacagcuuucggaugauuuuccagauggaaggccucuuuggguucuauaaaggaauccugcccccuauucuugccgagacgcccaagcgcgccguuaaauuuuucaccuuugaacaguacaagaagcugcucggcuaugugucccugucuccugcucugacauucgccaucgcugggcucggaagcggccugaccgaggccaucgucgugaaucccuuugagguugugaaagucggccuucaagcgaacagaaauacauucgccgaacagccuuccaccgugggguacgcucggcagauuaucaagaaagagggauggggccugcaggggcucaacaagggacugacagccacccuuggccgccaugggguguuuaauauggucuauuucggauuuuacuauaacguuaaaaauaugauuccggugaacaaggaucccauccuggaguucuggagaaaguucggcauuggccuccugagcgggacgaucgcuucugugauuaauaucccuuuugacgucgccaaaucccggauccaaggaccccagccugugcccggcgaaauuaaguacagaaccugcuucaaaacaauggcgaccguuuaccaggaggaagggauccuggcccucuauaagggacugcuuccgaaaauuaugcgccugggcccugggggagcugugaugcuccuggucuacgaguauacauacagcuggcuucaggaaaacuga

SEQ ID NO: 75705 - RNA, 972 nt, Artificial Sequence
  derived and/or modified sequence opt5 from SLC25A22__Homo_sapiens__XP_011518673
auggccgacaagcagaucagccugcccgcuaaacucauuaacggcgggaucgccggacugauuggcgugaccugcgucuucccuaucgaucuugcgaagacaagacugcaaaaucagcagaacgggcagcggguuuacacguccaugucugacugucucauuaaaaccgugcgcagcgagggauauuuuggcauguacagaggggcugccgugaaucugacacuugucaccccggaaaaggccaucaaacuggcugccaacgauuucuuucggcaccaacucuccaaggacggacagaagcugacacugcucaaagagaugcuggcuggcugcggcgccgggaccugucaggugaucguuacaacccccauggaaaugcuuaagauucagcugcaagaugcgggacgcaucgccgcucagagaaaaauucucgccgcucagggccagcugucugcccaagggggagcgcagccuagcguggaggcccccgcugccccucggcccacggcuacccagcuuacacgcgaccugcucagaucccggggcaucgccgggcuguauaagggacugggcgccacccuccugcgcgaugucccuuucucugugguuuacuuuccgcuuuucgcuaaucugaaccaacucggcagacccgcgagcgaagagaaauccccuuuuuaugugagcuuccuggccgggugcgucgcuggaucugccgccgcuguggccgugaaucccugugacgucguuaagacacggcuucagucccugcagcgcggcgugaacgaggauaccuacagcgggauucucgacugcgcgagaaagauccugcggcaugaaggaccuucugcuuuucugaaaggcgccuauugucgcgcccucgugauugcuccccuguucgggaucgcccaggucguguacuuucuuggaaucgcugagucccugcucggccugcuucaagauccgcaggccuga

SEQ ID NO: 75706 - RNA, 1407 nt, Artificial Sequence
  derived and/or modified sequence opt5 from SLC25A23__Homo_sapiens__NP_077008
augagaggcagccccggggacgccgagcggcgccagagauggggacggcuguucgaggaacucgauuccaacaaggacggccgcguggauguccacgaacugagacaagggcuugcucggcugggaggcgggaauccugacccgggagcccagcagggcaucucuagcgagggcgaugcggaccccgaugggggacucgaccuggaagaguuuucccgcuaccuucaggagagagaacaacggcugcuccugauguuccauucucuggaucgcaaccaggacggccacauugauguuagcgagauccagcaguccuuuagagcucucgggauuucuaucagccuggaacaagccgagaaaauucuucauuccauggaccgggauggaaccaugacaaucgacuggcaggaguggcgcgaccacuuccugcuccauagccuggaaaauguggaggaugugcuuuauuuuuggaagcacucuacgguccuggacaucggcgaaugccucaccgugccugaugaguucuccaaacaggaaaagcugacagggaugugguggaaacagcugguugccggagcuguggccggcgcugucagcagaaccggcacagcgccccucgaccggcugaagguguuuaugcaaguucacgccucuaagaccaaccgccuuaauauucucgggggacugagauccauggugcuggagggcgggauccggagccuuuggagaggaaacggcauuaauguccugaaaaucgccccugagucugcuauuaaguucauggccuacgaacagaucaaacgcgcuauucucgggcagcaagagacacugcaugugcaggaacgguuuguggccggaucccuggcgggcgccaccgcucagacgaucaucuaucccauggagguccucaagaccagacugacacuucgccggaccggccaguacaaagggcugcucgauugugccagacgcauucuggaacgggagggaccuagagcuuucuaucgcggcuaccuuccgaacguucuggggaucauucccuaugccggaaucgaccucgccguguacgagacacugaagaauugguggcugcaacaguacagccacgauuccgcugacccuggcauucucgugcugcuugcgugcgggaccaucucuagcacguguggccagaucgccuccuauccccuggcucucguccggacaagaaugcaggcccaagccagcauugaaggaggcccucagcugucuaugcuggggcuucuccgccauauccugucccaggagggaaugcggggccuguacagagggauugcucccaacuuuaugaaggugaucccggccguuagcauuucuuauguggucuacgaaaauaugaaacaggcgcucggagugaccagccgguga

SEQ ID NO: 75707 - RNA, 1512 nt, Artificial Sequence
  derived and/or modified sequence opt5 from SLC25A25__Homo_sapiens__NP_001006642
auggugagcuccguccugugcagauguguugccucucccccuccggacgcugccgcgaccgcugccagcuccucugccagcucccccgcuucugugggcgauccuugcgggggagccaucuguggcgggcccgaccaccggcuccgccuguggagacuuuuccagacacuggaugugaaccgggacggaggccucugcgucaaugaucuggcuguggggcuucgcagacugggacuccaucggacggagggcgaacugcaaaagauuguucaggccggcgacaaagaucuggacgggcagcucgauuuugaggaguucgugcacuaccugcaggaccaugaaaagaaacuucgccuggucuuuaagagccucgauaaaaagaacgacggaagaaucgaugcgcaagaaauuaugcagucccugcgggaccuuggcgugaagaucagcgagcagcaggccgagaaaauucugaagucuauggacaaaaaugggaccaugacaaucgauuggaacgaauggcgcgacuaucaccuccugcauccuguugagaauauccccgaaauuauccuguacuggaagcacuccaccauuuucgaugugggagagaaccucacagucccugacgaguuuaccguggaagagagacaaacaggcaugugguggcggcaccugguggcugggggaggcgccggcgcugucagccgcaccuguacggccccgcuugauagacugaaaguucucaugcaagugcaugcgucucgguccaauaacauggggaucgugggaggcuucacccagaugauucgcgaagggggagccagaagccuguggcggggcaaugggaucaacguccuuaagauugcucccgagucugccaucaaguuuauggcuuaugaacagaucaaaagacuggugggauccgaccaggagacacuccgcauucacgagcggcugguugccggcagccuggccggcgcuaucgcgcaguccucuauuuacccuauggaagugcucaagaccagaauggcccugcgcaaaacagggcaguauagcggaaugcuugauugcgcucggagaauccuggcccgcgagggcgucgccgcuuucuacaagggguaugugcccaauaugcucggaauuaucccuuacgccggcaucgaccuggcgguuuacgaaacccuuaaaaacgcuuggcugcaacauuaugccgucaauuccgccgaucccgggguguuugugcuccuggcuuguggcacgaugagcucuacaugcggacagcuggccuccuacccgcucgcucugguccggaccagaaugcaggcccaggcgagcauugagggcgccccugaagugacaaugucuagccuuuucaagcacauccugcgcaccgagggggcuuuuggacucuaucggggccuggcccccaacuucaugaaaguuauuccugcuguguccaucucuuacgucguguaugagaaucugaagauuacccuugggguucaaagcagauga

SEQ ID NO: 75708 - RNA, 903 nt, Artificial Sequence
  derived and/or modified sequence opt5 from SLC25A27__Homo_sapiens__NP_001190980
augagcgugcccgaggaagaggaaagacugcucccucugacccagcgguggccgcgcgccuccaaguuccuucugucuggcugcgcugccacagucgcggagcucgcuacguuuccccuggaccuuaccaaaacaagacugcaaaugcagggggaagccgcccucgcucggcugggagauggcgcccgcgagagcgcuccuuacagagggaugguucggaccgcccugggaaucauugaggaagagggcuuccucaagcuguggcagggggugacacccgcgaucuaucgccacguggucuacuccggaggcagaauggugaccuaugaacaucuucgggagguuguguuuggcaaaucugaggacgaacacuacccucuguggaaaagcgucauugggggaaugauggccggcgugaucgggcaguuccucgcuaaccccacagaucugguuaaggugcaaaugcagauggagggaaagcgcaaacuugaaggcaagccucugagauuucgcgggguccaucacgccuucgcuaagauucucgccgagggaggcauccggggccugugggcggggugggugccgaauauccagagagccgcucuggugaacaugggagaccucaccacguaugauaccgucaaacauuaccugguucuuaauacaccccuggaagacaacauuaugacccacggccucuccucucuguguagcgggcuuguggccuccauccugggaaccccugcugaugugauuaagagccggaucaugaaucagccccgcgacaaacaaggcagagggcuccuguauaagucuuccacagauugccugauucaggccguccagggagagggcuuuaugagccucuacaagggcuuccugccuucuuggcuucggauguga

SEQ ID NO: 75709 - RNA, 906 nt, Artificial Sequence
  derived and/or modified sequence opt5 from SLC25A2__Homo_sapiens__NP_114153
augaaaagcggccccgggauccaggccgcuauugaccugaccgccggagcggcuggcgggacagccugcgugcucacgggacaaccuuucgauaccaucaaggucaagaugcagacauuuccggaccuguacaaaggccuuaccgauuguuuccugaagacauaugcccagguugggcucagaggauuuuacaaaggcaccggccccgcucugauggccuauguggcugagaacuccgugcuuuucaugugcuacggguuuugucagcaauucguccggaagguggccggaauggacaagcaggcgaaacugucugaucuccagacagccgcugccggcagcuuugcuuccgccuucgcggcccuggcucugugcccuaccgaacucguuaagugucgccugcagacgauguaugagauggaaaugucugggaaaauugccaagagccacaauaccaucugguccguggucaaaggcauucuuaagaaggacggaccccugggguuuuaccauggacucucuagcacacugcuucaagaggugccuggcuauuucuuuuucuuuggcggguacgaacugucccggagcuucuucgcuucuggaagauccaaagaugagcucggccccguucaccugaugcugagcgggggaguggccggcaucugccucuggcuggucguguuuccuguggacuguaucaagucucgcauucagguccuuuccauguacgggaaacaggccggauucaucggcacccugcucagcguugugagaaacgagggcauuguggcucuguauucugggcuuaaggcgacaaugauccgggccauuccggcuaauggagcccuguuugucgccuacgaauauucccgcaaaaugaugaugaagcagcucgaggcuuacuga

SEQ ID NO: 75710 - RNA, 936 nt, Artificial Sequence
  derived and/or modified sequence opt5 from SLC25A36__Homo_sapiens__NP_001098117
augagccagagagacacccuggugcaccucuucgccggcgggugcggaggcacagucggggcuauccugacguguccccuugagguugugaagacccggcugcaauccucuagcgugacacucuacauuuccgaaguccagcugaacaccauggccggagcgucugugaaucgcguugugagcccuggcccgcuucauugccugaaagucauccucgagaaggaagggcccagaucccuguuucggggacugggcccuaaccucgugggcguugcucccucucgcgccauuuauuucgccgcuuacagcaauuguaaagagaagcugaacgauguguuugacccugauuccacacagguccacaugaucagcgccgcuauggccggguucaccgcgauuacagccaccaaucccaucuggcuuaucaaaacgagacugcagcucgacgcucggaaccgcggagaaagacggaugggcgccuuugagugcgugcgcaagguguaucaaaccgaugggcugaagggauucuacagaggcaugucugcuuccuaugccgggauuagcgagacagucauccauuuuguuauuuacgaaucuaucaaacagaaacuucuggaguauaagaccgcguccacaauggaaaaugacgaggagagcgugaaggaagccucugauuucgugggaaugaugcucgcugccgcuaccuccaaaacgugugccacaaccauugccuacccucacgaggucgugcggacacgccugagagaagagggcaccaaguaccggagcuuuuuccagacccugucccuccugguucaggaagagggcuaugggucucuuuaccgcggacugacaacgcaucucgugagacaaaucccgaacaccgcuauuaugauggcgacauaugagcuggucguguaccuucugaauggcuga

SEQ ID NO: 75711 - RNA, 1017 nt, Artificial Sequence
  derived and/or modified sequence opt5 from SLC25A37__Homo_sapiens__NP_057696
auggagcugagaagcggcuccguggggucucaggccgucgcucggcgcauggacggagauagcagagacggcgggggaggcaaggaugccaccggguccgaagacuacgagaaccuccccacaucugcgagcguuuccacgcacaugaccgcuggagccauggccggcauccuggaacauucugugauguauccuguggauagcgucaaaacacggaugcaaucccuuagcccggaccccaaggcucaguacaccucuauuuauggcgcccugaaaaagaucaugcgcacagagggguucuggagaccucuccggggagugaauguuaugauuaugggcgcugggcccgcccacgcgauguacuuugccugcuaugaaaacaugaaacgcacccugaaugauguguuccaucaccagggaaacucccaucuugcuaauggcaucgccgggagcauggcuacacugcuccacgacgccgucaugaacccugcggaggugguuaagcagagacugcaaauguacaauucucagcaccgguccgccauuagcuguauccgcaccguguggagaacggagggacugggcgcuuuuuaucggucuuacaccacacagcucaccaugaacauccccuuccaguccauucauuuuaucacauacgaguuccugcaagaacaggucaauccucaccgcaccuauaacccgcagagccauauuaucuccggcgggcuugccggagcucuggccgccgcugcgacgacaccccucgaugugugcaagacccugcuuaauacacaggaaaacguggcccugucucucgcuaauauuagcggcagacuguccgggauggccaacgccuuucggaccgucuaccaacugaauggacucgcuggcuauuucaaagggauccaggcccgcguuauuuaccagaugccuagcaccgcgaucucuugguccguguaugaguuuuucaaguacuuucugacaaaaagacaacuugagaaccgggcucccuauuga

SEQ ID NO: 75712 - RNA, 915 nt, Artificial Sequence
  derived and/or modified sequence opt5 from SLC25A38__Homo_sapiens__NP_060345
augauccagaacagcagacccucccugcuccaaccucaggacgugggcgauaccgucgagacacugaugcuucacccgguuauuaaggccuuccugugcgggucuaucagcggaacguguuccacccuccuguuucagccccuugaccugcucaaaacacggcugcagacccugcaaccuucugaucauggcagccgcagaguggggaugcucgcugugcugcuuaaggucgugcggacagaaucccugcucggacuguggaaaggcaugucucccagcauuguucgcugcgugccuggggucggaaucuacuucggcacccuuuauucccugaagcaguacuuucucagaggccaucccccuacagcccuggagagcgugaugcuggggguuggaucucgguccguggcgggcgucuguaugagcccgauuaccgugaucaaaacgcgcuaugaaucugggaaguacggauaugaguccaucuacgcugcccucagaagcauuuaucacucugaaggccaccgggggcuguucuccggacuuaccgccacacugcuccgcgacgcucccuuuagcggcaucuaccugauguucuacaaucagaccaagaacauugugccucaugaucaggucgacgccacacuuauccccauuaccaauuuuuccugcggcaucuucgcugggauucuggccucucucguuacgcaaccugcggaugugaucaaaacacacaugcagcuguauccccugaaguuucaguggaucggacaggccgugacccucauuuucaaagacuacggccugagaggguuuuuccaaggaggcaucccgcgggcccuucgcagaacacugauggcugcuauggccuggaccgucuaugaggagaugauggcgaagauggggcucaaaagcuga

SEQ ID NO: 75713 - RNA, 1086 nt, Artificial Sequence
  derived and/or modified sequence opt5 from SLC25A3__Homo_sapiens__NP_002626
auguucagcuccguggcccaccuggcuagagccaaccccuuuaauaccccucaucuccagcugguccacgacggccuuggggaucugcggucuagcuccccgggacccacaggccaaccucgcagaccccggaaccucgcggcugccgccguugaggaauacucuugcgaguucgggagcgcuaaguauuacgcccuguguggauuuggcggggugcuuuccugcggacugacgcauaccgcuguggucccucucgaccuggugaaaugucgcaugcagguugauccccagaaguauaaaggcaucuucaauggcuuuucugugacacugaaggaagacggggucagaggacucgccaaaggcugggcgccuaccuuccugggguacagcaugcagggacuuugcaaguuuggcuucuaugagguguuuaagguucuguacuccaacaugcucggggaagagaauacauaucuguggcggaccagccuuuaccuggccgcuucugccuccgcugaguucuuugccgauauugcgcucgccccgauggaagcugccaaagugcgcauccaaacacagcccggauacgcuaacacccugagagacgccgccccuaagauguauaaagaggaaggccugaaggcuuucuacaaaggcgucgcgccccucuggaugcggcagauuccuuauacgaugaugaaguuugccuguuucgagcgcaccguggaggcucuguacaaguucgugguccccaaaccgagaagcgaaugcucuaagccugagcagcuuguugugacauuuguggccggguauaucgccggagucuucugugcuauugugucccaccccgccgauagcguugugucuguccugaauaaagaaaagggcuccagcgcgucccucgugcugaaacggcuuggguuuaagggaguuuggaaaggccuguucgcucgcaucaucaugauugggacccucacagcccugcaaugguuuaucuacgacucugugaaggucuauuucagacugccucggcccccucccccggagaugcccgaaagccucaagaaaaagcugggacuuacccaguga

SEQ ID NO: 75714 - RNA, 1017 nt, Artificial Sequence
  derived and/or modified sequence opt5 from SLC25A40__Homo_sapiens__NP_061331
auggaccccgagaccagaggccaggaaaucauuaaggugacaccucugcaacagaugcucgccagcugcacgggggcuauccugaccuccgucauuguuacaccgcuugauguggugaaaauccggcugcaggcccagaacaauccccucccuaagggaaaauguuucgucuacucuaacggccugauggaccaccuuugcgugugugaggaagggggaaauaagcugugguauaaaaagcccggcaacuuucaagggacccucgaugcguucuuuaagauuauccgcaaugagggaaucaaaagccugugguccggccugccucccacacucguuauggcugugccugccaccgucauuuacuucacaugcuaugaccagcugucugcccuucugagaagcaagcucggcgaaaacgagaccuguaucccgauuguggcugggaucguugcccgguuuggagcugugacggucauuucuccccuggagcuuauccgcaccaaaaugcaguccaagaaauucagcuacguggaacugcauagauuuguguccaagaaggucagcgaggauggcuggauuucucucuggcgggggugggccccuacaguucugcgcgacgugcccuucuccgcgauguauugguacaauuaugaaauccugaaaaaguggcucugcgagaaaagcggacuguacgagccuaccuuuaugaucaacuucacaucuggcgcccuuuccgggagcuuugcugccguggcuacccugcccuucgaugucgugaagacgcagaaacaaacacagcucuggaccuacgaaucucacaagauuuccaugccgcugcauaugagcacauggaucauuaugaaaaauaucguugccaagaacggauuuuccggccuuuucucuggccugauuccuagacucaucaagaucgcgcccgccugugcuauuaugaucagcaccuaugaguucgggaaagccuuuuuccagaagcagaaugugcggcgccaacaguacuga

SEQ ID NO: 75715 - RNA, 1113 nt, Artificial Sequence
  derived and/or modified sequence opt5 from SLC25A41__Homo_sapiens__NP_775908
augggcgcccagcccggggagccucaaaauaccugcagcagaauccagacacuguuccggcgcgugaagacgcuccugauuaaagcuccgcccccuccccagccucccccuccgcccccuuccuggaaccccggauguacccacgucuacggcuaugccuuugggcauaugcacgacaacaaucuugaacaucugccuucucagcaaguucucgauacaggagagcagcugauggugcccguggaaguccuugagguggacaacaaggaagcgcuguggaaauuccuccugagcggcgcuauggccggggccguuuccagaaccggaacagcuccgcuggaucgggccaagguguacaugcaggucuauucuagcaaaaccaauuuuacaaaccuccugggcggccuucaguccauggugcaagagggaggauuccgcucucuguggagaggcaaugggaucaacguucucaagauugcuccugaguacgccaucaaguuuagcguguucgaacagugcaaaaauuauuuuugugggauucagggcuccccucccuuccaggagcggcugcuugcggggagccuggccgucgcuaucucucaaacccucaucaaccccauggaagugcugaagacgcgccugacccucagacggacaggacaguacaaaggccugcuugacugcgcccgccagauucugcaaagagagggcacccgggcucucuaucgcggguaccugcccaauaugcuuggaaucauuccuuacgccuguacagaucuggcgguguaugagaugcuccagugcuuuugggucaaguccggcagagacaugggggauccgagcggacugguuucucuguccagcgugacccucucuacgacauguggccagauggccuccuacccccugacccuugugcggacacgcaugcaggcucaagacaccgucgaagggagcaacccuaccaugagaggagugcugcagcggauccucgcccagcagggcuggcugggccuuuauagagggaugacacccacgcugcucaaaguucugccugcuggaggcauuuccuacguggucuaugaggccaugaagaagacccuggggaucuga

SEQ ID NO: 75716 - RNA, 957 nt, Artificial Sequence
  derived and/or modified sequence opt5 from SLC25A42__Homo_sapiens__NP_848621
augggcaacggggugaaggagggacccgucagacugcacgaagacgccgaggcuguucucagcuccucugugagcuccaaacgggaucaccgccaggugcugucuagccuucuguccggcgcccucgcgggggcucuggccaagaccgccgucgcuccucuugacagaacaaaaaucauuuuccaagugucuagcaagcgguuuuccgccaaagaggcuuuccgcguucuguacuauacguaccucaaugaaggauuucugagccuguggagaggcaacucugccaccauggugcgggucgugccguaugcggccauccaguucuccgcucacgaagaguacaagcgcauucucgggagcuauuacggauuuagaggcgaggcccugcccccuuggccccggcuuuucgcuggcgcccuggcggggacaaccgccgcuucucucacauauccucuggaucuuguucgcgccagaauggcugugacccccaaggaaauguacuccaauaucuuucaugucuucauucggaucagccgcgaggaaggacugaaaacacucuaccacggcuuuaugccuaccgugcugggggugaucccguaugccggacugucuuucuuuacguacgagacccucaagucccugcauagagaguauagcggccggcgccagcccuacccuuucgaaagaaugauuuuuggggccugcgcuggacuuaucggccaguccgcgucuuauccccuggacgucguucggagacgcaugcaaacagccggcgugaccggguacccucgggcuagcauugccagaacacuccgcaccaucgugcgggaggaaggagccgucagaggccuguauaaagggcuuuccaugaacugggugaagggacccauugcuguuggcaucagcuucacgacauucgaucugaugcagauucuccugcgccaucugcagucuuga

SEQ ID NO: 75717 - RNA, 1026 nt, Artificial Sequence
  derived and/or modified sequence opt5 from SLC25A43__Homo_sapiens__NP_660348
auggccaccuggagacgggacggccgccugacagggggacagagacuccugugcgcuggccuugccgggacgcugagccucucccugaccgcgccccuugagcuggcuacagugcucgcccaagucggaguugugcggggccacgcccgcgggccuugggcuaccggacauagaguguggcgggccgaaggccugcgcgcucuguggaagggcaacgccgucgcgugucucagacuguucccgugcucugccgugcagcuugcugccuaccggaaauuuguugugcuguucacagaugaccucgggcacaucagccagugguccucuauuauggcuggaagccuggccggcauggucuccaccaucgugacauaucccaccgaucuuauuaagacgcgccugaucaugcagaauauucucgagccuucuuacagagggcugcugcaugcguuuagcaccaucuaucaacaggaaggauuccucgcccuguaccggggcguuucccuuacaguggucggggcucugcccuuuagcgccggaucucuccugguguauaugaaccuugagaaaaucuggaauggcccucgcgaccaguucucccugccccagaacuuugcuaaugugugucucgccgccgcugucacccaaacacugagcuucccuuuugaaaccguuaagagaaaaaugcaggcgcagucuccguaccugccccacuccggcgggguggaugugcauuucagcggagccgucgacugcuuucggcagauugugaaggcucaaggcguucucgggcuguggaacggacuuacggccaaucugcucaagaucgugccuuauuucggcauuauguuuucuacauucgaguucuguaaacgcaucugccuguaccagaacggguacauucuuagcccccuguccuauaagcucaccccuggagucgaucagucccugcaaccccaggagcugagagaacucaaaaaguuuuucaaaacacggaagccgaagccuaaaaagcccacccuguga

SEQ ID NO: 75718 - RNA, 795 nt, Artificial Sequence
  derived and/or modified sequence opt5 from SLC25A45__Homo_sapiens__NP_001265179
augcccguggaggaguucgucgccggcuggaucagcggggcucugggacucguucugggccacccuuuugacaccgugaaacuucugggguucuuuaagggaauguccuucccgauugccucuaucgcgguggucaacagcgugcucuuuggcguuuacuccaauacacugcuugugcugacggcuaccucucaucaggaaagacgggcccaacccccuagcuauaugcacauuuuccucgccgggugcacaggaggcuuucugcaggcuuacugucuggcccccuucgaucucaucaagguccgccugcagaaccagaccgaaccuagagcucaacccggcuccccuccgccccgguaucaggggccugugcauugcgccgcgucuauuuuucgcgaggaaggacccagaggccuuuuccgcggggccugggcucugacacuccgggacaccccuacaguuggaaucuacuuuaucaccuaugagggccuguguagacaguacacgcccgaggggcagaauccgagcuccgccaccgugcuugucgcuggaggcuucgccggcauugcgagcuggguggccgcuacaccucuggaugugaucaaaucucggaugcaaauggacgggcuccgcagacgggucuaucagggaaugcuggauugcaugguuuccagcauucgccaggaaggccuggggguguuuuucagaggagugaccaucaacucugcccgggcuuuccccgucaaugccgugacauuucucuccuacgaguaccugcuucgcugguggggcuga

SEQ ID NO: 75719 - RNA, 1014 nt, Artificial Sequence
  derived and/or modified sequence opt5 from SLC25A46__Homo_sapiens__NP_001290178
augcaccccagacggccugacggcuucgaugggcugggauaccgcggcggggccagagacgagcagggauuuggcggggcuuucccggcccggagcuuuuccaccggaucugaucucggccauugggugacaacgcccccugacauccccggcagccgcaaccugcacuggggagaaaaguccccucccuauggggucccuaccacaucuaccccguacgagggccccacagaggaaccuuucagcuccgggggaggcgggucuguucaaggacagagcuccgaacagcuuaauagauuugcgggcuucggcauugggcuggcuagccucuuuaccgagaacgugcuggcccaucccugcaucgugcuucggcgccagugucaagucaauuaucacgcccagcauuaccaccugacaccuuucaccgugauuaacaucauguauucuuuuaauaaaacgcagggacccagagcucucuggaagggcaugggguccaccuucauuguucagggagugacacugggcgccgaggggaucaucagcgaauuuaccccgcugccucgggagguccuccacaaauggucucccaagcaaauuggagaacaucugcuucugaaaucccucacauacgugguugcuaugccuuucuauagcgccucucugaucgagaccgugcaguccaugcuugaugcguacuuucccgagcugauugccaacuucgcugccagccucugcuccgacgucauccuguacccccuggaaacggugcuccaccgccugcauauucagggcacaagaaccaucauugauaauacagaccuuggcuaugaggugcugccuaucaacacccaguacgaagggaugcgggauuguaucaauaccauucgccaagaggaaggagucuucggcuuuuauaagggguucggagcuguuaucauucaguacacacuccacgccgcggugcugcagaucacgaagauuaucuauucuacccuucugcaaaacaauaucuga

SEQ ID NO: 75720 - RNA, 927 nt, Artificial Sequence
  derived and/or modified sequence opt5 from SLC25A47__Homo_sapiens__NP_997000
auggacuucguggccggcgcuaucgggggagucugcggcguugccgugggguacccccuggauaccgugaagguccggauucagacagagccuaaauauacgggaaucuggcacugugugagagacaccuaccaucgcgaaagaguuuggggcuuuuaucgggggcucagccugccggugugcacagucucccuugugucuagcguuuccuucggaaccuaccgccacugucuggcgcauauuugcagacuccgguauggcaaccccgaugcuaagccuacaaaagccgacaucacccugucuggcugugccagcgggcuugugcgcgucuuucugacaucccccaccgagguggcuaaggugagacuccaaacgcagacccaggcccagaaacaacagcggcgccugucugcuagcggaccucuggccgucccucccaugugcccgguucccccugcgugucccgaaccuaaguacagaggcccccuccacugccuggccacaguggcucgggaggaagggcuuuguggacuguauaagggcuccagcgcccucgugcugcgcgaugggcauucuuucgcuaccuacuuucuuuccuacgccguccugugcgaguggcucagcccggcgggacacucuagaccugacgugcccggcguucugguggccggcgggugugcuggaguccuggccugggcuguggccacaccuauggauguuauuaaaucccggcuccaggccgacggccaggggcaacgcagauaucggggacugcuucacugcauggugaccagcgucagagaggaaggcccccgcgugcuguucaaggggcucguccugaauugcugucgggcuuuucccgugaacaugguuguguucgucgcguacgaggccgugcuuagacuggcucgcggacuccugacguga

SEQ ID NO: 75721 - RNA, 897 nt, Artificial Sequence
  derived and/or modified sequence opt5 from SLC25A4__Homo_sapiens__NP_001142
augggcgaccacgccuggagcuuccugaaggauuuucucgcugggggaguggccgcggcugucuccaaaaccgccguugcccccaucgagagagugaagcugcuucuccaggugcaacaugcuucuaaacagauuagcgccgaaaagcaguacaaaggcaucauugacugcgucgugcggaucccuaaggagcagggguuccuguccuuuuggcgcggaaaccuggcuaauguuauuagauauuucccgacacaagcccuuaacuuugcguucaaggauaaauacaagcagcuguuucucggcgggguggaccggcacaaacaguucuggcgcuauuuugccggaaaucuggcuucuggcggcgccgcuggggccacgagccuguguuucgucuacccccucgauuuugcgagaacccggcuggccgcugacgugggaaagggcgccgcucagcgcgaguuccaugggcuuggagauugcaucaucaaaauuuuuaaguccgacggccugagagggcucuaucaaggauucaacguuucugugcagggcaucauuaucuaccgggccgccuauuucggcgucuacgauacagcuaaggggaugcugccugaccccaaaaaugugcacauuuuugugagcuggaugaucgcgcaguccgucaccgccguugcuggacuugugagcuacccuuucgauacagugcgcagacggaugaugaugcagucuggccgcaagggggccgacauuauguauaccggaacagucgauuguuggagaaaaaucgccaaggacgaaggcgcuaaagccuuuuucaagggggcgugguccaacgugcugcggggaaugggcggcgcuuuuguucucgugcuguacgacgaaaucaaaaaguaugucuga

SEQ ID NO: 75722 - RNA, 924 nt, Artificial Sequence
  derived and/or modified sequence opt5 from SLC25A52__Homo_sapiens__NP_001029344
augcccuucaugagaaagauccugagcaacaugauugacuccgaggcccacgaaaaacggccuccgauccucaccucuagcaagcaggauauuucuccccauaucacaaaugugggcgagaugaaacacuaccugugcggguguugcgcugccuuuaacaaugucgcgauuacguauccuauccaaaagguucuuuuccgccagcagcuguacggaaucaaaaccagagacgcugugcuccagcugcggcgcgauggcuuuagaaaccuuuaucgggggauucugcccccucucaugcaaaagacaaccacacuggcccugauguucggacucuacgaagaccuguccugucuucugcgcaagcaugugagagcccccgaguuugcuacccacggcgucgccgcugugcucgccgggacagcggaagccaucuucaccccucuggagcggguucagacgcuucugcagaaucauaaacaccacgauaaguuuaccaacacauaucaggcuuucaaagcccucaagugccauggaauuggcgaguacuaucgcggccuggugccgauccuguuuagaaaugggcucagcaacguccuguucuuuggacuucggggccccauuaaagaacaucugccuaccgcuacaacccacuccgcccaccucgugaaugacuucaucgggggaggccugcuuggggcgaugcugggauuucucuguuuccccauuaacguugugaagacgcgccugcaaucucagaucggcggcgaguuccagagcuuuccuaaggucuuccagaaaaucuggcuggaaagagaucggaagcucauuaaucuguuucgcggggcccaccuuaacuaccauagaucccugaucagcuggggaauuaucaaugcuacauacgaguuccuccugaaauuuauuuga

SEQ ID NO: 75723 - RNA, 897 nt, Artificial Sequence
  derived and/or modified sequence opt5 from SLC25A5__Homo_sapiens__NP_001143
augaccgacgccgcugugagcuucgccaaggauuuucuggcgggcggggucgcugccgccaucuccaaaacagcuguugcccccauugagagagugaagcuccugcuucaggugcaacacgcuucuaaacagaucacggccgacaagcaguacaaaggaauuaucgauugcgucgugcggauuccuaaggaacagggcguucugagcuucuggcgcgggaaccucgcgaaugugaucagauauuuuccgacccaagcccugaacuucgcuuuuaaggacaaauacaagcagaucuuccuuggaggcgucgauaaacggacacaguuuuggcuguauuucgccgggaaucucgcuuccggaggcgccgcgggcgccaccucucuguguuuuguguacccccuggacuucgcucgcacaagacucgccgcugauguugggaaggccggagccgagcgggaauuucgcggccugggggacugccuugugaaaauuuauaagagcgauggaaucaagggccuguaccagggguucaacgucuccgugcaaggaauuaucauuuauagagcugcguacuuuggcaucuacgacaccgccaaaggcaugcucccugaucccaagaauacacauauugugaucucuuggaugaucgcucagaccgucacggccguugccgggcugaccagcuauccuuucgacacagugcggcgcagaaugaugaugcaguccggacggaaaggcaccgauauuauguacacagggacccuugacuguuggcgcaagaucgcuagagacgagggaggcaaagccuucuuuaagggggcguggagcaacgugcugcggggaaugggcggcgcuuucguccucgugcuguaugaugaaauuaaaaaguacacguga

SEQ ID NO: 75724 - RNA, 897 nt, Artificial Sequence
  derived and/or modified sequence opt5 from SLC25A6__Homo_sapiens__NP_001627
augaccgagcaggccaucagcuucgcuaaggacuuucuggccggcgggauugcggcugccaucuccaaaacagccguggcucccauugaaagagucaagcuccugcuucaaguucagcacgccucuaaacagaucgcugccgauaagcaguacaaaggaauuguggacugcaucgugcggaucccuaaggagcaaggcguccugagcuucuggcgcgggaaccucgcgaaugugauuagauauuuuccgacgcaggcccugaacuucgcuuuuaaggauaaauacaagcagaucuuccuuggaggcguugacaaacauacccaguuuuggcgguauuucgccgggaaucuggcuuccggaggcgccgcgggcgccacaucucucuguuuuguguacccccuggauuucgcucgcaccagacuggccgcugacgucggaaagagcgggacagaacgggaguuucgcggccucggggauugccuggugaaaauuaccaaguccgacggaaucagaggccuuuaucaaggguucucuguuagcgugcagggaauuaucauuuaccgggccgccuauuuuggcgucuacgauacagcuaagggcaugcugccugaccccaaaaacacccacaucgugguguccuggaugaucgcgcagacggucaccgccguugcugggguggugagcuacccuuucgauacaguccgcagacggaugaugaugcagucuggacgcaagggcgccgacauuauguauaccgggacaguggauuguuggagaaaaaucuuccgggacgaaggaggcaaggccuuuuucaaaggggcuugguccaauguucuccgcggaaugggcggcgccuuugugcugguccuuuacgacgagcugaagaaagugauuuga

SEQ ID NO: 75725 - RNA, 2106 nt, Artificial Sequence
  derived and/or modified sequence opt5 from SLC26A1__Homo_sapiens__NP_071325
auggacgagagccccgaaccucugcagcaaggcagagggccggugcccguccggcgccagagaccugcuccccggggacuccgcgagaugcugaaggcuagacuuuggugcuccuguucuugcagcguucugugugugcgggcccucgugcaggaucugcuuccugcgacccgcuggcugagacaguaccggccccgcgaauaucucgcuggcgacgucauguccgggcuggugaucggaauuauccugguuccucaagccauugccuacucucuccuggcuggccuucagccgaucuauagccuguacacauccuucuuugccaaccucauuuauuuccugauggggacgucuagacacgugagcgucggaaucuuuucccuucugugccucauggugggccagguuguggaucgggagcugcagcuggcuggcuucgaccccagccaagaugggcuccagccuggagccaauucuuccacccugaacggcagcgcggccaugcuugacugugggcgcgauugcuacgcuaucagagucgccacagcucugacccucaugacaggacuguaucaggugcuuaugggcgugcugcggcucggguuugucucugccuaccugucccagccccugcucgacggauucgcgaugggcgccagcguuaccauucugacaucucaacuuaaacaucugcucggcgugcgcaucccuagacaccaggggcccggaauggugguccugaccuggcuuucccugcuccggggcgcugggcaggccaaugugugugauguugugacgagcaccgucugccuggcugugcugcucgccgccaaggaacuguccgacagauaccgccaucggcuuagaguuccgcugccuacagagcuccuggugauugucguggcuacccuggucucucacuuuggacaacuucauaaacgcuucggcagcuccguggcgggggauauccccacaggauuuaugccuccccagguucccgagccucggcucaugcagagaguggcccuggacgcugucgcccuggcccucguggcugccgcguucagcauuucucuggcugaaauguuugcccgcucccacggcuauagcguucgggccaaccaggagcuucuggcugugggcuguugcaauguccucccggccuuccugcacuguuuugcuaccucugccgcgcuggccaagagccuugugaaaacggcuacagggugcagaacccaacucuccucugugguuagcgccacagucgugcugcuggugcuccuggcucuugcgccccuguuccaugaucuccagcgcuccguccuggccugcgugaucguugugagccugcggggagcccuuagaaaggucugggaccucccucgccuguggcggaugucucccgcugacgcccuggugugggcuggcaccgccgccaccuguaugcucguuuccacagaagcugggcugcuugcgggagugauucugagccuccugucucuggccggcagaacgcagcggccucgcaccgcccuucucgccagaaucggggauacagccuucuacgaggacgcuaccgaguuugaaggccugguccccgagccgggagugcggguuuucagauuuggcgggccucuguauuacgccaacaaggauuucuuucuccagucccuguauagccuuacaggacuggacgcgggcugcauggcugcccgccggaaagaagggggauccgagaccggcgugggggaaggcggacccgcccaaggcgaggaucucgggccugucucuacgagagcugcccuggugcccgcggcugccggauuccacacaguggucaucgacugugccccucugcuuuuucuggaugcugccggcguuagcacccuccaggaccugcgcagagauuacggggcucucggaauuucccugcuucuggccugcuguucucccccggugcgggacauccucagccgcggcggguuccugggcgagggaccuggcgauaccgcggaagaggaacagcuguuucuuuccgugcaugacgccguccagacagcuagagcccggcaccgcgagcuggaagcuaccgacgcccaccucuga

SEQ ID NO: 75726 - RNA, 2220 nt, Artificial Sequence
  derived and/or modified sequence opt5 from SLC26A2__Homo_sapiens__NP_000103
augagcuccgagucuaaggaacagcacaacgugagccccagagacuccgccgagggcaaugauucuuacccuagcgggauccaucuggaacuccaacgggaguccucuaccgacuucaaacaguuugaaacaaacgaucagugccgcccguaucaccggauucugaucgagagacaggaaaagagcgacacgaauuucaaagaguuugucauuaagaaacuucaaaagaacugucagugcucccccgcuaaggccaaaaauaugauccugggauuccucccuguucugcaguggcuucccaaguacgaucugaaaaagaacauucucggcgacgugaugagcgggcugaucgugggaauccugcucgucccucagucuauugcguauucccugcuugcuggccaagagcccguguacgggcuguauaccagcuuuuucgccucuaucauuuacuuucuccugggaacaucccgccauaucagcguuggcauuuucggcgugcuuugucugaugaucggggaaaccgucgauagagagcuccagaaagccggauaugacaaugcucacucugccccuucccugggcauggugagcaacggguccacacugcucaaucauaccucugaucggauuugcgacaagagcuguuacgcuaucaugguuggauccacagugaccuuuaucgccggcgucuaccagguggcgaugggguucuuucaggugggauucgucagcguuuaucugucugaugcccuucuguccggcuuugugacgggcgcuagcuucaccauucucacaucucaagccaaguaccugcuugggcugaaccucccgcgcaccaauggagugggcagccugaucacaaccuggauucacgucuucagaaacauccacaaaacgaaucugugcgaccucauuacaucccugcuuugucugcucgugcugcuucccaccaaggagcugaacgaacauuuuaaaucuaagcucaaagcuccuauccccaucgagcugguuguggucguggccgcgacacuggccagccacuucgggaagcuccaugaaaauuauaacuccagcauugcuggacacaucccuaccggcuuuaugcccccgaaaguuccugaguggaaccugauucccucuguggccgucgaugcuaucgccauuuccaucaucggguucgccauuaccgugagccuuucugaaauguuugcuaagaagcacggauacacagucaaagcgaaucaggagauguaugccaucggcuucugcaacauuaucccuuccuuuuuccauuguuuuacgaccagcgcugcccuggccaagacacucgugaaagaguccaccggcugccacacacagcugucugggguugugaccgcucugguccuucuccuggugcugcucguuauugcgccccuguucuacagccuucaaaaguccgugcugggagucaucacgauugugaaucuccggggcgcccugcgcaaauuuagagaccugcccaagauguggucuaucagccggauggacacagugaucugguucguuaccaugcuuuccagcgcucuccugucuaccgaaauugggcugcucgucggaguguguuuuuccaucuucugcgugauucugcgcacacagaagccuaaaagcucucuucugggccucgucgaggaauccgagguguucgaaagcguuucugccuauaagaaccugcagaucaaaccggggauuaagaucuuuagauucguggcuccccuguacuacaucaauaaagagugcuuuaagagcgcccuuuauaagcagaccgucaacccuauucucaucaaaguggccuggaagaaagcugccaagcggaaaauuaaggagaagguugugacacugggcggaauccaagaugaaauguccguccagcugagccaugacccccucgagcugcacacgauugugaucgauuguucugcgauccaguuccuugacaccgccggcauucauacacugaaagaaguucgcagagauuacgaggcuaucgggauucaggugcuccuggcccaaugcaauccuaccguccgggacucccugacaaacggagaauauuguaagaaagaggaggaaaaucuucucuuuuacagcguguaugaggcuauggccuucgcggaaguguccaagaaccagaaaggcgucugcguucccaaugggcugucucugagcuccgauuga

SEQ ID NO: 75727 - RNA, 2295 nt, Artificial Sequence
  derived and/or modified sequence opt5 from SLC26A3__Homo_sapiens__XP_011514169
augaucgagcccuucggcaaccaguacauuguggccagaccugucuauagcaccaaugcuuuugaagagaaccacaagaaaacagggcggcaucacaagacguuccuggaccaucucaaaguuugcuguuccugcucuccgcaaaaggccaaacgcaucgugcugagccuuuuucccauugcguccuggcugccugcuuacagacucaaggaauggcugcuuucugauaucgugagcggaauuuccaccggcaucgucgccgugcugcaggggcucgccuucgcucugcugguugacauucccccuguguauggacucuacgccuccuuuuuccccgcuauuaucuaucuguuuuucggcacaagccggcacauuuccgucgggccuuuuccgauccuuagcaugauggugggacuggccguuucuggcgcgguguccaaggccguccccgaucgcaaugcuaccacacucggccugccuaacaauagcaacaauucuucccuucuggacgaugagagagugcggguggccgcugccgcgagcgucaccguucucucugggauuauccagcuggccuucggaauccugcgcaucggcuuuguggugaucuaccucuccgaaagccugauuuccggguucacaaccgcugccgcuguccaugugcuuguuucucagcugaaauuuaucuuccaacucacggugcccagccacaccgacccugucuccauuuucaaggugcuguauagcguguuuucucagaucgagaaaacaaacauugccgaucuuguuaccgcccugaucguccuccugguggucuccaucgugaaggagauuaaucagagauucaaagacaagcugcccguuccgaucccuauugaauuuaucaugacagugauugcugcgggagucagcuacggcugugauuucaagaaccgguuuaaaguggccguugugggggacaugaaucccggauuccagccucccaucacccccgaugucgagacguuucaaaacacagugggcgacugcuucggcaucgcuaugguggccuuugccguugcuuucucugucgccagcguguacucccucaaguaugauuacccucuggacgggaaucaggaacuuauugcgcugggacucggcaacaucguguguggggucuuucgcggauucgcuggcucuaccgcccugagcagauccgccgugcaggagagcacagggggaaaaacccagauugcuggccuuaucggcgccauuaucguucugauugugguccucgcuaucggguuucugcuggccccgcuccaaaagucugugcuggcggcccuugcucugggaaaucucaaaggcaugcugaugcaguucgccgagaucgggcggcuguggcgcaaggacaaauaugauugccuuauuuggaucaugaccuucauuuuuacaaucguucucggacugggccuggggcucgcugccuccguggcguuccagcugcuuacgauugucuuuagaacccaauuccccaaguguagcacacuggccaacaucggccggaccaacaucuacaagaauaaaaaggacuauuacgauauguaugaaccugagggagugaaaauuuuucgcugccccucuccuaucuacuucgcuaacauuggcuuuuucagacggaagcucaucgacgccguuggguuuucuccccugcgcauucugagaaaacggaauaaggcucuuagaaagauccgcaaacuccagaagcagggacugcuccaggugacaccgaaaggcuucaucuguaccgucgauacgauuaaggacagcgaugaggaacuggacaacaaucaaaucgaagugcuggaucagccuauuaacacaaccgaccuucccuuucacaucgauuggaaugacgaccugccucucaacauugaggugcccaaaaucucccugcauucucugauccuugauuucagcgccgucuccuuucucgacguuucuagcgugcgggggcugaaguccauucugcaggaguucaucagaauuaagguggaugucuacaucgugggaaccgacgaugacuucauugaaaaacucaaucgcuaugaguuuuucgauggcgaaguuaagagcucuaucuuuuuccugacaauucacgacgccgugcuucauauccugaugaaaaaggauuacuccaccagcaaauuuaacccuucucaggagaaggacgggaagaucgauuucacaauuaauacgaacggcggacuccggaauagagucuaugaagugcccguugagaccaaauuuuga

SEQ ID NO: 75728 - RNA, 2343 nt, Artificial Sequence
  derived and/or modified sequence opt5 from SLC26A4__Homo_sapiens__NP_000432
auggccgcucccggcgggagaagcgagccuccgcagcugcccgaauacuccugcucuuauauggugagccggccugucuacuccgagcucgccuuccaacagcagcacgaacgcagacugcaggagcggaagacccuucgcgaaucucuggcgaaauguugcagcuguuccagaaagcgggcuuuuggaguucucaaaacacuggugcccauccuugaguggcugccuaaguaucgcgugaaagaguggcuccugucugacgucauuagcggcguguccacggggcugguugccacccuccaaggaauggccuacgcucugcuugccgcugugcccgucggcuaugggcuguacagcgccuucuuuccuauccucacauauuucauuuuuggaaccucuagacauaucuccgugggcccguuccccguugugagccugauggucggcucuguggugcuuuccauggcgccugaugaacacuuucuggucucuagcuccaacgggacaguucucaauaccacaaugauugacaccgccgcucgggauacggcccgcgugcugaucgcuagcgcccugacccuccuggugggaaucauucagcuuaucuucggcgggcugcagauuggauuuaucgucagauaccucgcggacccccuggugggcggguucacaaccgccgcugccuuucagguucuugugucccaacugaagauuguccucaacgugucuacaaagaauuacaacggaguucugagcaucauuuauacccugguggagaucuuccagaauaucggcgauacgaaccucgcugacuuuacagccggccugcuuaccauugucgugugcauggccgucaaagaacugaaugaucgguuccgccauaagaucccugugcccauuccgaucgagguuauugugacaaucaucgcuaccgcgauuuccuacggggccaaccucgagaaaaauuauaacgcuggaaucgucaagagcauuccuagaggcuuccugcccccugaacuuccucccgugucucuguuuuccgagaugcucgccgccagcuucucuaucgcuguuguggccuacgcgauugcugucagcguggggaaaguguaugccaccaaguacgacuauacaaucgauggaaaucaggaauuuaucgccuucggcauuuccaacaucuuuucuggguucuuuagcuguuucguugcuacgaccgcccugucccggacagcuguccaggagagcaccggaggcaagacacaaguggccggcauuaucucugcggccauugugaugaucgcuauucuggcccucgggaaacugcuugaaccccugcagaaguccguccucgcugccgugguuaucgcgaaucugaaaggaauguuuaugcagcugugcgacaucccgcgccuuuggagacaaaacaagauugaugccgugaucugggucuucaccuguauugugagcaucauucucggccuggaccuggggcuccuggcuggacuuaucuuuggccugcucacgguugugcugcggguccaguuccccucuuggaaugggcugggcuccaucccuagcacagauauuuacaaauccaccaagaacuacaaaaacaucgaggagccccagggagugaagauucuuagauuuucuagcccuaucuucuauggcaauguugacggguucaagaaaugcauuaaguccaccgugggauuugacgccauccgcgucuacaacaaacggcucaaggcucugagaaaaauccagaagcugauuaagucuggccaacuccgcgccaccaaaaaugggaucauuagcgaugccguguccacaaacaaugcuuucgaacccgacgaggauaucgaagaccuggaggaacuugauauuccgacaaaggagaucgagauccagguggacuggaacagcgaacugccugucaaaguuaaugugcccaaggugccuauucacucucucguccuggauuguggagcgaucuccuuucuggacgugguuggcgugcggagccuuagagucauugugaaagaguuccagcgcaucgauguuaacguguauuuugccucucuccaggacuacgucauugaaaagcuggagcaaugcggguucuuugaugacaauauccggaaggacacguucuuucugaccgugcaugaugcuauucucuaucugcagaaccagguuaaaucccaggaaggccaaggaagcauccuugagacaaucacccugauucaggacuguaaggauacacucgagcugaucgaaaccgagcugacggaagaggagcuugacgugcaggaugaagccaugagaacccucgccucuuga

SEQ ID NO: 75729 - RNA, 2139 nt, Artificial Sequence
  derived and/or modified sequence opt5 from SLC26A5__Homo_sapiens__NP_001161434
auggaccacgccgaggaaaacgagauccuggcugccacccagagauacuauguggaacggcccauuuucagccauccuguccuccaagagcgccugcacacaaaggauaaaguuccggacuccaucgcggauaagcugaaacaggcuuuuacgugcacccccaagaaaauuagaaauaucauuuacauguuccugccuaucacaaaguggcuccccgccuauaaguuuaaagaauacgugcugggcgaccuugugucugggaucagcaccggaguccugcagcucccucagggccuggccuucgcuaugcuggccgcugugcccccuauuuuugggcucuauuccucuuucuacccgguuaucauguauuguuuucugggaacaagccggcauauuuccaucggccccuucgccgugauuucucuuaugaucgggggagucgcggugcgccugguuccugaugacauugugauccccggcggcgucaacgccaccaaugggacagaggcuagagaugcccuccgggugaagguggcuaugagcgucacccugcuuuccggaaucauucaauuuugccugggcguuugucgcuucggguuuguggccaucuaccucacggagccucuggugagaggauucaccacagcggccgcuguccacguguuuaccagcaugcugaaauaccucuucggcguuaagacaaaacgguauucugggauuuucuccguggucuacagcaccguggccguucugcagaacgugaagaaucuuaacgucugcucucugggagugggccucauggucuuuggccugcuucuugggggaaaggaguucaaugaacgcuuuaaagaaaagcuccccgcuccgaucccucuggaguucuuugccgugguuaugggcacggggauuuccgccggauucaaccugaaagagagcuauaauguggacgucgugggcacacucccccuggggcuucugccucccgcuaaccccgauaccucucucuuucaucugguuuacguggacgcgaucgccaucgcuauugucggauucuccgugacaaucagcauggccaagacccuugccaauaaacacggcuaucagguggauggcaaccaggaacugauugcucucgggcuguguaauuccaucggaucucuguuucaaaccuucagcauuuccugcagccucucuagaucccugguucaggagggcacagggggaaagacgcagcuugccggcugucuggcgagccucaugauccugcuggucauccuugcuaccggguuucucuucgaaucucugccucagacaauuuggcugaccacauuugugagcucccucuuccugggccuugacuacggacugaucaccgccgugauuaucgcccuccugacggucauuuaucggacacaaucuccgagcuacaaagugcugggcaaacuucccgagaccgauguuuacaucgacauugacgcuuaugaagaggugaaggagaucccugggaucaagauuuuccagaucaacgcccccauuuacuaugcuaauuccgaucucuacagcaacgcccugaagcgcaaaaccggagucaacccugcggugaucaugggcgccagacggaaggcuaugcgcaaauaugccaaggaaguugggaaugcuaacauggccaaugcgacaguggucaaggccgacgcugagguggauggagaagacgccaccaaacccgaggaagaggauggcgagguuaaguacccgccuauugugaucaaaucuacauuucccgaagagaugcagagauucaugccucccggggacaacguccacacggugauccuggauuuuacccaagugaauuucauugacuccgucggcguuaagacacucgcuggaaucgugaaagaauauggcgauguggggauuuacgucuaccuggccggaugcagcgcccaggugguuaacgaccuuacccggaauagauuuuucgagaacccugcucugugggaacuccuguuucauucuauccacgaugcggugcugggcucccagcuucgcgaggcccucgcugagcaggaagccagcgcucccccgucccaagaggaccuggaaccuaaugccacacccgccacccccgaggcguga

SEQ ID NO: 75730 - RNA, 2217 nt, Artificial Sequence
  derived and/or modified sequence opt5 from SLC26A6__Homo_sapiens__NP_001035544
auggaccugagacggcgcgauuaccacauggagagaccccuccugaaccaggaacaucuugaggaacugggccggugggggagcgcuccucgcacccaccaauggagaacauggcuccagugcucccgggcucgcgccuaugcgcugcuucugcagcaucucccggugcuggucuggcugcccagauacccuguucgggacuggcuccugggagaucuucugucuggccucagcguggcuaucaugcagcugccccaagggcuugccuaugcccugcucgcuggacugccucccguguucggccuguacuccucuuuuuauccugucuucauuuacuuucucuucgggacgagccgccacaucuccgugggaaccuuugccguuaugucugugauggucggcagcgugacagagucccuggcuccgcaggcccuuaaugacagcaugauuaacgaaaccgcgagagaugccgcucggguucagguggccucuacacuguccguccucgugggccuguuccagguggggcuuggacugauccauuuuggcuucgucguuaccuaucucagcgagccccuggugcgcggguacacaaccgcugccgcggugcaagucuuugugucucagcugaaguacguuuucggacuccaccuguccagccacucuggcccucuuucccugauuuauacggugcucgaggucuguuggaaacugccccagagcaagguggggaccguugugacagccgcugucgccggagugguccuugugguugugaaacugcucaaugacaagcugcagcaacagcugccuaugcccaucccgggcgaacuccugacccuuaucggcgcuacagggauuuccuacggaaugggccugaaacauagauuugaggucgaugugguugggaacaucccugccggacucgugcccccugucgcccccaauacccagcuguucucuaagcuggugggcagcgcuuuuacgauugcggugguuggguucgccaucgcuauuucccuuggaaagaucuucgcccuccggcacggcuaucgcgucgacagcaaccaagaacugguggcccugggccucucuaaucugauugggggaaucuuucagugcuuccccguguccuguagcaugucuagaagccuuguccaggaguccacaggcgggaacucucagguggcuggagccaucagcucccuguuuauucuccugaucauuguuaaacugggcgagcuuuuccaugaucucccuaaggcggugcuggcugccaucauuaucgucaaucugaaagggaugcuccggcaacugagcgacaugagaucucuuuggaaggccaaccgcgcugaucugcucaucuggcuggugaccuuuacagccaccauucugcuuaaucucgaccugggccugguuguggcugucaucuucucccuccugcuugugguugugcggacccagaugccgcacuacagcguccugggacaggugcccgauacagacauuuauagagacguggccgaauacucugaggcgaaagaaguccgcggcguuaagguguuucgguccagcgccacgguguauuucgcuaacgccgaguuuuacuccgaugcucucaagcagagaugcggggucgacguggauuuccugaucucucagaaaaagaaacugcuuaagaaacaggaacagcucaagcugaaacagcugcaaaaggaggagaagcuccgcaaacaggccgcgagcccuaagggagccuccguuucuauuaaugugaacaccagccuggaagacaugcgguccaauaacgucgaggauuguaaaaugaugcaagugagcucuggcgacaagauggaagaugcuacagccaacgggcaggaggacuccaaagcucccgauggaagcacccuuaaggcccugggccucccucaacccgacuuucacucucugauccuggaucuuggggcccuguccuucguugacacagugugccucaagagccugaaaaauaucuuucaugacuucagagaaauugaggucgagguguacauggcugcgugucacucuccgguugugagccagcucgaagccggccauuucuuugaugcuuccaucaccaagaaacaccuguucgccagcguccaugacgccgugacguuugcccuucagcacccucgccccgugccugauucucccgucuccguuacacggcuguga

SEQ ID NO: 75731 - RNA, 1971 nt, Artificial Sequence
  derived and/or modified sequence opt5 from SLC26A7__Homo_sapiens__NP_439897
augaccggcgccaagcggaaaaagaaaagcaugcugugguccaagaugcacacaccccagugcgaggacaucauucaaugguguagacgcagacucccuauccuggauugggcuccgcauuacaaccuuaaagaaaaucugcuccccgacacggugucugggauuaugcuggccguccagcagguuacccagggacuugcguucgcugugcugagcuccgugcacccugucuuuggccucuaugggucucuguuccccgccaucauuuacgccaucuuuggaaugggccaucacguggcuacagggaccuucgcccugacaagccucaucuccgcuaacgccguugagcggauugugccucaaaauaugcagaaccugaccacacagucuaauaccagcguccuuggacuguccgauuuugaaaugcagcgcauccauguggcggccgcuguuagcuuccucggcggcgugauucaagucgccauguuugugcugcagcuugggucugcuacguucguggucaccgagcccguuaucuccgccaugacaaccggagcggccacacacguggugaccagccaggucaaguaucugcucggcaugaagaugccuuacauuucugggccgcugggauuuuucuauaucuacgcuuauguguuugaaaacauuaaauccguuagacuggaggcccuccugcuuagccugcucucuaucgugguccuggugcuuguuaaggagcugaaugaacaguucaaacggaagaucaaagugguccuccccguggaccugguccugauuaucgcugccuccuuugccugcuacuguacgaacauggagaauacauacggccucgaagugguugggcacauuccucaaggaauccccagcccucgcgcucccccgaugaacauucuguccgcggugaucaccgaggccuucggcgucgcucuugugggcuauguugccucucuggcccucgcucaggggagcgccaagaaguucaaauacuccaucgaugacaaucaggaguuucuggcgcauggacuuagcaacauugugucuuccuucuuuuucugcaucccuagcgcugccgccaugggcagaacagcugggcuguauucuaccggagccaagacccaagucgcuugucucauuagcugcaucuuugugcugauugugaucuacgccaucggcccccugcucuauuggcugccuauguguguucuugcguccauuaucgucguggggcugaaaggaaugcucauucaguuccgggaucugaagaaauacuggaauguggacaagaucgauuggggcauuugggucucuacauauguguuuacgaucugcuucgccgcuaacguuggccugcuuuuugggguggucuguaccauugccaucgugaucggacgcuuccccagagcuaugacaguuagcauuaaaaauaugaaggaaauggaguuuaaggugaaaaccgaaauggacuccgagacacuccagcaggucaagaucauuagcaucaacaacccccugguguuccugaaugccaaaaaguuuuacaccgaucucaugaacaugauucaaaaagaaaaugcgugcaaccagccucuggacgauaucucuaagugugagcagaauacgcuucugaacucccucagcaauggcaacugcaaugaggaagccucucaguccugcccgaacgagaaguguuaccugauccuggacugcagcggguucacauucuuugacuauuccggaguuucuaugcuuguggaagucuacauggauuguaaaggccggagcguggacgugcuccuggcucacugcaccgccucccugauuaaggcuaugaccuauuacgggaaucucgauucugagaaacccaucuucuuugaaagcgucuccgccgccauuagccauauccacucuaacaagaaucuguccaaacuuagcgaccacucugagguuuga

SEQ ID NO: 75732 - RNA, 2913 nt, Artificial Sequence
  derived and/or modified sequence opt5 from SLC26A8__Homo_sapiens__NP_001180405
auggcccagcuggagagaagcgcuaucuccggcuucucuagcaagucccggcgcaacucuuuugccuacgacgugaaaagagaagucuauaaugaggaaaccuuccaacaggagcacaagcggaaagcgagcuccucugggaacaugaauauuaacaucacaacguuucgccaucacguucagugcagauguagcuggcaucgguuccuccgcugcgugcugaccauuuuucccuuccuugaauggauguguauguacagacugaaggauuggcuccugggagaccuucuggcuggcaucuccguggggcucguccaggugccucaaggacugacacugagccuccuggcccggcagcuuauuccgccccugaauaucgccuaugcugccuuuuguucuuccguuaucuacgugauuuucggcagcugccaccagaugucuaucggguccuuuuuccucgucagcgcucugcuuauuaacgugcugaaaguuucuccuuuuaauaacggacagcucgugaugggcuccuucgucaagaaugaguuuagcgcccccuccuaucugaugggcuacaacaagucucugagcgugguggcgaccacaaccuuccucacagggaucauucaacugaucaugggaguccuuggccugggguucauugccaccuaucucccugaguccgcuaugagcgccuaccuggcugccguugcgcuucauaucaugcugucucagcucacguuuaucuucggaauuaugaucuccuuucacgccggccccauuagcuucuuuuacgauaucauuaauuauugcguggcucugccuaaagccaacucuaccagcauccugguguuccucacagucgugguugcucugcgcaucaauaaguguauuagaaucuccuuuaaccaguacccgauugaauuucccauggagcuuuuucugaucauuggguucaccgugaucgccaauaaaaucucuauggccacagaaaccagccagacgcucauugacaugaucccuuauuccuuucugcuucccgucacaccugauuucagccugcuccccaagauuauccugcaggcuuuuucucugucccucgugagcucuuuccugcuuauuuuccuggggaaaaagaucgcgucccuccacaacuacagcguuaacuccaaucaggaccugauugccaucggccugugcaacguggucucuagcuuuuuccgguccuguguguuuaccggcgcuaucgcccgcacaauuauccaggauaagucugggggaagacaacaguucgccagccuugucggcgcuggggugaugcuccugcugaugguuaaaaugggacauuucuucuauacccucccgaaugccgugcuggcgggcauuauccuuuccaacgucauuccuuaccuggagaccaucagcaaucuccccucucuguggcggcaggaccaguaugauugcgcucuguggaugaugacauuuuccagcucuaucuuccuugggcucgacauuggacugaucauuuccgugguuagcgccuuuuucaucacgaccgugcgcucucacagagccaagauucugcuccugggccaaaucccuaacacaaauaucuaccggagcauuaacgauuacagagagaucauuaccauccccggcgucaaaauuuuucaguguugcuccagcaucacauucgugaauguguauuaccuuaagcauaaacugcucaaggaaguugacauggucaaagugccccugaaggaggaagagaucuuuucucuguucaacuccagcgauaccaaucuucaagggggaaagauuugccgcuguuucugcaacugugacgaccucgaaccucugccgcggauccuguauacggagagauuugagaauaaacucgaucccgaggcuuccucuauuaaccugauccacugcagccacuucgaauccaugaauacaucucagaccgccagcgaagaccaagugccuuacaccgucuccucugugagccagaagaaccagggccagcaauaugaggaaguugaggagguguggcuucccaacaauuccagccgcaacucuuccccugggcugcccgaugucgcugaaagccagggacggagaucucucauuccguacuccgacgccagccugcugccuucugugcauacaaucauucuugauuuuuccaugguucacuauguggacagccgcggccucgucgugcugcggcagaucuguaaugcguuccagaacgccaauauccugauucucaucgcugggugccauuccagcauuguuagagccuuugagcgcaacgauuucuuugacgcuggcaucaccaaaacacaacuguuccuuucugugcacgaugccguccuguuugcgcucagccggaaggugauuggauccucugaacugagcaucgacgaguccgaaacggugaucagagagaccuacucugagacagauaaaaaugacaacagccgcuacaagauguccucuagcuuccugggcucccagaagaaugucagccccggguuuauuaaaauccagcaaccuguugaagaggaaucugagcuugaccuggagcucgaauccgagcaggaagccggacugggccucgaucuggaccuugaucgggagcuggaacccgagauggagccuaaggcugaaaccgagacaaaaacccagacggaaauggagccccagccggaaaccgagccugagauggaacccaaccccaagagcagaccucgggcccauacauucccgcaacagcgcuauuggcccauguaccacccuucuauggcuuccacccagagccagacacaaaccagaacgugguccguggagcggagacgccaccccauggacucuuauagcccugaaggaaauuccaacgaggauguguga

SEQ ID NO: 75733 - RNA, 2664 nt, Artificial Sequence
  derived and/or modified sequence opt5 from SLC26A9__Homo_sapiens__NP_599152
augagccagcccagaccucgguacguggucgaccgcgccgcuuauucccugacccucuucgaugacgaguuugaaaagaaagauagaacauacccgguuggcgagaagcugcggaacgccuuccgcugcucuagcgcgaaaaucaaggcugugguguuugggcuucugcccguccucuccuggcugccuaaauauaagauuaaggacuacaucauucccgaucuucugggaggccucucugggggaagcauccaagugccucagggcauggccuucgcccugcuggcuaaucuccccgccguuaacgggcuguauuccuccuuuuucccucuucugacguacuuuuuccucggaggcgugcaccagauggucccgggcaccuuugcugugauuagcauccugguugggaauaucugucuucagcuggcccccgaauccaaauuccaaguguuuaacaaugcgacaaacgagagcuaugucgacaccgccgcuauggaagccgagagacuccaugugucugcuacacuggccugccugaccgcgauuauccagaugggacucggcuucaugcaguuuggguucguggccauuuaccuguccgagagcuucauccggggauuuaugacagcugccggccuucagauucugaucucuguccucaaguacauuuucgggcugaccaucccuuccuauacgggacccggcagcaucguuuuuaccuucauugauaucuguaaaaaucuuccucacacaaacauugcuucucugaucuuugcccucauuuccggcgccuuccuggugcuggugaaggaacucaaugcucgcuacaugcauaaaaucagauuucccaucccgaccgagaugauugucgugguuguggcgacagccaucagcgggggaugcaagaugccuaagaaauaucacaugcaaauugucggcgaaauccagcggggguuccccaccccugugucccccguugugucucaguggaaggacaugauuggaacggcuuuuagccuggccaucgucuccuacgugaucaaccuugccaugggccgcacacuggcuaauaaacauggguaugaugucgacagcaaccaggagaugauugcccucggauguucuaauuucuuuggcuccuucuuuaagauccacgugauuugcugugcgcugagcguuacccuugcuguggauggcgccgggggaaaaucucaagucgccagccugugcgugucccucguugugaugaucacaaugcugguccugggcauuuaccucuauccccugccuaagucugugcuuggggcucugaucgccgugaaccucaaaaauagccugaagcagcugaccgacccguacuaccuuuggagaaaguccaaacucgauuguugcauuuggguugucagcuuccugucuuccuucuuucugagccuccccuauggaguggcugugggcgucgccuucucugugcugguuguggucuuucagacccaauuccggaacggguacgcgcuugcccaggugauggacacagacaucuauguuaacccuaagacguacaaucgcgcucaggauauccagggcauuaaaaucauuaccuauuguucuccccuguacuuugccaacagcgagaucuucagacaaaaggugauugcuaaaacaggaauggacccucagaagguccuccuggccaagcagaaauaucugaagaaacaggaaaagcggcgcaugagacccacccaacagcggagaucccuuuuuaugaaaacaaagaccgugucucuccaggagcugcagcaagauuucgaaaaugcgccgccuacggaccccaacaauaaccagaccccugccaauggcacaagcguuuccuacaucaccuuuucucccgauagcuccagcccugcucagucugagcccccggccuccgcugaagccccuggggagcccagcgacaugcuggccucugugcccccuuucgucacauuucacacccucauccuggauauguccggagugagcuucguggaccuuaugggcauuaaggcucuggcgaaacucucuagcacauacgggaagaucggagucaaaguuuuucuggugaacauucaugcccagguguauaaugauaucucccacggcggggucuucgaggacggcagccuggaaugcaagcauguguucccgucuauucacgaugcuguucuuuuugcccaagccaacgcucgcgacgugacgcccggacacaauuuccagggcgccccuggggacgcggagcucucccuguacgauagcgaagaggacauccgguccuauugggaucuggaacaggagauguuuggaucuauguuccaugcugagacccucacagcccuggaaagccuuuccgccgcuggcgggugcuaccccuauagaucugagagccuggucuccccucucuuuacccgccaagcccuggcggcuauggacaaacccccugcccacucuacacccccgaccagcgcccugucccuugcugccgaaggacaucucgauuuccagcugcugcgggugagccagaagcagaaggacaaauacaacugugcuggccuccuguauaaacuucaaaagguuucucaguccccucacgggagcgugucugauggcgucagacugucccgcacguga

SEQ ID NO: 75734 - RNA, 1977 nt, Artificial Sequence
  derived and/or modified sequence opt5 from SLC27A1__Homo_sapiens__XP_011526304
augagagcccccggcgcuggggccgcgagcguggucucccuggcucuccuguggcuucugggacucccuuggaccuggucugccgccgcugcccugggcguuuacguggggagcggaggcuggcgguuccuucgcaucgugugcaagacagcuagacgggaccuguuugggcucuccguccugauucgcgugagacuggagcuccggcgccaccagagagccggacauacgaucccgcggauuuuccaagcgguugugcagcgccagcccgaaagacuggcccuugucgaugcuggcaccggcgaguguuggacauuugcccagcuggacgcuuauucuaacgccguggcgaaucucuuccggcaacugggguuugccccuggagauguuguggcuaucuuccuugaaggccgccccgaguuugucgggcuguggcucggacuggccaaagcuggcauggaagccgcccugcucaacgugaaucugagacgggagccucuugcuuucugccuggggaccagcggagcgaaggcccucauuuuuggcggcgagaugguggcugccgucgccgaaguuuccgggcaccugggaaaaucucuuaucaaguucuguagcggcgaccuggggcccgagggaauccucccugauacacaucugcuggacccgcuccugaaagaagccuccaccgcuccccuugcgcagauuccuagcaagggcauggaugaccgccuguuuuacaucuauacaucugggaccacgggacuccccaaggcugccauuguggugcacuccagauacuaucggauggccgcuuucggccaucacgccuacagaaugcaggcugccgauguccuguaugacugccuuccucuguaccacagcgcgggcaacaucauuggggugggacagugucucaucuacggccugaccguugugcugcgcaaaaaguuuucugccucccgguucugggaugacugcauuaaauauaauuguacaaucaacggggucagacauugccgccuccugugucuugugguucaauacaucggagagauuugccgguaucugcucaagcagcccgugagagaggcugaacgccggcacagaguccgccuggccgugggcaaugggcugcggccggcuaucugggaggaauuuaccgagagauuuggcguccgccagauuggagaguucuacggcgccacagaauguaacugcagcaucgcgaauauggaugggaaagugggaucuugcggcuuuaacucccggauucuuccucauguuuaucccaucagacucgugaaggucaaugaggacaccauggaacugcugcgggacgcccaggggcucuguaucccuugccaagcuggagagcccggccugcuuguggggcagauuaaccagcaagauccccugcgcagauucgacggcuacguuagcgaauccgccacgucuaagaaaaucgcucacagcguguuuuccaagggagauagcgccuaucucucuggcgacguccuggugauggaugagcugggguacauguacuuccgggacagauccggagauacauuucgcuggcggggcgaaaaugugagcaccacagagguugaggggguccuuucuagacuccugggacagaccgacguggccguguauggcgucgcugugccugggguugaaggcaaagcgggaauggccgcuguggccgauccgcacagccugcucgaccccaacgccauuuaccaggagcugcagaagguccuugcuccuuaugcccgccccaucuuccugagacuccugccucaaguggauaccacaggcacguuuaaaauucagaagacccggcugcagcgcgaaggguucgaccccagacagacauccgaccggcuuuucuuccucgaucugaaacaaggacauuaccugccgcucaaugaggcgguuuauacccgcaucuguucuggcgcuuuugcccuguga

SEQ ID NO: 75735 - RNA, 1704 nt, Artificial Sequence
  derived and/or modified sequence opt5 from SLC27A2__Homo_sapiens__NP_001153101
augcugagcgccaucuacaccgugcucgcuggccugcuuuuccugccccuccuggucaaccuuugcuguccuuauuucuuccaggacauuggguacuuucugaagguugccgcggugggaagacgggugcgcuccuauggcaaaagacggccggcucgcacaauccucagagccuuccuggagaaggcccggcaaacgccccacaaaccuuuucuucucuuccgcgaugaaacccugacauacgcucaggucgacagacggucuaaucagguggcccgcgcucugcaugaucaccuggggcucagacagggagacugcguugcccugcuuaugggcaacgagcccgcguauguguggcuguggcucgggcuggucaagcugggaugugccauggcuugccucaauuacaacauucgggccaaaagccugcuucauuguuuucaaugcuguggcgcuaaggugcugcucguuuccccugaacugcaggccgcgguggaggaaauccuucccucucugaagaaagaugacgucagcauuuauuacgugucccgcaccucuaauacagauggcaucgacagcuuccucgauaagguggacgaggucuccaccgagccuaucccggaaagcuggagaucugagguuacauuuuccacccccgcccuguacauuuauacgagcgggaccacaggagcuacccuggcccuccggacaaaauucucugcuucccaguuuugggaugacugccgcaaguacaacgugaccgugauccaguauauuggcgaacugcuuagauaccuguguaauagcccucaaaaacccaacgaucgggaccacaaggucagacucgcccuggggaauggacuucgcggcgacguguggcggcaguucguuaagagauuuggggauaucugcauuuaugaguucuacgccgcuacggagggaaacaucggcuucaugaauuaugcgcgcaaagugggcgccgucgggcgggugaacuaccugcagaagaaaauuaucacauacgaccucaucaaguaugauguugaaaaagacgagccugugagagaugaaaauggauacuguguccgcgugcccaagggcgaggucgggcugcuggugugcaaaauuacccagcucacaccguuuaacggauaugcuggcgccaaggcccaaaccgaaaagaaaaagcugcgggacguuuucaaaaagggggaucuuuacuuuaauucuggagaccugcucaugguggaucaugagaacuucaucuauuuucacgacagagucggcgauaccuuccgcuggaaaggcgagaacguggcuacaacggaaguugccgacaccguggggcuggucgacuuugugcaggaggugaauguuuacggaguccacgugccugaucaugaaggccggauugggauggcguccaucaagaugaaggagaaccacgaauuugacggcaaaaagcuguuucagcauauugcugauuaucuucccagcuacgccagaccucgcuuccuccggauccaagacacaaucgagauuaccggaacauuuaaacacagaaagaugacccugguggaggaaggguucaaucccgccgucaucaaagaugcucuguacuuucucgacgauacggccaagauguaugugcccaugacagaggacauuuacaacgcuaucuccgccaagacccugaaacuuuga

SEQ ID NO: 75736 - RNA, 2193 nt, Artificial Sequence
  derived and/or modified sequence opt5 from SLC27A3__Homo_sapiens__NP_077306
augggcgugugccagagaacccgggcccccuggaaggagaaaagccaacuggaacgcgcugcccucggguucagaaagggaggcuccgggauguuugcgucuggauggaaccagacagucccuaucgaggaagcuggcagcauggccgcccugcuucugcucccgcugcuucugcuccugccccugcuccugcuuaaacugcaccucuggccucagcugcgguggcuucccgcugaccuggccuucgcuguucgcgcccucuguugcaagagagcgcugcgggcccgcgcucuggccgcugccgcggccgauccugaggggcccgaaggaggcuguucccucgcuuggagacuggccgagcuugcucagcaacgggccgcccauacguuucugauucacggcucucgcagauucagcuacuccgaggcugaacgggagucuaaucgcgcggccagagcuuuucuccgggcccuggggugggacuggggaccugauggcggggacagcggagaaggcuccgccggggagggagagcgcgcugccccgggcgcgggcgaugcugccgccgggagcggagcugaguucgccggcggggacggagcugccagaggcgggggagcggccgcuccccuuucuccuggcgccaccguggcucugcuccugcccgccggcccugaauuucuguggcucugguucgggcuggcgaaagccggacuucggacagcuuuugugcccaccgcccugagacgcggcccgcuccugcauugccuucgguccuguggggcuagagcccugguccucgccccugaguuccuggaaagccuggaacccgaucucccugcucugcgcgcgaugggacuucaccugugggccgcuggccccgggacacaucccgccggcaucucugaccuccuggccgagguguccgcugagguugauggaccugugccgggcuaucugagcucuccccaguccauuaccgacacaugccuuuacaucuuuaccagcgggacgaccggacucccuaaggccgcgcggauuucccaccugaagauccugcagugucagggcuucuaucaacucugcgggguccaccaggaagaugugaucuaccuggcccuuccccuguaucauaugucuggaagccuccugggcauuguuggguguaugggcaucggagcuacagugguccugaaauccaaguuuagcgccggccaguucugggaggacugccagcaacacagagugaccguguuccaguacauuggggaacuuugucgcuaucucgucaaccagccucccucuaaagcugagcggggacauaagguuagacuggccgugggcuccgggcugcgcccggauacaugggaacgguuugugagacgcuucggaccucuccaaguccuggagaccuacggccuuacggaggggaauguggcgacaaucaacuacaccggccagcggggagcuguuggcagagccagcuggcuguauaaacacauuuuucccuucucucucauccgguacgacgugacaaccggggaaccuauucgcgacccccagggacacugcauggccaccagcccuggcgagcccgggcugcuggucgcuccggugucccagcaaucuccuuuucuuggauaugccggcgggcccgaacucgcucagggcaagcugcugaaggauguuuucagacccggagacguguuuuucaauacaggcgaucuccuggucugcgacgaucagggguuucuucgguuccaugacagaacgggagauaccuuucgcuggaaaggcgagaacguggccacaaccgaagucgcggagguguucgaggcccuggacuuucuccaggaaguuaauguguacggggucacagugccuggacacgagggccgggcuggcauggccgcucugguucugagaccgccccaugcccuugaucucaugcaacuguauacccacgugagcgaaaaccugccucccuacgcccgcccuagauuccuccggcugcaggagucccuugcuacgacagagaccuucaagcagcagaaaguccgcauggcgaaugaaggguuugaccccagcacccugucugauccucucuaugugcuggaccaagccgugggagcuuaccugccccuuacaaccgccagauacuccgcccugcucgcuggcaaccugcggaucuga

SEQ ID NO: 75737 - RNA, 1932 nt, Artificial Sequence
  derived and/or modified sequence opt5 from SLC27A4__Homo_sapiens__NP_005085
augcugcucggcgccagccugguggggguccuucuguucuccaagcucguucugaaacuucccuggacccaggugggauuuucucuccuguuccuguaccugggcagcgggggauggagauuuauccggguguucauuaagacaauccgcagagacauuuuuggcgggcucguccugcuuaaagugaaggcuaaaguucggcaaugccugcaggagcgcagaacggugccuauccucuucgccuccaccguccggcgccacccggauaagacagcgcugauuuuugaaggaaccgacacacauuggaccuucagacagcuugaugaguauucuagcuccguggcuaacuuucugcaggcccggggccucgccucuggcgacguugcugccaucuucauggaaaaucgcaacgaguuuguggggcuguggcugggaauggcuaagcucggcgucgaagccgcgcugaucaauacaaaccuuagacgggaugcccugcuccacugucugaccacgagccgcgcuagagcccuuguguucggguccgagauggcuagcgccauuugcgaggugcaugcgucucuggaccccucccucagccuguuuuguucuggauccugggaaccuggcgccgugcccccuagcaccgagcaccuggauccccuccugaaagacgcuccuaagcaucuuccgucuugccccgauaaaggguucacagacaagcuguucuacaucuauaccuccggaacaaccggccucccuaaagccgcuauuguugugcacagccgguacuaucgcauggccgcccugguguacuauggcuuuagaaugcggcccaaugauaucgucuacgacugucuuccucuguaccacuccgcugggaacauugugggaaucggccaaugccuccugcaugggaugacgguugugauuagaaagaaguucucugcgagccgcuuuugggaugacuguaucaaauauaauugcacaaucguccaguacauuggagaacugugucgguaucuccugaaccagcccccgagagaggccgagaaucagcaccaagugcgcauggcucuuggcaacgggcugcggcaguccaucuggaccaauuucagcucuagauuucauauuccucagguugccgaguucuacggagccacagaaugcaacuguucccucggcaauuuugacagccaggugggcgcuugcggguucaacucucgcauccugagcuuugucuaucccauucggcuggugagagucaaugaagauaccauggagcuuauccgcggaccugacggcgugugcauccccugucaacccggggaaccuggacagcucguuggccggauuauccagaaggauccgcugagacgcuucgacggguaccugaaccaaggcgccaacaauaaaaagauugcgaaagauguguuuaagaaaggagaccaggcuuaucucaccggcgauguccuggugauggacgagcuuggguaccuguacuuccgggauagaacaggagacacguuucgguggaagggcgagaacguuuccaccacagaaguggaggggacccucucucgccugcuggauauggccgacgucgccguguauggaguggaaguucccggcacagaggggagagcuggcauggccgcugucgccagcccuaccggaaauugcgaccuugaacgguucgcgcagguccucgagaaggagcugccccuguacgccagaccuaucuuccuccgccugcuucccgaacugcacaaaacgggcacauauaaguuucagaaaaccgagcuccggaaggaaggguucgauccggcuauugugaaagacccucuguuuuaccuggaugcccaaaagggaagauaugucccccuugaccaggaggcuuacucccgcauccaggccggcgaagagaagcucuga

SEQ ID NO: 75738 - RNA, 2073 nt, Artificial Sequence
  derived and/or modified sequence opt5 from SLC27A5__Homo_sapiens__NP_036386
augggcgugagacagcaacuggcccuccugcuucugcuccugcuucugcucugggggcugggacagcccgucuggccuguugcuguggcccugacccuccgguggcugcuuggcgacccgacaugcugugugcugcucgggcuggcgaugcuugcucgccccuggcugggaccuugggucccccacggccucagccuggccgccgcugcccuggcucucacgcugcuuccugccagacugcccccugggcuccgguggcugccggcggaugugaucuuccuugccaagauucugcaucucggacugaaaauccgcggcugccuguccagacagcccccugacaccuuuguugaugcuuucgagcggcgcgccagagcucagcccggccgggcccuccugguguggacagggccuggagcgggcucugucaccuuuggggaacuugacgcccgcgcuugucaagccgcuugggcccugaaggccgagcucggagaucccgcuagccugugcgcgggcgaaccgacagcccuucuggugcucgcuucccaggccguuccugcccuguguauguggcuggggcucgcuaaacugggaugccccaccgccuggauuaacccucacggcagaggcaugccccuugcgcauucugugcugagcuccggggcucggguccucgugguggaccccgaucugcgcgagucucuggaagagauccuuccuaagcuccaggccgagaauauuagauguuucuaccugagccacacauccccgacccccggagucggcgcccugggggcugcccucgacgcugccccuagccaucccguuccugcggaucugcgggccggaaucacguggcgcucucccgcucuuuuuaucuauaccuccggcacaaccgggcugccgaaaccugccauucucacacacgaaagagugcugcagaugagcaagaugcugucucuuuccggagcuaccgccgacgauguggucuacacggugcucccccuguaucacguuaugggccugguggucggcauccucgggugccuggaccuuggagcgacaugugugcuggccccuaaguucagcaccucuugcuuuugggaugacugucggcaacauggcguuacagugauucucuacgucggggagcugcugagauaucuuugcaacaucccccagcagccugaagaccgcacccacaccgugcggcucgcuaugggaaauggccugagagccgaugucugggagacauuccagcaacgcuuugggcccauucggaucugggagguguacggcuccacggaaggaaacaugggccugguuaauuauguggggagaugcggagcucucggcaaaaugagcugucugcuucgcaugcuguccccguucgagcucguccaguuugacauggaagccgccgagccugugcgggauaaccagggguucugcauucccguuggacugggcgaacccgggcugcuucucaccaagguggucucucaacagccuuuugugggcuacagaggaccgcgcgagcugagcgagcggaaacuggugagaaauguucgccaguccggcgacgucuacuauaacacaggggaugugcucgcuauggaccgggaaggauuccuguacuucagagaucggcuuggcgacaccuuucgcuggaagggggagaaugugagcacacaugaagucgagggagugcugucucagguugauuuccuccaacaggugaacgucuauggcguguguguucccgggugcgaaggcaaagugggaauggcggccguccagcuggcuccuggccagaccuuugacggggagaagcuguaccaacacgugagagccuggcuucccgccuaugcuacgccucacuucauccggauccaggaugccauggagguuacauccaccuuuaagcugaugaaaaccagacucgugcgcgaaggauucaaugucggcauugugguggacccccuguuuguccucgacaaccgggcgcagagcuucagaccucugacagcugagauguaccaggccguuugugaagggaccuggcgccuuuga

SEQ ID NO: 75739 - RNA, 1950 nt, Artificial Sequence
  derived and/or modified sequence opt5 from SLC28A1__Homo_sapiens__NP_004204
auggagaacgaccccagcagacggcgcgaauccaucucucugaccccuguggccaagggccucgagaauaugggggcugauuuccuggaaagccuugaggaaggacagcugccgagauccgaccucucucccgccgagauucggagcuccuggucugaggcggcuccuaaacccuuuagccgcuggagaaaccugcaaccugcccuucgggcccgcuccuucugcagagaacacaugcagcuguuucgguggaucggcacagggcuccuguguacgggacugagcgcuuuccuccuggucgccugccuucuggauuuucagcgcgcucucgcccuguucguucuuaccuguguggugcugacauuucucggccauagacugcugaagcggcuccuggggcccaaacuucgcagauuccugaagccucagggacacccgcggcuccugcuuugguuuaaacgcggccuggcgcucgccgcuuuccugggccugguccucuggcugucucuugacaccucccaaagacccgagcagcuggugagcuuugccgggauuugcguuuucguggcucuccuguuugccuguucuaagcaucacugcgcggucuccuggcgggccgugagcuggggacuuggccugcaguucguucucgggcugcuggugaucagaacagaaccuggauucauugcuuuugaguggcucggcgagcagauccgcaucuuccugucuuacaccaaggccggguccagcuuugucuucggagaagcucuugugaaagauguguuugccuuccaaguccugcccauuaucguguuuuucuccuguguuauuucugugcucuaucaugucggccugaugcagugggugauccugaagauugccuggcuuaugcagguuacaaugggcaccacggcuaccgagacacucagcguggcggggaauaucuuugucucccagaccgaagccccucugcugauucggcccuaccucgcugacaugacacugagcgaggugcacguugugaugaccggaggcuaugccacgaucgccgggucucuucugggagcuuacaucuccuucggcauugaugccacaagccucaucgcggcuucugucauggccgccccgugcgcucuggcccugagcaaacuuguguauccugaagucgaggaguccaaguuuagacgcgaagagggggugaaacucaccuacggagacgcucaaaaccugauugaagccgcgucuacaggcgccgcuaucagcguuaagguggucgccaauauugcugccaaccugaucgcguuccucgccgugcuggauuuuaucaaugcugcccuuuccuggcugggcgacaugguugauauucaggggcucagcuuccagcugaucuguucuuauauucugcggcccguggcuuuccuuaugggagucgccugggaggacugcccugugguggccgaacuccugggcaucaagcuguuucucaacgaguucguugcuuaccaagaucuguccaaauacaagcagagacgccuugcgggggccgaggaaugggucggagaccggaaacaguggauuagcgugagagcugaggugcugaccaccuuugcccucuguggcuucgccaauuuuucuuccaucgggaucaugcugggcggacugacaagcauggucccccagcgcaaguccgacuucucucaaauugugcuucgggcucucuuuacgggcgccugcguuagccuggugaacgcgugcauggcugggauccuguauaugcccagaggagccgaagucgauuguaugucccuccugaauaccacacuuucuagcuccagcuucgagauuuaccagugcugucgcgaagccuuucagucugugaacccugaguucuccccggaggcucuggacaauugcugucgguuuuauaaccacaccaucugcgcccaguga

SEQ ID NO: 75740 - RNA, 1977 nt, Artificial Sequence
  derived and/or modified sequence opt5 from SLC28A2__Homo_sapiens__XP_011520500
auggagaaggccagcggcagacaguccaucgcucugucuaccguggaaacagggacggucaaccccggacucgagcugauggaaaaagagguugaaccugagggcagcaagcggaccgacgcccaagggcacucccuuggagauggccuggggccgucuacauaccagcgcagaagccgguggcccuucuccaaagcgcgcucuuuuugcaagacccaugcuagccucuucaaaaagauucugcuuggacugcucugucuggccuaugccgcuuaccugcucgccgcuugcauccugaauuuucagagagcccuugcgcuguucgugauuacaugucucgugaucuuuguccuggugcacuccuuccuuaagaaacugcucggcaagaaacugacccggugccugaagccuuuugagaacagccgccucagacuguggacaaaauggguuuucgccggcgugucucuugucgggcugauucucuggcuggcucuugacaccgcccagcggcccgaacaacugaucccuuuugcuggaaucuguauguucauucucauccuguuugccugcuccaagcaucacagcgcggugucuuggcgcacgguuuucuccggccuggggcuccaguuuguguucggcauucuggucaucagaaccgaucuuggauauacaguguuccaguggcugggggaacaggugcaaauuuuucucaauuacaccgucgccggaagcucuuucguuuuuggcgacacacuggugaaggauguguucgcuuuucaggcccuucccaucauuaucuucuuuggcugugucguguccauccuguauuaccucgggcugguucagugggugguccagaaaguggcuugguuccugcaaauuaccaugggaacgacagccaccgagacacucgccguugcuggcaacaucuuuguggggaugaccgaggcgccucugcuuauucggccguaucugggagacaugacccucagcgagauccaugccgucaugacaggcggguucgcuacgauuuccggaaccgugcugggcgccuuuaucgccuucggcgucgaugcuucuagccugaucuccgccagcgugauggcggcucccugcgcccuugccucuuccaagcucgcuuacccugaaguugaggaaagcaaauuuaagucugaggaaggggugaaacugccccgcggaaaggagagaaauguccuggaggccgcuagcaacggcgccguggacgcgauugggcucgccacaaauguugcugccaaccugaucgcuuuccuugccgugcuggcguucauuaaugccgcucucuccuggcugggagaacuggucgauauccagggccuuaccuuucaggugauuuguucuuaccuccugcggccuaugguguucaugauggggguugaguggacagacugccccauggucgccgaaauggugggcaucaaauuuuucaucaacgaguuuguggcuuaucaacagcugagccaguacaagaauaagcgccucuccggaauggaagaguggauugagggcgaaaaacaguggaucagcgucagagccgagauuaucaccacguucucucuguguggguuugccaaccuuuccagcauuggaaucacacugggcgggcucaccucuauugugccgcaccggaaguccgaucugagcaaaguuguggucagagcucuguucaccggagcgugcgugucccuuaucucugccugcauggcuggcauccucuauguuccucgcggggccgaagccgacugugugagcuuucccaauacauccuucaccaaccggacauacgagacguauaugugcuguagaggccuguuucaaucuaccagccugaauggaacaaacccucccuccuucagcggccccugggaagauaaggaguuuucugcuauggcccucaccaacugcuguggguucuacaauaacacagucugcgcguga

SEQ ID NO: 75741 - RNA, 2076 nt, Artificial Sequence
  derived and/or modified sequence opt5 from SLC28A3__Homo_sapiens__NP_001186562
auggagcugagaagcaccgccgcuccccgggccgaaggcuacuccaacgugggguuccagaaugaggaaaacuuucucgagaaugaaaacacaucuggaaauaacagcauccgcuccagagcgguccaaucucgggagcacacgaauaccaagcaggacgaggaacagguuacaguggagcaggauagcccucgcaacagagaacauauggaggacgaugacgaggaaaugcaacagaaaggcugccuggagcggcgcuaugauaccguguguggguucugcagaaagcacaaaacaacccuucggcauauuaucuggggcauucugcucgcuggauaccuggucauggugaucuccgccuguguucuuaauuuucaccgcgcccugccgcuuuucgugauuacagucgcugccaucuuuuucgugguuugggaccaucugauggcuaaguaugaacacagaaucgaugagaugcugucucccgggcggcgccuccugaacagccacugguuuuggcuuaaaugggugauuugguccagccugguccucgccgugaucuucuggcuggcguuugacaccgccaagcucggacagcagcaacuggugucuuucggcggccucauuauguacaucguccugcuguuucucuucuccaaguauccuacgagaguuuacuggcggcccgugcugugggggauuggacuucaguuucugcucggccugcuuauccugcgcaccgauccuggguucauugcuuucgacuggcucggaagacaggugcagacauuucuggaauauaccgaugccggcgcuagcuucgucuuuggggagaaauacaaggaccauuucuuugccuucaaagugcugcccaucguuguguuuuucucuacagucauguccaugcucuacuaucugggacuuaugcaauggaucauucggaaggugggcuggaucaugcugguuaccacgggcagcucuccuauugaguccguggucgcgagcgggaauaucuuugugggacagacagaauccccgcuccuggucagacccuaccuuccuuauauuaccaaaucugagcugcacgccaucaugacagcuggcuucagcaccaucgccggguccgugcucggagcuuacauuagcuuuggcguucccucuucccaucugcugaccgccagcgugaugucugccccugcuagccucgcggccgcuaagcuguucuggcccgaaacagagaagccgaaaaucacgcuuaagaacgccaugaaaauggaauccggggauucuggaaaucugcucgaggccgcuacccagggcgccagcuccagcauuucucuggucgcgaacaucgcugugaaucugauugccuuucuugcccuccuguccuucaugaacagcgcucugucuugguucggcaacauguuugacuauccucaacucuccuucgagcugaucugcagcuacaucuuuaugcccuucuccuuuaugauggggguugaauggcaggacucuuucaugguggcccgccuuauuggauauaagacauuuuucaaugaguuugucgcuuacgaacaccugagcaaauggauccaccuccggaaggagggcgggccuaaauucgugaacggagugcagcaguacauuuccaucagaucugaaauuaucgccaccuaugcgcuguguggcuuugccaauauugggagccugggcaucguuaucggaggccuuacauccauggcucccagccgcaagcgggauauugccucuggggcugucagagcccucaucgcgggaaccguggccugcuucaugacggcuuguauugccggcauccuguccagcacacccguggacauuaacugccaucacguccuggagaaugcuuuuaacucuaccuucccugggaauaccacaaaggugaucgccuguugccaaucccuccugagcucuaccguugccaaaggaccgggcgaggugauccccgggggcaaccauagccuuuacucccugaagggauguugcacacuccugaauccuagcacguucaacugcaauggcauuucuaacaccuuuuga

SEQ ID NO: 75742 - RNA, 1371 nt, Artificial Sequence
  derived and/or modified sequence opt5 from SLC29A1__Homo_sapiens__NP_001071643
augaccacaagccaccagccccaagacagauacaaggccguguggcugaucuucuuuaugcucggccuggggacgcuucugccuuggaacuucuuuaugaccgcuacacaguauuucaccaaucggcucgauaugucccagaacgucucucugguuacagccgagcuuagcaaagacgcgcaggcuuccgccgccccggcugcuccccugccugaacgcaauucucucagcgcuauuuuuaacaaugugaugacccugugcgccaugcugccccuccugcuuuucacauaccugaacuccuuucuccaucaaagaaucccucagucugugcggauucugggaagccuugucgcgauccugcucguguuccugauuaccgccauccugguuaaggugcagcucgaugcucugcccuuuuucgucaucacgaugauuaaaaucgugcuuauuaauuccuuuggcgccauccugcaggggagccucuucggacuggcuggccuucugccugccucuuauaccgcgccgauuauguccgggcaaggacucgccggcuuuuucgcuagcguugccaugaucugugcuauugccucuggcuccgagcugagcgaaucugccuucggguacuuuaucacagcuugcgcggugaucauucugaccaucauuuguuaucucggacugccccgccuugaguucuacagauauuaccagcagcugaagcucgaaggcccuggggagcaggagacaaaacuggaccuuaucuccaagggagaggaaccccgggccggcaaggaagagagcggggucuccgugucuaacagccaaccuaccaaugagucccacagcauuaaagcuauccugaagaacaucucugugcucgccuuuuccgucugcuucauuuuuacgaucacaauuggaauguuccccgccguuaccguggaagugaaaagcucuaucgcuggcagcuccacaugggagcgcuacuuuauuccggucucuuguuuccugaccuuuaauaucuucgauuggcugggcagaagccucaccgccguguuuauguggccugggaaggacucccgguggcugcccagccuuguucuggcgcgccucguguucgucccucugcugcuucucugcaacaucaaacccagacgguaucugacagugguuuuugaacaugaugcuugguucauuuucuuuauggccgccuucgcuuuuucuaauggauaccuggccucccucuguaugugcuucggccccaagaaggugaaaccugcugaggccgaaacggcgggggccaucauggccuuuuuccugugucuuggacuggcccucggcgcugucuuuagcuuccuguuucgcgccauuguguga

SEQ ID NO: 75743 - RNA, 1371 nt, Artificial Sequence
  derived and/or modified sequence opt5 from SLC29A2__Homo_sapiens__XP_011543277
auggccagaggcgacgcuccccgggauagcuaccaccugguggggaucuccuucuuuauucucggacugggcacccuucugccuuggaacuucuuuaucacagccauuccguauuuccaggcgcgccucgcuggggccggaaauucuacggccagaauccugagcaccaaccauacaggccccgaggacgcuuuuaauuucaacaauugggucacccuucugucccaacucccucugcugcucuuuacacugcuuaacucuuuccuguaccagugcguucccgaaaccgugcggauucucgggagccugcuugccauccugcuccuguuugcucugacagccgcgcucgugaaggucgauauguccccuggacccuucuuuucuaucaccauggccagcguguguuucauuaauuccuuuagcgcuguucugcagggcucucuuuucggccagcuggggacgaugccuuccaccuauagcacacucuuccugucuggacaaggccuugccgggaucuuugcugcccuggcgaugcuccuguccauggccagcggaguggacgcugagaccucugcccugggcuacuucauuacaccgugcgucgggauccucauguccauuguguguuaucugagccuuccccaccugaaauuugcucgcuacuaucucgccaacaaguccucucaggcccaggcucaggaacuggagaccaaagcggaacuucugcaaagcgaugagaauggaaucccuuccagcccccagaagguugcccucacgcuggaccuggaucucgagaaagaaccugagucugaacccgacgagccgcagaagccuggcaagcccuccguguucacagucuuucagaaaauuuggcugaccgcucuuugccuggugcucguguucacagucacccugagcguuuuuccugccaucaccgccauggugacaucuagcacgucccccggcaaguggucucaauucuuuaaccccaucuguugcuuccugcuuuuuaauauuauggauuggcucgggagaagccugaccuccuacuuccuguggccugacgaggauagccggcuccugccgcuucuggugugucuccgcuuucuguucgucccccuguucaugcuuugccaugugccucagagaucucggcuccccauccuguuuccucaggacgcuuacuucauuacauuuaugcuccuguucgccguuuccaacggauaucuggugagccuuaccaugugucuggcgccccgccaaguccucccgcacgaaagagagguggcuggcgcccugaugacauuuuuccuggcccuugggcucucuugcggagcuucccugagcuuucuguucaaagcccuccuguga

SEQ ID NO: 75744 - RNA, 1428 nt, Artificial Sequence
  derived and/or modified sequence opt5 from SLC29A3__Homo_sapiens__NP_060814
auggccguggucagcgaggacgauuuccagcacuccucuaacagcaccuacagaacaacguccucuagccugcgggcugaccaagaagcccuccuggagaaacuucuggaucggcccccuccgggccuccagagacccgaagaccgguuuugcgggaccuauaucauuuucuuuucccugggaaucggcucucuucugccuuggaauuucuuuauuacagcgaaggaguacuggauguucaagcuccgcaacagcuccagccccgcuaccggggaagauccugagggaucugacauccugaauuauuuugaguccuaccuggccguugccagcacagugcccucuaugcucugucugguggcuaacuuccuucuggucaauagaguggccguucauauucgggugcucgcuucccugaccgucauccuugccaucuuuauggugauuacagcgcugguuaaaguggauaccagcucuuggacgcgcggcuucuuugccgucaccaucgugugcauggugauucucuccggggcuagcacagucuucuccucuagcaucuauggaaugaccggcuccuuuccuaugagaaacagccaggcccugauuucuggcggggcuaugggaggcacaguuuccgccguggcgagccugguggaccucgccgcuucuagcgauguccgcaauuccgcccuggcuuucuuccuuaccgccacgguguuucugguucucuguauggggcuguaccuucugcucucucgccuggaauaugccagauacuacaugcggccggugcuggcugcgcacgucuucagcggagaggaggaacucccccaggacucccugagcgccccuucuguggcuucccgcuuuaucgauagccauacacccccucuuagacccauucugaagaaaaccgccucucucggcuucugcguuacauauguguuuuucaucaccucccugaucuacccggccauuuguaccaacaucgagagccuuaauaagggguccggaucucuguggacaacgaaguuuuucauuccucucaccacauuucugcuguauaacuucgcugaccucugcggccggcaacugaccgccuggauccagguccccggcccuaauagcaaagcgcuucccggguuugugcugcuccgcacaugucugauuccccuguucguccuuugcaacuaccagccuagagugcaccucaagaccguuguguuucaguccgaugucuauccggcucugcugucuagccuccugggacuuuccaauggcuaccugagcacgcucgcccugcuguaugggcccaaaaucgugccucgggaacuugccgaggcuacaggaguugugaugucuuucuacgucugucucggccugacccugggguccgccugcagcacccuccuggugcaucuuaucuga

SEQ ID NO: 75745 - RNA, 1593 nt, Artificial Sequence
  derived and/or modified sequence opt5 from SLC29A4__Homo_sapiens__XP_006715730
augggcagcguggggucccagagacuggaggaacccucugucgccggaaccccugacccgggcguugugaugagcuucacauuugauucccaccaacucgaggaagcugccgaggcggcucaggggcagggacugcgggcccgcggcgugcccgccuucacggacaccacacuugaugaaccuguccccgacgauagauaccaugcuaucuauuuugccaugcugcucgcuggggugggauuccugcuuccuuacaacucuuuuauuaccgacguugauuaucugcaccauaaguaccccggcacaagcaucguguucgacaugucccucaccuauauucuggucgcccuggcggccgugcuccugaauaacguucuuguggagcggcugacacuccacacccgcaucacggcuggcuaccugcuugcccuggggccucuccuguuuauuucuaucugcgaugucuggcugcaacucuucagcagagaccaggcuuaugccaucaaucuggcggccgugggaaccguggcuuuuggcuguacaguccagcaguccagcuucuacggguacaccggaaugcuuccgaaacgguauacacagggcguuaugaccggggagucuacggccggagugaugauuucccugagccgcauccucacaaagcugcuucugcccgaugaaagagcuucuacccucaucuuuuuccugguguccgucgcccuggagcuccugugcuuucuucugcaucuccuggugcggcgcagcagauucguucuuuucuacacaacccggccucgcgacucucacagaggccggcccggccuggggcgcggauauggcuacagagugcaccaugaugucguggccggggacguucacuuugaacauccugcucccgcgcucgccccgaacgaguccccuaaagacagccccgcucacgaggugaccggauccggcggggccuauaugcgguucgaugucccuagaccccgcgugcaacggucuuggcccacauuuagagcccugcugcuccaccgcuacgucguggcucggguuauuugggccgacaugcugagcauugcggugacguauuucaucacccuuugucuguuuccuggacucgaauccgagauuagacauugcauccugggcgaauggcugccgauccuuauuauggcugucuucaaucucagcgauuuugugggcaagauccuggccgcccugcccguugacuggcgcgggacacaccuccuggcuuguucuugccuucggguggucuucauuccucuguuuauccucuguguguaccccuccggaaugccugcccugagacaucccgcuuggccgugcauuuucagccugcuuaugggcaucucuaacggguacuuuggaagcgugccuaugauccucgccgcgggcaaaguuucccccaagcagcgcgagcuggccgggaauaccaugacagucucuuauaugagcggccugacccucggauccgcuguggccuacuguacguauagccugacacgggaugcucacggcucuugccuucaugccuccaccgcgaacgggagcauucuggccggacucuga

SEQ ID NO: 75746 - RNA, 1626 nt, Artificial Sequence
  derived and/or modified sequence opt5 from SLC2A10__Homo_sapiens__NP_110404
augggccacagcccucccgugcugccgcucugcgccuccgucucucugcuugggggacugaccuucggcuacgagcucgcuguuaucagcggggcccugcuuccccugcagcucgacuuuggacuguccugucuggaacaagaguuccucgugggcucucugcuucugggggcgcuccuggcuagccuugugggaggcuuucugauugauugcuauggcagaaagcaggccauccucggguccaaccugguccugcucgccggaucucugacacuuggccuggcugggagccucgccuggcuggugcuuggacgggcuguugugggcuucgccauuucccugagcucuauggcguguugcaucuacgucuccgaacucguggggccucgccagagaggaguucuggugagccuguaugaggccggcauuacggucggcauccuccugucuuacgcucuuaauuaugcccuggcugggacccccuggggauggcggcauauguuuggcugggccacagcgccugccgugcuccagucccugagccuucuguuccuccccgcugggaccgacgaaacagccacccacaaagaucugaucccucugcaaggaggcgaggcuccgaagcucgggcccggacgcccuagauacucuuuucuggaccuuuuccgggcccgcgauaacaugagaggccggacaaccgugggccuggggcucguccuguuucagcagcugacgggacagcccaauguucuuuguuaugccuccaccauuuucagcuccgugggcuuucaugggggaucuagcgcugugcucgcguccgucggccugggggccgugaaaguugcugccacacugaccgccaugggccucguggaccgcgcuggaagacgggcccugcuucuggcgggcugcgcucucauggcccugagcgucucugggaucggacugguguccuucgccguuccuauggauagcggccccucuugucuugcugugccgaacgccacagggcaaaccggacucccuggcgacagcgggcugcugcaggauuccucucugcccccuauuccccgcacgaaugaggaccagagagaacccauccucagcacagcuaagaaaaccaagccucacccgcgguccggcgaucccagcgccccuccccgccuugcgcugucuuccgcccucccuggacccccgcugccugcuagaggccaugcccugcuucgguggacagcucuccugugccugauggucuuugugagcgccuucucuuucggguuuggacccgucaccuggcucgugcuguccgagauuuacccuguugaaaucagaggccgcgcguucgccuuuuguaacagcuucaauugggcugccaaccuuuuuauuucccugucuuuccucgaccugaucgggaccaucggacugagcuggacauuucuucucuacggccugacggcugugcuggggcucggcuucauuuaucuguuuguccccgagaccaagggacagucccuugccgagaucgaucaacaguuccagaaacggagauuuacacugucuuucggccaccgccaaaauagcaccgggauuccuuacucccggaucgaaauuagcgccgcuucuuga

SEQ ID NO: 75747 - RNA, 1491 nt, Artificial Sequence
  derived and/or modified sequence opt5 from SLC2A11__Homo_sapiens__NP_001020109
augagagcccugcggcgccucauccagggccggauucugcuucugaccaucugcgcugccgggauuggaggcacauuccaauuuggguacaaccucagcaucauuaaugcgcccacgcugcacauccaggaguucaccaacgaaacauggcaggcucggaccggagagccucuuccggaccaucuggugcuccugauguggucccugaucgucucucucuauccccugggcgggcuuuuuggagcccugcucgccggcccucuggcuauuacacuuggccgcaagaaaagccugcucguuaauaacaucuucgugguguccgccgcuauucuguuuggguucucuagaaaggccgggagcuuugaaaugaucaugcugggccggcuccuggucggggugaaugcgggaguuuccaugaacauucagcccauguaccuuggcgagucugccccuaaagaacugcgcggggcuguggccaugagcuccgcuaucuucaccgcccucggaauugucaugggccaagugguuggccugagagagcuucugggaggaccccaggcguggccucuccugcuggccagcugucucgugccgggcgcucugcagcuugccucucugccccuccugccugagucccccagauaucuucugaucgauugcggggacacagaggcuugucucgccgcccugcgcagacugcggggaagcggcgaucucgcuggggagcuggaagaacuugaggaggaacgcgcggccugccagggauguagagcucggcgcccuugggaacuguuucaacacagagcccuccggagacaggucaccucucugguggugcugggcuccgccauggagcuuugcggcaaugacagcgucuacgcuuaugccucuuccguuuuccgcaaggcgggggugcccgaagcuaaaauccaguacgccauuaucggaacgggcagcugugagcuccugaccgccguggucuccugcgugguuauugagcggguggggagacgcguccugcucaucggaggcuauucucugaugacauguugggggagcauuuuuaccguggcucuuugccugcaguccagcuucccguggacacucuaccuggccauggcuuguaucuuugccuucauccugucuuucggcauuggaccugcgggcguuaccgggauccuugccacggaacucuuugaucaaauggcucggcccgccgcuugcauggugugcggagcccugauguggauuaugcugauccucgucggccugggguucccuuuuauuauggaggcgcuuucccauuuccuguacgugcccuuucucggagucugugugugcggcgccaucuauacagggcuguuccugcccgaaaccaagggcaagacauuucaggagaucagcaaagaacuucacagacucaacuucccucgccgggcucagggaccgaccuggagaucucuggagguuauucaaagcaccgagcuguga

SEQ ID NO: 75748 - RNA, 1854 nt, Artificial Sequence
  derived and/or modified sequence opt5 from SLC2A12__Homo_sapiens__NP_660159
auggugcccgucgagaacaccgaaggcccuagccugcucaaucagaaggggacagccguugagacggaaggauccggcucuagacacccgcccugggcucgggggugcggaauguucaccuuucugagcuccgugacagccgcggugucuggccuucuggucggguacgagcucggaaucauuagcggcgcucugcuucaaaucaaaacccugcucgcccuguccugucaugaacaggagauggugguuucuagccuggugauuggcgcccuccuggcuucccuuacagggggaguccugaucgaccgcuauggcagacggaccgccauuauccucagcucuugccugcuugggcugggaucccucgugcugauccugagccucucuuacacaguucugauugugggccgcaucgcuauuggggucuccaucagccuuucuuccauugccaccuguguguauaucgcggagauugccccucagcacagacggggacugcucgugagccugaacgaacuuaugaucgucaucggcauucuguccgcuuacaucucuaauuaugccuucgcuaacguuuuucauggcuggaaguacauguucgggcucgugauuccccugggagugcugcaggccaucgcgauguauuuucucccucccagcccucgcuuccuggucaugaaaggccaagagggggccgcuuccaaggugcuuggaagacugcgggcccucagcgauacgaccgaggaacugacaguuauuaaaucuucccuuaaggacgaguaccaguacagcuuuugggaucuguuccgcucuaaggacaauaugagaacccggaucaugaucggccucacacugguguuuuucguccagauuaccgggcagccgaacauccuguuuuaugcuagcacggugcucaaauccguuggauuccaaucuaaugaagccgccagccuggcuuccacaggcgugggcgucgugaaggucauuagcaccauccccgcgacacuucugguggaucacguugggucuaaaaccuuucucugcauuggauccagcgugauggccgcuucucuggucaccaugggcaucgugaaccugaauauccauaugaacuucacacacauuugucgcucccacaauagcaucaaccagucccuugacgagucuguuauuuacgggccuggaaaucucagcacgaacaauaacacccugagagaucauuucaagggcaucuccucucacagccgguccagccugaugccccuccgcaacgacguggauaaaagaggggaaacaaccucugccucccugcuuaaugccggccugagccauacagaguaucagauugucaccgacccuggagaugugcccgcuuuucucaaguggcugucucuggccucccuucucguguacguugcggcuuucagcaucggccuggggccgaugccuuggcugguccucucugaaauuuuucccggaggcauccgggggagagccauggcccugacgagcuccaugaacuggggaaucaaucuucugauuagccucacauuccugaccgugaccgaccugaucggccuuccuugggugugcuuuauuuauacaaucaugucucucgcuucccugcuguucgucgugauguuuauucccgagaccaagggguguagccucgagcagaucuccauggaacuggccaaaguuaacuacgugaagaauaacaucugcuucaugucucaccaccaagaggaacuuguccccaaacagccucagaagcgcaaaccgcaagagcagcugcucgaauguaauaagcugugcggccggggacagagcagacagcugucccccgagacauga

SEQ ID NO: 75749 - RNA, 1947 nt, Artificial Sequence
  derived and/or modified sequence opt5 from SLC2A13__Homo_sapiens__NP_443117
augagcagaaaggccuccgagaacguggaauacacccugcggucucucagcucccugaugggcgagcgcagacggaaacagcccgaaccugacgcugccucugcggcuggggagugcagccuucuggccgccgcugaauccucuacaagccuccaauccgccggagcuggcgggggaggcgucggggaucuggagcgcgccgcgagacggcaguuccagcaggacgagacgccggccuuuguuuaugugguggcugucuucagcgcccuuggaggcuuucuguucggcuacgauaccggggugguuucuggagcuaugcuccugcugaagcgccaacucucccuggacgcccuuuggcaggaacugcucgugagcucuacagucggcgcggccgcuguguccgcccuggcugggggagcccuuaauggcguuuuugggagacgggccgcuauccugcucgcgagcgcccuguucaccgcuggaucugccgugcuggccgcugccaacaauaaagagacacuccuggcgggccgccuugucgugggccuggggauuggaaucgcuuccaugaccgugcccgucuauauugccgaaguuagcccucccaaccucagaggccggcuggugacaaucaauacccuuuuuauuaccgggggacaguucuuugccuccguggucgauggcgcuuucucuuaccugcagaaggacggguggcgcuauaugcucggacuggccgcugugccugccguuauccaauuuuucggcuuucuguuccuccccgagagcccuagauggcugauccagaaaggccagacgcagaaggcgcggcgcauucuuucccaaaugagagggaaccagacaaucgaugaggaauacgacagcauuaagaauaacaucgaggaagaggaaaaagaggugggaucugccggcccggucauuugucggaugcuguccuaucccccuaccagacgcgcucucaucguggggugcggacugcagauguuccaacagcuuagcggcauuaauacaaucauguacuacucugccaccauccugcagaugagcgggguugaggaugaccggcucgcuauuuggcuggccuccgugacggcguuuacaaacuucaucuuuacccuggucggcguguggcucgucgaaaaggugggaagacgcaaacugacauucggcucucuugccgggaccaccguugcucugauuauccucgcccugggauuugugcugagcgcucaggucagcccccggauuacauucaagccuaucgcccccuccggccaaaaugccacguguaccagauauucuuacugcaacgaguguaugcuugauccggacugcggguuuuguuauaaaaugaauaaguccacagugaucgauagcucuugcguuccugugaacaaggcuuccaccaaugaagcggccuggggacgcugugagaacgaaacaaaauucaagaccgaggacaucuuuugggcuuacaacuucugccccacgccuuauagcuggacagcccuccugggccugauucucuaccuggucuuuuucgcccccgggaugggccccaugccuuggaccguuaauuccgagauuuauccgcuuugggcucggucuaccggaaacgccuguagcuccggcaucaauuggauuuuuaacgugcuggugucucucacauuccugcacaccgcggaauaccugacauacuauggggcuuucuuucuuuacgccggauucgccgcugucggccuccuguuuaucuaugggugccugcccgagacgaaaggaaagaaacucgaagagaucgaaagccuguucgacaauagacuuugcaccuguggcacauccgauagcgacgaggggcgcuacauugaguauauccgggugaagggcucuaacuaccaucuguccgauaaugacgccagcgauguggaauga

SEQ ID NO: 75750 - RNA, 1494 nt, Artificial Sequence
  derived and/or modified sequence opt5 from SLC2A14__Homo_sapiens__NP_001273163
auggacaacagacagaaugugacccccgcccugaucuucgcuauuacagucgccacgaucggcagcuuucaauucggguacaacaccggaguuauuaaugcgccugagacaaucauuaaggaauuuaucaacaaaacccucacagauaaggcuaaugccccgcccuccgaggugcugcuuaccaaccuguggucucucagcguggccaucuucuccgucggcgggaugauuggaucuuuuagcgugggccuguucguuaaucgguuugggcgcagaaacuccaugcuuaucgugaaucugcucgcugccacaggaggcugccugaugggccuguguaaaauugcugaaucugucgagaugcucauccuggggcggcuugugauuggacuguucugcggccucuguaccggguuuguuccuauguauaucggagaaauuagccccacggcccugcgcggcgcguucgggacccuuaaccagcugggaaucgugaucggcauucucgucgcccagaucuuuggccuggagcugauucucggguccgaggaacuguggccugugcuucugggauucacaauccuccccgcuauucugcagagcgccgcccuuccuugcuguccggagucucccagauuucugcucaucaaucggaagaaagaagagaacgcuacccgcauccugcaaagacuguggggcacacaggacgugucccaggauauucaggagaugaaggacgaaagcgcgcggaugucucaagagaagcaggucaccguucucgaacuguuccgcguguccagcuacagacagccuaucauuaucucuauugugcuucagcugucccaacagcucagcgggaucaaugccgucuucuauuacuccacgggaaucuuuaaagaugcuggcgugcagcaacccauuuaugccacaaucucugcugggguugugaacaccauuuucacacugcuuagccuguuucucgucgagcgggccggacgcagaacccugcacaugaucggccugggcgggauggccuucugcuccacccucaugacagugagccugcuucugaagaaucauuacaacggaaugucuuuuguuuguauuggcgcuauccucguguucgucgcgugcuuugaaauugggccuggacccaucccgugguucaucguggccgagcuguuuucccagggcccucggcccgcugccauggccgucgcuggguguagcaacuggacgucuaauuuccuggugggccuucucuuuccuagcgccgcguauuaccugggagcuuacguuuucauuaucuuuaccggcuuccugauuacauuccucgccuuuaccuucuuuaaagugcccgagacacgcgggagaaccuucgaagacaucacgcgggccuuugagggacaggcucacggcgccgauagauccgggaaggacggagucaugggcaugaacucuauugaacccgcuaaagagacaaccaccaauguguga

SEQ ID NO: 75751 - RNA, 1575 nt, Artificial Sequence
  derived and/or modified sequence opt5 from SLC2A2__Homo_sapiens__NP_000331
augaccgaggacaaggugacaggcacgcuggucuucaccguuaucacagccgugcucgggagcuuucaguucggauacgauauuggcgugaucaacgcuccccaacaggucauuaucucccacuauagacaugugcuggggguuccucuugacgaucggaaagccauuaauaacuacgugaucaauucuaccgacgaacugccgacaaucagcuauuccaugaaccccaagccuacccccugggcggaggaagagacagucgcugccgcccagcucauuaccaugcuguggucucuuagcguguccucuuuugcuguuggaggcaugacggccagcuucuuugggggauggcugggcgauacccucggccgcaucaaagcuaugcugguggccaauauucugucccucgucggggcgcugcuuaugggauucagcaagcugggcccuucucacauccucauuaucgccgggagauccauuagcggacuguacugcggccuuaucucugggcuggugcccauguauaucggagaaauugcuccuacagcccuccggggcgcucugggcaccuuucaucagcuggccaucgugacagggauucucaucucccaaauuaucggacuggaguucauccuuggcaacuacgaccuguggcacauucuccuggggcuuagcggaguccgcgcgauccugcagucucuccugcuguuuuucuguccggagucccccagauaucucuacauuaaacuggaugaagagguuaaggccaagcagagccuuaaacggcugcgcggcuacgacgaugugaccaaggacaucaaugaaaugagaaaagagcgggaggaggcuuccucugaacagaaggugagcauuauccaacucuuuacgaacuccagcuaucgccagccuauccuggucgcccuuaugcugcauguggcucagcaguucucugggauuaauggaaucuuuuacuauuccacaagcauuuuccaaaccgccggcaucucuaaacccguuuacgccacaauuggcgugggggcugucaacaugguguucaccgcgguuagcguguuucucgucgaaaaggccggaagacggucccuguuccugaucggcaugucugggauguuugugugcgcuauuuucaugagcgucggacucgugcugcuuaauaaguuuuccuggaugagcuauguuucuaugaucgccaucuuccuguuuguguccuucuuugagauuggcccugggcccaucccgugguucauggucgccgaauuuuucagccagggcccucgccccgcugcccucgcgauugcugccuuuucuaacuggaccuguaauuucaucguggcccugugcuuccaguacauugcugauuuuuguggaccuuauguuuucuuucuguucgccggcgugcuucucgcuuuuacacuguucacguuuuucaaaguccccgagaccaaggggaaauccuuugaggaaaucgccgcggaguuccaaaagaaaagcggauccgcccacagacccaaggcugccguggaaaugaaauuucugggcgcuacagagaccguguga

SEQ ID NO: 75752 - RNA, 1491 nt, Artificial Sequence
  derived and/or modified sequence opt5 from SLC2A3__Homo_sapiens__NP_008862
augggcacccagaaggugacacccgcccugaucuucgcuauuacggucgccaccaucgggagcuuucaauucggauacaacacaggcguuauuaaugcgccugagaaaaucauuaaggaauuuaucaacaaaacccucacagacaaggggaaugcuccgcccuccgaggugcugcuuaccucucuguggagccucuccguggccaucuucucugucggaggcaugauugggagcuuuuccgugggacuguucguuaacagauuuggccggcgcaauucuaugcuuaucgugaaccugcucgccgucacaggcgggugcuucaugggacuguguaaaguggcuaagagcguugaaaugcugauucucggcagacuggugaucgggcuguuuugcggacuuuguaccggcuucgucccuauguauauuggggagaucucccccacggcccuccggggagcuuuuggcacccugaaucagcuuggcauugugguggggauccuggucgcccagaucuucggacucgaauuuauucugggcagcgaggagcuguggccucuccugcuuggguucacaauccugcccgcgauucuccagucugccgcucugccuuucugcccggaaagcccccgcuuucuucugaucaacagaaaggaggaagagaaugccaaacaaauucuccagcggcuguggggaacccaggauguuucccaggacauccaagagaugaaggaugaaucugcucgcaugucccaggagaaacaggugacagugcuggaacucuucagagucagcucuuaccggcagccuaucauuaucuccauugugcugcaacuuagccagcagcuguccggcaucaacgccguguuuuauuacucuaccgggauuuucaaggacgcgggaguucaagagcccaucuaugccacgaucggcgcuggcgucgugaauacaauuuuuaccguugugagccucuuccuggucgaacgcgccgggagacggacacuucacaugaucggacugggcgggauggcuuuuuguuccacccucaugaccgugagccugcugcucaaagauaacuacaauggaaugucuuucgucugcauuggcgccauccugguguuuguugccuucuuugagauugggccuggccccaucccgugguucauuguggcugagcuguuuucccagggaccucgccccgcggccauggcugucgccggcuguagcaacuggacaucuaauuuccuuguggggcuccuguucccuagcgccgcucauuaucugggagccuacguuuuuaucaucuucacgggcuuucuuauuaccuuccucgcguuuacauucuuuaaggugcccgaaaccagagggcggacauucgaggacaucacccgcgcuuuugaaggacaggcccacggcgccgauagauccgggaaggacggcgucauggagaugaacucuauugaacccgcuaaagagacgacaaccaacguguga

SEQ ID NO: 75753 - RNA, 1164 nt, Artificial Sequence
  derived and/or modified sequence opt5 from SLC2A4RG__Homo_sapiens__NP_064446
auggagagacccccuccgcgggccgcuggccgcgaccccagcgcccugagagcggaagcuccuuggcuccgggccgaggggcccggaccucgcgccgcucccgugaccgucccuacaccgccccagggcuccucuguugggggaggcuucgccgggcuggaauuugcuagaccucaagagagcgaaccccgggccuccgaucuuggagcgccucgcacguggaccggcgccgcugccggccccagaacaccgucugcucacaucccugugcccgcccagcgggcgaccccugggaaggcccgccuggacgaggugauggcugccgcugcccucacaagccuguccaccucuccccuucugcucggagcccccgucgcugcguucagcccugagccgggccuggaacccuggaaagaggcccuggugagaccucccggguccuacucuagcuccagcaacucuggagauuggggcugggaccucgcuuccgaucagagcucuccuuccacacccagcccgccucugcccccugaagccgcccauuuucuuuucggggagcccacccugcggaagcgcaaauccccugcucagguuauguuucaaugccucuggaagucuuguggaaaagugcugagcacggccuccgcgaugcagagacacauucggcuuguccaucugggccgccaggcugagcccgaacagagcgacggcgaggaagauuucuauuacaccgagcucgacguggggguugauacacugaccgacggacugucuucccucacaccggugagcccuaccgccucuaugccucccgccuuuccuagacuggaacuuccggagcugcucgagcccccugcucugcccagcccucuucggcccccugcucccccgcugccucccccucccguccucuccacgguggccaauccgcaaucuugccacagcgauagaguguaucagggcugucugacacccgcccgccuggaaccccagccuaccgaggucggggcgugcccucccgcccucuccagccggaucggaguuacacugagaaagccccgcggcgacgcuaagaaaugucggaagguguacgggauggaaagacgcgaucuuuggugcaccgccugucgguggaaaaaggcuugccagagauuccuggacuga

SEQ ID NO: 75754 - RNA, 1476 nt, Artificial Sequence
  derived and/or modified sequence opt5 from SLC2A5__Homo_sapiens__XP_011540307
augagacugacccucgugcuggcccuugcuacacugaucgccgcguucggcagcuccuuucaguacggguauaacgucgcugccguuaauucucccgcccuccugaugcaacaguucuacaacgagacguauuacggacggaccggcgaauuuauggaggacuucccucuuacacugcucuggagcgugaccguguccauguuuccguucgggggauuuauuggcucucugcuggucgggccccucgugaauaaguucggacgcaaaggcgcucugcuuuuuaacaauaucuucagcauuguuccugccauccugaugggcugcuccagaguggcuacaucuuuugaacucauuaucaucagccggcugcuugucgggauuugugccggaguguccagcaacguugugcccauguaucugggcgagcucgcgccuaagaaucugcgcggggcccugggagucgugccccaacucuucaucaccgugggcauucuggucgcucagaucuuugggcuuagaaaccugcucgccaauguugauggauggccuauucugcuuggccugacaggcgugccggcugcccuccagcugcugcuccugcccuucuucccugaaucuccccgguaccuucugauccagaaaaaggacgaggcggccgcuaaaaaggcccuccagacccugcgcgggugggauuccguggacagagaggucgcugaaauucggcaggaggaugaagccgagaaggccgcuggauuuaucagcgugcuuaaacuguuccgcaugagaucucuccgguggcaacugcuguccaucauuguucucaugggcgggcagcagcugagcggagugaacgcgaucuauuacuacgccgaccagauuuaucuuucugcuggcgucccugaggaacacgugcaauacguuacggccgggaccggagccgugaaugucgugaugacauuuugcgcugucuucgugguugagcugcucggccgcagacugcugcuucuccugggcuuuuccaucugucugauugccugcugugugcucaccgcggcucuggcccuucaggauacagucagcuggaugcccuauaucuccaucgugugcguuauuucuuacgugaucgggcaugcccugggaccgagcccuauucccgcucuccugaucaccgaaauuuuccugcaguccagccggccuucugccuuuauggucggcggguccgugcacuggcuuagcaacuucacggugggacucaucuuucccuucauccaagagggccuggggcccuauucuuuuauuguuuucgcugucaucugucugcucacaaccauuuacaucuuucugauugugccugaaacaaaggccaaaaccuucaucgagauuaaucagaucuucaccaagaugaacaaagugagcgaggucuauccggaaaaggaggaacuuaaggagcugcccccugugacauccgaacaguga

SEQ ID NO: 75755 - RNA, 1338 nt, Artificial Sequence
  derived and/or modified sequence opt5 from SLC2A6__Homo_sapiens__NP_001138571
augcaggagccccugcucggcgccgaagggccugacuacgauaccuucccggagaagcccccucccagcccuggagacagagcucgggugggcacacugcaaaacaaacgcgucuuucuugccacguucgcggcuguucuggggaauuuuuccuucggauaugcccucguguacaccucucccgugaucccugcccuggaaagaagccuugauccggaccugcaccucacaaagucccaggcuucuugguuuggcagcgucuucacccugggggccgcugccggaggccuguccgcgaugauucucaacgaucugcuuggccggaaacugucuaucauguuuagcgccgugcccuccgcugccggguaugcucucauggccggagcgcauggccuguggaugcuucugcucgggcgcacacugaccggauucgccggcgggcugacagcugccugcauuccuguuuacgugagcgagaucgcucccccuggagucagaggcgcccucggcgccacgccccagcugauggcuguguuugggucucuuucccuguaugcgcucggacugcuucugccguggcgguggcucgccguugcuggcgaagccccugugcugauuaugauccugcuccugagcuucaugcccaauucuccucgcuuucuucuguccagagggcgggacgaggaggcccuccgcgcucuggccuggcuuagaggaaccgaugucgacgugcacugggaguucgaacagauccaagauaacgugcggcgccagagcucuagagucuccugggcggaagcucgggcuccccauguuugucgccccauuaccguggcccugcucaugagacugcugcagcagcucacaggcaucaccccuauucugguguaccuucaaagcaucuuugacuccacagccguccugcucccgcccaaggaugacgccgcuauugugggggccguucggcugcugucugugcuuaucgcggcccucaccauggaucuggcuggaagaaaaguccugcuguucgugagcggcuaugccguuggcugggggccuauuacguggcugcuuauguccgaggugcugccccuccgcgcucggggagucgccagcggccugugcgugcuggcgucuuggcuuacagccuucguccucaccaaguccuuucugccugugguuagcacauucgggcuccaggugcccuuuuucuuuuucgcugccaucugucucgucucucugguguuuaccggaugcuguguuccggagaccaagggcagaagccuugaacagaucgaguccuucuuucgcacagggcggagaucuuuccugcgcuga

SEQ ID NO: 75756 - RNA, 1236 nt, Artificial Sequence
  derived and/or modified sequence opt5 from SLC2A8__Homo_sapiens__NP_001258640
augacccccgaggacccugaagagacacagccgcugcucgggcccccugggggaagcgcccccagaggccggcgcguguuccuggcugccuuugcggcugcccuugggccucuguccuucggauuugcccucggcuacucuagccccgcuaucccuucccugcaaagagccgcuccgcccgccccucggcuugaugacgcggccgcuucuugguucggggccgucguuacgcugggagcugccgcgggcggcgugcucgggggauggcugguggaucgcgccggcagaaagcugagccuccugcuuugcuccguccccuuuguggcuggguucgccguuauuaccgcugcccaggacguguggaugcugcucggaggccggcugcuuacagggcuggccuguggagucgcuucucucguggcgccuguuuauaucagcgaaauugccuaccccgcugugcgcggccugcugggcuccugcguccagcucauggugguggucgggauccugcuugccuaucuggccggauggguucucgaguggagauggcuggcugugcuuggcugugugccgccuagccugaugcuccugcugaugugcuuuaugcccgaaaccccucgguuccuccugacacagcaccgcagacaagaggccauggcggcccuucgguuucugugggggucugagcagggaugggaagauccucccauuggcgcugagcaguccuuccaucucgcccugcuucgccagcccgggaucuacaaaccguuuaucauuggagucagccugauggcuuuccaacagcucucuggcgugaacgccguuauguuuuaugcugaaaccaucuucgaggaggccaaguucaaagacuccagccuggcgucuguggucgugggcguuauucaggugcuguuuacagccgucgcugcccucaucauggauagagcugggcggcgccugcuucuggugcucuccggagucgugaugguuuucagcaccuccgccuuuggcgcguacuucaagcugacgcagggcggacccggcaauucuagccacguggccauuuccgcuccugucagcgcccaacccguggacgcuucuguugggcuggccuggcuugccgugggcuccaugugucucuuuaucgcuggaggcccucaggcgcuguggagccugcucgccugccugagauuccuucaucugcagugucccuuucacuucguccucugcccguga

SEQ ID NO: 75757 - RNA, 1536 nt, Artificial Sequence
  derived and/or modified sequence opt5 from SLC2A9__Homo_sapiens__NP_001001290
augaagcugagcaaaaaggacagaggcgaggaugaagaguccgacucugccaaaaagaaacucgauuggagcugcucccugcuuguggcuucucuggccggggcguucggaagcuccuuucucuacggcuauaaccugucugucguuaaugcucccaccccuuacaucaaggccuucuauaacgaaagcugggagcggcgccacgggagaccgauugaccccgauacacuuacgcugcucugguccgugaccgugagcaucuuugccauuggaggccuggucgggacacugaucgugaagaugauuggaaaaguucucggccggaagcauacccugcuugcuaauaacggcuucgccaucucugcugcccugcucauggcguguucccugcaggccggggcuuuugaaaugcuuaucgugggacgcuucauuaugggcaucgacgggggagucgcccugagcgugcucccuauguaccugucugagauuucccccaaagagaucagaggcagccuggggcaaguuacagcuauuuuuaucugcauuggaguguucaccggccagcuccugggccuuccugaacugcucgggaaggagucuacauggcccuaucuguuuggagucaucguggugccugccgucguucagcuucugucccucccguuccugcccgauagcccucgguaccugcuccuggaaaaacacaaugaggcgcgcgccgugaaggcuuuucagaccuuccuuggcaaggccgacgugucccaagaggucgaagaggugcuggcugaaucuagaguucagcggagcauccgccucguguccguccuggagcuucugagagcccccuaugugcgguggcagguugugacggucauugugaccauggccuguuaccagcucugcgggcugaacgcuaucugguuuuacacaaauagcauuuucggaaaagcgggcaucccucccgccaagauuccguaugucacccugucuacagggggaaucgaaacccucgcugccguguucuccggccugguuaucgagcaucuuggccgcagaccucugcucauugggggauuuggccugauggggcuguucuuuggaacgcuuacaaucacccucacacugcaagaucacgcccccugggugccuuaccugagcauugucggcauccucgcuauuaucgccucuuucuguagcgggcccggcggaauccccuuuauucugaccggcgaguucuuucagcagucccagcggccugcggcuuucaucauugccgggaccgugaacuggcuuucuaauuuugccguuggacuccuguucccguuuauccagaaaagccuggacacauauugcuuccugguguuugcuacgauuuguaucaccggcgccauuuaccuuuauuucguccuccccgaaacaaagaaccgcaccuacgcugagaucucccaagccuucagcaaaagaaauaaggcguauccucccgaagagaaaaucgauucugccgugacagacgggaagauuaacggacggccuuga

SEQ ID NO: 75758 - RNA, 1458 nt, Artificial Sequence
  derived and/or modified sequence opt5 from SLC30A10__Homo_sapiens__NP_061183
augggcagauacagcgggaagaccugccggcugcuguucaugcuggugcuuacagucgccuuuuucguugcugagcugguguccggauaucucggcaacucuaucgcccugcuuagcgacuccuuuaauaugcugucugaucucauuagccuguguguggggcuguccgcgggauacaucgcucgcagacccacgcggggcuucucugccaccuauggguacgcccgcgcugaagucgugggagcccucagcaacgcuguuuuucugacagcccuuugcuucaccauuuuuguggaggcgguccugagacucgcccggccugaacgcaucgacgauccggagcuggugcuuauuguuggcgugcugggccuccuggucaaugugguggggcugcucaucuuccaggacugugcugccugguuugcuugcugucugagaggacggucccgcagacuucaacagcggcagcagcuggccgaaggcugcguccccggggcguucggaggcccucaaggggccgaggauccccgcagagcugccgacccuacagcucccggaagcgauucugccguuacccuccggggcacauccguggagcgcaaaagagaaaagggcgccaccguguuugcuaacgucgcgggggacagcuucaauacgcagaacgagccugaagauaugaugaaaaaggagaaaaagucugaggcccugaauauccggggagugcuucugcacguuaugggcgacgcucucggguccguggucgugguuauuaccgccaucaucuuuuaugugcugccgcucaagagcgaagaucccuguaacuggcagugcuacauugacccuucucucacaguccugauggugauuaucauucuuuccagcgccuucccccugaucaaagagaccgcugccauccuccugcagauggucccuaagggagugaauauggaggaacuuauguccaaacugucugcgguucccggcauuagcuccgugcaugaaguccacaucugggagcucgugagcgggaagauuaucgcuacacugcauauuaaauauccgaaggauagaggauaccaagacgccucuaccaagauccgcgagaucuuccaccaugccggcauucacaacguuacgauccaguuugaaaauguggaccugaaagagccucucgaacagaaggaucugcuucugcucuguaacucccccugcauuagcaaaggcugugcuaagcagcugugcugcccucccggggcccugccccuugcucacgucaauggaugugccgagcauaacggcgggccuucucucgacacauacggaagcgauggccugucccggagagacgcgcgcgaaguggccaucgaggugucucuggauagcugccucuccgaccacgggcaaagccugaauaaaacccaggaggaucaguguuauguuaaccggacacauuucuga

SEQ ID NO: 75759 - RNA, 1524 nt, Artificial Sequence
  derived and/or modified sequence opt5 from SLC30A1__Homo_sapiens__NP_067017
augggcugcugggggagaaaccggggacgccugcucuguaugcuggcccuuaccuucauguuuauggugcuggaggucguugugagcagagugacauccucucucgcuaugcugagcgacuccuuccacaugcuuucugauguccuggcccucgugguugcgcugguggcugaacgguuugcccgcagaacgcaugccacccagaagaauacauucggcuggauccgggcugaggucaugggggcccuggugaacgcuauuuuucucaccggacugugcuucgccauccuucuggaagcgauugagcgcuuuaucgaaccccacgagaugcaacagccucucguugugcugggcgucgggguggccggacuucuggugaauguccucggccugugucuguuccaucaccauagcggcuuuucccaggacucugggcacggacacagccauggcgggcacggacauggccacgggcucccgaaaggacccagaguuaaguccacacggccuggcagcucugauauuaacguggcucccggcgagcaggggccugaccaagaagagaccaauacacugguggccaacaccuccaauagcaacggacuuaaacuggaucccgcugacccugaaaauccgcgcucuggcgauacggucgaggugcagguuaacgggaaucucgugagagagcccgaccacauggaacuggaggaagaucgggccggacagcuuaacaugcgcggcgucuuccugcaugugcucggggacgcgcugggauccguuaucguggucgugaaugcccuggucuuuuacuucagcuggaagggcugcucugagggcgauuuuugugugaacccuugcuuccccgacccuuguaaggcuuucguugaaaucauuaauuccacccacgccagcguguaugaggcugggcccugcuggguccucuaccuggauccgacacuuugugugguuauggugugcauccugcucuauaccacauacccucugcuuaaagaguccgcccugauucuccugcagaccguccccaagcaaaucgacauuagaaaccugaucaaagaacuccggaacguggagggaguggaagagguucaugaacugcacgucuggcagcuugccggcucucgcauuaucgcuacggcgcauaucaagugugaggacccuacaagcuauauggagguggccaaaaccauuaaggauguguuucacaaucacgggauccaugcuacaaccauucagcccgaguucgccuccgucggaagcaaaucuuccgugguucccugcgaacuggccugcagaacccagugugcucucaagcaaugcuguggcacacugccucaggccccgagcgggaaggacgcggagaaaacgcccgcugugucuaucagcugccuggaacuuuccaacaaucucgaaaagaaaccucggagaaccaaggccgagaacauucccgccgucgugaucgagaucaaaaauaugccuaacaagcagcccgaaucuagccuguga

SEQ ID NO: 75760 - RNA, 1167 nt, Artificial Sequence
  derived and/or modified sequence opt5 from SLC30A3__Homo_sapiens__NP_003450
auggagcccagcccugccgcuggcgggcuggaaaccacaagacucguguccccgcgggaccgcggaggcgccgggggaucucugagacuuaagagccuguucacggagcccuccgaaccucuccccgaggaaucuaaaccugucgagaugcccuuucaccauugccaccgggauccucugccgcccccuggccuuacccccgagcgccugcaugcgagacggcagcucuacgcugccugugccguuugcuucguguuuauggcuggggaaguggucggaggcuaucuggcccacagccuggcuaucaugacagacgccgcgcaucuccuggccgaugugggcuccaugauggggucucuuuucagccuguggcucuccacccgcccugcuacaagaaccaugacauuuggauggcaccggagcgagacccugggcgcccuugcuucuguugugucccuguggauggucacggggauucuccuguaccuggccuucgugcgccuccugcacagcgacuaucauaucgaaggaggcgcgaugcuucugaccgccucuauugcuguuugugccaaccuccugauggcuuuugugcuucaccaagccgggcccccgcauucccacggaagcagaggcgccgaguacgcuccucuggaggaaggccccgaggaaccucucccccuggggaauacaucuguccgggcggccuucgugcacgugcugggagaucuccugcaguccuuuggcguccuugcugccagcauccugauuuauuucaagccccaguacaaagccgcugacccuaucuccaccuuucucuucucuaucugcgcccuggggagcacagcgccgacccuucgcgauguucugcggauucucauggagggaacgcccagaaacgugggcuuugaaccugugcgcgacacacugcuguccguccccggggugagagcuacccaugagcuccaccugugggcccuuacacugaccuaucauguugccagcgcucaccucgccaucgauucuaccgcugacccugaggccgugcuggcggaagccuccagccggcuguacucuagauucggauucagcuccuguacacuucaggucgagcaauaccagcccgaaauggcucagugccuccgcugucaggagccgccucaagccuga

SEQ ID NO: 75761 - RNA, 1290 nt, Artificial Sequence
  derived and/or modified sequence opt5 from SLC30A4__Homo_sapiens__XP_011520299
auggccggcagcggggcuuggaagagacugaaauccaugcuccggaaggacgaugcgccccuguuccuuaacgacaccucugccuuugauuucagcgacgaggcuggagaugaaggccugucccgcuuuaauaaacucagaguggucguugccgacgaugggucugaggccccugaacggccggugaacggagcucaccccacacugcaggccgacgaugacagccuucuggaucaagaccucccucugacgaauagccagcugucucucaagguggauagcugcgacaacuguuccaaacagcgcgagauccugaagcagagaaaggucaaagcucggcuuaccauugccgcggugcuguaccuccuguucaugaucggcgaacuuguugggggauauauugccaauagccuggcuaucaugacagacgcccuccacaugcugaccgaucugucugcuauuauccucacacugcuugcccuguggcucuccagcaagucucccaccaaacgcuuuacauucggcuuucacagacuggaggugcuuuccgcgaugaucagcguccugcucguguacauucugaugggcuuccugcucuaugaggccguucaacggaccauccauaugaacuacgaaauuaauggggacaucaugcugauuacggcugccgugggagucgcugugaacgugaucaugggcuuucuucugaaucagucugggcaccgccauucccacagccacucccucccuucuaacagccccaccagaggauccggcugcgagcggaaucaugggcaggauagccuggccguccgcgccgcuuucguucacgcgcuuggagaccuggugcagucugugggcguccucauugccgcuuauaucaucagauuuaagccugaauacaaaauugccgauccgaucuguacauauguguucucccugcugguugccuuuaccacauuccggauuaucugggacaccguggucauuauccucgagggcgugcccagccaucugaacguugauuacaucaaggaggcucuuaugaagauugaagacguguacucugucgaggaucugaauaucuggagccucacguccgggaaaucuacagccauugugcacauccaacugauuccuggaagcuccagcaagugggaagagguccagucuaaagcgaaccaucugcuucucaauaccuucggcauguaucgcugcacaauccagcugcaguccuacagacaagaaguggaccggaccugugcuaacugccaguccucuucccccuga

SEQ ID NO: 75762 - RNA, 2298 nt, Artificial Sequence
  derived and/or modified sequence opt5 from SLC30A5__Homo_sapiens__NP_075053
auggaggaaaaguacggcggggacgugcuggccggacccggcgggggaggcgggcucggaccugucgauguuccgagcgcuagacugaccaaauauaucgugcuucugugcuucacaaaguuucucaaagccgugggccuguucgaguccuacgaccuucugaaggcgguccacauugugcaguuuaucuucauucucaaacugggcacggccuuuuucaugguucuguuucaaaagcccuucucuagcgggaagaccaucacaaaacaucaguggauuaagaucuuuaaacacgcuguggccggauguaucauuucccuccugugguucuuuggccuuacccugugcgggccucuccggacacugcuucuguucgaacauucugauaucgucgugauuagccuccuguccguucuguuuaccucuagcggaggcgggcccgcuaagacacgcggagccgcuuucuucaucauugccgugaucugucuccugcuuuuugacaacgaugaccugauggcgaaaauggccgagcacccugaaggccaucacgauuccgcucucacccacaugcuguauacggccauugcuuuccuuggcgucgccgaccauaaagggggagugcugcuccuggugcuggcgcucugcuguaaggucggcuuucacaccgccagcagaaagcugucuguugaugucgggggagcuaagcggcuucaggcccugucccaucucgugagcgugcugcuucugugccccugggugaucguucucucugugacaaccgaguccaaagucgagagcugguucucucugaucaugccuuuugcuacagugauuuucuuuguuaugauccuggacuucuacguggauuccauuuguagcgucaagauggaaguguccaaaugcgcccgcuauggcucuuuuccgaucuucauuagcgcccuccuguuugggaauuucuggacccaccccaucacggaccagcuuagagcuaugaacaaggcggcccaccaagaguccacagaacauguccugagcggaggcgugguugugucugcuaucuuuuucauucucuccgccaauauccugagcucuccuagcaaacggggccagaaggggacccugauuggauacucccccgagggcacaccucuuuauaacuucaugggggaugccuuucagcacucuagccaguccaucccccgcuucauuaaggagagccucaaacaaauccuggaagagucugacuccagacagaucuuuuacuuccugugucucaaucugcuuuuuaccuucgucgaacuguuuuacggagugcucaccaacagccugggccugauuucugacggguuccauaugcuuuuugauugcuccgcucucguuaugggccuguucgccgcgcugaugagccgguggaaggcuacacgcaucuuuuccuauggauacggcagaauugagauccucucuggguucauuaauggacuguuucuuaucgugauugccuucuucgucuuuauggaaagcguggcccggcugaucgacccgccugagcucgauacgcacaugcugacccccguguccguuggcgggcugaucgucaaccuuauuggaaucugugcuuucucucaugcccacagccacgcucauggcgccucccaggggagcugccacucuuccgaccauagccacucucaccauaugcacggccauuccgaucacggacauggccacagccacgggucugcgggaggcgggaugaaugccaacaugcgcggaguguuucuccaugugcuggcugacacacugggcagcauuggggucaucguguccaccguucucauugagcaguucggcugguuuaucgccgauccucugugcagccuuuucaucgcuauucugaucuuucucucuguggucccccugauuaaagacgccugucaagugcugcuucucagacugcccccugaauaugagaaggaacugcacaucgcgcucgagaaaauucagaagaucgaaggacugaucuccuaccgggauccgcauuucuggcgccacagcgccuccauuguugcuggcacaauccauauucaggugaccucugacguccuugagcaaagaaucgugcagcagguuacggggauucugaaggaugccggagugaauaaccucacaauccaggucgagaaagaggcuuauuuucaacacaugagcggccuguccaccggguuccacgacgugcuggccaugaccaagcagauggaaucuaugaaauacugcaaggacggaacauauaucauguga

SEQ ID NO: 75763 - RNA, 1506 nt, Artificial Sequence
  derived and/or modified sequence opt5 from SLC30A6__Homo_sapiens__NP_001180442
augggcaccauccaccuguucagaaagccccagcggagcuuuuucgggaaacuccugcgcgaauuuagacuuguggccgcugaccggcgcuccuggaagauucuccuguucggagucaucaaccugauuugcacaggcuuucuucugaugugguguucuagcaccaauuccaucgcccucacggcguacacauaucugaccauuuucgaucuguuuagagacgggguuucuccuuucuggcucggauggagccaaacaccggaucugaaaugguccacccaucuuggccugcccaagugcugggacaaccggcgcgaacucccuugucugucuaauagccuuaugacaugccugaucuccuacugggugacccucagaaaacccagcccuguguauucuuuuggguucgagcggcuggaaguccuggcuguguuugccuccacgguucucgcccagcugggagcucuuuucauccugaaggagagcgccgaacgcuuucucgagcagcccgagauucacaccggcagacugcuugugggcacauucgucgcucuguguuucaaccucuuuaccaugcugucuauccggaauaagccuuucgccuacguguccgaagcggccagcacaucuuggcugcaggagcauguugcugaucucucccgcagccugugcgggauuaucccgggacuuuccucuauuuuucugcccagaaugaacccuuucgugcucaucgaccuggccggcgcuuuugcccuuuguauuaccuauaugcugaucgaaaucaauaacuacuucgcggucgauacggccagcgcuauugccaucgcucucaugacauuugggaccauguaucccauguccguguacagcggaaaagugcugcugcaaacaaccccuccccacgucauuggccagcucgacaagcugauccgggagguuucuacccuugauggggugcuggaggugcgcaaugaacauuucuggacacucggauuuggcucccuggccggcagcguccacgugcggauuagaagagacgccaacgagcagaugguucuggcucacgugacgaaucgccuuuacacccucgucucuacacugaccgugcagaucuucaaagaugacuggauccggccggcgcugcucagcgggccuguugccgcuaacgugcugaauuuuuccgaucaucacgucauucccaugccucuucugaagggaacagacgaccucaaccccgugaccucuacgcccgccaaaccuagcuccccgcccccugaguucagcuuuaauacacccggcaagaacgucaacccugugauccugcugaauacccaaaccagacccuauggguucggacuuaaccauggccacacaccguacucuuccaugcucaaucaggggcugggaguuccuggcauuggcgccacccaggggcugcgcacaggauucacgaacauccccagccgguauggcaccaauaacagaauugggcagccucgccccuga

SEQ ID NO: 75764 - RNA, 921 nt, Artificial Sequence
  derived and/or modified sequence opt5 from SLC30A7__Homo_sapiens__XP_011539081
auguucuuugacagcaccgccauccuggcuggccucgccgcguccgugauuucuaaguggagagauaacgacgcuuucagcuacggguauguccgggccgagguucuggccggauuugugaauggccuuuuccugaucuuuacagcuuucuuuauuuucuccgaagggguggagcgcgcccucgcucccccugauguccaccaugaaagacugcuucuggugucuauccucggauuuguugugaaccugauuggcaucuucgucuuuaaacacgggggacauggccacagccauggcuccgggcacggacacucucauagccuguucaauggcgcccucgaccaggcgcacgggcauguggaucacugccacucccaugagguuaagcacggagccgcucauagccacgaccaugcccacggccacgggcauuuucacucucaugauggaccgucccugaaagaaacgaccggccccagccggcaaauccuucagggcguguuccugcacauucucgcugacacacuggggucuaucggagucauugccuccgcgaucaugaugcagaacuucggccuuaugauugccgauccuaucuguagcauucugaucgcuauccucauuguggugucugucaucccccugcugcgcgaguccguugggauucucaugcagagaaccccuccccugcuugagaauagccugccucaaugcuaccagcgggugcagcagcuccaaggaguguauucccugcaggaacagcacuuuuggacacuuuguucugacgucuacgugggcacccugaagcucaucguugccccggaugcugacgcccgcuggauucugagccagacacauaacaucuucacccaagccggggugagacagcuguauguccagaucgauuuugcugcgauguga

SEQ ID NO: 75765 - RNA, 963 nt, Artificial Sequence
  derived and/or modified sequence opt5 from SLC30A8__Homo_sapiens__NP_001166286
auguaccacugccauagcggcuccaagcccaccgagaaaggggccaacgaauaugcuuacgccaaguggaaacuguguucugcgagcgcuaucugcuucauuuuuaugaucgccgagguggucggaggccacauugccgggucccucgcuguugugacagacgccgcucaucugcuuaucgaucugacgucuuuccuccugagccuguuuucccuuuggcucucuagcaagccuccguccaaaagacugaccuucggauggcaccgggccgaaauucugggcgcgcuccugagcauccuuuguaucuggguggucacaggggugcugguuuaucucgccugcgagcgccugcuuuaccccgacuaucagauucaagcuaccgugaugaucauugucucuuccugugccguggcugccaauaucguucugacagugguccuccaucagagaugccugggacacaaccacaaggaagugcaggcgaaugccagcgugcgggcugccuuuguccaugcucugggcgaucucuuccagucuauuuccguucugaucagcgcccuuauuaucuacuuuaagccugaguauaaaaucgccgaccccauuuguaccuucaucuuuucuauucuggugcucgcuuccacaaucaccauucugaaggauuucagcauccuucugauggagggcgugccuaaaucccucaacuacucuggggucaaggaacugauccuggcgguggacggaguucucagcgugcacucccugcauauuuggagccuuacgaugaaucaagucauccugucugcccacguggcuaccgccgccucccgcgauagccagguugugagacgggagauugcuaaagcccucucuaagagcuuuacaaugcacucccugaccauccagauggaaucucccgucgaccaggauccugacugccuuuucugugaggauccgugcgacuga

SEQ ID NO: 75766 - RNA, 1707 nt, Artificial Sequence
  derived and/or modified sequence opt5 from SLC30A9__Homo_sapiens__NP_006336
augcugcccggccucgccgcugccgcggcucacagaugcagcugguccucucugugucggcuucgccugagaugccgggccgccgcuuguaacccuagcgaccgccaggaguggcaaaaucucgugaccuucggguccuuuucuaacauggucccgugcagccaucccuacaucggaacacugucccagguuaaacuuuauucuacgaaugugcagaaagaaggccaggggagccaaacccugagaguggagaaggucccuuccuucgaaacagccgagggaauuggcaccgaacucaaagcuccccugaagcaggagccucuccaggugcggguuaaagccgugcugaagaagcgcgaguacgggagcaaauauacacagaacaauuuuaucaccggagucagagcgauuaacgaguucugucugaagucuuccgaucuugagcaacugcggaaaauccgcagacggagcccccacgaagacacagagucuuuuaccguguaccuccgcuccgauguugaggccaagagccuggaaguguggggcucuccugaggcucuugccagagaaaagaagcugcggaaggaggcugaaauugaguaucgcgagagacucuuccggaaucagaaaauccugagagaauaccgcgacuuucugggcaacacgaagccgcgguccagaaccgccagcgucuucuuuaaagggcccggaaagguggugauggucgcgaucugcauuaauggccucaacuguuucuuuaaauuccuggccuggaucuauacaggguccgcuucuauguuuagcgaggccauucauucccuuagcgauaccugcaaucagggacugcucgcucugggcaucucuaaguccguucagacaccugaccccagccacccuuacggguucucuaacaugcgcuacauuagcucccuuaucucuggagugggcauuuucaugaugggcgccgggcugagcugguaucauggagugaugggccuccugcacccccaaccgaucgaaucccugcucugggccuacuguauccuggcugggagccuugucucugagggagcgacccugcucguggccguuaaugaacugcggagaaacgcucgcgccaaaggcauguccuuuuauaaguacgugauggagagccgggauccuucuacgaaugucauucuucuggaggacacagccgcugugcucgggguuaucauugccgcgaccugcaugggacugacauccaucaccggcaacccccuguaugauagccucggcucccugggggugggaacccuucugggcauggucucugcuuuccucauuuacacaaacacggaagcccugcuggggagaagcauccagccugaacaggugcaacgccuuaccgaacuccuggagaaugaccccuccguccgggccauccacgaugugaaggcuacagaccugggacucggcaaaguuagauuuaaggccgaaguggauuucgacgggcgcgucgugacccggucuuaucuggagaaacaggacuuugaucagaugcuucaggagauucaagaaguuaagacacccgaggaacuggagaccuucaugcucaaacauggcgagaacaucauugacacgcugggagcugaaguggauagacuggagaaggaacuuaagaaacggaauccugagguccgccacguggaccucgaaauccuguga

SEQ ID NO: 75767 - RNA, 573 nt, Artificial Sequence
  derived and/or modified sequence opt5 from SLC31A1__Homo_sapiens__NP_001850
auggaccacagccaucacaugggcauguccuacauggauucuaacagcaccaugcagcccucccaucaccauccuacaacgucugccagccacucccacgggggaggcgacucuagcaugaugaugaugccgaugaccuucuauuuuggguucaagaauguggagcugcucuuuuccggacuggucaucaacacagcuggcgaaauggccggggcguucguugcuguguuucuucuggccauguucuacgagggacucaaaauugccagagaaagccugcuucggaagucucaaguguccauccgcuauaauagcaugcccgucccuggccccaacggcaccauucugauggagacacauaaaaccguggggcagcagaugcucucuuuuccucaucugcugcagacaguucuccacaucauucaaguggucaucuccuacuuccugaugcuuaucuuuaugaccuauaauggauaccugugcauugcuguggccgcuggcgccgggacgggauauuuccucuuuagcuggaagaaagcgguuguggucgauaucaccgaacacugucacuga

SEQ ID NO: 75768 - RNA, 432 nt, Artificial Sequence
  derived and/or modified sequence opt5 from SLC31A2__Homo_sapiens__NP_001851
auggccaugcacuucaucuuuagcgacaccgcugugcuccuguucgauuuuugguccguccauucucccgccggcauggcgcugagcguucuugugcugcuccugcuugcugugcuguacgaggggauuaaggucggaaaagccaagcuccugaaccaggugcugguuaaucucccuacauccaucucucaacagacgauugccgaaaccgacggcgauagcgcuggguccgacucuuucccggugggaagaacacaccaucggugguaucugugccacuuuggccagagccuuauccaugucauucaggugguuaucggguacuucaucaugcuggccgugauguccuauaacaccuggauuuuucucggagucgugcugggcagcgcugugggcuacuaucuugccuacccccugcucucuacagcguga

SEQ ID NO: 75769 - RNA, 1578 nt, Artificial Sequence
  derived and/or modified sequence opt5 from SLC32A1__Homo_sapiens__NP_542119
auggccacccugcucagaagcaagcuguccaacguggcuacaucugucagcaauaaaucccaggccaagaugucuggcauguucgcgcggaugggguuucaagcugccacggacgaggaagccguuggauucgcucacugcgaugaccuugauuuugagcaucgccagggccugcagauggacauccucaaagccgaaggggagcccuguggagaugaaggcgcugaggccccuguggagggggacauucacuaccagagaggaagcggcgcgccgcugcccccuuccggcucuaaggaucaagucgggggaggcggggaguucggaggccaugacaaacccaagaucaccgccugggaagcuggguggaacgugacaaaugccauucagggaauguuugugcuuggccugccuuaugcuauccuccacggcggguaccugggacuguuccucauuaucuuugccgcgguugugugcuguuauaccggcaagauccugauugccugccuuuacgaagagaacgaggauggggaagucgugcggguucgcgacagcuauguggcuaucgccaaugcuuguugcgcccccagauucccuacacugggaggccgggucgugaacguggcccagauuaucgagcucgucaugaccuguauucuguacguugugguguccgggaaucuuauguauaacagcuuuccgggacugcccgucucucagaaauccuggagcaucauugcuacagcggugcuccugccuugcgccuuccugaagaaucucaaagcuguuucuaaguuuucccugcuuuguacccuggcccauuucgugaucaacauccucgucauugccuacugccugagccgcgcuagagauugggccugggaaaaagugaaguuuuacaucgacguuaagaaauuccccauuucuaucggcauuaucguguucuccuauacgagccaaaucuuucuuccuucccuggagggcaauaugcagcagcccucugaguuccacuguaugaugaacuggacccacauugcggcuugcguccucaaggggcuguuugcccugguggccuaccucacaugggcugaugaaaccaaagaggucaucacagacaaucugccgggaagcauucgggccgugguuaacaucuuccuuguggcuaaggcccugcucuccuauccucugcccuuuuucgcggccgucgaagugcuugagaaaagccuguuucaggaaggcucucgcgcuuucuuuccugccugcuacuccggggacggaagacucaagagcuggggccugacccugcggugugcucucguuguguucacgcugcuuauggccauuuaugucccccauuuugcgcugcucauggggcugacaggcucucugaccggagccggccuuugcuuccuccugcccagccuguuucaccuccgccugcuuuggagaaaacugcucuggcaucaaguguucuucgauguggcuaucuuuguuaucgggggaauuuguuccgucucuggcuucgugcacagccuggaggggcugaucgaagccuaccggacaaaugcugaggacuga

SEQ ID NO: 75770 - RNA, 1650 nt, Artificial Sequence
  derived and/or modified sequence opt5 from SLC33A1__Homo_sapiens__NP_001177921
augagccccaccaucucccacaaggacucuagcagacagcggcgcccuggcaacuucucccauucucuggauaugaaaagcgggccgcuucccccuggaggcugggacgauucccaccuggacucugccgggagagagggagaucgggaagcccuucugggcgacacagggacgggagauuuucucaaggcuccccagagcuuccgcgcggagcuguccagcauucuucugcuccuguuucuguacgugcuccaaggcaucccucugggccuugcugggucuauuccccugauccuccaguccaaaaaugucagcuauaccgaccaggccuucuuuucuuucguuuucuggccuuucucccugaagcuccugugggccccgcucguggaugcuguguacgucaaaaacuuuggaagacgcaagagcuggcuggugcccacacaauauauucugggccucuucaugaucuaccugucuacccagguugaccggcuucuggggaauacagaugacagaaccccugaugugaucgcccucacagucgccuuuuuccuguuugaauuucuugcugcgacccaggacauugccguggacggaugggcucugacgaugcucucccgggagaacguuggcuaugccagcacaugcaauuccguggggcagaccgcuggauacuuccugggcaacguccuguuucucgcccuggaaucugcggauuucuguaauaaguaucuucgcuuucaaccccagccuagaggcaucgugacccugagcgacuuccucuuuuucugggggacaguguuucugauuaccacgacacuugucgcccugcucaaaaaggagaacgagguuuccguggugaaagaagagacccagggaaucacagauaccuacaagcugcuguucgcuauuaucaaaaugcccgccguccucaccuuuugccugcuuauucugacagcuaagaucggcuucagcgccgccgacgcugugacggggcucaagcugguugaagagggagugccgaaagagcaucuggcgcuucucgccgucccuauggugccccugcagaucauucugccucucaucauuucuaaguacaccgcuggcccccaaccccugaauacauuuuauaaagccaugccuuaccggcuucugcucgggcuggaauaugcccugcuuguuugguggaccccgaagguggagcaccagggaggcuuccccaucuacuauuacauugucgugcuccuguccuaugcucugcaucaggucacaguguacagcauguacguuucuaucauggccuuuaacgcgaaagugagcgauccucucaucggcgggaccuauaugacgcugcuuaauacagucuccaaccugggaggcaauuggcccucuaccguggcucucuggcugguugacccucugaccgugaaggaaugugucggggccagcaaccaaaauugccgcacacccgaugccguggagcuuuguaaaaagcucggaggcuccugcgugaccgcucuggacggguacuauguugaaagcauuaucugugucuucauuggcuucggauggugguuuuuccugggcccgaaguuuaaaaagcuccaggaugaggggucuuccagcuggaaaugcaagagaaacaacuga

SEQ ID NO: 75771 - RNA, 1023 nt, Artificial Sequence
  derived and/or modified sequence opt5 from SLC34A1__Homo_sapiens__NP_001161051
augcugagcuacggcgagagacucgggucccccgccgugucuccucugccgguccggggaggccacguuaugcgcgggaccgcuuucgccuaugugcccagcccucaggugcuucauagaauccccggaacauccgcguacgcuuuuccuucucugggccccgucgcccucgccgaacacacgugcccuuguggggaggugcuggaacggcaugagccgcuucccgcuaagcuggcccucgaagaggagcaaaaaccugaaagccgccugguucccaagcugagacaggcuggagccaugcuccugaaagugccucuuaugcugaccuuccucuaucuguuugucugcucccuugacaugcugucuagcgcguuccagcucgccggcggcaagguggcuggggauauuuuuaaagacaacgccauccuguccaaucccguugcuggacugguggucggcauucucgugacagugcugguccagucuagcuccaccagcacaucuaucauuguuuccauggugagcucugggcuucuggagguguccagcgccaucccgaucauuaugggauccaacaucggcaccucugucacaaauaccauuguggcgcucaugcaagccggggaucggacggacuuccgcagagcuuuugccggagcuaccguucacgauuguuucaacuggcugagcgugcuuguccugcucccucuggaagccgccacaggcuaccugcaucacaucacccggcucgugguugcuuccuuuaauauucacggcgggcgcgacgcgcccgaucugcuuaagaucauuacagagccuuucaccaagcugaucauccagcucgacgagagcgugauuacgucuaucgccacaggagaugaaucccugagaaaccauagccuuauucagaucuggugccaccccgacucucugcagcaaaaucucgagggccgggaaauuacccauuuugaucugcgcaaaaagcaggcuauggaggacagcuccgucccccacuguccuuga

SEQ ID NO: 75772 - RNA, 2070 nt, Artificial Sequence
  derived and/or modified sequence opt5 from SLC34A2__Homo_sapiens__NP_001171470
auggcccccuggccugagcugggcgacgcucagccgaaccccgauaaguaccucgaaggggccgcgggacaacagccuaccgcucccgacaaaagcaaggagacaaauaaaaacaauacggaagccccugugaccaagaucgagcugcuucccuccuauucuacagccacccugauugaugaaccuacagaggucgacgauccguggaaccuccccacccugcaggacagcggcaucaaaugguccgagagagauacaaaggggaagauucuuugcuucuuucagggaaucggccggcugauucuccugcugggguuccucuacuuuuucguuuguucucuggacauccuuagcuccgcuuuucaacuggugggaggcaaaauggccggccaguucuuuucuaauagcuccaucaugagcaacccucuccuggggcuugugauuggaguccuggugaccguucucgugcagucuuccagcacgucuaccuccaucgucgugagcaugguuucuuccagccugcugacagugcgcgcugccauucccaucauuaugggcgcgaauaucgggaccuccauuacaaacaccaucgucgcccucaugcaagugggagauagaucugaguuccggcgcgcuuuugccggcgcuacggugcacgacuucuuuaauuggcugagcguccuuguucugcucccuguggaaguggccacacauuaucuggaaaucauuacccagcuuaucgucgaguccuuccacuuuaagaacggggaggaugcgcccgaccugcucaaagugauuacaaagccguucaccaaacugaucguucagcuggauaagaaggugauuagccagaucgccaugaaugacgaaaaagcuaagaacaaaucucucgucaagaucuggugcaaaaccuucacaaauaagacgcagauuaacgugaccguuccuuccacagccaauuguaccagccccucucugugcuggacagacggaauccaaaacuggaccaugaaaaacgugacguacaaggagaauauugcuaagugucagcauaucuuugucaacuuccaccuuccugaucuggccgugggcacaauucuccugauccuuagccugcucguccugugcggcugucugaucaugauugugaaaauccucggguccguucugaagggacagguggccaccgucauuaaaaagaccaucaauacagacuuucccuuccccuuugcuuggcuuaccggcuaucuggcgauucucgugggggccggaaugacauucaucguucaaucuagcuccguguuuacgagcgcucugaccccucugauuggcaucggggucaucacaauugaaagagccuacccgcuuacccucggaucuaacaucggcacaaccacgaccgccauucuggcugcccuggcgucccccggcaaugcucuccggagcucucugcagaucgcccuuugccauuucuuuuucaacauuuccgggauccugcucugguauccuauccccuuuacacgccugccuauuagaauggccaaaggacugggcaauaucagcgcuaaguaccggugguucgccguguuuuaccuuauuaucuucuucuuucucauuccccugaccguguucgggcugucccucgcuggauggcgcguucuggucggcgugggggugccggucguguuuaucaucauucuuguucugugucucagacugcugcagucucggugcccucgcgugcuucccaagaaacuccagaacuggaauuuccugccucuguggaugagaagccucaagcccugggaugccgucguguccaaauuuacaggcuguuuccaaaugcggugcugcuguugcugucgcguuugcuguagagcgugcugucugcuuugcggauguccuaagugcugucggugcucuaaaugcugugaggaccuggaagaggcccaggagggccaggaugugcccgucaaggcuccggaaaccuuugacaacaucacgauuagcagagaggcccagggggaagugccugcuuccgauagcaagacagagugcaccgcccucuga

SEQ ID NO: 75773 - RNA, 1800 nt, Artificial Sequence
  derived and/or modified sequence opt5 from SLC34A3__Homo_sapiens__NP_001170788
augcccagcucccugccuggcucucaggugccgcaccccacccucgacgccgucgaucugguugagaagacacuuagaaacgaagggacgagcuccucugcuccugugcuggaggaaggagacaccgaucccuggacacucccucaacugaaagacaccagccagcccuggaaggagcuucggguggccggccgccugagacgggucgcgggguccgugcucaaggcuugcggacugcugggcucucucuacuucuuuaucuguagccuggauguucuuuccagcgccuuccagcugcucgggucuaagguggccggagacauuuuuaaagauaaugucgugcuguccaacccuguugcuggccuugugaucggcguccuggugacagcccucgugcagucuagcuccaccucuagcuccauugucguuagcaugguggcugccaagcugcugacagugcgcgucuccgugccgaucauuauggggguuaaugugggaaccucuaucacgagcacccucgucuccauggcgcaaagcggcgacagagaugaauuucagcgggccuuuucuggguccgcugugcauggaaucuucaacuggcugacaguucuugugcugcucccccuggagagcgccaccgcccuucuggagcgccucucugaacuggcucugggcgcggccagccucacaccuagagcucaggcccccgacauucugaagguccuuaccaaaccucugacgcaccucaucgugcagcuggauuccgacaugauuaugucuagcgcuacagggaaugccaccaacuccagccuuaucaagcauuggugcggaacaaccggccaacccacccaggaaaauucuuccuguggcgccuuugggccgugcacagagaaaaacagcacggcuccugcggaucggcugcccugucgccaccucuucgccggaaccgagcugacagaccuggcugucggcugcauucuccuggccgggucucuucuggugcucuguggaugccugguucugaucgugaaacuucucaauuccguccugagaggccggguggcccagguugugcgcaccgucauuaacgcugacuuuccuuucccccugggguggcucggaggcuaucuggccgugcuugcgggcgcugggcugacauuugcccuccagagcuccucuguguucaccgccgcuguugucccccugaugggagugggcgugaucagccuggauagagccuacccucuucuccugggguccaauaucggaacgacaaccaccgcucugcucgccgcgcuggccucuccggcugaccggaugcuuagcgcccugcaagucgcucucauucauuucuucuucaaccuggccggcauccugcuuugguaucucgugcccgcgcugcgccugccuauuccccucgccagacacuuugggguugugacagcucgguacagaugggucgccggcguguaucugcuucugggauuccuccugcugccucuugcugccuuuggccucucccuggccgggggaaugguucuggcugcggugggcgggccccucgucggacuggugcuucugguuauccucgugaccguccugcagcgccggagaccggccuggcugccugugcgccuucggagcugggcuuggcugcccguguggcuccacucucuggagccuugggauagacucgucacacgcuguugccccuguaauguuugcuccccucccaaagccacgaccaaggaagccuacugcuaugagaacccggaaauucuggcuagccagcaacuuuga

SEQ ID NO: 75774 - RNA, 837 nt, Artificial Sequence
  derived and/or modified sequence opt5 from SLC35A1__Homo_sapiens__NP_001161870
auggccgcucccagagacaacgugacccuucucuucaagcuguacugccuugccgucaugacacugauggcggcuguuuauacgaucgcccuccgguacacccgcacaagcgauaaagagcuguauuuuuccaccacagccguguguauuaccgaagugaucaagcugcugcucucugucggcauucuggcuaaagagacagggagccugggaagauucaaggccucccuccgggaaaaugugcugggcucuccuaaagagcuucugaagcucagcguuccgucccugguguacgcuguccagaacaauauggccuuucuugcgcugucuaaccucgacgccgcuguguaucaaguuaccuaccagcugaagauccccugcacggcccuguguaccgugcucaugcugaaucgcacacuuagcaaacugcagugggucuccguguucaugcucugcgcuggggugacccugguccaguggaagccugcccaagcgacaaaaguugugguggaacagaacccccuucugggauuuggcgccauugcuaucgccguccucuguagcggguucgcugugcuggccucuguuggaggccuguauaccuccguggucgugaaguacacggauaauaucaugaaaggcuuuagcgccgcugcggccauuguucucucuacaaucgcuuccgugaugcuguucgggcuucagauuacccugacauuugcccucggaacccugcuugucugcgugagcaucuaccuguauggccucccuagacaggacaccacaucuauucaacagggggagacggccuccaaggagcgggucaucggaguguga

SEQ ID NO: 75775 - RNA, 729 nt, Artificial Sequence
  derived and/or modified sequence opt5 from SLC35A2__Homo_sapiens__NP_001027460
auggccgcugugggcgccgggggaagcaccgcggcucccggcccuggggccgucuccgccggagcucuggagccgggcacagccucugcugcccacagacggcucaaguacaucagccuggcgguucuuguggugcagaacgccucccugauucucucuauccgcuaugcuagaacgcugcccggggaccgguucuuugccaccacagcugucgugauggccgaaguucuuaaaggacugaccugccuccugcuucucuucgcgcaaaagcgcggcaaugugaaacaucugguccuuuuucugcacgaggccgugcucguucaguacguggauacacugaagcuggcugucccuagccugauuuauacccuccagaacaaucugcaguacguggccaucuccaaccugcccgcugccacauuccaaccuucucccagauguagccagucccauagccucugccugugucuucggcugcgcgcccucagaucuccugcugcgucccgggccgcuaccacgaccgccgccguguuuccgcccuggcgcccucaccauggcgcucugagcgccaaagucucugcgggggaaguuagagcuggauccaauggcgggacacagggacggggcaccgggguggagggagugggccaccuucaggaccccagccgccacccucccggcccggggucuuccggauucggcagauggagcuuucugccugggcauuga

SEQ ID NO: 75776 - RNA, 936 nt, Artificial Sequence
  derived and/or modified sequence opt5 from SLC35A3__Homo_sapiens__XP_011539439
augagcuccagaucugugcugagccccgucguuggcaccgacgccccugaucagcaccucgagcugaagaaaccgcaagaacuuaaggagauggaacggcugccccucgcuaacgaggacaaaacaauguucgccaaucugaaguacgugucccuugggauccugguguuucagacgaccucucucguccugacaaugcgcuauagcagaacccugaaagaagagggaccucgguaccucuccucuacagcggugguuguggcugagcugcuuaagauuauggccugcauccugcucgucuauaaggauagcaaauguucccugcgcgcccuuaacagagugcugcaugacgaaauucucaauaagcccauggagacccugaaacuggcuaucccuagcggcauuuacacacuccagaacaaucugcuuuauguugcccugucuaaccucgaugcugccaccuaccaggugacguaucaacugaagauccuuaccacagcgcuguucuccgucagcaugcucucuaaaaagcuggggguguaccaguggcugucccucgugauccugaugaccggagucgccuuuguucaguggcccagcgacucucagcuugauuccaaggaacugagcgcuggcucccaauucguggggcucauggccgugcugacagcuugcuuuucuagcggauucgccggcgucuacuuugagaaaauucuuaaggagaccaaacaguccguguggauccggaauauucagcugggcuucuuugggagcaucuucggacucaugggcguuuauauuuacgacggggaacuggugucuaagaacggauuuuuccagggcuauaaucgccugacguggaucgucgugguucuccaaugucuguuuccuuggucccacccgugcaacaauagcuacuucuucguguggcuuuga

SEQ ID NO: 75777 - RNA, 975 nt, Artificial Sequence
  derived and/or modified sequence opt5 from SLC35A4__Homo_sapiens__NP_542401
augagcguggaggacggcgggaugcccggacugggcagaccucggcaggcccgcuggacccucaugcugcuucuguccacagcuauguacggggcccacgcgccgcuccuggcucuuugccaugucgauggaagaguucccuuccggccuucuagcgccgugcugcucacggaacugaccaagcugcuccugugugccuuuucccuucuggugggcuggcaggcuuggccccaagggccucccccuuggcgccaggccgcuccguucgcccucucugcgcugcuuuauggagccaacaauaaccuggucaucuaccuccagagauauauggaccccagcacauaccaagugcuguccaaucugaaaauuggcucuaccgcuguucucuauugccugugucuucggcaccgccugagcgugagacagggccucgcccugcuucugcucauggcugccggggcgugcuacgccgcuggaggccugcaggucccugggaacacacugcccuccccucccccggccgcugccgccagcccuaugccccuccauaucaccccucugggacuucugcuccugauucuuuauugucugaucucuggccucuccagcguguacacagagcugcugaugaagcggcagcgccucccccuggcgcuucaaaaucuguuucucuacaccuucgggguucugcugaaccuuggacuccacgcuggcggcgggucuggacccggccugcuggaaggguuuuccggaugggccgcucucgugguccugagccaggcccuuaauggccugcucaugucugccgugaugaaacauggguccagcauuacgagacuguucguggucuccugcucucugguugugaacgcugugcuuagcgccguccuccugcggcugcagcucaccgcggccuuuuuccuggcuacacuucugaucggacucgccaugcgccuguauuacggcuccagauga

SEQ ID NO: 75778 - RNA, 1020 nt, Artificial Sequence
  derived and/or modified sequence opt5 from SLC35B2__Homo_sapiens__NP_001273442
augcugcucgccaugcccgcucugugguaccuugccaccagcuggugcuccacaucuggcgggagaacgaccuggcggccugugagcuaucugacauggggaguccuccaggagcgcguuaugaccagauccuacggcgcgacagcuaccucuccgggggaacgguucacagacagccaauuucuggugcuuaugaaccgcgugcuggcccucaucgucgccggacuguccugugugcugugcaagcagcccagacacggcgcuccuauguaucgguacucuuucgccagccucuccaauguucugagcucuuggugucaguaugaggcucuuaaauuuguguccuuccccacccagguccuggccaaggcgagcaaagugauuccuguuaugcucauggggaagcuggugucucgcagauccuacgaacauugggaguaucuuacggccacccugaucagcauuggagucucuauguuucuccuguccagcggccccgaaccucgguccucuccggcuacaacccugagcggccucauccugcuugccggguacauugcuuucgauuccuuuacaagcaacuggcaagacgcccuguucgcguacaaaaugucuuccgugcagaugauguuuggagugaauuucuuuagcugccucuucaccgucggcucucugcuugagcagggggcccugcucgagggaacgcgcuuuaugggcagacacagcgaguucgcugcccaugcucugcugcucuccaucuguucugccugcgggcagcuguucaucuuuuauacaauuggacaauucggcgccgcuguuuuuaccaucauuaugacacuucggcaggcguucgccauccugcucagcugucugcuuuacggccacaccgugaccguggucgggggacugggcguggcuguuguguuugccgcccuccugcugcgcgucuaugcuagagggcggcucaagcagcgcggaaagaaagccgugcccguugaauccccugugcagaaggucuga

SEQ ID NO: 75779 - RNA, 996 nt, Artificial Sequence
  derived and/or modified sequence opt5 from SLC35B4__Homo_sapiens__NP_116215
augagacccgcccuggcugugggccucgucuucgccgggugcuguagcaacguuaucuuucuggagcuucuggcgcggaagcacccuggaugcggcaauauugugaccuucgcucaguuucucuucaucgccguggaaggguuucuguucgaggccgaccuuggacgcaaaccgcccgcuauuccuaucagauacuaugccauuauggucacaauguuuuucacgguguccguugugaacaauuacgcucugaaccucaauaucgccaugccccugcauaugaucuuucggucuggcagccugauugcgaacaugauccucgggauuaucauucugaagaaacgcuauuccaucuucaaguacaccucuauugcccuugucagcgugggaaucuuuaucuguacauucauguccgcuaaacaaguuaccucucagagcucccugagcgaaaaugauggcuuucaggccuucgugugguggcuccugggcauuggggcucuuacauucgcccugcucaugucugcgagaaugggaaucuuucaggagacccuguauaagcgguucggcaagcacuccaaagaagcccuguuuuacaaccaugcucucccucugcccggguucgucuuucuugccagcgacauuuaugaucacgcugugcuguucaauaagucugagcucuacgagaucccugugauuggagucacacugccgaucaugugguuuuaccuucugaugaacaucauuacccaauauguuugcauccgcggcguguucauucucacgaccgaaugugccucccugacagugacccuggucgugacacucagaaaauuuguuagccugaucuucucuauucuuuacuuucagaaucccuucacccuguggcauuggcucgggacgcuguuuguguucaucggaacacuuauguauaccgaggucuggaacaaucugggcacaaccaaguccgaaccucagaaagacagcaagaagaacuga

SEQ ID NO: 75780 - RNA, 1056 nt, Artificial Sequence
  derived and/or modified sequence opt5 from SLC35C1__Homo_sapiens__NP_001138738
auggcccugaccggcgcuagcgaccccuccgccgaggcggaagcuaacggggagaagccuuuccuccugagagcccuucagaucgcccugguggucucucucuacuggguuacaagcauuuccaugguguuucugaauaaauaucuucuggauucuccgagccuccggcuggacacgcccaucuucgugaccuuuuaccaaugccuggucacaacccuccuguguaagggacuuuccgcucuggccgcuugcuguccuggcgccguggauuuccccucucuccgccuggaccuuagaguugcgcggagcgugcugccucucuccgucguguuuauugggaugaucacauucaacaaucugugccugaaauauguuggaguggccuuuuacaacgucggccgcagccucaccacaguguucaaugugcugcuuucuuaucugcuccugaagcagaccacguccuuuuacgcccuucugaccugugggauuaucaucggaggcuucuggcucggcgucgaucaggaaggggcugagggaacacugagcuggcugggcaccguuuuuggggugcucgcuucucugugcgugucccuuaacgccauuuauacaaccaaaguccugcccgcgguggacggaagcaucuggagacucacguucuacaauaacguuaaugccuguauucuguuucuuccucugcuccugcugcucggcgaacugcaggcccuucgggauuucgcucaacuggggucugcucacuucuggggaaugaugacacucggcggccuguuuggguucgccaucggauacgugaccggccugcagauuaaguuuacauccccgcuuacccauaacgucagcgggaccgccaaggcuugcgcgcagacagugcucgccguucuguauuacgaggagacgaaauccuuccugugguggaccucuaauaugauggugcucggaggcagcuccgcuuauacauggguccgcgggugggaaaugaagaaaacccccgaggaaccuagccccaaggacucugagaaauccgccaugggaguguga

SEQ ID NO: 75781 - RNA, 1251 nt, Artificial Sequence
  derived and/or modified sequence opt5 from SLC35D3__Homo_sapiens__NP_001008783
augagacagcugugccggggccgcgugcucgggaucagcgucgccauugcucacggaguuuucuccggcucucugaacauccuucugaaguuucucauuagcagauaccaauucuccuuucugacccuugugcagugucugacaucuagcacggccgcgcucucccuggagcugcuccggcgccuggggcuuaucgcugugcccccuuucggacugucucucgcccggagcuuugccggcgucgcugugcuguccacccuucagagcucucugacacucuggucccugcgggggcugagccucccgauguauguuguguucaaacgcugccugccccuugucaccaugcugauuggagugcucguucugaagaauggcgccccuucucccggcgugcuugcugccguccugaucacaaccuguggggcggcccucgcuggagccggcgaccugacaggggauccuaucggauacgugaccggcgugcuggcuguccucguucaugccgcguaucuggugcuuauucagaaagccuccgcugacacggaacacgggccccugaccgcccaauacgugaucgcugucagcgccacaccucuccuggugauuugcucuuuugccuccaccgauagcauccaugcuuggacauucccgggauggaaggaccccgcgaugguuuguauuuuuguggccugcauccuuauuggcugugcuaugaacuucaccacgcugcacugcacauauaucaauuccgccgucaccacaucuuuugugggcguugugaaaagcaucgccaccauuaccgucgggaugguggcuuucuccgaugucgagccuacaagccucuuuaucgccggagugguugugaacacgcugggcucuauuaucuacugugucgcgaaguucauggaaaccagaaagcaguccaauuaugaggaccuggaagcucagcccagaggggaggaggcccagcucagcggagaucaacugccuuucgugauggaggaacuucccggcgaagggggaaacggccgcucugagggcggggaggccgcuggaggcccggcccaggaaagcagacaggagguucggggguccccucgcggagugccccuggucgcuggcucuagcgaagagggguccagacggagccucaaagacgccuaccuggaaguguggcgccuggugagaggcacacgguacaugaagaaagauuaucuuauugagaaugaggaacucccuucucccuga

SEQ ID NO: 75782 - RNA, 1227 nt, Artificial Sequence
  derived and/or modified sequence opt5 from SLC35F1__Homo_sapiens__NP_001025029
augauucccccugagcagccgcaacagcagcugcagcccccuagccccgccccucccaaccacguggucaccacaauugaaaaucucccugcugagggcuccgggggaggcgggucucugagcgccuccucuagagcgggaguucggcaacgcaucagaaaggugcuuaaccgggaaaugcugauuagcguggcucucggccagguccugucccuucugaucugcgggauuggacucacgucuaaauaccugagcgaggacuuccaugccaauaccccgguguuucaguccuuccugaacuauauccuccuguuucuuguuuacacaaccacacuggccgugcgccagggcgaagagaaucuccuggcuauccuuagacggcgcugguggaaguauaugauucugggccucaucgaucuggaggccaacuaccuggucgugaaggcuuaucaauacaccacacucaccagcauucagcugcuugacuguuucguuauccccguggucauucugcucucuugguuuuuccugcuuaucagauauaaagccgugcacuuuauugggaucguggucugcauccugggaaugggcuguaugguuggggcggaugugcucgugggacggcaucagggcgccggggaaaauaaacuggucggagaccugcucgugcugggcggcgcuacgcuuuacgggauuuccaacguuugggaggaauacaucauucgcacccugagcagaguggaguuccucggaaugaucggccuguuuggggccuucuuuucuggaauccagcuugcuaucauggagcacaaggaacugcucaaggucccuugggauuggcaaaucggccugcuguaugugggguucuccgccugcauguuuggacucuacagcuucaugcccguugugauuaaaaagacaucugcgaccuccgucaaucugagccuucugacagccgaccucuauucccuguucuguggccuguuucuuuuccauuacaaauuuucuggccucuaucugcugagcuucuuuaccauccucauugggcuggugcuuuacuccagcacgucuacauauaucgcucaggauccucgggucuacaagcaguuccgcaaccccuccggaccggugguugaccugccuaccacagcccaaguggagcccagcgucaccuacaccucucucggccaggaaacagaggaggaaccucacgugagaguugcuuga

SEQ ID NO: 75783 - RNA, 1125 nt, Artificial Sequence
  derived and/or modified sequence opt5 from SLC35F2__Homo_sapiens__NP_059985
auggaggccgacagccccgcuggcccuggggccccggaaccccuggcggagggagcugccgccgaguucuccucucuccugagacggaucaagggcaaacuuuuuaccuggaacauucugaagacaaucgcucucgggcagaugcugagccuuugcauuuguggaacggccaucaccucccaauaccuggcugaacgcuauaaagugaauacaccuaugcuccagucuuucauuaacuacugccugcuguuucucaucuauaccgucaugcuggccuucagaagcggcuccgauaaucuucugguuauccucaagcggaaaugguggaaguacauucugcuugggcuggcggacguggaagccaacuaugugaucguccgcgcuuaccaguauacaacccucacaucugugcagcugcuggauuguuuuggcauucccguucucauggcccugagcugguucauccuucacgcuagauaccgggugauucauuuuaucgccgucgcggugugccugcucggaguuggcaccauggugggggccgacauucuggcuggacgcgaggauaauuccggcagcgacguccuuaucggggauauccuggugcuccugggagccucucuguacgcuauuuccaacgugugugaggaauauaucgucaagaaacucagcagacaagaguuccugggcaugguugggcuuuuuggaacgauuaucucuggcauucagcugcucaucguggaauacaaggacaucgccuccauucacugggauuggaaaaucgcccugcuuuucguggcuuuugcgcugugcauguucugucucuauagcuuuaugccucuggucauuaaggugaccucugccacauccguuaaucugggcauccucaccgcugaccuguacagccuuuucguggggcuguuccucuuuggauauaaauucuccggccuguacauucugucuuuuacagucaucauggugggguucauccuuuauugcagcacccccacgcggacagccgagccugccgaguccagcguuccgcccgugaccucuauuggaaucgauaaccucggccugaagcuggaagagaaucuccaggaaacacauuccgcuguccuguga

SEQ ID NO: 75784 - RNA, 1266 nt, Artificial Sequence
  derived and/or modified sequence opt5 from SLC35F3__Homo_sapiens__NP_001287774
augaagaaacacagcgccagaguggcuccccuguccgccugcaacucuccuguccucacccugacaaagguugagggcgaggaacggccgcgcgacagccccgggccugcggaagcucaggcccccgccggaguggaggcuggcgggagagccucccggcgcuguuggacgugcucuagagcucaacuuaaaaagaucuucuggggaguggccgucgugcuguguguuugcagcuccugggcgggcucuacccagcucgccaaacugacauuucggaaguucgaugcuccuuuuacccuuacaugguucgccaccaauuggaacuuucuguucuuuccccucuacuauguggggcaugucuguaagagcacagaaaaacaguccgugaagcagcgcuacagagagugcugucgguucuuuggagacaauggccugacccugaaaguuuucuuuacgaaggcugccccuuucggcgugcucuggacccugacaaacuaucuuuaccugcacgcgauuaaaaagaucaauaccacagaugucagcgugcucuuuugcuguaacaaggccuucguguuccugcuuucuuggauuguccugcgcgacagauuuauggggguucggaucguggcugccauucucgcuaucgccggaaucgugaugaugaccuaugccgauggcuuccauucccacagcgucauugggaucgcucuggugguugcgucugccuccaugagcgcucuguacaaagugcucuuuaagcugcuucugggaucugccaaauucggcgaggccgcucucuuucuguccauucuuggggucuucaauauccuguuuauuacgugcaucccgauuauccucuauuucacaaagguggaauacuggagcuccuuugacgauauccccuggggaaaccuguguggcuucucuguucugcuccugaccuuuaauauugugcuuaacuucggcaucgccgucacauacccuacccugaugagccucgggauugugcuguccauccccgucaaugcggugauugaccauuauaccagccaaaucguuuuuaacggagugcgcgucaucgcuauuaucauuaucggccuuggguuccugcuccugcugcucccugaggaaugggauguguggcugauuaaacuucugacaagacucaagguucggaaaaaggaggagcccgccgaaggagccgcugaccugucuuccggcccgcagagcaagaaucgcagagcccggccuucuuucgcuagauga

SEQ ID NO: 75785 - RNA, 1599 nt, Artificial Sequence
  derived and/or modified sequence opt5 from SLC35F4__Homo_sapiens__XP_011535022
augcuggugcaccucagagacagccuguacccccagcuuggcaucaaccaacuguccuauacccggaagcucgccacacgcugcucuagcgucguuacggcuuccuacaccgugcugaaaccugagaagagaaaaauucuucugcaguauaaguuccagaaagaaacauuucagcucccguucaagaccacauuuuggaucaauaacuuccaaauugugaucuuuccccuggggucucuguguagcaccucccggucuagcgucacacgcugcaagccuggagccaauugucccuccagccauucuggcauuuccagacagcucagcccucugucugugaccgaggauuccagcgcgcccauccuugaacugcagaaccaggggucuuccggaguuugcggccaccggguggagcgccaaaauagaagcgcugacgaugggacgcagacccauuccgaaaacucuagccaggagaaucggaucaaagcccgcugucucuccugcacaagcaugguccugaagggaauuuggggccuucugaucauucucucuguguccagcucuuggguuggcaccacacagaucgugaaaauuaccuacaagaacuucuauuguccguuuuucaugacgugguuuagcacaaauuggaacaucauguucuuuccugucuacuauuccgggcaccuggccaccgcucaagagaaacagucucccaugaagaaguucagagaaugcagccggauuuuuggagaggacggccugacacucaaacuguuccuuaagcgcaccgccccuuucuccauccuguggacccucacaaauuaccuguaccuucuggcucucaaaaagcugacggccaccgaugugagcgcgcuguuuuguugcaacaaagccuucguguuucuccugucuuggaucguccuuaaggacagauucauggggguucggauuguggcugccaucauggcuauuacaggaaucgugaugauggccuaugcggauaauuuucaugccgacuccauuaucggcgucgcuuucgccguggggagcgcuucuaccuccgcccuguacaaaguucucuuuaagauguuccugggaagcgccaacuuuggcgaagcugcgcacuucguguccacacuuggcuuuuucaaucugaucuuuauuucuuucacccccgucauccucuauuucacgaagguggagcacuggagcuccuuugccgcucugccuugggggugucugugcggaauggccggccucuggcuggccuucaacauucuuguuaacgugggggucgugcugacauaccccauccucauuucuaucggaaccguccugagcgugccgggcaaugcugccguugaucugcuuaaacaggaggugaucuuuaacgucgugcgccucgcggcuaccauuaucauuugcaucggguuccugcugaugcuccugccugaagagugggacgaaauuacacuuagauuuaucaauucccugaaggagaaaaagagcgaggaacauguugaugacgugaccgaucccucuauucaccuccggggaagaggccgcgccaacggcacagucuccaucccucuggccuga

SEQ ID NO: 75786 - RNA, 1116 nt, Artificial Sequence
  derived and/or modified sequence opt5 from SLC35F6__Homo_sapiens__NP_060347
auggccuggaccaaguaccagcuguuccucgcuggccugaugcuugugacagggagcaucaacacgcuguccgccaaaugggcggacaauuuuauggcugagggaugcggcgggucuaaggaacacagcuuccaacaucccuuucuccaggccgucggaauguuccugggcgaguuuuccugucuugccgcuuucuaucugcucagaugccgggccgcugggcagucugauagcuccguugacccucagcaaccguuuaacccccugcuguuccucccucccgcccugugugauaugaccggaacaucucuuauguacguggcgcugaauaugaccagcgccuccagcuuucagaugcuccgcggcgcugugauuaucuucacaggccuguuuucugucgccuuccuugggagacggcuggugcucucccaguggcugggcauucuggcuaccaucgccggacucguuguggucgggcuggcggaccuucugagcaaacacgauucucagcauaagcucuccgaagugauuacaggagaccugcuuaucaucauggcccaaauuaucguugcuauucagauggugcuggaggaaaaauuugucuauaagcacaacgugcauccucuccgcgccgugggcaccgaggggcuguucggauucgucauccugagccuccugcuuguucccauguacuauauuccugcuggcucuuuuuccggcaauccgagagggacgcuggaggaugcccucgacgccuucugccaggugggacagcaaccccugaucgcuguggcgcuucugggcaacauuagcuccaucgccuuuuucaauuuugcugggaucucugucaccaaggaacucagcgccacaacccggauggugcuggauucccugcgcacaguugugauuugggcccucagccuggcucuuggaugggaggccuuccacgcgcugcagauccucggcuuucugauucugcuuaucgggaccgcucucuacaacggacugcacagaccucugcucggccggcugucucgcggcagaccccuugccgaagaguccgagcaggaacggcugcucgggggaacgcgcacaccuauuaaugacgccagcuga

SEQ ID NO: 75787 - RNA, 1098 nt, Artificial Sequence
  derived and/or modified sequence opt5 from SLC35G1__Homo_sapiens__NP_001128130
augagaccccaggacagcaccggcguggccgagcugcaagaaccugggcucccgcugacagaugacgcucccccuggagccacggaggaacccgcggcugccgaggccgcuggcgccccugaucgggggcgcugcuggcuuugucuguccucucccugcuguagcagaaccgaaccugaggcuaagaaaaaggccccgugccccggacucggccuguucuacacacuucuguccgcguuucucuucucugucgggagccuguuuguuaaaaaggugcaggacgugcacgccgucgagaucuccgcuuuccgguguguguuucagaugcugguugugauuccuugccucaucuaucgcaaaaccggauucauuggccccaagggccagagaaucuuucugauucuucgcgggguccugggaucuacagccaugaugcucaucuacuaugcuuaccaaaccaugagccuggccgaugcgacagugaucaccuucuccagcccuguuuuuacgucuauuuucgccuggaucugucuuaaggaaaaauauucccccugggacgcucuguuuaccguguucacaauuaccggcgucauccucauugugcggccgccuuuucuguucgggagcgauacaucuggaauggaggaauccuacagcggccaucugaaggggaccuucgccgcuaucggaucugccguguuugccgcuuccacgcucgucauucugagaaaaaugggcaagagcguugacuauuuccuuuccaucugguacuacguggugcugggccucgucgagucugugaucauucugagcguucuuggggaguggucccugcccuauugcggacucgaucggcuguuucugaucuucauuggccucuuugggcugggaggccagaucuucauuacaaaagcgcuucagaucgaaaaggccgggccuguggcuaucaugaagaccauggacgucguguuugccuucauuuuucagaucauuuucuuuaacaauguucccacaugguggaccgugggaggcgcccugugugucguggcuagcaacgucggcgccgcgauccgcaaaugguaccaaucuuccaaguga

SEQ ID NO: 75788 - RNA, 1239 nt, Artificial Sequence
  derived and/or modified sequence opt5 from SLC35G2__Homo_sapiens__NP_001091069
auggacaccagccccuccagaaaguacccugugaaaaagcgggucaaaauccacccgaacacaguuauggugaaguauacgucucauuacccccagccuggcgaugacggguaugaggaaauuaaugagggauacggcaacuucauggaagagaaucccaaaaaggggcugcucagcgaaaugaagaaaaagggacgcgccuuuuucggcaccauggauacacugccucccccuaccgaggacccgaugaucaacgagauugggcaauuucaguccuucgcugagaaaaauaucuuucagucuagaaagauguggauugugcuuuucggaagcgcccuggcgcacggcugcgucgcucucaucacacggcugguguccgaucgcucuaaaguucccagccuugaacugaucuuuauuagauccguguuccagguccucagcgugcugguuguguguuauuaccaagaagccccuuuuggccccucuggguaucggcugcgccucuucuuuuacggagucugcaacgugaucuccauuaccugugccuacaccagcuucucuaucgugccucccuccaauggcacaacgauguggagagcuaccacaaccgucuuuagcgccauucuggcuuuccuucugguugacgagaagauggccuauguggauauggcgacaguggucugcucuauccucggggugugucugguuaugauuccgaacaucguggacgaggauaauucccuucugaacgccuggaaggaggcuuucggauacaccaugacggucauggccggccucacaaccgcucugagcaugaucguguaucgguccauuaaagaaaagaucucuauguggacagcccuguuuaccuucggguggaccggaacaauuuggggcaucagcacgauguuuauucuccaggaaccuaucaucccccuggacggcgagaccugguccuaccuuauugcgaucugcguuuguagcacagccgcuuuccuggggguguauuacgcccucgauaaauuucauccugcucuggucucuaccgugcagcaccuugaaauugucguggccaugguucugcagcuccuggugcugcauaucuuccccuccauuuaugacgucuuuggaggcgugaucaucaugauuagcguuuucgugcucgccggguacaagcuguacuggcgcaaucuuagaaaacaagauuaucaggagauccuggacucucccauuaaguga

SEQ ID NO: 75789 - RNA, 1017 nt, Artificial Sequence
  derived and/or modified sequence opt5 from SLC35G5__Homo_sapiens__NP_473369
auggccggcagccaccccuacuucaaccugccugacuccacccauccgucucccccuagcgcucccccuucccucagauggcaccagcggugccaacccucuggggccacaaauggacugcuuguggcgcugcucggcgggggacugccugcuggcuuugucgggccgcuuagccgcauggccuaucagggauccaaccugcccucucucgagcugcugaucuguagaugccucuuccaucugccuauugcccuucugcucaagcugcggggcgauccccuucugggcccucccgacauccgcgggugggcuuguuuuugcgcccuccugaauguucugagcauuggaugugcuuacuccgccguccagguggugccggcgggcaacgccgcuacggugagaaaagggagcucuaccguuugcuccgccgugcucacacugugucuugaaagccagggacugggcggguaugaguggugcggacuccugggcucuauccuuggccugauuaucauccucgggccuggacuguggacccugcaagaaggcacaaccggggucuacacaacccucggauaugugcaggcuuuccugggcgggcuugcccugucccucggacugcuuguuuaccggagccugcacuuucccucuugucucccuacgguggcguuccuguccggccuggucggccuccuggggugcgugcccggacuuuuugugcugcagacccccguccucccuagcgaucugcuguccuggucuuguguuggcgccgaggggauucuugcucucgugagcuucacaugcgugggauaugccgucaccaaggcucauccggcccuggugugcgccguucugcacuccgaaguggucguggcucucauccugcaguacuacaugcuucacgagacaguugcgcugagcgacauuaugggcgccggggugguccucggcucuaucgcuauuaucaccgcccgcaaucuguccugugagagaacgggaaaaguggaagaguga

SEQ ID NO: 75790 - RNA, 1017 nt, Artificial Sequence
  derived and/or modified sequence opt5 from SLC35G6__Homo_sapiens__NP_001096084
auggccggcagccaccccuaccugaacccuccggacuccacccaucccucuccucccagcgcuccucccucccucagauggcaccagugcugucaaccuucugaugccacaaaugggcugcuuguggcgcugcucggaggcgggcugccggcuggauucgucggcccccuuagccauauggccuaucaggccuccaaccugccuucucucgagcugcugaucugccggugucucuuucaccuucccauugcucugcugcucaagcugcgcggggacccucuucugggacccccggauaucagaggccgggccuacuucuaugcucuccugaauguucugagcauuggcugcgccuacuccgcgguccagguggugccugccgggaacgcugccacggugcgcaaaggaagcucuaccguuuguuccgcugugcucacacugugccuugaaagccagggccugucuggguaugacugguguggacuccugggcuccauccuugggcugauuaucaucgucggacccggccucuggacccugcaagagggcauuacagggguguacaccgcccugggauauggccaggcguuuguugggggacucgcccugagccuuggccugcucguguacagaucucugcauuucccuuccugccuucccacagucgcuuuucugagcgggcucgugggacugcugggcuccgugcccggccucuucguccugcagccuccgguucuucccucugaucugccuagcugguccugugugggggccgugggaauccucgcucuggucagcuuuaccugcgugucuuacgccguuacgaaggcccaccccgcucuggugugugcgguccuucacuccgaagugguuguggcccucauucugcaguauuacaugcugcaugagaccgucgcuccuagcgacaucgugggcgccggggucgugcucggaucuauugccaucauuacagcuuggaaucugagcugcgaacgggagggcaaaguugaggaauga

SEQ ID NO: 75791 - RNA, 1431 nt, Artificial Sequence
  derived and/or modified sequence opt5 from SLC36A1__Homo_sapiens__NP_510968
augagcacccagagacugcggaacgaggacuaccacgauuauuccucuacagacgugagccccgaagaguccccuucugaaggccucaauaaccugagcuccccggggucuuaccaacgcuucggacagagcaauuccacgaccugguuucagacacuuauccaucugcucaagggcaacauugggaccggacugcuuggccugccccucgccgucaaaaaugcugggaucguuaugggaccuauuagccugcugaucauuggcaucguggccgugcacugcaugggcauccucgucaagugugcgcaucacuucugcagacggcugaacaaaucuuuuguggauuauggggacacaguuauguacggacuugaguccagccccuguucuuggcugcgcaaucaugcucacuggggcagacggguggucgauuucuuucucauugugacccagcugggguucugcuguguuuauuuuguguuccuugccgacaacuuuaagcaagucaucgaagccgcuaauggaacaaccaacaauugccacaacaaugagacggugauucugaccccuacaauggauucccgccucuacaugcugagcuuccugcccuuucucgugcugcuugucuucaucagaaaccugcgggcccucucuaucuuuucccugcuugcuaauauuaccaugcugguuagccucgugaugauuuaucaguucaucgugcagcgcaucccugacccgucccaucugccccuggucgccccuuggaaaacauacccccucuucuuuggcaccgcgauuuucucuuuugaggggaucggaauggugcugccucuugaaaacaagaugaaggaucccagaaaauucccgcugauucucuaccugggcaugguuaucgugacgauucuuuauaucagccugggcugucucggguaccugcaguuuggagccaacauccaaggcuccauuacacugaaucucccuaacugcuggcuguaucagagcgucaaacuucuguacucuaucgggauuuucuuuaccuaugcucuccaguucuacgugcccgccgagaucauuauccccuuuuucguuucccgggcucccgaacacugugagcugguggucgaccuguuugugcgcacaguccuugugugccucaccuguauccuggccauucugauccccagacucgaucugguuauuagccuugugggaucugucagcuccucugcgcuggcccucaucauuccuccgcugcuggaggugaccacauucuauagcgaaggcauguccccucuuacgaucuuuaaggacgcucucauuagcauccugggguucguuggauucguggucggcaccuacgaggcccuguacgaacucauccagccuucuaaugcucccauuuuuaucaacuccacaugcgccuucauuuga

SEQ ID NO: 75792 - RNA, 1452 nt, Artificial Sequence
  derived and/or modified sequence opt5 from SLC36A2__Homo_sapiens__NP_861441
augagcgugaccaaguccacagagggcccccagggggccgucgcuaucaaacuggaccucaugucuccuccggaaagcgccaagaaacuggagaacaaggauuccacguuccuugacgaaucucccagcgaguccgcgggacugaaaaagaccaagggcauuacaguuuuucaagcucucauccaccuggugaaagggaauaugggaaccggcauucuugggcugccucucgccgugaagaacgccggaauccugaugggcccccugucucuccuggucaugggcuucauugcuugccauuguaugcacauccuugugaaaugcgcccagagauuuuguaagcggcugaauaaaccuuucauggauuacggggacacaguuaugcauggacucgaagcuaaccccaaugccuggcugcagaaccacgcgcauuggggccgccacaucgugagcuuuuuccuuauuaucacccagcugggguuuugcugugucuauauuguguuccucgccgauaaucugaagcaaguuguggaggcugucaacuccacaaccaauaacugcuacagcaaugagacggugauccugaccccuacaauggacucuagacucuauaugcuguccuuucuuccguuccuggugcuccugguccuuauucggaaccugcgcauccucaccauuuuuagcaugcuggccaauaucucuaugcugguuucccucgugaucauuauccaguacauuacacaggaaauccccgauccuagcagacugccccuuguggcuucuuggaagaccuauccucuguucuuuggaacggccauuuucuccuucgagagcaucggcgucgugcucccccuggaaaacaaaaugaagaaugcgcggcacuuuccggccauccuuucccuggggaugucuauuguuacaagccucuacaucggaauggcugcccugggcuaucugcgcuucggcgacgauauuaaggcuuccaucagccucaaccugccuaacuguuggcuuuaccagucugugaaacugcucuacauugccgggauccugugcaccuaugcccugcaauuuuacguccccgcugagaucauuaucccuuucgcgauuuccagagugagcacacggugggcccuuccccucgaccugucuauccgccugguuauggugugucugaccugccuccuugcuauucugauccccagacucgaucuggucauuagccuggugggauccgucucuggcaccgcccuugcccucaucaucccuccgcugcuggaggugacaacguuuuauagcgaagggaugagcccccucaccauuuucaaagacgcucugaucuccauucuuggauuuguuggcuucguggucgggacauaccaggcccuggaugagcuccugaagucugaagacucccauccuuuuagcaauucuaccacauucgugcgguga

SEQ ID NO: 75793 - RNA, 1602 nt, Artificial Sequence
  derived and/or modified sequence opt5 from SLC37A1__Homo_sapiens__NP_061837
auggccagacugcccgcuggcauccgguucauuaucagcuuuucccgcgaccagugguacagagccuucauuuuuauccucaccuuccugcuuuaugcgucuuuucaccugagccggaagccuauuuccaucgugaaaggggagcuccauaaguacugcacagcuugggaugaagccgacguccgcuucucuagccaaaacagaaaauccggaucugccgcuccgcaccagcugcccgauaaugagacggacuguggcugggccccuuuugauaagaacaauuaucagcagcuucugggggcucucgacuacagcuuccugugcgccuaugcgguuggaauguaccuguccggcaucauuggggaacggcuccccauccgcuauuaccugaccuuuggaaugcuugccagcggcgcuuucacagcccuguuuggccucggguacuucuauaacauucauucuuuuggauucuacguggugacccaagucaucaauggccuggugcagacaaccggguggccuuccguugugacaugucuuggaaacugguucggcaaagggagacggggacugauuaugggcgucuggaauagccacaccucugugggcaacauccucgggucccugauugcuggauauuggguuagcacgugcuggggccugucuuuugugguccccggggccaucguggcggccaugggaaucguguguuuccucuuucugauugagcauccuaaugauguccgcugcuccagcacccuuguuacacacuccaagggcuacgaaaacgggaccaauagacugcggcuccagaagcagauccugaaaucugagaagaacaaaccgcuugaccccgagaugcaaugucugcuccugagcgauggaaagggcuccauucacccuaaucauguggugauccugcccggcgacgggggaagcggcacagcugccauuucuuucaccggggcucucaaaaucccuggagucaucgaauuuucccugugccuucuguucgccaagcucgugagcuauacguuucuguucuggcuuccccuguacauuacaaacguugaucaccucgacgccaagaaagcuggcgagcugucuacccuguuugaugucgggggcaucuucggaggcauucucgcgggggugaucagcgaccgccuggaaaagagagccuccacauguggacuuaugcugcuccuggcugccccgacccuguauaucuuuucuaccgugagcaaaaugggccuugaggccacaauugcuaugcuccugcuguccggggcccucguuagcggaccuuacacgcugaucaccacagcggugucugcugaccuuggcacccauaagucccugaaagggaaugcccacgcccucagcacagucaccgcuauuaucgauggcacgggaucugugggcgccgcucuggggccccugcuugccggacuccuguccccuagcggcugguccaacgucuucuacaugcugauguuugcggacgccugcgcucuccuguuccuuauucggcugauccacaaggagcucucuugucccgggagcgccacaggagaucaggugcccuucaaagaacaguga

SEQ ID NO: 75794 - RNA, 1506 nt, Artificial Sequence
  derived and/or modified sequence opt5 from SLC37A2__Homo_sapiens__NP_001138762
augagaagcucccuggcccccggcgugugguucuuucgggcuuucucucgcgacagcugguuuagagggcucauccugcuucugaccuuccucauuuacgccugcuaucacaugucccggaagccuaucucuauugucaaaagccgccugcaucagaacuguuccgagcaaaucaagccgauuaaugauacacacucucuuaacgacacgauguggugcagcugggcgcccuuugauaaagacaauuacaaggaacugcucggaggcguugauaacgcuuuccugaucgccuaugccaucgggauguuuauuuccggaguguucggcgagagacugccucuccgguacuaucugagcgcugggaugcuucugucuggacucuuuaccucccuguucggccuuggcuacuuuuggaauauccaugaacugugguauuucguggucauucagguguguaacgggcucguucagacaaccggauggcccagcguggucacaugcgugggcaauugguuugggaaaggaaagcgcggcuucaucauggggauuuggaacucucacaccuccguuggaaauauccugggcagccugauugccggcaucugggugaacgggcaguggggacucucuuucaucgucccuggcauuaucacagcugugaugggggugauuaccuuucuguuccuuaucgagcaucccgaagacgucgauugugccccuccgcaacaccacggagagcccgcggagaaucaggacaacccugaagaucccggcaauuccccuugcagcauuagagaguccgggcuggaaacgguugccaaguguucuaaaggacccugcgaggagccggcugccaucagcuuuuucggcgcucuccggaucccuggcgugguggaauuuucccugugucuucuguucgccaagcucgucagcuacaccuuucuguacuggcugccccucuauauugcgaacguggcccauuucucugcuaaagaggccggggaccuguccacacuuuuugauguuggaggcaucauugggggaaucguggcuggccuggucagcgacuacaccaaugggcgcgccacaaccugcugugugaugcucauucuggccgcuccuaugauguuccuuuauaacuacaucggccaggauggaaucgcgucuagcauuguuaugcugaucauuugcggcgggcucgugaacggacccuaugcccugaucacgacagcugucuccgccgaccugggcacccacaagucucucaaagggaaugccaaggcucugagcacagugaccgccauuaucgacggaaccggcuccauuggggcggcucuuggcccccugcucgccggacugaucagcccuacaggcuggaacaaugucuuuuacaugcugaucucugccgaugugcuugcuugccuccugcuguguagacucguuuauaaggaaauucuggccuggaaagugucccuuagccgggggucuggauacaaggagaucuga

SEQ ID NO: 75795 - RNA, 1290 nt, Artificial Sequence
  derived and/or modified sequence opt5 from SLC37A4__Homo_sapiens__NP_001157749
auggccgcucagggcuacggguauuacagaaccgugaucuucagcgccauguuuggaggcuauucccuguacuauuucaaccggaagacauuuucuuucgucaugcccagccucguugaggaaauuccucuggacaaagaugaccuuggguuuaucacguccucucaaagcgcggcuuacgccauuuccaaguucgugucuggagugcugagcgaucagauguccgcccgcuggcucuuuagcucuggccugcuucuggucgggcucgugaauaucuucuuugcuugguccagcaccguuccgguguucgccgcucugugguuucugaacggacucgcccagggccugggcuggcccccuugcgggaaaguccuuagaaagugguucgagcccucucaguuuggaacauggugggcgauucuguccaccagcaugaaucucgccggcgggcugggaccuauccuugcuacaauccuggcccaaucuuauuccuggcggagcacccucgcucuguccggcgcccugugugugguugugucuuuccucugccugcuucugauucacaacgaacccgcggacgucgggcuccgcaaucuggauccuaugccgagcgagggaaagaagggcucccuuaaggaagagagcacacugcaggagcuccugcugucucccuaccucugggugcuguccaccggcuaccuuguggucuucgggguuaaaacguguugcaccgacuggggacaguuuuuccugauccaggaaaagggccaaagcgcccucguggggucuagcuauauguccgcucuggaggugggaggccuugucgggucuauugccgcuggauaccugagcgauagagccauggccaaagcuggccucuccaacuauggcaauccucggcaugggcugcugcucuuuaugauggcgggaaugacagugagcauguaccuguuccgcguuaccgugacaucugacucccccaaacuuuggauccugguccucggcgccguguuuggguucagcucuuauggaccuauugcucuguuuggcguuaucgccaacgaauccgcucccccgaaucugugugggaccagccacgccauugugggccuuauggccaacgucggaggcuuccucgcggggcugccuuuuuccacgaucgcuaaacauuacucuuggagcacagccuucuggguggccgaggucaucugcgcugccuccaccgcugccuuuuuccugcucagaaauauucggacaaagaugggacgcgugucuaagaaagcggaguga

SEQ ID NO: 75796 - RNA, 1464 nt, Artificial Sequence
  derived and/or modified sequence opt5 from SLC38A1__Homo_sapiens__NP_001265316
augaugcacuucaagagcggccuggagcucaccgaacugcagaacaugacagugcccgaggacgauaauaucuccaacgacucuaaugauuuuacggaagucgagaacgggcaaauuaauagcaaauucaucuccgacagagaaucucggcgcagccuuaccaacucccaucuggagaagaaaaagugcgaugaguacauuccuggaacaaccucucucggcaugagcguuuuuaaucuguccaacgccaucauggggagcggcauucuuggacuggcuuucgcccucgcgaauacagggauccugcuguuucucgugcugcuuaccucugugacacugcucuccaucuauagcauuaaccugcuucugaucuguucuaaagaaaccggaugcauggucuacgagaagcucggcgaacagguguucggcacgaccgggaaguuuguuauuuucggagcuacaucccugcagaauaccggcgccaugcugagcuaucucuuuaucgugaaaaacgagcugccgucugccauuaaguuccuuauggggaaagaggaaacauuuuccgcuugguacgucgacggaagagugcugguugugaucgucaccuucggcauuauccucccccugugucuucugaagaaucucggguaucugggauacacgagcggcuuuucccugucuugcaugguguucuuccucaucguggucauuuauaaaaaguuucagaucccuuguauuguucccgagcugaacagcacaaucuccgccaauagcaccaacgcugauacaugcaccccuaaguacgugaccuucaacucuaaaacaguguacgcccuucccacgauugcguuugccuucgucugucacccuuccgugcugccgaucuauagcgaacucaaggaccggucucagaaaaagaugcaaaugguuagcaauaucuccuuuuucgcuauguuugugauguacuuccugaccgccauuuuuggcuaucuuacauucuacgauaacguccagucugaccugcuccauaaauaucagagcaaggaugacauccugauucugaccgugcgccucgcuguuaucguggccgucauucugacagugcccguccuguuuuucaccgugagauccagccuuuuugagcucgcgaaaaagacgaaguucaaucugugccggcacacaguugugaccuguauccugcuugucgugaucaaccuccugguuauuuucaucccuucuaugaaagauauuuuugggguggucggagugaccuccgccaauaugcugaucuucauucuccccagcucucuguaccuuaagaucacagaccaagacggcgauaaagggacccagcgcauuugggcugcccuguuucucggacugggcgugcuguucucccuuguuagcaucccucucgucaucuaugacugggcuugcuccucuagcuccgaugaagggcauuga

SEQ ID NO: 75797 - RNA, 1521 nt, Artificial Sequence
  derived and/or modified sequence opt5 from SLC38A2__Homo_sapiens__NP_061849
augaagaaagccgagaugggcagauucagcaucucccccgacgaagauucuagcuccuacucuagcaacuccgacuuuaauuauucuuacccuaccaagcaggcugcccugaaaagccacuaugcggauguggacccggagaaccaaaauuuccuccuggaauccaaccuugggaagaaaaaguacgagacagaauuucaucccggaacgaccagcuucggcaugucugucuuuaaucuguccaacgcuauuguugggagcggaauccucggccugucuuaugccauggccaauacagggauugcucuuuucaucauucugcucaccuuuguguccaucuucagccuguacucugugcaccuucuccugaagacagccaacgagggaggcucccuucuguaugagcagcucggcuacaaggcuuuugggcuggucggaaagcuggccgcgagcggcuccaucaccaugcagaauauuggggccaugucuagcuaccuguucaucgugaaauaugaacucccucugguuauucaggcucugacaaacaucgaggauaagaccggacucugguaccugaauggcaacuaucuugugcugcucgucucccuggugguuauucuuccccugagccucuuucggaaucugggguaccugggauauacgucuggccucucccugcuuugcaugguguucuuucugaucgucgugauuuguaaaaaguuccaagugccuugccccgucgaagccgcucucaucaucaacgagaccauuaauacaacccugacacagccuaccgcccuuguuccggcgcugagccauaacgugacggagaacgacucuugucgcccccacuacuucaucuuuaauagccagacaguguaugccgucccuauucucaucuucuccuuugugugccaucccgcuguucugccuauuuacgaggaacugaaggauagaucucggcgcagaaugaugaacgugagcaaaaucuccuucuuugccauguuccucauguaccugcuugcugcccuguuuggcuaucucaccuucuacgaacacgucgagagcgaacugcugcacacauauucuuccauccuugggaccgacauucuccugcugaucgugcggcucgccguucugauggcugugacccuuacaguccccguggucauuuuuccgauccgcagcucugugacgcaucugcucugugcguccaaggauuucagcugguggagacacucccugauuaccguuucuauccuggccuuuacaaaucuucucgugaucuucgucccuaccauucgggacaucuuuggauucauuggcgcuagcgccgccuccaugcugaucuucauucugcccucugcuuuuuacaucaaacucgugaagaaagagccuaugaaaagcguucagaaaauuggggcccuguucuuucuucuguccggagugcucgucaugacaggcagcauggcgcugaucgugcuggauugggugcauaacgcucccgggggaggccacuga

SEQ ID NO: 75798 - RNA, 1644 nt, Artificial Sequence
  derived and/or modified sequence opt5 from SLC38A4__Homo_sapiens__NP_001137296
auggaccccauggagcugagaaacgugaauaucgaaccugaugacgagagcuccucuggcgaaagcgccccggauuccuacauugggaucggaaacucugagaaggcugccaugagcucccaguucgcgaaugaagacaccgagucucaaaaauuucucacaaacggcuuccuggggaagaaaaagcuggcugauuaugccgacgagcaccaucccggaacgaccagcuuuggcauguccagcuucaaucuuucuaacgccauuaugggguccggaauccucggccugagcuacgcuauggccaauacaggcauuauccuuuuuaucauuaugcugcucgcugucgccauccugucucuguauuccguucaccuccugcuuaaaaccgcgaaggaagggggaagccugauuuacgagaagcucggcgaaaaagccuucggguggccuggaaagaucggcgcuuuugugucuauuacaaugcagaacaucggggccauguccagcuaucuguucauuaucaaauacgagcuucccgaggugauccgggcuuuuaugggacuggaagagaauaccggcgaaugguaucucaacggcaauuaccugauuaucuucgucuccguggggauuauccugccucucucucugcuuaagaaccugggauaccucggcuauacaagcggguuuucccugaccugcaugguuuucuuugugagcgucgugauuuacaaaaaguuccagauccccuguccucuuccgguucuggaucauucugugggaaaucucuccuucaacaauacgcugcccaugcacgucgugaugcugccuaacaacagcgagucuagcgacgugaauuuuaugauggauuauacccaucgcaaccccgccggccucgacgaaaaucaggcgaaggggucccugcacgauucuggagucgaguacgaggcccacagcgacgauaaaugcgaaccuaaguauuucguuuuuaacuccagaacagcuuacgccauccccauucuuguguucgcuuuugugugucauccggagguccugccuaucuauagcgaacucaaagaccggucucgcagaaagaugcaaaccguguccaauauuagcaucacaggcaugcugguuauguaccuucuggccgcccucuucggcuaccugaccuuuuauggggagguggaagacgagcugcuccacgcuuacucuaaagucuauacgcuggauauuccccuucugauggugcggcucgcgguucugguggccgucacacugaccgugccuaucguccuuuuccccauccgcacauccgugauuacccuccuguuucccaagagaccuuucagcuggauccggcauuuucugauugcugccguucucaucgcccugaacaaugugcuugucauucuggugccgaccaucaaauacauuuucggauuuaucggcgcuuccucugccacaaugcucaucuucauucugcccgcgguuuucuaucugaaacuugugaagaaggagacguuucgcagcccucagaaggucggggcucucaucuuccugguggugggaaucuuuuucaugauuggcuccauggcccugauuaucaucgacuggauuuacgaucccccuaacucuaaacaccacuga

SEQ ID NO: 75799 - RNA, 1419 nt, Artificial Sequence
  derived and/or modified sequence opt5 from SLC38A5__Homo_sapiens__NP_277053
auggagcugcaggaccccaagaugaacggcgcccucccuagcgaugcugugggguacagacaagaacgggagggauuccugccgucccgcggccccgccccugggucuaaacccguccaguuuauggacuucgaaggaaagaccagcuuuggcauguccguuuucaaucuuucuaacgcgaucauggggagcggcauucugggacucgcuuaugccauggcccacacaggcgugaucuuuuuccuggcccuucugcucugcauugcucugcuguccucuuacagcauccaucuccugcuuacgugugcugggauugccggaaucagagcguaugagcagcugggccagcgggccuuugggccugcuggaaaaguggucguggccaccguuaucugccuccacaaugugggcgcuauguccagcuaccuguucauuaucaagucugaacuuccccuggucauugggacauuucucuauauggauccugagggagacugguuccugaaaggcaaccugcucaucauuaucguguccguucugauuauccuuccgcuggcccucaugaagcaucugggcuaccuuggguauaccagcggacugucucucacauguaugcuguuuuuccugguguccgucaucuacaagaaauuucaacucggcugcgcgauugggcacaaugagaccgccauggaaagcgaggcucuggugggacuucccucucagggccugaacuccagcugugaagcccagauguucacaguggauucccagaugucuuacaccgucccuaucauggcuuucgccuuuguuugccaucccgaggugcucccuauuuauacggagcugugucgccccagcaagagacggaugcaagccguggcuaaugucuccaucggggcgauguucugcauguacggacuuaccgccacauuuggcuaucugaccuucuacagcucugugaaagcugaaaugcuccacauguauucccagaaggacccgcugauucuguguguucgccucgccgugcugcuugccgucacacugaccgugccuguugugcucuuucccaucagacgggcucugcagcagcugcuuuucccuggcaaagccuuuagcuggccccgccacgucgcgaucgcucucauucugcuggugcucgucaacgugcugguuaucugcgugcccacgauuagagauaucuucggggucauuggaucuacaagcgccccuucccuuaucuuuauccugccgucuauuuucuaccuccggaucgugcccagcgagguugaaccuuuucuguccuggcccaagauucaagcccuguguuucggcgugcuugggguccucuuuauggcugugagccugggauucauguucgccaauugggcuaccggccagucucgcauguccgggcauuga

SEQ ID NO: 75800 - RNA, 1566 nt, Artificial Sequence
  derived and/or modified sequence opt5 from SLC38A6__Homo_sapiens__NP_001166173
auggaggccagcuggggcuccuucaacgcugaaagagggugguacgugucuguccagcaacccgaggaagccgaggcggaagaacugagcccucuccuguccaaugagcuucaccggcagcgcucuccgggaguuagcuuuggccuguccguguucaaccucaugaaugcuaucauggggucuggcauucugggacuugccuaugugcuggccaacaccggggucuuuggauucagcuuucuccugcugacaguggcucuccuggccuccuacagcguucaucuucugcucucuaugugcauccagacggcugugaccuccuaugaagaccugggccuuuucgccuuuggccugcccgggaagcucgucguggcgggaacaauuaucauucagaauaucggcgccaugagcucuuaccugcugaucauuaaaaccgagcucccugcugccaucgcugaguuccugacaggggauuauuccagauacugguaucuugacggacaaacccugcucauuaucauuuguguuggcaucguguuuccccuggcccuucugccuaagauuggguuccucggauacacaagcucucuguccuuuuucuuuaugauguucuucgcgcuggucgugaucaucaaaaaguggagcauucccugcccucucacccugaacuacguggagaaaggcuuucagaucuccaaugucacggaugacuguaagccgaaacuuuuccacuuuucuaaggagagcgccuaugcucugcccaccauggccuucuccuuucucugccauacaagcauucugccuaucuacugugaacuucagucucccuccaagaaacggaugcagaacguuaccaauacagcuauugcccugagcuuccucaucuauuuuaucucugcccuguucggcuaccugaccuuuuaugauaagguggagagcgaacuccugaaaggguacuccaaguaucuuucucacgacguggucgugaugacgguuaagcugugcauucucuucgcugugcugcugacagucccucuuauccauuuucccgcgcgcaaagccgugaccaugauguucuuuagcaacuucccguucuccuggauuagacacuuucucaucacacuggcucugaauauuaucaucguucuccuggccauuuacgugccugauauccggaacgucuucggaguggucggcgccagcaccucuaccugucuuauuuuuaucuuccccgggcuguuuuaccucaagcugucccgcgaggacuuccugagcuggaaaaagcucggaggccuuauucugucucacagacuggcuugcuccggggugaucagcgcccauuguaaucucugccugccugauuccucuaacccucccacaagcgcgucccggguugcugaaacgaccggacgcgacacaauggagauguguacccaaagaaaaggccacgcccggacacagcaggagggcaauugccuucaggccaaggggcgcggacugagacggaccaaacgcgugcauacgcucauucugcacuuucccacaucuagaaccgucagcaaguga

SEQ ID NO: 75801 - RNA, 1389 nt, Artificial Sequence
  derived and/or modified sequence opt5 from SLC38A7__Homo_sapiens__NP_060701
auggcccaggugagcaucaacaaugacuacuccgagugggaucugucuaccgacgcuggcgaaagagcccggcuccugcaaagccccugcgucgauacagcgccuaaguccgagugggaggcuucucccgggggacuugaccgcggcacgaccagcacacugggggccauuuucaucguugugaacgccugucucggagcuggccugcuuaauuuuccggccgcuuucuccaccgccgggggaguggcggccggcauugcucugcagaugggcaugcucgucuuuaucauuucugggcuggugauccuggccuauugcagccaggcuuccaacgaaagaacauaccaggaaguugugugggccgucuguggaaaacucaccggcgugcugugcgagguugcgaucgccguguauacauucgggaccuguauugcuuuucuuaucauuaucggagaucaacaggacaagauuaucgccgucauggcuaaagagccugaaggcgccagcgggcccugguacacggaucggaaguucaccauuucucugacagccuuucucuucauccugccucuuuccaucccccgcgagauuggauuucagaaauaugcuagcuuccugucuguggugggcaccugguacgucacagcgaucguuauuaucaaguauauuuggccugacaaggaaaugaccccgggcaauauccucacgagacccgccuccuggauggcuguguuuaacgccaugccuacaaucugcuucggguuucagugucacgugagcucuguccccguguucaauuccaugcaacagccugagguuaaaaccuggggaggcguggucacagccgcuauggugauugcccuggcgguuuacauggggaccggaaucugcggcuuccugaccuuuggggcugccguggaucccgacguccuccugagcuacccguccgaggauauggccguggcugucgcccgggcuuucauuauccuuucugugcugacaagcuauccuauucuccauuuuuguggacgcgccguuguggaaggccuguggcuuagauaccagggcguccccguggaggaagacguugggcgggagcgcagacggcgcgugcugcagacgcucgucugguuccugcugacccuccugcuugcgcuguuuaucccugauaucggaaaggugauuuccgugaucggcgggcucgccgcuugcuucauuuuuguuuuccccggacugugucuuauccaagccaaacugagcgaaauggaggaggucaagcccgcuucuuggugggugcucguguccuauggcguccugcuggugacacucggggccuuuauuuucggccagaccacagcgaacgccaucuuuguugaccugcuugcuuga

SEQ ID NO: 75802 - RNA, 1308 nt, Artificial Sequence
  derived and/or modified sequence opt5 from SLC38A8__Homo_sapiens__NP_001073911
auggagggccagacccccgggagcagaggacugccugaaaagccgcaccccgccacagcugccgcgacgcucuccucuaugggcgcuguguucauccugaugaaaagcgcccuuggggccggacugcucaacuuuccuugggcuuucuccaaggccggcggggucguucccgcuuuucugguggagcuugugucucuggucuuccucauuagcggacuggugauccugggcuacgccgcggccguuuccggccaagcuaccuaucagggggugguccggggacucugcggcccugccauugggaaacugugugaggcuugcuuucuucugaaucuccugaugaucucuguggccuuccuucgcguuauuggagaccagcuggaaaagcucugugauagccugcuguccggcacacccccugcgccgcagcccugguacgccgaccaaagauuuacccucccucugcuuagcgugcuggucauccucccccugucugcuccucgggaaaucgccuuccagaaauauacauccauucuugggacccuggcugccugcuaccucgcccuggugaucacagugcaguauuaccuguggccccagggacucguccgcgagagccauccgucucuguccccugcuagcuggaccucuguguuuuccguguuccccacgauuuguuuuggcuuccaaugccacgaggcggccgugagcaucuauuguuccaugagaaagcggucucuuagccauugggcucuggucuccgugcucagccugcuugccugcugucugauuuacucucucaccggcguuuacggguuucugacauucggaaccgaaguguccgccgauguccugaugagcuauccuggcaacgacauggugaucauuguugcucgcguucucuucgccgucucuaucgugacagucuaccccaucgugcuguuucuugggagaagcguuaugcaggauuucuggcggcgcuccugccugggaggcugggggcccucugcgcucgcugacccuagcggacugugggugagaaugccgcugaccauucuuugggucacggugacacucgccauggcccuguuuaugcccgaucuguccgagaucguuagcauuaucggcggcauuucuuccuucuuuaucuucaucuuuccugggcucugucugauuugcgcuaugggaguggaacccaucggcccucgggucaagugcugucuugagguguggggagugguuagcguccugguggggaccuucauuuuuggccagucuacagccgcugccgugugggagauguucuga

SEQ ID NO: 75803 - RNA, 1497 nt, Artificial Sequence
  derived and/or modified sequence opt5 from SLC38A9__Homo_sapiens__NP_001245215
augaacaagagaauccacuacuauagccggcugaccacacccgccgacaaagcucucauugccccugaucauguggucccggcgcccgaggaaugcuacguuuauuccccucugggcucugcuuacaaacuucagagcuauacggagggguacggaaagaauaccucccuggugacaaucuucaugauuuggaacaccaugaugggcacaucuauccucagcauucccugggggaucaagcaagccggauuuaccacaggcaugugugugaucauucugauggggcuucugacccucuauugcuguuaccgcgucgugaaauccagaacgaugauguucucucuggacaccacaagcugggaauacccugauguuugccggcacuauuuuggauccuucggccaguggagcucucugcucuuuucccuggugagccuuaucggcgccaugauugucuacugggugcugaugucuaauuuccucuuuaacaccgggaaguucaucuuuaauuucauucaucacaucaacgacacagauaccauucuguccacgaauaacagcaaucccguuaucuguccuucugcuggauccggcgggcauccggacaacagcuccaugaucuuuuaugccaaugauacaggagcucagcaguucgagaaguggugggacaaaucucgcaccgugcccuuuuaccuugucggccugcuccugccucugcucaacuucaagagccccuccuucuuuagcaaauucaauauucuggggacagugucugugcuuuaucugaucuuucucgucaccuucaaggccguuagacugggauuucaccuugaauuucacugguucauuccuaccgaguucuuugugcccgagauccgguuccaauuuccgcagcugacaggcgugcucacgcuggcguucuuuauucauaacugcaucaucacccugcucaaaaauaacaagaagcaggaaaacaauguccgcgaucuguguauugccuacaugcuugugacacugaccuaucucuacaucggcguucugguguucgcuuccuucccuucucccccucuuagcaaagacugcauugagcagaacuuucuggauaauuuccccagcuccgacacacucucuuuuaucgccagaauuuuccugcuguuucaaaugaugaccgucuacccccuccugggguaucuugcucgggugcagcugcucggacacaucuucggcgauaucuacccuagcauuuuucauguucugauccugaaccuuauuaucgugggggccggagucauuauggcguguuucuauccgaauaucggcgggauuauccgcuacuccggagccgcuugcggccucgccuuuguguucaucuaucccagccugauuuacaucauuucucugcaccaggaagagagacucacguggccuaagcugaucuuucacgucuucauuaucauccuuggcguggcuaaccugauuguucaguuuuucauguga

SEQ ID NO: 75804 - RNA, 2496 nt, Artificial Sequence
  derived and/or modified sequence opt5 from SLC39A10__Homo_sapiens__NP_001120729
augaaggugcacaugcauaccaaauucugccugaucugucuccugacauuuauuuuccaccauugcaaccacugucaugaggaacacgaccacggccccgaggcccuucauagacagcaccgggggaugacggaacuggagccuagcaaguuuuccaaacaagcugccgaaaaugagaagaaauacuauaucgagaaacucuucgaacgcuacggagagaacggcagacuguccuuuuucgggcuugaaaagcugcucaccaaucugggacugggcgagcggaaggucguugagauuaaccaugaagaucucgggcacgaccacgugagccaucuggauauccuugcggugcaggagggaaagcacuuucauucccacaaucaucagcacucucacaaccaucugaauagcgaaaaccagacagucaccuccgugucuacaaaacgcaaucacaagugcgacccggagaaagaaaccguugaggugagcgucaaguccgaugacaagcauaugcacgaucacaaccauagacuccggcaccaucaccgccugcaucaccaccuugaccauaauaacacacaccauuuccacaaugauagcauuacccccucugagagaggcgaaccuuccaacgagcccagcacggaaaccaauaaaacacaagagcagucugacgugaagcugccuaaaggcaagcggaaaaagaaagggcgcaaguccaacgaaaacagcgagguuaucacccccggauuuccuccgaaucaugaucagggcgagcaguaugaacacaacagagugcacaagcccgaccggguccauaauccugggcacucucaugugcaccuccccgagcgcaacggacacgauccuggcagagggcaucaagaccuggaccccgauaaugaaggagagcugcggcacacacgcaaaagagaagcuccgcaugugaagaacaaugccaucauuucccuccggaaagaccugaacgaggaugaccaccaucacgagugucuuaaugucacccagcugcucaaguacuauggccacggcgccaacagcccuaucuccacggaucuguucacauaccuuugccccgcucugcucuaucagauugacucuagacuguguaucgaacauuuugauaaacugcucguugaggacauuaauaaggauaagaaccuggugccugaagacgaggccaauaucggggcuagcgccuggauuugcggaaucaucuccauuaccgugaucagccuucugucucuccugggcgucauucuugugcccaucauuaaccagggguguuucaaauuucugcucacauuccugguugcgcuggccgugggaaccauguccggcgaugcucuccugcaccuucugccccauagccaagggggacacgaccacucucaucagcacgcccauggccacggccauagccacgggcacgaguccaauaaguuccucgaagaguacgacgcuguccugaaaggacugguggcccuuggcgggaucuaccuccuguuuaucauugaacauugcauccgcauguucaagcacuauaaacagcaacggggaaagcagaagugguuuaugaaacagaacaccgaggaaucuacaauuggcagaaagcugagcgaucauaaacucaacaauacgccugacuccgauuggcugcagcuuaagccgcuggcggggaccgacgauagcguugugucugaggaccgccucaacgagacagaacugaccgaucuggagggccaacaggaaucucccccuaaaaauuaccuuuguaucgaggaagagaagauuaucgaccacagccacucugauggacuccauacaauccacgagcaugaccugcacgccgcugcccauaaccaccacggcgaaaauaagaccguccugcggaaacauaaccaccaguggcaucacaagcauucccaccacagccaugggcccugccacuccggaucugaucucaaagagacgggcauugcuaauaucgccuggauggugauuaugggggacggaauccauaacuucagcgauggccuggccauuggggcugcguuuuccgccggccuuacaggaggcaucucuaccagcauugcugucuucugccacgaacugccucacgagcucggggacuuugccgugcugcugaaggccggaaugaccguuaaacaggcuaucguguauaaucuucucuccgccaugauggcguacaucggcaugcugauugggacagcugucggacaauaugccaacaauaucacccuguggauuuucgccgugacagcuggcauguuucucuacguugcccugguggacaugcuucccgaaaugcugcauggggauggcgacaacgaggagcacggauucuguccggucggccaguuuauccuccagaaucuggggcugcuuuucggauuugcuauuaugcucgugaucgcccuguaugaagauaagaucguguucgacauucaguucuga

SEQ ID NO: 75805 - RNA, 1029 nt, Artificial Sequence
  derived and/or modified sequence opt5 from SLC39A11__Homo_sapiens__NP_001153242
augcugcagggccacagcuccguguuccaagcccuccuggggaccuuuuucacauggggaaugacggcugccggcgcggcucuugucuuuguuuucucuagcgggcagagacggauccuggacggaucccucggcuuugccgccggggugaugcuggcugccucuuacuggagccuucuggcucccgccguggagauggcgaccuccucuggaggcuucggcgccuuugcuuucuuuccugucgccgugggguucacacucggagcugccuuuguuuaucuggcggaucugcucaugccgcaucugggcgccgcugaagacccccagaccacacuugcccugaacuucgggagcacccucaugaagaaaaaguccgauccugagggacccgcucugcuuuuuccugaaagcgagcugucuauucgcaucggcagagccgggcuccuguccgacaaaagcgaaaauggagaggccuaccagcggaagaaagcugcggccacaggccugcccgagggcccugcugugccgguccccucucgcgggaaccucgcccaaccuggaggcuccagcuggagacggauugcccugcuuauccuggcuauuaccauccacaaugugcccgaagggcucgccguuggagugggcuucggggcgaucgagaagacggcuucugccaccuucgaauccgcccgcaaccuggcuauuggaaucggcauucagaauuuuccugagggccuugccgucagccugccccucagaggggcuggauucuccacauggcgggccuuuugguauggccagcugucugggaugguggagccgcuggcgggaguguucggcgccuuugcugucguucucgccgaaccuauccugcccuacgcucuugccuucgcggccggggcuaugguguauguggucauggaugacauuaucccugaggcccagauuagcggcaacggaaagcuggcuuccugggccagcauccucggcuuugugguuaugaugucucuggauguggggcuuggauga

SEQ ID NO: 75806 - RNA, 2076 nt, Artificial Sequence
  derived and/or modified sequence opt5 from SLC39A12__Homo_sapiens__NP_001138667
augugcuucagaaccaagcugagcguguccugggucccccucuuucugcuucugucucggguuuucagcacagagacggacaaaccuuccgcccaggauucucgcagcagaggcuccucugggcaaccggcugaccuccuucaggugcugagcgccggagaucaucccccucacaaccacucccggagccugaucaagacccuccuggagaaaacaggcuguccccgcagacggaaugggaugcagggagacugcaaccuguguuuugaaccugaugcgcuccugcuuauugcuggcgggaauuucgaagaccagcugcgcgaggaagugguccaaagagugucucuccugcuucuguacuauaucauucaucaggaggagaucugcuccagcaagcucaacaugucuaauaaagaauacaaguuuuaucugcacucccugcucagccugcggcaggaugaggacucuuccuuccuuagccagaacgaaaccgaggauauucuggccuuuacacgccaauacuucgacaccucccagucucaguguauggagacaaagacccuccagaaaaagagcggaaucguuuccagcgaaggcgccaaugagucuacgcugccccaacuugcugccaugaucauuacccugucccuccagggcgugugccuggggcagggaaaccugccuagcccggauuauuuuacagaauacaucuucucuagccucaauagaaccaacacacugcggcuuuccgagcuggaccaacuccugaauacccuuuggacgcgcucuacauguauuaaaaacgaaaagauccaucaguuucagagaaaacagaauaacauuaucacccacgaucaagacuauagcaauuucuccagcucuauggagaaggaguccgaagacggccccgucagcugggaucagacaugcuuuucugcucggcagcugguggagauuuuccuccagaaggggcugucccugaucagcaaagaagacuucaagcaaauguccccuggaaucauucagcagcuccugucuuguagcugccaccuucccaaagaucagcaagccaagcugccucccaccacccucgagaaauacggcuacuccacaguugcggugacgcugcugacccuugggucuaugcucggaacagcccugguccuguuucauagcugugaagagaacuaucgccucauccugcagcuuuucgugggccuggcugugggcacccucuccggggacgcccugcugcaccuuauuccgcagguccucggacugcauaagcaggaggcuccugaauuuggccacuuccacgagagcaaagggcauaucuggaagcugaugggacucauuggcgggauccacggauuuuuccugaucgaaaagugcuuuauucuucugguuucucccaacgauaaacaaggccucucccuggugaauggccauguggggcacagccaucaccuggcccuuaacucugagcucuccgaccaggcgggaagaggcaagagcgccucuacaauccagcugaaaagcccugaagauucccaagcugccgagaugcccauugggagcaugaccgcuucuaaucggaagugcaaagccaucucccugcucgccauuaugauccuggucggagacagccuucacaacuucgcugauggccuggcgaucggggccgcuuuuuccucuagcuccgagucuggcgugacgacaaccauugccauccucugucaugaaauuccccacgagaugggagacuucgccguucugcugagcuccggccuuucuaugaagaccgcuauccucaugaauuuuauuagcucccugacagccuucauggggcuguacaucggacucagcgugucugcggauccuugcguccaggacuggauuuuuaccgugacagcuggcauguuccuguaucuuucccugguugaaaugcucccggagaugacgcaugugcagacccagagacccuggaugauguuccugcugcaaaacuuugggcuuauccugggauggcucagccugcuccugcuugccaucuacgagcagaauauuaagaucuga

SEQ ID NO: 75807 - RNA, 1116 nt, Artificial Sequence
  derived and/or modified sequence opt5 from SLC39A13__Homo_sapiens__NP_001121697
augcccggcugcccuuguccggggugcggaauggccggccccagacuucucuuccugaccgcucuugcccuggagcuccuggggcgggcgggaggcagccagccugcucugcgcuccagagggacagccacggccugucggcuggacaacaaggaaucugagagcuggggagcucuccuguccggcgaacgccuggauaccuggaucugcucucuccugggcagccuuaugguggggcuguccggagucuuuccccuccugguuauuccucuugagaugggcacaaugcugagaucugaagccggggcuuggcggcucaaacaacugcugagcuucgcccucggaggccugcuugggaauguguuucugcaccuccugcccgaggcgugggccuacaccuguuccgcuagcccuggaggcgagggccagucucuucagcagcaacagcagcuggggcucugggugaucgccggcauucugacauuccuggcucucgaaaagauguuucuggacuccaaagaggaaggaaccagccaggccccgaacaaggaucccacagcggccgcugccgcucuuaaugggggacauugccuggcccaaccugccgcugagcccggccucggggcggucgugcgcucuaucaaaguuuccggauaucugaaccuucuggccaauaccauugacaacuucacgcacggccucgcuguggccgccagcuuucuggucucuaagaagaucggccugcucaccacaauggcuauccugcuucaugagauuccucacgaagugggggauuucgccauccugcucagagcgggauuugaccggugguccgcugccaaacugcagcugagcaccgcccuuggcgggcuccugggagcuggcuucgccauuuguacacagucccccaaggggguugugggcugcucuccggcugccgaggaaaccgcggccuggguccugccuuuuacgagcggaggcuuccucuacaucgcucuggugaaugugcuucccgaucugcucgaggaagaggacccuuggcgcucccugcagcaacugcuucuccugugugccgggauugucguuauggugcuguuuagccucuucguggauuga

SEQ ID NO: 75808 - RNA, 1479 nt, Artificial Sequence
  derived and/or modified sequence opt5 from SLC39A14__Homo_sapiens__NP_001121903
augaagcugcuccugcuucaccccgccuuccagagcugccugcuccugacccuucugggccucuggagaacaacgccugaggcucaugccuccucucugggggcgccggcuaucagcgccgccuccuuucugcaagaccucauucaccgguacggagaaggcgauucucugacccuucagcagcugaaagcucuccugaaccaucuugacgugggggucggacgcggcaauguuacacagcacgugcaagggcauagaaaccugagcaccuguuucuccucuggagaucucuuuacagcccacaauuucagcgagcagucccggaucggcagcucugaacugcaggaguuuugccccaccauucugcagcaacucgacucccgcgcuuguacaagcgaaaaccaggagaaugaggaaaacgagcagaccgaagagggcagaccuucugccguggaggucuggggguauggacugcuuugcgugacgguuaucucccuguguagccuccugggcgcgucugugguccccuucaugaagaaaaccuuuuacaagcggcuucugcucuauuucauugcccuggcuaucgggacacuguacuccaaugcccucuuucagcugaucccugaagcguucggauuuaacccccuugaggauuauuacgugagcaaauccgccguuguguucggcggguuuuaucuguucuucuuuaccgaaaagauucucaagauccugcuuaaacaaaagaaugagcaccaucacggacauucucacuacgcgagcgaaucccugccuagcaaaaaggaccaggaggagggcgucauggaaaaacuccagaacggcgaucuggaccacaugauuccgcaacauuguucuuccgagcuggaugggaaggcccccaugguggacgaaaaggugaucgucggaagccucucuguucaggaucugcaggcuagccaguccgccugcuacuggcuuaaaggcgugcgcuauucugacauugggacacuggcuuggaugaucacccucagcgauggacugcacaauuucauugacggccuggccaucggggccuccuuuacggugagcgucuuccaaggaaucucuacauccguggcuauucuuugcgaggaauuuccucaugagcucggcgacuucguuauccugcugaacgcgggcaugagcauucagcaggcccucuuuuucaauuuucugucugcuuguugcuguuaccuugggcuggccuucggaauccucgccggcucccacuuuagcgcuaacuggauuuucgcccuggcugggggaauguuucuguauaucucccuugcugauauguuccccgagaugaaugaagugugccaggaggacgaaagaaagggcucuauccucauuccuuucaucauucaaaaccuggggcugcucaccggcuuuacaaucauggucgugcugaccauguacagcggacagauucagaucggcuga

SEQ ID NO: 75809 - RNA, 975 nt, Artificial Sequence
  derived and/or modified sequence opt5 from SLC39A1__Homo_sapiens__NP_001258888
augggccccuggggagagccugaacugcucguguggagaccggaggccgucgcuagcgaacccccuguucccguggggcuggaggugaagcugggcgcccugguccuccugcuugugcugacccuccugugcucccugguuccuaucugugugcuccggcgccccggggcgaaccacgaaggaucugcuagcagacagaaagcccugucccuugucucuugcuucgccggcgggguguuucuggcuacaugucuccuggaccuucugccugauuaccucgccgcuauugacgaggcccuggcggcccugcacguuacgcuccaauucccgcugcaggaguuuauccuugcuaugggauucuuucuggugcucgucauggaacagauuacccuggccuauaaggagcagagcggccccuccccucuugaagagacacgggcucugcucggcaccgugaaugggggaccccaacacuggcaugauggcccuggggugccccaggccucuggagcgccggccacaccuagcgcucugcgcgccugcguccugguuuucucccucgcucugcacagcguguuugagggccuugccguggggcugcagagagaccgggcccgcgcuauggaacucugucuggcgcuucugcuccauaaaggaauccuggccgucucucugucccucagacugcuucagagccaucugcgggcucaagugguugccggcugcggcauucucuucucuuguaugacaccccuggggaucggacugggcgccgcucuugccgaguccgcggggccucuccaccagcuggcucagagcgugcuggaaggaauggccgccggcaccuuucucuacaucaccuuccuggagauucuuccccaggaacuggcuucuuccgagcaacgcauccucaaggucauucugcugcuugccggguuugcucuccugacgggacuucucuucauccagauuuga

SEQ ID NO: 75810 - RNA, 930 nt, Artificial Sequence
  derived and/or modified sequence opt5 from SLC39A2__Homo_sapiens__NP_055394
auggagcagcugcucggcaucaagcuggggugccuuuucgcccugcucgcucugacccuuggauguggccugacacccauuugcuuuaaaugguuccaaaucgacgccgcgagagggcaccaucggcucgugcugcgccugcucggauguauuagcgcuggcgucuuucugggggccggauucaugcacaugacggccgaagcucuugaggaaaucgagucccagauucagaaguuuaugguucagaacagaucugccagcgaacgcaauuccucuggcgaugcugacagcgcccauauggaguacccuuauggcgagcugaucaucucccucggguucuuuuucguguuuuuccuggaaucucuugcgcugcaaugcuguccgggagccgcuggcgggagcaccgugcaggaugaggaauggggaggcgcccacauuuuugagcuccauucccacgggcaucugcccagcccuucuaaaggaccccugcgggcucucguccugcuucugucccucagcuuccacucuguguuugagggccuggccguuggccuucagccuacaguggcggccaccguccagcugugccucgcugugcuggcccacaaggggcugguuguguucggagucggcaugagacucgugcaucuggggacauccagccggugggcuguguucucuauccuucugcucgcccugaugagcccccuuggacuggccgucggccucgcuguuaccgggggagacuccgaaggcggccgcgggcuggcgcaagccgugcuggagggaguggcugccggcacauuucucuacgucaccuuccuggaaauucuuccuagagagcuggccuccccggaagcuccccucgccaaauggucuuguguggcggcuggguuugccuucauggccuuuaucgcucugugggccuga

SEQ ID NO: 75811 - RNA, 945 nt, Artificial Sequence
  derived and/or modified sequence opt5 from SLC39A3__Homo_sapiens__NP_653165
auggugaagcugcucgucgccaaaauccugugcaugguuggcguguucuuuuucaugcuucuggggagccuccugcccgugaagauuaucgagaccgacuuugaaaaagcucacagauccaagaaaauucuuucucuguguaacacauucggaggcggggucuuucucgccacgugcuucaaugcgcugcugccugcugugcgggagaagcuccagaagguucugagccuuggacauaucuccaccgauuacccgcuggccgaaacaauucuccugcuuggcuuuuucaugaccguguuucuggagcaacucauccugacauuccgcaaagaaaagcccucuuuuaucgaccuggagaccuucaacgccgggagcgaugucggauccgacucugaguaugaaagcccuuuuaugggcggcgcuagagggcacgcccucuacguggagccccauggacacggcccuucccugagcguucaggggcuuucucgggcuucccccgugcgccugcucagccuggccuucgcgcuuucugcccauuccgucuucgaaggacuggcucucggccugcaggaggagggggaaaaaguggugagccuguuugucggaguugccgugcacgagacacucguggcugucgcccugggcauuucuauggcgagauccgccaugccucuucgggaugcugccaagcuggcugugaccguuagcgccaugaucccgcucggcauugggcugggacuuggcaucgaauccgcccagggggugcccggaucugucgcuagcgugcugcuccaaggccuggccgggggaacguuccuguuuauuaccuuccucgagauccuggcgaaagaacuugaggagaaguccgaccgccugcucaagguucuguuucuggugcuuggcuauacaguccucgcuggcaugguguuccugaaaugguga

SEQ ID NO: 75812 - RNA, 1869 nt, Artificial Sequence
  derived and/or modified sequence opt5 from SLC39A4__Homo_sapiens__NP_060237
augguggacgucguuggccuggagagagaaaccgggccccggggaagcccuuggccgggccucccccugccuucccuuguggggcccgccccucugcucacaugccuguguccccagugccuuucuguggaggaugcucugggacucggcgaaccugaggggagcggacugccgcccggcccuguccuggaagcccgcuacguggcgagacucuccgcugccgccguucuguaucuuucuaaccccgagggcacgugugaggacgcucgggccgggcugugggcuagccacgccgaucaucuccuggcgcuucuggaauccccuaaggcccucacccccggacugucuuggcugcuccaacgcaugcaggcuagagccgcuggccagacaccgaaaaccgccugcguggacaucccucagcugcuugaggaagcggucggggccggagcucccggcagcgccgggggagugcuggcugcccuccuggaucacguucgguccggcagcuguuuccaugcccuuccuucuccccaauacuuuguggacuucgucuuucagcagcacuccagcgaggugcccaugacacuggcugagcucucugcgcugaugcagcgccugggcguggggagagaagcccauuccgaucacagccaccggcaucgcggagcuucuuccagagacccugucccgcucauuagcuccucuaauagcuccagcguuugggauaccgugugccugucugcccgggacgugauggccgcuuauggccuuuccgagcaagccggggucacacccgaagcgugggcucagcugagcccugcccuccugcagcagcaacuuucuggagccuguaccagccaguccagacccccugugcaggaucaacugucucagagcgagcgcuaccucuauggcucccuggcuacgcugcucaucugccugugugccguuuucgggcuucugcuccugaccugcacaggaugucggggcgugacccacuacauucugcagacauuucuuagccucgcugucggcgcccugaccggggacgcggugcugcaucucacgcccaagguucugggacuucacacacacucugaagagggccuguccccgcagccuaccuggcgccuccuggccaugcuggcugggcuuuaugccuucuuucucuucgagaaccuguuuaaucugcuccugcccagagauccugaagaccuugaggacggacccugcggccauagcucucacucccaugggggccacagccauggagugucccugcaacucgcuccuucugaacugcggcagcccaaaccgccucacgagggcagcagagccgaucuggucgcggaagagucccccgagcuucucaaccccgaaccucgccggcugucuccggagcugagacuccugcccuacaugaucacacuuggggacgccgugcacaauuucgcugauggacuggccgucggcgcugccuuugccagcuccuggaagaccgggcucgcuaccagccuggcgguguucugccaugaacugccucacgagcuuggagacuuugccgcucuccugcaugccggccugucuguucgccaggcccuccugcuuaaccuggcuuccgcccucacagcguucgcugggcuguacguggcccuggccgucggcgugagcgaagagucugaggcuuggauucuugccguugcgacgggacuguuccucuauguggcucugugugauaugcuccccgccaugcugaaaguccgggacccuagacccuggcuucuguuucuccugcacaaugugggccugcuugggggauggaccgugcugcuccugcucucccuguacgaagaugacaucacauucuga

SEQ ID NO: 75813 - RNA, 1302 nt, Artificial Sequence
  derived and/or modified sequence opt5 from SLC39A6__Homo_sapiens__NP_001092876
augggcauccaggugccccugaacgccaccgaguucaauuaccucugcccugcuauuaucaaccaaauugacgccagaagcugucugauccacacauccgaaaagaaagcggagauuccgcccaagacguauucucuucagaucgcuugggucgggggauuuaucgccauuagcaucauuuccuuccugucucuccugggcguuauccuugugccucugaugaaucggguguuuuucaaauuucuccugagcuuccuggucgcccucgcuguggggacccuguccggagaugccuuucuucaucugcucccccacucucaugcuagccaccaucacucccacagccaugaagaaccugccauggaaaugaagcgcggcccccuguucucucaccuuuccagccagaacauugaggagucugcguacuuugacuccacauggaaagggcugaccgcccucggaggccuguauuucauguuucugguugaacaugugcucacacugaucaagcaguucaaggauaaaaagaaaaagaaucagaaaaagccugagaacgacgaugacgucgaaauuaagaaacaacuuagcaaguacgagucucagcuguccaccaaugaggaaaaaguggauacagacgauagaaccgagggcuaucuccgggcugacagccaggaaccgucccacuuugauucucaacagcccgccguucuggaggaagaggaggugaugaucgcucacgcccauccucaggaagucuacaacgaguaugugccccgcgggugcaagaauaaaugucacagccauuuccacgacacgcuuggacaguccgaugaccugauccaucaccaccaugacuaccaccauauucuccaccaccaucaccaucaaaaccaccauccucacagccacucucagagauacucccgggaggagcugaaggaugcgggcguggccacccuggcuuggauggucaucaugggggacggacuccauaauuucagcgauggccuggccauuggggcugccuuuacagaaggacuuucuagcggccuguccaccucuguugccguguucugccacgagcucccccaugagcugggcgacuuugcugugcuucugaaagcggggaugacagucaagcaggccgugcucuauaacgcucugagcgccaugcuggccuaccucggaauggcuaccggcaucuucauugggcacuaugccgaaaauguuuccauguggaucuuugcgcugacggcuggacuuuucauguacguggcccuggucgauauggugagcuuuuga

SEQ ID NO: 75814 - RNA, 1410 nt, Artificial Sequence
  derived and/or modified sequence opt5 from SLC39A7__Homo_sapiens__NP_001070984
auggccagaggccugggggcuccccacuggguggccgucggacuccugaccugggcgacacuuggccugcucguugcugggcugggaggccaugacgaucuucacgacgaucugcaggaggacuuccaugggcacagccaucggcacucccacgaagauuuucaucacggacauucucacgcccacggccauggccacacgcaugagagcaucuggcacgggcauacccacgaccacgaucauggacacucccaugaagaccuccaccacggccauucucacggguacagccaugagucccuguaucaccgcggacauggccacgaucacgaacauucucacgggggauacggcgagagcggcgccccugggauuaagcaagaccuggaugcugugacacucugggccuaugcucugggagccaccgugcuuaucuccgcggccccguucuuuguccuguuccucauucccguggagagcaacucuccuagacaucggucccugcuucagauccugcucagcuuugcuucuggcgggcugcugggagacgccuuccuccaccugauuccccaugcucuugaaccucacucccaccauacacuggagcagcccggccacgggcauagccacucuggacagggcccuauccucuccguuggccugugggugcuuagcgggaucgucgccuuucuggugguugaaaaauucgugcgccacgucaagggaggccaugggcacucccauggacacggccaugcgcacucucacaccagagggagccauggccacggacggcaagagcgcuccacaaaagagaagcagagcucugaagaggaagagaaagaaaccagaggcgugcagaagcggcgcgggggauccacggugccgaaggauggccccgucagaccucagaaugccgaggaggaaaaacgggggcucgaccugcgcguuagcggauaccugaaccucgcugccgaccuggcucauaauuuuaccgauggccuugccauuggggccucuuucagaggcggacggggccuggggauccucacaaccaugacagugcugcuucacgaggugccccacgaagucggagacuuugcuauucuggugcaaagcggcugcuccaagaaacaggcgaugcgccuccagcugcugaccgccguuggggcucucgccggaacggccugugcucugcuuacagagggcggggccgugggcucugaaaucgcgggaggcgcugggccuggauggguccugcccuucaccgccggcggguuuauuuauguggccacaguuagcgugcucccggagcugcugagagaggcuuccccucuucagagccuccuggaaguccugggacuccugggcggggugaucaugaugguccuuauugcccaucuggaguga

SEQ ID NO: 75815 - RNA, 1383 nt, Artificial Sequence
  derived and/or modified sequence opt5 from SLC39A8__Homo_sapiens__NP_001128618
auggcccccggcagagcuguggccgggcugcuccugcuugcggcugccggacugggcggggucgccgagggaccuggccucgcuuucagcgaagacguucuguccguguuuggggccaaccuuucucugagcgcugcccagcuccaacaucugcuggagcagaugggagcggccucccgggugggcgucccggaacccggccagcuccacuucaaucagugccugaccgcugaggaaaucuuuucucuucacggguucagcaacgccacacaaauuacguccucuaaguuuagcgugaucuguccugcuguucugcagcagcucaauuuccaucccugcgaggaucgcccuaaacacaagaccagacccucccauagcgagguguggggauacggcuuucugucugucacaauuaucaaccuugccucccugcucgggcugauucugaccccucucaucaaaaagagcuauuucccgaaaauccugacauuuuucgugggacuugcgauuggcacccuguuuucuaaugccaucuuccagcucauucccgaggcuuuuggguucgacccuaagguugauuccuacguggaaaaggccgucgcuguguucggaggcuuuuaucugcuuuucuuuuucgaacggaugcugaaaaugcuccugaagacauacggccaaaacgggcacacccacuuuggaaaugacaacuucggcccccaggagaaaacgcaucagccuaaggcccugcccgccaucaauggggugaccuguuaugcuaacccggcggucacagaggccaauggacacauucauuuugauaacguuagcguggugucucuccaggacggcaaaaaggaaccuuccagcugcaccugucugaaggggcccaaacuuuccgagaucggaacaauugcuuggaugaucacccugugcgaugcccuccacaauuucaucgacggccuggccauuggcgcuucuuguacgcuuagccugcuccaagggcuguccacaagcaucgccauucugugcgaagaguuuccucacgaacucggagauuucgucauccugcuuaacgcgggcaugucuacccgccaggcucugcucuuuaauuuccuguccgccuguagcugcuacguggggcuggccuuuggcauucuuguuggaaacaacuucgcucccaauaucaucuucgcccucgcugggggcauguuucuguauauuucucuggccgacauguuccccgagaugaacgauaugcucagagagaaggugacaggacggaaaaccgacuuuaccuucuuuaugauccagaaugcgggcaugcugacaggguucacggccauucuucugaucacccucuacgcuggagaaauugagcuggaauga

SEQ ID NO: 75816 - RNA, 699 nt, Artificial Sequence
  derived and/or modified sequence opt5 from SLC39A9__Homo_sapiens__NP_001239079
auggacgauuucaucagcauuucccugcucucucuggccaugcuugugggcugcuacgucgcugggaucauuccccuggccguuaacuuuagcgaggaaagacucaagcuggugaccgugcuuggagcgggccugcucugugggacagcucuggccgucaucgugccugagggaguucacgcccuguaugaagacauucucgagggcaaacaucaccaggcuuccgaaacgcauaaugugaucgccucugauaaggcugccgagaaaagcgucgugcacgagcaugaacacucccacgaccauacccaacugcacgcguacaucgggguuucucuugugcugggauucgucuuuaugcuccugguggaucagauuggcaacagccaugugcacuccacagacgauccggaggccgcucggagcucuaauuccaagaucaccacaacccuuggccuggucguucacgccgcugccgacgggguggcgcucggagccgcugccagcacaucucagaccuccgugcagcugauugucuucguggcuaucaugcugcauaaagcccccgccgcuuuuggccucguuagcuuccugaugcacgcggggcuugaacgcaaccggauuagaaagcaucugcucguguuugcccuggcugccccugucaugucuauggugacguaucuuggacuguccaaggauuga

SEQ ID NO: 75817 - RNA, 2058 nt, Artificial Sequence
  derived and/or modified sequence opt5 from SLC3A1__Homo_sapiens__NP_000332
auggccgaggacaagagcaaaagagauuccaucgaaaugucuaugaagggcugccagaccaacaauggguucgugcacaacgaggacauucuggaacaaacacccgauccuggaagcuccacggacaaucucaaacauucuacccggggcauccuggggagccaggagccggauuuuaagggaguccagcccuacgcuggcaugccuaaagaaguucuuuuccaguuuuccgggcaagcccgcuaucgcauuccccgggagauccuguucuggcucacaguggcgucugugcugguccuuauugcugccaccaucgccaucauugcucugagcccuaagugucucgacugguggcaggagggacccauguaccagaucuauccucgcuccuuuaaggauagcaacaaagacggcaauggcgaucugaaggggauucaggacaaacuggauuacaucacagcccucaacauuaagaccguguggaucacaucuuucuauaaauccagccugaaggacuuuagauacggaguugaagauuuccgggagguggacccgauuuuuggcaccauggaagacuucgagaaucuugucgcugccauccacgauaaggggcugaaacucaucauugacuuuauccccaaccauacgucugauaagcacauuugguuccaacugucccgcaccagaacaggaaaauauaccgacuacuacaucuggcaugauugcacacacgagaauggcaagaccauuccucccaacaauuggcuuagcguguaugggaacucuuccuggcacuuugacgaaguucggaaucaguguuacuuccaucaguucaugaaagagcagccugaucugaacuuucgcaaucccgacgugcaagaagagaucaaggaaauccucagauucuggcugacgaaaggagucgauggcuuuagccuggacgcggugaaguuccuccuggaggccaagcaccuucgggaugagauucaggugaacaaaacacagaucccggacaccgucacacaauauuccgaacuguaccaugacuuuaccaccacacagguuggcaugcacgauauugugcgcucuuucagacagacgauggaccaguauagcaccgagccugggcgguaccgcuuuaugggaacagaggcuuaugccgaauccaucgauagaaccgugauguacuacggccuccccuucauucaagaagcugacuuuccuuucaacaauuaucugagcaugcuugauacagucucugggaacuccguguacgagguuaucaccagcuggauggagaauaugcccgaaggaaaguggcccaacuggaugaucggcgggccugacucuagccggcugacguccagacucggaaaucaguaugugaacgucaugaauaugcugcuguuuacacucccgggcacccccauuaccuacuauggcgaggaaaucgggaugggaaacauuguggccgcgaaucugaacgagucuuacgauaucaauacacuucgcagcaaauccccuaugcagugggacaacagcucuaaugccggcuucuccgaagcuagcaacaccuggcugcccacaaauucugauuaucacacgguuaacguggacguccagaagacccaaccucgguccgcccucaaacuguaccaggaucuuagccugcuccaugcuaacgagcugcugcucaauagagggugguuuugccaccugagaaacgacucccauuacguggucuauacacgggagcuugauggaauugacagaaucuucauugugguucugaauuucggcgaaucuacccuccugaaccugcacaauaugaucagcgggcuucccgccaagaugcgcauccggcucuccacaaacucugccgacaagggcagcaaaguggauaccuccggaauuuuucuggacaagggcgaggggcugaucuucgaacauaauacgaaaaaccuccugcacagacagaccgcuuuucgcgaucgguguuucgucagcaauagagcgugcuacucuuccgugcuuaacauucuguauacaagcuguuga

SEQ ID NO: 75818 - RNA, 1896 nt, Artificial Sequence
  derived and/or modified sequence opt5 from SLC3A2__Homo_sapiens__NP_001012680
auggagcugcagcccccugaagccagcaucgcuguggucuccauuccgagacaacuccccggcucucacagcgaggccgggguucagggacuguccgcgggcgacgauucugaaaccgggagcgacugcgugacacaggcuggacuucagcugcucgccuccucugauccucccgcccuggcuagcaagaacgccgaggugacggucgaaaccggcuuccaucacgugucccaagcugacaucgaguuucuuacaagcauugauccuaccgccucugcguccgggagcgccggaaucacaggcaccaugucucaggacacagagguugauaugaaagaaguggagcugaaugaacucgagcccgagaagcagccuaugaacgcugccuccggcgcugccaugagccuggcgggggccgagaaaaauggacuggucaagauuaaaguggcugaggacgaagccgaggcugccgccgcugcgaaguucaccggccucucuaaggaagaacugcuuaaaguugccggguccccgggaugggugcggacgcgcugggcucugcuccugcuuuucuggcugggcuggcucgggaugcuggccggagccgucgugaucaucgugagagcuccccggugucgcgagcugccugcccagaagugguggcauaccggcgcgcucuacagaauuggcgaucugcaggcuuuccaagggcacggagccggcaaccuugccgggcugaaaggacggcucgacuaucugagcucccuuaaggucaaaggccugguucucgggcccauccauaagaaucagaaggaugacguggcucagacagaucugcugcaaauugacccuaacuuuggaucuaaagaagacuucgauagccuccugcaguccgccaagaaaaagagcauccgcgugauucuugaccugacccccaauuacagaggcgagaacucuugguuuuccacacaggucgauaccguggcuacgaaaguuaaggacgcccucgaauuuuggcugcaagcgggcguggauggguuucagguccgggacaucgagaaucuuaaagaugccagcucuuuccuggcugaauggcagaacauuacaaagggauuuagcgaggaccgccuccugaucgccggcaccaauuccucugaucugcagcaaauccucagccugcuugaguccaacaaggaccugcuccugacaagcucuuaucuguccgauagcgggucuaccggagaacacaccaaaucccuugugacacaguaccucaaugcuacgggcaacagauggugcagcuggucccugucucaggcccggcugcucaccagcuuccugccggcgcagcuucugcgccucuaucaacugaugcuguuuacacuuccugggacccccguuuucuccuacggcgacgagauuggacucgacgccgcugcccugccuggccagcccauggaagcucccgugaugcugugggaugagucuagcuucccugacaucccgggggccgucuccgccaauaugacagugaagggacagagcgaagaucccggcucucuccugucccuuuuuagacggcugagcgaccagcgcucuaaagagagaucccuccugcacggggauuuccaugcuuuuagcgcgggaccuggccuguucucuuauauucggcacugggaccaaaacgagagauuucuugucgugcucaacuucggggauguuggccugagcgccggacugcaggcuuccgaccuccccgccagcgccucucugccugcuaaggccgaucuucugcucuccacccagcccggccgcgaagaggggagcccgcuggaacuggagcggcuuaaacucgagccucaugaaggacugcugcucagauuucccuacgcggcuuga

SEQ ID NO: 75819 - RNA, 1716 nt, Artificial Sequence
  derived and/or modified sequence opt5 from SLC40A1__Homo_sapiens__NP_055400
augaccagagccggcgaccacaaccggcagcgcgggugcuguggaagccuggcugauuaccucacauccgccaaguuccugcuuuaucugggccauucucucagcacguggggagacagaauguggcacuuugcgguguccgucuuccugguugagcuuuacggcaauucucugcuccugaccgcuguguaugggcugguggucgccgggagcgugcucguucugggagccaucauuggcgauuggguggacaaaaacgcucggcuuaaggucgcccaaacaucccuggugguucagaaugugucugucauccucugcggcauuauccugaugaugguguuucuucauaaacacgaacugcucaccauguaccaugggugggugcugacaagcuguuauauucugaucaucaccauugcuaacaucgccaaucucgcguccacagccaccgcuauuacgauccagcgcgauuggauugucguuguggccggagaggacagaagcaagcuggcuaacaugaaugccaccauccggcgcauugaucagcuuacaaacauccuggcgcccauggccgugggccaaaucaugaccuucgggucuccugucauuggaugcggcuuuaucuccggguggaaucucgugagcauguguguugaauacgugcugcuuuggaaagucuaucagaagacaccggcucuggccgugaaggcuggacucaaagaggaagagaccgagcugaagcagcugaaccuccacaaagacacggaacccaagccucuggagggcacacaccuuaugggcguuaaagauucuaauauucaugaacuggagcacgagcaggaaccuaccugcgccucccaaauggccgagcccuucagaacauuucgggacgggugggugagcuacuacaaccagcccgucuuccucgcuggaaugggccuggcguuucuuuauaugaccgugcugggguucgauuguaucaccacaggauacgccuauacgcagggccucucuggguccauucugagcauccugaugggagcuuccgccaucaccggcauuaugggcacagucgccuuuaccuggcuccgcagaaagugcgggcuggugcggacaggacuuaucucuggccuggcucagcucagcugucugauucugugcguuaucuccguguucaugccugggagcccgcuugaccucucugucucccccuuugaagauauucgcagcagauucauccaaggagagucuaucaccccuacgaagauucccgaaaucacaaccgagauuuacaugagcaauggcuccaacucugccaauaucgugccugagaccagccccgaauccguuccgauuaucagcgugucucugcuguucgcgggggucauugcugcccggaucggccucugguccuuugaccugacagugacccagcuucugcaggagaacgugaucgaaagcgagcgcggaauuaucaacggcguucaaaauucuaugaacuaucuccuggaccugcuucauuucauuauggucauccucgccccuaaucccgaggcuuuugggcugcuggugcucauuuccgugagcuucgucgccaugggacacaucauguacuuuagauucgcucagaacacacugggcaauaaacuuuuugccugugggccugaugcgaaggaagugcggaaagagaaccaggccaauacguccguuguguga

SEQ ID NO: 75820 - RNA, 1542 nt, Artificial Sequence
  derived and/or modified sequence opt5 from SLC41A1__Homo_sapiens__XP_005245126
augagcuccaagcccgagccuaaagacgugcaccagcugaacggcaccgggccgucugccagccccugcuccucugauggaccuggcagagaaccccucgcugggacaagcgaguuccugggaccugacggcgccggggucgaaguugugaucgagucccgggcgaaugcuaagggagugcgcgaagaggaugcccuucuggagaacggcucucaaagcaaugaauccgacgaugucagcacggacagaggccccgccccuccgucuccccucaaagagaccuccuuuagcauugggcuucaggugcuguucccuuuucugcucgcuggauucggcacaguugccgcugggauggugcuggauaucguccagcauugggaaguguuucagaagguuaccgagguguucauucugguccccgcccuccugggacuuaaaggcaaccuggagaugacacucgcgucucggcuguccaccgccgcuaauaucgggcacauggacacaccuaaggaacuuuggcgcaugauuaccggaaacauggcccugauccaagugcaggcuacgguggucggcuuucucgccagcaucgcggccguuguguucggcuggauucccgaugggcauuuuucuaucccgcacgcuuuccugcugugugccuccagcguggcuaccgccuuuauugccucccucguccugggaaugaucaugauuggcgugaucauugggucuagaaagaucggaaucaauccugacaacguugcuacacccauugcggccagccuuggcgaucugaucacccucgcucugcuuuccgggauuagcuggggacuguaccucgagcugaaucauuggcgguauaucuacccucuggugugcgccuucuuugucgcccuccugcccguguggguugugcuugcucgcagaucucccgccacacgggaaguccuguauuccggcugggagccugugauuaucgcgauggcuaucagcucugucggcgggcucauucuggacaaaaccgugagcgauccgaacuucgccggaauggccguuuucacgcccgugaucaauggcgucgggggaaaccuuguggcuguucaggccucccgcauuucuacauuucugcacaugaauggcaugccuggggaaaacagcgagcaggcucccagacgguguccuucccccugcaccacauucuuuagcccggacgugaacucucgcuccgccagaguccucuuccugcugguggugccuggccaccucguuuuucuguacaccaucagcuguaugcaaggaggccauaccacacuuacgcugauuuucaucaucuuuuauaugaccgcggcccuccugcagguccugauucuucucuacaucgcugacuggauggugcacuggaugugggggcggggacuggaucccgacaauuucucuauuccuuaucugacagcccucggcgaucugcuugggaccggacugcucgcucuguccuuucaugugcuguggcuuaucggcgaccgcgauacagacgucggggauuga

SEQ ID NO: 75821 - RNA, 1680 nt, Artificial Sequence
  derived and/or modified sequence opt5 from SLC43A1__Homo_sapiens__NP_001185739
auggcccccacccugcagcaggcuuacagacggcgcugguggauggccugcacagcggugcucgagaaccuguucuuuagcgcuguccuucugggcugggggucccuccugaucauucuuaagaaugaaggauucuauucuagcacguguccugccgaguccucuaccaacacaacccaagacgaacagagacgguggccgggcugcgaucagcaagacgagaugcugaaucucggguuuacaaucggauccuucguucugagcgccaccacacugccccucggcauucugauggaucgcuuugggccuagacccgugcggcuugugggaucugcuuguuucaccgccagcugcacgcugauggcucucgccucccgcgacgucgaagcgcugagcccucuuaucuuucuggcccucucucugaacggcuucggcgggauuugucugaccuuuacaucccucacccugcccaauauguucggaaaccuuagaagcacacugauggcucucaugaucggcucuuacgccuccagcgcuaucaccuuuccugggauuaaacugaucuaugaugccggaguggcguucguugugauuauguuuacguggucuggccuugccugccugaucuuccucaauuguacacugaacuggccgauugaggcuuuccccgccccugaggaagucaauuacaccaagaaaaucaagcuguccgggcucgcucuggaccacaaagugacaggagaucuguuuuauacccauguuaccacaaugggccagcggcuuagccagaaggcccccucccucgaggacggcucugaugccuucaugagcccucaggacgugcgcgggacguccgaaaaccugcccgagagaagcgucccgcuucggaagucucugugcuccccuaccuuucucuggagccugcugacaaugggaaugacccaacuccgcauuaucuucuacauggcugcggugaauaaaaugcuggaguaucuugugacaggcgggcaggaacacgagaccaacgaacagcagcaaaaggucgccgagacgguuggauuuuacucuagcguguucggcgcuaugcagcugcucugucugcugacaugcccccuuaucggguacauuauggauuggagaaucaaagacuguguggaugccccuacccagggaaccguccucggcgacgcccgggacggcguggcuacaaaguccauucgccccagauauugcaaaauccaaaagcugaccaaugccauuucugcguuuacacugacgaaccuccugcuuguuggguucggaauuaccugccugaucaauaaccuccaucugcaguuugugacauucguccugcacaccaucgugcggggcuuuuuccauagcgcuugugggucccuuuacgccgccguuuuucccagcaaccacuucggaacacucaccggccugcagucucugaucuccgcuguguucgcccuccugcagcaaccucuuuuuauggcuauggucgggccgcugaagggcgaacccuucugggugaaucucggacugcugcuuuuuagccuccugggcuuccugcucccuucuuaucuguuuuacuauagagcccgccuucagcaggaguacgcggccaacgggaugggaccccugaaaguccucuccggcagcgaggugacggcuuga

SEQ ID NO: 75822 - RNA, 1299 nt, Artificial Sequence
  derived and/or modified sequence opt5 from SLC43A2__Homo_sapiens__NP_001271428
augaccuacggcagcccccaggccaacgcuuccccuucugacgccguggcgcuggaucacggggaggucagcagacggcaacagcaggaacucccgaauauguucggagaccugcgcuccacauuuaucgcucuuaugauuggcucuuaugccagcuccgccguuacguuccccgggaucaagcugauuuacgaugcuggagugucuuuuaucgugguccucgugguuugggccggcugcagcgggcugguguuccuuaacugcuuuuucaauuggccucuggagcccuuuccuggacccgaagacauggauuauuccgucaaaauuaaguucagcuggcucggcuuugaccauaaaaucaccggcaagcaguucuacaaacaagugacaaccguugggagacggcugucugugggauccagcaugcgcucugcuaaggagcaggucgcccugcaggaaggccacaagcucugucuguccacaguggaucuugaggugaaaugucagccugacgcggccgucgcuccgagcuuuaugcauucuguuuucucccccauccugcuccugagccuugugaccaugugcgugacacaacugagacucaucuuuuauaugggggccaugaacaauauucugaaguuccuggucuccggagaucagaaaaccgugggccucuacacgucuauuuucgggguucugcagcuucugugucuccugaccgcuccugugaucggauauauuauggacuggcggcuuaaggagugcgaagaugccagcgaggaacccgaggagaaagacgcgaaccagggcgaaaagaagaaaaagaaacgcgauagacaaauccagaagauuacaaaugccaugcgggcuuuugccuucaccaaccugcuccuggucggcuuuggggugacaugucugaucccuaaucucccccugcagauccuuuccuucauucugcacaccaucguucgcggauuuauucauagcgcugugggcgggcucuacgccgccgucuacccgucuacgcaauucggaucccugacaggccuucagagccugaucucugcucucuuugcgcugcugcagcagccucucuuccuggccaugauggggccccuucaaggagacccucugugggugaacgucggccuccugcugcuuagccuccugggcuuuugccugccccucuaucugauuuguuacagacggcagcuugagcgccagcugcagcaaagacaggaagacgauaaacucuuccugaagaucaauggguccucuaaccaggaggcuuuuguguga

SEQ ID NO: 75823 - RNA, 1515 nt, Artificial Sequence
  derived and/or modified sequence opt5 from SLC43A3__Homo_sapiens__NP_001265135
auggccggccaggggcugccccuccacguggcuacccugcuuacaggacugcucgagugccugggcuucgccgggguccuuuuuggauggccuagccugguuuucguguuuaagaacgaagacuacuucaaagaucucuguggcccggacgcggggcccaucggaaaugcuacgggccaagccggcagacuggggugcaugggagaucuguuuuccaccccugacuguaaggcccaggaugagcgguucucucucauuuuuacacugggcagcuucaugaacaauuuuaugaccuuccccacaggguauaucuuugaccgcuucaaaaccacaguggcuagacuuauugccaucuuuuucuacaccacggcuacccugauuaucgccuucacauccgcgggaucugccguccuccuguuucuugcuaugccuaugcugaccaucggcgggauucucuuccugaucacaaaccugcagauuggaaaucucuuuggccagcaucggagcaccaucauuacgcuguauaacggcgccuucgauuccucuagcgcuguguuucuuaucauuaagcugcucuacgaaaaagggaucucccugcgcgccagcuucaucuuuauuucuguuugcuccacauggcacguggcgagaaccuuccuucugaugccccggggacauaucccuuauccgcugcccccuaauuacagcuauggccucugucccgggaacggaacaaccaaggaggaaaaggagaccgccgagcacgaaaaucgcgagcugcaaucuaaagaauuucucuccgcuaaggaggagacaccuggcgccgggcagaaacaggaacugcggagcuucuggucuuacgcuuuuuccagacgcuucgccuggcaucuugucuggcugagcgugauucagcucuggcacuaccuguuuaucggaacgcuuaacucccugcucaccaauauggccggcggcgacauggcuagaguuucuacauauaccaacgcguucgccuucacacaauuuggggugcugugcgcucccuggaauggacugcucauggaucggcugaagcagaaauaccagaaggaggcccgcaagaccggcagcuccacgcuugccgucgcucuguguagcacagugccgucucucgcccugaccucccugcuuugccucggguucgcgcugugugcuagcgugccuauucugccccuccaguaucugaccuuuauccuucaagucaucucucggagcuuccuguacggauccaacgccgccuuucucacacuggcuuucccuucugaacacuuuggcaaacuguucgggcuuguuauggcccucagcgcuguggugucccugcugcaguuucccauuuucacccucaucaagggcagccugcagaaugaccccuuuuaugucaacgugauguucaugcuugccauucugcucacauuuuuccauccuuuccugguuuacagagagugccgcacguggaaagaaucuccguccgcgaucgccuga

SEQ ID NO: 75824 - RNA, 1959 nt, Artificial Sequence
  derived and/or modified sequence opt5 from SLC44A1__Homo_sapiens__NP_001273659
augggcugcuguagcuccgccucuagcgcugcccaguccucuaagagagaguggaaaccccuggaagaccggagcugcaccgauaucccuuggcuccugcuuuucauucuguuuuguaucgggaugggauucauuugcggcuuuuccaucgcgacaggggcugccgcccgccucgugucuggauacgacagcuauggcaacauuugugggcaaaagaauacgaaacuggaggcuaucccgaacuccggaauggaucacacccagagaaaguacgucuucuuucuugaccccugcaaucuggaucucaucaaccggaaaauuaagagcguugcccuguguguggcugccugcccucgccaggaacugaagacacucucugacgugcagaaauucgcggagaucaauggcuccgcccuguguagcuauaaccuuaagcccucugaauacaccacauccccuaaaagcucuguccugugccccaagcucccugugccggcuuccgcccccauuccuuucuuccauagaugugcucccguuaauaucagcugcuaugccaaauuugcggaggcccugauuaccuucguguccgauaacucuguccuucaccggcugaucagcggcgugaugacauccaaggagauuauccucgggcugugccugcucagccugguucuuucuaugauccugauggugauuauccgcuacauuuccagaguccucguguggauccugaccauucuugugauccugggaagccucggcgggacgggaguccugugguggcuguaugcuaagcaacggcgcucuccuaaagaaaccguuacacccgagcagcuccagaucgccgaagacaaucugagagcucugcugauuuacgccaucagcgccaccguguuuacagugauucucuuccugaucaugcuugucaugcggaagcgcguggcucugaccauugcgcucuuucauguugccggcaaaguguucauccaccuuccgcugcucgucuuccagccuuuuuggacguucuuugcucuggugcuuuucuggguuuacuggaucaugacacugcucuuucuggggaccacaggaucccccgugcaaaacgagcagggcuucgucgaguuuaagauuucuggcccucugcaguauauguggugguaccauguggucgggcuuaucuggauuagcgaauuuauccucgccugucagcaaaugaccguggccggagcuguugugaccuauuacuuuacaagagauaaacggaaucugcccuucacgcccauucuggccuccgucaaccgccucaucagauaucaccugggcaccguggcgaaggggagcuuuauuaucacacuuguuaaaaucccucggaugauucugauguacauccacucucagcucaagggaaaggagaaugcuugcgccagaugugugcugaaauccugcauuuguugccuguggugucuugaaaagugccucaacuaucugaaucagaacgccuacaccgcuacagccaucaacagcaccaauuucuguacgucugcuaaagacgccuuugucauucugguggagaacgcgcuccgcguggccacaaucaauaccguuggcgauuucaugcuguuccuugggaagguccugaucgugugcuccaccggacucgcuggcauuaugcugcugaacuaccaacaggacuauacaguguggguccuuccgcucaucauugugugucuguuugccuuccugguugcucauugcuuucucagcaucuacgaaaugguggucgaugugcuguuccuuugcuuugccauugacaccaaauauaaugacggcucccccgggcgggaguucuacauggauaagguucugauggaguuuguggaaaacucuagaaaggcgaugaaagaggccggaaagggcggggucgcugacagccgcgaacucaaaccuaugaucaaguga

SEQ ID NO: 75825 - RNA, 2115 nt, Artificial Sequence
  derived and/or modified sequence opt5 from SLC44A2__Homo_sapiens__NP_001138528
auggaggacgaaagaaagaacggcgccuacgggacgccccagaaauaugauccuacauucaagggaccgaucuacaaucggggcugcacggacauuaucuguugcguguuucugcuccuggcuauugucggguauguugccgugggaaucauugcguggacccacggcgauccccgcaaagugaucuacccuacagacagcagaggggaguucuguggacaaaagggcaccaaaaacgaaaauaagcccuaucuguuuuacuucaacaucgucaagugcgcuuccccucuggugcuccuggaguuucagugucccacaccucagauuugcguugaaaaauguccggaucgguaucuuaccuaccugaaugcccgcucuagcagagacuucgaguacuauaagcaguuuugcgugcccggcuucaaaaacaauaagggggucgccgaggugcuccaagauggagacuguccugcuguucugauccccuccaaaccucuggcccggcgcugcuuucccgcuauucaugccuacaagggcgugcucauggucgggaacgaaacaaccuaugaggauggacacggcucuagaaagaauaucacggaccugguggaaggggcgaaaaaggccaacggagugcuugaggcucggcagcuggccaugcgcauuuucgaggauuacaccgucagcugguauuggaucauuaucggccucguuaucgcuauggccaugucccugcuuuuuauuauccugcucagauuccuggcgggcauuauggugugggugaugaucauuauggucauccuggugcucggguacggaaucuuucauuguuauauggaauacucucggcugcgcggcgaggccgggagcgacguuucccuuguggaucugggauuccagacagacuucagagucuaccuccaccuucggcagaccuggcuugcuuuuaugauuauccugagcauucucgaagugaucauuauccugcugcucaucuuccugcgcaaacgcauucuuaucgccauugcucugaucaaggaggccucucgggccguuggcuaugugaugugcucccuccuguacccgcuugucacauuuuuccugcucugccuguguauugcuuauugggcgagcaccgccguguuucugucuacguccaaugaagcugucuacaaaaucuucgacgauagcccuugccccuuuacagccaagaccuguaacccugagacauuccccucuuccaaugagagcagacaaugccccaacgcccgcugucaguuugcuuucuaugggggagaauccggcuaccaucgggcccuccugggccuucagauuuuuaaugcguucauguuuuucuggcuggcuaacuucgugcucgcccuggggcagguuacccuggccggagcuuuugccucuuauuacugggcucuuagaaaaccugacgaucucccggccuucccccuguuuagcgcguucggccgcgcccugcgguaccacaccgggucccucgcuuuuggagcccugauccuugcuaucgugcaaauuaucagagucauucuggaguaucucgaccagcgccugaaggccgcggaaaacaaguucgccaaaugccugaugacaugucuuaagugcuguuuuuggugccucgagaaauucaucaaguuucugaaucggaacgcuuacauuaugaucgccaucuauggcacgaauuucuguaccagcgcuagaaacgccuuuuuccugcucaugcgcaauauuauccggguggccguucuggauaaagugacagacuuucuuuuccugcucgggaagcugcugauugucggcucugugggaauccuugcuuucuuuuucuuuacccacagaauuagaaucgugcaggauacagcgccuccccucaacuacuauuggguuccuauccugaccgucauugugggcuccuaccugaucgcccauggguucuuuagcguguauggaaugugcgucgacacccucuuccugugcuuucuugaagaucuggagcggaaugacggcucugcugagagacccuacuucaugagcuccacacucaagaaacugcugaacaagaccaauaaaaaggccgccgaaucuuga

SEQ ID NO: 75826 - RNA, 2007 nt, Artificial Sequence
  derived and/or modified sequence opt5 from SLC44A4__Homo_sapiens__NP_001171515
augggcgggaagcagagagacgaggaugacgaagccuacggaaaacccgugaaguaugauccuagcuuccggggcccgaucaaaaaccgcuccugcaccgacgucauuuguugcguucuguuucuccuguucauccuuggguacauuguggugggaaucgucgcuuggcuguauggcgaucccagacaagugcucuacccucgcaauucuacaggggccuauuguggaaugggcgagaacaaggacaaacccuaccugcuuuauuuuaauauuuucagcugcauccuguccucuaacaucauuagcguugcggaaaauggccuccaguguccuacgccccagaccgugaucacaucccugcagcaagagcugugcccuucuuuucuccugccgagcgcucccgcccuugggcgguguuucccuuggaccaacgucacacccccugcccugcccggaauuaccaaugauacaaccauccagcagggcauuuccgggcucaucgacagccugaacgcuagagauauuucugugaagaucuuugaagacuucgcccaguccugguacuggauccuuguugcucugggaguggcccucguccugagccugcucuuuauucugcuucugcggcucguggcgggcccgcuggugcuuguccugauccucgggguucugggagugcuggccuacggcauuuauuacugcugggaggaguaucgcgugcucagagauaagggcgcuucuaucucccaacugggguucacgaccaaucuuagcgccuaccagucuguccaggaaacauggcuggcugcccucauugugcuggcgguucuugaggccauccugcuccugaugcugaucuuucuccggcagcgcauuagaaucgcuauugcccugcuuaaagaagccuccaaggccgugggacaaaugaugagcaccauguucuauccucuggucacauuugugcuccugcugaucuguauugccuacugggcuaugaccgcgcuuuaucucgccacguccggccagccccaguacguucugugggcuucuaacaucagcuccccugggugcgagaaagugcccaucaauacaagcuguaaccccaccgcccaccuggucaauucuuccugcccuggacucaugugcguguuccaaggcuacagcucuaaggggcugauucagcggagcgucuucaaccuucagaucuauggagugcugggccucuuuuggacacugaauuggguucuggcccuuggccagugugugcucgcuggggccuucgcguccuuuuacugggcuuuccauaaaccgcaagacauucccaccuuuccucugaucucugccuucauucgcacccugagauaucacacaggaagccucgccuuuggcgcucugauccuuacgcugguccagauugcccgggugauccucgaguacaucgaucauaagcugcgcgggguucagaaccccguggcuagaugcauuauguguugcuucaaguguugccuguggugucuugaaaaauuuaucaaguuccucaaccggaaugccuauauuaugaucgcgauuuacggcaaaaacuuuugcgucuccgccaagaaugcuuucaugcugcugaugagaaacaucgugcgcgugguuguccucgacaaagugaccgaccugcuucuguuuuucggaaagcuccugguggucgggggcgugggaguucugagcuucuuuuucuuuucuggccggaucccugggcuuggaaaagauuucaagagcccccaccucaauuauuacuggcugccgauuaugacauccauccugggcgccuacgugauugcuucuggguuuuucuccgucuuuggaauguguguggacacccucuuccugugcuuucuugaggaucuggaaagaaacaauggcagccucgaccgcccuuauuacauguccaagucucugcugaaaauccuugggaagaaaaacgaggcucccccugauaauaagaaacggaagaaguga

SEQ ID NO: 75827 - RNA, 2169 nt, Artificial Sequence
  derived and/or modified sequence opt5 from SLC44A5__Homo_sapiens__XP_011539285
augggccugcaggcccucagcgagaagcccgcugacaccccuuccgaagaggaagauuucggggacccgagaacauacgaucccgacuuuaaaggaccuguggccaaccggucuugcacggauguccuguguugcaugaucuuccuucuguguauuaucggcuauauuguucucgggcugguggcgugggugcacggagacccccgcagagcugccuacccuaccgauagccaaggccauuuuugcgggcagaagggaacacccaaugagaacaaaaccauccuuuucuauuuuaaucugcuccgguguacauccccuucuguccugcugaaccuccagugcccgaccacacagauuugugugagcaagugccccgaaaaauuccugaccuacguugagaugcaacuucuguauacgaaggacaaguccuacugggaggauuaucgccaguuuuguaaaaccacagccaagccugugaaaucucucacccagcugcuucuggacgaugacugccccacagcuaucuucccuagcaagcccuuucuccagagauguuucccggauuuuuccaccaaaaauggcacgcugacaaucggcagcaagaugauguuccaagacgggaacggaggcacccggucugucguggaacuggggauugccgcuaauggaaucaacaagcuccuggacgccaaaucccuuggccugaagguuuuugaggauuacgcgcgcacaugguacuggauucucaucgggcugaccauugccauggugcuuagcuggaucuuccugauucuccugagauucaucgcuggaugccuguuuugggucuucaugaucggcgugauuggcaucauuggguauggaaucuggcacugcuaccagcaguauaccaaucuccaggaacggccuucuuccgugcugacaauuuacgacaucggcauccaaacgaacauuagcauguauuuugagcuucagcagaccugguucacauuuaugaucauucuguguaucauugaggucaucguuauccucaugcugauuuuccuucgcaauagaauccggguggccauuauccugcucaaagaagggucuaaggcuauuggauacgugcccuccacccuggucuauccugcccugacauuuauccuccugagcauuugcaucuguuacugggugguuaccgcgguguuccuugccacguccggcguccccguguacaaaguuaucgcucccgggggacauugcauucacgagaaccaaacaugugauccugaaaucuuuaauaccaccgagauugccaaggcuugcccgggcgcccuguguaacuucgccuuuuauggcgggaaaucucucuaccaucaguauauccccacauuccacguguacaaucuguuugucuuccuguggcuuauuaacuucgugaucgcucucggacagugcgcgcuggccggcgcuuuugccaccuauuacugggccaugaagaagccugacgauaucccccgcuauccucuguucacagcuuuugggagagccauucgguaccacacgggaagccucgcguucggcucccugaucauugcucuuauccagauguuuaaaauuguccuggaauaccucgaccaucgccugaagagaacccaaaacacacugagcaaauuccuucaguguugccuccgguguugcuuuuggugccuggagaaugccaucaaguuccugaacagaaaugccuauaucaugauugcuaucuacgggcgcaacuuuugucggucugccaaagaugcuuucaaucuccugaugagaaacgugcuuaagguugccgugaccgacgaggucacauauuuugugcuguuccucggcaagcugcugguugcgggauccauuggcgugcuugccuuucucuucuucacccagcgccugcccgucaucgcucaggggccggccagccugaauuacuauugggugccucuccugacggugauuuuuggaucuuaccuuaucgcucacggcuucuuuagcguuuaugccaugugcgucgaaaccaucuucauuuguuuuugcgaggaucuggaacggaacgacggguccacagagaaacccuacuucgugaccccuaaucuccauggaauccugauuaagaaacaacuggugccccagaagcagaaagaauga

SEQ ID NO: 75828 - RNA, 1383 nt, Artificial Sequence
  derived and/or modified sequence opt5 from SLC45A2__Homo_sapiens__NP_001012527
augggcagcaacuccgggcaggccggaagacacaucuacaagucucuggcugacgauggccccuucgacagcguggagccuccgaaacggcccaccucccgccucauuaugcauucuauggccauguuugggagagaguucugcuaugcggucgaagcugccuacguuacaccugugcugcuuagcgugggacugcccuccucucucuauagcaucgucugguuucuguccccuauucuuggcuuccugcuccaacccgugguugggagcgccucugaucacugucggucccgcuggggaagacggcgcccuuacauccugacgcugggcgugaugaugcucgucggcauggcucuguaucuuaauggggccaccgugguugcugcccugauugcgaacccgagacggaagcucgugugggccaucagcgucacaaugaucggaguggugcuguuugacuucgcugccgauuuuauugacggccccaucaaggcuuaccuuuucgaugucugcucucaucaggacaaagaaaaagggcugcacuaucaugcccucuuuaccggauucggcggggcgcugggauaccugcucggcgccauugauugggcucaccuggagcuuggccgccugcucgggacagaauuucagguuauguucuuuuucuccgcccuggugcuuacccuguguuucacagugcaccucugcagcaucucugaggcuccucugaccgaggucgccaagggcauucccccucagcaaacgccccaggacccgccucuguccagcgauggaauguacgaauauggguccaucgagaaggugaaaaauggauacguuaaccccgaacucgccaugcagggcgcuaagaauaaaaaccaugcggagcagaccagacgggccaugacacugaagucucuucugcgcgcucucgugaauaugccuccccacuauagauaccuguguauuagccaucuuaucggguggaccgccuuucuguccaacaugcuguucuuuacagacuucaugggacaaaucgucuaucggggcgaucccuacagcgcccacaauucuaccgaguuucugauuuaugaacgcggcguggagguugggugcuggggauucuguaucaacuccguguuuagcucucuguacagcuacuuccagaaaguccucguguccuauauuggccugaaggggcuuuacuuuacgggauaucuccucuucggccuggggacaggcuuuaucggacuguucccuaaugucuacucuacccuugugcucugcagccuguuuggcguuauguccagcacacuguauaccgugccguucaaccucauuaccgaauaccacagagaggaagagaaggaggucuguugccauuga

SEQ ID NO: 75829 - RNA, 1662 nt, Artificial Sequence
  derived and/or modified sequence opt5 from SLC45A3__Homo_sapiens__NP_149093
auggugcagagacugugggucagccggcuccugcgccacagaaaggcccaacuucugcucguuaaccugcuuaccuucggccuggaggugugccucgcugccgggaucacauacgugcccccucugcugcucgaagucggaguggaggaaaaauuuaugacgaugguucugggcauugggccggugcuuggacuggucugugugccccuccugggcuccgcgucugaccauuggcgggggcgcuauggaagacggcgcccuuucaucugggcucuuagccugggcauucuccugucccuguuucucauccccagagccggcuggcuggccgggcuucugugcccugauccccggccucucgagcuggcccuucugauucucggaguuggccugcuggacuucuguggacaggugugcuuuaccccgcucgaagcucugcuuucugaucuguuccgcgaccccgaucacuguagacaggcuuacagcgucuaugccuuuaugaucucccucgggggcugccugggguaccuucugccugcgaucgacugggauacaucugcccucgcucccuaucugggaacccaggaggagugucuguucggccuccugacacuuauuuuucugaccugcguggccgcuacacuccugguggccgaagaggcggcccugggcccuaccgaacccgcugaggggcuuagcgccccgucccucagcccucauuguugccccugucgggcucgccuggccuucagaaaucugggagcccuccugccucggcuucaccaacugugcugccgcaugcccagaacgcuccggagacuguuugucgcugagcuguguucuuggauggcgcuuaugaccuucacacucuuuuacaccgacuucguuggcgaagggcuguaucagggagugccccgcgccgagccuggcacagaagcucggagacauuacgaugagggggugcgcaugggaucccugggccucuuccugcagugcgccaucagccuugucuuuucucuggugauggaccggcucguucagagauucggcacccgcgccguguaccuggcuuccgucgccgcguuuccgguggcugccggggccacgugucugagccacucuguugcuguggucacagccuccgcugcccuuaccggauucacauuuagcgcgcuccaaauucugcccuauacccuggccucccucuaccaccgggaaaaacagguguuccugccuaaguauagaggcgauaccgggggagcuucuagcgaggacucccuuaugacgagcuuucugcccggcccuaagcccggggccccguucccuaacggccaugucggagcuggcgggucuggacuccugcccccucccccugcccugugcggcgcguccgccugugaugugagcguucgcguggucgugggggagcccacagaagcucggguugugccgggaagaggcaucugccuugaccucgccauucuggacucugcuuuucugcucagccaggucgccccuucccuguucauggggucuaucgugcagcuuagccaauccgugaccgccuacaugguuagcgcugcgggccugggacucgucgccauuuauuuugcuacacaggugguguucgauaaaucugaccuggccaaguacuccgccuga

SEQ ID NO: 75830 - RNA, 2397 nt, Artificial Sequence
  derived and/or modified sequence opt5 from SLC45A4__Homo_sapiens__NP_001073900
augggcaaggccagccccgcuuccgggcugucuagaccuaaaacccucgugagcccgcugcgguccaaccaguggucucuucaaaagggacugcccgagcaguacuauagccucacaugguuccuguccccuauccuuggccugauuuuuacgccccucaucgggucugccagcgaccgcugcacccuguccuggggaagacggcgcccuuucauucuggcgcucugugucggcguucuguuugggguggcucuuuuccugaauggaagcgccaucggccucgcccugggcgaugugcccaacagacagccuauugggaucguccuuacagugcugggaguugugguccucgacuuuucugcugaugccaccgaaggcccgauccgggcuuaccugcuggacgugguugauuccgaggaacaggacauggcccucaauauucacgcguucagcgccgggcugggaggcgcuaucggguaugugcuuggaggccuggauuggacacaaaccuuucucggcucuugguuccgcacacagaaccagguccuguuuuucuuugccgcuauuaucuucaccguguccguggcccuucaucuguuuagcauugacgaggaacaguacucuccccaacaggagagauccgcggaggaaccuggggcccucgauggaggcgagccccacggggucccugcuuuccccgacgaaguucagagcgagcaugagcuggcccuggauuauccggacguggauaucaugcgguccaaaucugacagcgcucuccacgugccugacacggcccuggaucuugaacccgagcuccuguuccugcaugacauugaaccuuccaucuuucacgaugccagcuaccccgcuacaccccgcucuaccucccaggagcuugcgaagaccaaacugccuagacucgccacauuccugaaggaagcugccaaggaggacgagacccugcucgauaaucaccugaacgaagccaaagucccgaauggaagcggcucucccacgaaggacgcucuugggggauauacacggguggauaccaaaccuagcgccacauccucuagcaugcgcagacggcgccaugcguuuagacggcaagcuagcagcaccuucucuuacuacggcaagcugggcucccacugcuauagauaccgccgggccaacgccguugugcucaucaaacccagcagaucuauguccgaccuguaugauaugcagaagcgccagcggcaacauagacaccgcaaucagagcggggcuaccacauccucuggagacacggagagcgaagagggcgaaggggagaccacaguccggcugcuuuggcucuccaugcugaagaugccuagagagcugaugcgccucugucugugccaccuucugaccugguuuucugugauugccgaagcuguuuucuacacagauuuuaugggacaggugaucuucgagggcgaccccaaagccccgagcaacuccaccgcguggcaggccuauaaugcuggggucaagaugggcuguuggggacucgugauuuacgccgcuacgggcgccaucugcagcgcgcugcugcaaaaauaucuugacaacuacgaucucucuguccgggugauuuacguucuggggacacugggauuuuccgugggcaccgccgucauggcuauguucccuaauguguauguugccauggugaccaucagcacaauggggaucgucucuauguccauuagcuacugucccuaugcucuccugggacaguaccaugacaucaagcaguauauucaccauucuccuggcaacagcaaaagaggguuuggcaucgauugcgccauucuuuccugucagguguacaucagccaaauccugguggccucugcucucggaggcguugucgacgcgguggggaccgugcgcgucauucccaugguggccuccguuggauccuuccugggcuuucugacagcuacguuccuugugaucuauccuaaugucuccgaagaggccaaggaggaacagaaagggcucucuagcccccuggccggagagggccgggcugggggcaacuccgaaaagccgaccgugcugaagcucacaagaaaagagggacugcagggcccuguugaaaccgagcggcuucaggugcugacaucuguccgcagcagacacauuggguggugccgguccuguuggagaguguucuuuuucaugaucauucucgagaagaaauuuucuuucccccaaugcggaagccugcgccggaugaccuaccugcuuuuucucuccgaacuggauacgcugugccccggccagccuuguccgugggccgcgaccgcucaucagagcugggaggaagccgggcccggaggccucgggagacgccaguga

SEQ ID NO: 75831 - RNA, 1296 nt, Artificial Sequence
  derived and/or modified sequence opt5 from SLC46A1__Homo_sapiens__NP_001229295
auggagggcagcgccucucccccugaaaagccgagagcucggcccgccgcggcugugcugugccgcgggccugucgagccccucguuuuccuggccaacuuugcccuugugcugcagggaccucucaccacacaauaccuguggcacagauucucugcugaccuuggcuauaaugggacgcggcagcgcggaggcuguagcaacagauccgccgaucccaccaugcaggaaguggagacacugaccucucauuggacacucuacaugaaugucgggggauuucuggugggccuguucagcuccacccuccugggcgcuuggucugacagcguugggcggcgcccucuucuggugcucgccucccugggacuucugcuccaggcgcuggucagcguguuuguugugcaacugcagcuccacgucggcuauuucgugcuggggagaauccuuugcgcccugcucggagauuuuggcgggcugcuugcugccucuuucgcuuccguggccgacgucagcuccucccggagccgcacauuuagaauggcgcugcucgaagccucuauuggaguugcuggcaugcuggccucccugcucggcgggcauuggcugcgggcucagggauacgccaacccguucuggcuugcccuggcucuccugaucgcgaugacccuuuaugccgcuuuuuguuucggcgagacgcugaaagagcccaagagcacccgccucuuuacauucagacaccaucgguccauugugcagcuguacguggccccugcccccgaaaaaucucgcaagcaccuggcucucuauagccuggccaucuucgucgugauuaccguucacuuuggggcgcaagauauccuuacacuguacgagcucuccaccccucugugcugggacagcaaacugaucggauacggcucugcugcccagcaucuucccuaucucacgucccugcuggcccucaagcugcuucaguacugucuggcugaugccuggguggcugaaauugggcucgccuucaauauccugggaauggucguguuugcguucgccacaauuaccccgcugauguuuacaggcgcucuuuucagcgccguugcuugcgugaacucucucgccaugcugaccgcgagcggcaucuuuaauucccuguauccugccacccucaacuucaugaagggguuucccuuccugcuuggagcuggccugcuccugauuccugccguccugaucgggaugcuugagaaagcugacccccaccucgaguuucagcaauucccccagucuccuuga

SEQ ID NO: 75832 - RNA, 1428 nt, Artificial Sequence
  derived and/or modified sequence opt5 from SLC46A2__Homo_sapiens__NP_149040
augagccccgaggugaccugcccuagacggggccaucugccgcgcuuccaccccagaacaugggucgaaccuguuguggccuccucucagguggcugccagccucuacgacgcggggcugcuucuggucgugaaggcuuccuauggaacgggcgggucuagcaaccacuccgccucucccagcccucggggagcccucgaggaucaacagcagcgcgcuaucuccaauuuuuacauuaucuauaaccugguugugggccuuagcccccugcucucugccuacgggcugggauggcuguccgacagauaucaucggaaaauuagcaucuguaugucucuccugggcuuccuucugucccgccucggccugcuucugaagguccuccuggauuggccuguggaaguucuguacggggcugccgcgcucaauggacuguuuggcggguucagcgccuuuuggucuggagugauggcucuuggcucccuggggagcuccgagggaagacggucuguccgccucauucugaucgaccuuaugcugggccucgccggcuucugcgggagcauggcuuccggacaccuguuuaaacagauggccggccauagcgggcaaggacugauccucaccgcguguucuguguccugcgccagcuucgcucugcuuuauucucugcucgugcugaaggucccggaaagcguugccaaacccucccaggagcuuccugcuguggauacagugucuggcaccgucgggacauacagaacccuggaccccgaucagcucgaccagcaauacgccgugggacacccucccagcccgggcaaggccaagccucacaaaacaaccauugcucugcuguuuguuggcgcgaucauuuaugaucucgccguggucgggacgguggacguuaucccccuguucgugcuucgggagccucugggauggaaccagguccaggugggcuacgggauggcugccggauauaccauuuuuaucacauccuuccucggcguccugguguuuagccgcuguuucagagauaccacaaugauuaugaucgggaugguuucuuucggcuccggagcccugcuucucgcuuuugugaaggaaaccuacauguucuauaucgcccgggcggucaugcuguuugcucugauucccgugacgacaauccgcagcgccaugucuaaacucauuaagggcuccagcuacgggaaaguuuucgugauccugcagcuuucccuggcccucaccggagucgugacaucuacccuguauaauaagauuuaccaacugaccauggacauguuugugggcagcugcuucgcucuuuccucuuuucucagcuuccuggccaucauccccauuuccaucguugcuuacaagcaggucccucugagcccguauggggauauuaucgagaaauga

SEQ ID NO: 75833 - RNA, 1713 nt, Artificial Sequence
  derived and/or modified sequence opt5 from SLC47A1__Homo_sapiens__NP_060712
auggaggcccccgaagaaccugcuccggugagaggcgggcccgaagccacccuggagguccggggaagccgcugccucagacuguccgcguuccgggaggagcuucgcgcucugcucguucuggccggcccugccuuucuugugcagcugaugguguuccucaucucuuuuauuagcuccgucuucugugggcaccugggaaagcuggagcucgacgcugugacacuggccaucgcuguuauuaacgugacgggcgucucugugggguuuggacuuagcuccgccugcgauacccugaucucucaaacauacggcagccagaaucucaaacauguuggcgugauucugcagagauccgcgcuuguccugcuccuguguugcuuccccuguugggcccuguuucucaacacccagcacauccugcuucuguuccggcaagacccugaugugagccgccucacacagaccuaugugacaaucuuuauucccgcucugccugccaccuuccuuuacaugcugcaggucaaguaucuccugaaucaggggaucguucugccgcaaauugugacgggaguggcugccaaccucgucaaugcgcuggccaacuaccuuuuucugcaucagcuccaccugggcgugaucgggucugcucuugccaaucugauuucccaguauacccucgcucugcuccuguuccuguacauccuuggcaaaaagcugcaucaggccacauggggaggguggagccucgaaugccugcaagacugggccucuuuucugagacuugcuauucccuccaugcucaugcuguguauggaguggugggcguaugaaguuggcagcuuccugucuggaauccucggcaugguggagcugggggcccaguccaucgucuacgagcuugcuauuaucguguacaugguuccugccggauucagcguggccgcuuccguccgggugggcaacgcccugggggcgggagauauggaacaggcucgcaaaucuagcaccgucucccuccugauuacagugcuguuugccguugccuucagcgugcuucuccugucuugcaaggaccacgucggcuauaucuuuaccacggauagagacauuaucaaucugguggcucaaguugugcccaucuacgccgucucccaccucuucgaggcucuggccuguacaagcgggggagugcuucggggcucuggcaaccagaaggugggggcgauuguuaauaccaucggauauuacgucgugggccugccuauugggaucgcccucauguuugcuacaacccugggagugaugggccuguggagcgggauuaucaucugcaccgucuuccaggccguguguuuucuuggcuucauuauccagcucaacuggaaaaaggcuugccaacaggcccagguucaugcgaaucugaaagugaacaaugucccccgcuccggaaacucugcccugccgcaggauccucuccaccccggcugcccugaaaaccuggaggggauucuuacaaaugacgugggaaagacgggcgaaccccaaagcgaucagcagaugagacaggaggagccccugccugaacauccgcaagacggggcuaaacucucccggaagcagcugguucugcgcagaggacuucuccugcugggcguguuucucauccugcuugucgggauucuggugcgguucuauguuagaauccaguga

SEQ ID NO: 75834 - RNA, 441 nt, Artificial Sequence
  derived and/or modified sequence opt5 from SLC48A1__Homo_sapiens__NP_060312
auggcccccagcagacugcagcucggccugcgggcugccuacuccgggaucucuagcguggcgggauucuccauuuuucuugucuggaccguuguguaucgccaaccuggcacagcugccaugggagggcuggccggcgugcucgcucuguggguccuugugacgcacguuauguacaugcaggacuauuggagaaccuggcugaaggggcuccggggauucuuuuucgugggcguccuguuuucugccgugagcaucgcugccuucugcacauuucugguucucgcgauuacccgccaucagucccugacagauccgaccucuuacuaucuuagcuccguguggagcuucaucucuuuuaaaugggccuuccugcucucccuguacgcucacagauaucgggccgacuuugcugauauuagcauccuuucugacuucuga

SEQ ID NO: 75835 - RNA, 3357 nt, Artificial Sequence
  derived and/or modified sequence opt5 from SLC4A10__Homo_sapiens__NP_001171486
auggagaucaaggaccagggcgcccaaauggaaccccugcucccuaccagaaacgaugaggaagcuguggucgaccggggcggaacacgcagcauucugaaaacgcacuucgagaaggaagaucuugagggccauagaacccuguuuaucgggguucacgugccgcucggaggccggaaaucccaucgcagacaccggcaucgcgggcacaagcacagaaaacgggaccgcgagagagauucuggacuggaagacggccgggagagccccuccuucgauacaccuucucagcgcgugcaguuuauucuuggcaccgaagacgaugacgaggagcauaucccccacgaucuguucacagaacucgacgagauuugcuggagagaaggggaggaugccgaauggcgggagaccgcgcgcuggcugaaguuugaggaagacgucgaggacggaggcgaaagauggagcaagccuuacguggcuacacugucccuccauucucuguucgagcuucggagcuguauccugaaugggaccguucuccuggauaugcacgccaacacgcuugaagagaucgccgacauggugcuggaucagcaagucuccagcggacagcucaaugaggacgugagacaccgcguucaugaagcucugaugaaacagcaccaucaccagaaccaaaagaaacugaccaaucggauucccaucgugagaucuuuugccgauauuggcaagaaacaguccgagccuaacagcauggacaagaaugcugggcaggucgugucuccgcaguccgcccccgcgugcguggaaaacaagaaugaugucagccgcgagaacucuacaguugacuucuccaaaggacucggcggccaacagaaggggcauaccagcccuuguggaaugaaacagcggcacgaaaaggggcccccucaccaacaggagagagagguggaucugcauuuuaugaaaaagauucccccgggggccgaggcuuccaauauccuugugggagaacuggaguuccucgaccgcacagucguggccuuuguucggcugucuccugcugugcuucugcagggccucgccgaaguccccaucccuaccagauuccuguuuauucugcucgggccccugggaaaaggccagcaauaucacgagaucggccgcagcaucgcgacgcuuaugacagaugaaguguuccaugacguugccuacaaggcuaaggaccggaacgaucugguguccgggauugacgaguuccucgaucaggucaccgugcugcccccuggagaaugggacccgagcaucagaauugagcccccuaaaaauguccccucucaggaaaagcgcaaaaucccugccgugcccaacggcacagcugcccacggggaggccgagccgcacggaggccauuccgggccugaacuucagcggaccggcagaauuuuuggaggccugauccucgauaucaagcggaaagcucccuauuucuggagcgacuuucgcgaugcguucucucugcaaugccuggccagcuuucucuuccuguacugugcuugcauguccccuguuauuaccuuugggggacuucugggcgaggccacagaagggagaaucucugccauugagagccucuucggagcuuccaugacgggcaucgccuauagccuguuugggggccagccccugaccauucuuggaucuacaggcccugugcucgucuucgaaaagauccuguuuaaguucuguaaagaguacgggcuguccuaucucagccugcgggcgucuaucggacuuuggaccgcuacacugugcauuauccucguggccaccgacgccuccagccugguuuguuacauuacgagauuuacagaggaggcuuucgccucccugaucugcauuaucuucauuuacgaagcucuugaaaagcucuuugagcugucugaagccuaucccaucaauaugcacaacgaucuggagcuccugacccaguacagcuguaacugcguggagccgcauaauccuuccaacggcacccuuaaagaauggcgcgagucuaauaucagcgcguccgacauuaucugggaaaaccugacagucagcgagugcaagucucuccacggggaguaugugggacgggccuguggccaugaucaccccuacgugcccgacguucuguucugguccgucauucuguuuuucagcaccgugacacuuucugcuacgcucaaacaguuuaagaccuccagauauuucccuacaaaggugcgcagcaucgucucugauuuugccguguuccugaccauucugugcaugguucucaucgacuacgcuaucgggauuccgagccccaaacugcaagugccuuccgucuuuaagcccacaagagacgaucggggcugguucgugaccccucuuggacccaauccuugguggacgguuaucgccgcgauuauccccgcccugcucuguaccauucugaucuuuauggaccagcagaucacagcugugauuaucaaccgcaaagaacacaagcugaaaaagggcugcggguaucaucuugaucuccugauggucgccgugaugcugggaguuuguagcauuaugggccucccgugguucguggcugccaccguccugucuaucacacacgucaauucccuuaagcuggagagcgaaugcuccgccccuggggagcagcccaaauuucucggaauuagagaacaacgggugaccggccugaugaucuucauccugauggggucuagcguguucaugacguccauucuuaaguuuaucccuaugcccguucuguacggcguguuccucuacaugggagcuucuagccugaaaggcauucaguuuuucgaccgcaucaagcucuuuuggaugccggcgaaacaucagccugauuucauuuaucugagacacgugccccuucggaagguccaucuguuuacaaucauucaaauguccugucucgggcugcuguggaucaucaaagugucucgcgccgcuauuguuuucccuaugauggugcuugcccuggucuuugugagaaagcucauggaccuccuguucaccaagcgggagcugagcuggcuugaugaccugaugcccgaguccaaaaagaaaaagcucgaagaugccgagaaagaagaggaacagagcaugcuggcuauggaggacgagggaacaguucagcugccccuugaaggccacuaccgcgaugacccuucugugaucaacauuuccgaugagaugagcaagaccgcccuguggagaaaucuccugaucaccgcggacaacucuaaggacaaagaauccagcuuuccgucuaaguccagccccuccuga

SEQ ID NO: 75836 - RNA, 2628 nt, Artificial Sequence
  derived and/or modified sequence opt5 from SLC4A11__Homo_sapiens__NP_001167560
auggccgcugccaccagacggguguuccaucugcagcccugcgagaacagcccuacaaugucccaaaauggcuacuuugaagacucuagcuauuacaagugugauacggacgauaccuucgaggcgcgcgaagagauccucggggacgaggcuuuugauacagccaacuccucuauugucagcggagaguccaucagauucuuuguuaaugugaaccuggagaugcaggccaccaauacagaaaacgaggcuaccucuggcgggugcgugcuucugcacacaagccggaaauaucucaagcugaaaaauuucaaggaagagauucgcgcccacagagaccuugauggauuucuggcucaggccuccaucguccucaacgagaccgcgacgagccuggacaaugugcugcggaccaugcuccgcagauucgcccgggauccggacaacaaugaacccaacuguaaucuggaucuucugauggcuaugcucuuuacagacgccggcgcuccuaugcgcgggaaaguucaucugcuuucugauaccauucagggagugacagccaccgucacgggcgugagauaccaacaguccuggcugugcaucaucuguacaaugaaggcgcuccagaagcggcacguuugcauuagccgccuggugagaccccagaacuggggcgaaaauucuugugaaguccgguucgugauccuggugcucgccccucccaaaaugaaguccaccaaaacagcuauggaggucgcccgcaccuuugcuaccauguucagcgacauugccuuuagacaaaagcugcuugaaacacggacggaggaggaguucaaagaagcccugguucaucagagacagcuccugaccauggugucucacgggccuguggcuccgcgcacaaaggaacgguccaccgucagccuucccgcgcacagacauccugagcccccuaagugcaaagacuucgugcccuuuggaaagggcauccgcgaagauauugcccggagauucccgcuguauccucucgacuuuacagaugggaucauuggcaaaaacaaggcuguuggaaaauacaucaccacgacacuguuccuguauuuugccugucuccugcccaccaucgccuucgggucccuuaacgacgagaauaccgauggagcuauugacgugcagaagacaaucgccggccaaucuauuggcgggcugcucuacgcgcuguuuagcggacagccucuugucauccugcucaccacagcuccccuggcccuguacauucaggugauccgcguuaucugcgaugacuaugaucucgacuucaacuccuuuuacgccuggacgggccuguggaauagcuucuuucuugcucuguaugccuucuuuaaccucucucuggugaugucccuguucaaacggagcaccgaggaaauuaucgcucuuuucauuucuaucacauuuguccucgaugccgugaaggggaccgucaagauuuucuggaaauacuauuacggacacuaucuggacgacuaccauacaaagagaaccagcucccuggugucucucagcggccugggggcgucccuuaaugccagccugcacacggcucucaacgccucuuuucuggcuucccccaccgagcugccuagcgccacacacucuggacaagcgaccgccguucuuucccuccugaucaugcugggcacacucuggcugggcuacacccuuuaucaguucaaaaagagcccguaccugcaucccugugugcgcgaaauccucuccgauugcgcucugccuauugccguccuggcuuuuucucuuaucagcucccacggguuccgggagauugaaaugucuaaauuuagauauaaucccagcgaguccccuuucgccauggcccagauccagagccucucucugcgcgcuguguccggagcgaugggccugggguuucuccugagcaugcuuuucuuuauugagcaaaaccugguugccgcucucgugaaugcccccgaaaaccggcuggucaagggaacggccuaccauugggaccugcuucuccuggcuaucauuaauacaggccugucucucuucgggcugccguggauccacgccgcguauccucauagcccccuucacgugagagcucuggcccucguggaggaacggguugagaacggccacaucuacgauaccauugucaaugugaaggagacacgccugaccucccugggagccucugugcuugucggccugagccuccugcuccugccugugccccuucaguggaucccuaaacccguucuguaugggcucuuucuguacauugcucugaccucccuugacggaaaccagcuggugcagagagucgcccuccugcucaaggaacaaacagcguacccgccuacgcauuauauccggagagugccccagcgcaaaauucacuacuucaccggccugcagguucuucagcugcuccugcugugcgcuuucgggaugagcucucuucccuauaugaagaugaucuuuccucugaucaugauugccaugaucccgauucgguacauccuccugcccagaauuaucgaggccaaauaucucgaugugauggacgcugaacaucgcccuuga

SEQ ID NO: 75837 - RNA, 2391 nt, Artificial Sequence
  derived and/or modified sequence opt5 from SLC4A1AP__Homo_sapiens__NP_060628
augcuggcuccccucagaaacgccccuggccgggagggggccaccagcccgagcccucccacagacgcgacgggaucucugggcgaaugggaugucgaccgcaaugucaagaccgagggguggguuagcaaagaaagaaucuccaaacuucaccggcugcgcauggcugauauucucucucagagcgagacacuggccucccaagaccuuucuggagauuucaaaaagcccgcccugccugugagccccgcugccagauccaaagcuccugccuccucuuccagcaacccggaagaggugcagaaggagggccccaccgcgcuccaggacucuaauuccggggaaccugauauucccccuccccagccggacugcggagauuuucggagccugcaagaggaacagucucgcccucccacagccgucuccagcccuggcggccccgcuagagcucccccuuaccaggagccgcccuggggagggccugccaccgcccccuauucccuggagacacucaagggcgggaccauccugggaacgcggucucuuaaaggcaccagcuacugucuguucgggcgccucuccggaugcgacgugugucuggaacauccuagcguuucuagauaucacgcggugcuucagcaucgggccuccggccccgauggcgagugcgacagcaacgggccgggauuuuaccuguaugaucucggcucuacacacgggaccuuccugaauaagacacgcaucccucccagaaccuacugucggguccaugugggacacguugugcgcuuuggcgggagcacgagacuguucauucuccaaggaccugaagaggaccgggaagcugaguccgagcugacagucacccagcuuaaagaacugagaaagcagcagcaaauccuccuggagaaaaagaugcuuggcgaagacucugaugaggaagaggagauggacacaagcgaacgcaagaucaacgccggcucccaggaugacgagauggggugcaccuggggaaugggcgaagaugcuguggaggacgaugccgaagagaaucccauugugcuggaguuucagcaagaacgggaggccuucuauaucaaagacccuaagaaagcucuccagggguuuuucgauagagaaggagaggagcuggaauacgaguuugacgaacagggccacagcaccuggcugugucgcguccggcuccccguugaugacucuacagggaagcagcugguggcggaggccauucauuccggcaaaaagaaagaagcuaugauccaaugcagccuugaggccugucgcauucuggacacgcucggacugcuuagacaggaggccgugucucggaagagaaaggcuaaaaacugggaagaugaggacuucuacgauuccgacgaugacaccuuucuggaucgcacaggccucaucgaaaagaaacggcugaauagaaugaagaaagccgggaagauugacgagaagccggaaaccuucgagagccuggucgcgaaacucaacgaugcugagcgcgaacuguccgagaucucugaacggcuuaaggccagcucccaggugcugucugagagcccuucccaggacagccucgaugccuucaugucugaaaugaaauccggaagcacacuggacggcguuucuagaaagaaacugcaccuucggaccuuugagcuccgcaaggagcaacagagacugaaggggcugaucaaaauugugaagcccgcugaaauccccgagcucaaaaagacggaaacacagaccaccggagccgagaauaaagcuaagaagcugacacuuccucuguucggcgccaugaaagggggcuccaaguuuaaacucaagaccggaacagucggcaaacugccgcccaagcggccugagcugcccccuacgcuuaugagaaugaaagaugaacccgagguggaagaggaagaggaggaagaggaagaggaagagaaggagaaggaggaacaugaaaagaagaaacucgaggacgggagccugucucgcccucagcccgaaauugagccggaggcggccguucaagaaaugcggccucccaccgaccugacacacuucaaggagacccagacacacgaaaacaugagccagcucuccgaggaggaacagaauaaagauuaucaagacugcagcaagaccacgucucugugugcuggaccuuccgccagcaagaacgaguacgaaaaauccagaggcgagcuuaagaaaaagaaaacccccgggccgggaaagcugccucccacacucucuagcaaguauccugaagaugaccccgauuacugcgugugggugcccccugagggccaguccggggacggccgcacccaucugaaugauaaauauggauacuga

SEQ ID NO: 75838 - RNA, 2736 nt, Artificial Sequence
  derived and/or modified sequence opt5 from SLC4A1__Homo_sapiens__NP_000333
auggaggaacugcaggacgauuacgaggacaugauggaagagaaccucgaacaagaggaguaugaagaucccgacaucccugagagccagauggaggaaccggccgcucacgauaccgaggccacagcgacggacuaccauaccacaucccaccccggcacccauaagguguaugucgaacugcaggagcuuguuauggaugagaaaaaucaggaacugagauggauggaagcugcccggugggugcaacucgaggagaaccugggggaaaauggagccuggggccgcccucaccuuucucaucugacauucuggagccuccuggagcugagacggguguuuaccaaggggacaguccuccuggaccuucaggaaaccucccuggcuggaguggccaaccagcuccuggaucgcuucauuuuugaggaccagaucagaccccaagaucgggaggaacuucugcgcgcucuccugcugaaacacucucacgccggcgagcucgaagcgcugggaggaguuaagccugccgugcuuacgagaagcggcgaccccucccagccucugcucccgcagcauucuagccuggagacccagcuuuucugcgaacaaggcgaugggggaacagagggccacucccccagcgggauucuggagaaaaucccucccgacucugaagcuacccucguccuggugggacgggccgacuuucuggagcagccuguucucggcuucgugcgccugcaggaagcugccgagcuugaagcggucgagcugcccgugccgauuagauuucucuucgugcugcuugggccugaggcuccccauaucgauuacacacaacugggacgggcugccgcuacccucauguccgaacgcgucuuuagaaucgacgccuauauggcccagagccggggcgagcugcugcacucucucgaaggcuuccuggauuguucccuuguucugccucccacggacgcucccagcgagcaggcgcuccugucucuggugccugugcagcgcgaacuucucagacggagauaccaauccagcccggccaagcccgauuccucuuuuuauaaggggcuggaccugaauggaggcccugaugacccccuccagcagacagggcagcuguucggaggccuuguccgcgauauucggagacgcuacccuuacuaucugagcgacaucaccgaugcuuuuagcccccaagugcucgccgccguuauuuucaucuacuucgcugcccuguccccggcgauuacauuugggggacugcuuggcgagaaaacccggaaccagaugggcgugucugagcuccugaucuccaccgcuguccaggggauucuguucgcccuccugggagcccagccucuucuggugguuggcuuuagcgggccccuccugguguucgaagaggccuuuuucucuuuuugcgaaacaaauggacuggaguauaucgucggcagaguguggaucggguucuggcuuauucuccuggucgugcugguuguggccuuugaaggcagcuuccucguccgcuuuaucucccgguacacgcaagagauuuucucuuuucugaucagccuuauuuucaucuaugagaccuucuccaagcugaucaaaauuuuucaggaccacccucuccagaagacauacaacuauaaugugcugaugguucccaaaccucagggaccccugccgaacaccgcccuucucagccuggugcugauggcuggcacauucuuuuucgcgaugaugcucagaaaguuuaaaaauucuuccuacuucccugggaaacugcgccgggucaucggagacuuuggcgugcccauuagcauccuuauuauggugcugguugauuucuuuauccaagacaccuacacgcagaagcucucuguccccgauggguucaaaguguccaacagcuccgccagaggaugggugauccauccucugggccugcgcucugaauuuccgauuuggaugauguucgcuagcgcccuucccgcucugcucgucuuuauccugauuuuccucgagucccagaucacaacccugauugugucuaagccugaacggaaaaugguuaaggggagcggcuuccaccuugaccugcuccugguggucggaaugggcgggguggccgcgcuguuuggaaugcccuggcuuuccgccaccacaguuagaagcgugacccaugcuaaugcccugacagucaugggcaaggcuucuacgccuggggccgccgcucaaauccaggaggugaaggaacagcggauuuccggacuccugguugcggugcucgucggccugagcauccuuauggagcccauccugucucgcauuccucucgccgugcuguucgggaucuuucuguauaugggcgugaccucccuuagcgggauucagcuguucgauagaauccuccugcucuuuaagcccccgaaauaccacccugacguccccuauguuaagcgggugaaaacauggagaaugcaucuguucaccggcauucaaaucaucugucuugcugugcugugggucgugaagucuaccccugccagccuggcccuccccuuuguucugauucuuacagugccgcugcgccggguccuccugccucucaucuucagaaacguggagcugcagugccuugaugcugacgaugccaaagcgacguuugacgaagaggaagggcgcgaugaguacgacgagguugcuaugcccguguga

SEQ ID NO: 75839 - RNA, 3699 nt, Artificial Sequence
  derived and/or modified sequence opt5 from SLC4A2__Homo_sapiens__NP_001186622
auggacuuccugcucagaccccagccugagccggaaagccugggccccgggaccccuggauuucccgagcaagaagaggaugaacuucaccggacacugggcguggagcgcuucgaggaaauccuccaggaggccggguccagaggaggcgaggaaccugggcggucuuacggagaggaagacuuugaguaucaucgccagagcucccaccauauucaccauccccugucuacgcaccuuccuccggaugcuagacggcgcaagacaccccagggcccuggcagaaaaccccggcgcagaccuggggccagccccaccggagaaaccccgacaaucgaggaaggcgaggaggacgaagaugaggcguccgaagcugagggggcccgggcccugacccaaccuucucccgucagcacaccuuccagcguucaguucuuucuccaggaagacgauucugcugaccgcaaggccgagagaaccucccccagcucucccgcuccucugccgcaccaggaggccacgccccgggcguccaaaggagcccaagcuggcacccagguggaagaggccgaagcugaggccguggcggucgccagcgggacagcuggaggcgaugacggcggggccucuggacgcccucugcccaaggcucagccuggccauagauccuacaaccuccaggaacggagacgcauugggagcaugaccggagccgagcaagcccugcuuccccgggugccgacagaugagaucgaagcucagacccuggcgacggccgaccucgaucugaugaaaucccacagauucgaggacguuccuggcgugcgccggcaucuugucagaaagaaugcuaaggggucuacacagagcggacgcgaaggccgggagcccggcccuacccccagagcccgcccucgggcuccccacaaaccgcacgagguguuuguugaacugaacgagcuccugcuggacaagaaucaagaaccucaguggagagagacagcccgcuggauuaaauucgaagaggauguggaggaagagaccgaacggugggggaagccccaugucgccucccucagcuuuagaucucugcuugagcugcggcgcacccucgcgcacggagcugugcugcuugaccuggaucagcagacacuccccggcguggcccaucaagucguugaacagauggugaucuccgaccagaucaaagccgaggauagagcuaacgugcugcgggcccugcuccugaagcacagccauccuucugacgagaaggauuucagcuuuccgagaaauauuuccgcugggucucuuggaagccugcucggccaccaccaugggcagggcgccgaauccgacccccacgucacggagccucugaugggaggcgugcccgaaacccgccuugagguugaacgggagagagagcugccucccccugcgcccccggccgggaucacacgcagcaaaucuaagcaugaacucaaacugcuggagaagauuccugaaaacgcugaggccaccgugguccucgugggaugcguugaguuccuguccagacccacaauggcuuuugugcggcuucgcgaagccgucgagcuggaugcggugcucgaagucccugugcccguuagauuccuguuccugcuucucggcccgagcucugccaauauggacuaucacgagaucgggcgguccauuagcacccugauguccgauaaacaauuucacgaagcugccuaccuggcugacgagcgcgaggaccuccugacggccaucaacgccuuccuugauuguucugugguccugccucccagcgaagugcagggagaggaacuccugagauccguugcucauuuucagcggcagaugcugaagaaacgcgaggaacaaggcagacuucucccuacaggggcgggccuggagcccaagucugcccaggacaaggcucugcuccagaugguggaggccgccggagcugccgaagaugacccccugcggcgcaccggcagaccuuucgggggacuuauucgggaugucagacgccgguauccgcacuaccugagcgacuuuagagaugcgcucgacccccagugccuggcugccgugaucuucaucuauuuugccgcucuguccccugccauuaccuucggcgggcuucucggagagaaaacacaagaucugaucggcgugagcgaacugauuaugucuaccgcgcuccaggggguugucuuuugucugcuuggcgcucagccccugcucgugaucggauucuccggcccucugcugguguuugaggaagccuucuuuagcuucuguucuuccaaucaucuugaguaccucgucgggcgcguguggauuggauucuggcugguuuuucuggcccuccugaugguggcucuugagggcagcuuccugguccgguuugugucuagauucacacaagaaaucuuugccuuccucaucagccugauuuuuaucuacgagacguucuauaagcugguuaaaauuuuucaggaacacccccuucaugggugcuccgcuagcaacucuuccgagguggacggaggcgagaauaugaccugggccggggcgcgcccuacacugggcccgggaaaccggagccucgccggccaguccgggcagggaaagcccagaggccaaccuaauaccgcucugcucucucugguccuuauggccgggacauucuuuaucgcuuucuuucugcgcaaauucaagaacagccgguucuuucccggacggauuagacgcgugaucggcgauuucggcguuccuaucgccauucucaucauggugcuggucgacuacuccauugaagauaccuauacgcagaagcugucugugcccagcggguuuuccgugaccgccccggagaaaagaggaugggucaucaauccucuuggcgaaaagucucccuuccccguuuggaugaugguggcuagccugcucccugcgauucugguguuuauccucauuuucauggagacacagaucaccacacugaucauuuccaaaaaggaacggaugcuucagaaagggagcggauuucaccuggaccuccugcugaucgucgccaugggcgggauuugcgcucuuuucggacugcccuggcucgccgccgcuaccgugcgcucuguuacgcacgccaacgcgcugacagugauguccaaggcugucgccccuggcgacaagccgaaaauccaagaggugaaggagcagagaguuaccggccuccugguggcccuucuggucgggcugagcauugugaucggagaucuccugcggcagaucccccuugcuguucuguuuggcauuuuccucuacaugggggugacaucucugaacggaauccaguuuuaugaaagacuccaucugcuucugaugccucccaaacaccauccugacgucaccuacgugaagaaagugcgcacccugcggaugcaccucuucacagcccugcaacuucugugucucgcgcugcucugggcugucauguccacggccgccagccuggcuuuccccuuuauucuuauccugaccguuccgcugagaaugguggugcucacacgcauuuucaccgaucgggagaugaagugccuggacgccaaugaagcugagccugucuuugaugaaagagagggcguggacgaguauaacgaaaugcccaugccuguuuga

SEQ ID NO: 75840 - RNA, 3699 nt, Artificial Sequence
  derived and/or modified sequence opt5 from SLC4A3__Homo_sapiens__NP_005061
auggccaacggcgugauucccccucccgggggagcuagcccccugccucaggucagaguuccccucgaggaaccuccccuguccccugacguggaggaagaggaugacgaucuuggcaagacccuggccgugucucgguucggggaccucaucagcaaaccgcccgcgugggauccugaaaagcccucccgcucuuacagcgagagagacuuugaguuccaccggcauacaucccaccauacgcaccauccucugucugcucgccuucccccgccucacaaacugagacggcugcccccuaccagcgcccgccacacaagacggaagcgcaaaaaggaaaagaccuccgccccgcccagcgagggaacaccuccgauccaagaagagggcggggcuggagucgaugaggaagaggaagaggaagaggaggaagagggcgaaucugaggccgaacccguggagccucccccuuccggcacaccccagaaagcuaaguuuagcauugggucugacgaggaugacuccccgggacugccuggcagagccgcgguuaccaaaccccugccuagcguggggccccauaccgauaagucuccucagcacuccagcuccucucccagcccgcgggcccgcgcuuccagacucgccggagaaaaaucccggccuuggucucccuccgcuagcuaugaccugcgcgagagacuuugccccggcucugcccuggggaauccuggaggcccggaacagcaaguccccacggaugaggcggaagcccagaugcucggcagcgcugaccuggacgauaugaagucccaucggcuugaggacaacccuggggugagacgccaccugguuaagaaacccucucggacccagggaggcagagggagcccuuccggacucgcccccauccugcgccggaagaaaaagaaaaagaaacuggauagacgcccucacgagguguucgucgaacucaaugagcugaugcuugaccggagccaggaaccccauuggagagagacagcucgcuggauuaaguuugaggaagauguggaggaagagaccgaacgguggggcaagccgcacguggccucucuguccuucagaagccuccuggagcuucgccggacaaucgcccauggggcugcgcugcucgaccuggagcaaaccacgcugccuggaaucgcccaccucgucguugaaacaaugauugugucugaucagaucagacccgaggaccgggcuuccgugcugcgcacccuucugcucaaacauagccacccuaacgaugacaaggauuccggcuuuuuccccagaaauccgucuagcuccucuaugaacagcguccugggcaaucaccauccuacacccucccacgggccugacggagccgugcccaccauggccgacgaucuuggcgaacccgcuccucuguggccgcaugaccccgaugccaaagagaagccucuccacaugcccgggggagacggccaccgggggaaaagccugaagcugcucgaaaagauuccugaggaugcggaggcuaccguugugcuggucggcugugugcccuuucuugaacagccugccgccgcuuucguuagacugaacgaggccgugcuccuggaaucuguccuggaggugccgguccccgugcgcuuucuuuucguuaugcucggaccuucccauacaagcacggacuaccacgaacugggccggucuaucgcuacccugauguccgauaaacucuuucaugaggccgcguaucaggccgacgauagacaagaccugcuuagcgcuauuucugaguuccuggaugggagcaucgugauucccccuuccgaagucgagggacgcgaccuccugagaagcguggccgcuuuccagcgggaacugcuucgcaagagacgggagcgcgagcagacaaaaguugaaaugaccacaagaggcggguacaccgcccccggaaaggagcucucucuggaacugggcggguccgaggcgacgccggaagaugacccucuccugcggacaggcagcguguuuggaggccuuguccgcgacgugagacggcgcuauccccacuaccccuccgaucugagagacgcccuccauucucaaugcguggcugccguucuguucaucuauuuugcugcccugagcccugccaucaccuucgggggacuucucggcgagaaaaccgaggggcugaugggagucuccgaacugauugugucuacagcugugcucggcguccuguuuagccuucugggggcgcagccccuccuggugguuggcuucuccggaccucugcuuguguuugaggaagccuucuuuaaguucugucgggcucaggaucucgaguaccugaccggcagagucuggguggggcuguggcucguuguguuuguccuggcccuuguggccgcugaaggaucuuuccugguucgcuacaucagcccguuuacacaggagauuuucgccuuccucaucucccugauuuuuaucuaugagacguucuacaagcuguauaaaguguuuaccgaacacccccuucugccuuucuaucccccugagggcgcgcucgaagggagccuggacgcuggacucgagcccaauggcucugcccugccgccuacagaagggcccccuagcccccggaaccaaccuaauaccgcccuucugagccucauccugaugcugggcacauuuuucauugccuuuuuccuuagaaaguuucgcaacucucgguuccugggaggcaaagcuagacgcaucauuggggauuuuggaauccccauuuccauccucgucauggugcugguggacuacagcaucaccgauacguacacccagaagcucacagucccgaccggccugucuguuacauccccugacaaacggagcugguucauuccuccccuuggguccgcgagacccuuuccgcccuggaugaugguggcugccgccgugccugcucugcucguccugauccugauuuucauggagacccagaucacggcccuuauugugagccagaaggcucgccggcugcucaagggaucuggcuuccaccuggaucuccugcuuaucggcagccucgggggacugugcggccucuuugggcugcccuggcuuacagccgcgaccguuagauccgugacacaugucaaugcccugaccgugaugcggaccgcuauugccccuggagacaaaccccaaauccaggagguucgcgaacagagagugacaggcguccucaucgcuucucugguggggcucagcauuguuaugggagccgugcugcggcgcaucccucuugccguccuguucggcauuuuucuguauaugggcgugacgucccucucugggauccagcugagccaaagacuucugcucauucugaugccggcuaagcaccaucccgagcagccuuacgugaccaaagucaagacauggcggaugcaccucuucaccuguauccagcugggaugcaucgcgcuucuguggguugugaaauccacagccgcuucucuggccuuucccuuccuccugcuucugaccgugccucucagacauugucugcucccccgccuguuucaggaucgggaacuucaagcccuggacagcgaggaugcugagccgaacuucgacgaagacggccaggaugaguacaaugaacugcacaugccugucuga

SEQ ID NO: 75841 - RNA, 3240 nt, Artificial Sequence
  derived and/or modified sequence opt5 from SLC4A4__Homo_sapiens__NP_001091954
auggaggacgaagccgugcuggauagaggcgcuagcuuccucaagcacgucugcgacgaggaagagguugaagggcaucacaccaucuacauuggagugcaugugcccaaauccuaucggcgcagacggcgccacaagagaaaaacaggccauaaggagaaaaaggagaaggaacggaucucugagaacuacagcgauaaauccgacauugaaaaugccgaugagucuagcuccucuauccugaagccucuuauuagcccggcggcugagcgcaucagauuuauccugggggaagaggacgauucccccgccccuccccagcucuuuacggaacuggacgagcuucuggccgucgauggacaagaaauggaguggaaagagaccgcucgguggauuaaguuugaagagaaaguggaacagggcggggagcgcuggagcaagccucacguugccacacucucucugcacucccuguucgaacucagaaccuguauggagaagggaagcaucaugcuggaccgggaggcuucuucccuuccccagcugguggaaaugauugucgaucaucagaucgagacaggccuccugaaaccugaacuuaaggacaaagugaccuauacacugcuccgcaagcacagacaucaaaccaaaaagagcaaccugcggucucuggccgauauuggcaaaacgguuuccagcgcgucccgcauguuuaccaauccggacaacgggucucccgccaugacacacagaaaucucaccagcuccagccugaacgacaucucugauaagccugagaaggaccagcuuaaaaauaaguucaugaaaaagcugccccgggaugcugaagccuccaacgugcucgucggagagguggacuuucuggauacaccuuucauugcuuuugugagacuucagcaggccgucaugcugggcgcgcucaccgagguucccgugccgacgcgcuuccuguuuauccugcucgggccuaaaggaaaggccaagagcuaccacgaaaucggccgggcuauugccacacugaugucugacgagguguuccaugauaucgcuuauaaagccaaggacagacacgaucuuauugccgggaucgacgaauuucuggaugaggucauugugcuucccccuggagagugggaccccgcuauccgcaucgaacccccuaaaagccugccguccucugacaagcggaaaaauauguacagcggcggcgagaacguucaaaugaauggggauacaccccaugacggaggccacgggggaggcgggcauggagauugcgaagaacuucagagaaccggccgcuucuguggcgggcugauuaaggacaucaagcggaaagcgccuuucuuugccuccgauuucuaugacgcucucaacauucaggcccugagcgccauccuguuuauuuaccucgcuaccgugaccaaugccaucacauucggaggccugcuuggggaugcgacggacaacaugcagggaguccuggaaucuuuucucggcaccgcuguguccggggccaucuucugccuguuugccggccaaccccugacaauucuuagcucuaccggaccuguucucguguucgagagacugcuguuuaauuucuccaaggauaacaacuuugacuaccucgaguuccgccuguggaucggccuuuggagcgcuuuucugugucucauucuggucgccacagaugcuuccuuccuggugcaguauuucacccgguuuacggaagagggguucucuagccuuaucuccuuuauuuucaucuacgacgccuuuaaaaagaugauuaaacucgcggauuauuaccccaucaauucuaacuucaaggucggauauaauacacuguuuagcugcaccugugugccgccugaccccgccaacaucuccauuagcaaugacaccacacuggcuccugaauaccuccccaccaugucuuccacagauauguaucacaacacgaccuucgacugggccuuucugagcaagaaagagugcucuaaguacggcgggaaucuuguuggaaacaauuguaacuucgugccugauaucacacugauguccuuuauucucuuccugggcaccuacacaagcucuauggcucugaaaaaguuuaaaaccagccccuauuucccgacgaccgccagaaagcucaucuccgacuucgcgauuauccucagcauccugauuuucugcgucaucgaugcccugguggggguugacacaccuaaacucauugugcccucugaguucaagcccaccuccccuaaucgcggcugguuugucccgcccuucggagagaacccuuggugggugugucuggcugccgcuauccccgcccuucuggugacaauucucaucuuuauggaucagcaaaucaccgccguuauugucaaucggaaggagcacaaacugaagaaaggcgcuggguaccaucuggaccuuuucuggguggcgauccucauggugauuugcagccugauggcccugccuugguaugucgcugccacggugaucuccauugcccacaucgauucucucaagauggaaacagagaccagcgcucccggagaacagccuaaauuucugggcguuagagagcagcgggugacagggacccuugucuucauccugaccggacucuccguguuuauggcccccauucugaaguucaucccgaugccuguucuguacggcguguuucuuuauaugggggucgcgucucugaacggcgugcaguucauggaccgccucaagcugcuccugaugccccuuaaacaucaaccugauuucauuuaccugagacacguuccccuccggagagugcaccuguuuacauuccugcagguccuuugccuggcucuccuguggauccucaagagcacgguggccgccauuaucuuuccggugaugauucuggcucuugucgccguucgcaaaggaauggacuaucuguucucccagcaugaucucucuuuucuggacgacgugaucccugaaaaggauaaaaagaagaaagaggacgagaagaaaaagaaaaagaagaaaggcagccuggauuccgacaaugaugacagcgauugucccuacucugaaaaggugccuuccaucaaaauucccauggacaucauggagcagcaacccuuccuuagcgauucuaagccuuccgaccgggaaagaagcccgaccuuucuggagcgccacacaucuugcuga

SEQ ID NO: 75842 - RNA, 3414 nt, Artificial Sequence
  derived and/or modified sequence opt5 from SLC4A5__Homo_sapiens__NP_067019
augaaggugaaagaggaaaaggccggcgucgggaaacuggaccacaccaaccauagacggcgcuuccccgaucagaaggagugcccuccgauccacauuggacuccccguuccuacauacccccaaagaaaaacggaccagaagggccaucugagcgggcuucagaaggugcacuggggacugcggccugaucagccccaacaggaacucaccggcccuggguccggagcuucuagccaggacuccucuauggaucugaucagccgcacaagauccccggccgcggagcagcuucaagacauucugggcgaagaggaugaggcucccaauccuacccucuuuacagaaauggacacccugcagcaugauggcgaccagauggaguggaaagaaucugcccgguggaucaaguucgaggagaaaguggaagaagggggagaacgcuggagcaagccccacgucuccacacugagccuccacucucuguuugagcuuagaaccugucugcagacgggcaccgugcuccuggaucuugacuccgggagccugccucaaauuaucgaugacguuaucgaaaaacagauugaggacggacuccugcggcccgagcugcgcgaaagagugucuuauguccuccugcggcgccauagacaccagacaaagaagccgauccaucggucccuugccgauauuggcaaaagcgugucuaccacaaaccgcuccccugcuagaagccccggggccggaccuucccugcaccacucuaccgaggaccuccggaugagacaaagcgcuaauuacggccgccugugccaugcccagucccggagcaugaacgauaucucucuuacgcccaauacagaccagagaaagaacaaauucaugaagaaaauucccaaggauuccgaagcgagcaauguucuggugggcgaggucgacuuucucgaucagccuuucaucgccuuugugcgccugauucaaucugcuaugcucgggggagugaccgaagucccgguucccacacgguuccuguuuauccugcuuggcccuagcgggagagccaaauccuauaacgagaucggacgcgcuauugccacccugaugguggacgaucucuucucugacguggcguacaaggcccggaauagagaggaucugaucgcuggcauugacgaauuucuugacgaggucaucgugcugcccccuggggaaugggaucccaacauucgcaucgagccgccuaagaaaguucccagcgccgacaagcggaaauccguguucagccucgcugaacugggacagaugaauggcucugucggcgggggaggcggggccccuggaggcgggaacggcggaggcgggggaggcggguccggaggcggggccggcagcggaggcgcugggggaaccucuuccggcgaugacggggagaugcccgcgaugcacgagaucggagaggagcugauuuggacaggcagauuuuucgggggccucugucuggauaucaagcgcaaacuuccuugguuccccagcgacuuuuaugauggauuccauauucaguccaucucugccauucuguuuaucuaccucggcugcaucacgaaugcuauuaccuucgggggacugcugggcgacgccacagauaacuaucagggggugauggagagcuuucuuggaaccgccauggcuggcucccucuucugucuguuuucugggcaaccgcugaucauucucagcuccacaggcccuauccugauuuucgaaaaacuucuguuugacuucagcaagggaaauggccucgauuacauggaguuucggcuguggaucgggcugcacucugccguucagugccuuauucucguggcgaccgacgcuuccuucaucaucaaauacauuacgagauuuacagaagagggauucagcacccugaucucuuucauuuuuaucuaugaugccauuaagaaaaugaucggcgccuucaaguacuaucccaucaacauggacuuuaaacccaacuucauuaccacauacaagugugaaugcgucgcuccugacaccgugaauacaacggucuuuaacgccuccgcuccgcuggcccccgauaccaaugcgagccucuauaaccugcuuaaucugacagcccucgacuggucucugcugagcaagaaagagugucuuuccuacgggggacggcuccugggcaacagcugcaaguucaucccugaucuggcucucaugucuuuuauucuguucuuuggcaccuauuccaugacacuuacccugaaaaaguucaaauuuagccgcuacuuccccacgaaggugagagcccucguugcugacuuuuccaucguguucucuauucugauguucugugggaucgaugccugcuuuggacuggaaaccccuaaacuucauguccccagcgugaucaaaccuacacggcccgacagaggcugguucguugcgccguuugggaagaauccuugguggguguaccccgccuccauucucccugcucugcuggucaccauccucauuuucauggaucagcagaucacagccgugauugugaaccgcaaagagaauaagcugaaaaaggcugccggauaucaccuugaccuguuuuggguuggcauccucauggcccugugcucuuucauggggcugcccugguacgucgcugcgaccgugaucagcauugcccacaucgauucccuuaaaauggagacggaaacaucugcuccgggagagcaaccucaguuucugggcgugcgggaacagagagucaccggcauuaucguguucauucucacagggaucagcguuuuucuggcccccauucucaaguguaucccucugcccgugcuuuauggagucuuccuguacaugggcguggccucccucaacgggauccagaugggaaccggcgggagcgaguuuaagauucaaaagaagcugacccccuucugggaacgcugcaaacuguuccuuaugccugcuaagcaucagccggaccacgccuuucugagacauguuccccuccggcgcauccaccuguucacacucgugcagauucugugucuugcgguccuguggauccucaaaucuacgguggcugccauuaucuuuccuguuaugauccugggacugauuaucgugagacggcuucuggauuucauuuucucccaacacgaccucgccuggaucgauaauauucugcccgagaaggagaagaaagaaaccgacaagaaacgcaagagaaagaagggcgcucaugaggacugcgaugaggaaccucaguuucccccuccgagcgucaucaagauccccauggaaucugugcaguccgacccucagaacggcauucacuguaucgcccggaaacgcucuagcuccuggagcuauucccucuga

SEQ ID NO: 75843 - RNA, 3396 nt, Artificial Sequence
  derived and/or modified sequence opt5 from SLC4A7__Homo_sapiens__NP_001245308
auggaggccgacggcgcuggggaacagaugagaccccugcucacccggggaccugaugaggaagccguggucgaccugggcaagacaagcuccacgguuaacaccaaauucgagaaggaagaacuugagucucaccgcgcgguguacaucggggugcaugucccguuuagcaaagaauccagacggcgccacagacaucggggacacaagcaucaccaccgcagacggaaagauaaggagucugacaaggaagauggccgcgagagccccuccuaugacacaccuucucaaagagugcaguucauucuggggaccgaggaugacgaugaggagcauaucccccacgaccucuuuacagaaauggaugagcugugcuaccgggacggagaagaguaugaguggaaagaaaccgcucgcuggcuuaaguucgaggaagauguugaggacggcggcgacagauggagcaaaccuuacguggccacacugucccuccauagccuguuugaacugcggucuuguauucucaaugggaccgucaugcuggauaugcgcgccuccacgcuugacgagaucgcugauauggugcuggacaacaugauugccagcggacagcucgaugagucuaucagagaaaauguucgggaggcucugcuuaagagacaccaccaucagaacgaaaaacgcuucaccucccggaucccccuggugagaucuuuugccgacauuggcaagaagcacucugauccucaucuccuggagcgcaaugggauccuggcguccccgcaaagcgcccccggaaaccucgacaauuccaaaucuggcgaaauuaaggggaacggaagcggcggcucccgggagaauagcacagucgauuucucuaaaguggacaugaacuuuaugagaaagaucccuaccggggcugaggccuccaaugugcuggucggagaaguugauuuccuugagcgccccauuaucgcuuuugugcggcuggccccugcggugcuccugacaggccuuaccgaaguccccgugccgacgagauuccuguuucuccugcuggggccugccggaaaagcuccccaguaucacgagauuggccgcagcaucgccacacucaugaccgacgagaucuuccaugacguugcuuacaaggccaaagaucggaacgaccugcuuucugggauugaugaguuccuggaccaggugacaguccucccucccggagaaugggaucccagcaucagaauugaaccuccgaaguccgugcccucucaggagaagcgcaaaaucccuguuuuucacaauggcagcacccccacccugggcgaaacaccuaaggaggccgcucaccaugcggggcccgagcuucaacggacgggaagacuguucggcgggcucauucuggacaucaaacggaaggccccguuuuuccuguccgauuuuaaagacgcucucagccugcagugccuugccucuauccuguuccucuauugugccugcauguccccugugauuaccuuuggaggccugcugggggaagcuacagagggccgcaucagcgccauugaaucucuuuucggagcgucccucaccggcaucgcuuacagccuguuugccgggcagccccugacaauucucggauccaccggcccuguccugguguucgagaagauccuuuacaaguuuuguagagauuaucagcugucuuaccucagccugcggacguccaucgggcuguggacaucuuuccuuugcauuguccucguggccaccgacgcuagcucccugguuuguuauaucaccagauuuacagaagaggccuucgcugcccugauuugcaucauuuucaucuacgaggcgcucgaaaaacuguuugaucuuggagagaccuaugccuucaacaugcacaauaaccuggacaagcucacaagcuacucuugugugugcacggaacccccuaaccccuccaaugagacccuggcucaauggaaaaaggauaacauuacagcccauaauaucagcuggcgcaaccugaccgucucugaauguaaaaagcuccggggcguguuucuuggguccgcuugcggccaccacggaccguauaucccugacguucuguucuggugcgugauucuguuuuucacaaccuuuuuccucagcucuuuucugaagcaguucaaaacgaagagauacuuucccaccaaaguccgcagcacaaucuccgacuucgccguguuucuuaccauugugaucaugguuacaauugauuaccuggucggcgugcccagcccuaagcuccaugugccggagaaauucgagcccacccacccugaaagaggguggaucaucucuccccugggagacaauccuugguggacgcugcuuauugcggccauccccgcucuccuguguacaauucugaucuucauggaucagcaaauuaccgccgucaucaucaaccggaaggagcauaagcucaaaaagggcgcuggguaucaccuggaccuucugauggugggaguuaugcucggcgugugcuccgucauggggcugccuugguuuguggccgccacaguucugagcauuucccaugugaauagccuuaaagucgaaagcgaguguuccgcucccggcgagcagccgaaguuccugggaauccgcgaacagagagugaccggccucaugauuuuuauccugauggggcucucuguuuucaugaccagcgugcugaaauuuauuccuaugcccguccuuuacggaguguuccuguauaugggcguguccucucucaaggggauccagcuguuugaucggaucaaacuguucggaaugccugcgaagcaccaacccgaccuuauuuaccugcgcuaugucccgcucuggaagguucacaucuuuacagugauucagcugacgugccucgugcugcuuugggucaucaaagugagcgccgcugccguuguguucccuaugaugguccuggcccucguguuuguuagaaagcugauggaucuguguuucaccaaacgggagcuuuccuggcuggacgaucucaugcccgaaagcaagaaaaagaaggaggacgauaaaaagaaaaaggaaaaagaggaggcugaacgcaugcugcaggacgaugacgacacagugcaucucccuuucgagggcgggucucugcuucagauucccgucaaggcccugaaguacuccguggaucccagcaucguuaacauuucugacgaaauggcgaaaaccgcucaauggaaggcccuguccaugaauacagagaacgccaaagugaccagaagcaauaugucuccugauaagccggucuccgugaaaaucagcuuugaagacgagccccggaagaaguauguggaugcugagacgucccucuga

SEQ ID NO: 75844 - RNA, 2838 nt, Artificial Sequence
  derived and/or modified sequence opt5 from SLC4A9__Homo_sapiens__NP_001245355
auggagaugaagcugcccggccaggaaggguucgaggccagcuccgcuccuagaaacaucccgucuggagaacucgacagcaaucccgauccuggcaccgggcccuccccugacggacccucugauacagagagcaaagaacugggcgugccuaaggacccgcuucuguuuauucaacucaacgagcugcuuggguggccccaggcccuggaguggcgggaaacgggacgcuggguccucuucgaggaaaaacuggagguugcggcuggcagaugguccgccccucacgugcccacccuggcccucccuucucugcagaaacuucggagccugcucgcugagggccuggugcuucuggauugccccgcccagucccuccuggaacuggucgagcaagugacacgcguugaaagccucucuccggagcugagagggcagcuucaggcucugcuccugcagcggccucaacauuacaaucagaccacaggaacccgccccuguuggggcuccacacacccuagaaaggccagcgacaacgaagaggcgccccuucgggagcagugccagaauccccugcgccaaaagcucccuccgggggccgaagcuggaaccgugcuggccggcgagcugggguuucucgcucagccccugggagccuucgucagacuucggaacccugugguucugggcucucucacggaagugucccugcccagccgcuuuuucugucuucugcucggcccuugcaugcuggggaagggauaucaugagaugggcagagcggccgcuguccugcucucugauccccaguuucaaugguccgugcggcgcgccagcaaucugcacgaccuucuggcugcccucgaugccuuccuggaagaggugaccguccugccgccugggagaugggaccccacagcucggaucccucccccuaaaugucuucccucccagcauaagagacucccgucucagcagcgcgagauucggggaccugcgguucccagacugaccagcgccgaagaucgccaccggcacggcccccaugcucacuccccugagcugcaaagaacagggcgcaaagugccgugguaccccagcgacuuucucgaugcccugcaucuucagugcuucucugccgugcuguauaucuaccucgcuaccgucacgaacgccauuacauuuggaggccugcugggcgacgcgaccgacggggcucagggagugcuugaauccuuccucggcacagccguugccggggcugccuuuugucugauggcuggacagccucugaccauccucagcucuaccggccccgugcuggucuucgagcggcuucuguucagcuuuuccagagauuauucucucgacuaccugccuuuccgccuguggguggggaucuggguugccacauuuugccuugugcucgucgcgacggaagccagcgugcugguccgguauuucaccagauuuacagaggagggcuucugugcucugauuucccucaucuuuauuuacgaugccgugggaaagaugcugaaucuuacccacacauaccccauccaaaaaccuggcagcucugcuuaugggugccugugucaguaccccggaccgggcgggaacgaaucccaguggauucgcacccggccuaaggacagagaugacaucgaucucggacugauuaaugccagccugcuucccccucccgagugcacgcggcagggcgggcacccgcgcggcccuggaugccauacaguucccgacaucgcguucuuuucucuccugcuguuccucaccuccuuuuucuuugccauggcucugaagugugugaaaaccagcagauucuucccuuccgucgugcggaagggccuuucugauuuuagcuccguucuggccauccuccuggggugcggacuggacgcuuuccuuggccuggccacacccaaacucauggugcccagagaauuuaagccuacccugccggggcgcggauggcucgucucucccuucggcgccaacccuuggugguggagcguggcugcggcccugcccgcccuucugcucuccauucugaucuuuauggaucaacagauuacagcugugauccugaaucggauggaguauagacuucagaaaggggccggcuuccaccuggaccucuuuuguguugcuguccugaugcuccugacgagcgcccuuggacugccuugguacgugucugcgaccgugauuucccucgcucauauggacagccugcgcagagagucucgggccugcgcccccggcgaacgcccuaacuuccuggggaucagagagcagcggcuuacaggacuggucguguuuauccucaccggcgcuuccauuuuccuggccccgguucucaaguuuauccccaugccugugcuguaugggauuuuccuuuacaugggagucgcggcucugagcucuauccaauuuacaaaucgcgugaaacugcuccugaugcccgccaagcaccagccugaucuucugcuccugagacauguuccccucacccgggugcaccuguucacggccauucagcuugcuugucugggccugcucuggaucaucaagagcaccccggccgcuauuaucuucccucugaugcuucuggggcucgucggcgugcgcaaagcccuggaaagaguuuuuagcccccaagagcuccuguggcuugacgaacugaugcccgaggaggaacgguccauuccugagaagggacuggaacccgagcacucuuucuccggcagcgauuccgaagacucugagcucauguaucagccuaaagcgccggagaucaacauuagcgugaacuga

SEQ ID NO: 75845 - RNA, 501 nt, Artificial Sequence
  derived and/or modified sequence opt5 from SLC50A1__Homo_sapiens__NP_001116309
augagaggccugcaccccuggcaugugcuccggcgcccucuggggccgcaggcccacgcuaacgaccccgagugcggacaaagaccuguccccgcccuuagccaucacggcucccagcggguugugcugcuccagaccgcgacacugcuuggggugcugcuccugggauacggcuauuucuggcugcucgucccuaaucccgaagcucgccugcagcaacuugggcuguuuuguucuguguucacgaucagcauguaccucuccccucuggccgaucuugccaagguuauucagaccaaaucuacacagugccugagcuauccgcucaccaucgcuacacugcugaccuccgccucuuggugucucuacggauuuagacugcgggaccccuauauuauggugagcaacuucccuggcaucgucacauccuuuauucgcuucuggcuguuuuggaaguacccccaggagcaagauagaaauuauuggcuucuccagaccuga

SEQ ID NO: 75846 - RNA, 1023 nt, Artificial Sequence
  derived and/or modified sequence opt5 from SLC51A__Homo_sapiens__NP_689885
auggagcccggcagaacccagaucaagcuggacccucgguacacagccgaucuccuggaagugcuuaaaacgaacuaugggauuccgagcgcuugcuucucccaacccccuaccgccgcgcagcugcuccgcgcucugggacccgucgagcuugcccugacaucuauccucacccugcuggcccucggcagcauugcuaucuuucuggaagacgccguuuaccuuuauaagaauacacuguguccuauuaaaagacggacccuccuguggaaguccucugcucccacaguggugagcguccuuugcuguuucgggcuguggaucccucgcucccucgugcugguugagaugaccaucacgucuuuuuacgccgugugcuucuaucugcucaugcuggucaugguggaaggauuuggcgggaaagaggcgguucuuagaacccugcgggauacaccgaugauggugcacaccggacccuguugcuguugcuguccuugcuguccccgccuccugcuuacaagaaagaagcugcagcuccugaugcugggcccuuuccaguacgccuuucucaaaauuacccugacgcuugucggccuguuccucgugcccgacgggaucuaugauccggcugacauuagcgagggauccacagcccuguggaucaacaccuuucuuggcgugagcacacugcucgcucuguggacccuggggauuaucucucggcaagcccgccuccaucugggagaacagaauaugggcgcgaaguucgcccuuuuucagguccugcucauucugaccgcucugcagccuuccaucuucagcguucuugccaacgggggacaaaucgcuugcucucccccuuacuccagcaaaacaagaucucaggugaugaauugccaccuccugauucuggagacguuucucaugaccgugcugacacggauguacuaucgcagaaaggaucauaaagucggcuacgaaaccuucuccagccccgaccuugaucugaaccucaaggccuga

SEQ ID NO: 75847 - RNA, 387 nt, Artificial Sequence
  derived and/or modified sequence opt5 from SLC51B__Homo_sapiens__NP_849190
auggagcacagcgaaggcgcccccggggacccugcuggaaccguggucccgcaggagcugcucgaagagaugcugugguucuuuagaguugaagaugccucccccuggaaccauucuauccuugcgcuggcugccgugguggucauuaucagcauggugcuccugggccgguccauucaagccucucgcaaggagaaaaugcagccucccgagaaggaaacaccugagguucuucaccuggacgaagcuaaagaucauaauagccucaacaaucugagagagacgcugcucuccgagaagcccaaccuggcccagguggaacuugagcugaaagaacgggacguccucucuguguuccugccugauguuccggagaccgaaagcuga

SEQ ID NO: 75848 - RNA, 1347 nt, Artificial Sequence
  derived and/or modified sequence opt5 from SLC52A1__Homo_sapiens__NP_060456
auggccgcucccacccugggcagacucgugcugacacaccuucuggucgcccucuucgggaugggaagcugggcggcuguuaacggcaucuggguggagcugccuguggucgugaaggaccuuccggaaggguggucccugcccucuuaccucagcguuguggucgcccugggaaaucugggccuccuggugguuacgcuuuggcggcagcuggccccugggaaaggagagcaagugcccauucaggucguccaggugcucuccgugguuggcaccgcucugcuugccccucuguggcaucacguggcucccguggccggccagcuccauucugucgcguuucugacacuggcccucgugcuggcuauggccugcuguaccagcaacguuacauuccuuccuuuucugucccaccucccgcccccuuuccugcgcucuuucuuccuugggcaaggacugagcgcucuccugcccugcgugcuggcccucguccagggcguggggagacuggaauguccucccgcgccgaccaauggaacauccggcccuccccuugauuuuccugagcgguuccccgccagcaccuuuuucugggcucugacggcccuccugguuaccucugcugccgccuuucgcgggcuucugcuccugcugcccucccucccuagcgugacaaccggaggcucuggcccggaacugcagcuugggucccccggagcugaggaggaagagaaggaagaggaggaagcgcugccucuccaggagcccccuagccaagccgcuggcacaauccccgggccggacccugaagcccaucagcuguucucugcccacggagcuuuucugcuuggccucauggccuucaccuccgcggucacgaacggggugcugcccagcguccaguccuucucuugccugccuuauggaagacucgcuuaccaccuggccgugguucuuggcagcgccgcuaauccccuggccuguuuucucgcuaugggcgugcugugccggucccuggccgggcuugucggacucagccugcugggcaugcucuuuggggcguaucugauggcccuugcuauucugucuccuugucccccgcucgugggaacaaccgccggcguugugcuggucgugcuguccugggugcuuugccucuguguuuuuagcuacgucaaaguggcugccucuagccugcugcaugggggcggacgcccugcgcuccuggccgcuggcguggccauccaggucgggucccuucugggagcuggcgccauguucccucccacaucuauuuaucacguguuucaaagcagaaaggauugcguugaccccugugggccguga

SEQ ID NO: 75849 - RNA, 1338 nt, Artificial Sequence
  derived and/or modified sequence opt5 from SLC52A2__Homo_sapiens__NP_001240745
auggccgcucccaccccugccagaccggugcugacacaccuccuggucgcgcuuuucggcauggggagcugggcugccguuaacggaaucuggguggagcugcccguggucgugaaggaacucccugagggcuggucccugcccucuuacguuagcgugcuugucgcccuggggaaucucggacugcuggugguuacgcucuggcggcgccuggcuccuggcaaagacgaacaggugcccauuagagucgugcaagugcuugggauggucggaaccgcccugcucgcuucccuguggcaucacguugccccuguggcgggccagcuucauucuguggccuuucuggcucucgccuucguccuggcucuggccugcugugcgagcaacgugacauuucucccguuccugucccaccuucccccucgguuucugcgcucuuucuuucucggccaggggcugagcgcccuucugcccugcguucucgcucuggugcagggagucggcagacuggaguguccucccgccccgaucaaugggaccccuggacccccucucgauuuccuggaacgguuucccgcuuccacauucuuuugggcccuuaccgcccugcucguggcuagcgcggccgcuuuccaaggccugcuucugcuccugcccccuccgcccucuguuccuacaggggagcugggauccggccuccaggugggcgcccccggggccgaggaagaggucgaagagagcucuccucugcaggagcccccgucccaggcugccggaaccacgccuggccccgacccuaaggcguaucaacuucugagcgcucgcucugccugccuccuggggcugcuugccgcuaccaacgcccucacaaauggagugcugcccgcuguccaguccuuuagcugucugccuuacggcagacucgccuaucaucuggcggugguucuuggguccgccgcuaacccccuggccugcuuccucgcuaugggagugcugugucggucucuggccggccuuggcgggcucagccugcugggagucuucugcggcggguaccucauggcgcuggccgugcuuuccccguguccuccccugguuggaaccagcgcuggcgugguccucguggugcugucuuggguucugugccuuggggucuuuuccuaugugaaaguggccgcuagcucucuccugcacggcggaggccgccccgcccugcucgccgcuggggucgcgauucaggugggaagccugcuuggcgccguugcuauguucccuccgacauccaucuaccacguguuucauucuagaaaggauugugccgaccccugcgauagcuga

SEQ ID NO: 75850 - RNA, 1410 nt, Artificial Sequence
  derived and/or modified sequence opt5 from SLC52A3__Homo_sapiens__XP_011527450
auggccuuccugaugcaccuccuggugugcgucuuuggcauggggagcuggguuaccaucaacggacuuuggguggagcugccccuccuggugauggaacuuccugagggcugguaccugccguccuaucucacagucgugauucagcuggcuaauaucgggccccugcucguuacgcugcuucaucacuucagaccuucuugucugagcgaagugcccauuaucuuuacccuccugggagucggcacagugaccugcauuaucuucgccuuucuuuggaacaugacauccuggguucuggacgggcaucacucuaucgcguuccucgugcugaccuuuuuccuggcucucgucgauuguacaagcuccgugaccuuucugccuuucaugucucggcuucccacguacuaucugaccacauuuuucgugggagagggccucagcggccugcuuccugcccuggucgcccucgcucaaggguccggacugaccacaugcguuaaugugaccgaaauuagcgacucugugccgucccccgucccuacgcgcgagacagauaucgcccagggcgugcccagagcucugguuagcgcccucccugggauggaggcgccccugucucaucuugaaucccgguaccugccggcccacuuuagcccucucguguucuuccugcuucugucuauuaugauggcuuguugccucgucgccuuuuucgugcugcagcgccagcccagauguugggaggcuuccguugaagaccugcucaacgaucaagugacccugcacagcauccggccucgcgaggagaaugaccuuggacccgccggcacagucgauuccucucaggggcagggauaucuggaagagaaggcggcccccugcuguccugcucaucucgccuuuauuuacacccugguggcuuucgucaacgcccugaccaauggcaugcuuccgagcgugcagacauauuccugccucagcuacggccccguugccuaccaccuggcugcgacgcugucuaucguggccaacccucucgcuucccuggucagcauguuucuucccaauagaucucuccucuuccugggggugcugagcguucuuggaaccuguuuuggcggguauaacauggccauggccgugauguccccuugcccccuccugcaaggacauuggggcggggaaguccugauuguggcuucuugggugcuguucagcggaugccuguccuacguuaaagucaugcuuggcguggugcugcgggaccucagccgcucugcccugcugugguguggcgcggcuguccagcuugggucccuccugggagcccugcucauguuuccgcuggugaauguucuuagacuguucagcucugccgauuuuugcaaccuccacuguccugcuuga

SEQ ID NO: 75851 - RNA, 1923 nt, Artificial Sequence
  derived and/or modified sequence opt5 from SLC5A11__Homo_sapiens__NP_001245340
auggagagcggcaccuccucuccccagccuccgcaacuggacccccucgaugccuucccucagaaggggcuggaacccggagacaucgcugugcuuguccuguacuuucucuucguucuggccgugggccuuuggagcacagugaaaacgaagagagauaccgucaaaggguauuuucuggcgggaggcgacauggugugguggccuguuggggcuucccucuucgccucuaacgugggaagcggccacuuuauuggccuggccggguccggagcugccacaggcaucucugucagcgcuuacgagcugaauggacucuucuccgugcugaugcuugccuggauuuuucugcccaucuauauugcggggcagguugauauguacgccggcgcuaucuucauccagcaaagccuccaucuggaccuuuaucuggccauuguggggcuccuggcuaucaccgccgucuacacaguggcgggaggccuggccgcugugauuuauaccgaugcccuccagacacugaucaugcuuauuggcgcucugacccucaugggguacucuuuugccgccgucggaggcauggaagggcugaaggagaaauacuuccuugcucuggcguccaaccggagcgaaaauucuuccugcggacucccucgcgaggacgccuuucacaucuucagagauccgcugacgagcgaccugcccuggccuggcguucucuuugggaugucuauucccucccugugguauugguguaccgaucaggugaucgugcagcggacacuugcugccaagaaccugagccaugccaagggaggcgcucucauggccgcguaccugaaaguccuuccucuguucaucaugguguuccccggcaugguuucccgcauucucuuuccggaccaaguggcuugcgccgauccugagaucugucagaagauuugcucuaaucccagcggguguuccgacaucgccuauccuaaacugguccuggaacuccugcccaccggacuuagaggccugaugauggcugugaugguugccgcucucaugagcucucugacauccauuuucaacagcgccucuaccaucuuuacgauggaccuguggaaucaccuucggccccgcgcgagcgagaaggaacucaugaucguggggagagucuucgugcugcugcucguccugguguccauucuuuggaucccuguugugcaggccucucagggaggccaacuguuuauuuacauccagagcauuuccagcuaucuccagccgcccgucgcugugguuuucaucauggggugcuuuuggaaacggacaaacgagaagggcgccuucuggggacugaucucuggccugcuucucgggcuggugcgccugguccucgauuuuauuuacgugcaaccuagaugugaccagcccgaugagcggccugugcugguuaaguccauccauuaucuuuacuucagcaugauucugucuaccgucacacucaucaccguguccaccgugagcugguuuacagaacccccguccaaagagauggucucucaccugacgugguucacccgccacgacccugugguucagaaggaacaggcucccccugccgcgccccugagccuuacacucucccaaaauggaaugccugaggccucuagcuccagcucugugcaguuugaaaugguccaggagaacaccuccaaaacacauagcugcgauaugacccccaagcagucuaaagugguuaaggcuauucuguggcuguguggcauccaagagaaagggaaggaggaacucccggccagagcugaagccauuaucgugucccuggaggaaaauccucuugucaagacgcugcucgacgugaaccugaucuucugcguuagcugugccauuuucaucuggggauacuuugcuuga

SEQ ID NO: 75852 - RNA, 1857 nt, Artificial Sequence
  derived and/or modified sequence opt5 from SLC5A12__Homo_sapiens__NP_848593
auggaggugaagaacuucgccgucugggacuacguuguguuugcugcccuguucuuuaucagcuccggcauugggguguucuuugcgaucaaagaaagaaagaaagcuaccucucgggaguuccucgucggaggccgccagaugagcuuugggcccgugggacugucccuuacagccucuuucaugagcgccguuacggugcugggcaccccuuccgaagucuauagauuuggggcuucuuuccucguguuuuucauugccuaccuguuuguuauccuucugacaagcgagcuuuuccugccgguguucuaucgguccggaauuaccagcacauacgaauaucugcaacuccgcuuuaauaagcccgucagauacgcugccaccgugaucuauaucgugcagacaauucuguacaccggcgucguuguguacgcgccugcccuugcucugaaccaggugacgggcuucgaucucugggggucugucuuugccaccggaaucgugugcacauucuauuguacccugggcgggcuuaaagcuguuguguggacagacgccuuucagauggucgugaugauuguuggauuccugaccgugcucauccaaggcuccacgcacgccgggggauuucauaauguccuggagcagagcacaaacggcucucggcugcacauuuucgauuuugacguggauccccuccgcagacauaccuucuggacaaucaccgucggcgggaccuuuacauggcugggaauuuacggcgugaaucaguccacgauccagcggugcaucagcuguaagaccgagaagcacgcgaaacuugcucuguauuucaaccuccuggggcuuuggauuauccugguuugcgccguguuuucuggacucauuauguacucccauuucaaggacugugauccuuggacaagcggcaucauuuccgcucccgaccaacugaugccuuauuucgucauggaaaucuuugccaccaugccggggcugcccggacucuucguggccugcgcuuuuucuggcacacugagcaccguugcguccagcaucaaugcccuugcuacggugacauucgaggauuuugucaaaucuuguuucccucaccuguccgacaagcucagcaccuggauuucuaaaggccugugccuucuguuuggggugauguguaccagcauggccguggccgcuuccguuaugggaggcgucgugcaggccucucucagcauccacgggaugugcggaggccccaugcuggggcuguucucccucggcauuguguuuccuuucgucaacuggaagggagcgcugggcgggcuucugacaggaaucacccucagcuuuuggguggcuauuggcgccuucaucuaccccgccccggcuucuaagacauggccucugccccuguccacggaucaguguaucaaaagcaauguuaccgccacagggccucccgugcuuucuucccgccccggaauugcugacaccugguauagcaucuccuaccucuacuauucugccgucggcugccuggggugcauuguggcgggcguuaucauuagccugaucacaggaagacagcggggcgaagauauucaaccucuccugauccgcccgguguguaaccucuuuugcuucugguccaagaaauacaagacccuguguuggugcgggguccagcaugacucuggaacggagcaggagaaucucgaaaacggcagcgccagaaaacaaggggcugaguccgugcugcagaauggacugcggcgcgaaagccuuguucacgugcccggcuaugacccuaaggauaaaucuuacaacaauauggccuucgagaccacacauuuuuga

SEQ ID NO: 75853 - RNA, 1995 nt, Artificial Sequence
  derived and/or modified sequence opt5 from SLC5A1__Homo_sapiens__NP_000334
auggacagcuccaccuggucucccaagacaacggccgugaccagaccugucgagacacacgaacugauccggaacgcugccgauauuagcaucauuguuaucuacuucgugguggucauggcggugggccucugggcuauguuuuccaccaaucgcgggacaguuggaggcuucuuucuggccgggagaucuauggugugguggccgauuggagccagccuuuucgcuuccaacaucggcucugggcauuuugucggacuggccggcaccggcgcugccagcgggaucgcgauuggaggcuucgaguggaaugcccucgugcugguugugguccuuggguggcuguuugugcccaucuauauuaaagcuggaguggucacaaugccugaauaccuccggaagcgcuucggcgggcagagaauccaaguuuaucugucccugcucagccugcuucuguacauuuuuaccaaaaucucugccgacauuuucuccggagcuaucuuuaucaaccucgcccugggccuuaaucuguaucucgcgauuuuccugcugcucgccaucacggcucuguacaccauuacaggcgggcuugccgcugugaucuauaccgauacacugcagaccgugauuaugcucgucggaagccugauccuuacgggcuuugccuuccacgagguugggggauacgacgccuucauggaaaaguacaugaaagcuauccccacaauugugucugauggcaacaccacauuucaggagaagugcuauaccccucgggcggacuccuuccauaucuuucgcgauccccugaccggggaccucccuuggccgggauucauuuuuggcaugagcauccugacacugugguacugguguacggaucaggugauuguccaaagaugccucucugccaagaauaugucccacgugaaaggcggguguauccugugcggauaucuuaagcugaugcccauguucaucaugguuaugccuggcaugauuagccggauccucuacaccgagaaaauugcuugugugguccccuccgaaugcgagaaguauugugggacaaaagugggaugcaccaacaucgccuacccuacacuggucguggaacuuaugcccaauggccugcgcgggcucaugcugucuguuaugcuggccagccucauguccagccugaccucuauuuuuaacuccgcuagcacgcuuuucacaauggacaucuaugccaaggugagaaagcgggcgucugagaaagagcugaugauugcuggccgccucuuuauccugguccugaucggaauuagcaucgccugggugccgauuguucaguccgcccagucuggccagcuuuucgauuacauccaaagcauuaccuccuaccucgggccucccaucgcugccguguuucugcuggcuaucuucuggaagagagucaaugaaccuggagccuuuuggggccucauucuggggcuucugaucggaauuagccggaugaucaccgaguucgcguauggcacagggucuuguauggaacccuccaacugccccaccauuaucuguggcgugcauuaccucuauuucgccaucauucuguuugcuaucagcuucauuacaaucgugguuauuucucugcuuacgaaaccuaucccggacguccaccucuaccgccugugcuggucccugagaaauagcaaggaggaacggaucgaucucgacgccgaggaggaaaacauucaggagggacccaaagaaaccaucgagauugaaacacaggugccugagaagaaaaagggcaucuuuagacgcgcuuaugaccuguucugcgggcuugagcagcacggagcccccaagaugaccgaagaggaagagaaagcgaugaagaugaaaaugacagauaccuccgaaaagccucuguggcggacggugcucaaugucaacggcauuauccuggugaccguugccguguuuugucaugcuuacuucgccuga

SEQ ID NO: 75854 - RNA, 2019 nt, Artificial Sequence
  derived and/or modified sequence opt5 from SLC5A2__Homo_sapiens__NP_003032
auggaggaacacaccgaggccggcagcgcucccgaaaugggggcccagaaggcgcugaucgacaacccugcugauauucucgugaucgccgccuacuuccugcuugucauuggaguuggccugugguccaugugcagaacaaaucgggggacggugggaggcuauuuucucgcugggcgcucuauggugugguggccggucggagccagccuguucgcuuccaacaucggcucuggccauuuuguggggcuugccggaaccggcgcggccagcgggcuggcuguugccggauucgaguggaaugcucucuuugugguccugcugcucggcuggcuguucgcccccguguaccuuacagcggggguuauuaccaugccucaauaucugagaaaacgguuuggaggccgcagaauccggcucuaccuguccgugcuuucucuguuccucuauaucuuuacaaagauuagcgucgacauguucuccggcgccguguuuauccagcaggcucugggguggaacauuuacgccagcgugaucgcucugcucggaauuaccaugaucuauacagucaccggcgggcuggccgcccuuauguacacggauaccguucagacauucgugauucugggaggcgcuuguauccucaugggguacgcguuucacgaagugggaggcuauucuggccuguucgacaaauaccuuggggccgcuaccucccugacagucagcgaggaucccgccgugggaaauaucucuuccuucugcuaucgcccuagacccgacagcuaccaucuccugcggcacccuguuaccggcgaucugccguggcccgcccuccugcuugggcugacgauugugucuggaugguauugguguuccgaccaagucaucgugcagcgcugccucgcuggcaagagccugacacauauuaaagccggguguauccuuugcggcuaccugaagcucaccccuauguuucugaugguuaugcccggaaugauuuccagaauccuguauccugaugagguggcgugugucgugcccgaagucugccggcgcguguguggcacagagguugggugcucuaacaucgcuuacccgagacucguggucaagcugaugccuaauggacuucggggccugaugcucgccgugaugcuggccgcucugaugagcucccuugccagcauuuucaacucuuccagcacccucuuuaccauggacaucuacacacgccugagaccccgggcuggggauagagaacugcuccugguuggacgccuuuggguggucuucauuguggugguuucugucgccuggcugccuguggugcaggcggcccagggcgggcaacucuuugacuauauccaggcugucagcuccuaccuggccccucccgugucugcuguuuucgugcuggcccuuuuugucccccgggugaaugagcagggcgcguucuggggacucauuggcgggcugcugaugggacucgccagacugaucccggaguuuagcuucggcuccgggagcuguguucagcccucugcuugcccugccuuucuuugcggagugcacuaucuguacuucgcuaucguccucuuuuucuguuccggccugcugacgcuuaccgugagccucugcacagcccccauuccucgcaaacaucugcaccggcugguuuucucucucagacacuccaaggaggaacgcgaagaucuggacgccgacgagcaacaggggagcucccuucccgugcagaacggcuguccggaaucugcuauggagaugaaugagccucaagcgcccgccccuagccuguuucggcagugccuccugugguucuguggaauguccagaggcggggucggaucucccccuccccugacccaggaagaggcugccgccgcugcccgccggcuugaagauaucagcgaggacccguccugggcgagaguggugaaccucaaugcucugcugaugauggccgucgccguuuuucucuggggcuucuaugcuuga

SEQ ID NO: 75855 - RNA, 2157 nt, Artificial Sequence
  derived and/or modified sequence opt5 from SLC5A3__Homo_sapiens__NP_008864
augagagccgugcuggacaccgcugauaucgccauugucgcgcucuacuucauccugguuaugugcauuggcuuuuucgcuauguggaaaagcaaccgguccacagugucuggguauuuucuugccggacgcagcaugacguggguggccaucggcgcuucccuguucgucucuaauauugggagcgagcacuuuaucggacucgccggcuccggggcugccucuggauucgcggugggcgccugggaauuuaacgcucugcuucugcuccagcugcugggcuggguuuucauccccauuuacaucagaagcgggguguauaccaugccugaguaccucuccaagcgguuuggaggccaucgcauucaagucuauuucgccgcucugagccuuauccuguacauuuuuacaaagcucucuguggaccuguauuccggggcccuuuucauccaggaaagccugggauggaaucucuacguuucugugauucugcugaucggcaugaccgcgcuccugacagucaccgggggacuuguggccgugaucuacacagauacccugcaggcucuccugaugauuaucggcgcccuuacgcugaugauuaucuccauuauggagaucggcggguuugaagaggucaaaagacgguauaugcucgcuagcccggacguuaccucuauccugcugacauacaaccucuccaauaccaacagcuguaaugugucccccaagaaagaggcccugaagaugcuucgcaacccuacagaugaagacgugcccuggccuggauucauucugggccagacccccgccucugucugguauuggugcgcugaucaagugaucguucagagagugcucgcggccaagaauauugcucacgccaaagggagcacgcugauggccggauuccuuaagcugcucccuauguuuaucauugucgugccgggcaugaucucccggauccuguucacagacgauauugcuuguaucaaccccgagcauugcaugcugguuugugggagccgcgccggaugcucuaauauugcguacccuagacucgugaugaaacugguccccgugggccuucggggccugaugauggcugucaugaucgccgcccucauguccgaccuggauagcauuuuuaacucugcuagcaccaucuucacacuggacguguauaaacuuauucgcaaguccgccucuagcagagaacucaugaucguugggcggaucuuuguggcuuucauggucgugauuuccaucgccuggguuccuauuaucguggagaugcagggaggccagauguaccuguauauucaagaggucgcggauuaccugacacccccgguggccgcucucuuucugcuugccaucuucuggaagcgcuguaaugaacagggggcuuuuuacggaggcauggccggguucgugcugggcgcgguuagacucauccuggccuuugcuuaucgggccccugagugcgaccagcccgacaacagaccuggauucauuaaggauauccacuacauguaugucgcuaccggccuguuuugggugaccgggcuuauuacggugaucgucagccuccugaccccuccgcccacaaaagaacagauucgcaccacaaccuucuggucuaagaaaaaucuggugguuaaggagaacuguucccccaaagaggaacccuacaagaugcaagagaaaagcauccuccggugcucugaaaacaaugagacgaucaaccauauuaucccuaauggaaaguccgaagacagcauuaagggccugcagcccgaggaugugaaccuucuggucacauguagagaagaggggaauccuguggccucccucggacacucugaggccgaaacccccguugacgcuuauagcaacggccaggcggcccugaugggggagaaagaacgcaagaaagagaccgaugacggcggacgguacuggaaguucaucgauugguuuugcggcuucaaauccaagucucugagcaagagaucccuucgcgaccucauggaagaggaggcugugugccugcaaaugcuggaagagacacggcaggucaaagugauucucaauaucgggcuguuugccguuuguagccuuggaaucuucauguuuguguauuucucucuguga

SEQ ID NO: 75856 - RNA, 1980 nt, Artificial Sequence
  derived and/or modified sequence opt5 from SLC5A4__Homo_sapiens__NP_055042
auggccagcaccgugucccccucuacaaucgcugagacgccugaaccgcccccucugagcgaccacauuagaaacgccgcggauaucuccgucauuguuaucuacuuccucguggugauggcugucggccugugggccaugcuuaagaccaaucgggggacaauuggaggcuuuuuccuggccgggcgcgacauggcuugguggcccaugggagccucucucuuugcuagcaacaucggcuccaaucauuauguggggcuggccggaaccggcgcggccucuggcguugcuacagugaccuucgaguggacaagcuccgucaugcuucugauccucggguggauuuuugugccuaucuacauuaaaagcggaguuaugaccaugcccgaauaucugaagaaaagauucggcggggagcggcuccagguguaccucucuauccugucccuuuuuauuugcgucgugcugcucaucagcgccgauauuuucgcuggagccaucuuuaucaagcuggcgcuuggccuggaccucuaucuggccauuuucauccugcucgcuaugacggccguguacaccacaaccgggggacuggcuucugucauuuauacagauacccuucaaacgaucauuaugcugaucggcuccuuuauccucaugggcuucgccuuuaacgaaguugggggauacgagagcuucacagagaaauacgugaaugccaccccuucuguggucgaaggcgacaaccugacaauuuccgcuagcuguuauaccccgcgcgcggauuccuuccacaucuuuagagacgccgugaccggggauauucccuggccuggaaucauuuucggcaugcccaucacagcucuuugguacuggugcacgaaucagguuaucgugcagcggugucugugcgggaaggacaugucucaugucaaggccgccuguauuaugugcgcuuaucucaaacugcugccuauguuucucauggugaugcccggaaugaucagccgcauucuguacaccgauaugguugccuguguggucccguccgagugcgugaagcacuguggcgucgacgugggcugcacaaacuaugcguacccuaccaugguucuugaacugaugccccaggggcucagaggacugaugcuuagcgugaugcuggcuucucucauguccagccugacaucuaucuucaauagcgccuccacccuguuuacgauugaucucuauacaaaaaugcggaagcaagccucugagaaagagcugcuuaucgcuggccgcauuuucguccugcuccugaccgugguuagcaucgugugggucccucugguucaggugucccagaacgggcagcuuauccauuacaccgaaagcauuucuuccuaccucggaccucccaucgccgcuguguuuguccuggccauuuucuguaagagagugaaugagcaaggcgcguuuugggggcugauggugggccucgccaugggacugauccggaugauuacagaguucgcuuauggcaccgggagcugccuugcccccucuaacugcccgaagaucaucuguggaguccacuaccuguauuuuuccauugugcuguucuuuggcagcaugcugguuacacuggggaucucccuucucacgaaacccauuccugacgugcaccuguaccgccugugcuggguccucagaaauucuaccgaggaacggaucgacauugaugcugaggaaaagagccaggaagagacagacgauggaguggaagaggacuaucccgaaaaaucccgcggcugucugaagaaagccuacgaucuuuucugcgggcugcagaagggcccuaaacucaccaaggaggaggaagaggcgcugucuaagaaacugacagacaccagcgaaagacccuccuggcggacgaucguuaacaucaaugccauucuucuccuggcuguggucguguucauccauggauauuacgccuga

SEQ ID NO: 75857 - RNA, 1932 nt, Artificial Sequence
  derived and/or modified sequence opt5 from SLC5A5__Homo_sapiens__NP_000444
auggaggccguggaaaccggcgagagacccacauucggggcuugggacuacggagucuuugcccugaugcuccugguuagcacgggcaucgggcuuugggugggacuggcgcggggcgggcagcgcuccgcugaagauuucuuuaccggaggcagacggcucgccgcccugccugugggccuuucucugagcgcuuccuucaugucugccguccaagugcucgggguuccgagcgaggcuuaucgcuacggacugaaguuucuguggaugugccucggccagcugcuuaacuccgugcugacagcccuccuguucaugcccgucuuuuauagacuugggcugaccucuacauacgaauaucucgagaugcgguucagccgcgcggugagacuguguggaacccugcaguacauuguugccacaaugcucuauaccggcaucgugauuuacgcuccugcccugauccuuaaucaggucacggggcuggacauuugggcuucccuccugagcaccggaaucaucugcacauuuuacaccgccgugggcggcaugaaagcgguggucuggacagauguuuuccaagugguggucaugcuuucuggguuuugggugguucuggcccggggagugaugcucgucggcgggccccgccaggugcugacccuggcucagaaccacuccagaauuaaucucauggacuucaacccugauccccggagccgcuauacguuuuggacauucguugugggaggcacccuggucuggcuuucuauguacggggugaaucaggcccaaguccagagauauguggcuugucggacagagaagcaggccaaacuggcccuccugaucaaccagguuggacuuuuccugauuguguccagcgcugcgugcuguggcaucgucauguuuguguucuacaccgacugcgauccucuccugcugggccgcauuucugccccggaccaauauaugccccuccugguucuugauaucuuugaagaccugccuggggugcccggacucuuccuggcuugugccuacuccggcacccugagcacagccuccacgucuauuaaugcuauggccgcggucaccguggaggaucuuaucaagccuagacuccggagccuggcucccagaaaacuggugaucauuuccaaggggcucagccugaucuauggaucugccugccuuacaguugccgcucuguccagccuccugggcgggggcguccugcagggaucuuuuaccgugaugggcgugauuagcgggccgcuucucggagccuucauccugggcauguuucugccugcuuguaacacacccgggguccucgccggacugggcgcggggcuugcccugucccucuggguggcucugggcgccacccuguacccucccucugaacagacgaugcgcguucuucccagcuccgcugcccggugcguggcgcucagcgucaaugccucuggacugcuggacccugcucuccugccggccaacgauuccagcagagcucccucuuccggcauggacgccagccgcccugcccuugcugacuccuucuacgcgauuucuuaucuguacuauggggcccucggaacacugaccaccgugcuguguggcgcucuuaucagcugccucacagggcccaccaagcgguccacacuggccccuggacugcucuggugggaucuggccagacaaacggcuucuguugcccccaaagaggagguggcgauccuugacgauaaucuggucaagggcccggaggaacucccuaccgggaacaaaaagcccccuggcuuucugcccacaaaugaagaccgccuguucuuucuuggacagaaagagcuggaaggcgcugggagcuggaccccuugcgugggacaugauggcgggcgggaccagcaggagacaaaccucuga

SEQ ID NO: 75858 - RNA, 1908 nt, Artificial Sequence
  derived and/or modified sequence opt5 from SLC5A6__Homo_sapiens__XP_006712193
augagcgugggcgucuccaccucugcuccccugagcccuacauccgggacgucuguuggaaugagcaccuucuccaucauggacuacgugguguuuguccuccugcuugugcugucucucgccauuggccuguaucacgccugcagaggguggggacggcauacaguuggcgagcuucugauggcggaucgcaagauggggugucucccgguggcucugagccugcucgccaccuuccaguccgccgucgcuauccugggagugcccagcgaaauuuacagauuuggcacacaauauugguuccuuggcugcuguuacuuucuggggcuccugaucccugcccacauuuucauccccguguuuuaucggcuucaucugaccucugcuuacgaguaucucgaacugcgcuucaacaaaacaguuagagucugcggaaccgugacguuuaucuuccagauggugauuuacaugggcgucguucuguacgccccuucccucgcgcugaaugccgugaccggguuugaccuuuggcugagcgugcucgcucugggaaucgucuguacaguguauaccgcccuuggcgggcugaaggcuguuauuuggacagauguguuccagacccucgucauguuucugggacagcuggccgugaucauuguuggcucugcgaaagugggcgggcucggacgggucugggccguggcuucccaacacggccgcaucagcggguucgagcuggaccccgauccuuucgucagacauacguuuuggacacuugccuucggaggcguguuuaugaugcugucucucuacgggguuaaccaggcucaggugcagcgguaucuguccagccgcaccgaaaaggccgccguccuuuccugcuacgcuguguucccguuucaacagguuucucugugugugggaugccucauuggccuggucauguucgcguauuaccaggaguaucccaugagcauccagcaagcccaggcugccccugaccaguuugugcuguacuucgugauggaucuccugaaaggccuucccgggcugccuggacucuuuaucgccugucuguucuccggcagccugucuacaauuuccagcgcuuuuaauucucuugccaccguuaccauggaggaccucaucagacccugguucccggaauuuagcgaggcgcgggcuauuaugcugucccgcgggcuggccuucggauacggccuccugugccuugggauggccuauaucucuagccaaaugggcccuguccugcaggcugccauuuccaucuucggaauggugggcgggccccuccugggacuguuuugucuuggcauguucuuuccuugcgcuaacccucccggggccguggucggacuccuggcgggccuggugauggccuucuggaucgggauuggcagcaucguuacaucuaugggauccagcaugcccccgucucccuccaauggcagcuccuuuucucucccuacgaaccugaccguggcuacagucaccacacuuaugccccugaccacguucagcaagccuacagggcuccagagauuuuacucccugucuuaucugugguacagcgcccacaauuccaccaccgugauuguugugggacuuaucgucagccuccugacaggccggaugcgcgggagaucucugaaccccgcuaccauuuauccggugcucccuaagcugcuuucccugcucccccugagcugccagaaacggcugcacuguagaucuuacggacaagaucaucuugacacaggccucuucccugaaaagccccgcaaugggguucugggcgauucccgggacaaagaggccauggcgcuggauggaacggccuaucagggcagcucuagcacaugcauccuccaggagaccucccuguga

SEQ ID NO: 75859 - RNA, 1743 nt, Artificial Sequence
  derived and/or modified sequence opt5 from SLC5A7__Homo_sapiens__NP_001291934
auggccuuccacguggagggccugaucgcuauuaucgucuuuuaccuccugauucuucugguugggaucugggccgcguggagaaccaagaacagcggauccgcugaggaacggucugaagccauuaucgugggcgggcgcgacaucggacuccuggugggcggguucacaaugacggccaccugggucggaggcggcuauauuaaugggacagcugaggccguguacguucccggauauggccuugcuugggcccaggcgccuaucggguacagccugucccucauucugggaggccuguuuuucgccaaaccgaugagaucuaagggguaugugaccaugcucgaucccuuucaacagaucuacggaaaacggaugggcggccugcuuuucauuccugcucugaugggggaaauguuuugggccgcugccaucuucagcgcgcucggagccacaauuuccgucaucaucgacguggauaugcauauuucuguuaucauuagcgcucugaucgccacccuuuauacacuggugggcgggcucuacuccgucgcuuacaccgacguggugcagcuguuuugcauuuucgucggacuguggaucagcguucccuuugcccucucucacccugccguggcugauaucggcuucacggcggugcaugccaaguaucagaaacccuggcuggggaccgucgacuccagcgagguguacucuuggcuugauuccuuucugcuccugaugcuuggaggcauuccuuggcaggcuuauuuccaacgcguucugagcagcuccagcgccacauacgcccaggugcucuccuuccuggcugccuuuggcugucuggucauggcgaucccggcuauucucaucggggccauuggagccucuaccgacuggaaccagacagcuuauggccugcccgauccuaagaccacggaggaagccgacaugauccuucccaucgugcugcaauaccucugcccuguuuauauuagcuucuuugggcugggagcuguguccgccgcggucaugagcucugccgauuccagcauccuuucugcuagcuccauguucgccagaaauauuuaccagcugucuuuucggcagaacgcuagcgacaaggagaucgugugggucaugcgcauuacaguguucguuuuuggcgccuccgcgaccgccauggcucuccugacaaaaaccguguacgggcugugguaucucagcucugaucuggucuacaucgugauuuucccccagcuucuguguguucucuuugugaagggcaccaauacauauggagccgucgcuggcuacguguccgggcuguuccugagaaucacgggaggcgaaccguaucuuuaccuccaaccucugaucuuuuaucccggguacuacccugacgacaacggaauuuauaaucagaaauuccccuuuaagacccuggccauggugacaucuuuccucaccaacaucugcauuucuuaccuggccaaauaucuuuucgaguccggcacacugcccccuaagcucgauguuuuugacgcugucguggcgcggcacagcgaggaaaauauggauaagaccauccuggugaaaaacgagaauauuaagcuggacgaacuugcccucgucaaaccgcgccaguccaugacgcugucuagcacauucaccaacaaggaggcuuuucuggauguggacuccucucccgaagggagcggcaccgaggauaaucuccaauga

SEQ ID NO: 75860 - RNA, 1833 nt, Artificial Sequence
  derived and/or modified sequence opt5 from SLC5A8__Homo_sapiens__NP_666018
auggacacccccagaggcaucgggacauucguggucugggauuacguuguguuugccggaaugcuggugauuagcgcugccaucggcauuuauuacgcguucgcugggggaggccagcaaacguccaaggacuuucucaugggaggacggcgcaugaccgccgucccuguggcccugucucuuacagcuagcuucauguccgccguuaccgugcugggcacaccgucugaggucuauagauuuggcgcuaucuucagcauuuuugccuucaccuacuuuuucgugguugugaucuccgcggaagucuuucuccccguguucuauaaacuggggaucacaucuaccuacgaguaucuugaacugcgguuuaacaagugcgugcgccucuguggaacgguccuguucauuguucagaccauccuguacacaggcauugugaucuacgccccugcucucgcccugaaucaggugaccggguucgaucuuuggggagcugucguggccacaggcguugugugcaccuuuuauuguacgcucgggggacugaaagcggucauuuggacagacguguuccagguuggcaucaugguggccggcuuugcuagcgucauuauccaagccguggucaugcaagggggaaucuccaccauucugaacgaugcuuacgacggcgggagacuuaauuucuggaacuuuaaucccaacccucugcagcggcacacauucuggaccaucauuaucggaggcaccuuuacauggacgagcauuuauggggugaaucagucucagguucagcgcuacaucuccugcaagagcagauuccaggccaaacucucucuguauaucaaccuggugggacucugggccauucugaccuguuccgucuuuugcggccuugcucuguacagccgguaucaugauugugaccccuggacagcgaagaaggugucugccccugaucagcucaugccguaccugguucuugacauccugcaagauuaccccggccucccugggcuguucguggcuugcgccuauuccggaacccugagcacagucuccucuagcauuaaugcccucgcugccgugaccguggaggaccugaucaaacccuacuuucgcucccuuagcgaaagaucucuguccuggauuagccagggcaugucuguugucuauggggcgcucuguaucggaauggcugcccuggccagccuuaugggcgcucugcuccaggccgcucuguccguguucgggauggugggcggaccucugaugggccucuuugcccuggggauccuuguccccuucgcgaacucuauuggagcccuggugggccucauggcuggguucgccaucagccuguggguuggaauuggcgcucaaaucuacccgccucugcccgagcggacgcuuccucuccaccuggauauucaggggugcaauuccacauauaacgagaccaaucugaugaccacaaccgaaaugcccuuuacaacgagcguguuccagaucuacaacguccagcgcacaccccucauggacaauugguauucucuguccuaccuuuacuuuagcaccgugggcacccugguuacacuccugguggggauucuggucucucuuuccaccggcgggagaaagcaaaaccucgacccucgguauauccugacgaaagaggauuuccugagcaacuuugacaucuucaagaaaaagaagcaugugcucuccuacaaaucucacccgguugaagauggaggcaccgacaaucccgccuuuaaccauauugagcugaauagcgaucaguccgggaagucuaacggaacacgccuuuga

SEQ ID NO: 75861 - RNA, 1899 nt, Artificial Sequence
  derived and/or modified sequence opt5 from SLC6A11__Homo_sapiens__NP_055044
augaccgccgagaaggcucugccccucggcaacgggaaagccgcggaagaggcuagagaaagcgaggccccuggaggcgggugcuccucuggaggcgccgcuccggcccggcacccccgcgugaagagagacaaagcuguccaugaacgggggcacuggaauaacaagguugaguucgugcugagcguggccggagagaucauuggccuuggcaaugucuggcgcuuuccuuaccuguguuauaaaaacgggggaggcgcguuccucauccccuacgugguuuucuuuauuugcugugggaucccuguguuuuuccuggaaacagcccuuggacaguuuacguccgagggcgggauuaccugcuggagaaaggucuguccccuguucgaaggaaucggcuaugcuacacaagugaucgaggcccaucucaauguuuacuauauuaucauucuggcuugggccaucuuuuaccugucuaacugcuucaccacagagcucccuugggcgaccuguggccacgaauggaauacagagaacugcguggaauuucagaagcugaaugucagcaacuauucccaugugucucuucagaaugccaccagcccggugauggaguucugggaacaccggguccuggcuauuuccgaugggaucgagcacauuggaaaccuccgcugggagcuggcccuuugucugcucgcugccuggacgaucugcuacuuuuguaucuggaaaggcaccaagagcacagggaaaguuguguacgugaccgccacauuccccuauauuaugcugcugauccuccugauuagaggagucacccuuccuggcgcuucugaagggaucaaguucuaccuguaucccgaccucucccggcugagcgauccucagguguggguugacgcgggaacgcaaaucuuuuucucuuacgccauuugccuuggcugccugacagcucucggcuccuauaauaacuacaauaacaacuguuaucgcgauugcaucaugcuguguugccugaauagcgggaccucuuuuguggccggauucgccaucuuuuccguccucggcuucauggcuuacgagcagggggugcccauugccgaaguugcggagagcggaccgggccuggcuuuuauugccuacccuaaagccgugacaaugaugccccuuuccccucugugggcuacccucuucuuuaugaugcugaucuuccuugggcuggacucucaguuugucuguguggaaagccucgucaccgccgugguugauauguaucccaagguguucagacggggcuaccgcagagagcugcugauucucgcucuguccgucaucagcuauuuucuuggacuggugaugcucacagagggcgggauguacaucuuccagcuguucgacucuuaugccgcguccggaaugugccugcuuuuuguugccauuuucgaauguaucugcauuggcuggguguacgggagcaaccgguuuuaugauaauaucgaggacaugauuggauacagacccccuucucucaucaagugguguuggaugauuaugacgccgggcaucugcgcugggaucuucaucuuuuuccugauuaaauacaagccccugaaauauaacaauauuuacaccuauccugccuggggcuacggaaucggcuggcucauggcucugagcuccaugcuuuguauuccccuguggaucugcaucacagucuggaagaccgaagggacacucccugagaaacugcaaaagcugaccacgcccucuacagaucuuaaaaugcgcggaaagcucggcgugagcccgcggauggugaccguuaacgacugcgaugccaagcugaaauccgacgggaccauugcggccaucacagaaaaggagacccauuuuuga

SEQ ID NO: 75862 - RNA, 1845 nt, Artificial Sequence
  derived and/or modified sequence opt5 from SLC6A12__Homo_sapiens__XP_005253803
auggacggcaagguggccguccaggagugcgggcccccugcuguuagcugggugccggaagagggagaaaaacuggaucaagaggacgaagaucaggugaaggacagaggccaguggaccaacaaaauggaguucguccucuccguggccggggagaucauuggacugggcaauguuuggcgguuucccuaccuuuguuauaagaacgggggaggcgcguucuuuaucccuuacuucauuuucuucuuugugugcggcauccccgucuucuuucuggaaguggcucucgggcaguauacaucucaaggaagcguuacggccuggcgcaaaauuuguccucuguuccagggcaucgggcuugccuccguggucaucgagucuuaccugaauguguauuacauuaucauucucgcuugggcccuguuuuaucuguucagcuccuuuaccucugaacuccccuggacaaccugcaacaauuucuggaacacagagcacuguaccgauuuccugaaucauagcggagcuggcacagugaccccuuuugagaacuucacguccccggucauggaauuuugggagagacggguucuugggaucaccagcggcauucacgaccugggaucucuccgcugggaacuggcccuuugccugcuccuggcgugggugaucuguuacuucugcauuuggaagggcgugaaguccacagggaaagucguguacuuuaccgccacauuccccuaucugaugcucguuauccugcuuaucagaggagugacccugccuggcgcuuaccaggggauuaucuauuaccucaagcccgaucuguuucggcuuaaagacccucaggucuggauggaugccggaacgcaaauuuucuuuagcuucgcuaucugucagggcugccugacagcccucgggucuuauaauaaguaccauaacaauuguuauaaagacugcauugcgcugugcuuucugaacuccgccaccagcuucguggcuggauuuguuguguucucuauccucggcuucaugucccaggagcagggcguccccaucagcgaaguggccgaguccgggccgggacuggcuuuuauugccuucccuaaggccgucacaaugaugccccuuucucaacuguggagcugucucuuuuucaucaugcugauuuuucuuggccuggauucccaguucgugugcguugagugucucgugaccgcuagcaucgacauguuuccucgccagcugagaaagucugggcggcgcgaacugcucauucugaccaucgcggucaugugcuaccuuaucggacuguuccucgugacagagggcgggauguacauuuuucaacuguucgauuauuacgccuccagcggcaucugucugcuuuuucucucucuguucgaaguugugugcauuagcugggucuauggagcugacagauuuuacgacaauaucgaggauaugauuggcuaucggcccuggccccuggugaaaaucuccuggcucuuucugacgccugggcuuugucuggccaccuuccucuuuucucugagcaaguacacaccgcugaaauauaacaauguguacguuuaucccccuuggggauacuccauuggcugguuccuugcccucagcucuauggucugcgugccccuguuuguggucaucacccugcucaagacacgcgggccuuucagaaaacggcugcgccagcuuaucacccccgacuccagccugccgcagccuaagcagcaccccugucucgauggaucugcuggcagaaacuuugggccuucccccacgcgggaaggccugauugccggagagaaagagacacaucuguga

SEQ ID NO: 75863 - RNA, 1533 nt, Artificial Sequence
  derived and/or modified sequence opt5 from SLC6A13__Homo_sapiens__NP_001177926
auggacagcagaguguccggcaccacaucuaacggggagacgaagcccgucuacccuguuauggagaaaaaggaagaagauggaacccuggagcggggccacuggaauaacaaaauggaauuugugcucagcguggccggggagaucauuggacugggcaaugucuggcgcuuuccguaucuuugcuacaagaacgggggagagcauuguauggaguuccagaaaacaaauggcucccugaacggcaccucugaaaaugcuacaagccccgugaucgaauuuugggagagacggguucucaagauuuccgacgggauccaacaccugggagcccuucgcugggagcuggcgcucugccugcugcucgcuugggugauuuguuauuucugcaucuggaagggcgucaaaucuaccgggaaggugguuuacuuuacagccaccuucccuuaucugaugcuugugguccugcucaucagaggagugacgcugcccggcgccgcucaggggauucaguuuuaccuuuauccuaaccugacccggcucugggauccccagguguggauggacgccggaacacaaaucuucuuuagcuucgcuauuugucugggcugccugaccgcccucggcuccuacaauaaauaccauaacaauuguuaucgcgauugcaucgcgcuguguuuucuuaacagcgggacaucuuucgucgccggauuugcuauuuucuccauccugggcuucaugagccaggaacaggggguuccuauuucugagguggccgaauccggaccgggccucgcuuuuaucgccuaccccagagcgguggucaugcugccuuucagcccccuuugggccugcuguuucuucuuuauggugguucugcucgggcuggacucucaguucgugugcgucgagucccuggugaccgcucucguugauauguauccucacguguuucggaagaaaaaucgcagagaaguccugauccuuggagugagcgucguguccuuccugguuggccucauuaugcugacggagggcgggauguacguguuucaacuuuucgacuauuacgccgcuucuggaaugugccugcucuuugucgccaucuucgagagccuguguguggccuggguuuauggcgcuaagcgguuuuacgauaacauugaagacaugaucggguaccgccccuggccgcugauuaaguauugcuggcuuuuccugaccccugcgguguguaccgccacauuccucuuuucccugaucaaauacacaccccucaccuauaauaagaaauacacauauccuugguggggagaugcucugggcuggcugcuugcccucagcucuauggucugcauccccgccuggucccuguacagacuggggacgcucaagggccccuuccgggagcgcauuagacagcugauguguccugcugaagaccuuccgcagcggaaccccgccggaccuagcgcgcccgcuaccccuagaacaucucugcuccgccugaccgagcuggaaagccauugcuga

SEQ ID NO: 75864 - RNA, 1929 nt, Artificial Sequence
  derived and/or modified sequence opt5 from SLC6A14__Homo_sapiens__NP_009162
auggacaagcugaaaugccccagcuucuuuaaguguagagagaaagaaaagguguccgccucuagcgagaacuuccacgucggcgaaaaugaugagaaccaggaccgggggaauugguccaaaaagucugauuaccuccugagcaugaucggauaugcuguuggccuugggaacguguggcgcuuuccuuaccugaccuauuccaauggaggcggggccuuccucauuccguacgcgaucaugcuggcucuugccggacugccccucuuuuuccuggaaugcucucugggccaauuugccagccucggcccuguguccgucuggcggauucugccccuuuuccagggggugggaaucacaaugguucugauuagcaucuuugugacgaucuauuacaacgucauuaucgcuuauucucucuacuacauguucgccuccuuucagagcgagcugccuuggaagaauuguucuuccuggagcgacaaaaacugcucuagaucccccauugugacccauuguaauguuagcacagugaacaagggcauccaggagauuauccaaaugaauaaauccugggucgauauuaacaauuuuaccugcaucaacgggucugaaaucuaucagccuggacagcuuccgagcgagcaguacuggaauaagguggcucugcaacgcuccagcggcaugaacgaaacaggggugauugucugguaucucgcccugugucugcuccuggcguggcuuaucguuggagccgcucuguucaaaggcauuaagucuuccggcaaggugguguacuucaccgcccucuuccccuaugucgugcugcuuauccugcucguuagaggggcuacacuggagggagccagcaaaggcauuucuuacuauaucggggcgcagagcaacuuuaccaagcugaaagaggccgaaguguggaaggacgcugccacgcagaucuucuacucccucucugucgcuuggggaggccugguggcccuuagcuccuacaauaaauuuaagaacaauugcuucagcgaugccauuguugugugucugaccaacugccucacaucugucuuugcuggguucgcgaucuuuuccauucugggacacauggcccauaucagcggcaaagaggugucucaggucgugaaguccggcuucgaccuugcuuuuauugccuauccugaagcccuggcucaacuccccgggggaccuuucuggagcauccuguuuuucuuuaugcugcucacccugggccuugauucccaguucgccucuaucgagacaauuaccacgacaauccaggaccuguuccccaagguuaugaaaaagaugcgggugccgauuacccucggguguugccugguccuguuucuucucggacuggugugcguuacacaagcgggcaucuacugggugcaccugauugaucauuucugugcuggguggggcauccucauugccgccauccuggaacuugucggaaucauuuggaucuauggcgggaaucgcuuuauugaggacaccgagaugaugaucggagcuaaaagauggauuuucuggcugugguggcgggccugcugguuugugaucaccccuauccuccugauugcuaucuucauuuggagccuggugcaguuucaccgccccaacuacggcgccaucccuuaucccgauuggggaguugcgcuugggugguguaugauugucuucugcaucaucuggauucccaucauggccauuaucaagauuauccaggcuaaaggcaauaucuuucagagacucauuuccuguugccggccugccucuaacugggggccguaccuggaacaacaccgcggcgagagauauaaggacaugguggaccccaagaaagaagcugaucaugagaucccuacagugagcggaucccggaagcccgaauga

SEQ ID NO: 75865 - RNA, 870 nt, Artificial Sequence
  derived and/or modified sequence opt5 from SLC6A15__Homo_sapiens__NP_060527
augcccaagaacagcaaaguggucaagagagagcuggacgaugacguuaccgaauccgugaaagaucuccugucuaaugaggacgccgcugaugacgccuucaagacaagcgaacuuaucguggauggccaggaggaaaaagacacggaugucgaggagggguccgaaguggaggacgaacggccugcguggaacucuaagcugcaauacauucucgcucagguuggauuuagcgugggccuggggaaugucuggcgcuucccguaucuuugccagaagaacggaggcggggccuaccugcuccccuaucugauccugcucauggugauuggaaucccucuguuuuuccuugagcuguccguuggccagcggauuagacgcggcucuaucgggguguggaauuacaucagccccaaacucggaggcauuggguuugccuccugugucgugugcuauuucguggcucuguacuauaacgucaucauuggauggagccuguuuuacuucucucaauccuuucagcagccucuucccugggaucaguguccucucguuaagaaugccagccacaccuucguggagccggaaugcgagcaaucuuccgcuacaaccuacuauugguacagagaagcccugaacaucucuagcuccauuagcgaguccggcgggcugaauuggaaaaugacaaucugucuccuggcggccugggugauggucugccuugcuaugauuaagggaauccagucuagcggcaaaguguccaugcuggaacccuuucucauccugcuuauuaccaucagcggcuucauuccucugucuaacuccguuacagacuuuugugggcagaucacccauaauacgagcuucuga

SEQ ID NO: 75866 - RNA, 1887 nt, Artificial Sequence
  derived and/or modified sequence opt5 from SLC6A18__Homo_sapiens__NP_872438
auggcccacgcucccgagccugacccggccgcgugcgaucugggcgacgaaagacccaagugggauaacaaagcucaguaccuccugagcuguaccggguucgccgugggacuuggcaauaucuggcgguuuccuuaucugugccaaacauacgggggaggcgccuuccucauucccuaugucaucgcucugguuuuugaggggauuccuaucuuccauguggaacuugccauuggacagcgccugagaaagggcuccgugggcgucuggacggcuaucucucccuaccucagcggggugggacugggcuguguuacccuguccuuucucaucucucuguauuacaacacaauuguggccuggguccuuugguaucugcucaauagcuuccagcacccucugccgugguccucuugucccccugaccuuaaccggaccggguuuguggaggaaugccagggaagcuccgcgguuagcuacuucugguaccgccaaacacugaauaucaccgccgauauuaacgacucuggcuccauccagugguggcuccugauuugccuggcugccagcugggcuguggucuauaugugugugaucagagggauugagacaaccggaaaagugaucuacuuuacggcccucuuccccuaucugguccuuaccaucuuucugauucggggccucacacugccuggcgcgaccaaggggcuuaucuaccuguucacacccaauaugcauauucuccagaacccgcgcguuuggcuggaugccgcuacccagaucuuuuucucucugucccucgccuucggaggccacauugcuuuugccagcuauaauucuccuagaaacgacugccaaaaagaugccguggugaucgcucuggucaaucggaugacgucccuuuacgcgagcaucgccguguucuccguucugggguuuaaggcuacaaacgacuaugagcauugucucgaucgcaauauucugucucuuaucaacgacuucgauuuucccgaacagagcauuuccagagacgacuacccugccgugcugaugcaccucaaugccaccuggcccaagcgggucgcucagcugccccugaaagccugccuccuggaggauuuccuugacaagagcgcgucuggaccuggccuggcuuuugugguuuucacagaaaccgaucuccacaugccgggggcccccgugugggccaugcuguuuuucggaaugcuguuuacccuuggccucuccacaauguucggcacggucgaggcugugaucaccccucugcuggacgucggggugcucccccgcuggguuccuaaagaggcccugacaggacuugugugucuggucugcuuucucagcgcuaccugcuucacacugcagucuggcaacuacuggcuggaaauuuucgauaacuuugccgcgagccccaaucuucucaugcuggccuuccuggaggugguugggguggucuauguguacggaaugaagagauuuugugacgauaucgcuuggaugaccggccggcgcccguccccuuauuggagacucacguggcgggugguuucuccccugcuucugacaaucuucgucgccuacauuauccuccuguuuuggaaaccucugagauauaaggcuuggaaccccaaguacgaacuuuucccuagccgccaagagaaacucuaucccgggugggcccgggcggccugcgugcugcugucccuccugccggugcuuugggucccuguggcugcccuggcucagcuccugaccagacgccggagaaccuggcgcgaccgggaugccagacccgacacagauaugcgccccgacaccgacacacggccugauacggacaugagaccggauaccgacaugcgcuga

SEQ ID NO: 75867 - RNA, 1905 nt, Artificial Sequence
  derived and/or modified sequence opt5 from SLC6A19__Homo_sapiens__NP_001003841
auggugagacugguccuccccaacccuggccuggacgcccggaucccgagccuugcugagcuggaaaccauugagcaggaagaggccuccucucgccccaagugggauaauaaagcgcaauacaugcucacaugccugggguucuguguuggacuuggcaacguguggagauuuccuuaucugugccagagccacgggggaggcgcuuucaugauccccuuucucauucugcuggugcucgaagggaucccucugcuuuaccuggaguucgccauuggacagcggcuccgcagaggcucccugggcgucuggucuagcauccaucccgcccuuaaggggcugggacucgcuuccaugcugacgucuuuuauggugggccuguauuacaauaccaucauuagcuggaucaugugguaucucuucaacuccuuucaggagccucugccguggagcgacuguccccuuaaugaaaaccaaacaggguacguugaugagugcgcccggucuuccccuguggacuauuucugguaccgcgaaacccugaauauuagcacaucuaucuccgauagcggaucuauucagugguggaugcuccugugucuugcuugcgccugguccguccuguacauguguaccaucagaggcauugagacaaccgggaaagcgguguauaucacgagcacccuccccuacguugugcugacaaucuuucugauucggggacucacccugaagggcgccacaaacggcaucgucuuccuuuuuaccccuaaugugacggagcuggcucagcccgacacauggcucgaugccggggcucagguguucuuuuccuucucucuggccuucggaggccuuauuagcuuuuccagcuauaacucuguccacaauaacugcgaaaaagacuccguuaucgugagcauuaucaauggguucaccucuguguacgucgcgaucgugguuuauagcgugauuggauuucgcgccacacaaagauacgaugacuguuucuccaccaacauccugacccucauuaauggcuuugaucugccggaggggaacgucacacaggaaaacuucguggacaugcagcagcggugcaaugcuucugauccugccgcuuaugcccaacugguuuuucagacgugugacaucaacgccuuccucagcgaggcuguggaaggaaccggccuggcguuuauugucuucacagaggccaucaccaagaugccccuuuccccucuguggagcgugcucuuuuucaucaugcuguuuugccugggccuuucuuccauguucgggaauauggagggagucgugguuccccuccaggaccugcgcgugauucccccuaaguggccgaaagaaguccugacaggccucaucugccuggggaccuuccuuauuggauuuaucuucacgcugaacagcggccaauacuggcucucucugcuggauuccuacgcugggagcauuccccuucucaucauugccuuuugugagauguucuccgugguuuauguguacggcgucgacagauuuaauaaggauaucgaauuuaugaucggacauaaaccuaacauuuucuggcaagugacauggcgggugguuucuccccugcugaugcucaucauuuuccuguuuuucuuugucguggaggugagccaggaacuuaccuauuccaucugggacccuggcuacgaggaguuccccaagucucagaaaauuagcuauccgaauugggucuacgugguuguggucaucguggccgggguuccuucccugaccauccccggauaugcuauuuacaagcucauccgcaaccacugccagaagccuggcgaucaucaggggcuggugagcacacugucuaccgccuccaugaauggagaccuuaaauacuga

SEQ ID NO: 75868 - RNA, 1800 nt, Artificial Sequence
  derived and/or modified sequence opt5 from SLC6A1__Homo_sapiens__NP_003033
auggccaccaacggcagcaagguggcugacgggcagaucuccacagaggucucugaagcccccguugcgaaugauaaaccuaagacgcugguggugaaaguccaaaagaaagcugccgaccucccggauagagacaccuggaagggacgguucgauuuucugaugagcugcgugggcuacgccauugggcuuggaaacguuuggcgcuuccccuaucuguguggcaagaaugggggaggcgcuuuucucaucccuuacuuccugacacuuauuuuugccggcgugccccuguuccuccuggagugcucccuggggcaguauaccucuaucggaggccucggggucuggaaacuggcuccuauguuuaagggagugggccuugccgcggccguucugagcuucuggcucaacauuuacuauaucgugaucauuuccugggcuaucuacuaucuguacaauucuuuuacaaccacacuucccuggaaacagugugacaacccuuggaauaccgauagaugcuucagcaacuacuccauggucaauacgaccaacaugacaagcgccgugguggaauuuugggagcggaauaugcaccagaugaccgacgggcuggauaagccgggacaaauucgcuggccccucgcuaucacacuggccauugcguggauccuggucuauuucuguauuuggaaaggcguuggcuggaccgggaaggugguguacuuuucugccacguauccuuacaucaugcucaucauucuguucuucagaggagucacacuucccggcgcuaaggaagggauccuguuuuauauuaccccuaacuuccggaaacucuccgacagcgagguguggcuggaugccgcuacacagaucuuuuucucuuacggacuuggccuggggucccucauugcccugggaagcuauaauucuuuucauaacaauguuuaccgcgacuccaucaucgugugcuguauuaacagcugcaccuccauguucgccggcuuugucaucuucucuauugugggcuuuauggcucacguuaccaagagaagcaucgcggauguggccgcuuccgggcccggacuggccuuccucgccuacccggaggcugucacacagcugccuauuagcccccuuugggccauccuguuuuucucuaugcuccugaugcuuggcaucgacucccaguuuuguacgguggaaggguucauuaccgcgcuggucgacgaguauccucggcuccugcgcaacagacgggaacuguucaucgcugccgugugcauuaucagcuaccucauuggacugucuaauaucacacaaggcgggauuuauguuuuuaaacuuuucgauuacuauagcgccuccggcaugucucugcucuuucugguguucuuugagugugucagcaucuccugguucuacggagugaaccgcuuuuaugacaauauccaggagaugguuggcagcagacccugcauuugguggaagcugugcuggucuuucuuuacccccaucauuguggcuggggucuucaucuuuuccgccgugcagaugacaccucuuaccaugggaaacuacguguucccgaaauggggccaggggguuggauggcucauggcucugagcucuaugguccugauucccggcuacauggccuauauguuucucacgcugaaggggucccuuaaacaacggauccaggugauggugcagccuagcgaagauaucguccgccccgagaauggcccugaacaaccccaggcgggauccucuacaagcaaggaggccuacauuuga

SEQ ID NO: 75869 - RNA, 1779 nt, Artificial Sequence
  derived and/or modified sequence opt5 from SLC6A20__Homo_sapiens__NP_064593
auggagaaggcccggccccugugggcuaacagccuccaguucguguuugccugcaucuccuacgcggucggccuggggaauguuuggcgguucccuuaucuuugucaaauguacggaggcgggucuuuucuggugccguauauuaucaugcucauuguggaaggaaugccccugcuuuaccuggagcucgcugucggccagcgcaugagacaggggagcaucggagccuggcggaccauuuccccuuaucugucuggcgugggcguugccagcguggucguguccuucuuucugucuauguacuauaacguuaucaaugcuugggccuucugguaccucuuucacagcuuccaggacccccugccuugguccgugugcccccuuaacgggaaucacacaggauacgaugaagagugugaaaaagcuagcucuacgcaauauuuuugguaccgcaagacccugaacaucuccccuagccuccaggagaauggcgggguccagugggagccggcccugugccuucugcucgcguggcuggugguguaucuguguauucucagaggaacagaaucuaccggcaaagucguuuacuucacagccucccugcccuauugcgugcuuaucauuuaccugauccgggggcucacccugcacggagcuacaaacggccuuauguauauguuuaccccuaagauugagcagcuggccaaucccaaggcuuggaucaacgccgcgacgcaaauuuucuuuagccucggccugggguucggaucucugaucgccuucgcuuccuacaaugaaccuagcaacaauugucagaaacaugccaucauugugucccucaucaacucuuuuaccagcauuuucgcuuccaucgucacauuuagcauuuacggcuucaaggccaccuuuaauuaugagaacugccugaaaaaggugucucuucugcucacaaacaccuucgaccuggaggauggguuucuuacggccuccaaucuggaacagguuaaaggauaccucgcuagcgcguaucccucuaaguacagcgagauguucccgcagaucaaaaacuguucccuggaaucugagcuggacacagccgugcaaggcaccgggcucgcuuuuaucgucuauacagaagccauuaagaauauggaggugagccagcugugguccguucuuuacuucuuuaugcugcucaugcugggaaucggcagcaugcugggcaacaccgccgcuauucuuaccccucucacagauucuaagaucauuuccagccaucugcccaaagaggccaucucugggcuggugugccucgucaauugugcgaucggaaugguguucacgauggaagcuggcaacuauugguuugacauuuucaaugauuacgccgccacccugucccuucugcucaucguccugguggagacaauugcuguuugcuacguguaugggcugcgcagauucgaaagcgaccuuaaggccaugaccggacgggcugucuccugguacuggaaagugaugugggccggcguuucuccucuccugaucgugagccuguuugucuucuaucucuccgauuacauucugacagggacccuuaaguaucaggcgugggacgccucucaaggccagcuggugacgaaagauuaccccgcuuaugcccucgcugugaucggacugcugguugccagcuccacaaugugcauuccccuugcggcccucggcaccuuuguccagcgcagacugaagagaggggacgcugauccuguggccuga

SEQ ID NO: 75870 - RNA, 1854 nt, Artificial Sequence
  derived and/or modified sequence opt5 from SLC6A2__Homo_sapiens__NP_001165972
augcugcucgccagaaugaacccccaggugcaaccugagaauaacggcgcugacaccgggccggaacagccccugcgggcccgcaagacagcggagcuucuggucguuaaagaaagaaauggagugcagugccuccuggcuccucgggauggcgacgcccagccccgcgagacgugggggaagaaaaucgauuuccuucugagcguggucggauuugccguggaccucgcuaacguuuggagauucccuuaccuguguuauaagaauggcgggggagccuuucugauucccuacacccucuuccugaucauugcuggcaugccucuuuucuauauggaacuggcccucggccaauacaaccgggagggggcggccacaguguggaaaaucugcccguucuuuaagggagucggcuaugcugugauucugaucgcccuuuacguuggguucuauuacaaugugaucauugcuuggucccuguacuaucucuuuucuagcuucacccugaaccugcccuggacagauuguggacacaccuggaacuccccuaauugcacagaccccaagcuccugaauggcucuguccuugggaaccauaccaaauacagcaaguauaaauuuacgccugccgcggaguucuacgaacgcggagugcugcaccuccaugaguccucuggcauccacgauauuggccugccccaguggcagcuucugcucugucugaugguggucguuaucgugcuguauuuuagccucuggaagggggugaaaaccuccggaaaggucguguggauuacagccacccugccguacuucguucuuuucgugcugcucguccauggcgugacacugccuggggcuagcaauggaaucaacgccuaucuucacauugacuuuuacagacugaaggaagcuaccguuuggaucgaugccgccacgcagaucuucuuuucucucggcgcuggguucggagugcugauugcguuugccuccuacaauaaauucgacaacaacugcuaucgggaugcucugcucacaagcucuaucaauuguauuaccuccuuugucagcggcuucgccaucuuuucuauucugggcuacauggcccacgagcauaaggugaacaucgaggacgucgcuacagaaggggccggacuuguguucauccuguaucccgaggcgauuuccacccucagcggcuccaccuuuugggcuguuguguucuuugucaugcugcuggcccuugggcucgauucuagcaugggaggcauggaagccgugaucacagggcuggcugacgacuuccaaguucugaaacgccacagaaagcucuuuacguuuggcgugaccuucuccacauuucugcuugcccuguucugcauuaccaaaggaggcaucuacguccucacacugcuggauaccuuugcugccgggacgagcauucuuuucgcggugcucauggaggccaucggagugucuugguuuuauggcguugaccgguucuccaaugauauccagcagaugaugggguuucgcccuggacuguacuggagacuguguuggaaguucgucagccccgcuuuucuccuguucgugguggucgugucuauuaucaacuuuaaaccccuuacauaugacgauuacauuuucccuccgugggccaauuggguuggcugggggaucgcucugagcuccauggugcucguccccauuuacgugaucuauaaguuccugucuacccagggcagccugugggaacggcuugccuacggaauuaccccugagaacgagcaucaccucguugcgcaacgcgacaucagacaguuucagcugcaacacuggcuggccaucuga

SEQ ID NO: 75871 - RNA, 1893 nt, Artificial Sequence
  derived and/or modified sequence opt5 from SLC6A4__Homo_sapiens__NP_001036
auggagaccacaccccugaacagccagaagcaacucuccgccugcgaagacggcgaggauugucaggaaaauggggugcugcagaaagucguuccuacgccgggagacaagguggagucuggccagaucagcaacggguacuccgcugugcccucuccuggagccggcgaugacaccagacacagcauucccgcgacaaccacaacccuugucgcugaacugcaucaaggggagcgggagacauggggaaagaagguggauuuccuccuguccguuaucggcuaugccguggaccuuggcaaugucuggcgcuuuccuuacauuugcuaucagaacgggggaggcgccuuccugcuccccuacaccaucauggcuauuuuugggggaaucccucuguucuauauggaacuggcccucggccaguaccacagaaauggguguaucucuauuuggcggaaaaucugcccgauuuuuaagggaaucggcuaugcuauuuguaucauugccuucuacaucgcgagcuacuauaacacgaucauggccugggcucuguacuaucuuauuuccagcuuuaccgaucagcugcccuggacaucuugcaaaaauuccuggaacaccggcaauuguacaaacuacuucagcgaggacaauaucaccuggacgcuccauucuacauccccugccgaagaguuuuauacccgccacgugcugcaaauucauagaagcaaagggcuucaggaucugggaggcaucucuuggcagcucgcucugugcauuaugcugaucuucacaguuaucuacuuuuccauuuggaagggggugaaaaccagcggaaaggucgugugggugaccgccacauuccccuauaucauucucuccguccugcuuguucggggcgcgacgcugccuggggccuggcgcggagugcucuuuuaccugaaacccaacuggcagaaacuucuggagaccggcguguggaucgacgcugccgcucaaauuuucuucucucucggcccgggguuuggaguccugcuggccuucgccagcuacaauaaguuuaacaauaacuguuaucaggaugcucucgugacauccguugugaacugcaugaccagcuucgucucuggcuuugugaucuucacaguucugggguacauggcggaaaugagaaaugaggacguguccgaagucgccaaggaugcuggaccuagccuucuguuuaucaccuaugccgaggccauugcuaacaugcccgccucuacguucuuugcgaucauuuucuuucucaugcugaucacacuuggccuggacagcaccuucgcugggcucgaaggcgugauuaccgccguccuggacgaguuuccucacgugugggccaagcggcgcgagagauucguucuggcuguggucaucacauguuucuuuggaucccucgugacccugacauucggcggggccuacguugugaaacuucuggaagaguaugcuacgggacccgccguccucaccguggcgcugauugaagccguggcuguuucuugguuuuacggcaucacacaguucugccgggaugucaaggagaugcugggguuuagccccggaugguucuggcgcaucugcuggguggccauuuccccucuuuuucuccuguucaucauuuguagcuuucugaugucuccgccccaacucagacuguuccaguauaauuacccuuacugguccaucauucuuggcuauugcaucgggaccagcucuuuuaucuguauucccacauacaucgcuuaucggcugauuaucaccccuggcacguucaaagaacgcauuaucaaguccaucacccccgagacaccgaccgagauuccuugcggagacaucagacucaacgccguguga

SEQ ID NO: 75872 - RNA, 2394 nt, Artificial Sequence
  derived and/or modified sequence opt5 from SLC6A5__Homo_sapiens__XP_011518775
auggacugcagcgcccccaaggagaugaacaaacugccugcuaauuccccggaagccgcggcugcccagggccaccccgaugggccuugugcccccagaaccucuccugagcaagaacuccccgcugccgcugccccuccgcccccucgggugccccgcagcgcguccacaggagcccagacguuccagucugcugacgccagagcuugcgaggccgaacggccuggcgucgggagcuguaagcuguccucuccccgcgcgcaggccgcuagcgccgcucuuagagaucugcgggaggcccaaggagcccaggcuuccccgccucccggcagcucugggccuggaaacgcgcuccauugcaaaauccccuuucugcgcggccccgagggcgacgccaauguuuccguggggaagggaacccuugaaagaaacaauacaccuguggucggcugggugaacaugagccagucuaccguugugcuggcuacagaugggauuaccuccguccucccgggaagcguggccacaguugccacccaggaggacgaacaaggcgaugagaauaaagcucgggggaacuggucuuccaagcuggacuucauccugagcauggugggauacgccgucggccucggcaauguguggcgcuuucccuaucuggcguuccagaacgggggaggcgcuuuucuuauuccuuaccugaugaugcucgcccuggccgggcuucccaucuucuuucuggaggugucccucggacaguucgcuucucagggcccugucagcguuuggaaggccauucccgcucugcaaggguguggaaucgccaugcugaucauuuccgugcucaucgcgauuuauuacaaugugaucauuugcuauacgcuguuuuaccuuuucgccagcuuugucucugugcugccguggggcuccuguaacaauccuuggaacacccccgaaugcaaagauaagacaaaacuccugcuugacagcuguguuaucucugaucacccuaagauucagaucaaaaauagcaccuucugcaugacagcuuaucccaacgugaccauggucaacuuuacgucccaggccaauaagacauucgugucuggcagcgaggaauacuucaaguacuuuguucugaaaaucuccgcugggauugaguauccuggagaaaucagauggccccucgcccugugucuguuccucgcgugggugauugucuacgccagccuggcuaagggcaucaaaaccucugggaagguggucuauuuuacagccaccuucccguacgugguucuugugauucugcucauccggggagucacccugccuggcgcuggggccggcaucugguauuuuauuacacccaaaugggagaaacuuacggacgccaccguguggaaggaugcugcgacacaaaucuucuuuucccugagcgccgcuuggggaggccucauuacccugucuuccuacaacaaguuccauaauaacugcuaucgcgacacacugaucguuaccugcacgaauagcgccacauccauuuuugccggguucgugaucuuuucugucaucggauucauggcuaacgagagaaaggugaauauugaaaacguggccgaccagggccccgggaucgcguuuguugucuacccugaggcucucacccggcugccgcuuagccccuucugggccauuaucuucuuucugaugcuccugacccugggacuugauacaauguucgccaccauugaaacaaucgugacguccauuucugacgaguuuccuaaauaccuccgcacccacaagcccguguucacacugggcuguugcaucugcuuuuucaucaugggguuuccuaugauuacccagggcggaaucuauauguuccagcuggucgauacauacgcugccagcuaugcgcucgugauuaucgcuauuuuugaacugguuggcaucuccuacguguaugggcuucaaagauucugugaggacaucgagaugaugauuggauuucagcccaauaucuucuggaaagucuguugggccuuugugaccccuacgauucugaccuucauccucugcuucagcuuuuaccagugggaacccaugacauauggcucuuaccgguacccgaacugguccaugguucugggguggcugaugcuugccuguagcgugauuuggaucccuaucauguucgucauuaagaugcaucucgcucccggaagauuuaucgagcgccugaaacuggugugcucuccucagcccgauuggggcccguuccucgcccaacacagaggggaacgguauaagaauaugauugacccucugggcaccuccagccuuggacugaagcuccccguuaaagaucuggagcugggcacacaguguuga

SEQ ID NO: 75873 - RNA, 2166 nt, Artificial Sequence
  derived and/or modified sequence opt5 from SLC6A6__Homo_sapiens__NP_001127839
augggcgacgccgagagcugccugcucagacagcaaacccgggaagugcgcaagaaaccccugaucaacuacagauuccuucgggcugccgcgaaugcugagccucgcgggccgcaggcccagagaacauccugugccaagcgggaaugcggagcuuuuacgcagcgcgucagagagcgggccggccgccaacccccugcugggggaaccagacacucucgggccgaacgcggcagacggcgcagccaucccagaucccggacaagaaccacagcgcugcuccgcucuagccagaccaaagagauggccacaaaggagaaacugcagugucuuaaggauuuccacaaggacauucugaaaccuucccccgggaagucuccuggaacccggccggaagaugaggcugaaggcaaacccccucagagagagaaguggagcuccaaaaucgacuuuguucucagcguggccggcggguucgugggacugggcaacgucuggcgcuuucccuaucugugcuacaagaaugggggaggcgcuuuccucauuccuuauuuuaucuuccuguuugggucuggacuucccguguucuuucuggagauuaucaucggccaauacacguccgaaggcgggauuaccuguugggagaagaucugcccccucuucagcggaauuggcuaugccucuguugugaucgucucccugcuuaacguguacuauauuguuauccuggcgugggccacauacuaccucuuucagagcuuccagaaagaacugccuugggcucauuguaaucacucuuggaacaccccgcauugcauggaggauacaaugcggaagaauaaauccguguggauuaccaucagcuccacgaacuucacaucuccugucaucgaauuuugggagagaaaugugcugagccucucccccgggauugaccaccccggaagccugaagugggaucuugcccugugucuccugcuuguguggcuggucugcuucuuuuguaucuggaaaggcguucgcucuaccgggaaggugguguauuucacagcuaccuuuccuuucgccaugcuccugguccugcucgugcggggacugacccuuccgggcgccggcgcugggauuaaauuuuaccuguaucccgacaucacaagacucgaggauccucagguuuggauugacgcgggaacgcaaaucuucuuuuccuacgccaucugccugggcgcuaugaccagccuugggucuuauaacaaguacaaguauaauagcuaccgcgauugcaugcugcucggaugucugaacuccggcacaucuuucgugagcggguuugccauuuucuccauccugggcuuuauggcccaggaacagggagucgacauugcugauguggccgagagcggccccgggcucgcguucaucgcuuacccuaaagccguuaccaugaugccccugccgacauucuggucuauucuguuuuucaucaugcuucuccugcugggacuugacucccaauuuguggaagucgagggccagaucaccagccucguggaccuguauccuucuuuccugcggaagggguacagacgcgaaauuuuuaucgccuucgucugcuccauuagcuaucuccugggacuuacgauggugacagagggcgggauguacguuuuucagcuguucgauuauuacgcugccuccggcgugugucuccugugggucgccuuuuucgagugcuuugugaucgcuuggauuuauggaggcgacaaucuguacgaugggaucgaagacaugauuggauaccggcccggcccuuggaugaaauauucuugggcgguuaucacccccgugcuuugugucgggugcuucaucuuuagccucgugaaguacgugccucugaccuauaacaaaacauacguuuaucccaauugggccauuggacugggcuggucccucgcucugucuagcaugcuuugugucccgcuggugaucgugauuagacucugccagaccgaggggccuuuccugguccgggugaaguaccugcuuacaccccgcgaacccaacagaugggccguugagcgggaaggcgcuacgccuuauaacuccagaaccgugaugaauggagcccucgucaagccgacacacaucauuguggagaccaugauguga

SEQ ID NO: 75874 - RNA, 1911 nt, Artificial Sequence
  derived and/or modified sequence opt5 from SLC6A7__Homo_sapiens__NP_055043
augaagaaacugcagggcgcccaccucagaaagcccgugaccccugaccugcuuaugacaccgagcgaucaaggggacgucgaucuggacguugauuucgcugcccaucggggaaacuggacgggcaaacucgacuuucugcuuuccugcaucggguacugugugggacugggcaauguguggcgcuuccccuauagagcguacaccaacgggggaggcgcuuuucucgucccuuauuuccugaugcuggccauuugcggcaucccccucuuuuuccuggagcuuucucuggggcaguuuagcucccucggaccucuggccguguggaagauuucuccccuuuucaaaggcgcuggggccgcuaugcugcucaucguuggacugguggccauuuacuauaauaugaucaucgcguacguccuguuuuaucucuucgccagccugacauccgaucuuccuugggaacacuguggcaacugguggaauaccgagcugugccucgaacaucgggugucuaaggacgggaacggagcucugccgcuuaaucugacauguaccguuagccccuccgaggaauacuggagccgcuacgugcuccacauucagggcucucagggcaucggguccccuggagagauuagauggaaccugugccugugucuccugcuugccugggucaucguguuucugugcauucucaagggcgugaaaagcucugggaaggucguuuauuucacagcuaccuuucccuaccugauccuucugaugcuccuggugcggggagugacgcugccuggcgccuggaaagggauucaauucuaucucacaccccaguuccaucaucugcuuuccagcaaggucuggaucgaggcggcccugcagaucuuuuacucucucggagugggcuucggcgggcugcugaccuuugcuuccuauaauaccuuccaccagaacauuuaccgcgauacauuuaucguuacccuuggaaaugccauuacgagcauccucgcuggcuucgccauuuucuccgugcugggguauaugucucaagaacugggagucccgguggaccagguugccaaagcuggcccugggcucgcguucguggucuacccccaggccaugacaaugcugccucuuagccccuuuugguccuuccuguuuuucuuuaugcuccugacccugggccuugauagccaguucgcuuuccucgagacaaucgugaccgccgucaccgacgaauuucccuacuaucugagaccuaagaaggccguguucucuggacugaucuguguugcuauguaccucaugggccugauucuuacaacggaugggggaauguauuggcuggugcuccuggacgacuacuccgccagcuuuggccugauggucgugguuaucaccacaugccuugcggugacccgggucuaugggauucaacgcuucuguagagauauccacaugaugcucggauuuaaaccgggccuguacuuccgggcuugcuggcuguuucucucucccgccacacugcuugcccugaugguguauagcauugugaaguaccagccuuccgaguacgggucuuaucgcuuucccccuugggcugagcuccugggcauccugaugggacuucucagcugccugaugauccccgccggcaugcugguugcuguccucagagaagaggggucccugugggaacggcuucagcaagccagccgcccggcgauggacuggggaccuucucuggaggaaaacagaaccggcauguacguggccacgcucgcugggucccagagccccaaaccucugauggugcacaugcggaaguauggaggcauuacaucuuuugagaauaccgccaucgaggucgauagagaaauugcugaggaagaggaauccaugauguga

SEQ ID NO: 75875 - RNA, 1878 nt, Artificial Sequence
  derived and/or modified sequence opt5 from SLC6A8__Homo_sapiens__NP_001136277
auggccaagaaaagcgcugagaacggcaucuacuccgugucuggggacgaaaagaaaggaccccugauugccccuggcccggauggggcgcccgcuaagggagacggcccugucgggcucggaacccccggcggcagacuggccguuccuccccgggagacauggacgcgccagauggauuucaucaugagcugcgugggguuugccgugggacuuggcaaugucuggagauucccuuaucuguguuacaaaaacgggggaggcguguuucucauuccguauguucugaucgcucuugugggagggauucccaucuucuuucuggaaaucucccucggccaauucaugaaggccggcucuauuaaugucuggaacaucugcccucuguuuaaggggcugggauacgcuagcauggugauuguuuucuauuguaauaccuacuauaucauggugcucgccuggggcuuuuacuaccuggucaaauccuucacaaccacacuucccugggcgaccugcgggcacacauggaacaccccugacuguguggagauuuuucggcaugaagauugcgccaaugcuucucuggccaaccucacgugugaccagcuggcugaucgcagaagccccgugaucgaguucugggagaauaagguccuucggcuguccggaggccucgaaguuccgggggcccugaacugggaggugacccugugccuccuggcguguugggugcuugucuauuuuugcguguggaaaggaguuaagagcacaggcaaaauuguguacuucaccgccacauucccuuaugucgugcugguugugcuccugguccgcggcgugcuucugcccggggcucucgacggaaucaucuacuaucugaagccugauuggucuaagcugggcucuccccaggucuggauugacgccgggacccagaucuuuuucagcuacgcuauuggacucggcgcccugacggcccuugggucuuauaauagauuuaacaauaacuguuacaauggcacauccuucuuugcuggauucgugguuuuuagcauccugggcuucauggcggccgaacaaggggugcacauuucuaaagucgcugaguccggacccggccucgccuuuaucgccuacccucgggcugugacccugaugccgguugcuccccuuugggcggcucuguucuuuuucaugcuccugcugcucgggcuggauagccaguuugugggagucgagggcuucaucacagggcuucuggaccuccugccugccuccuauuacuuccgcuuucagagagaaauuucuguggcccugugcugcgcucuuuguuucgugaucgaucucagcaugguuaccgacggcggaauguaugucuuucagcuguucgacuacuauuccgccagcggcaccacacugcucuggcaagccuuuugggagugcgugguggucgccuggguguacggggcggaucgguucauggacgauauugccuguaugaucggauaucgccccugcccuuggaugaagugguguugguccuuuuucacgccccugguuugcaugggcauuuuuaucuucaacguggucuacuacgaaccgcuuguguauaacaauaccuacguuuauccuugguggggagaggcuauggggugggccuuugcucuguccagcaugcucugugugccccugcaucugcuuggcugccuccugagagccaaagggacaauggcggaacgguggcagcaccugacccagccuaucuggggccuccaucaccuggaguaccgcgcccaggacgcugaugucagaggacuuacaacccugacgcccgugucugagagcuccaagguuguggucguggaaucugugauguga

SEQ ID NO: 75876 - RNA, 1857 nt, Artificial Sequence
  derived and/or modified sequence opt5 from SLC6A9__Homo_sapiens__XP_011540319
augagcggcggggacaccagagccgcuaucgcccggccccgcauggcggcugcccacggaccuguggccccguccucucccgagcaggucacacugcucccuguucaaagauccuucuuucugcccccuuucuccggcgcuacgcccucuaccagccuugccgaauccgugcugaagguguggcauggggcuuacaacucuggacuccugccucagcuuauggcccagcacagccuggcgauggcccagaauggcgcugucccguccgaggccacaaaacgggaucaaaaccucaagcgcgggaauuggggaaaccagauugaauuugugcugaccagcguuggcuaugcugugggccuggggaaugucuggagauuccccuaccucugcuaucggaacggaggcggggccuuuauguucccuuacuuuaucaugcugauuuucuguggaaucccccuuuucuucauggagcugucuuuuggccaguucgcgucccaggggugccucggaguguggcgcauuagcccuauguuuaaaggcguuggcuaugggaugaugguggucucuacauacaucggaaucuauuacaauguggugauuuguaucgccuucuacuauuucuuuuccagcaugacccauguccugcccugggcuuacugcaacaauccguggaacacacacgacugugccggcguucuugaugcuucuaaucugaccaacggguccagaccugccgcccuccccagcaaucugucccaucugcucaaccacucucugcaacggacgagcccuuccgaagaguauuggcgccuuuacgugcugaagcucagcgacgauauuggaaauuucggcgaggugagacugccccuucuggggugccucggagucucuuggcuggugguuuuucugugucucauccggggcgugaaauccagcggcaaggucguguauuucaccgcuacauuucccuacguugugcugaccauucuuuucguccgcggggugacacuggaaggagcguuugacggcaucauguauuaccucaccccucagugggauaagauucuggaggccaaagucuggggagacgcugccucucagaucuucuacagccuugggugcgccuggggcgggcugaucacgauggcuuccuauaacaaguuucacaacaauuguuacagagauucugugauuaucagcauuacaaacugcgccaccuccguuuaugcgggcuucgugaucuuuagcauucucggauucauggcuaaucaucugggcgucgacgugucucggguugccgaucacgggccgggacuggccuuuguggcuuaccccgaagcccucacacugcuuccuaucagcccccuguggagccuccuguucuucuuuaugcugauccuucucggccuggggacccaguucugucugcucgagacccuggucacagcuauuguggacgaggugggaaacgaauggauccuucagaaaaagacguauguuacccugggcgucgccguggcgggguuucuccugggcauuccucugacaucucaagccggaaucuacuggcuucuccugauggauaauuaugcugccuccuucagccugguggucauuuccugcaucaugugcguggcuaucauguacauuuacggccaucgcaacuauuuucaggacauccaaaugaugcucggguuucccccgccucuguuuuuccagauuuguuggagauuuguuucucccgccaucauuuucagccuuccuacccaccgggcgcccgccccuggacccgcuugcuuuuuccacggcccggacguggauuccuguccuugcucugcccccaaugcucuguuuuga

SEQ ID NO: 75877 - RNA, 1572 nt, Artificial Sequence
  derived and/or modified sequence opt5 from SLC7A10__Homo_sapiens__NP_062823
auggccggccacacccagcaacccagcgggagaggaaacccucggccggcucccuccccuucucccgugccuggcacaguccccggggccagcgagcgcguugcgcugaagaaagaaaucggacuccuguccgcuugcacgauuaucauuggcaauaucauugggucuggaaucuucaucagcccuaagggcgugcuugagcauuccggcucuguggggcuggcccucuuugucugggugcugggaggcgggguuaccgcccuuggaagccuguguuacgcugaacucggcguggccauuccgaaauccgggggagacuaugcuuacgucacagagaucuucggcggccuggccggguuucugcuccuguggagcgcggugcuuauuauguaucccaccucucuggccguuaucuccaugacauucagcaacuacgugcuccagccugucuuucccaauugcauuccucccaccacagcuucuagagugcuguccauggccugucuuaugcugcucaccugggugaacagcagcuccguccggugggcuacgcgcauccaggauauguucaccggaggcaagcugcuggcccucagccugauuaucgggguuggacuucugcagaucuuucaaggccacuucgaggaacucagaccguccaaugcguuugccuucuggaugacaccuucuguggggcaucuggcucuugccuuucugcagggaucuuucgcuuuuuccggcuggaacuuccucaauuaugugaccgaggaaauggucgacgcccggaaaaaccugccccgcgccauuuucaucagcauuccucuggugacauuuguuuacaccuucacgaauaucgcuuauuuuacagcgaugucuccccaggagcuccuguccagcaacgccguggcugucaccuucggcgaaaagcugcugggguacuuuucuugggugaugcccguuagcguggcccucuccacauucggaggcauuaauggguaccuguuuaccuauucuagacuuugcuucagcggagcccgggagggccaccuuccuucccuccuggcuaugauccauguccgccacuguaccccgauccccgcccugcucgugugcuguggggcgacagcugucauuaugcuggugggcgauacguacacccuuaucaacuauguuagcuuuauuaauuaccugugcuauggagugacaauccucggccugcugcuucucagauggcggcgcccugcccugcacagacccauuaaggucaaccugcucaucccuguggccuaccugguuuucugggcuuuucuucugguguucucuuuuaucuccgagcccauggucuguggggugggagugauuaucauucucaccggcguuccgaucuucuuccugggggucuuuuggcggagcaaaccuaagugcgugcaucgccugacagaaucuaugacccacuggggacaggagcuuuguuucguggucuauccccaagacgccccugaagaggaagagaauggccccugcccucccucccuccugccggcuacggauaaaccuagcaagccccaguga

SEQ ID NO: 75878 - RNA, 1506 nt, Artificial Sequence
  derived and/or modified sequence opt5 from SLC7A11__Homo_sapiens__NP_055146
auggugagaaagcccgucguuagcaccaucuccaaaggcggguaccugcagggaaacgugaauggccggcucccuucucuggggaacaaggagccgcccggacaagaaaaagugcagcuuaagcgcaaagucacacugcucagaggcgugagcauuaucauugggacgaucauuggagccggcaucuucaucuccccuaagggcguucugcagaauaccgggucugugggaaugagccuuacaauuuggaccgucugcggcgugcugucccucuuuggggcucugucuuaugccgagcugggaacaaccaucaagaaaagcggcgggcacuacacauauauucucgaaguuuucggaccccugccugcguuugugcgggucuggguggagcuucugaucauucgccccgcugccaccgccgugaucucccucgcuuucggcagauacauucuggaaccguuuuucauccagugugagaucccugagcuugccauuaagcugaucacggcugucggcauuaccguugugauggugcucaacagcaugucugucuccuggagcgcccggauccaaauuuuucugacauucugcaaacugaccgcgauccucaucauuaucgugcccgggguuaugcagcugauuaagggacagacacagaauuuuaaagacgccuucucuggccgcgauuccagcaucaccagacuuccucuggcuuuuuauuacgggauguaugccuacgcuggaugguucuaccucaacuuugugacggaagaggucgaaaaucccgagaagacaauuccucuggccaucuguaucucuauggcgauugugaccaucggcuauguucuuacaaacguggccuacuucaccaccauuaaugcugaggaacugcuccuguccaacgccgucgcugugacauucagcgagcggcugcucgggaauuuuucccuggccguccccaucuucguggcccuuucuugcuuuggaagcaugaacggcggcguuuucgcugugucccgccuguuuuaugucgcgagcagagaagggcaucucccggagauucugucuaugauccacgugcggaagcauacgccucuucccgccguuauugugcugcacccucucaccaugaucaugcuguucuccggagaccuggauagccuccugaauuuucuuucuuucgcucgcuggcuguuuaucggccucgccgucgccgggcugauuuaccugagauauaaaugucccgacaugcaucggcccuucaaggugccucuuuuuaucccggcucucuucagcuuuacaugccuguucaugguggcccugucccucuacucugaucccuucagcaccggaauuggcuuuguuaucacacugaccggggucccugcguauuaccuuuucauuaucugggacaaaaagccccgcugguuuagaaucauguccgagaaaauuacgcggacacugcaaaucauucucgaaguggugccugaggaagauaagcuguga

SEQ ID NO: 75879 - RNA, 1413 nt, Artificial Sequence
  derived and/or modified sequence opt5 from SLC7A13__Homo_sapiens__NP_620172
auggacagaggcgagaagauccagcugaaacggguguucggguacugguggggaaccagcuuucuccugauuaacaucauuggcgccgggaucuucgucucccccaagggaguucuugcuuauucuugcaugaaugugggcgugagccugugugucugggccgggugcgcgauucucgcuaugacauccacgcuguguucugccgaaaucagcaucuccuuuccuugcucuggagcccaauacuauuuccuuaaacgcuacuuuggcagcaccguggcuuuccugaaccucuggacaucccuguuucugggcagcgggguuguggccggacaggcucuccugcuugccgaguauucuauucagccguucuuucccuccuguagcgucccuaagcugcccaaaaagugccucgcgcuggccaugcuuuggaucgugggcauucugaccucuagagggguuaaggaagugacauggcuccagaucgcuuccagcguccugaaagugucuauucuguccuucaucagccucaccggaguggucuuucugauucggggcaagaaagagaauguugaacgcuuccaaaacgccuuugaugcugagcuuccugacaucucccaccugauccaggccauuuuccagggguacuucgcguauucuggaggcgccuguuuuacacucaucgcuggcgagcugaagaaacccagaaccacgauuccuaagugcaucuucaccgcccuuccgcuggugacaguggucuaccuccuggugaauauuagcuaccugaccguucucacaccccgggaaauccuguccagcgaugcuguggccaucaccugggccgaccgcgcuuuuccuucucuugcguggauuaugcccuucgccaucuccacgagccuguuuucuaaccuccugauuagcaucuucaaguccucuagaccuauuuaucuugcuagccaggaggggcaacugccccuccuguuuaauacacugaacucccauagcucuccguucaccgccguccuccugcuugugacacugggaucccucgccaucauccugaccagccugauugaucuuaucaauuacaucuuuuucaccggcucucucugguccauucugcugaugauugggauccuccggcgcagauaucaggaaccuaaccugagcauucccuacaaaguuuuucuuuccuucccucuggcuacaaucgugaucgacgucggacucguggucauuccccuggugaagucucccaauguucacuauguguacguccugcuucucgugcugagcggccugcucuuuuauaucccucugauucauuucaaaauccggcuugccugguucgagaagaugacguguuaccugcagcuccuguuuaacauuugccugccggauguuuccgaggaauga

SEQ ID NO: 75880 - RNA, 2316 nt, Artificial Sequence
  derived and/or modified sequence opt5 from SLC7A14__Homo_sapiens__NP_066000
augagcggcuucuuuaccucccuggaccccagacgggugcaguggggagccgcuugguacgccaugcacucucgcauccucagaacaaagccugucgagagcaugcuggaagggacgggcaccacaaccgcgcaugggacaaaacuugcucaaguucugaccacaguggaucucauuucccugggagugggcucuugcgucgggaccggaauguaugugguuagcggccuuguggccaaggagauggccggcccgggggucaucguguccuucauuaucgcugccguugcuucuauucugagcggaguguguuacgccgaauuuggcguccgggugcccaaaacgaccggguccgcguauacauacagcuaugugaccgucggagaguucguugccuuuuucaucggcuggaaccucauccuggaauaccugauugggacagcugccggagcuucugcccucuccagcauguuugacucucuggcgaaucacaccaucucccgcuggauggccgauagcgugggcacgcuuaacggccuggggaagggagaggagucuuauccugaccuccuggcccuucugauugccgugaucgucacaauuaucguggcucucggcguuaaaaauuccauuggguucaacaaugugcugaacguccugaaucucgccguguggguuuuuaucaugaucgccggacuguucuuuauuaacggcaaguacugggcugaagggcaguuccuuccccauggauggagcggcgugcugcagggcgcggcuaccugcuuuuacgcuuucaucggguucgauauuaucgccacaaccggagaggaagccaagaauccuaacaccuccauucccuaugcuaucacagccucucucgucaucugucugacggcguacgugagcgucuccgugauucuuacccugaugguuccuuauuacacaaucgacaccgagagcccgcucauggagauguuuguggcucacggcuucuaugccgccaaauuugucguggcuauugggucuguugccggacugacagugucccugcucggcagccuguuccccaugccuagagucaucuacgcuauggccggggauggccuucuguuucgguuccucgcgcaugugucuagcuauaccgaaacgcccgugguugccugcauugucuccggauuucuggcugcccuucuggcucuccuggugucucugcgcgaccucaucgagaugaugagcaucggcacacugcuugccuacacccugguguccgucugugugcuccugcugagauaccagccugaaagcgauauugacggguucguuaaguuucuuucugaggaacacaccaaaaagaaagagggaauccucgcggauugcgagaaggaagccuguucccccgugagcgagggcgacgaguucucugggccggcuacaaauaccugcggagccaagaaccugccuucccugggcgauaaugaaaugcucauugggaaaagcgacaaguccacauauaacgucaaucaccccaacuacggcacgguggacaugaccacaggaaucgaagcugaugagucugagaacauuuaucugaucaaacuuaagaaacugauuggcccucauuacuauaccaugcggauccgccucgggcugcccggaaagauggacagacccacagccgccaccggccacacgguuaccaucugugugcugcuucucuuuauucugauguucaucuuuugcagcuucauuaucuucggguccgauuacauuucugaacaaagcuggugggcuauccugcucgucgugcugaugguucuucugaucuccacacucguguuugucauucugcagcagccugagaauccgaaaaagcugcccuauauggcgccuugucuucccuucgugccugccuuugcuaugcucgugaacaucuaccugaugcugaagcucagcaccauuacauggauccgguucgccgucuggugcuuuguuggacugcuuauuuacuucggcuaugggaucuggaacucuacccuggaaaucuccgcccgcgaggaagcucuccaucagagcacguaccaaagauaugacguggaugaccccuuuucuguggaggagggcuucuccuacgccacagaaggagagagccaggaagauuggggcgggccgaccgaggacaaaggauuuuauuaccagcagaugucugaugcgaaggcuaauggccggacaagcuccaaagccaagagcaaaucuaagcacaagcaaaauuccgaggcccugauugcuaacgacgaacuggauuauagcccugaguga

SEQ ID NO: 75881 - RNA, 1890 nt, Artificial Sequence
  derived and/or modified sequence opt5 from SLC7A1__Homo_sapiens__XP_005266564
augggcugcaaggugcugcucaacaucgggcagcaaaugcugagacggaaagucguugacuguagccgcgaggaaaccagacuuucccggugccugaauacauucgaucucguggcccugggagugggcucuacgcuuggggcuggagucuacgugcuggccggcgcgguugcucgcgagaacgccgggcccgccauugugaucagcuuucucauugcugcccuggcuuccguccuggccggacucuguuauggcgaguucggcgcgagagugccuaagaccgggucugccuaccuguauagcuacguuacagugggagaacuuugggcuuuuaucaccggcuggaaucugauucucuccuauaucaucgggacaucuagcgucgcccgggcuugguccgccaccuucgacgaacugauuggacgcccgaucggcgaguuuagcagaacacacaugacccuuaacgcgcccggggugcuggccgagaauccugauauuuucgcugugaucauuauccucauucugacgggacugcucacccugggcgucaaagaaucugccaugguuaacaagaucuuuacaugcaucaaugugcuugugcugggcuucauuauggucuccggguuugugaaaggaagcguuaagaacuggcagcucaccgaggaagacuucggcaauacaucugggcggcugugucuuaacaaugauaccaaggagggaaaacccggcgucgggggauuuaugccuuucggcuuuuccggcgugcugagcggggcugccacgugcuucuacgccuucgugggauuugacuguaucgcuacaaccggcgaggaaguuaagaacccccagaaagcgauuccuguggggaucgucgccucucuccugauuugcuucaucgcuuauuuuggaguguccgccgcccugacacucaugaugccguacuucugucuggauaauaacagcccccuuccugacgcuuuuaagcaugucggcugggagggggccaaauacgcgguggcuguuggcucccugugcgcccucucugccagccugcuuggauccauguuccccaugccucgcgugaucuaugcuauggccgaagauggccugcucuuuaaguuccuggcuaaugucaacgacagaaccaagacccccauuaucgccacacuggcgagcggggccguggcugccguuauggcuuuucucuucgaucugaaagaccuuguggaucugaugucuauuggaacgcuccuggccuacucccuggucgcggccugugugcuugugcuccgguaucagccggagcaaccuaaccugguuuaccagauggcuagcaccucugacgaacuggaccccgccgaucagaaugagcucgcuagcacaaacgacucccagcugggcuuucuuccugaggccgaaauguucucucugaagaccauccucagccccaaaaauauggagcccuccaagauuagcgggcugaucgucaacaucucuacaucccugauugccgugcuuaucauuaccuuuugcaucgugacgguccucggacgcgaagcucugacaaaaggcgcgcugugggccguguuccuccuggcugggagcgcccuucugugcgccguugugaccggcgucauuuggagacaaccugagucuaagaccaaacucuccuucaaggugccguuucugcccguucugccuauccuuagcauuuucgugaaugucuaucucaugaugcagcuggaucagggaacaugggugcgguuugcuguuuggaugcugaucggcuucaucauuuacuuuggguauggacucuggcacuccgaagaggccucucuggacgcggaucaggcucgcacccccgacggcaaccuugaucaauguaaguga

SEQ ID NO: 75882 - RNA, 2097 nt, Artificial Sequence
  derived and/or modified sequence opt5 from SLC7A2__Homo_sapiens__NP_001158243
augaagaucgaaaccagcggcuacaacuccgacaaacugauuugcagaggguucaucggaacacccgccccuccggugugugauucuaaguuucuccugagccccuccucugacguccggaugauuccuugccgcgcugcccuuacguucgcgagaugucugauccggcgcaaaauuguuacccucgauagccuggaagacacaaaacuuugcagaugucuguccaccauggaucucaucgcucugggcguggggucuacacugggagccggcguguauguccucgccggggagguggcuaaggccgacagcggacccuccaucguugugagcuuucugauugcugcccuugcgucugucauggccggccugugcuacgcugaguucggcgcccgggugccuaagaccggguccgcuuaucucuacacauauguuaccgugggagagcugugggccuuuaucacgggcuggaaucuuauucugagcuacgucaucgggaccucuuccguggcgcgcgccuggagcggaacauucgaugaacuccugucuaagcagauuggccaauuucugagaaccuauuuccggaugaacuacacagggcucgcugaguaccccgacuuuuucgccgugugucugauccuucugcucgcuggacugcuuuccuuuggcgucaaagagagcgccuggguuaauaagguguucaccgccgugaacauucugguccuccuguuugugaugguugcuggcuucgugaaagggaaugucgcgaacuggaagaucuccgaagaguuccugaaaaauaucucugccagcgcucgcgaaccuccguccgagaacggaacgagcauuuauggcgccgggggauuuaugcccuacggcuucacagggacccucgccggagcugccacaugcuuuuaugcguucgugggcuuugauuguaucgcuaccaccggcgaggaaguuagaaauccucagaaggccauucccaucgggauugugacaucucugcuugucugcuucauggccuacuuuggaguguccgcugcccugacgcucaugaugccuuauuaccugcuugacgaaaagagcccccugccggucgcuuucgaauaugugggcugggggccugccaaauacguuguggcggccggaucucucugugcucugagcaccucccugcucggcucuaucuuucccaugccucgggucaucuacgccauggcugaggaugggcugcuuuucaagugccuggcccagauuaacagcaaaacaaagacccccaucauugcgacacucuccagcggcgccguggcugcccugauggcuuuucuguucgaccuuaaagcccucguugauaugaugucuaucggaacccugauggccuauucccugguggcugcgugcguccucauucugcgcuaccagcccggccuuagcuaugaccaaccuaaguguucuccggaaaaagacgggcugggauccagccccagagugacguccaagucugagagccaggugacaaugcuccagcggcagggcuuuuccaugcgcacccuguucugcccuucucugcuucccacccaacagagcgccucccucguuagcuuccuggucggguuucuggcuuuccucgugcugggacuuucugugcugacaaccuacggcguccacgccaucacaagacucgaggccuggucccuggcucugcuugcccucuuucuggugcuguucguugcgaucgugcucacgauuuggcggcagccucagaaucaacagaaggucgcuuuuauggugcccuuccugccguuucuuccugccuucagcauccugguuaacauuuaucucauggugcagcugucugccgauaccugggucagauuuuccaucuggauggcuauuggguuccugaucuacuuuagcuauggcauucgccauucucuugaaggacaccuccgggacgagaauaacgaagaggaugccuaccccgacaaugugcaugcggcugccgaagagaaaagcgccauccaagcuaacgaucaccauccuagaaaccuguccagccccuucaucuuucacgagaagacaucugaguucuga

SEQ ID NO: 75883 - RNA, 1860 nt, Artificial Sequence
  derived and/or modified sequence opt5 from SLC7A3__Homo_sapiens__NP_001041629
augcccuggcaggccuucagacgguuuggccaaaagcuggugcgcagacggacccucgagagcgggauggcugaaacacgccuggccagaugccuuuccacgcuggaccucgucgcgcugggaguuggcucuacccuuggggcuggaguguacgugcuggccggcgaggucgccaaagauaaggcugggccuagcaucgugauuuguuuccucguugccgcucuguccucugugcuggccggacucugcuaugcggaauuuggcgcccgggucccgcgcagcggcuccgcuuaccuguauucuuacgugacaguuggggagcuuugggccuucaccacaggauggaaccugauccucagcuaugugauuggcaccgcuuccgucgccagagcguggagcucugccuuugacaaucugaucgggaaccacauuuccaaaacacuucagggaagcaucgcucugcaugugccccacgugcucgccgaauacccugauuucuuugcucugggccugguccuccugcuuaccgggcugcucgcccugggagccucugaguccgcucuuguuacgaagguguucaccggcgugaaucugcucguccugggcuuugugaugaucagcggguucguuaaaggagacgugcauaacuggaagcugacagaggaagauuaugagcucgcgauggccgaacugaaugacaccuacucucuuggcccccugggguccggaggcuuugucccuuucggguuugagggcauucuccggggagcugccacauguuucuacgccuucgugggcuuugauugcaucgcuaccacgggggaggaagcccagaacccccagcgcagcauuccuaugggaaucguuauuucccugucuguguguuuccuugcguauuuugcugucagcuccgcccugacacucaugaugccguacuaucaacugcagcccgagagcccucugcccgaagccuuccucuacaucggcugggcuccugccagauauguggucgcuguggggucucugugcgcccuuuccaccagccugcucggaucuauguuucccaugccgcggguuauuuacgcgauggccgaggacggccugcuguuccgcgugcuugcuagaauccacacagggacccggaccccuaucauugccacagucgugagcggcaucauugcugccuuuauggcguuccucuuuaagcugacggaucugguugaccucauguccaucggaacccugcuugccuauucucuggugagcauuuguguccucauccugcgcuaccagcccgaucaggaaacaaaaaccggcgaggagguggaacugcaagaggaagcuaucacaaccgaguccgaaaaacuuacgcucugggggcuguucuuuccucugaauagcauucccacaccccucucuggacagaucguguacguuugcuccagccugcuugccguccugcucaccgcucugugucuggugcuugcccaguggucugugccucuccuguccggcgaccugcucuggaccgccgucgugguucugcuucugcuccugauuaucgggauuaucguggucaucuggagacagccgcaaagcuccacaccccugcauuucaaggugccugcgcuuccccuccugccucugaugucuauuuuuguuaacaucuaucucaugaugcagaugaccgcuggaacaugggcccgguucggcguguggaugcugauuggguucgcuaucuacuuuggcuauggcauucagcacagccuugaggagaucaaguccaaucaacccucuagaaaaagccgcgccaagacggucgaucuggacccgggaacccucuacgugcacuccguuuga

SEQ ID NO: 75884 - RNA, 1908 nt, Artificial Sequence
  derived and/or modified sequence opt5 from SLC7A4__Homo_sapiens__NP_004164
auggccagaggccugcccaccaucgcuagccucgcccggcugugccagaaacuuaaccgccugaagccucucgaggacuccacaauggaaacgucucugagacggugucuuagcacccuggaucucacacugcugggggugggaggcauggucggguccggacucuacguucugaccggcgcgguggcuaaggagguggccgggccggccguccuucugucuuucggaguggcugccguugcuagccuccuggccgcgcuuugcuaugccgaauuuggcgcucgcgugcccagaacaggcuccgccuaccuguucaccuaugucucuaugggggagcucugggcuuuucugauuggauggaaugugcugcucgaauacaucauuggcggggccgcgguugcccgggcuuggagcggauaucuggacuccauguucagccacucuauccgcaacuuuacagagacccaugugggcuccuggcaagucccucuucuggggcacuaccccgauuuccucgccgcuggaauuauccugcuugccagcgccuuugugucuuguggcgcuagaguguccagcuggcugaaucauacguucucugcgaucucccuccuggucauucuguuuaucguuauucucggcuucauccuggcccagccucacaacuggagcgcugacgaagggggauuugcccccuucggcuuuuccggggugauggccggaaccgcuucuugcuucuaugccuucgugggcuuugaugucauugcggcuagcuccgaggaggcccagaauccucggcgcagcgugccgcuugccaucgcuauuucucuggccaucgcugccggggcguacauccucguuuccacagugcugacccuuaugguccccuggcauagccuggacccugauucugcccucgcugacgccuucuaccagagaggauaucggugggcuggcuuuauuguggccgcgggcagcaucugugccaugaacacaguucugcugucccuccuguucucucuuccccgcauuguguacgcuauggccgcugaugggcuguuuuuccaagucuuugcccacgugcacccuagaacccagguccccguggccggaacgcucgcuuucggccugcugacagcguuucuugcccuccugcuggaccucgaaagccugguucaguuccuuucccuggggacccuccuggcuuauacauuuguggccaccagcaucauuguccugcgguuccagaagucuuccccgccuagcucucccggaccugccucccccggcccccuuaccaagcaacagagcuccuuuucugaucaucuccagcugguggggacaguucacgcuagcgugccugagccgggcgagcugaaacccgcccuccgcccuuaccugggauuccuugacggcuauucccccggggcggucgugacgugggcucugggagugaugcucgccucugccaucaccaucggcugcguucuggucuucgggaauagcacacugcaucuuccucacuggggauacauucuccugcugcuccugaccuccgugauguuucuucugagccuccuggugcugggcgcucaccagcaacaguauagagaagaucuuuuccagauccccauggucccgcucauuccugcccugucuaucgugcugaacauuugucucaugcugaaacuuuccuaccugacauggguucgguuuagcaucuggcuccugauggggcuggcgguguacuucggcuauggaaucagacauucuaaggagaaucaacgcgaacuucccggccugaacuccacccacuacgucguguuuccucgggggagccucgaggaaacgguucaggcuaugcagcccccuucucaggcccccgcccaagacccgggacauauggaguga

SEQ ID NO: 75885 - RNA, 1524 nt, Artificial Sequence
  derived and/or modified sequence opt5 from SLC7A5__Homo_sapiens__NP_003477
auggccggcgcugggcccaagagacgggcccuggcggcuccugccgccgaggaaaaagaggaagcucgcgagaagaugcucgccgcuaaaagcgccgacggauccgcgccggccggcgaaggggagggagugacccugcagagaaacaucacacuucugaauggcgucgcuauuaucguugggacgauuaucggaucuggcauuuucgugacccccacaggcgugcucaaggaggccgggagcccuggacuggcucuugucgugugggccgcgugcggcguguuuuccaucguuggggcccuguguuacgcugaacucggaaccacaaucucuaaaagcggcggggauuaugccuacaugcuggaggucuauggaucccugcccgcuuuccucaagcuguggauugaacuucugaucauucggccuucuagccaauacaucguggcccucguuuuugccaccuaucugcuuaagccccuguucccuacaugcccggugcccgaggaggcugcgaaacucgucgccugucugugcgugcugcuccugaccgcugugaacuguuacuccgucaaggccgccacgcgcguucaggacgcuuuugccgcggcuaaacuucuggcccucgcccugauuauccuucugggcuucgugcagauuggcaagggggaugugagcaaucucgacccuaacuuuucuuucgaaggaaccaaacuggaugucggcaauaucgugcuggcucucuauuccgggcuguuugccuacggaggcuggaacuaccuuaauuucguuacagaggaaaugaucaaccccuauagaaaucugccucucgcuauuaucauuagccugcccaucgugacccuugucuacgugcugacaaaccucgccuauuuuaccacgcugucuacagagcagaugcuguccagcgaagcgguugccguggacuucgggaauuaccaccucggagucaugucuuggauuaucccgguguuugucggccuguccugcuucggcagcgugaacgggucccuuuucaccucuagccggcuguuuuucguuggaucccgcgagggccaucucccuagcauccugucuaugauucacccccaacugcuuacaccugugcccucccucgucuuuaccugugugaugacccugcuguaugcuuucagcaaggauaucuuuucuguuauuaauuucuuuagcuucuuuaacuggcucugcguggcccuggcuaucauugggaugaucuggcuuagacaucggaagcccgagcuggaacgcccuaucaaagucaaucucgcccugccgguguucuuuauucuggcgugucuuuuccucaucgccguguccuuuuggaagacacccguugagugcggaauuggcuucacgaucauucugucugggcugccugucuacuucuuuggcgugugguggaaaaacaagcccaaauggcuccugcagggaaucuucagcaccacagugcuuugucagaagcugaugcaggucgugccucaagaaaccuga

SEQ ID NO: 75886 - RNA, 1548 nt, Artificial Sequence
  derived and/or modified sequence opt5 from SLC7A6__Homo_sapiens__NP_003974
auggaggccagagaacccggccggccuaccccgacauaccaccuggugcccaacacgagccagucccaagucgaggaagacguuucuagcccuccccagcgcuccucugagaccaugcagcucaagaaagaaaucagccugcuuaauggggugucccugguggucggaaacaugauuggcucugggaucuucgugagcccuaagggaguucucgugcauacagcuuccuauggcaugagccugauugucugggccaucgggggacuguuuucugugguuggcgcgcuuugcuacgcugagcucggcaccacaauuaccaaauccggggccagcuaugccuacauccuggaggcuuucggaggcuuuaucgccuucauuagacugugggugucucuccuggucguggaacccacagggcaggcuaucauugccaucaccuuugcgaauuauauuauccaaccuuccuucccgagcugugaucccccuuaccuugccugccggcugcucgcugccgcuuguauuugccugcuuacguuugugaacugugccuaugucaaguggggaacccgcguucaggacacauucaccuacgcgaaagugguggcccugaucgcuaucauugucaugggccucgugaagcugugccaggggcacucugagcauuuucaggaugccuucgaaggauccagcugggacaugggcaaucugucccucgcucuguacucugcccuuuuuagcuauuccggcugggauacacugaacuucguuaccgaggagaucaagaaucccgaaagaaaccucccucuggccauugggaucagcaugcccauugugacgcuuaucuacauccugacaaaugucgcuuauuacaccgugcucaacauuucugacguucuguccagcgaugcgguggccgucacauuugcugaccaaaccuucggaauguucucuuggaccaucccgauugccguggcccugagcuguuuuggcgggcucaaugcuuccaucuucgccucuagccggcuguuuuucgucggaucccgcgagggccaccuuccugaucugcucagcaugauucauaucgaaagauuuacacccaucccugcgcugcuuuucaacugcacgauggcucugauuuaucucaucguggaggacguuuuucagcugauuaauuacuucucuuuuuccuauugguucuuuguggggcugagcgucgugggacagcucuaccugcgguggaaagaacccaagcgccccagaccucuuaaacugucuguuuucuuuccgaucguguucuguauuugcuccgucuuccucgugaucgugccccuguuuaccgauacaauuaacagccugaucggcaucggcauugcccuuuccgggguuccuuucuacuuuaugggagucuaucuccccgagucucggcgcccucuguucaucagaaaugugcuggccgcuauuacccggggcacacagcaacucuguuuuugcgugcugaccgagcuugacgucgccgaagagaagaaagaugaacgcaagacggacuga

SEQ ID NO: 75887 - RNA, 1536 nt, Artificial Sequence
  derived and/or modified sequence opt5 from SLC7A7__Homo_sapiens__XP_011535601
augguggacagcaccgaguacgaagucgccucccagcccgagguugaaacaucuccucugggcgauggggcuagcccgggacccgagcaagugaagcucaaaaaggaaaucucccugcuuaacggcgugugccugauugucgggaauaugaucggaucuggcauuuucgugagcccuaaagggguucucaucuauuccgccucuuuuggacugagccuugugauuugggcggucggcggccuguucuccguguuuggggcucucuguuacgccgagcugggaacgaccaucaagaaaagcggcgccucuuaugcuuacauccuggaggccuucgggggauuucucgcuuucauuagacuguggacaucccuucugaucauugaacccaccagccaggccaucauugcgaucacauuugccaacuauaugguucagccucucuuccccucuugcuuugcuccuuacgccgcuucccggcugcuugccgcggccuguauuugccugcucaccuucaucaauugugcuuaugugaaguggggcacacugguccaggacaucuuuaccuacgccaaggugcuggcucucauugccgugaucgucgccgggauuguucgccugggacaaggcgcuagcacgcacuucgagaacucuuuugaaggcuccagcuucgcggugggggauaucgcccuugcucuguacuccgcccucuucucuuauagcggaugggacacccugaauuacgugacagaggagauuaaaaacccggaaagaaaucuuccccuguccaucggcaucagcaugccuauugucaccaucauuuauauccucacaaacguggccuacuauaccguucuggauaugcgggacauucuggcuucugaugccguggcggucacguuugcugaccagaucuucgggaucuuuaauuggauuaucccccucuccguggcccugagcugcuucggaggccuuaacgccucuauuguugcugccagccgccuguuuuucgugggguccagagagggacaucucccugaugcuaucuguaugauucacgucgaacgguuuacacccgugccgucucugcuuuucaauggcaucauggcccugauuuaccucugcgucgaggacaucuuucagcugaucaacuauuacagcuucuccuacugguuuuucgugggccugagcauuguugggcagcucuaucugcgcuggaaggaaccugauagaccccggccucuuaaacugucuguguuuuuccccaucgucuucugucucugcaccauuuuucugguggcgguuccccuguacuccgacacaaucaauagccuuauuggaaucgccaucgcucucucuggccugccuuucuauuuucugauuauccgcgugccggagcauaagagaccccucuaccugcggcgcauugucggguccgccaccagauaucuucaagugcuguguaugagcguggcugccgagauggaucucgaagacggaggcgagaugccuaaacagcgggaccccaaguccaacuga

SEQ ID NO: 75888 - RNA, 1293 nt, Artificial Sequence
  derived and/or modified sequence opt5 from SLC7A8__Homo_sapiens__NP_001253965
augggccaguacgggcaagagcugagcuggaagugccucgugaaagccgucugucugcaggaacacucccagcccucucagcuucugugcacccuccugcuuuguuggugcguucugggaagagagcggccuuuccgcaaggcucaaagcacauccucuccgcucgaaggcgugcccagauuucugaaacggcugcuccugacgugggugaacuguagcuccguccgcugggccaccagagugcaggacaucuucacagcggggaaacuucuggcucucgcccugauuaucauuaugggaaucguucagauuugcaaaggcgaguauuuuuggcuugaaccuaagaaugccuucgagaacuuucaggagcccgauaucgggcugguggcucucgccuuccugcaaggaucuuuugcuuacggcggcuggaauuuccugaacuaugucaccgaagaacucguggacccuuacaagaaucugccccgggccaucuuuauuagcaucccucuuguuacauucguguaugucuuugcgaacguggccuacgugaccgcuauguccccgcaggaacugcucgccagcaaugcugucgccguuacauucggggagaaacugcuuggagugauggcguggauuaugcccaucucuguggcccuguccaccuuuggcggggucaacggaagccucuucacgucuucccgccuguucuuugcuggcgccagagaggggcaucugccuagcgugcucgcuaugauucacguuaagcgguguacccccaucccugcccugcuuuucacaugcauuucuacccugcucaugcuggugacauccgauauguauacccuuaucaauuacgucggauuuaucaacuaccuguucuauggcgugacgguugccggccagauugugcuccgcuggaaaaagcccgacaucccgagaccuauuaaaaucaaucugcuguuucccauuaucuaccuccuguucugggcuuuucuucuggucuucagccucugguccgaaccuguggucugugggaucggacuggcgauuaugcugacaggcgugcccguuuauuuucuugggguguacuggcagcauaagcccaagugcuucucugauuuuaucgagcuccugacccuggucagccaaaagaugugugugguuguguauccugaagucgagcggggauccggcacagaagaggccaacgaggacauggaggagcagcagcaaccgauguaccagcccaccccuaccaaggauaaagacguggcugggcagccccagccuuga

SEQ ID NO: 75889 - RNA, 1464 nt, Artificial Sequence
  derived and/or modified sequence opt5 from SLC7A9__Homo_sapiens__XP_011524704
augggcgacaccgggcugagaaagcggcgcgaggaugaaaaauccauccagucccaagagcccaagacaacgucucuccagaaagaacugggacuuauuagcggcaucuccauuaucguggggaccauuaucggaucuggcaucuucgucagcccuaaguccguucugucuaacacagaggccguggggccgugccucauuaucugggcugccuguggagugcuggcgacccuuggcgcucugugcuuugccgaacucggcacaaugauuaccaaaagcgggggagaguaccccuaucugauggaggccuacggcccuauccccgcuuaucuguucuccugggccagccucauugucaucaagccuacaucuuuugcuauuaucugucuguccuucagcgaauacgugugcgcccccuuuuauguuggguguaagccuccgcagaucguggucaaaugccuugcggccgcugccauucuguucaucucuaccgugaauagccucagcguuagacugggaucuuacgugcagaacauuuuuacggcugccaagcuggucaucguggcgauuaucaucauuuccggccuggugcuccuggcccaagggaauaccaaaaacuucgacaauagcuuugagggagcucagcuguccgucggcgccaucucucucgcuuucuauaacggccugugggccuacgauggguggaaucagcuuaacuacauuacagaggaacugcggaaucccuaucgcaaccucccucuggccaucauuaucggaaucccccuuguuaccgcuuguuacauucugaugaaugugagcuauuuuacagugaugaccgcgacggagcuccugcagucccaagccgucgcugugacauucggcgacagaguucuguacccugccagcuggaucgugccccucuuugucgccuucucuaccauuggggcugccaacggaacaugcuucaccgcgggccggcugaucuauguggcugggcgcgaaggacacaugcuuaagguucuguccuacauuagcgugagacggcucaccccggccccugccaucaucuuuuauggcauuaucgcuacaauuuacaucauucccggcgauaucaauucucuggucaacuacuucagcuuugccgcuuggcuuuucuaugggcugacgauucucggacugaucgugaugcgcuuuaccagaaaagagcuggaacggccuaucaagguccccgugguuauucccgugcucaugacacugaucuccgucuuccuugugcuggccccuauuaucucuaagccgaccugggaguaccucuauuguguucuguuuauucugagcggccuucucuucuacuuucuguucgugcauuauaaauuugggugggcgcagaagaucuccaaacccaucacaaugcaccuucagaugcucauggaagucgugccucccgaggaggacccugaauga

SEQ ID NO: 75890 - RNA, 2907 nt, Artificial Sequence
  derived and/or modified sequence opt5 from SLC8A1__Homo_sapiens__NP_001106271
auguacaacaugagacggcugagccucucccccaccuucucuaugggcuuucaucugcuugugacagucagccuccuguucucccacguugaccacgugaucgccgaaacggaaauggagggggaaggaaaugagaccggcgaaugcacagggucuuauuacuguaagaaaggagugauucugccuaucugggagccgcaggaucccagcuuuggcgacaagauugcucgcgccaccgucuauuucguggcgaugguuuacauguuucuugggguguccaucauugcugauagauucaugucuagcaucgaggucaucacaucccaagaaaaagagauuaccaucaagaaaccuaacggagaaacaaccaagacgaccgugcggauuuggaaugagacaguuagcaaccugacccucauggcccuggggucuuccgcccccgagauccugcucagcgugauugaagucugcggccauaauuuuacagcuggcgaccugggaccuucuaccaucgugggcuccgccgcuuucaacauguuuauuaucaucgcccuuuguguguaugucguucccgauggggagacgcgcaagauuaaacaccugagaguguucuuugugacagcggccuggagcaucuucgcuuacaccuggcucuauauuauccugucugucauuuccccuggagugguugaagugugggagggccuucugacauuuuucuucuuuccgaucugcgucguguucgccuggguugcugaccggcgccuccuguuuuacaaguacguguauaaaagauaccgggccgggaagcagcgcggaaugaucauugaacaugagggcgauagacccagcuccaaaaccgagaucgaaauggacggcaaggucgucaauucucacguggagaacuuccuggauggggcgcucgugcuggaaguugacgagcgggaucaggacgaugaagaggcccgcagagagauggcucggauucuuaaggaacugaaacagaagcacccugacaaagagaucgaacaacucauugagcuggccaauuaucaggugcuuagccagcagcaaaagucccgcgcuuuuuacagaauccaggccacccggcugaugacaggagccggcaacauccucaaaagacaugcugcggaccaggcccgcaaggcugucagcaugcacgaagugaauacggagguuaccgagaacgaucccgugucuaaaauuuucuuugaacaggggacauaucaaugucuggagaauugcggaaccgucgcccugacaaucauucggagaggcggggaccucaccaacacgguguucguggauuuucgcacagaagacggaaccgccaaugcuggcuccgauuacgaguucaccgagggcacaguugucuuuaagccuggggacacccagaaggaaauccgggugggaauuaucgaugacgauauuuucgaggaagacgagaacuuucuggugcaucuuagcaacgucaaagugucuagcgaagccuccgaggauggcauccuggaggcgaaucacguuucuacacucgcuugucuggggagccccuccacggccaccgugacaaucuucgacgacgaucacgccggaauuuucaccuuugaagaaccggucacacaugugagcgaaucuaucggcauuauggagguuaaggugcuuagaaccuccggggcucgcggcaacgucaucgugccuuauaaaacgauugaaggaaccgcccggggcgggggagaggacuucgaggauacaugcggcgaacuggaguuucagaaugacgaaaucguuaagaccaucagcgugaaagucauugaugacgaggaauacgagaagaacaagacauucuuucucgagaucggggaacccagacugguggagaugucugagaaaaaggcucugcuccugaaugagcuuggaggcuucaccauuacggggcaaccuguguuucgcaaaguccacgcccgggagcaucccauccuguccacaguuauuaccaucgcggaugaauacgacgauaagcagccccucacaagcaaagaggaagaggaaagacgcaucgccgagaugggccggccuauucugggagagcacaccaagcuggaagugaucauugaggaauccuaugaguucaagucuaccguggacaaacuuaucaagaaaacaaaccucgcucuggucgugggcacgaauagcuggagagaacaguuuauugaggccaucaccguuuccgcuggggaggaugacgaugacgacgaauguggagaggaaaagcugccgucuugcuucgauuacgugaugcauuuucucacagucuucuggaaagugcuguuugccuucguucccccuaccgaguauuggaacggcugggcguguuucaucgugagcauucuuaugaucgggcugcucacagccuuuauuggagaccuggcuucccacuucggcugcaccaucgggcugaaggauagcgucacggccgugguuuuuguggcucuuggcacaucuguccccgacaccuucgccuccaagguggccgcuacccaggaucaauacgcggacgccagcauuggaaaugugacaggcucuaacgcugucaauguuuuucucgggaucggaguggccugguccauugccgcuaucuaucacgccgcgaacggcgaacaguucaaagugagcccugggacccuggcuuuuucugucacacuguucacgaucuuugccuucauuaaugugggaguucuccuguaccggcgcagacccgagaucggcggggagcuuggcggaccgcggaccgccaagcugcucacaagcugccuguuugugcugcuuuggcuccuguauauuuucuucuccagccuggaggcuuacugucauaucaaaggcuuuuga

SEQ ID NO: 75891 - RNA, 2766 nt, Artificial Sequence
  derived and/or modified sequence opt5 from SLC8A2__Homo_sapiens__NP_055878
auggcgccccuggcucucgugggcgucacccugcuucuggccgcgccuccgugcagcggggcugccacacccacgccuucccugcccccucccccugccaacgacucugauaccagcacaggaggcugucagggguccuacagaugccaaccgggaguucugcuucccgugugggagccugacgaucccucucugggcgacaaggcugcccgggcuguggucuauuucguggccaugguuuacauguuucucggggugagcaucauugcggaucgcuucauggccgcuaucgaagucauuaccuccaaagagaaggaaaucacaauuaccaaagccaauggagagacaucugugggcaccguuagaaucuggaacgaaacggugagcaaucugacccugauggcucucggcuccagcgccccugagauccugcuuucugucauugaggugugugggcacaacuuucaggcgggagaacugggccccgggacaaucgugggauccgccgcuuucaauauguuugucguuauugccgugugcaucuaugugauuccggcuggcgagagccggaagaucaaacaucuccgcgucuucuuugugaccgccucuugguccauuuucgccuacguuuggcuguaucuuauccuggcuguguuuagcccuggggucgugcagguuugggaagcgcuccugacacugguguucuuucccgucuguguggucuucgccuggauggcugacaagagacuccuguuuuacaaguauguguacaaacgguaccgcaccgauccuagaucuggaaucauuaucggcgccgagggcgacccucccaaguccauugagcuugaugggacguucguuggagccgaagcucccggcgagcucgggggacucggcccggggcccgccgaagcgcgggagcuggacgcuagccgcagagaagugauccagauucuuaaagaucugaagcaaaaacacccugacaaggaucucgagcagcuggucggaaucgccaacuauuacgcccugcuccaucagcagaagucccgggcuuucuaucgcauccaagccacaagacugaugaccggcgcuggcaaugugcuucggcgccacgccgcggacgccucuagacgggcugcccccgcugagggggccggagaagacgaggaugacggcgcgagcagaaucuuuuucgaaccuucccuguaccauugccucgagaacugugggagcguucugcuuucugugacaugccagggaggcgaaggcaauuccaccuuuuaugucgauuaccgcaccgaggacgggagcgccaaagcuggaucugauuaugaguacagcgaaggcacacugguguucaagcccggggagacgcagaaagaacuccggauuggaauuaucgacgaugacauuuuugaggaagaugagcacuucuuugugagacugcugaaccuccgcguuggcgacgcccaggggauguucgagccggauggaggcgggcggccuaagggcagacuggucgcuccccuucuggccaccgugacaauccucgacgacgaucacgccggaaucuuuuccuuccaagaccgccugcugcaugugucugaauguaugggcaccgucgaugugcggguugugagaagcuccggggcucgcggaacaguccggcuuccuuacagaaccguggacggcacggcgcgcgggggaggcguucacuaugaggaugccugcggggaacucgaguuuggcgacgaugagacaaugaaaacccuccaggugaagauugucgacgaugaagaguacgaaaagaaggacaauuucuuuaucgagcugggacagccccaauggcugaagcggggcauuagcgcucugcuucugaaccagggggauggagacagaaaacucaccgccgaagaggaggaagcccggcgcaucgcugagaugggcaagccugugcugggggaaaauuguagacuggagguuauuaucgaagagucuuaugauuucaaaaacacaguggacaaacuuauuaaaaagaccaaucucgcccuggucaucggaacacauuccuggcgggagcaguuccuggaagcgaucacggugagcgcuggcgacgaggaagaggaagaggaugggucuagagaggaacgccuccccuccugcuuugacuacgugaugcacuuccugaccgucuuuuggaagguucuuuucgccugcgugccgccuacagaguauugucacggcugggccugcuuuggagugagcauucuggucaucggccuccugaccgcucugauuggggaucuugccucccauuucggauguacagugggccucaaagacucuguuaacgcgguggucuuuguggcucuggggaccagcauccccgauacguucgccuccaagguugccgcucugcaggaccaaugcgccgaugcuucuauuggaaacgugaccggcagcaaugccgucaacguguuucucggccuggggguugcgugguccguggccgcugucuacugggccgugcagggacggcccuucgaagugagaacaggcacccuugcuuuuagcgucacacuguucaccguuuuugccuucguggggaucgccgugcuccuguaucgcagacggccucacaucggaggcgagcuugggggaccgcgcggccccaaacuggcuacgacagcccucuuccugggccuguggcuccuguacauucuuuuugccucucuggaggcuuacugucauaucagaggguucuga

SEQ ID NO: 75892 - RNA, 897 nt, Artificial Sequence
  derived and/or modified sequence opt5 from SLC8A3__Homo_sapiens__NP_001123889
auggagagaggcaucagcgacgugaccgaucggaagcugacaauggaagaggaagaggccaaacgcauugcugaaauggggaagcccguccucggagagcacccuaaacuggagguuaucauugaagaguccuacgaguucaagacgaccguggacaaacuuaucaagaagacaaaccuggcccucguggucggcacccauucuuggagagaucaguuuauggaggcgauuacagugagcgcugccggggacgaggaugaagacgaguccggagaagaacggcugccgucuugcuucgauuauguuaugcacuuucuuaccguguucuggaaaguccuguuugccugugugcccccuacagaauacugccauggcugggcuuguuucgccguuagcauccucaucauugggaugcugaccgcuaucauuggagaccuggccucccacuuuggcugcacgaucggccucaaggauucugugaccgcggucguguucguggccuuugggacaagcguccccgacaccuucgcuuccaaagccgcugcccugcaagauguuuaugcggacgccagcauuggaaaugugacaggcucuaacgcugugaaugucuuucuugggaucggacuggccugguccguggcugccauuuacugggcccuccagggccaggaguuccauguuagcgcugggacccuggcguuuucugugacgcuuuucacaaucuucgccuuugucuguaucuccgugcugcucuaucgcagacggccucaccugggaggcgagcugggcgggccccgcggaugcaagcucgcuaccacauggcuguucguuagccuuuggcugcucuacauucuguuugccacccuugaagccuauuguuacaucaaaggcuucuga

SEQ ID NO: 75893 - RNA, 2118 nt, Artificial Sequence
  derived and/or modified sequence opt5 from SLC9A1__Homo_sapiens__XP_011540323
augggcaaggacgccugccccggguuccacgugaucccuaccauuagcuccaucgucccggagucuugucugcucauuguugugggacugcuugugggcgggcugaucaaaggagucggcgaaacacccccuuuucuccagagcgauguguucuuucuguuccuucugcccccuauuauccucgacgcuggguacuuucugccccugagacaauucacggagaaccucggaaccauccugauuuuugccguugugggcacacuuuggaaugcguucuuucugggcgggcucauguaugcugucugccuggugggaggcgaacagaucaacaauauugggcuucuggauaaccuccuguucggauccaucauuucugccguugacccuguggccguccuggcuguguuugaggaaauccauauuaaugagcuccugcacauccuuguguucggcgagagccugcucaacgaugccgucaccguugugcuguaccaucuuuuugaagaguucgcuaauuaugaacacguggggaucgucgacauuuuccugggauuucucuccuucuuugugguugcccugggcggcgugcuggucggggugguuuacggagugaucgcggccuucacaucucgguuuaccagccauauucgcgucaucgagccccucuucguguuucuguauuccuacauggcuuaucuuagcgccgagcuguuccaccucucuggcauuauggcucugaucgccuccggggucgugaugagaccguacguugaagcgaacaucagccacaagucucauacaaccauuaaauacuuucuuaagaugugguccagcgugucugagacgcugaucuucauuuuucucggagucuccaccguggccggcagccaccauuggaauuggacauucguuaucuccacccugcuguuuugucucauugcucgggugcuggggguccuuggacugacaugguucaucaacaaauuccgcaucgugaagcucaccccuaaggaucaguuuauuaucgccuauggcggccugagaggggcuauugccuucucucugggauaccuucucgacaaaaagcacuuucccaugugcgaucuguuccugacggccaucauuacagugaucuuuuucaccguuuuuguccagggcaugacaauucggccucucguggaccugcuugcugugaaaaagaaacaagaaaccaagcgcagcaucaaugaggaaauccacacccaguuccuggaucaucuccugacagggauugaggacaucuguggacacuauggccaucaccauuggaaggauaaacugaacagauuuaauaagaaauacgucaagaaaugccuuauugcgggggagcgguccaaggaaccccagcucaucgccuucuaucacaaaauggagaugaagcaggcuauugaacugguggagagcggcggaaugggcaagaucccgucugccguuuccacggugagcaugcaaaacauccacccuaaaucucugcccagcgaacgcauucucccugcccuguccaaggacaaagaggaggaaaucagaaagauucuucggaauaaccugcagaaaacccgccagagacuccggucuuacaaccgccauacacuggucgcugaccccuaugaggaagccuggaaucagaugcugcuuagacggcaaaaggcgagacagcucgagcagaagaucaacaauuaccugaccgugcccgcucacaaacuggauagcccuacaaugucccgcgcccggauugggagcgacccgcucgccuacgaacccaaggaggaucugccuguuaucaccaucgaccccgcuucuccucaaucccccgagagcguggaucuugucaacgaggaacugaaaggaaaggugcucggccugucuagagacccggccaaaguugcugaagaggaugaggacgaugacgggggaauuaugaugcgcuccaaggaaacgagcuccccuggcacagaugacguguuuacccccgccccuucugacagccccuccucucagcggauccagagaugucugagcgauccugggccccauccggagccuggcgaaggagagcccuucuuucccaagggccaguga

SEQ ID NO: 75894 - RNA, 2439 nt, Artificial Sequence
  derived and/or modified sequence opt5 from SLC9A2__Homo_sapiens__NP_003039
auggagccccugggcaacuggagaagccuccgggccccucugccgcccaugcuucugcuccugcuucuccagguggcugggccugucggagcccuggcggaaacccugcugaaugcuccccgcgccaugggcacauccucuagcccucccuccccugccucuguuguggcuccggggacgacccucuucgaggaaagcagacugcccguguuuacacuugacuacccucacguccaaauccccuucgagauuacccuguggauccuccuggccucccuugcuaagauuggauuucaucuguaucacaaacucccuacaaucgugcccgaaucuugccugcugauuaugguuggccuccugcuugggggaaucaucuucggcguggaugaaaagagcccgccugccaugaaaaccgacgucuuuuuccuguaccuccugcccccuauugugcuugaugcgggcuauuuuaugcccacacggcccuucuuugagaacaucgggaccauuuucugguacgccguugugggaacgcuguggaacuccaucggcauuggggucagccucuuuggaaucugucagauugaggcuuucggccugucugacaucacccugcuccagaaucugcuuuuugggucccugaucagcgccguggauccuguggcuguccucgccguuuucgagaauauucaugugaacgaacagcuguauauccuuguguucggagagucucugcucaaugacgcggucacagugguucuguacaaccuguuuaaguccuucugccaaaugaaaaccauugagacaaucgauguguuugccggcauugcuaauuucuuugucgugggcaucgggggaguucucaucggcauuuuccugggguuuaucgccgcuuucaccacgcgcuuuacacacaacauuagagugaucgaaccgcuuuucgucuuucuguauagcuaccucucuuacauuaccgccgagauguuccaucuguccggaaucauggccaucacagcuugugcgaugaccaugaauaaguauguggaagagaacgucagccagaaguccuacaccacaauuaaauauuuuaugaagaugcugucuagcguguccgaaacgcuuaucuucauuuucaugggcguuagcaccguggggaaaaaucacgaguggaacugggccuuugucugcuucacacucgcuuuuugucugauguggcgggcccugggaguguucguucucacccaggugaucaaucgcuuuagaacaauuccccugaccuucaaggaccaguuuaucauugccuacggcggccuucgcggggcuaucugcuucgcccuggucuuucuccugccugcggcuguguucccccggaaaaagcuguuuaucacggccgccauugugguuaucuucuuuacagucuucauucuuggaaucaccauuagaccucucguggaguuccuggaugugaagcggucuaacaaaaagcaacaggcugucuccgaagagaucuauugucgccuguuugaccacgugaaaaccggcaucgaagauguuugcgggcauuggggacacaacuucuggagagacaaguuuaaaaaguucgaugacaaauaccuccggaagcugcuuauucgcgagaaucagcccaagagcucuaucgugagccuguauaaaaagcucgaaauuaaacaugccaucgagauggcugagacaggcaugauuuccaccgucccgacauuugccucucugaacgacuguagagaagagaagauccggaaagugacgagcuccgaaaccgaugagaucagagaacugcuuagccgcaaucucuaccagauucggcaaagaacacugucuuacaaccgccacucccugaccgcggacacaagcgagcggcaggccaaggagauccucauuagacgccggcacucucugagagaauccauccgcaaggauagcucccuuaaucgggagcauagagcuucuaccagcacgucccgcuaucugucucucccuaaaaacaccaagcugcccgaaaaacugcagaagcggagaacaauuagcaucgccgacggcaauuccagcgauucugacgcugaugccgggaccacaguucuuaaccuccaaccucgggcgcgcagauuccugcccgagcaguuuuccaaaaagagcccucagucuuacaagauggaguggaaaaaugaaguggacgucgauuccggacgggacaugcccagcaccccgccuacgccccacucuagagagaagggcacacagaccagcgggcugcuccaacagccccugcuuuccaaagaucagagcggaucugaacgcgaggacucccugacagaaggcaucccuccgaagcccccuccccggcucguguggagagccagcgagccugggucccgcaaagcuagauucggaucugagaagcccuga

SEQ ID NO: 75895 - RNA, 2505 nt, Artificial Sequence
  derived and/or modified sequence opt5 from SLC9A3__Homo_sapiens__NP_004165
auguggggccugggggccagaggacccgaccggggccuccugcuugcucuggcccucgggggacuggcgcgcgcuggcgggguggaggucgaaccuggaggcgcccacggcgagagcgggggauuccagguugugaccuuugaaugggcccaugugcaagauccguacgucaucgcucuuuggauucugguggccucccucgcuaagaucggcuuccaccugucucauaaaguuacaagcgugguccccgaguccgcccugcucauugugcuggggcuuguucugggaggcaucgugugggcggccgaccacauugcuucuuuuacgcucaccccuacagucuucuuuuucuaucugcuucccccuaucgugcuggaugccggguacuuuaugcccaacagacucuucuuuggaaaucugggcaccauccugcucuaugcuguggucggcacaguuuggaacgccgcgaccacagggcugagccuuuacggaguguuccuguccggccucaugggggaccugcagauuggacuucuggauuuucuccuguucggcucucugauggccgcuguggacccugucgccgugcucgcuguuuuugaagaggugcaugucaaugaggugcuguucaucauuguuuucggggaaagccuucugaacgaugccgugaccgucgugcucuauaaugucuuugaguccuucguggcccugggaggcgacaacguuacgggcguggauugcgucaaggggaucgugagcuuuuucguugugucucuuggaggcacccuggucggggugguguuugcuuuccuccugucccugguuacacgguuuaccaaacacguccgcauuaucgaaccgggauucguguuuauuaucagcuaccucucuuaucugacauccgagaugcuuagccugucugcgauccucgccauuaccuucuguggcaucugcugucagaaguacgugaaagcuaauauuuccgagcagagcgccacgacagucagauacaccaugaagaugcuggccuccucugcugaaacaaucauuuuuauguuccuggggaucagcgccgugaaccccuuuaucuggaccuggaauaccgcguucguucuucucacacugguguucauuuccgucuaucgggcuaucggcgugguucugcaaacguggcuccugaaccgcuacagaauggugcagcuugagccuauugaccaggucgugcugagcuauggaggccuccgcggggccguugccuuugcucuggugguccugcuugauggagacaaggugaaagaaaagaaucucuucgugucuaccacaaucauugucguuuucuucaccgugaucuuucagggccugacaaucaaaccccuggugcaauggcucaaggucaaacgcuccgagcacagagaaccucggcugaacgagaaacuucaugggcgcgccuucgaucacauucugagcgcuaucgaggacauuucuggacagaucggccauaauuaccucagagacaaguggagccacuuugaucggaaguuccugucccgcgugcugaugagacggucugcccaaaagagcagagaccgcauucuuaacguuuuucacgaacucaaucugaaagaugcgaucuccuauguggccgagggggaacggagaggcagccuggcuuucauucgcucucccuccaccgacaacgucgugaacguugauuuuacgccgcggagcucuacaguggaggccuccgucagcuaccuccugagagaaaauguguccgcuguuugccuugacaugcagucucuggagcagcgccggagaagcauccgcgaugccgaggacauggugacccaucacacccuccagcaguaucuguacaagccucggcaagaauacaaacaucuguauuccagacacgagcuuacacccaccgaagaugagaagcaggaccgcgaaaucuuccaucggacaaugagaaaacggcucgagucuuuuaagagcacgaagcugggacugaaccagaauaaaaaggcggccaaacucuacaagcgcgagagagcucagaaacggagaaacuccagcauuccuaauggcaagcugcccauggaaucucccgcccaaaacuucaccaucaaggagaaagaucuugaacuguccgacacagaggagccuccgaauuaugacgaagagaugagcgggggaauugaauuucucgcuucugucaccaaggauacagccuccgacagccccgccggcaucgauaacccuguguuuucucccgacgaggcucuggaucgcagccugcuugcgcggcugccucccuggcucuccccgggggaaaccguggucccuagccagagagcccgcacgcagauucccuacucuccuggaaccuucuguagacugaugcccuuucggcucuccagcaaauccguugacucuuuccugcaggcugauggcccugaggagcggcccccggccgcccuuccugaaagcacacacauguga

SEQ ID NO: 75896 - RNA, 1077 nt, Artificial Sequence
  derived and/or modified sequence opt5 from SLC9A3R1__Homo_sapiens__NP_004243
augagcgccgacgcugccgcgggcgcuccccugccuagacucugcugucuggagaaggggccgaacggauacggcuuccaccuucauggggaaaaaggaaagcugggccaguauauccggcucguggagcccggguccccugccgaaaaagccggacugcuugcuggcgaucgccuggucgagguuaauggcgaaaacguggagaaggagacccaccaacagguggucucucggauucgggccgcucucaaugccgugcgccugcugguuguggaccccgaaacagaugagcagcuccagaaacuggggguccaagugagagaggaacuucugcgggcgcaggaggccccuggacaggcugaacccccugccgcugccgagguucagggcgcggggaacgaaaaugagccgcgcgaagccgacaagagccaucccgagcaaagagagcuccggccucgccugugcacgaugaagaaaggacccuccggcuacggguuuaaccuucacucugauaagagcaaaccuggacaguucaucagauccguggaccccgauucuccggcugaagccagcggccugcgggcucaggaccgcauugucgaggugaauggcguguguauggaagggaagcagcauggagaugucguuuccgccaucagagccggcggggacgagaccaaacuccuggugguggaucgggaaacagacgaguuuuucaagaagugccgcgucauuccuagccaagagcaccugaacggaccccucccugugcccuuuaccaauggcgaaauccagaaagagaacucuagagaagcucuggcggaggccgcucuugaaucccccagaccugcccugguuagaagcgccucuuccgauacaagcgaggagcucaauucucaggacuccccgcccaagcaagacagcaccgcuccuuccucuacaagcuccagcgaucccauccuggacuucaacauuucucuugccauggcgaaagaacgcgcucaccagaagcgguccagcaaaagagccccucagauggauuggucuaagaaaaaugagcuguuuagcaaccucuga

SEQ ID NO: 75897 - RNA, 1014 nt, Artificial Sequence
  derived and/or modified sequence opt5 from SLC9A3R2__Homo_sapiens__NP_001123484
auggccgcucccgagccucugagaccgcggcucugccgccuggugagaggcgaacagggguacggauuccaccuucauggcgagaaggggcggcgcggacaauuuauuagacgggucgaacccggcagcccugccgaggcggcugcccugcgcgccggggacagacucguugaagugaacggagugaaugucgagggcgagacccaccaucaggugguucagcggauuaaagcuguggaaggccagacacgccugcuugucguggaucaagagacggacgaagaacugagacggcgccagcucaccuguacagaggaaauggcccagagagggcugcccccugcucacgaucccugggagccuaagccggacugggcccauaccggaucccacucuagcgaagcgggcaaaaaggauguuuccgggccccugcgggagcuccgcccuagacugugccaccuucggaaaggaccccagggcuauggguucaaccugcauucugacaagagcagaccuggacaauacauccgcuccguggaucccggcucuccggccgcucggagcggccucagagcccaggaccgccugauugaagucaaugggcagaacguggagggacuucggcacgcugagguggucgccuccaucaaggcgagagaagaugaggcccgccugcucguuguggacccugaaacagaugagcauuuuaaacggcugagagugacccccacagaggagcacgucgagggcccucugcccagccccgugaccaaugggacgucuccugcucagcucaacggaggcuccgccuguagcucucgcuccgaccugccggggagcgauaaggacaccgaagacggaucugcuuggaaacaagaucccuuccaggaguccggccuucaccugagcccuacagccgccgaagcuaaggagaaagcgcgggccaugagaguuaauaagcgcgcuccccagauggacuggaaccggaagagagaaaucuuuuccaauuucuga

SEQ ID NO: 75898 - RNA, 2397 nt, Artificial Sequence
  derived and/or modified sequence opt5 from SLC9A4__Homo_sapiens__NP_001011552
auggcccugcagauguucgugaccuacagccccuggaacugccuccugcuucuggucgcucucgaguguuccgaagccucuagcgaccugaaugaguccgcgaacucuacagcucaauaugccagcaaugccugguuugcugccgcuuccucugaaccugaggaaggcaucagcguuuucgagcuugauuacgacuaugugcagauuccguacgaggugacgcuguggauccuccuggccucccuggcgaagauuggguuucaccucuaucauagacugcccggacuuaugccugaaagcugccugcucauccuggucggcgcccuuguugggggaauuaucuucggcaccgaucacaaaucucccccugugauggacuccagcaucuacuuucuguaucuccugcccccuauugugcuggaagggggauacuucaugccgacacggcccuuuuucgaaaacaucggcucuauucucuggugggcuguccugggcgcccuuaucaaugcucuggggauuggacucucccuguaccuuaucugucaggugaaggccuuuggccugggggauguuaaccuccugcagaaucuccuguucggaagccugauuucugcgguggacccugucgccgugcuugcuguguuugaggaggcccgcgucaacgaacaacuguauaugaugaucuucggcgaggcucuccugaaugaugggaucaccguugugcuuuacaacaugcugauugccuuuacaaaaaugcauaaguucgaagacaucgagaccguggauauucucgccggaugcgcuagauucaucgucgugggccugggcgggguucuguuuggaauuguguucggcuuuaucuccgcguucaucacacgguuuacccagaauauuagcgccaucgaaccccucauugucuucauguuuuccuaucugucuuaccuugcugccgagacgcuguaucucagcgggauccuggccauuaccgcuugugccgugacaaugaaaaaguacguugaggaaaacgugucccagaccagcuauacaaccaucaaguacuucaugaaaaugcugucuuccgucagcgagacgcuuaucuuuauuuucaugggagugucuacagucggcaagaaucacgaauggaacugggcguuuaucugcuucacccucgcuuuuugucagauuuggcgcgccaucagcguguucgcccuguucuacauuuccaaucaauuuagaacauucccuuuuucuaucaaagaccagugcauuaucuucuauagcgggguucggggagcuggcuccuuuagccuggccuuccuccugccccuuucucuguuuccgcgcaagaaaauguucgugaccgcuacccucgucgugaucuacuuuacaguuuucauucagggcaucacgguggggccucuggucagauaucuggaugugaagaagaccaacaaaaaggaguccauuaacgaggagcuucauauccggcucauggaccaccugaaagccggaauugaggauguguguggccacuggagccauuaccagguucgcgacaaguuuaaaaaguucgaccacagauaucugcggaaaauccucauccgcaagaaucugcccaagucuuccauugucagccuuuacaaaaagcuggaaaugaaacaagcgaucgagaugguggaaacagggauucucuccucuaccgccuuuagcaucccucaucaggcucagcggauucaaggaaucaagagacugucccccgaggauguggaaucuauccgcgacauucugacaagcaacauguaucaggucagacagcggacccuuuccuacaauaaauacaaccucaagccccagacgagcgagaagcaagccaaagagauccugauuagacgccagaauacacugcgggaaucuaugagaaagggccacucccucccuugggggaaaccggcuggcaccaagaacauccgcuaucugagcuaccccuauggaaauccucagucugccggccgggauaccagagcggccggguucuccgacgaugacagcucugaucccggaagcccuuccauuacauucagcgcuugcucucgcaucggcucccuucagaaacaagaggcccaggaaaucauucccaugaaaagccugcaccgggggagaaaggcuuuuuccuucggauaccagcgcaacaccucucaggaggaguaucucggcggggugcggagaguugcccugcgcccgaaaccucuguuucaugccguggacgaagagggcgaaagcggaggcgaguccgaagggaaggcuucucuugucgaggugcggagcagauggacagcggaucacggacauggccgggaccaccaucgcucccacucuccccuccugcaaaagaaguga

SEQ ID NO: 75899 - RNA, 2691 nt, Artificial Sequence
  derived and/or modified sequence opt5 from SLC9A5__Homo_sapiens__NP_004585
augcugagagccgcucucagccugcuugcccugccccucgcgggcgcugccgaggaaccuacccagaagccggagucccccggggaaccucccccuggacuggagcuuuuccgguggcaauggcacgaaguggaggcccccuaccuggucgcucucuggauccugguugccucucuggcuaaaauuguguuucaucucagccgcaaggugacaucccuggucccugagucuugccuucugauccuccugggccuugugcucgggggaauuguucuggccguggcgaaaaaggccgaauaucagcuggagccgggcacguucuuucuguuccuccugcccccuaucguccuugacagcggguacuuuaugcccuccagacuguucuuugauaaccucggagcuauucugaccuaugccgugguuggcacacuuuggaaugcuuucaccacaggcgccgcgcugugggggcuccagcaggccggacugguggcuccucggguccaagccggccugcucgacuuucugcuuuucgggucucugaucagcgcuguggaucccguggccguccucgccguuuuugaagaggugcacgugaacgagacccuguucaucauugucuuuggagaaucccuucugaaugacgcugugacaguugugcucuacaaagucuguaacagcuucguggagaugggcucugcgaauguucaggccaccgauuaucugaaggggguggcuucccuguucgucgugagccucggaggcgccgccgucggccugguguuugcuuuccuucuggcccucacgacccgcuuuacaaagagaguucggaucauugaaccgcugcugguguuccuucucgcguacgcugccuaucugaccgccgagauggcuucucuguccgccauccucgcugucacaaugugcgggcugggauguaaaaaguacguggaagccaacauuagccauaaaucucgcaccacgguuaaguacacaaugaaaacccuugcguccugcgccgagacagugaucuuuaugcugcucggcauuagcgcugucgacuccucuaagugggccugggauagcgggcuggugcugggaacccuuaucuucauccucuuuuucagagcucugggcgugguucugcagaccuggguccucaaucaguuucggcuggugccucuugacaagauugaucaaguggucauguccuaugggggacugcgcggcgccguggcguucgcccucguuauccugcuggacagaacaaaagugcccgcuaaggauuacuuugucgccacgaccauugugguuguguucuuuacagucaucgugcagggccuuaccauuaaaccucucguuaaguggcugaaagugaagcggagcgagcaccauaaacccacacugaaccaggaacuccacgagcacaccuucgaccauauccuggcugccgucgaagaugugguggggcaccauggauaucacuacuggcgcgacagaugggagcaguucgacaagaaguaucuuucucaacugcucaugcggcgcuccgccuacagaauccgggaucagauuugggacgucuauuacagacugaauauccgcgaugcuauuagcuuuguugaccagggcgggcacgugcugucuagcacgggacuuacacuccccuccaugccuucucggaacagcguggcggaaaccuccgucaccaaucugcugagagagagcggcucuggggccugucucgaucugcaagugaucgacacaguucgcuccggccgggauagagaggacgcugugaugcaucaccuucugugcggaggccucuacaaaccgcgccggagauauaaggccagcuguucucgccauuucauuuccgaagaugcccaggagcggcaggacaaagaagucuuucagcaaaacaugaagagacgccuggagagcuucaaauccaccaagcacaauaucugcuuuacaaagucuaaaccccggccuagaaagacggggcggcgcaaaaaggauggaguggcuaacgccgaagcgaccaauggcaaacauagagggcugggauuccaggacacagcugccguuauccuuaccguggagagcgaggaagaggaagaggaguccgacucuagcgaaacagagaaggaagaugacgagggcauuaucuuugucgcccgggcuaccuccgaagugcugcaggaggggaagguuagcggcucucucgaggugugucccuccccuagaauuauucccccgagcccuacgugcgccgaaaaagagcugcccuggaagucuggacagggcgaucucgcggucuacguguccagcgaaaccacaaaaaucgugccugucgacaugcaaaccggguggaaccagucuaucagcucccuggagagccuugcuucucccccuuguaaccaggcccccauucugacaugccucccgccucacccccgcggaaccgaggaaccccagguuccucugcaucugccguccgauccccggagcuccuucgccuuuccucccucucuugcuaaggccggcagaagccgcuccgagucuagcgcugaccugccucaacagcaggaacuccagccccugauggggcacaaagaucacacgcaucucuccccuggaacagccaccucucacuggugcauccaauucaauagaggcagccggcuguga

SEQ ID NO: 75900 - RNA, 2106 nt, Artificial Sequence
  derived and/or modified sequence opt5 from SLC9A6__Homo_sapiens__NP_001036002
auggccagacggggcuggcgcagagcuccccugcggcgcggggugggaagcuccccuagagcccggcgccucaugagaccgcuguggcuucugcucgcggucggcguuuucgacugggcuggggccucugauggaggcgggggagaggcccgggcuauggacgaagagaucgugagcgaaaagcaggccgaggaaucccaccgccaagauucugcuaaccugcuuauuuuuauccugcuccugacccugacaauucucacgaucuggcuguucaaacauagacgggcccgcuuucuucacgagaccggccuggcgaugauuuacggccuccugguggggcuuguccugagauauggaauccaugugcccagcgacguuaauaacgugacacucuccugcgagguccagucuagcccuaccacacugcuggugaauguuuccggcaaguucuacgaauauaugcucaaaggggagaucagcucucacgaacugaacaaugugcaggauaacgagaugcuucggaaggucaccuuugaccccgagguguucuuuaauauucugcucccucccaucauuuucuacgccggauauucccugaaacgcagacacuuuuuccggaaccuuggcagcauccuggcuuacgccuuucucgggacagcuauuucuuguuucgugaucggauccauuauguauggcugcgucacccugaugaagguuacgggccagcuggccggggauuuuuacuucaccgacugucuccuguucggagcgaucgugagcgccacagauccugugaccguccuugcuaucuuucaugaacugcaaguggacguugagcucuacgcccugcuuuucggcgaaucugugcugaaugaugcugucgccauugugcucuccagcuccaucguugccuaucagccggcuggggacaacucucacacauuugaugugaccgcgauguucaagagcauuggaaucuuucugggcauuuucuccgggagcuuugccaugggagcugccacgggcgucgugacagcccuggucaccaaauucacaaagcucagagaguuucagcugcuugaaaccggccuguucuuucucaugucuugguccaccuuccugcuggcugaggccuggggguuuacaggagugguugcggugcuuuucugcggcaucacgcaggcucauuacaccuauaauaaccucagcacagagucucaacaccgcaccaaacagcuguucgaacugcucaauuuucuggccgagaacuucaucuuuagcuacauggggcuuacacuguucaccuuucagaaucaugucuucaaccccacguuugugguuggagccuucguggcuauuuuucucggccgggccgcuaacaucuauccucugucccugcuucucaaucuggggagacgcucuaagauuggcagcaacuuccagcacaugaugauguuugccggacugcggggcgcgauggccuucgcucucgccaucagagacacagcuaccuacgcccgccaaaugauguuuuccaccacacugcuuauugucuucuucaccguguggguguuugggggaggcacaacggcgaugcugagcugucuccacauccggguuggggucgacucugaucaggaacaucugggagugcccgagaaugaaagacgcaccacaaaagccgaguccgcuuggcuguuccggaugugguauaacuuugaccacaauuaccuuaagccucuccugacccauagcgggcccccgcugacaaccacgcucccugccugcuguggccccaucgcuagaugccugaccucuccucaggccuacgagaaccaagaacagcuuaaggaugacgauuccgaccugauucucaaugauggcgacaucagccugacauauggagauuccaccgugaacacagagcccgccaccucuagcgcuccccgccgguucaugggcaauuccucugaagacgcgcuggauagagagcuugccuuuggggaccacgaacucgucauucggggaacgcgccuggugcugccuauggacgauagcgagccgccccucaaccugcuugacaauacaagacauggcccugcuuga

SEQ ID NO: 75901 - RNA, 2178 nt, Artificial Sequence
  derived and/or modified sequence opt5 from SLC9A7__Homo_sapiens__NP_115980
auggagcccggcgacgccgcuagaccugggagcggacgggccaccggcgcgccgcccccucgccugcuccugcuuccccugcuccugggguggggacuuagaguggcugccgccgcuuccgccucuagcuccggcgcugccgcggaagauucuagcgccauggaggaacuggcuacagagaaggaagccgaggagucccaccggcaggacucugucagccuccugacguucauccugcuccugacccuuacaauucugaccaucuggcucuuuaaacaucgcagaguucgguuccugcacgaaacagggcuugcuaugauuuacggacugaucgugggcgugauucuccgcuauggcaccccugccacauccgggagagauaagagccugucuugcacccaagaggaccgggcguuuuccacgcugcucgucaacgugagcggaaaauucuuugaauacacccugaagggcgagaucucucccgggaaaaucaauuccguugagcagaacgauaugcuucgcaaggugacauucgacccugaagucuuuuucaauauucugcucccgcccaucauuuuucaugccggauauagccugaagaaaagacacuucuuucggaaccuuggcucuauccuggcuuacgccuuccucgggaccgcuguguccuguuuuauuaucggaaaucugauguauggcguugugaagcugaugaaaauuaugggccagcucagcgauaaguucuacuauacagacugccuguucuuuggggccaucaucuccgccaccgauccugucacggugcuugcuauuuucaacgagcugcaugcggacguggaucucuacgcccugcuuuuuggagaaucuguccugaaugacgcuguugccaucgugcucagcuccagcauuguggccuaccagcccgcuggccugaacacacacgccuucgaugcggcugccuuuuucaaaucugucgggaucuuucugggaauuuucuccggcagcuuuaccaugggggccgugacaggaguuaaugcuaacgugaccaaguucaccaagcuccacuguuuuccucugcuugagacagcccuguucuuucucaugucuuggagcacguuccugcuggcugaagccugcggcuucaccggcgucguggcgguucucuuuugugggaucacacaagcccauuauaccuacaauaaccuuuccguggagucucgcagcagaacaaaacagcuguucgagguccugcacuuucucgcugaaaauuucaucuuuuccuauaugggacuggcccuuuucaccuuucagaagcauguguucagccccauuuuuaucauuggcgcuuucgucgccaucuuucuggggcgggcggcccacauuuacccgcucucuuucuuucugaaccugggacgcagacacaaaaucggcuggaauuuccagcauaugaugauguucuccgggcuucggggcgcuauggccuuugcucucgccaucagagacacggccagcuaugcucgccaaaugauguucacaaccacccugcugauuguguuuuucacaguuuggaucauuggaggcgggaccacaccuaugcucucuuggcugaacauccgggugggagucgaggaacccuccgaggaagaccagaacgagcaccauuggcaguacuuuagagugggcguugauccugaccaggaucccccucccaauaacgacagcuuccaagugcuucagggggauggaccggacuccgcgcgcggcaaucggacgaagcaggagucugccuggauuuuuagacugugguauagcuucgaucacaacuaccucaaacccauccugacccauuccgggccuccccugacaaccacacuuccugcuuggugcggccuccuggcccgcugucugaccucuccccaagucuacgacaaucaggaaccgcuccgggaggaagauagcgacuuuauucugacggagggagaucuuacccugacauauggcgacuccaccgugacagccaacgggucuagcuccagccacaccgcuucuacgucccucgaaggaagcagacgcacaaagucuagcuccgaggaggugcuggaacgggaccugggcaugggggaucagaaaguuagcucuagaggaacccgccuugucuucccucucgaggacaaugccuga

SEQ ID NO: 75902 - RNA, 1794 nt, Artificial Sequence
  derived and/or modified sequence opt5 from SLC9A8__Homo_sapiens__NP_001247420
augggcgagaagauggccgaagaggaaagauuccccaacaccacacacgagggguuuaaugugacgcugcauaccacacucgucguuaccacaaaacuggugcuuccuaccccgggaaagcccauccugccugugcagacaggcgaacaagcucagcaggaggagcagagcuccgggaugaccauuuucuuuucucuccugguccuugccaucugcauuauccuggugcaccuccugauucgguaccgccugcauuuccuccccgaaagcguugcgguggucucccugggaauccuuaugggcgcugugaucaaaauuaucgaguuuaagaaacuggccaacuggaaggaagaggagauguucagaccuaauauguuuuuccuccugcuucugcccccuauuaucuuugaaucuggguauagccuccacaagggaaacuucuuucaaaauauuggcuccaucacgcuguucgccguuuuuggcaccgcuauuucugccuucguggucgggggaggcaucuacuuccuggggcagggauuuuucuuugugugugugugcgucuucguuuguuuuauccuccaggcugacgugauuagcaaacugaacaugacagauuccuucgccuuuggcagccuuaucucugcgguggacccggucgccaccauugcuaucuucaaugcccugcauguggaucccguucucaacaugcugguguuuggggaguccauucuuaaugacgcugucagcaucgugcugacaaacaccgccgaaggacucacgcggaagaauaugucugauguuuccggcuggcagacauuccugcaagcgcuggacuauuuucucaaaauguucuuuggcagcgccgcucuggggacccuuacaggacugaucucugcccucgugcugaagcacauugaucuucgcaaaaccccuucccuggaguucggcaugaugaucauuuucgcuuaccuccccuaugggcuggccgaaggaaucagccuguccggcauuauggccauccucuuuucugggaucgucaugagccacuacacccaucacaaccuguccccugugacacagauucuuaugcagcagacgcugagaaccgucgcuuuccucugcgagacauguguguuugcguuccugggacugagcaucuuuucuuucccccauaaguuugagauuuccuucguuaucuggugcauugugcuuguccucuuuggccgggccgugaauaucuucccgcugagcuaucugcucaacuuuuuccgcgaccacaagauuaccccuaaaaugauguuuaucaugugguucucuggccugagaggggcuauccccuacgcccuuagccugcaccucgaucuggaaccuauggagaagcggcaacugauuggaacaaccacgaucguuauugugcuuuucacaauccuccugcugggcggguccaccaugccccucauucgccugauggacaucgaagaugccaaagcucauagacggaauaagaaagacgucaaccuuucuaagaccgagaaaaugggaaacacaguggaaagcgagcaccuguccgagcucaccgaagaggaauacgaggcccauuauauccgcagacaggaucugaagggcuuuguguggcuggacgcgaaguaccuuaaucccuucuuuacacggcgccucacgcaggaagaccugcaccaugggcggauucaaaugaaaacccugacaaacaagugguaugaggagguuagacagggcccuagcggaucugaagaugacgagcaggaacuccuguga

SEQ ID NO: 75903 - RNA, 1938 nt, Artificial Sequence
  derived and/or modified sequence opt5 from SLC9A9__Homo_sapiens__NP_775924
auggagagacagagccgggugauguccgaaaaggacgaguaccaauuccagcaccagggcgccgucgaacugcucguuuuuaacuuccugcuuauccugaccauucucacaaucuggcuguuuaaaaaucaucgcuucagauuucuucacgagacgggcggagcuaugguguauggccugauuauggggcucauccugcgguacgccaccgcgcccacagauauugaaucuggaaccguguaugacugcgucaagcugacauucagcccuuccacccuccuggugaacaucacagaucagguuuacgaguauaaauacaagcgcgagaucucucaacauaauauuaacccgcaccagggcaaugcuauccuugagaaaaugaccuuugaccccgaaauuuucuuuaacgugcugcucccucccaucauuuuccaugccggguauagccugaagaagagacacuuuuuccagaaucuuggauccauccugacguacgccuuucucggcaccgcuauuucuuguaucgucaucggccugauuauguacggguucgugaaagccaugauccacgcuggacagcugaagaacggcgauuuccauuuuacagacugccucuucuuugggagccugauguccgccaccgauccuguuacagugcuugcgauuuuccacgaacugcaugucgaccccgaucucuauacccugcuuuuuggagagagcgugcugaaugacgccguggcuaucguccucacguacucuauuuccaucuauagcccuaaagagaacccgaaugccuucgaugcugccgcguuuuuccaaucuguuggcaacuuucuggggaucuucgccggauccuuugcuaugggcagcgccuacgcuauuaucacagcccugcucaccaaguucacaaaacugugugaauuucccaugcuugagaccggccuguucuuccuccugucuugguccgccuuucuuagcgcugaagcggccgggcugaccggaauuguggcuguccucuucugcggcgugacacaggcccacuauacguacaauaaccuguccucugacagcaagauccggaccaagcagcuguuugaguucaugaauuuucucgccgaaaacgugauuuucuguuauauggggcuggcucuuuuuacauuccagaaccacaucuuuaaugcccuguucauccucggagcguuucuggcuauuuucguugcccgcgccugcaacaucuacccucuguccuuucuucucaaucugggcagaaaacaaaagauucccuggaacuuccagcauaugaugauguucagcgggcugcggggagcuaucgccuuugcucucgccauucgcaauaccgagucucagccuaaacaaaugauguucacaaccacgcugcuucugguguuuuucacagucuggguguuuggcggcgggaccacccccaugcucacauggcugcagaucagaguuggaguggaucuggacgagaaccuuaaggaagacccguccagccagcaccaggaggcgaauaaccucgauaaaaauaugaccaaggccgaaucugcucggcuguuccgcaugugguacagcuuugaccauaaauaucugaagccuauucucacacacuccgggcccccucugacgaccacacuucccgaguggugugggcccaucucuagacugcucaccagcccucaagccuacggagaacagcugaaggaggaugacgucgagugcaucgugaaccaggaugaacuggcuauuaauuaucaggagcaagccuccagcccguguucucccccugcgcggcuuggccucgaccagaaagccagcccccagacaccugggaaggaaaacaucuacgagggcgaucugggacugggcggguaugaacucaaacuggagcagacccuuggacaaucccagcugaauuga

SEQ ID NO: 75904 - RNA, 1428 nt, Artificial Sequence
  derived and/or modified sequence opt5 from SLC9B1__Homo_sapiens__NP_001094344
augcacaccacagagagcaagaacgaacaucuggaggacgaaaauuuccagacguccaccacaccccaaucucucaucgauccuaacaauaccgcccacgaggaaacaaaaaccgugcugagcgacacagaggagauuaagccgcagaccaaaaaggaaacguacaucuccugcccccuuagaggcguccugaacguuauuaucaccaauggggugauucucuuugugaucugguguaugacauggucuauccugggaagcgaggcucugccuggcgggaaccuguucggacucuuuauuaucuucuauuccgccauuaucggcgggaaaauucugcagcugauccggauuccccucgucccuccccugccuccgcuucugggaaugcuccuggcgggcuuuaccauccgcaaugugcccuucaucaacgaacauguucacgugccuaauacauggucuagcauucuuagauccaucgcucugaccauuauccucauucgggccggccuggggcuggauccccaggcccuccgccaucugaaggucgugugcuuuagacuugcuguuggaccuugucugauggaggccagcgcugccgcgguguucucucacuuuaucaugaaguuccccuggcaaugggccuuucuccugggcuucguccuuggggcuguguccccggccguggucguuccuuacaugauggugcugcaggagaacggauauggcguggaagaggggauccccacgcuccugauggcugccagcucuauggacgauauucuggcgaucacaggauuuaauaccugccucuccauugucuucagcucuggcggcauccugaacaaugccauugcuuccauccggaacguguguaucagccuucuggccgggauuguucucggauucuuugugcgcuacuucccuuccgaagaccagaaaaagcugacacuuaaaagaggcuuucugguccucaccaugugcgugucugcuguucuggggagccagcggaucggacugcacggcuccgggggacucuguacccuggugcuuagcuucauugccggcacaaaguggucucaagagaaaaugaagguccagaagaucauuacgaccgugugggauaucuuucagccccuucucuucggccuggucggggccgaaguguccguuagcucucuggagagcaauauugugggaaucuccgucgcuacacuuucucucgcgcugugcgugcgcauccugaccacauaucuccugauguguuuugccggcuucagcuuuaaagagaagauuuucaucgcucuugccuggaugcccaaagccaccguucagauuaaccaagcuauccugcuccuguuucugcuuagagaagaguggacgaacugcaagguggccaaaaagugugaauacacaaaagagcggcaguga

SEQ ID NO: 75905 - RNA, 1254 nt, Artificial Sequence
  derived and/or modified sequence opt5 from SLC9B2__Homo_sapiens__NP_001287685
augggcgacgaggauaagagaaucaccuacgaagacagcgagcccuccacagggaugaacuauacgccuucuaugcaccaggaagcccaagaggaaaccgugaugaaacugaagggaauugaugcuaaugagccgacagagggcagcauccuccugaaauccucugaaaagaaacuucaggagacccccacagaagccaaccauguccagcggcugcgccagaugcucgcgugcccuccccacgggcugcuugacagaguuauuaccaauggaaugcugcucgcuggcuuccugauccggaacauuccugugaucaaugauaacgugcaaaucaagcauaaguggagcuccucucugcgcagcauugcccucuccaucauucuggucagagccgggcuuggacuggacagcaaagcucucaagaaacugaagggcguguguguucggcuuucuaugggccccugcaucguggaggccuguacauccgcucugcucgcccacuaccugcuggggcucccuuggcaguggggauuuauucugggcuucguccuuggggcggugagcccggccguugugguccccucuaugcugcuccugcagggaggcggguauggaguggagaaaggcgugccuacccuucugauggcugccggcuccuuugaugacauccucgcuauuacgggguucaauaccugccugggaaucgccuuuagcacaggcucuaccgucuucaacguucugcgcggggugcucgaaguggucaucggaguggcgacaggcuccguucugggguuuuucauucaguacuuucccagcagagaucaagacaaacuuguguguaagcggaccuuccugguccucggacuguccgugcuugccguguuuucuagcguucauuucggcuuuccuggcuccgggggacugugcacgcucgucauggcuuuccuggccggcaugggguggacaagcgagaaggcugaaguggagaagaucauugccgucgccugggauaucuuccagccccugcucuuuggacugauuggcgcugaagugucuaucgcgucccuucgcccggagaccguuggguguaauagaaucugcggcuucggacacagcaaagugacauggcgggagaccauucgcagacuguggaacggcugugucgacucugggaucuuugugcacccucaucacagccccaauuggaaguccgccuauugguucaccggaccucaggcuucugccgaaagcuga

SEQ ID NO: 75906 - RNA, 3534 nt, Artificial Sequence
  derived and/or modified sequence opt5 from SLC9C1__Homo_sapiens__NP_898884
auggccggcaucuucaaggaguuuuucuuuagcaccgaagaccugcccgaggugauucucacacugucccuuaucucuagcauuggggcuuuccugaacagacaccucgaagauuuuccuaucccgguccccguuauucuguuccuucugggaugcuccuuugaggugcucucuuucacgagcucccaggugcaacgguacgccaaugcgauccaguggaugucuccugaccuguuuuuccgcaucuuuacccccgucguguucuuuacaaccgcuuucgauauggacacauauaugcugcagaaacucuucuggcagauucugcuuaucagcauuccuggcuuucugguuaacuacauccucgugcuguggcaucuugccuccgucaaucaacugcuccugaagcccacccaguggcuucucuucagcgccauucuggugucuuccgauccuaugcuuacagcugccgcuaucagagaccuggggcucagccggucucugauuucccuuaucaacggagaaagccugaugaccucuguuaucucccucauuacguuuaccagcaucauggauuucgaccagcgccugcaguccaaaagaaaucacacacuggccgaggagauugugggcgggaucuguucuuauauuaucgcgagcuuucucuucggaauccuguccagcaagcugauucaauuuuggaugucuaccgucuucggcgaugacgugaaccauaucucccugauuuuuagcauccucuaccugauuuucuauaucugcgaacuugugggcaugucugggaucuuuacacuggccauugucggacuccugcugaauagcaccuccuucaaagcugccaucgaggaaacgcuccugcuugaguuuuggacauuccugucucggauugcuuuccucaugguuuuuaccuucuuuggccugcugaucccggcccacacauaccuuuauauugaguucguggauaucuacuacagccucaacauuuaucugacccugaucgugcuccgcuuucugacccuucugcucaucucccccguccugagcagaguggggcaugaguucucuuggcgguggauuuuuaucaugguuuguuccgaaaugaagggaaugccuaauauuaacauggcgcugcuucucgccuacagcgaccuguauuucggcucugauaaggaaaaaucccagauccuguuucacggggugcucgucugccugauuacacuugugguuaaucgcuucauccugcccguggcugucacgauccucggacugagagacgccaccagcacaaaguacaaauccguguguugcaccuuucagcacuuccaggagcugacaaagucugcugccagcgcccuuaaauuugacaaggaucucgcuaacgcggacuggaauaugauugaaaaggccaucacccuggagaacccuuauaugcugaaugaggaagagacgacagaacaucaaaaagucaaguguccccacugcaacaaagagauugaugaaaucuucaacaccgaggcuauggagcucgccaaucggcgccugcuuuccgcccagauugcuucuuaccagagacaauaucggaacgaaauccugagccaguccgccgugcagguucucgugggcgcggcugagagcuucggcgaaaagaaagggaaguguaugucucuggacaccaucaaaaauuacuccgagagccagaagacagucaccuuugcccgcaagcugcuucucaacuggguguacaauacaagaaaagaaaaggagggaccgucuaaauauuucuuuuuccggauuugccauacgaucguuuuuaccgaggaguucgaacacgugggcuaccuggucauucugaugaacaucuuuccuuucauuaucuccuggaucagccaacucaaugugauuuaucacucugaacugaagcauacaaacuacuguuuucuuacccuguauauccucgaggcccugcugaaaauugcugccaugagaaaggauuucuuuagccacgcuuggaauaucuucgagcuugccauuacacugaucgggauucuccaugugauccugaucgaaauugacaccaucaaguacauuuucaacgagacggaaguuaucgucuuuauuaaaguggugcaguucuuucgcauccuccggaucuucaagcugauugcgcccaaacuucugcagaucauugauaagagaaugucccaccagaaaaccuuuugguauggaauccucaagggcuacguccaaggggaggccgacauuaugacaaucaucgaucagauuaccagcucuaagcagaucaaacagaugcugcugaagcaagugauucgcaauauggaacaugcuaucaaagagcuuggauaccuggaguaugaccacccugaaauugccguuacagugaagaccaaagaggaaaucaacgucaugcucaauauggcuacggagauucugaaggccuucggccucaagggcaucaucuccaaaacagaaggggcgggaauuaacaagcugaucauggccaaaaagaaagaggugcuugauagccaguccauuauccggccccugaccguugaggaagugcucuaccacauucccuggcuggacaagaauaaagacuauaucaacuuuauccaggagaaggcuaaggucgugacauucgauugcggcaacgacauuuuugaagagggggaugaaccuaaaggaaucuacauuaucauuucuggcaugguuaagcuggagaaaagcaagccggggcuuggcaucgaccagaugguggaguccaaagaaaaggauuuccccaucauugacaccgauuauaugcugucuggagagaucauuggcgaaaucaauugccucaccaacgagccuaugaaguacagcgccacauguaaaacggucguggagaccugcuuuauucccaagacacaucuguaugacgcuuucgaacaauguuccccucucaucaaacagaagauguggcugaaacuugggcuggccauuaccgccagaaagauccgcgagcaccugucuuacgaagauuggaauuacaacaugcagcucaagcugagcaauaucuauguggucgacauucccauguccacaaaaaccgauaucuacgacgagaaccuuauuuauguuauccugauucauggagcuguggaagauugccuccugcggaagacguacagagcgccguuucucaucccuaucacaugucaccaaauucagagcaucgaggacuucaccaaaguggucauuauccagacccccauuaauaugaagacauuccgccggaacaucagaaaauuugugccuaagcacaagucuuaucugacccccggccuuaucggguccguuggaacacuggaggaaggcauucaggaggaacgcaaugugaaagaggacggggcccauagcgcugccacggcccggucuccucaacccugcucccugcucggcaccaaguucaacuguaaagaaagcccgagaaucaaucugcggaagguccgcaaagaguga

SEQ ID NO: 75907 - RNA, 3375 nt, Artificial Sequence
  derived and/or modified sequence opt5 from SLC9C2__Homo_sapiens__NP_848622
augagcuccuacuucugggcccagaacgagucuaauagacccgaccugcucugcggccaaccugcugauuaucugguggaagagaagcacuuuaccacacuugucuguuucaucguugugcucgggggacugcugaaaaugugccuuaagaacugugaagugauuguccugacgauccucagccuguccggcuuugugauugggcauauggccuacaauucuguugaggugcaccagaucgucuauccgcugcuccggaccagcuccuucucucuguacagcuauuuuagcccccuuauuaucuucaugguggcgcuggacguugaauuuuacacacucaaaaagauguucuggcaagugcugcuuaccggacugaucuccuuuucuacagcuuccauuaucauuggcuaugucgugaucaaauucaacaaggauagcugggaccuccagucuugccugcuguuuuccauuacccucgggaucauugauccucugcgcagcguuaauucucuuaagacaaucggaaucuccaaaauuuacaucgaccugauuagaggcgagagccucaucauuuguuccaucgccucuaucuucuuuggcaacuuccgggggaaucgcauucauuucagcaucuuuagagaucugcacgucggaauugagcuuuccuacgacauccugggcagcauuaucuucggguauuggugcgccaagaucauucaauguauccucgcugauguguuuucuaacaugcugaccaauauuauccugugcuucuccaugguguacaugacguuuuauauuguggaguuccucggaaugagcggcacccuggcccuugcugccgucgggcugaaccucgacucucugacauuuaaacccaagaucgaacuugugauuaccaaauuccugcggaucuuuagcuccguuuacgaacaucucaucuaugcguucuuuggaauugugaucggcuguggcgagcugucucacuacgaguuccacacaauuccuuuuaucuucauucuguucaccacggucaaucucgugcgccugcuuacaauccugcucguuagccccauccugaugcauuccaacuaugaauacaauuggagauggggaguggucauuaccuggagcgggaucaagggcguguuuaaccugcuuugggccccugaugucuacaaucucgcugagcggaagguggaaguuccgcagauguucauucuguaugugcaggucaucucucugcucacaauggggauuaacuccuacgugaugacccagagcgcccgcaaacuggaccuuugcguucugucucuccccagacaaaugauccugcagaacgcuacccagcacauccaggagauugugcaaaauacaaucacgcuguuuaagaccgaaaagauucuuacaaacgucaauuggacccucguggaggauaagacacggaucgaguauauuccuuucucccaugugagccacaacgacaugaaaaccgaauccacgacagacgaggcccugauggaagaggcgcgccugcacguugccgcuauccagaugucuagcuuugaaaagcagagaaauaacggaauccucgagauugaggccgcucggauccugauuggcgccgccaaauguuacuauuccauccaagggaaguucaugucuauuuacgaugucagcaccuauaugcgcaccagauccuggcuuaucaaguuuaaaaaugugcugacauuccucgaauacugcauugagaagauccauuuuauucccccugaaagcaacaccuuccugacauuuaucuuccacaucguguuuucugaggaguucgaauacacgggacagauuaucaaucugauuuauaucuaccccaugaucauucaucuuuggccgauggcucggggccucaacgucuccgcgcugaucagcauuaauuauuacuucauguuucuguaugugcucgagucuacccugaaaaucauuauccuuaagagaaaauacuuccagcagugcuggaacacacuggaauuuuucauccucguuauuggcaucauugacaucuuuuguguguauuucgucaagcugcgcccugauaaucuggcccuuauucaacucaccgugaucaugggguaccugcggauuaucagauuucugccccucuucaagaucauuguuccuauccugauucgcaucgcugacgugcagauuaaaaagcggcuuucccugauguacagcaucacaaaaggauauaucaagucucaggaggaugccaaacuccugauuaagcagaucgccgucugcgaaagcauuuaccaaaagcugugugagauccuugagaccaacaaacaggacgcugugaaggaacugguucucauggagcacgaaggcagagauguggucauugcccugaaaacgaagcaggcgauccgcaaugugaucgcuaaagcccucaagaaccugaccuuucuuugcucccgggggauuaucgacaagcaugaggugauugaaaucaacaaaguccugcucaagaaacugaaggcccugaauaacuuccccaaagcuauucccccuccgacacccgauaucuaucuucacaauauuaucuggcuggagggaaaggacguucucaucgacuuuuucaaagagagagccaagcuggcuuguuucgauagcggcgacaccauuugcaaagggggcgaaaugccucagggaaucuaccucauuaucucuggcauggccauucugcacucccuuagccccacauuugggaucgaguccaaccaacgcugugaucggggaucuagagacauguucaccgaauuuugcacgacaggcgauaucauuggggagcugagcugucuccugaaacgcgaaaucgaguauaccgugauuugcgagacaucccugcaggcguguuucaucucucuugaagaccuguacgagggauuugaugccuucuggccuagccucgaauauaagauuuggcugaaacucgcucuguccaccgccuaccaguacuuugagucuagccuuaucgacgaagaucugcgguuccagaauugcgugauguuuaaccaggcuuaugucgagacccuguccagcuacucugacaugaucauugauaauaugacaaugaaguucgugaucauuguuuauggcuccgugaucgacacgaaaaccgaggaacccuacuuugccccgugcauuaucccuacaaccugugagcagguccaggggacaagcgaucucucuaagcugcuuauuauccaagcguccgaacugacccagagaaacagcaauacgaacgugauggccucuguuaauacaguguucgagcagcccggcaagaacaucaauggacggcagaaaauguccuga

SEQ ID NO: 75908 - RNA, 2013 nt, Artificial Sequence
  derived and/or modified sequence opt5 from SLCO1A2__Homo_sapiens__NP_602307
augggcgagaccgaaaagagaaucgagacacaccggauucgcugccugagcaaacucaagauguuccugcuugccaucacgugugcuuuuguguccaaaacccugucugggagcuacaugaacuccaugcucacacagauugaaagacaauucaauauccccaccucucuggucggauuuauuaacggcagcuucgagaucgggaaucuucugcucaucauuuuuguuuccuauuucggaacaaagcugcaucggccuaucaugauuggcaucgggugcguggugaugggacugggcuguuuucucaaaucucugccgcacuuccuuaugaaccaguacgaauaugagagcaccgucuccgugagcggcaaucugucuuccaacagcuuucucugcauggagaaugggacacagauucugcgccccacccaggacccuucugaauguacgaaggagguuaagucccuuauguggguguacguccuggugggaaacaucguuagaggcaugggggaaacccccauucucccucugggaaucagcuauaucgaggauuucgccaaauuugaaaauucuccccuguacauuggccucguggagacaggggcgaucauuggaccucugaucggccuucugcucgcuuccuucugcgccaacgucuauguggacaccggcuuugugaauacagaugaccugauuaucaccccgacggauacacggugggucggggccuggugguucggauuccuuaucugugcuggcguuaacgugcugaccgccauucccuuuuucuuucucccuaauacacugcccaaggaggggcuggaaaccaacgcugacaucauuaaaaaugagaacgaagauaagcaaaaagaggaggugaagaaggaaaaauacggaaucaccaaggacuuccucccuuuuaugaaaagccuguccugcaaccccauuuacaugcuuuucauccuggucucugugauccaguuuaaugccuucguuaacaugauuagcuuuaugccgaaguaucucgagcagcaguacggcaucuccagcucugaugcgauuuuccugauggggaucuauaaucuuccucccauuuguaucggauacauuaucggcggccugaucaugaaaaaguuuaaaauuacagugaagcaagccgcucauaucgggugcuggcucucccugcuggaauaucuccuguacuuccuuagcuuucugaugacgugugagaacucuagcgucgugggaauuaauaccuccuaugaaggcaucccucaggaccucuacguugagaacgauauuuucgccgacugcaauguggauugcaacugucccucuaagaucugggaccccgucugcgggaauaacggacugagcuaccuguccgcuugucuugccggcugcgagacaagcaucgggaccggcauuaauaugguguuccagaacuguucuugcauccagacauccggaaauagcucugcgguccucggccugugugacaaagggccugauugcucccugaugcuccaauauuuucugauucuuagcgccauguccucuuucaucuacagccuggcugccauuccgggauauauggugcuccugcgcuguaugaaguccgaagagaaaucucugggcguugggcuucacaccuuuugcacgagaguguucgcuggaauccccgccccuaucuacuuuggcgcccucauggacagcacaugucugcauugggggacccugaagugcggcgaauccggagcuugccggauuuaugauagcaccacauuccgcuacaucuaucucggccugcccgcggcccuuagagggucuuccuuugucccugcucugauuauccucauucugcugcggaaaugucaccuucccggagagaacgccagcucuggcaccgaacucaucgagacaaaggugaaggggaaagagaaugaaugcaaggacaucuaccagaaauccacgguucugaaggaugacgagcugaaaaccaagcucuga

SEQ ID NO: 75909 - RNA, 2076 nt, Artificial Sequence
  derived and/or modified sequence opt5 from SLCO1B1__Homo_sapiens__NP_006437
auggaccagaaccaacaccugaauaagaccgccgaggcucagcccagcgaaaacaaaaagacaagauacugcaauggccucaaaauguuccuggccgcgcuuucccugucuuuuaucgcuaagacgcucggggccauuaucaugaaaagcuccauuauccauauugagcggcgcuucgaaaucucuagcucccuggugggauuuaucgauggcucuuucgagauugggaaccuucuggucaucguuuuugugagcuauuucggauccaagcuccacagaccuaagcugauuggcaucggguguuuuauuaugggaaucggcggcgugcugaccgcccucccgcauuucuuuaugggguacuaucgguacagcaaagaaacaaauauuaacucuuccgagaauagcaccucuacacuguccacaugccuuaucaaccagauccugagccucaaucgcgcuucucccgagauugucggaaagggcugucugaaagaauccgggagcuauauguggaucuacguguucaugggaaacaugcuuagaggcauuggggagaccccuaucguuccccugggacucuccuauauugacgauuuugccaaggaaggccacucuagccuguaccugggcauccucaaugcuaucgccaugauugggccuaucauuggauucacccugggcucccuuuuuagcaaaauguacguggacaucggguaugucgaucugucuacgauucggaucacccccacagacucccgcugggugggagcgugguggcucaacuuccugguuagcggccuuuucucuaucauuagcuccaucccguuuuucuuucugccucagacccccaauaagccucaaaaggagagaaaagccucucucagccugcaugugcuggagacaaacgaugaaaaggaccagaccgcuaaucucacgaaccaggggaaaaacauuacaaagaaugucaccggauucuuucaguccuucaaaagcauccugacaaacccccuuuacgugauguuugugcugcucacccugcuucaagucucuuccuauauuggcgccuucaccuacguuuuuaaguauguggagcagcaguacggccagccuagcucuaaagcuaauauccugcucggggugauuacaauccccaucuucgccuccggaauguuucugggcggguauauuaucaagaaguucaaacugaacacggucggaauugcgaaguuuagcugcuucaccgccgugaugucccucucuuucuaccugcuuuacuuuuucauccugugugaaaauaaaagcguugcuggccucacaaugaccuaugaugggaacaauccggugacaucccaccgggacgucccucugucuuacugcaacagcgauuguaauugcgacgagucccaaugggaacccguguguggcaacaauggaauuaccuauaucagcccuugccuggccggcuguaagucuuccagcgggaacaaaaagcccaucguguuuuacaauugcucuugccuugagguuacgggacuccagaaccgcaauuauuccgcucaccugggcgagugucccagagaugacgccugcacacggaaguucuacuuuuucgucgccauucaggugcugaaccucuuuuucagcgcucuugggggaaccucucaugucaugcugaucgugaaaauuguucaaccugaacucaagagccuggcgcugggcuuucacuccauggugauccgcgcccuugggggcauucuggcuccgaucuauuucggagcccucaucgacaccacauguauuaaauggagcaccaacaauugcggcacaagagggucuugucggacguacaacuccaccagcuuuucccgcgucuaccugggacugucuagcaugcucagaguguccucucugguucuuuauaucauucugaucuacgccaugaagaaaaaguaucaggagaaggauauuaaugcuagcgaaaacggcuccgugauggacgaggccaaucucgaaucucugaacaaaaauaagcauuucguccccagcgcgggggcugauuccgagacacacugcuga

SEQ ID NO: 75910 - RNA, 2109 nt, Artificial Sequence
  derived and/or modified sequence opt5 from SLCO1B3__Homo_sapiens__NP_062818
auggaccagcaccaacaucugaacaagaccgccgagagcgcuuccucugaaaagaagaaaacaagacggugcaauggcuucaagauguuucucgccgcgcugagcuucuccuacaucgcuaaagcccuugggggaauuaucaugaagauuucuaucacgcagauugagcgcagauuugauaucagcuccucucuggccggccucaucgacgggagcuucgaaauuggaaaccugcuugugaucgucuuuguuuccuauuucggcagcaagcugcaccggcccaaacucauugggaucggaugucugcugaugggcaccggcucuauucucacaucccugccucauuucuucaugggguacuaucgcuacagcaaggagacccacaucaauccgucugaaaacuccacaagcucucuuuccacaugccugauuaaucagacccucagcuuuaacggaaccucccccgagaucguggagaaagauugugugaaggaaucuggcagccauauguggaucuaugucuucauggggaauaugcugagaggaauuggcgagacgccuaucgugccccuugggauuuccuacaucgacgauuuugcuaaagaaggacacagcucucuguaucucggcucccugaacgccauuggcaugaucgggccuguuaucggauucgcucugggcagccucuuugccaagauguacguggacauuggguacgucgaucugucuaccauccggauuacacccaaggacagccgcugggugggagcgugguggcuuggcuuccugguuuccgggcuguucucuaucauuagcuccaucccguuuuucuuucugccuaaaaaucccaacaagccucagaaagagagaaagaucagccuuucucugcacgugcucaaaaccaaugaugaccggaaccaaacagccaaucugaccaaccagggaaagaaugucacgaaaaacgugacaggcuucuuucagucccugaaaagcauucucaccaacccccuguaugugaucuuccuucugcucacacugcuucaggucucuuccuuuauuggcagcuucaccuacguuuuuaaguauauggagcaacaguacgggcaguccgcuucucaugccaauuuccugcucggaaucauuaccaucccuacaguggcuacgggcauguuucucgggggauucauuaucaaaaaguuuaaacugagccucgugggcaucgccaaguucuccuuccugaccucuaugauuagcuuucuuuuccagcugcucuauuuuccccugaucugcgaauccaaaagcgucgcggggcugacacuuaccuacgauggcaacaauucuguggccucccacguugacgugccgcucagcuauuguaacucugagugcaauugugaugaaucccaaugggagccugucugcggaaacaauggcauuacauaccugagccccugucuggcugggugcaagucuagcuccggaaucaagaaacauaccguguucuacaacuguagcugcguugaagugacgggccuccagaaucgcaacuauucugcccaccugggggagugcccuagagacaauacauguacccggaaguuuuucauuuacgucgcuauccaggugaucaacucccuuuuuagcgccaccggaggcacaaccuucauucugcucacagucaaaaucgugcaacccgagcugaaggcccuggcuaugggguuucaguccaugguuauucgcacgcuuggcggaauccucgcgcccauuuauuucggcgcccugaucgacaaaaccugcaugaaguggucuacaaauagcuguggggcucagggagccugcagaaucuacaacuccguguuuuucggccgggucuaucuggggcucucuauugcccugcgcuuuccugcucuugugcuguacaucguuuucauuuucgccaugaagaaaaaguuucagggaaaagauaccaaggcgagcgacaaugaaagaaaagugauggaugaggcuaaccucgaauuucugaacaauggcgagcacuuugucccguccgccgggacagacucuaagaccuguaaccuggauaugcaagacaaugccgcugccaacuga

SEQ ID NO: 75911 - RNA, 1923 nt, Artificial Sequence
  derived and/or modified sequence opt5 from SLCO1B7__Homo_sapiens__NP_001009562
augaagaucagcaccacacagauugagagacgguucgaaaucuccucuagccuggugggccucauugacggguccuuugagaucggaaaccuguucgucauuguuuuugugucuuacuucggcagcaaacuucaccgccccaagcugaucgggaucggaugcuuucucaugggcacgggguccauucugauggcccuuccucauuucuuuaugggauauuacagauauucuaaagaaaccaauaucgauccgagcgagaacuccacaagcaaucugcccaacugucucauuaaucaaaugcugucucugaaccggaccccuuccgaaaucauugagcgcggcugcgugaaggagagcggcucucacauguggaucuacgucuucauggggaauaugcucagaggaauuggcgaaacacccaucgugccucuggggaucuccuauauugacgauuuugcuaaagagggacauagcucucuuuaccugggcaccguuaacgugauggggaugacaggacucgucuucgccuuuaugcugggcucccuuuucgcgaagauguauguggacaucggcuacguugaucugagcaccauucggaucacgcccaaggacucccgcugggugggggcuugguggcucggauuucuggucucuggcauugugagcaucaucuccagcauuccuuucuucuuucugccgcucaaucccaacaaaccucagaaggaaagaaaagugucucuguuccuucacguccugaagaccaaugauaaacggaaccagaucgccaaucucacaaaccgcagaaaguacauuaccaagaauguuacaggguuuuuccagucccugaaaagcauccuuaccaacccccuguaugugauuuuugugaucuucacgcuccugcauaugucuagcuacaucgccucccugacauauauuaucaagauggucgagcaacaguacggauggucugcuagcaaaaccaacuuucuccugggcgugcuugcccugccugcuguugccauugggauguucuccggaggcuauaucauuaagaaauuuaagcucagccuggugggccuugcgaaacuggccuucuguucugcuacaguccaccuccugucccaggugcuguacuuuuuccucaucugcgagagcaagucuguugccgggcugacccuuaccuaugacggaaauucccccgugcggagccacgucgaugugccgcuguccuacuguaacucugaaugcaauugugacgagagccagugggaaccugucugcggcaacaaugggauuacauaccucucccccugucuggcuggaugcaagucuagcuccggcaacaaagagccuaucguguuuuauaauuguagcugcguugaagugaucgggcugcaaaacaagaauuacucugcccaucuuggcgagugcccccgcgaugacgcguguacgagaaaauccuaugucuacuucgugauucagguucucgaugccuuccugugcgcugugggacugaccagcuauucuguccucgugauccggauugugcagcccgagcugaaggcccuugcuaucggcuuucacuccaugauuaugcgcagccucgggggaauccugguuccuaucuacuucggcgcccugauugacacaaccuguaugaaauggucuacaaacagcugcggggccagaggagcuugucggaucuauaauuccaccuaccugggcagagcguuuuucgggcuuaaggucgcccucauuuuuccggugcuggugcugcucacggucuucaucuuugugguucgcaagaaaagccauggcaaggacacaaaagugcuggaaaacgagcggcaggucauggaugaagcuaaucuugaguuccugaacgacucugaacacuuugugcccuccgccgaggagcaauga

SEQ ID NO: 75912 - RNA, 1992 nt, Artificial Sequence
  derived and/or modified sequence opt5 from SLCO1C1__Homo_sapiens__NP_001139417
auggacaccagcuccaaggagaacauccagcuguucugcaaaacaucugugcaacccgucggcagaccuagcuuuaagacggaauacccguccucugaggaaaaacagcccuguugcggggagcucaagguuuuccugugugcccuuagcuuuguguauuucgcuaaagcccuggcggaaggauaccucaaguccaccauuacacagaucgagcggcgcuuugauauuccuucuagccuggugggcgucaucgacggguccuucgagauuggaaaucuucuggugaucaccuuuguuagcuauuucggcgcuaagcuccacagacccaaaaucauuggggccggaugcgugaucaugggcgucggcacacugcugauugccaugccucaguuuuucauggaacaauacaaguaugagcgguacucucccuccagcaacucuacccucuccaucagcccuugucugcuugaaucuuccagccagcugccgguguccguuauggagaaaucuaagagcaaaauuuccaaugggugcgugcagacagucgcuaucauuggacccaucuuuggcuuccuccuggggagccuuugugccaagcuguauguggauaucggauuugugaaccucgaccauauuaccaucacgccuaaggauccccagugggucggcgcuugguggcugggguaccugauugccggaaucauuucucuccuggcggccguuccuuucugguaccuucccaaaucccugccgcgcagccaaucuagagaggacagcaauuccucuagcgaaaaguccaaauucaucaucgaugaccacaccgauuaucagacaccucagggcgagaacgcuaagauuauggaaauggcccgggacuuucuccccagccugaaaaaucuuuucggcaacccuguguacuuucuguaucucugcaccucuacagugcaguucaauucccuguuugggauggucaccuacaagcccaaauauaucgagcaacaguacggacagucuagcucccgcgcuaacuucgugauuggccugaucaauauucccgccguugcgcucgggaucuuuagcggaggcaucgugaugaagaaguucagaauuuccgucuguggggccgcuaaacuguaucuuggaucuagcguguuuggcuaccugcuguuccugucccuuuuugcccugggcugcgaaaacucugauguugcugggcucacggugagcuaccaaggaacaaagccugucuccuaucaugagcgggcccuguucagcgacuguaauucucgcugcaaaugcuccgagaccaagugggaaccgauguguggcgagaacgggaucacauacgugagcgccugccuggcuggaugucagaccucuaauagauccggcaaaaacauuaucuuuuauaacugcaccugugucgggauugcggccagcaagucuggcaauagcuccggaaucgugggccggugccagaaggauaacggguguccccagauguuccucuacuuccugguuauuagcgugaucacaucuuauacgcuuucccugggaggcaucccuggguacauucuccugcugcgcugcaucaaaccccaacuuaagagcuuugcucucggaauuuauacccuggccaucagaguccuggccggcauuccugcucccguguacuucgggguucucaucgacacauccugucugaaauggggcuuuaagcggugcggaucucgcggcagcuguagacuuuacgacuccaauguguuccggcacaucuaucuggggcucaccgucauucugggaacagugucuauccugcuuagcauugccgugcucuuuauccugaaaaagaacuacguuuccaagcauagaucuuucauuaccaaacgcgaacggacgauggucagcacaagauuucagaaggagaauuauaccaccuccgaucaccuccuccagccgaacuacuggccuggcaaagaaacacagcuguga

SEQ ID NO: 75913 - RNA, 1932 nt, Artificial Sequence
  derived and/or modified sequence opt5 from SLCO2A1__Homo_sapiens__NP_005621
augggccugcuccccaagcugggggccagccagggauccgacaccucuacaagcagagcuggccggugcgcccgcuccguguucgggaacaucaaagucuuuguucuuugucaaggacugcuccagcugugccagcuucuguacucugcguauuucaagagcucccucacgaccauugagaaaagauuuggccugucuagcuccagcucugggcugaucuccagccucaaugaaauuucuaacgcuauccugauuaucuucguguccuacuuuggaagccgggugcaccgcccuagacuuaucggcauuggcgggcuguuccucgccgccggagcuuuuauccugacacuuccgcauuuccugucugagcccuaucaguacacccucgccuccacaggcaauaacagccggcugcaagcugaacugugucagaagcacuggcaggaucucccucccuccaaaugccauucuaccacacagaauccucaaaaggagaccagcuccaugugggggcugauggucguggcccagcuucuggcgggaauuggcacgguucccauccagccuuuugggauuagcuauguggacgauuucucugaaccguccaacagcccccucuacaucucuauucuguuugccaucagcgucuucggaccugcuuuuggcuaucuucugggcuccgugaugcuccagaucuucguugacuacgggcgcgugaauaccgccgcugucaaccuggugcccggagauccuagauggauuggcgccugguggcuggggcuccugaucucuagcgcgcuucuggugcucacauccuuccccuuuuucuuuuucccgcgggccaugccuauuggagcuaagcgcgcccccgcuaccgccgacgaggccagaaaacuggaggaagcuaagagccggggcucucuugucgauuuuaucaaacgcuucccuuguauuuuucugagacuccugaugaacucccuguucguucucguggugcuggcgcaaugcacauuuagcucugucaucgccgggcuuuccaccuuccugaauaaguuucucgagaaacaguacggaacgagcgcugccuaugccaauuuccugaucggcgcugugaaccugcccgccgcggcucuuggcaugcucuuugggggcauucugaugaagcgguucguuuucucccugcaggccaucccccgcauugccacaaccaucauuacaaucucuaugauccucugugugccucuguuuuucaugggaugcagcaccccgaccgucgcugaaguguaucccccuuccacaucuagcuccauucacccccaaagcccugccuguagacgggacugcucuugucccgauuccaucuuucauccgguuugcggggacaauggaauugaguaccuuagcccuugccacgcuggcuguucuaacaucaauauguccagcgccacgucuaagcagcugauuuaccucaacugcagcugugugaccgggggcuccgcgagcgccaaaacaggaucuugccccgucccuugugcucacuuccugcugcccgccaucuuucuuauuuccuucgugagccucaucgcuugcaucucccauaacccucuguauaugaugguccugagagugguuaaucaggaggaaaagucuuuugccauuggcgugcaguuccuccugaugcgccuucuggcguggcuccccagcccggcccuguacgggcugaccaucgaucacuccuguauucgguggaacucucuuugccucggaagacgcggcgcuugugccuauuacgacaaugaugcucugcgggacagauaccuggggcuccaaaugggauauaaagcccugggcaugcuucugcucugcuuuaucagcuggcgcgucaagaaaaacaaggaguacaaugugcagaaagccgcugggcugauuuga

SEQ ID NO: 75914 - RNA, 2064 nt, Artificial Sequence
  derived and/or modified sequence opt5 from SLCO2B1__Homo_sapiens__NP_001138683
augggcaccgagaacacacccgggggaaaggccagcccugacccgcaggaugugagacccuccgucuuccacaauaucaaacuguuuguucucugccauucucugcuucaacuggcucagcucaugauuagcggcuaccugaaguccucuaucagcacgguggaaaaacgguucgggcuuuccucucagaccagcggacugcucgccuccuuuaacgaggugggcaauacagcgcugauugucuucgugagcuauuuugggucucgcguucacagaccucggaugaucggauacggcgcuauucugguggcccucgccggccugcuuaugacccugccccauuucaucuccgaaccuuaucgcuacgacaacacaagccccgaggauaugccucaggacuuuaaggcuucucucugucugccgaccacauccgcccccgcuagcgccccuucuaaugggaacugcuccagcuauaccgaaacgcaacaccuuuccgucgugggaaucauguucguugcgcagacccugcucggcgucgggggagugcccauucagccuuuuggcaucucuuacauugaugacuucgcccauaauagcaacagcccccuguaucuggggauccucuuugcugugacaaugaugggaccgggccuggccuucggccuugggucccugaugcucagacuguacguggauauuaaucagaugccugagggaggcaucucucuuaccauuaaagacccccggugggucggggcuugguggcugggauuucucaucgccgcgggcgccguugcucuggccgcuaucccuuacuucuucuuucccaaggagaugcccaaggaaaaacgcgagcugcaauucagacggaaggugcucgccgugacagauuccccugcccgcaaagggaaggacagcccgucuaaacagagccccggagaauccaccaagaagcaggauggccugguccagauugcuccuaaccuuacggugauccaauuuauuaaaguuuuccccagagugcugcuccagacacugcggcacccuaucuuucuucuggucgugcucucucagguuugucugagcuccauggcggccggcauggcuaccuuccugcccaaguuucucgagcgccaauucagcauuacagccucuuaugccaaucugcuuaucgggugccuguccuuuccgagcgugaucgucggaauuguggucggcggggugcucguuaaaagacugcaccugggaccugugggcuguggggcucuuugccuccugggcaugcugcucugucuguucuuuucucuuccccuguucuuuaucggaugcuccagccaucagauugccggcaucacccaccagaccuccgcgcauccugggcucgagcugucucccagcuguauggaggcuugcuccuguccucuggacggauucaaccccgucugcgauccgucuacacggguggaauacauuacgccuugccacgccggcuguagcuccuggguugugcaggacgcccuugacaauagccaagucuucuauaccaacugcucuugugugguggaagggaaucccguucucgcuggauccugcgauagcacauguucucaccuggucgugcccuuucugcuccuggugucccuuggcagcgcccuggcuugccucacccauacaccuucuuucaugcugauccugcgcggggucaagaaagaggacaagacccuugccgugggcauccaguuuauguuccucagaauccuggcguggaugccgagccccguuauucacggauccgccauugauacgacaugugugcauugggcucugagcugcggccggagagccgucugucgcuacuauaacaacgaccuccugcggaauagauuuaucgggcuucaguucuuuuucaaaaccggaucugugauuugcuuugcucugguucucgccgugcugcgccagcaagauaaggaagcgcggaccaaggaguccagaagcuccccugccgucgagcagcagcugcuugugucuggccccgggaaaaagccugaagacagccgcguuuga

SEQ ID NO: 75915 - RNA, 2079 nt, Artificial Sequence
  derived and/or modified sequence opt5 from SLCO3A1__Homo_sapiens__NP_001138516
augcagggcaagaaacccgggggaagcuccggcgggggaagaucuggcgagcugcaaggggacgaagcccagcggaacaagaaaaagaaaaagaaggugagcugcuucuccaauaucaaaauuuuucucgucucugagugugcucugaugcuugcccagggaaccguuggcgcguaccuggugagcgugcucacaacgcuggaacgcagauucaaccuucaguccgcugaugucggcgugaucgccucuagcuuugagauugggaaucuggcccucauccuguucguuuccuauuuuggagcucggggccaccgcccuagacugauugggugcggaggcaucgugauggcccucggggcucugcuuagcgcccugccggaguuccucacccaucaauacaaguaugaagcgggagagauccgguggggcgccgaaggccgcgacgucugugcugccaacgggucuggaggcgaugaggggcccgacccugaucugauuugcagaaaucggacagcuaccaacaugauguaccuucugcucaucggagcccaggugcugcugggcauuggggcgacacccguucagccucucggaguguccuauaucgacgaucacguccgcagaaaagacagcucucuguacauuggcauccuuuuuaccaugcugguguucggccccgccuguggguuuauucucggauccuucugcacaaagaucuauguggaugcugucuuuaucgacaccagcaaucuggauauuacgccugacgauccgcgguggaucggcgccugguggggaggguuccuucuguguggcgcucuccuguuuuucucuucccugcucauguucggguuuccccagagccugccuccccauuccgaaccugccauggagucugagcaagccaugcuuagcgaacgcgaguacgaaagacccaaaccguccaacggcguucugcggcacccucucgagcccgacagcucugcuuccugcuuccagcagcugcgcgugauuccuaaggugaccaagcaucuucugagcaaucccgucuuuacauguaucauucucgcggccugcauggaaaucgcugugguugccggauucgccgcuuuucugggcaaauaccuggagcagcaauucaaccucaccacaucuagcgccaaucagcugcuugggaugaccgcgauccccugugcuugccugggaauuuuucucggcgggcugcuggugaagaaacuuucccucucugcccugggagccaucagaauggcuaugcuggucaaccucgugagcacggccugcuauguuuccuuccuguuucuuggcugugacacagggccuguggcuggcgucaccgugccguacggaaauagcacagcccccggcucugcgcuggauccuuauucccccugcaacaauaacugugagugccagaccgacagcuucaccccugucuguggggccgauggaauuacauaccucucugcuugcuuugccggcuguaacuccacgaaucugaccgggugcgcuugucugacaaccgugcccgccgaaaacgcgacaguugugccgggaaagugcccuagccccggcugucaagaggccuuccuuaccuuucucugcgucaugugcaucuguucccugauuggggcuauggcccagacgccuucugugaucauccugauucggacaguuagccccgaacucaaauccuaugcucugggcgugcuuuuccugcuccugagacugcuuggauucaucccucccccgcucauuuuuggcgccgggaucgacucuaccugccuguucuggagcaccuuuuguggagagcagggcgccugcguccuguacgauaaugugguguaucgcuaccucuacguuuccauugcuaucgcgcuuaagagcuucgccuuuauucuguauacaaccacauggcagugucugcggaaaaacuacaagagauauaucaagaaucacgaagggggacucucuacguccaccgaguaccaagacaucgagacagagaaaaccugcccugaaagccacucucccuccgaagauagcuucguccgcucuuga

SEQ ID NO: 75916 - RNA, 2169 nt, Artificial Sequence
  derived and/or modified sequence opt5 from SLCO4A1__Homo_sapiens__NP_057438
augccccugcaccagcucggcgacaagccucugaccuucccgagccccaacuccgccauggagaaugggcuugaucauacaccucccucuagacgggcuagcccuggaacgccccuguccccuggcucucuccgcagcgccgcgcacuccccgcuggacaccucuaaacaaccccuuugccagcugugggcugaaaagcauggggccagaggaacacacgaggugcgguacgucagcgccggccaguccguugcuuguggguggugggccuuugcuccucccugccuccaggugcugaacaccccuaaaggaauccuguucuuucucugugccgcggccuuccugcaaggcaugacagugaauggcuuuauuaacaccgucaucacaagccuugaacgcagauaugaucugcauucuuaccaguccgggcucauugcuagcucuuaugacaucgccgcuugccugugucuuaccuucguguccuacuuuggaggcagcgggcacaagccccgguggcugggauggggcguucuccugauggggacgggaucucugguguucgcccucccgcacuuuaccgcgggccgcuaugaggucgaacuggaugccggcgugagaacaugcccugcuaaucccggggccguuugugcugacuccaccagcggacuuucccgguaccagcugguguucaugcucggccaguuucugcauggggucggagccacaccucuuuauacccugggcgugacguaccucgaugagaacgugaaaucuagcugcucccccgucuacauugccaucuucuauacagcugcgauccuggggcccgccgcuggauaccugauuggcggcgcccuccugaauaucuauaccgagauggggcgcagaacagaacuuaccaccgagagcccucuguggguuggagccuggugggugggcuuucucgggucuggagcugccgcguucuucacagcugugccgauucugggcuacccccggcaacuuccugggucccagcgcuaugccgucaugagagccgcugaaaugcaccagcugaaggacagcucucggggcgaggccagcaaccccgauuuuggaaagacgauccgcgaccucccucuguccauuuggcugcuccugaaaaaucccaccuucauccuucugugucucgcuggcgccacagaggcgacccugauuacagggaugucuaccuuuagcccgaaguuccuggaaucccaguuuagccuuucugccuccgaggcugccacgcuuuucggauaccuggugguuccugcuggcgggggaggcacauuucugggaggcuucuuugugaacaaacucagacugcggggaagcgccgucaucaaguucugccucuuuuguaccgugguuucucugcucggcauccugguguucucccugcauugccccagcgucccuauggcgggggugaccgccuccuauggaggcucucuucuccccgaagggcaccugaaucugacagcuccuugcaacgccgcuuguagcugccaacccgagcacuacuccccggucuguggaucugauggccucauguacuuuagccugugccaugccggguguccugccgcuaccgaaacaaauguggacggccagaaaguuuauagagauugcuccuguauuccccagaaccuuagcucuggauucggccacgcgacggccgggaagugcaccuccacaugucaacgcaagccccugcuccugguguucaucuuugucgugauuuucuuuaccuuccugagcucuaucccugcucuuacagccacccuccggugcguuagagacccgcagcgcuccuuugcccuggggauucaguggaucgugguccggauccugggcgggauucccggaccuaucgcuuucggcugggugauugacaaagccugucuccuguggcaggaucaaugcgggcagcagggcagcugccuuguguaccaaaauucugcgaugagcagauauauccugauuaugggacuccuguacaagguucugggcguccucuuuuucgcuaucgccuguuuucuuuauaaaccccuguccgagagcucugacgggcuggagacgugccucccuucccagagcuccgcccccgauucugcuaccgacagccagcugcaguccucuguguga

SEQ ID NO: 75917 - RNA, 2175 nt, Artificial Sequence
  derived and/or modified sequence opt5 from SLCO4C1__Homo_sapiens__NP_851322
augaaaagcgccaagggcaucgagaaccuggcuuucgugcccuccucucccgacauucucagacggcugagcgccuccccgucucagaucgaagucagcgcgcuuuccucugauccccaacgcgagaauagccagccucaggaacugcagaagccccaagagccucagaaaucccccgaaccuagccucccgucugcucccccuaacguuuccgaggagaagcugagaagccuuucucuguccgaauuugaggaagggagcuacggauggcggaauuuccacccccagugccuccagcgcuguaacaccccuggcggguuucugcugcauuauugccuccuggccgugacacaaggaauuguggucaauggccuugugaacaucucuauuuccacgguugagaaaagauacgagaugaaaagcucccugaccgggcucaucucuagcuccuaugacaucagcuucugucugcuuucucuguuuguguccuucuuuggagaacggggccacaagccccgcuggcucgccuucgcugccuuuaugauuggccugggggcucuggucuucagccucccgcaguuuuucucuggagaguacaagcugggcagccuuuuugaagauacaugcgugaccacaagaaauuccaccucuuguacaagcuccaccagcucucuguccaacuaucucuacguuuucauccuggggcagcuucugcucggagccggcgggacgccucuguauacccugggaacagcguuccucgacgauagcgugcccacccauaagucuucccuguacauuggcacaggcuacgccaugagcauccuugggccugcuauuggauauguccugggcgggcagcuccugaccaucuacauugacguggccaugggagaguccacggaugugacagaagacgauccccgguggcuuggcgcuugguggaucggguuucugcucucuuggaucuucgccuggagccugauuauccccuuuuccugcuucccuaaacaucugccgggaaccgcggagauucaagccggcaagacaucucaggcucaccagagcaauuccaacgccgacgucaaauuuggcaagagcaucaaggauuuccccgcugcccucaaaaaucugaugaagaacgccguuuuuaugugucuugugcugucuaccuccagcgaggcucucauuaccacaggguucgcgacguuucugccuaaauucaucgaaaaucaauuuggacugaccucuuccuucgccgcuacacuuggcggggccgugcucauccccggagccgcucugggccagauucucgggggcuuucuggucagcaaguuccgcaugaccugcaaaaacacaaugaaguucgcccuguuuaccucuggaguggcgcuuacgcugagcuucguuuuuauguaugcuaaaugugagaaugaaccuuucgccggcguguccgagagcuacaacgggacaggagaacucggcaaccugaucgcccccugcaaugcuaacuguaauugcucuagauccuauuacuauccggucugcggggacggagugcaguacuuuagcccuuguuucgccggcugcuccaaccccguugcucaccggaagccuaagguguacuauaauuguucuugcauugagcgcaaaaccgagaucaccagcacagccgaaaccuuuggguucgaggcgaaggccggcaaaugugaaacacacugcgcuaagcugcccauuuuucuuuguaucuucuuuaucgucauuaucuucacguuuauggccggaaccccuauuacaguguccauccucagaugcgucaaccaucggcagcgcucucuggcucugggcauucaauucauggugcucagacugcuugggaccauccccggaccgauuaucuucggcuuuacaaucgauagcaccuguauucugugggacaucaaugacugcgggauuaaaggagccuguuggaucuacgauaacauuaagauggcgcacaugcucguugccaucuccgugacgugcaaggucaucaccauguucuuuaauggcuucgcuauuuuucuguauaaaccuccucccucugccacagacgugagcuuccauaaggagaacgcuguugugaccaauguccuggccgaacaggaucuuaacaaaaucgugaaggagggguga

SEQ ID NO: 75918 - RNA, 2064 nt, Artificial Sequence
  derived and/or modified sequence opt5 from SLCO5A1__Homo_sapiens__NP_001139480
auggacgagggcaccgggcugcagcccggagccggcgaacaacucgaggcuccugccacagcggaagcugugcaggagagaugcgaaccggagacgcugcggagcaagucccuucccguccugucuagcgccuccugucgcccuucucucagccccaccuccggggaugccaacccugcuuucggaugcguugacucuagcggccaccaggagcugaaacaggggcccaauccucuugccccgucccccagcgcuccuucuacauccgccggacugggcgauuguaaccauagaguggaccucagcaagaccuuuucuguguccagcgcgcuggccaugcugcaagaacggcgcugccucuacgucgugcugacagauucuagauguuuccuuguuugcauguguuuucugaccuucauccaggcucucaugguguccggcuaucugagcuccgucauuacaaccaucgagcggcgcuacucucuuaaaagcuccgaaagcgggcugcucgugucuugcuuugacauuggaaaucugguuguggucguguucguguccuauuuuggcgggagaggacggcgcccccuguggcucgccgucggcgggcugcuuaucgcuuucggagccgcgcuguuugcccucccucacuucauuucucccccguaccagauccaggagcugaacgcuagcgccccuaaugauggccuuugucaaggcgggaacagcacggcuacccuggagcccccugccugccccaaggacuccggaggcaauaaccauuggguuuauguggcccucuuuaucugugcucagauucugaucgggaugggaucuacacccauuuacacccugggcccuacauaucucgaugacaaugugaaaaaggaaaacagcucccuguaccuugcgaucauguacgucaugggggcccugggaccggcugugggcuaucuccugggcgggcuucugauuggauucuacguugaucccagaaauccugugcaccucgaccagaacgauccccgguuuaucggcaauugguggagcggguuccugcugugcgccauugccauguuccucgucaucuuuccuauguucaccuuucccaagaaacugccgccucgccauaagaaaaagaaaaagaagaaauucucuguggacgcuguuuccgacgaugacgugcuuaaggagaaaagcaacaauucugaacaggccgauaagaaagucuccagcaugggauuuggcaaggacgugagagaucugccccgggcggcuguccgcauccucuccaacaugacguuccuguuugugucucugagcuauacagccgaguccgccauuguuaccgcuuucaucacauuuauuccuaaauucaucgaaucucaauuugggauucccgccagcaacgcuuccaucuacaccggcgugaucauugucccuagcgccggagugggcaucguucuugggggauauauuaucaagaagcucaaacugggcgcgagagagucugccaagcuggcuaugauuugcuccggggugagccuccuguguuucucuacccuuuuuaucgucggaugcgaguccaucaaucugggcgggauuaacauccccuacacaacgggcccgagccucaccaugccucaccggaaucugacaggaucuuguaacgugaauugcggcuguaaaauucacgaauaugagcccgugugcgggagcgacggaaucaccuacuucaaccccugucuggccggcugcguuaauuccgggaaccuuagcacaggaauuagaaauuacaccgaauguacgugcguccagucucgccaggugaucacaccuccgaccgugggccaacggucccagcucagagucgugauuguuaagaccuaucugaacgagaauggguacgcugugagcggcaaauguaagcgcacaugcaacacccugauccccuuccucgucuuucuguucaucgugacauuuauuacggccugcgcgcagccuuccgccaucauuguuacccuuucuauccauagcuauuccaaucugcucuggucuagccacuga

SEQ ID NO: 75919 - RNA, 2160 nt, Artificial Sequence
  derived and/or modified sequence opt5 from SLCO6A1__Homo_sapiens__NP_001275931
auguucgugggcgucgccagacacagcgggucccaggacgagguuucucggggaguggaaccccuggaggcugcccgcgcgcaaccugcuaaggauagacgggccaaaggcaccccgaaaagcuccaaacccgggaagaaacaucgcuaccucagacugcuuccugaagcccugauccgguuuggaggcuuccgcaagagaaagaaagcuaagucuagcguguccaaaaagcccggggaggucgacgauucucucgaacagccuugcggacugggcugucuugugagcacaugcugugagugcuguaacaauauucggugcuuuaugaucuucuauuguauucugcucaucugccagggcguuguguuugggcugauugacgucuccaucggagauuuccagaaagaguaccaacugaagacgaucgaaaagcucgcccuggagaaaagcuaugacauuucuuccggccuuguggcuaucuuuauugccuucuacggggaucgcaagaaaguuaucugguuuguggcgagcucuuuccugauuggacucggcucccugcuuugugccuuucccagcaucaacgaagagaauaagcagucuaaagucgggauugaggacaucugcgaagagaucaaggugguguccggaugucagagcuccggcauuucuuuccagagcaaauaucuguccuuuuucauccucggccaaaccguccaggggauugcuggaaugccucuguacauccugggcauuacauucaucgaugaaaacguugccacccacagcgcugggaucuaucucggaauugccgagugcacaucuaugaucggcuacgcgcugggguacgugcuuggagccccgcuggugaagguccccgaaaauaccacauccgcuaccaacacgaccgugaauaacggcagcccugaguggcucuggacaugguggauuaauuuucuguucgccgcuguuguggccuggugcacccuuaucccccugucuuguuuuccuaacaauaugcccggcagcacaagaauuaaggcccggaaacgcaagcagcuccauuucuuugacuccagacugaaagaucugaagcucgggaccaacaucaaagaccugugcgcugcgcuuuggauccugaugaagaauccgguccucauuugucuggcccuuucuaaggcuacggaguaucuggugaucauuggagccagcgaguuccucccuaucuaccuggaaaaccaguuuauucugacacccaccguugccacaacccucgcuggccuggugcuuaucccugggggagcccugggccaacuccuugggggcgucauuguguccacccuggaaaugagcugcaaagcgcuuaugcgguucaucauggucacaucugugaucucccucauucugcugguuuuuaucauuuucgugcgcuguaaucccguccaguuugcuggaaucaacgaggauuaugacggcacggggaagcucggaaaccugaccgcccccugcaaugaaaaauguagaugcucuagcuccauuuacagcuccaucuguggccgggacgauaucgaguauuucucuccuugcuuugccggguguacauacagcaaggcucagaaccaaaagaagauguauuacaauugcuccugcauuaaggagggacuuaucaccgccgacgcugaaggcgauuucauugacgccagaccggggaaaugugaugcgaagugcuacaaacugccccucuucaucgccuuuauuuucucuacacugaucuuuagcggcuucuccggagugccuaucguucuggcuaugacccgcgugguccccgacaagcugcggagccucgcccugggcgugucuuaugugauucugagaaucuuugggacgauuccuggacccuccaucuucaaaaugagcggcgagacaucuuguauucuccgcgauguuaacaagugcgggcacaccggacgguguuggaucuacaauaagaccaaaauggcuuuucugcuugucggcaucugcuuccuguguaagcucugcacaauuaucuuuaccacaauugccuucuuuaucuauaaaagacgccugaacgaaaauacggacuucccggaugugaccgugaagaacccuaaagucaagaaaaaggaggaaacagaccuguga

SEQ ID NO: 75920 - RNA, 1737 nt, Artificial Sequence
  derived and/or modified sequence opt5 from SLFN12__Homo_sapiens__NP_001275938
augaacaucagcguggaccuggagaccaauuacgccgaacucguccuggauguuggcagagugacacuuggggagaacucccggaagaaaaugaaggacugcaaacugcgcaagaaacagaaugaaucugugagcagagcuaugugugcccuccugaacuccggaggcggggucauuaaggcggagaucgaaaaugaggauuauucuuacacgaaggacggaauuggccuugaucuggagaacagcuucuccaauauccuccuguuugugcccgaauaucuggacuucaugcaaaacgggaauuacuuucucauuuucguuaaaucuuggagccugaacaccuccggacuucggaucacaacccugagcucuaaucucuauaagcgcgauaucacauccgcuaaagugaugaacgccaccgccgcucuggaguuucuuaaggacaugaaaaagacaagaggccggcuguaccuccgcccugaacugcuggccaagagaccgugcgucgauauucaggaggagaauaacaugaaagcucucgccggcguguucuuugaccggaccgaacuggaucgcaaggagaaacuuacguucaccgaaagcacacacguugagaucaagaauuuuucuaccgaaaaacugcuccagagaauuaaggagauccugccccaguauguguccgcguucgccaacacagacgggggauaccuuuuuauuggccugaacgaggauaaagaaaucauuggguucaaggcugagaugagcgaccucgacgaucuggaacgggagaucgaaaagucuauccgcaaaaugccuguccaucacuuuuguauggagaagaaaaagauuaauuacuccugcaaauuccugggaguguaugacaagggcagccucuguggguacgugugcgcccugagagucgagcgguucuguugcgcuguuuuugccaaggaacccgauuccuggcaugugaaagacaaccgcgugaugcaacuuaccagaaaggaguggauccaguucauggucgaagcggagccuaaauuuucuagcuccuaugaagaggugauuagccagaucaauacgucucugcccgccccucacuccuggccgcuccuggaguggcagcggcaaagacaucacugucccggacuuagcggccgcauuacauacaccccugaaaaccugugccggaaacucuuccugcagcacgagggccugaagcagcucaucugugaagagauggauucuguuagaaaggggagccugaucuuuucccgcucuuggagcguggaccuuggacugcaggagaaucauaagguccucugcgaugcucugcugauuucccaagacucucccccugugcuuuauacauuccacaugguucaggaugaagaguuuaaaggcuacagcacccagaccgcccucacacugaagcaaaaacuggcuaagaucgggggauauacgaaaaaggugugcgucaugaccaagauuuucuaccucucccccgaaggcaugacaagcugucaguacgaccugcggucucaggugaucuauccggaguccuacuauuuuaccagacgcaaauaccuucugaaggcccucuucaaagcccugaagcggcugaaaagccuuagagaucaguuuuccuucgcugaaaaccucuaucaaauuaucgggaucgacugcuuucagaagaaugacaaaaagauguucaagucuugucgccggcugacauga

SEQ ID NO: 75921 - RNA, 1767 nt, Artificial Sequence
  derived and/or modified sequence opt5 from SLFN12L__Homo_sapiens__XP_011522471
auggaccuggccagaaaggaguuccuccggggcaacgggcuggcugccggaaaaaugaauaucagcauugaucuugacaccaacuacgcggaacuggugcucaaugucggccgcguuacacugggggagaacaauagaaagaaaaugaaggauugccagcuucggaaacaacagaacgaaaaugugucccgcgcugugugugcccugcucaacucuggaggcggggucaucaaggccgagguggaaaauaagggauauagcuacaaaaaggacggcauuggccuggaucuggagaacuccuuuucuaauaugcuccccuucguuccuaacuuucuggacuucaugcagaaugggaacuauuuucacaucuucgugaaaagcuggucccuugagacgucuggaccgcagauugcuacccugagcuccagccucuacaagagagaugucacaucugccaaagugaugaaugcuuccgccgcgcuggaauuucuuaaggacauggagaagaccggcgggcgggccuaucugcgccccgaauuuccugcuaaaagagccugcguugaugugcaagaggagagcaacauggaagcucucgccgcggacuuuuucaaccggacagagcugggauacaaggaaaaacugaccuuuacagagucuacccaugucgaaaucaagaauuucuccacggagaaacuccugcagcgcaucaccgagauucuuccccaguaugugagcgccuuugcuaacacagauggcggguaccuguucgugggacucaaugaagacaaggaggucaucggcuucaaagccgaaaagucuuaccugaccaaacuugaggaaguuacaaagaacuccauuggcaagcugccugugcaccauuuuuguguggagaaagggaccaucaauuaucucugcaaguuccugggagucuacgauaaaggcagacuguguggguauguguacgcucuccggguugagcgcuuuugcugugccguguucgccaagaagcccgacagcuggcacgucaaagacaacagagugaagcagcugacggaaaaagaguggauucaauuuaugguugauuccgaaccugugugcgaggaacuuccgucucccgcuagcacauccagcccugucucucaguccuauccccugcgggaguacaucaauuucaagauucagccucuccgcuaucaucugcccggacuuagcgagaaaaucaccugugcgccgaagacauuuugcagaaaccuguucucucagcacgaaggccucaagcaacugaucugugaggaaauggggagcgugaauaaaggaucccugauuuucucucggagcuggucccucgaccugggccuucaggagaaccacaagguccugugcgaugcccuccugaucagccaggacaaaccucccgugcuguacaccuuccauaugguucaagaugaggaauuuaaggacuacucuacccagacagcucagacgcuuaaacagaagcucgccaagauuggcggguauaccaaaaaggugugcgucaugacaaaaaucuucuaccuguccccugagggaaagaccagcugucaauaugaucucaauucucaggugauuuaccccgaauccuauuacuggacaaccgcccagacgaugaaagaccuggagaaggcucugagcaacauccuucccaaagaaaaucagaucuuucuguucguuugccucuucagauuuugucuguucgugugcugguuugucuguuucuuucugcgcuga

SEQ ID NO: 75922 - RNA, 2739 nt, Artificial Sequence
  derived and/or modified sequence opt5 from SLFN14__Homo_sapiens__NP_001123292
auggagagccugaagaccgacacagaaaugcccuacccugaggugaucgucgauguuggcagagugauuuucggggaagagaaccggaaaaagaugacaaauuccugccucaaacgcucugaaaacagcagaaucauucgggccaucugugcucugcuuaauuccggaggcggggugauuaaggccgagaucgacgauaaaaccuauucuuaccagugccacggacugggccaagaccucgagacgagcuuucagaagcugcuuccguccgggucucagaaguaucuggauuacaugcagcaaggacauaaccuccugaucuucgucaaaagcuggucccccgacguguuuagccugccucuccgcauuuguucucugagauccaaucuuuaucggcgcgauguuaccagcgcgaucaaccugucugcuuccagcgcccucgaacugcuuagagagaagggcuuccgggcccagcgcggcagaccccgggugaaaaagcugcacccucagcagguccucaaucgcugcauucaagaagaggaggacaugagaauccuggcuucugaauuuuucaaaaaggauaagcugauguacaaagagaagcucaacuuuacagaauccacccauguggaguucaaacgguuuacaaccaagaaaguuauuccccgcaucaaggaaaugcugccucacuaugugagcgccuucgcuaauacgcagggaggauacguccuuauuggcguggacgauaaauccaaggagguggucggguguaagugggagaaaguuaacccggaccugcucaagaaagaaaucgagaauugcaucgaaaagcugcccaccuuucauuucuguugcgagaaaccuaaggugaacuuuacaaccaagauucuuaauguguaccagaaagauguccuggacggauauguguguguuauccagguggaacccuucugcugugucguguucgccgaggcgccugacucuuggauuaugaaggauaacagcguuacaagacucaccgccgagcaauggguggucaugaugcuggacacgcaguccgcucccccgagccuggugacagauuacaauucuugccucaucuccagcgccucuagcgcucggaaauccccuggcuaucccauuaagguccacaaauuuaaggaagcccugcagagacaccuuuucccugugacccaagaggaaguucaguuuaagcccgagucucugugcaaaaagcucuuuagcgaccauaaagaacuggaggggcuuaugaagacacugauccaccccuguucccagggaaucgugauuuucagccgcucuugggcgggcgaugucggcuuccggaaagagcagaacgugcucugcgacgcccugcugaucgcuguuaacuccccugugguccucuacaccauucugaucgauccgaauuggcccgggggacuugaauaugccagaaacaccgcucaucaacugaagcagaagcuccagacagugggcggguacacgggaaaaguguguauuaucccucgccugauccaccugagcucuacccagucccggcccggcgagauuccucuuagauauccccgcagcuaccggcucgccgacgaagaggagauggaagaucugcugcaagcccucguugucgugucccugucuagcagaucccuucugucugaccagauggggugcgaguuuuucaaucuccugaucauggaacagagccagcugcuuuccgagagccuccaaaagacacgcgaacuguuuauuuacuguuucccgggagugcggaaaaccgcucuggcgaucaagauuauggagaaaaucaaggaucucuuucacugcaaaccuaaggagauucuguaugucugugaaucugacucccuuaaggacuucgugacacagcagaccacgugccaggccguuacaagaaaaaccuuuaugcaaggcgaguuccugaagaucaaacauaucgugauggaugaaaccgagaacuucuguagcaaguacggcaauugguauaugaaagcuaagaacauuacacaccccaaggccaaagggaccggaucugaaaaucuccaucacggcauccuguggcuguuucuugacccuuuccagauucaucacgccgaugucaacgggcuucccccucccuccgcucaguuuccgcgcaagacaaucacgagcgggauucacugcgcccuggagaucgcgaaagugaugaaggaggaaaugaaacggaucaaggagaauccucccucuaacaugagccccgacacccuggcucucuucuccgaaacagccuacgaggaagccaccugugcucaagcccugccuggcguuugcgagacaaagaccaaucuuacgaccgagcagauugcuaacuauguggccagaaaaugccauagccuguuucaguguggguaccucccgaaggauaucgcgauucugugccggcgcggcgaagacagaggacgguauagacuggcccuucucaaagcuauggagcugaucgaaacacaccgccccucugaggucguguucuccccugccaccggcguuugggggagccauauugugcuggauuccauccagcaauuuucuggacucgagcggacagucguguucggccugagccccgaaugugaccaguccgaggaauuucacaagcucugcuucgcuucuagagccaucaaacaccuguaccuccuguacgagaagcgcgcggccuauuga

SEQ ID NO: 75923 - RNA, 2676 nt, Artificial Sequence
  derived and/or modified sequence opt5 from SLFN5__Homo_sapiens__NP_659412
augagccugagaaucgacguggauaccaacuuccccgagugcgucguugacgccggcaaggugacacucgggacgcagcaacggcaggaaauggauccucgccugagagagaaacagaaugaaauuauccuucgggcugugugugcccugcucaacuccggaggcgggauuaucaaggcggagauugaaaauaaaggauacaacuaugagcgccacggcgucgggcuggacgugccgcccaucuuuagaucucaucuugauaagaugcagaaagagaaucacuuccugaucuuuguuaagagcuggaacaccgaagcuggagugccucucgccacacugugcuccaaucuguaccaucgggagcgcaccucuacagacgucauggauagccaagaagcccucgcuuuccugaaguguagaacccagacacccaccaacauuaauguguccaacucucuuggcccucaggccgcucagggcagcguucaauaugaggggaauaucaacguguccgccgcggcccuguuugaccggaaacgccuccaguaccuggagaagcucaaucugcccgaaagcacgcacgucgaguucgugauguuuucuaccgaugugucccauugcgucaaagacagacucccuaaguguguuagcgcuuucgccaacacagaaggaggcuauguguuuuucggggugcacgaugagaccugccaggucauuggaugugaaaaagagaagaucgaccugacaucucugcgggcuuccauugauggcugcaucaagaaacucccggugcaccauuuuuguacccagcgccccgagauuaaguacguucugaauuuccuugaagugcacgacaaaggggcccugagaggauaugucugcgcgaucaagguggagaaauuuuguugcgccguuuucgcuaaggugccuagcucuuggcaagucaaagacaaccgggugcgccagcuccccacgagagaauggacagccuggaugauggaggcugauccugaccugucccggugccccgaaaugguccuucagcugagccucuccucugccaccccgagaagcaagccuguguguauccauaagaacuccgagugccugaaagagcaacagaagcgcuacuuccccguuuuuagcgaucggguggucuacacaccugaaucucuguauaaagagcuuuucucccagcacaagggccugagagaccuuauuaauaccgaaaugcgccccuuuagccagggcauccugauuuucucucaaagcugggccguggaucucgggcugcaggagaaacagggaguuaucugugacgcccuucugauuucccagaacaauacccccauccucuacacaaucuuuucuaagugggaugcgggcugcaagggguauagcaugauuguggccuacucccugaaacaaaagcuggucaacaaaggaggcuauacggggcggcucuguaucaccccucuggugugcgugcuuaauagcgacagaaaggcucagucuguuuacuccagcuaucugcagauuuacccggaaucuuacaacuucaugacaccccagcacauggaggcccuccugcaaucccuggucaucgugcuucucggauuuaaaucuuuccuguccgaggaacugggcucugaggugcucaaucugcuuaccaacaagcaguaugaacugcucagcaagaaucugcgcaaaacacgggagcuguuuguccauggccuuccuggguccggaaagaccauucucgcccugagaaucauggagaaaauccgcaacguguuccacugugaacccgcuaauauucuguacaucugcgagaaccagccucucaagaaacugguuucuuuuagcaagaagaauauuugucagcccgugacgcggaaaacauucaugaagaacaauuuugaacauauccaacacauuaucauugaugacgcccagaacuucagaaccgaggauggcgacugguaugggaaagcgaaguucaucacccagacagcucgcgacggaccgggcguccuuuggaucuuucuggauuacuuccaaaccuaucaucucuccugcagcgggcugccucccccuucugaccaguacccccgggaagagauuaacagagugguucggaaugccggcccuaucgccaacuaucugcaacaggugaugcaggaggcucgccagaaucccccgccuaaccuuccucccggaucccucgucaugcuguacgaacccaaaugggcccagggcgugccggggaaucuggagauuaucgaagaucucaaccuggaggaaauucuuaucuacguugcuaauaaguguagauuucugcuccggaacggauauagccccaaagacaucgccgugcuguucacaaaggcgucugaggucgagaaguacaaagauagacugcuuacggccaugcgcaagcggaaacucucccagcugcacgaagagagcgaccugcuccugcaaauuggcgaugcuucugacgugcuuaccgaucacaucgugcuggacagcgucugcagauuuuccgggcucgaacgcaauauuguuuucggaaucaacccuggcguggcucccccugcuggggccuauaaucugcugcuuugccuggcgagcagagccaagcggcaucucuacauucugaaagcuagcguguga

SEQ ID NO: 75924 - RNA, 4605 nt, Artificial Sequence
  derived and/or modified sequence opt5 from SLIT1__Homo_sapiens__NP_003052
auggcccugacccccggcugggggagcuccgcuggaccugugagaccggagcucuggcugcuucugugggccgcggcuuggcggcucggcgccucugccugccccgcucuguguacaugcacggggaccacagucgacugucacggaaccggccuucaggccaucccuaagaacauuccccgcaauacagaaagacuggagcucaacgggaauaacaucacccggauucauaaaaaugauuucgcuggacugaagcaacugcgcguucuccagcugauggaaaaccagaucggcgccguggagagaggcgcguuugacgauaugaaagaacuugagcggcugcgccucaauagaaaccagcugcacaugcuuccugagcuucucuuccaaaauaaccaggcccugagccggcuggaccucuccgaaaaugcuauucaggccaucccccgcaaggcuuuuagaggggccacagaucugaaaaaccuucagcuggacaagaaucaaaucucuugcauugaggaaggagcguuccgggcccuccgcggccuggaggugcuuacccugaacaauaacaacaucacgaccauuccugucagcuccuuuaaucauaugccgaagcucagaacauuccggcugcacucuaaccaucuguuuugugauugccaccucgcuuggcugagccaguggcuucgccagagacccaccaucgggcuguucacacaguguuccggaccugccagccuccggggccugaauguggcugagguucaaaaaucugaauuuuccugcagcgggcagggagaggccggcagagugcccaccuguacgcuuucuuccggcagcugcccugccauguguacaugcucuaacgggauugucgacugccgcggaaagggccugaccgcuauccccgcgaaucucccggaaacaaugaccgagauucggcuggaacugaacgggaucaaauccaucccucccggagccuucagcccuuacagaaagcuccgccggauugaucuguccaauaaccagaucgcugagauugcccccgacgccuuucaaggccuuagaucucugaauagccucgugcuguaugggaacaaaaucaccgaucugccccgcggaguuuucggcggccuuuacacacuccagcugcugcuccugaaugcuaacaagauuaauuguauccggccugacgccuuucaggaucuucagaaccugucccuccugagccuguaugacaauaagauccaaucucuugcgaaagggacguucaccucccucagagcuauucagacacugcaccuggcccagaacccguucaucugcgacuguaaccucaaguggcuggccgauuuucuucgcaccaaucccauugagacaagcggagcucggugcgccucuccuagacgccuggcuaacaaacggaucggccagauuaagagcaaaaaguucagauguuccgccaaagaacaauacuuuauccccgggaccgaggacuaucagcucaauucugaaugcaacagcgauguggucuguccucauaagugccggugugaggcgaaugugguggaaugcuccagccugaagcugacgaaaauccccgagcgcauuccgcagucuacagccgagcuuagacucaacaauaacgaaaucuccauucuggaggcuaccggaauguucaagaaacugacccaccucaagaaaaucaaucugagcaacaauaaggucucugaaauugaggacggcgccuuugaaggggcugccuccguuagcgagcuucaucugacagcgaaccagcucgaguccauccggucuggcauguucagaggacuggauggccugcgcacccuuaugcuccggaauaacagaauuagcuguauccacaaugacuccuuuacagggcugcgcaacgugagacugcucucucuguacgauaaccaaaucacgaccgugagcccuggagccuucgacacacuucagucccugagcacccucaaucugcuggcuaaccccuuuaauugcaacugccagcuugccuggcugggcggguggcuccggaagcgcaaaauugucacaggaaauccuagaugucagaaccccgauuuccugcggcaaaucccucuccaggacguggcuuuucccgauuuccgcugcgaagagggccaggaagagggcggcugucugccgagaccucaaugcccccaggagugugccugccuugacaccguugugcgguguucuaauaagcaucugcgcgcccuccccaaaggaaucccuaagaacgucacggaacuguaucuggacggcaaucaguuuacccuugugccggggcagcuguccacauucaaauaccuccaacugguugaucucagcaacaauaagaucucuucccugagcaacucuagcuucaccaauaugucccagcuuacaacccugauucucagcuacaacgcucugcagugcauucccccucuggcguuucagggacuuagaucucugcggcuccugucccuccacggcaaugacaucagcacgcugcaagaggggauuuucgccgaugugacaucccuuucucaccuggcuaucggagccaacccccuguauugugacugccaucuccgcuggcugagcuccugggucaagaccggcuacaaagaaccugggauugccagaugugcuggcccccaggauauggagggaaagcugcugcucacaaccccugccaaaaaguuugaaugccaggggcccccgacccuggcggugcaggcuaaaugcgaccucugucugucuagcccuugccaaaaccaggggacaugucacaaugauccccuugaggucuaucggugcgccuguccuuccggauacaagggcagagacugcgaggugucucuggauagcuguuccagcgggcccugcgaaaacggaggcacgugucaugcccaggagggggaagacgcuccguuuaccugcucuuguccuacaggcuucgagggaccuaccugcggcguuaauacagaugacugcguggaucacgccugugcgaacgggggagucugcguggacggcguugggaauuauaccugucaaugcccccugcaguacgaaggaaaggcuugugagcagcucguggaccugugcucccccgaucuuaaccccugucagcacgaggcccaaugcgucggcacgccugacggcccgcgcugugaaugcaugcccggguaugccggagauaauuguagcgagaaccaggacgauugccgggaccauagaugccagaauggcgcucaguguauggaugaagugaacucuuacuccugccugugugccgagggguacagcggacaacucugcgaaaucccuccccaucugccugcucccaaaucuccuugugagggcacagagugccagaauggggccaacuguguggaccagggaaaucgcccgguuugccagugucuccccggcuucggcgggccugaaugcgagaagcugcuuuccgucaacuuuguggaucgggacaccuaucugcaauucaccgaucugcagaauuggcccagagcgaacauuacacuccaggugagcaccgccgaagacaauggaauccugcuuuacaacggcgauaacgaccacaucgcugucgagcuguaucaggggcacgugcgcguuuccuacgacccuggaagcuaucccucuagcgccauuuacuccgcugagacaaucaaugauggccaauuucacacgguggaacucgucgccuucgaccagauggugaaccugucuauugaugggggaagcccgaugaccauggacaauuuuggcaaacauuauacacucaacuccgaggccccucuguacguuggcgggaugcccguggaugucaauucugcugcguuccggcuuuggcagauccugaacggaaccggcuuucacggguguauuagaaaucuguacaucaacaaugaacuccaagacuucacaaagacccagaugaaacccggagugguuccuggcugcgagcccugccgcaagcuguauugucuucaugggaucugccagccuaacgccacgccgggacccaugugucacugcgaagcuggcugggugggccugcauugugaucagccugccgacgggcccugccacggacacaaauguguccauggccaaugcgugccucucgaugcccugagcuacuccugucagugccaggacggguauucuggagcucuguguaaucaggccggcgcgcucgcugagcccugccgggggcuucaaugucugcacggacauugccaggccagcggcaccaagggcgcccacugcgugugugauccgggguucuccggagagcugugcgaacaggagagcgaauguagaggcgacccuguccgggacuuucaucagguucaacgcggguacgcuauuugccagacaaccagaccccucucuuggguggagugucggggauccugcccuggccagggguguugccaaggacugcgccuuaagagacggaaauucacauuugaauguagcgauggcaccucuuucgccgaggagguggaaaagcccacaaaaugcggcugugcgcugugcgcuuga

SEQ ID NO: 75925 - RNA, 4578 nt, Artificial Sequence
  derived and/or modified sequence opt5 from SLIT2__Homo_sapiens__NP_001276064
augagaggcgugggguggcagaugcugagccucucccugggacuuguccuggccauccucaacaagguugcuccccaagccugcccugcgcaguguucuugcagcggcuccaccguggacugucacgggcuggcccuucggucugugccgcgcaauauucccagaaacacagagcggcuggaucucaauggaaacaauaucacgcgcauuaccaaaacagacuucgcuggccugagacaucugcggguccuccagcugauggaaaacaagaucagcaccauugagcgcggggccuuucaggaucuuaaagaacuggagagacuccggcugaaucgcaaccaccuucaacuguucccugaacuccuguuucugggaacagcuaagcucuacagacuggaccuuuccgagaaucagauccaggccaucccccggaaggcuuuccgcggcgccguggauauuaaaaaccugcagcucgacuauaaucaaaucucuugcauugaggauggcgcguuuagagcccugcgggaccuugaaguucugacccucaacaauaacaauaucacacgccugagcguggcuuccuucaaccauaugccuaagcugagaaccuuucggcuccacagcaacaaucuguacugugauugccaucuugccuggcugucugacuggcucagacagcgcccccgggucgggcuguauacgcaguguaugggaccuucccaccuuagaggccacaacguggcugagguucagaaacgcgaguucgugugcagcgaugaagaggaagggcaucaaucuuuuauggccccguccuguagcguccugcacugccccgcggccuguaccugcucuaauaacauuguggacugccggggaaagggccucacagagaucccuaccaaucugcccgaaacaauuaccgagaucagacuggaacagaacacgaucaaagugauuccucccggggcuuucuccccguacaagaaacuccgccggaucgaucugagcaauaaccagauuuccgagcuugccccugacgcuuuucaaggacugagaucucucaauagccugguccuguauggcaacaagaucacagagcuucccaagucccucuucgaaggccuguuuagccugcagcuccugcuucugaaugccaacaaaauuaauugucuccgcguugacgccuuccaggaucugcauaaccugaaucuucucucucuguacgacaacaagcugcagaccaucgcuaaagggacauucuccccucuccgggcgauccaaaccaugcaccuggcccagaaccccuuuauuugcgauugucaccuuaaguggcuggcugacuaucuccauaccaaucccaucgagacaagcggagccagaugcacgucuccucgccggcuggccaacaaaagaauuggccagaucaagagcaaaaaguuccgguguuccgggaccgaagauuaccgcucuaagcugagcggagacugcuuugcugaucuugccuguccggagaaaugcagaugugaaggcacaaccguggacugcuccaaucagaagcucaacaaaauucccgagcacaucccucaauacacagcggagcugcggcugaauaacaaugaguucaccgugcucgaagcuacggggaucuuuaagaaacugccccagcuuagaaagauuaacuucagcaauaacaagaucacagauauugaagagggagccuuugaaggcgccucuggcgucaaugagauccugcucaccuccaaccgccuggagaaugugcagcauaaaauguucaaggggcuggaaagccuuaaaacccucaugcugcggucuaacagaauuacauguguuggaaaugacuccuuuaucggccugagcuccgugcgccuccugucucuuuaugauaaccagauuaccacagucgcuccuggggccuucgacacgcugcacagccucuccacccugaaccugcuugcuaaucccuuuaacugcaauugcuaccuggccuggcucggagaguggcugagaaagaaacggaucgugacaggcaacccgcgcugucaaaagccuuauuuccucaaggaaauccccauucaggacguugcgauccaggauuuuaccugcgacgaugggaaugacgauaacucuuguagcccucuguccagaugccccacagaguguaccugccuugacacggugguccgguguagcaauaaaggccugaaggugcucccuaaaggcauuccccgcgaugucaccgagcuguaccuggacggaaaccaguucacacuugugccgaaggaacugucuaauuauaaacaucucacccugaucgaucucuccaacaauagaauuagcacacugucuaaccaauccuucagcaauaugacccagcuucugacgcucauccugucuuacaaccggcugcgcugcaucccucccagaacauuugacgggcuuaagagccugcggcuccugucccuccacggaaaugauauuagcguugugcccgagggcgccuucaacgaccugucugcucuuucccaccuggccaucggggcuaacccucuguauugugauugcaauaugcaguggcucagcgacugggucaaguccgaauacaaagagccgggaauugcccgcugugcgggccccggggaaauggccgacaagcugcuucugaccacaccuucuaaaaaguuuaccugccaaggccccguggauguuaacauccucgcuaaaugcaauccuugucugagcaaccccugcaagaaugacggaaccuguaacuccgauccuguggacuucuacagaugcacaugucccuauggcuuuaaagggcaggauugcgacgucccgauucaugccuguaucucuaauccuugcaagcacggaggcacgugucaucucaaggagggggaggaagauggauucuggugcaucugugcugacggcuuugagggggaaaacugcgaggugaauguggaugacugcgaagauaacgacugugagaauaacagcacaugcguugauggcauuaauaacuacaccugucugugucccccugaguauaccggagaacuuugcgaggaaaaacuggacuucugcgcccaggaccugaaucccugucagcacgauuccaagugcauccucacaccgaaaggcuuuaagugugacugcaccccuggguacgucggagagcacugugauauugacuucgaugacugccaagauaacaaaugcaagaauggcgcccauuguacggacgcugugaacggguauacaugcaucugucccgaaggauacucuggccuguuuugcgaguucagcccucccauggugcuuccccggaccuccccuugugauaacuuugacugccagaauggggcgcaguguauugucagaaucaacgagccgaucugccagugucugcccggcuaucaaggagaaaagugcgagaaacucgugagcguuaauuucauuaacaaggaaucuuaccugcagaucccuuccgccaaagugcgcccccagaccaauauuacacuccagaucgcuaccgaugaggacagcggcauucugcuuuacaagggggacaaagaucacaucgccgucgagcuguaucggggaagagugcgcgccucuuacgacacaggcucccauccugcuagcgccauuuauucuguugaaacgaucaacgaugggaauuuccacaucguggagcugcucgcgcuggaccaaucccuuagccuguccgucgauggaggcaaccccaagauuaucaccaaucucagcaagcagucuacacugaacuuugacagcccucucuacgugggcgggaugccgggaaaauccaauguugcuucucugcggcaggcccccggccaaaacgggaccagcuuccauggauguauuagaaaucuuuauaucaacuccgaacugcaggauuuucagaaggugccuaugcagacaggcauucugcccgggugcgagccuugccacaaaaaggucugugcccacggaaccugccaacccucuagccaggcuggcuucacgugugaaugccaggagggcuggauggggccgcucugugaccagcgcaccaaugauccuugccugggaaacaaaugugugcauggcacaugccuucccaucaacgccuuuuccuacucuuguaagugccuggaggggcacggaggcgugcucugugacgaagaggaagaucuguucaaucccugccaagcgaucaaguguaaacaugggaagugccggcugagcggacucggccagccuuauugcgaguguuccagcggcuacaccggggacucuugcgauagagaaauuuccugucgcggagagcggaucagagacuacuaucagaaacagcaaggcuacgcugccugccagacaaccaagaaagucagccggcuugagugucgcgggggaugcgccggcgggcaguguugcggaccccugagaucuaagcggcgcaaauauuccuuugaauguacagacggcagcuccuucguugaugagguggaaaagguggucaagugcggcuguaccagaugcgugucuuga

SEQ ID NO: 75926 - RNA, 4572 nt, Artificial Sequence
  derived and/or modified sequence opt5 from SLIT3__Homo_sapiens__NP_003053
auggcccccggcugggcuggggugggagccgcggucagagcucggcuggcccucgcccuggcucuugccagcguucuguccggcccuccggcuguggccugccccaccaaguguacaugcucugcggccagcguggacugucacgggcucggacugcgcgcugucccuagaggcaucccccggaacgccgagcgccuugaucuggacagaaauaacauuacgcggaucaccaaaauggauuucgcugggcucaagaaucugcgcgugcugcaucucgaagacaaccagguuuccgugauugagagaggagccuuucaagaucugaaacagcuugaacggcugcgccucaauaagaacaaacugcagguccuuccugagcuccuguuccagucuacacccaagcugaccagacuggaccucagcgaaaaucaaauccagggcauuccucggaaggcguuucgcggcaucacagaugugaaaaaccugcagcuugacaauaaccacaucuccugcauugaggauggggccuucagagcucugcgggaccucgagauccugacccuuaauaacaauaacauuucucgcauccugguuacauccuuuaaucauaugccgaagauuagaacccuccggcugcacuccaaccaucuguacugugauugccaccucgccuggcugagcgacuggcuuagacagcgccggacggugggacaauucacccuguguauggcucccguccaccucagaggcuuuaacguggccgaugugcagaaaaaggaauaugucugcccugcuccccauucugagccucccuccuguaaugccaacagcaucucuugcccguccccuuguacaugcagcaauaacauuguugacugccgcgggaaaggacugauggaaauccccgcgaaucuuccugagggcaucguggagauucggcuggaacagaacucuaucaaggccauucccgcuggggccuucacccaguacaagaaacucaagagaaucgacauuuccaaaaaucaaaucagcgauaucgcccccgacgcuuuucagggacugaagucccugacaucucucgugcuguauggcaacaaaauuaccgagaucgccaagggccuuuucgaugggcuggucagccuccagcugcugcuucucaaugcgaacaaaauuaauugucugcgcgugaacacguuucaagaccugcagaaucucaaccugcuuucccuguacgauaauaagcuccagacaaucagcaagggacuguucgcuccucugcagucuauucaaacccuucaccucgcccagaacccguuuguuugcgacugucaucugaaauggcuggccgauuaucuccaggacaaccccaucgaaacauccggcgcucggugcagcucuccuagacgccuggccaauaagcggaucagccagauuaaauccaagaaauucagauguucugggagcgaggauuaccgcucccgguucagcucugaaugcuuuauggaccuugugugucccgagaagugcagaugugagggaaccaucgucgauugcuccaaccaaaagcuggugcggauuccuagccaccuccccgaauauguuaccgaccugcgccugaaugacaacgaggugucuguccuugaagcuacaggcaucuucaaaaagcucccgaaucugagaaaaauuaaccuguccaauaacaagaucaaagaggugcgggaaggggccuuugauggagcggccagcguccaggagcucaugcugacgggcaaucagcuugagaccgugcacggcagaguuuuccgcgggcuguccggacucaagacacugaugcugcggucuaaccuuauuggcugugugagcaaugacaccuuugcugggcucuccucugucagacugcugagccucuacgauaaccgcaucacaaccaucacgccuggagccuucacaacccuggugucccuuagcaccauuaaucugcucucuaaccccuuuaauugcaacugccaucuggcuuggcugggcaaguggcuuagaaaacggcgcaucguuuccgggaacccuagaugucagaagcccuucuuucugaaagaaauuccuauccaagacguggccauucaggauuucacaugcgacggcaaugaggaaagcucuugucagcucagcccccggugcccggagcaguguaccugcauggaaacagucgugcgcuguagcaacaagggacugagagcgcucccucggggcaugcccaaagaugugacggagcuguaccuugaggggaaucaccugaccgccguuccccgcgaacucucugcucugagacaucugacacuuaucgaccugagcaacaauuccaucagcaugcucaccaacuauacauuuucuaauaugucccaccugagcacccucauucuguccuacaaccggcuucgcugcaucccuguccaugccuucaauggacugagaucucuccgggugcugacgcugcacggcaacgauauuagcuccgugccggaggggucuuuuaaugaccuuaccagccugucccaccucgcucugggaacaaacccccuccauugugauugcucucugagauggcuuagcgaaugggucaaggccggcuauaaggagccugggaucgcccgcuguuccagccccgagccuauggcugaccggcugcugcucaccacacccacccacagauuccaaugcaaaggcccuguggauauuaauaucguugcgaagugcaacgccugucugucuucccccugcaaaaauaacggaacguguacacaggacccgguggaacuuuaccgcugcgcuuguccuuauagcuacaagggcaaagacugcaccguccccaucaacacauguauucagaauccuugccaacaugggggaaccugucaccugucugauucccacaaggacggcuucagcugcucuuguccccucggguuugagggacagcggugcgaaaucaacccggaugacugcgaggauaaugacugugaaaacaaugcuaccugcguggauggcauuaacaauuauguuuguaucugcccucccaacuacacaggggagcugugugacgaggugauugaucauugcgucccugaacucaaucugugucagcacgaggccaaaugcaucccccuugacaagggcuucuccugugaaugcgugcccggauacagcggcaagcugugugagacggauaacgacgauugcguugcccauaaaugcagacacggggcccaguguguggacaccaucaauggauauacaugcaccuguccucaaggcuuuuccgggccguucugcgaacaucccccucccaugguccugcuccagacaagcccuugugaccaguacgagugccagaacggagcgcaauguauuguggugcagcaggagccuaccugccgcugucccccgggcuuugcugggccccggugcgaaaagcugaucacggucaauuucguuggcaaagauucuuauguggagcuugccagcgccaaggugagaccucaggcuaacauuucccugcaagucgccacagacaaagauaauggaauccuccuguacaagggcgacaacgauccccucgcgcuggaacuuuaucaggggcacgugcgccugguuuacgacucucugagcuccccucccaccaccguguauucugucgagacagugaaugauggacaguuucacagcguugaacucgugacccugaaccaaacacuuaaccuggucguggacaagggcacgccgaaaucccucgggaagcugcagaaacagccugcuguuggaauuaauucuccccucuaccugggcggcauccccaccagcacagggcuuuccgcccugcggcagggaaccgauagaccucugggcggguuccauggauguauucacgaggugcggaucaacaaugagcuccaagacuuuaaggcccugcccccucagagccuuggcgucucuccggggugcaaauccugcacaguguguaagcauggacugugccgcagcguggaaaaggauucugucguuugugagugcagacccggcuggaccggcccucucugugaccaggaagcucgggaccccugccuggggcaccgcugucaucacggaaaaugcguggccacgggcaccuccuacauguguaagugcgcugagggguauggaggcgaucugugugacaacaaaaaugauagcgccaacgcgugcuccgccuucaagugucaccaugggcagugccacaucucugaccaaggagagccuuacugccucugucagcccggcuuuagcggcgaacauugccagcaggagaauccgugucuugggcaaguggucagagaagugauucggagacagaaaggauaugcuuccugcgccacagcuagcaagguuccuaucauggagugucgcggcgggugcggaccccaguguugccagccuacccggucuaagagacgcaaauacguguuccaauguacagauggcuccagcuuugucgaagagguggagcggcaccuggaaugcgggugucuggccugcucuuga

SEQ ID NO: 75927 - RNA, 2091 nt, Artificial Sequence
  derived and/or modified sequence opt5 from SLITRK1__Homo_sapiens__NP_001268432
augcugcucuggauccugcuucuggagaccagccucugcuucgccgcuggcaacgugacaggggacgucuguaaggagaaaauuugcuccuguaaugaaaucgaaggagaucugcacguugacugcgagaagaaaggcuuuacgucucuucagagauucaccgcccccacaagccaauuuuaccaucuguuccuccacgggaacucccugacccggcuguuuccuaaugaguucgcgaacuuuuauaaugcugugucucuccauauggaaaacaauggacugcacgagauugugccgggcgccuuccuugggcugcagcucgucaagcgccugcauaucaacaauaacaaaauuaagagcuuuagaaagcagacauuccuuggacuggaugaccucgaauaccugcaggccgauuuuaaucugcuccgggacaucgaucccggcgcuuuccaagaccugaacaaacuugaggugcugauccucaaugauaaccugauuuccacccuuccugccaauguuuuucaguaugugcccaucacacaccuggaccuccgcggcaacagacugaagacccugccuuacgaagagguccucgagcagauucccgggaucgcugaaauucugcuugaggauaacccuugggacuguacgugcgaucugcucucucugaaagaauggcuugagaauaucccgaagaacgcccugauuggacgggugguuugugaagcgcccacccgccuccagggcaaagaccugaaugagacaaccgagcaagaccugugcccucucaagaacagaguggauagcucccugcccgccccucccgcucaggaagagacauucgccccggggccucuucccaccccuuucaagacgaauggacaggaagaccacgcuacacccggcagcgcccccaacgggggaaccaaaaucccuggcaauuggcagaucaagauucggccgacagcggccaucgcuaccgggucuucccgcaacaaaccccuggccaauagccucccuugucccggcggaugcucuugugaucauauuccuggcuccgggcugaagaugaacugcaauaacagaaaugucagcucucuggcugaccuuaaacccaagcucuccaacgugcaagagcuguuucugcgggauaauaaaauccacagcauucgcaagucccauuucguggacuauaagaaccucauccugcuugaucugggaaacaauaacaucgccaccgucgaaaauaacacauuuaaaaaucuccuggaccugagauggcuuuacauggauucuaacuaucucgacacgcugagccgggagaaguucgccggccugcagaaucucgaguaccugaacguugaauacaaugcuauucagcuuauccugccggggaccuuuaacgcgaugccuaaacuccgcauucugauccugaauaacaaucuucucagaucccugcccguggauguguucgccggagucagccugucuaagcucucccugcacaacaauuauuuuauguaccuuccuguggcuggcguucuggaccaacucacaagcauuauccagaucgaccugcacggcaaccccugggagugcucuuguaccauugugccuuucaaacagugggccgaacggcuggggagcgagguccuuauguccgaucucaagugcgaaacacccgugaacuuuuucagaaaggacuuuaugcugcugucuaaugaugagaucuguccgcagcucuaugcccgcauuagcccuacccugacgucccauagcaaaaacucuacaggacuugcugagaccggcacccacuccaauagcuaccuggacacaucucggguuuccaucagcgugcucguccccgggcugcugcuuguguucgucaccuccgccuuuacagugguuggaaugcugguguucauucucagaaaccgcaagcggucuaaaagacgcgaugcgaauagcuccgcuucugaaaucaacagccugcaaacggucugcgacuccagcuauuggcauaauggccccuacaacgccgauggggcccaccggguguaugacuguggcucucauucccucagcgauuga

SEQ ID NO: 75928 - RNA, 2538 nt, Artificial Sequence
  derived and/or modified sequence opt5 from SLITRK2__Homo_sapiens__NP_115928
augcugagcggcgugugguuccucuccguccugaccguugccgggauccuucagacagagucuagaaagacggcuaaagacauuugcaagauccggugucugugcgaagagaaagaaaacgugcucaauauuaacugugagaauaagggauuuaccacagugagccugcuucaacccccucaguaccgcaucuaucagcuguuccucaacggcaaucugcugaccagacucuacccgaacgaauuugucaauuauuccaacgccgugacacugcaccuugggaauaacggacugcaggagauucggaccggcgcguucucugggcucaaaacacugaagcgccuucaucugaauaacaauaagcucgagauccugagagaagauaccuuucugggacucgagagccuggaauaccuucaagcugacuauaacuacaucuccgccauugaggccggcgcuuucucuaaacugaauaagcucaaaguucugauccuuaacgauaaccugcuccugagccugcccuccaauguguuucgguucguccuccugacgcaccuugaccugcgcggcaacagacucaaggugaugccuuuugccgggguucuggagcauauuggaggcaucauggaaauucagcuugaggaaaaucccuggaacugcaccugugaucugcucccucugaaggcuuggcuggacacaaucaccguguucgucggggagauugugugcgaaacacccuuucggcuccacggaaaagaugugacccagcugacgcgccaggaccuuuguccuagaaagagcgccucugauuccagccaacggggcucucaugcggacacacacguccagcgccuguccccgaccaugaaucccgcccucaacccuacaagagcucccaaagccagccggccucccaagaugcgcaauagaccgaccccucggguuaccgugucuaaagauagacaguccuucgggcccaucaugguguaucagacaaagagcccugucccccugacgugccccuccucuugugugugcaccagccaauccagcgacaacggacugaauguuaacugucaggagcgcaaauuuacaaauaucucugaucuucagccuaagccgaccucccccaaaaagcucuaccugacaggcaacuaccugcaaaccguguauaagaaugaccuccuggaguacagcucucuugaccugcuccaccugggcaacaaucggauugcugucauccaggaaggggccuucacgaaccugacaagccuuagacgccucuaucugaacggaaauuaccuggaggugcucuauccuuccauguucgauggccugcagucucuucaguaccuguaucucgaauacaacguuauuaaagagaucaagccccugaccuuugacgcgcugauuaaucuucaacuccuguuccugaacaauaaccuccugcggagccuuccugauaauaucuuugggggaaccgcccugacaagacucaaccugcgcaauaaccauuucucccaucugcccgugaaaggcguccuugaccagcucccggcuuuuauccagauugaucugcaggaaaauccuugggacuguaccugcgauaucauggggcugaaggacuggacagagcacgccaacagccccgugauuaucaaugaggucacgugcgaaucuccugcuaaacacgccggagagauucucaaguuccugggccgggaagccaucugccccgauuccccuaaccuuagcgacggcaccgugcugucuaugaaucacaacacagauacccccagaucccucagcguuuccccgucuagcuacccugagcugcauacagaagugccccuguccguccuuauccuggggcuccuggugguuuuuauucucucuguguguuucggagcuggccuguuugucuucgugcuuaagcgccggaaaggggugcccagcguuccuagaaacaccaauaaccuggacgucuccagcuuucaacuccaguauggaucuuacaauacggagacccacgacaagacagauggccauguguauaacuacaucccgcccccuguggggcagaugugccagaaucccauuuauaugcaaaaagagggcgacccugucgcguacuaucgcaaccugcaggaguucuccuacagcaaucuggaagaaaagaaagaggagcccgccaccccugcuuacacaaucucugccaccgaacuucuggagaagcaggccacgccccgggaaccggagcuccuguaucagaacauugcugaaagagugaaggagcucccuuccgccggacugguucacuacaauuuuuguacacuucccaaacggcaauucgcgccuagcuaugagucucgcagacagaaccaggaucggaucaauaagaccgugcuguacggcacacccagaaaaugcuucgucgggcaaagcaagccgaaccauccucuccugcaggcuaaaccccaguccgaaccugacuaucuggaggugcuugaaaagcagaccgccauuagccaacuguga

SEQ ID NO: 75929 - RNA, 2934 nt, Artificial Sequence
  derived and/or modified sequence opt5 from SLITRK3__Homo_sapiens__NP_055741
augaagcccagcaucgccgagaugcugcacagaggccggaugcucuggauuauccugcuuuccaccauugcucugggguggacaacgccuaucccgcucauugaagacucugaggaaaucgaugagcccugcuucgacccuuguuacugcgaagugaaagagagccuguuucacauccacugugauuccaagggauucaccaacauuucucagaucacagaguuuuggagccgccccuucaaacuuuaucugcaaagaaauuccaugcggaagcucuacaccaacucuuuucugcaucugaauaacgccgucagcauuaaucucggcaacaaugcgcugcaggacauccagacaggggcuuucaacggacuuaaaauucugaagcgccucuaucugcacgaaaauaaacuugauguuuuuagaaacgacaccuuccugggccucgagucccuggaauaccugcaggccgauuauaaugugaucaaacggauugagagcggggccuuucgcaaccucucuaagcugagagugcuuauccugaaugacaaccucaucccuaugcugcccacaaaucuuuucaaagcugucucccugacccaucucgaucugcggggaaaccgccugaaggugcucuuuuacagaggcaugcuggaccacauuggccggagccuuauggagcugcaacucgaagagaacccuuggaauugcacgugugaaaucguucagcugaaaucuuggcuugagcgcauuccguauaccgcccuggugggggauaucacaugcgaaacccccuuccacuuucauggaaaggaccucagagagauucggaagacagagcuguguccucugcucuccgauagcgaagucgaggcuucucugggcaucccccacuccagcuccucuaaagaaaacgccuggccuaccaagcccagcuccaugcuuagcucugugcauuucacggcguccagcguugaguacaaaucuagcaauaagcagccgaaaccuacaaagcagccccgcaccccuagaccucccuccacaucucaagcccuguaccccgggccgaaccagcccccuaucgcucccuaucagacccggccucccauuccgaucauuugcccuaccggauguacaugcaaucuccacaucaacgaccugggccugacggugaauuguaaagaaagaggguucaacaauauuagcgagcuucucccccgcccucugaacgccaagaagcuguaccucuccagcaaucugauccagaaaaucuaucggucugacuuuuggaacuucuccagccuugaucugcuccaccugggaaauaacagaauuucuuacguccaagacggcgcuuuuaucaaucugcccaaccuuaagucccucuuccugaacggcaaugauauugagaaacugaccccugggauguuucgcggacuccagagccugcauuaucuuuacuucgaauuuaacgugauccgggagauucagcccgccgcguucucccugaugccgaaucucaagcugcuguuucuuaacaauaaccuccugagaacacugccuaccgacgccuucgcuggcacaucucucgcccgccugaaucuucggaaaaacuauuuucuguaccuccccguggcugggguccuggaacaccugaaugccaucguucaaauugaucuuaacgagaaucccugggacuguaccugcgaucucgugccuuucaagcaguggaucgaaacgaucagcuccgugucugucgugggagacguucugugcagaagcccggagaaccugacacaucgcgaugugcggaccauugagcucgaaguccugugccccgagaugcuucacguggccccugcuggcgaaucccccgcgcagccuggggacagccaucugaucggagcccccaccucugcuuccccuuacgaguuuucucccccgggcggcccuguuccccucagcgugcugauucugucccuucugguccucuucuucagcgccguguuugucgccgcugggcuguucgccuaugugcucagacgccggagaaagaaacugccuuuucggucuaagcgccaggagggaguugaucuuacaggcauccaaaugcagugucacagacuguucgaagacgggggaggcgggggcggaggcagcgggggaggcgggcggcccacccucuccagcccggagaaagcgccucccgugggacacgucuacgaauauauuccucaucccgugacacagaugugcaauaaccccaucuacaagccuagagaggaagaggagguugcugugucuuccgcccaggaagccggcagcgcugagcgcgggggcccgggaacgcaacccccuggcaugggggaagcccugcugggauccgagcaguuugcugaaacccccaaagagaaucacucuaacuaucggacacuucuggagaaggaaaaggagugggcccucgcggucagcuccucucagcugaacaccaucgugacagugaaucaucaccacccucaucaccccgccguuggcggggucagcggaguggugggcgggaccggcggagaccucgcuggcuucagacaucacgaaaagaacgggggagucgugcuguuuccuccgggcgggggauguggcuccgggucuaugcuucuggaucgcgagagaccccagccugcccccugcacgguuggcuucguggacugucucuacggaaccgucccuaagcugaaagaacugcaugugcaucccccgggcaugcaauauccugaucuucagcaggacgcucggcugaaggagacacuccuguuuagcgccgggaaaggauucaccgaucaccagacacaaaaguccgacuaccucgagcugcgcgcgaaacuucagaccaagcccgauuaccuggaaguucuggagaagacgacauauagauuuuga

SEQ ID NO: 75930 - RNA, 2877 nt, Artificial Sequence
  derived and/or modified sequence opt5 from SLITRK5__Homo_sapiens__NP_056382
augcauaccugcugucccccugugacacuggagcaggaccuccacagaaagaugcacagcuggaugcugcaaacgcuugccuucgcugucaccucccugguucucucuugcgccgaaacaaucgauuacuauggcgagauuugugacaacgcgugcccgugugaagagaaagaugggauccugaccgugagcugcgaaaaucggggaauuaucucccuuucugagauuagcccuccccgcuuucccaucuaccaucugcuccuguccggcaaccugcucaauagacuguauccuaacgaguucgugaauuacacaggggcuucuauccuucaccugggaagcaacgucauucaggacaucgaaaccggcgccuuucaugggcuccggggacugcgcagacuucaccugaauaacaauaagcucgagcugcugcgggaugacacauuccucggccuggaaaaccuugaguaucuucagguggauuacaauuauauuuccguuaucgagcccaacgccuuuggcaaacuccaucugcuucaggugcugauucucaaugacaaccugcugagcucucucccuaauaaccuguuccgcuuugucccgcuuacccaccuggaucucagagggaaccggcugaagcugcugcccuacgugggacuccugcaacacauggacaaaguuguggaacugcagcucgaggaaaauccuuggaacuguuccugcgagcugaucagccuuaaggauuggcuggacucuauuuccuacagcgcucucgucggcgauguggugugugaaacgcccuuccgccugcaugggagagaccuggacgaggucucuaagcaggagcuuugcccucggcgccucaucuccgauuaugaaaugagaccccagaccccgcugagcacaaccggauaccugcacacaaccccugccuccguuaauucuguggcuacgagcuccagcgccguguauaaacccccucucaagccucccaaaggcacacggcaacccaacaagccgcgcgucagacccaccucucggcagccuuccaaagaccugggguacagcaauuauggacccucuaucgcguaccagacaaagagcccugugccccuugaguguccgaccgccugcuccugcaaccugcagauuucugaucucggccugaauguuaacugucaagaaagaaagaucgagagcauugcugaacugcagccuaaacccuauaauccuaagaaaauguaccuuaccgagaacuacaucgccgugguccgccggacagacuuucucgaggcuacgggccuggaucugcuccaccuggggaauaacagaauuuccaugauccaggaccgcgccuucggagaucuuaccaaucugcggagacucuaucugaacggcaaucgcaucgaacggcugagccccgagcuguuuuacgggcuccaaucucugcaguaucuguuccuccaguacaaccugauuagagaaauccaguccggaacauuugacccugugcccaaccuucaacuucucuuccugaauaacaaucugcuucaggcgaugccgagcggcguuuucucugggcucacccugcugcgccucaaccugcgguccaaucauuuuacaagccuuccuguguccggaguccuggaucagcucaagucucugauucagaucgaccugcacgauaaccccugggacugcaccugugacauugugggcaugaaacuuugggucgagcaacugaaggugggcguucucguggaugaagucaucugcaaagcccccaagaaguucgcugagacggacaugagaagcaucaaauccgagcugcucuguccugauuauucugacgugguugugagcacaccgacccccuccagcauucaggucccugcccgcaccucugcugugacacccgccgugcggcuuaauuccaccggggccccugcuagccuuggagcgggcgggggagccucuuccguuccccugagcguccucauccugucucugcuucugguguuuauuaugagcguguucgucgcugccggccucuuugugcugguuaugaagagacggaaaaagaaccaguccgaucauacaagcacgaauaacucugacguguccagcuucaauaugcaguacuccgucuaugggggcggaggcgggaccggaggccacccucaugcccacgugcaccaucgcgggcccgcucucccgaaaguuaagaccccugccggacacguguacgaauacaucccccauccucugggccacaugugcaagaaccccauuuauagaucucgggaggggaauagcgucgaagauuacaaagaccuucacgagcugaaggugacauauuccucuaaccaucaccuccaacagcagcagcaaccgccucccccuccccagcagccccaacagcagccuccgccccagcugcaacugcagccuggcgaggaagagagacgcgaaagccaucaccuucggucccccgcguacucuguuagcacaaucgagccuagagaagaucugcucucccccgugcaggacgcugaucgcuuuuauagaggcauucuggagccugacaaacauuguagcaccacgccggccggaaauucucuccccgaguacccuaaguuccccugcuccccugccgcuuauaccuuuagccccaacuacgaucugcggcgcccgcaccaguaccuucacccuggggccggagacucuagacugcgggaacccguccuguauuccccucccagcgcuguguucguggagcccaaccgcaaugaauaccucgagcugaaagccaagcugaacgucgaaccugacuaucuggagguucucgagaagcaaacaaccuuuucucaguucuga

SEQ ID NO: 75931 - RNA, 2526 nt, Artificial Sequence
  derived and/or modified sequence opt5 from SLITRK6__Homo_sapiens__NP_115605
augaagcuguggauccaccucuucuacagcucccugcuugccugcauuucucugcauagccagacccccgugcucuccucuagaggcagcugugacucccugugcaacugugaggaaaaagaugggacaaugcuuaucaauugcgaggcuaagggaauuaaaauggucucugaaaucagcguuccuccgucccggcccuuucaacugagccuccugaacaauggccugacgaugcuccacaccaacgacuucucugggcugacaaaugccauuuccauccaucuuggauuuaacaauaucgcggauauugagaucggcgcuuucaacgggcugggacuccugaagcagcuucacauuaaucauaacagccuggaaauccucaaagaggacaccuuucacggccuggagaaucuggaguuccuccaggccgauaacaauuuuauuacagugaucgagccuucugccuucuccaagcugaaccgccuuaaggugcugauucucaaugacaacgcuaucgaaagccugcccccuaacaucuuuagauucgucccccuuacccaccuggaucuccggggcaaucagcugcaaacacugccuuaugugggguuucucgagcauauuggacgcauccuggaccuucagcuggaggauaacaaaugggccuguaauugcgaccuccugcagcuuaagaccuggcuggaaaacaugccgccccagucuauuaucggcgauguuguguguaauuccccucccuucuuuaaagggagcauucucuccagacugaagaaagagucuaucugcccuacgcccccggucuacgaagaacacgaagacccuagcggaucccugcaucucgcugccaccagcucuaucaacgauucccggaugagcacaaagaccacaucuauucugaaacuucccaccaaggcgccuggccugauccccuauauuacgaagcccagcacacaacucccugggccguacugucccaucccuugcaauuguaaagugcugucccccucuggacugcuuauucacugccaggagcgcaacaucgagagccucuccgaccugagaccucccccgcagaauccucggaagcugauccucgccggcaacauuauccacagccugaugaaaucugaccuuguugaauauuucacccuggagaugcuccaucugggcaauaaccgcauugaagugcuggaggaaggguccuucaugaaucuuacaagacuccagaagcuguaccugaacggaaaucaccucaccaaacugagcaagggcauguuucuugggcugcauaaccucgaguaucuguaccuggaguacaacgcuaucaaggaaauucuucccggaaccuucaauccuaugcccaaacucaagguccuguaucugaacaauaaccuccugcaagugcuuccuccccacaucuuuucuggcgugccgcugacaaaagucaaucucaagacgaaccaguucacccaucugccuguuuccaauauucuggaugaccuugaucuccugacacagaucgaccuggaggauaaccccugggacugcagcugugaucucguggggcugcaacaguggauccagaaacuuuccaagaauaccgugacagacgauauucugugcaccucucccggacaccucgacaagaaagaacugaaggcccugaacagcgagauccuuuguccuggccuggucaauaacccguccaugcccacgcagacaucuuaccucauggugaccaccccugcuacaaccacaaauacggccgauaccauucugcggagccucacagacgcgguuccccuguccgugcuuauccugggccuccugauuauguuuaucaccaucgucuucugcgccgcugggauugugguucuggugcuucaccgcagacggcgcuauaaaaagaaacaagucgacgaacagaugagagauaacagcccugugcaucugcaguacucuauguauggacacaagacaacccaucacacgaccgagcggcccuccgccagccucuacgagcagcacauggucucuccuauggugcauguuuauagaucccccagcuuuggcccgaagcaccuggaagaggaagaggagcgcaaugaaaaagaggggucugacgcuaagcaucuccaacggagccugcuugaacaggagaaccacuccccucugacaggaagcaacaugaaauacaagaccacaaaucagucuaccgaguuccucuccuuucaggaugccagcucccuguacagaaacauccuggaaaaagagcgcgaacuucaacagcugggcauuacggaguaucuccggaagaauaucgcccagcugcagcccgacauggaagcucauuacccuggggcgcacgaggaacucaagcugauggagacacuuauguauucuagaccccgcaaagugcuggucgagcaaaccaagaacgaauacuucgagcugaaagccaaucuccacgcugaaccggauuaucuggaggugcuugaacagcagacauga

SEQ ID NO: 75932 - RNA, 3615 nt, Artificial Sequence
  derived and/or modified sequence opt5 from SLK__Homo_sapiens__NP_001291672
augagcuucuuuaacuucagaaagaucuuuaaacugggcuccgagaagaaaaagaaacaguacgaacacgugaagcgggaccucaaucccgaggauuucugggaaauuaucggggagcugggagacggcgccuuugggaaggucuauaaagcucaaaacaaggaaaccucuguucuugccgcggcuaaagugauugauacaaagagcgaggaggaacuggaggacuacaugguggaaaucgauauucucgccuccugcgaccauccuaauaucgucaaacugcuugaugccuucuauuacgagaacaaucuguggauccucauugaguuuugugcuggaggcgccguggacgcuguuaugcuggaacuggagcgcccgcucacggaaucucagauccagguggucugcaagcagacccuggaugcccuuaacuaucugcacgacaauaagauuauccauagagaucucaaagcggggaacauucuguucacacuugacggagauaucaagcuggccgacuuuggcgugagcgcuaaaaauacccggacaauucaacgcagagacuccuucaucggcacccccuacuggauggccccugagguugugaugugugaaacaucuaaggaucggcccuaugacuacaaagcugaugucuggagccucgggaucacccugauugagauggccgagaucgaaccuccccaccaugagcugaacccuaugcgcgugcuccugaagauugcgaaauccgaaccgcccacgcuugcccagccuagcagauggucuuccaauuuuaaggacuuccugaagaaaugccucgagaagaacguggaugcucgguggaccacaagccagcugcuucagcaccccuuugucaccguugacucuaauaaaccuauccgcgaacugauugccgaggcuaaggccgaggugacagaagagguggaagauggaaaagaggaagacgaggaggaagagaccgaaaacucccuccccaucccggccagcaagagagcuucuuccgaucugagcaucgcguccucugaggaggacaagcugagccaaaaugccuguauucucgaauccgucagcgagaaaacggaacggucuaacuccgaggauaagcugaacagcaaaauccuuaaugaaaagccuacaaccgacgagcccgagaaagcuguggaagacauuaacgagcacaucacagaugcccagcuggaagccaugaccgagcuccaugaccgcaccgcuguuauuaaggaaaaugagagagagaagcggccuaaacuggaaaaccuucccgauacagaggaccaggaaacgguggauaucaauucugucagcgagggcaaggaaaacaauaucaugauuacccuggagacaaacaucgagcacaaucucaaauccgaagaggaaaaggaccaggagaaacaacagauguucgagaacaagcugauuaagucugaagagaucaaagauaccauucugcagacaguggaccucguuagccaagaaaccggggagaaggaagccaauauccaggcgguggauuccgaggucggacugacgaaagaggacacacaggaaaaacuuggcgaggaugacaaaacccagaaggaugugauuagcaacaccucugacgucaucgggacaugcgaagcugccgacguggcccaaaaaguugaugaggacuccgcugaagauacccagagcaaugacggaaaggagguggucgaggugggccagaagcugaucaacaaacccaugguuggcccugaagccgggggaacaaaggaggugccgauuaaagaaaucgucgagaugaaugaaauugaggagggcaagaacaaagaacaggcuaucaacucuuccgagaauauuauggauaucaacgaagaacccgggacgaccgagggagaagagaucacagaaagcuccucuaccgaggaaauggaggugcgcagcgugguugccgacacagaucaaaaggcgcucggcuccgagguccaggacgccucuaaggugaccacgcagauugauaaagaaaagaaagagaucccugugagcauuaagaaagaacccgaggucaccgugguuucccagccuacagaaccccaaccggugcugaucccuagcauuaauaucaacucugacuccggggagaauaaggaggaaaucggaagccugucuaagaccgagacaauucuucccccugaauccgagaaccccaaagaaaaugauaacgacagcggcaccggcucuacggcugauacaagcuccaucgaccucaaucugagcauuucuuccuuccugagcaagaccaaagacuccgggucuaucagccuccaggagacaagacggcagaagaaaacccugaagaagaccagaaaauuuauugucgauggaguggagguuuccgugacaacgucuaagaucgucaccgacagcgauuccaaaacagaagaacuucgcuuccugcggagacaggaacuccgcgagcugcgguuucugcaaaaggaggaacagagagcccagcaacagcuuaacucuaaacuccagcagcaacgcgagcagaucuuccggagauuugaacaggagaugaugagcaagaaacgccaguacgaccaagaaauugagaaucuggagaagcagcagaagcagaccaucgaacggcuggagcaagaacauacaaacagacuccgcgaugaggcuaaacggauuaagggcgaacaggagaaagagcuguccaaguuccagaauaugcuuaaaaacagaaagaaggaggagcaagaauuugugcagaaacagcagcaagagcuggacgggagccucaagaaaaucauucagcagcagaaggccgaacuggcgaauaucgagcgggagugucugaacaacaaacaacagcuuaugcgcgccagagaagcugccauuugggagcucgaggagcggcaucugcaggagaagcaccagcugcucaagcaacagcugaaagaucaguauuucaugcagagacaccaacuucugaagcgccacgaaaaagagaccgaacagaugcagcgguacaaucaaagacucaucgaggaacugaagaaccgccagacgcaggagagagcucggcugccuaaaauccagcgcucugaggccaagacaagaauggccauguuuaagaaaucccuucggauuaauagcaccgcuacccccgaccaagaucgcgacaagaucaaacaguucgcggcccaggaagagaagagacagaaaaacgaacggauggcucaacaucagaagcacgagaaucagaugcgcgaucuccagcugcaaugcgaagccaacguuagagagcugcaucagcuccagaaugagaagugucaucugcuuguggaacacgagacacaaaaacugaaggaacucgacgaggaacacucucaggagcugaaagaguggcgggaaaagcugcgcccgagaaagaagacccuugaggaagaguuugcccggaaacugcaggagcaggaagucuucuuuaagaugacaggagaguccgaaugccucaacccuagcacgcaaucuagaauuuccaaguucuaucccauccccagccugcacuccaccggcagcuga

SEQ ID NO: 75933 - RNA, 2487 nt, Artificial Sequence
  derived and/or modified sequence opt5 from SLMAP__Homo_sapiens__NP_001291349
augcccagcgcccuggcuaucuuuaccugcagaccuaacucccacccguuccaggagcggcacguguaccucgacgaacccauuaagaucggccgcucugucgccagaugucggccugcgcaaaauaacgcuacauucgauugcaaaguucugagccgcaaucacgcccuugugugguuugaccauaagacggggaaauucuaucugcaggauaccaaguccucuaacggaacauuuauuaauagccagagacucucccggggcucugaggaaagcccucccugugagauccuguccggggacauuauccaguucggaguggaugucaccgaaaacacacgcaaagugacccacggcugcaucguuagcacaauuaagcuguuucugcccgacgggauggaggccagacuccggucugaugugauccaugcuccucugccgucccccgucgacaagguggccgcuaauaccccuagcauguacucucaagagcuguuccagcucucccaguaucugcaggaagcccuucaccgcgagcaaaugcuggaacagaaacucgcgacgcugcagagacuucuggccauuacccaggaggcuagcgauacaucuuggcaagcccucaucgacgaggaucggcugcugucccgccucgaaguuaugggaaaccagcugcaggcuuguagcaagaaucaaaccgaggacucccuuagaaaagaacugauugcccuccaggaggauaagcacaacuacgaaacaaccgcgaaagagucucugcggcgcgugcuucaggagaagaucgaagucgugagaaagcugagcgagguggaacggucccucagcaauacggaggacgaaugcacacaucugaaagagaugaacgagagaacccaggaagaacugcgcgaacucgccaauaaguauaacggcgcugucaaugagauuaaagaccugucugauaagcugaaaguugccgaaggcaagcaagaggagauccagcagaaagggcaggcugaaaagaaggagcugcaacacaaaaucgacgaaauggaggagaaggaacaggagcuccaggccaaaauugaagcccugcaggcugauaacgacuuuacaaacgagcggcuuaccgcgcugcaagugagacucgaacaucugcaggagaagacccugaaagaguguuccagccucgaacaccuucuuucuaagagcggaggcgauugcacauucauccaccaguuuauugagugucagaagaaacugaucguggaagggcaucucacgaaggccgucgaggaaaccaaacuguccaaggagaaucaaacacgcgcuaaagagucugacuucagcgauacccugucccccagcaaggaaaagucuuccgacgauacaaccgacgcccagauggaugagcaggaccuuaacgaaccucucgccaaagugagccugcugaaggacgaucuccaaggagcucagucugagauugaagccaaacaggagauccagcaccuucggaaggagcuuaucgaagcgcaagagcuggcuagaacguccaaacagaagugcuuugaacuccaggcccugcuggaggaggaacgcaaggccuaccggaaucagguugaggaaagcacaaaacaaauucaggugcuucaggcucagcuccaaagacugcauaucgacaccgagaaccugcgcgaagagaaggauuccgagauuaccucuacacgggacgaacuccugagcgccagagaugagauccuucugcuccaccaggcugccgcgaaagucgccuccgaacgcgacaccgauauugcuucucugcaggaggaacugaagaaagugcgggccgagcuugagagauggcggaaggcugccagcgaauaugagaaagaaaucacaucccuccaaaauagcuuccagcugcgcugucagcagugcgaggaccaacagagagaagaggcgacgcggcugcagggcgagcucgaaaagcugagaaaggaguggaacgcccuugaaaccgagugccauucucugaaacgcgagaauguucuccuguccagcgaacugcagcggcaagagaaggaacuucacaacucucagaaacagucccucgagcugacaagcgaucugucuauccuccagaugagcagaaaggaacuggagaaucaaguggggucccuuaaagagcagcaucugcgcgacagcgcugaucucaagacccugcugucuaaggccgaaaaccaggcuaaagacguccagaaggaguacgagaaaacacaaaccgugcuuuccgagcugaagcucaaauucgaaaugacggagcaggagaagcagagcauuaccgaugaacugaagcaauguaaaaauaaccucaagcugcuuagagagaaaggaaauaacaagcccuggccguggaugccuaugcuggccgcccucgucgcugugacagcgaucguucuguacgugcccggccuggcccgggcuuccccuuga

SEQ ID NO: 75934 - RNA, 585 nt, Artificial Sequence
  derived and/or modified sequence opt5 from SLMO2__Homo_sapiens__NP_057129
augaagaucuggaccagcgagcacguguucgaccaucccugggaaacagucacgaccgccgcuaugcagaaauacccuaacccgaugaaucccuccguugugggcguggauguccuggacagacacauugauccuucugggaagcuccauagccaccggcugcuuuccacagaguggggacugcccucuaucgugaaaagccucauuggcgccgcgcgcaccaagacauauguucaagaacauuccguggucgacccuguggagaaaaccauggaacugaagucuacaaacaucagcuuuaccaauaugguuuccguggaugagagacuuauuuacaagccccacccucaggacccggagaaaacgguccugacccaggaagcuaucaucacagugaagggggugagccucucuuccuaucuggagggacugauggccagcaccauuucuuccaacgccagcaaaggccgggaagcuauggagugggucauccacaagcucaaugccgagauugaggaacugacagcuucugcccgcgggaccaucagaacgcccauggcggccgcugccuucgcugaaaaauga

SEQ ID NO: 75935 - RNA, 96 nt, Artificial Sequence
  derived and/or modified sequence opt5 from SLN__Homo_sapiens__NP_003054
augggcaucaacaccagagagcuguuccucaauuuuacaauugugcugaucacggucauucuuauguggcugcucguucggagcuaccaguauuga

SEQ ID NO: 75936 - RNA, 399 nt, Artificial Sequence
  derived and/or modified sequence opt5 from SLPI__Homo_sapiens__NP_003055
augaaaagcuccgggcuguuccccuuucucgugcugcuugcccuggggacccucgcuccuugggccgucgagggaucuggcaagagcuucaaggcggggguuugcccgcccaaaaaguccgcucagugucugagauacaaaaagccugaaugccaaucugacuggcagugucccggaaagaaacggugcuguccugauacaugcggcaucaagugucuugaccccguggauacgccuaacccgacccgcagaaaacccgggaagugcccugugacauauggacagugucugaugcucaaucccccuaacuuuugcgagauggacggccaguguaaacgggaucugaagugcugcaugggcauguguggcaagagcugcgucucccccgugaaagccuga

SEQ ID NO: 75937 - RNA, 3051 nt, Artificial Sequence
  derived and/or modified sequence opt5 from SLTM__Homo_sapiens__NP_001013865
auggccgcugccaccggcgcgguggcugccagcgccgcuuccgggcaggccgagggaaagaaaaucacagaccugagagucauugaucucaagucugaacugaaacggcgcaaccuugacaucacgggcguuaagaccgugcugauuagcagacucaaacaagcuaucgaggaagaagggggagaucccgacaauauugaacugacaguguccaccgauacaccuaacaagaagccgaccaaaggcaaggggaaaaagcacgaggccgacgagcuuucuggagaugcgagcgucgaagacgaugccuucaucaaagacugcgagcuggaaaaucaggaggcucaugagcaggauggcaacgacgaacucaaggauuccgaggaauuuggcgagaaugaagaggagaacgugcacucuaaggaacugcugagcgccgaggaaaauaaacgggcucaugagcucaucgaagccgaggggauugaggacaucgaaaaggaggacauugaaucccaggagaucgaagcgcaagagggagaggaugacacauuccugaccgcccaggauggcgaagaggaagagaacgagaaagaagggagccuugcugaggccgaccacacggcucaugaagagauggaagcccacaccacaguuaaggaggccgaggaugacaauauuucugugaccauccaggcugaagaugcgauuacacuggacuuugauggagacgaucuccuggagaccggcaaaaacgucaagaucacggacuccgaagccagcaaacccaaggacgggcaggaugcuaucgcccaaucuccugagaaggaauccaaagacuacgagaugaaugccaaccacaaggauggcaaaaaggaggacugugugaaaggcgaucccguugaaaaggaggcucgcgaaagcucuaagaaagccgaguccggcgacaaggaaaaagauacacuuaagaaagggccuagcuccaccggagcgucuggccaggcuaagagcuccagcaaggagucuaaagacuccaagacaagcucuaaagaugacaaggggagcaccuccucuaccagcggauccagcggaucuuccacaaagaauauuugggugagcgggcugucuuccaacacgaaggccgccgaucucaagaaucuguucggaaaauauggcaagguccugagcgcuaaaguggugaccaacgccagaucccccggcgcuaagugcuacgggaucgucacaaugucuagcuccaccgagguuucucgguguauugcccaucuccaccgcacagaacugcauggacagcuuaucagcguggagaaagugaagggcgacccuuccaaaaaggaaaugaagaaagagaacgaugagaagucuagcuccagaagcucuggggacaaaaagaauaccuccgaccggagcucuaaaacgcaggcgagcgucaagaaggaagagaaacgcuccagcgaaaagucugagaaaaaggaauccaaagauacaaagaagauugagggaaaagacgagaagaacgauaauggcgccagcgggcaaaccuccgaaucuaucaaaaagagcgaggagaaaaagagaaucuccucuaagagcccgggccacauggugauucuggaccagaccaaaggagaucacugccggcccucccgcagaggccgguaugagaagauccaugggcgcucuaaagaaaaggagagagcuagccucgacaaaaagcgggauaaagacuacagacgcaaggagauucugccuuuugaaaagaugaaagagcagcggcuuagagaacaccugguucgcuucgagcggcucagacgcgccauggaacugcggagacgccgggagaucgcugagagagaacgccgggagagagaacggauucgcaucaucagagagcgggaggaaagagagcgccugcaacgggaaagagagcgccucgaaauugagagacagaagcuggagcgggaacgcauggagagagaacggcuugagcgcgaaagaauccggauugagcaggagcgcagaaaagaagccgagcggaucgcgcgcgaaagagaggaacugcggagacagcaacagcagcuccgcuaugagcaggagaagcggaacucccugaaaagaccccgcgauguggaccaucggagagaugacccuuacuggagcgaaaauaagaaacuuucucuggauacagacgcccgcuuuggacacggcuccgacuauagccggcaacagaacagauucaaugauuuugaccaucgcgagcgggggagauuccccgaaucuuccgcuguccagucuagcuccuuugagcggcgcgauagauucgugggacagagcgagggcaaaaaggcccggccgaccgcucgcagagaagacccuuccuuugagcgguaccccaaaaacuucagcgauucuagacgcaaugaaccucccccuccccggaacgagcucagagaaagcgaccgccgggagguuagaggggagcgcgaugaacggagaacagugauuauccacgaccgcccggauauuacgcaccccagacauccucgggaggccggccccaauccuucccgccccaccucuuggaaaagcgaaggauccaugucuacagacaagagagagacccgggucgaacgcccggagagaagcggccgggagguguccgggcacucugucagaggagccccucccggcaaccgcagcuccgcuagcggguacggaucucgggaaggcgauagaggggugaucacagaccgcggcggaggcucccaacauuauccugaggaacggcacguuguggagagacacgggcgggacaccagcggaccccgcaaggaauggcauggcccucccucucaggggccguccuaccacgauacgagacggaugggagacggccgcgcgggggccggcaugaucacccagcauagcuccaaugcuucuccuauuaacagaaucguccagauuagcggaaauuccaugccccggggcagcgggucuggauucaagcccuuuaaaggcgggccuccgcgcagauucuga

SEQ ID NO: 75938 - RNA, 1761 nt, Artificial Sequence
  derived and/or modified sequence opt5 from SLU7__Homo_sapiens__NP_006416
augagcgccaccguggucgacgcuguuaacgccgcgccccuguccggcucuaaggagaugagccucgaagaaccuaaaaagaugacaagagaagauuggcggaaaaagaaagagcuggaggagcagcgcaaacuugggaaugcuccggccgagguggacgaagagggaaaggauaucaacccccacauuccucaauacaucuccucugugcccugguauauugacccuagcaaaagacccacgcugaagcaucagcggccucagccggaaaaacagaagcaauucuccucuagcggcgagugguacaaacgcggggucaaggaaaauuccaucauuaccaaguauagaaaaggagccugcgaaaacuguggcgcuaugacacacaagaaaaaggauugcuuugagcggccccgcagagugggggccaaauucaccggaacaaauaucgcuccugacgaacauguucagccccagcucauguuugauuacgacggcaagcgggaucgcuggaacggcuauaauccugaggaacacaugaaaaucguggaggaguacgccaaggucgaccuggcgaagagaacccuuaaagcccagaagcugcaagaggagcucgcuagcgggaaacugguggaacaggccaacucucccaagcaucaguggggagaggaggaaccuaauucccagauggagaaagaucacaacagcgaagacgaggaugaagacaaguaugcugacgauauugacaugccgggccaaaauuucgauucuaagcggcgcaucacaguuagaaaccugcggauucgcgaggacaucgccaaauaccucagaaaucuggaucccaacuccgcguacuaugacccuaagacccgggccaugagagaaaaucccuacgcuaacgccgggaaaaaccccgaugaggugagcuaugcuggagacaauuuuguccgcuacacgggcgauaccauuucuauggcccagacacagcuuuucgccugggaggcuuaugacaagggguccgaagugcaucugcaagcggauccuaccaaacucgagcugcuuuacaagagcuuuaaggugaaaaaggaagacuucaaagagcagcagaaggaguccauccuggaaaaauauggaggccaggagcaccucgacgccccgcccgcugaacugcugcucgcccaaacagaggauuacgucgaauacucucggcacggcaccguuauuaaggggcaggagagagccguggcuuguagcaaguaugaggaagacgugaaaauccauaaccacacgcacaucuggggauccuacuggaaggagggccgcuggggguauaaaugcugucauagcuuuuucaaguacucuuauugcacaggagaagccggcaaagagauugucaauuccgaagaguguaucauuaacgagaucaccggggaagagagcgugaagaaaccucagacacugauggaacuucaccaggagaagcugaaggaagagaaaaagaaaaagaaaaagaagaaaaagaaacaucggaagucuagcuccgauucugacgaugaggaaaagaagcacgagaagcucaaaaaggcgcugaaugcugaagaggccagacuucugcauguuaaagagaccaugcaaauugacgaacgcaagcggcccuacaacagcauguaugagaccagagaaccuacagaggaagagauggaggccuaccgcaugaaacggcagagacccgaugacccgauggcuuccuuucucggacaguga

SEQ ID NO: 75939 - RNA, 312 nt, Artificial Sequence
  derived and/or modified sequence opt5 from SLURP1__Homo_sapiens__NP_065160
auggccagcagaugggcugugcagcugcuccuggucgccgcgugguccaugggcugcggggaggcucuuaaguguuauaccugcaaagaacccaugacaucugccagcugucggacgaucacccgcugcaagccugaggacacagccuguaugaccacacugguuaccguggaagcugaguacccguucaaccaaucccccguggucacaagaucuugcagcuccucuuguguggccaccgauccugacagcauuggagcugcccaccucaucuuuugcuguuuccgggaucugugcaauuccgaacuuuga

SEQ ID NO: 75940 - RNA, 5505 nt, Artificial Sequence
  derived and/or modified sequence opt5 from SLX4__Homo_sapiens__NP_115820
augaagcugagcgugaacgaagcccagcucggcuucuaccuggggucccuuucucaccugagcgcuugccccggaaucgacccuagauccucugaagaucaacccgagagccucaaaacaggccagaugauggacgaauccgaugaggacuuuaaggaacugugugccucuuucuuucagcgggucaaaaagcaugggauuaaagagguuagcggagagcgcaagacacagaaggcggcuuccaauggcacgcaaauccggagcaaacuuaagcggaccaaacagacagccaccaagacaaaaacccugcaggggcccgccgaaaagaagccucccucuggaucccaggcuccucgcaccaaaaagcaaagagugaccaaauggcaggccagcgagcccgcucacucugugaacggcgaaggcgggguccucgccuccgccccugauccgcccgugcugcgggagacggcccagaauacccagacaggaaaccaacaggagccuagccccaaucugucucgcgaaaagaccagagagaacguuccuaauuccgacagccagcccccgccuuccugccucacaaccgcugugcccucuccuagcaaaccccggacggcccaacugguccuucagcgcaugcagcaguucaagagagcugaucccgaacggcugcgccaugccuccgaggaauguagccucgaggcggccagagaggaaaacgugccuaaagacccgcaagaggaaaugauggcuggcaauguuuaugggcugggacccccugcccccgagucugaugcugccguggcccuuacacugcagcaggaauuugcucgggucggcgcguccgcccacgacgauagccucgaggagaaggggcuguucuuuugccagauuugucaaaagaaccugucugcuaugaaugugacccgcagagaacagcaugugaaccggugccucgacgaggccgagaaaacccugagaccuagcgucccccagaucccggaguguccuauuugcggaaagcccuuccuuacccugaaaucccgcaccucucaccucaagcagugugccguuaaaauggaagugggcccucaacugcuucugcaggcugugcggcuccagacagcccagcccgagggcagcuccagcccucccauguuuucuuucuccgaucacagcagagggcugaagcgccggggaccgacgucuaagaaagagccuagaaagcgccggaaagucgacgaagcgcccuccgaggaccugcucguggcuauggcccugagcagauccgaaauggagcccggcgccgcuguuccugcccuucgccuggagucugcuuuuagcgaacggaucagaccggaggccgaaaauaagucccgcaaaaagaagcccccugugucucccccucuccugcuuguccaagauagcgagaccacagggcggcagaucgaagacagaguggcgcugcuccuguccgaggagguugaacugagcucuacacccccucuccccgccucccggauucugaaagagggaugggaacgcgcuggccagugcccgccucccccugagagaaagcagagcuuccuuugggaagggucugcccugacaggagcuugggccauggaggauuuuuacaccgcgcggcucgugcccccgcuggucccucaaagacccgcccagggccugaugcaggagccugugccgccccuugucccuccggaacauuccgagcucagcgaacgccggucucccgcucugcacggcacgccuacagccggguguggaagcagaggccccuccccuagcgcuucucaacgcgagcaucaggcccugcaggaccucguggaucuggccagagaagggcuuuccgcuagccccuggccuggauccggcgggcuggcgggcucugagggaaccgccggccucgacguugugcccgggggacugccccugaccggcuucgucgugccuagccaggauaaacaccccgacagagggggacgcacacuucucucccugggccugcucguugcugauuucggggccauggugaacaauccucaccugucugacguccaauuucagaccgauagcggcgaggugcuuuaugcccauaaguucgugcuguacgcuagaugcccccuccugauccaguauguuaacaacgaaggauuuuccgccgucgaggacggcgugcugacacagcgggugcuucucggggacgucucuacggaagcggcucgcaccuuccugcacuaccuguauacagccgauaccggacucccgccuggccugagcuccgagcuuagcucucuggcccauagauuugggguguccgagcucguucaccugugcgaacaagugcccauugcuacagacagcgagggaaaacccugggaagagaaggaagccgagaauugugagucucgggcggaaaacuuccaggagcugcuucgcuccaugugggcugaugaagaggaagaggccgagacccuccucaaguccaaagaccaugaagaggaucaggaaaaugucaacgaggccgaaauggaggagaucuacgaauuugcugccacgcaaagaaagcugcuccaggaggaacgggcugccggcgcgggggaggacgccgauuggcuggagggcggaucuccuguguccggccagcuucuggcugggguucaggugcaaaaacagugggacaaggucgaagagauggaaccccucgagccuggacgcgaugaagccgcuaccacaugggagaaaaugggccagugcgcccugccgcccccucaggggcaacacagcggagccagaggcgcugaggcgcccgaacaggaggccccugaagaggcucuggggcacuccagcuguucuagccccucccgggacugccaggccgaaagaaaggagggcucucuuccgcauagcgaugacgccggagauuacgagcagcuguucuccucuacccaaggcgaaauuagcgagccuucccagaucacaucugaacccgaggaacagagcggggcugugcgcgagcggggacucgagguuucccacagacuggccccuuggcaggcguccccgccucaucccugucgcuuucuccugggcccgccucaagggggaucuccccggggcucccaccacaccagcggcucuagccuuagcacgcccagaucccgcgggggaacaucucaggugggcagcccuacccugcucuccccggcuguccccagcaaacagaagcgggacagaucuauucugacacuguccaaggaaccugggcaucaaaaaggaaaggagcgccggagcgugcuugaaugcagaaauaaaggcgugcugauguuccccgagaagucuccuagcaucgaccucacccaguccaaccccgaucacucuagcucccggucucagaaaagcuccagcaagcugaaugaggaagacgaggucauccuccugcuugauucugacgaagaacuggaacucgagcagaccaagaugaaauccauuagcuccgauccucuggaggaaaagaaagcccuggagaucucuccgcgcagcugugaacucuuuuccauuaucgacguugaugccgaccaagagcccucucagagcccucccagauccgaagcugugcugcagcaggaggaugagggggcccucccugaaaaccggggaagccugggccgcagaggcgcgcccuggcuuuucugcgaccgggagucuuccccgagcgaggcuucuacaacggauaccuccuggcuggugccugccacaccccuugccagcagaucucgcgacuguagcucccaaacccagauuucuagccugcgguccgggcuggcuguccaggccgugacacagcauacccccagagcuagcguuggaaaucgcgagggcaacgaaguggcccaaaaguuuuccgucauccggccucagacgcccccuccgcagacacccucuagcugccucaccccugugucccccgggaccucugauggaagacgccaaggccaccggagcccuuccagaccccaucccgggggacacccucacucuagcccccuggcgccucaucccaucuccggcgaccgcgcccacuucagcagacgguuccuuaaacauucuccucccggcccguccuuucugaaucagaccccugcuggggagguuguggaggucggagacagcgaugacgaacaggagguggccucucaccaggcuaaccgcagcccgccccucgauagcgacccuccgauucccaucgaugacuguugcuggcauauggaaccucugucucccauuccuaucgaucacuggaaucucgagagaaccggcccccuguccacaagcuccccuagccggcgcaugaacgaggccgccgacucuagagauugccggagccccgggcuucuggacacgaccccgauuagaggauccuguacaacccaacgcaagcugcaggaaaagucuagcggcgcugggucccucggaaauucucggccuagcuuccugaacuccgcgcuuugggauguuugggacggcgaggaacagagacccccugagacacccccgccugcccagaugcccucugcuggcggggcccaaaaacccgaaggacuggagaccccuaagggcgccaaccgcaaaaagaaucugcccccuaaagugccgaucacgcccaugccucaguauagcaucauggagacccccguccugaagaaggaacucgaccgguuuggggugagaccucugcccaaacggcagauggugcuuaagcugaaagagauuuuccaguacacacaccaaacccuggauuccgacagcgaagaugagucucaguccagccagccucuccugcaggcuccgcauugccaaacacuugccucucagaccuauaagcccucccgcgcgggaguccacgcucagcaagaagccacaaccggcccuggggcccauagacccaaaggaccugcuaagacgaaaggcccccggcaccagcgcaagcaccaugagagcaucacaccgccuuccagaucucccaccaaggaggcgcccccuggccugaacgacgaugcgcagauucccgccagccaggaauccguugcuaccagcguggacgggucugauuccagccucucuagccaauccucuagcuccugugaguuuggagccgcuuucgaaucugccggcgaggaagagggggagggagaagugagcgcuucccaggccgcgguccaggccgcugacacagaugaggcccugcggugcuacauccgcagcaaaccugcucucuaucagaaggugcugcuuuaccaaccguuugaacugagagagcugcaggccgagcuccggcagaauggccugcgcguuucuuccagacggcuucuggacuuccucgauacccacuguauuacguuuacaaccgccgcuacaagacgcgaaaaacugcaggggcggagacgccaaccccggggaaagaaaaagguggagagaaacuga

SEQ ID NO: 75941 - RNA, 1227 nt, Artificial Sequence
  derived and/or modified sequence opt5 from SLX4IP__Homo_sapiens__NP_001009608
auggccagcaagaaauucgcugugaagugcggcaacuuugccguccugguugaccuccacauccugccccagggguccaauaaagauaccucuugguucagcgagcaaaagaaagaagaggugugucuucugcucaaggaaacaauugacuccagagugcaggaguaccuggaaguccggaagcagcaucgcccuucuaacgcggaguuuacgagaagcaauccgcuuucccugaaaggauauggcuuccagaucaccgcuuacuuucucaagcgggggauucgccugagaugcauccggucuacacaaaacgccgagcuguguguguuccccgaucgcuuuguugugugcgucagccagcucgccuucuccagagaccugcuugcuagccagaaugaagaucugaccgagcgggugcuccacggaguuucugacuauuuugccgaaugugcugaguccagccugccucccucugccaaacuucgcagaaacgcgcugaaggagauugugaaacggacagaaaccaaguccagcgucacaucuaagucccagacccgcagagauacgguggagaccagcuccgacucugugaucgccgaaaucgcucggcgcagaaaugauggccaagccagcuccagcccucccucugaguccauggggcaggcuaaagacagcauuaaggccgcggaaucucauuggggacucccuguccagaaacuggagaagguuaaccagacacaaccggaggauaccagcggccagcagaaaccccacccuggcgaacggcugaagacagggcuccuguccagaucucccgugugcagcugugaguccgccagcccuugccccaaacaaucuccgcgcguggcuaagacccagcagaagcggagaaauuguuccagcgccgaagacuucgaucaucacggacgcgucucucuuggcuccgaccggcuggugccuagagagaucauuguugagaaaagcaaggcugugcgcguccuccccgccuccgaacugucugacccugggcuucugcucaaacaggaucuggccaagacgacaagcaaagaggaacugcacgugcucgagucccugucuagccggcaucuuaugaagaacaaucccggacaagcucagcagaccggccuggcgacaaacaccgaaagacucuccaccauccagaauagccccacaaagaaacgcaagaaauacgagcgggggcacuga

SEQ ID NO: 75942 - RNA, 1398 nt, Artificial Sequence
  derived and/or modified sequence opt5 from SMAD1__Homo_sapiens__NP_005891
augaacgugaccagccuguucuccuuuacaucucccgccgucaagagacuccugggcuggaaacagggggacgaggaagagaagugggcugaaaaagccguugaugcgcuugugaagaaacugaagaagaaaaagggagcuauggaggaacucgagaaagcccugagcugcccuggccaaccguccaauugugugacgaucccccggucucuugacgggcgccugcaggucagccacagaaagggacucccucaugugauuuacugccggguuuggcgcuggcccgaucugcagucccaccaugagcugaaaccucucgaauguugcgaguuccccuuuggcucuaagcagaaggaaguguguaucaacccuuaucacuacaaaagagucgagagcccggugcugcccccuguucuugugccccggcauuccgaguauaauccucaacacagccugcucgcccaguuccgcaaccuggggcagaaugaaccccacaugccgcuuaacgcuaccuuuccugacucuuuccagcaacccaauucccauccuuuuccccacagccccaacucuuccuacccuaauagcccgggaucuuccagcuccacauauccccauucuccuaccagcuccgaucccggcagcccuuuccagaugcccgccgacacaccgccucccgcuuaccugccucccgaggauccuaugacccaggacggcucucagcccauggauacaaacaugauggccccgccucuccccuccgaaauuaauagaggggacguccaagcgguggccuaugaggaacccaagcacuggugcagcaucguguacuacgagcugaacaaucgggucggagaggcuuuucacgccucuagcaccuccguucugguggauggcuucacggacccuucuaacaauaaaaaccgcuuuugucucgggcugcuuagcaacgugaauagaaacuccaccauugaaaauacacggcgccauaucggaaagggcguccaccuguauuacguugggggagagguguaugcugaaugccucagcgauucuuccaucuucgugcagagcagaaacuguaauuaccaucacggcuuucauccgaccacagucugcaaaauucccucuggcuguucccugaagaucuucaacaaucaggaguucgcccaacuucuggcgcagagcgugaaccacggguuugaaaccguuuaugagcucacgaaaaugugcacaauucggauguccuucgugaagggauggggcgccgaguaccaccgccaggacgucaccucuacaccuugcuggaucgaaauucaucugcacgggccccugcaguggcucgacaaggugcugacccaaaugggaagcccucauaaucccaucuccucugucagcuga

SEQ ID NO: 75943 - RNA, 1404 nt, Artificial Sequence
  derived and/or modified sequence opt5 from SMAD2__Homo_sapiens__XP_006722514
augagcuccauccugcccuucaccccuccgguggucaagagacuccugggcuggaaaaagucugccgggggaagcggcggggcuggaggcggggagcagaacggacaagaagagaaauggugcgaaaaggccguuaaaucccuugugaagaagcugaaaaagacaggccggcucgacgagcuggaaaaagcgauuacgacccagaauuguaacacaaagugcgugaccauccccucuacauguagcgagauuuggggccuuuccaccccuaauacaaucgaucagugggacaccacggggcuguacucuuuuagcgagcagacccgcucccucgauggaagacugcaagucagccaccggaaaggccugccccaugugauuuauugccgccucuggagauggccugaccugcacucucaucacgaacuuaaggcuaucgagaacugugaauacgccuucaaucugaagaaagaugagguuugcgugaaccccuaucauuaccagcgggucgagacaccugugcucccgcccguucuggugccucgccacaccgaaauccuuacagagcugcccccucucgacgauuauacccacuccauucccgaaaauacgaacuuuccggccgggaucgagccucagagcaauuacauucccgaaacaccuccucccggauauaucucugaggacggcgagaccuccgaucagcaacugaaccagagcauggacacagggucucccgcugaacuguccccgaccacccucagccccgucaaucauucccuggaucuucagccugugacauacucugagcccgccuucugguguagcauugcuuacuaugaacugaaccagagagugggagagacguuucacgccucccaaccuagccucaccgucgacggcuucacagaucccucuaauuccgaacgguuuugccugggccuucugagcaacguuaaucgcaacgcgaccguggagaugacaagacggcauaucgggcgcggagugagacucuacuauauuggcggggaggucuucgccgaaugucugucugacagcgcuaucuuugugcaguccccgaacugcaaucagcgguacggauggcacccugccaccguuuguaagauucccccuggcugcaaccugaaaaucuucaauaaccaagaguuugcugcccuccuggcgcagucugugaaucagggguucgaagccgucuaucagcuuacgcgcaugugcacaaucagaaugagcuuugugaagggauggggcgcugaguaccggagacaaaccguuaccuccacacccuguuggauugaacugcaccucaacggcccucugcaguggcuugacaaagugcugacccagauggggagccccucuguccgcugcuccagcaugucuuga

SEQ ID NO: 75944 - RNA, 963 nt, Artificial Sequence
  derived and/or modified sequence opt5 from SMAD3__Homo_sapiens__NP_001138574
auggagcugugcgaguucgccuuuaacaugaagaaagacgaagugugugucaaucccuaccacuaucagagaguugaaaccccugugcucccgcccgugcuggucccucggcauacagagauccccgcugaguucccuccccuugaugacuacagccacuccauuccugaaaacacgaauuuuccggccggcaucgagccccaaucuaacauuccugaaacacccccucccggguaucugagcgaggauggagaaaccuccgaccaucagaugaaucacucuauggaugcgggcagcccgaaccucuccccuaaucccaugucuccugcucauaacaaucuggaccuucagcccgugaccuacugcgagcccgccuucugguguagcaucuccuauuacgagcugaaccagcgcguuggggaaacauuucacgccagccaaccuucuaugaccguggauggauucacagacccguccaauagcgagagauuuugccucggccugcugucuaacgucaaucggaacgcugccguggaacucacccgcagacacauugggcggggaguucgccuguauuacaucggcggcgagguguucgcugaaugucuuuccgauagcgccaucuuuguccagucucccaauugcaaccagagauacggguggcauccugcgacgguguguaagauucccccuggaugcaaccugaaaaucuucaauaaccaggaguuugccgcucuccuggcccaauccgugaaucagggcuucgaggcugucuaucagcuuacccggauguguacaauucgcaugagcuuuguuaagggguggggagccgaauacagacggcagaccgugacauccacccccugcuggaucgagcugcaccucaacggcccgcugcaauggcuggacaaagugcucacgcagauggggucuccuagcauucgcuguuccagcgucucuuga

SEQ ID NO: 75945 - RNA, 1659 nt, Artificial Sequence
  derived and/or modified sequence opt5 from SMAD4__Homo_sapiens__NP_005350
auggacaacaugagcaucaccaauacacccacguccaacgaugccugccugucuauugugcacagccucaugugucauagacagggcggggaguccgaaaccuucgcuaagcgggccaucgagucucuggucaaaaagcugaaagaaaagaaagacgagcuugauagccucauuacagcgaucaccacaaauggagcucacccuuccaagugcguuaccauucaacgcacacuggacggcagacuucagguggccgggcggaagggauuuccgcaugugaucuacgcccgccuguggagauggcccgaucuccacaaaaacgaacugaagcaugucaaauauugucaguacgcuuucgaccugaagugcgauucuguguguguuaauccuuaucacuacgagcggguggucagccccggcaucgaccucuccgggcugacccuucagagcaacgccccuucuuccaugauggugaaagaugaguauguucacgacuuugaaggacaacccagccugucuacggagggccauuccauucagaccauccagcacccuccgagcaaucgcgcuucuacagaaaccuacuccacacccgcccuccuggcgccuagcgaguccaacgccaccucuacggcuaauuuccccaacauuccuguggccagcacaucccagcccgcuagcauccuuggcgggucucauuccgagggacugcuccaaauugccagcggcccgcagccugggcagcagcaaaauggauuuaccggccagcccgcgacauaucaccacaacucuaccaccacauggacggggagcagaaccgccccuuacacacccaaucugccccaucaccagaacggacaucugcaacaccauccuccgaugcccccucaccccggccacuacuggccuguccauaaugaacucgcuuuccagcccccgaucuccaaccacccugcccccgaguauuggugcucuauugcuuacuuugaaauggauguccaggugggcgagaccuucaaggugccuagcuccugucccaucguuacaguggacggguauguggauccuagcggaggcgaccgguuuugccuggggcagcuuucuaacguccaucgcaccgaagccaucgagagagcccggcugcacauuggaaagggcgugcaacucgaguguaaaggggaaggagacguuugggugcgcugccuguccgaucacgcugucuucgugcagagcuacuaucuugacagagaggcgggccgggcccccggcgaugcuguucauaagaucuacccgucugccuauauuaaaguguuugaccugcgccagugucacagacagaugcaacagcaggccgcuacggcccaggcggcugccgccgcucaagccgcugccgucgcggggaauaucccuggacccggcuccgucgggggaauugcccccgcuaucagccucuccgccgcugccggcaucgggguggaugaccugcggagacugugcauucuccgcaugucuuucgugaagggcuggggaccugauuacccgcggcagagcaucaaagaaacacccugcuggauugagauccaucugcacagagcgcuucagcugcucgacgaaguucugcauaccaugccuauugccgauccccagccucuugacuga

SEQ ID NO: 75946 - RNA, 1398 nt, Artificial Sequence
  derived and/or modified sequence opt5 from SMAD5__Homo_sapiens__NP_001001420
augaccagcauggccucccuguucucuuuuacaagccccgcugugaagagacuccugggcuggaaacagggggacgaggaagagaagugggccgaaaaagcggucgaugcucuuguuaagaaacugaagaagaaaaagggagccauggaggaacucgagaaagcccuguccucuccuggccaaccgagcaagugcgugacgaucccccggucccuugacgggcgccuccaggugucucacagaaaaggacugccucaugucauuuacugucggguguggcgcuggcccgaucugcagagccaccaugagcugaagccucucgacaucugcgaguuccccuuuggcuccaagcagaaagagguuuguauuaacccuuaucacuacaagagaguggaaagcccgguccugcccccugugcuuguuccccggcauaaugaguucaacccucaacacucucugcucgugcaguuucgcaaucugucccacaacgagccccauaugccgcagaaugcuaccuucccugauagcuuucaccagcccaacaauacaccuuucccccuuucucccaacuccccuuauccgcccagcccugccucuuccaccuaccccaauagcccugcuuccucugggcccggaagcccguuucaacugccugccgacacacccccucccgcguauaugccucccgaugaccagaugggccaggauaacucccagccgauggacaccagcaauaacaugaucccucaaauuaugcccucuaucuccagcagagauguccagcccguggccuacgaagaaccuaaacauuggugcucuaucguguauuacgaacucaauaaccgggucggcgaggcuuuccacgccagcuccacaucuguucugguggacggguuuaccgauccgagcaauaacaagucccgcuucugucugggacuccugagcaacgugaauagaaacucuacgauugaaaauacccggcgccacaucggcaaagggguccaucuuuacuaugugggaggcgagguuuacgcugagugccuguccgacagcucuauuuuugugcaguccagaaacuguaauuuccaccauggguuccaccccacaaccgucugcaagaucccuagcuccuguucucucaaaauuuuuaacaaucaagaguucgcccagcugcuugcgcagagcgugaaccauggauuugaagccguuuaugaacugacaaagaugugcaccauccggauguccuucgugaagggcuggggcgcugaguaccaccgccaggacgucacgucuacacccuguuggauugaaauccaccuccaugggccucugcaauggcuggauaaagugcucacccagaugggaagcccccugaauccuaucuccagcgucucuuga

SEQ ID NO: 75947 - RNA, 1491 nt, Artificial Sequence
  derived and/or modified sequence opt5 from SMAD6__Homo_sapiens__NP_005576
auguucagaagcaagcgguccggccuggugcgcagacucuggcggucucgcgucguucccgacagagaggaagggggaagcggcgggggaggcgggggagaugaggacggcucccugggcucucgggccgaaccugcuccgcgcgccagagaagggggaggcugcgggcggagcgaggugcgccccguggcgccuagacggccccgcgaugcugucggacagagaggcgcccaaggggccggacggcgcagacgggcuggcggcccucccagaccuauguccgagccgggggccggagcuggcucuagccuucuggacguggccgagcccgggggaccuggcuggcuccccgaauccgauugugagaccguuacaugcugucuguuuagcgaacgcgacgcggccggggcuccucgggaugccucugacccccuugcuggagccgcgcuggagccggccggcggcgggagaucccgcgaggcucggagcagacuccugcugcucgaacaggagcugaaaacggugaccuacucucuucugaagcgccucaaagaacggucccuggauacacuucuggaggccgucgaaagcagaggaggcgugccugggggaugcguucucgugccccgcgcugaccugcggcugggcgggcagccugccccuccccagcuccugcuuggcagacuguuccgcuggcccgaucuccaacacgccgucgagcugaagccgcuuuguggaugccauucuuuugcugcggccgcugacggccccaccguguguugcaacccuuaucacuucucccggcugugugggcccgagagcccucccccgccuuacuccagacucucuccccgggaugaauauaaaccucuggaccugagcgacuccacacucagcuacaccgagacagaagccaccaauucucugaucacggcccccggagaguuuuccgaugcuagcaugucuccugacgccaccaagcccagccauuggugcuccguggcguauugggaacaccgcacaagagucggccggcuuuacgcuguuuaugaucaggccgugucuauuuucuacgaccugccgcaggggagcggauuuugucucggccagcugaaccuugagcaaagauccgagagcgugcgccggaccagaucuaagaucggguucggcauucugcucuccaaagaaccugauggagucugggccuacaaucgcggcgagcaucccaucuuugugaacagccccacacuggacgcuccugggggcagagcccugguugugcggaaggucccgcccggauauucuauuaaaguguucgauuuugaacgcuccgggcuccagcacgcuccugagcccgacgccgcggauggaccuuacgaccccaauagcguuagaaucuccuucgccaagggcugggggccuugcuauucucggcaguuuaucaccagcugccccuguuggcuggaaauucuucugaacaauccgcgcuga

SEQ ID NO: 75948 - RNA, 636 nt, Artificial Sequence
  derived and/or modified sequence opt5 from SMAD7__Homo_sapiens__NP_001177751
auggacuuccugaagcccaccgccgauugcccugacgcugugccgagcuccgccgagacaggcgggacgaacuaccucgcgcccggaggccugucugauagccagcuucugcucgaaccuggggacagaucccacuggugugucguugcuuauugggaggagaaaacccgggugggacgccuguacugcgugcaagaacccucucuugauaucuuuuaugaccugccucagggcaauggguucugucucggacagcugaacagcgauaauaagucccagcugguccaaaaagugagaucuaagauuggcugcggcauccagcucacacgggaaguugacggggugugggucuacaaccgcagcuccuaucccauuuuuaucaaaagcgccacccuggauaauccugacucuagaacacuucuggugcauaagguuuucccgggauuuuccauuaaggccuucgauuacgagaaggcuuauagccuccagcggcccaacgaccacgaguuuaugcagcaaccuuggaccggcuucacagugcagaucucuuuugucaaaggguggggacaguguuacacccgccaguucaucuccagcugccccuguuggcuggaagugauuuuuaauucuagauga

SEQ ID NO: 75949 - RNA, 1404 nt, Artificial Sequence
  derived and/or modified sequence opt5 from SMAD9__Homo_sapiens__NP_001120689
augcacagcaccacacccaucuccucucuguucagcuuuacguccccugccgugaagagacuccugggcuggaaacagggggacgaggaagagaagugggcugaaaaagccgucgauucucuuguuaagaaacugaagaagaaaaagggagcgauggacgagcucgaacgggcucugagcugcccgggccaacccuccaaaugugugaccauuccucgcucucuugaugggagacuccaggugagccaucggaagggacucccccacgucaucuacugccgcguguggagauggccugaccugcagucccaucacgagcugaaaccccucgaguguugcgaguucccuuuuggcagcaagcagaaggagguuuguauuaacccguaucauuaccggcgcguggaaacacccguccugccucccgugcuuguuccuagacacucugaguauaauccccaacugucccuccuggccaaauuccggagcgccucucuucacuccgagccgcugaugccucauaacgcuaccuaccccgauagcuuucagcagccucccugcucugcccugcccccuuccccgagccacgcuuucucccagucucccuguacagccagcuauccucauucccccgggagcccuucugaacccgaguccccguaccaacacagcguggacaccccuccccugccuuaucacgcgacagaagccucugagacccagagcggacagcccgucgaugcuacggccgaccgccauguggugcuguccaucccuaauggcgauuuuagacccgucugcuacgaagaaccgcagcacugguguucuguugcuuacuaugagcucaacaaucgggugggcgaaaccuuccaagccagcucccgcagcgugcugauugacggguuuacagauccuucuaacaauagaaaccgguucugccuuggacugcucuccaaugucaaccgcaauagcaccaucgagaacacaagacggcauaucggcaagggggugcaccuguacuauguuggaggcgaaguguacgcggagugugucucugacuccagcauuuuugugcaguccagaaauugcaacuaucagcauggguuccaccccgccaccguuugcaaaauccccucuggauguagccuuaagguguuuaauaaccaacuguucgcucagcuccuggcccaguccguccaccauggcuucgaaguggucuacgagcugacgaaaaugugcacaauucgcaugucuuuugugaagggcuggggagcugaguaucaccggcaggauguuaccagcacaccuuguuggaucgaaauucaucuccacgggccgcugcaauggcuugacaaagugcugacccagaugggcagcccccacaacccuaucuccucugucuccuga

SEQ ID NO: 75950 - RNA, 294 nt, Artificial Sequence
  derived and/or modified sequence opt5 from SMAGP__Homo_sapiens__NP_001029045
augaccagccugcucacaacgcccuccccuagagaggaacugaugaccacaccgauccuucagcccaccgaggcccugucuccugaagacggcgcuagcacagcccucauugcgguggucaucaccguuguguuccugacacuucuguccguggucauucucaucuuuuucuaccuguauaagaacaaagggucuuacgugaccuaugagcccacggaaggagagccuagcgcuauuguucaaauggaguccgaucuggccaagggcucugaaaaagaggaauacuuuaucuga

SEQ ID NO: 75951 - RNA, 1404 nt, Artificial Sequence
  derived and/or modified sequence opt5 from SMAP1__Homo_sapiens__NP_001037770
auggccaccagaagcugccgggagaaggcucagaaacugaacgaacaacaccagcucauccuguccaaacuucugcgcgaggaagacaauaaguacugugccgauugcgaggcgaagggccccagaugggcuucuuggaacauugggguguucaucuguauucggugcgccggaauccaucgcaaucucggcguccacauuagcagaguuaaauccgugaaccuggaccaguggacagccgaacagauccaauguaugcaggauauggggaauacgaaggcucggcuucuguaugaggccaaccucccugagaauuuucgcagaccgcagaccgaccaggcuguggaauuuuucauccgggauaaguacgagaaaaagaaauauuacgacaagaacgccauugcgaucacaaauauuucuagcuccgaugcuccccugcaaccucuggucucuagccccucccuccaggccgccguggacaaaaacaagcuggaaaaggagaaagagaagaaaaaggaagagaaaaagcgcgaaaaagagccugaaaagcccgcuaagccucuuaccgccgagaaacugcagaagaaagaucagcaacucgagccgaagaaaagcacaucucccaagaaggcggccgaaccuaccguugaccugcuuggacuggauggccccgcuguggccccugucacaaaugggaacaccacggugcccccgcucaaugacgaucuggacaucuucggaccuaugauuuccaacccccugccugcuaccguuaugccucccgcccagggcacacccagcgccccggcugcggccacccucucuacagugaccuccggcgaccuggaucuuuuuacggagcagacaaccaaaagcgaagaggucgcuaagaaacaacugucuaaggacuccauccucagccuguaugggacaggaaccauucagcagcaguccacccccggcguguucauggggccuacaaauauccccuuuacgucucaagccccugccgcuuuccagggauuucccagcaugggcgugccggucccugccgcgcccgggcuuaucggaaacguuaugggccaguccccuagcaugauggugggcaugcccaugccuaacggguucaugggaaaugcucagaccggcgugaugccccugccgcaaaacgucguggggccucagggaggcaugguugggcagaugggagcuccccagucuaaauuuggccucccccaagcccagcagccucaguggucccugagccaaaugaaucagcagauggccggcaugucuauuagcuccgccacaccgaccgcuggguucggacaacccucuagcacaaccgccggcugguccgggucuagcuccggacagacgcugagcacacagcucuggaaguga

SEQ ID NO: 75952 - RNA, 3213 nt, Artificial Sequence
  derived and/or modified sequence opt5 from SMARCA1__Homo_sapiens__NP_001269803
auggagcaggacaccgccgcuguggccgcgacagucgcugccgccgaugcuacggccaccaucguugugauugaagacgagcaacccggcccuagcacaucccaggaagagggggcugccgcggccgcuaccgaagccacagcugccaccgagaagggagagaaaaagaaagaaaagaacgugucuagcuuccagcugaaacucgcggccaaggcuccgaaguccgagaaagaaauggaucccgaguacgaggaaaagaugaaagccgacagagcuaagcgguuugaguuccugcuuaaacagacagaacuguuugcccacuucauccaaccuucugcccagaagucucccaccuccccucucaauaugaagcugggccgccccagaauuaaaaaggaugagaaacagucucuuaucagcgcuggggacuaucggcaucgcagaacggaacaggaggaggaugaggagcugcucuccgaaagccggaagaccucuaacgucugcauucgcuuugagguguccccuagcuacguuaaaggaggcccgcugagagacuaucaaauccgggggcugaauuggcucaucucucuguacgaaaacggagugaauggcauucuugcggaugagaugggccuggggaagacacuccagaccaucgcccugcuuggauaucugaaacacuaccgcaacauucccggcccucauaugguccucgugcccaaguccacacugcacaauuggaugaacgaguucaagagauggguuccuagccugcgggugaucuguuuugucggggacaaagaugcucgcgccgccuucauuagagacgaaaugaugcccggagagugggaugugugcgugaccucuuaugaaauggucaucaaggagaaauccguuuuuaagaaauuccauuggcgguaccucgugauugacgaagcucaccgcaucaagaaugaaaagagcaaacuguccgagaucgugagagaauuuaagucuacgaaccggcuucugcucacaggcaccccgcugcagaauaaccuucacgagcugugggcccuccugaauuuccugcucccugacgucuuuaacagcgcggaugacuucgauuccugguucgacacaaagaauugucugggggaucagaaacuuguggaaagacugcaugcuguucucaaacccuuucugcuucgccggauuaagaccgacguggaaaagagccugccucccaaaaaggagaucaaaauuuaccucggacugucuaagaugcaaagagagugguauaccaaaauccugaugaaggauauugacguccucaacuccagcggcaagauggauaaaaugcgccugcuuaacauccugaugcagcuccggaagugcuguaaucaccccuaccuguucgacggcgccgagccugggccgcccuauacaacggaugaacauaucgugucuaacagcggaaaaaugguugugcuggacaaacuucucgccaagcugaaggagcagggcuccagaguccugauuuuuagccaaaugacccgccuccuggacauccuugaagauuacugcauguggcggggguaugaguacuguagacuggacggacagacaccucacgaggaacgcgaggauaaauuccucgaaguggaguuucugggccagcgggaagcuauugaggccuucaaugcucccaacagcuccaaguuuaucuucaugcugagcaccagagccgggggacuuggcauuaaucucgcgucugccgacgucgugauccuguaugauuccgacuggaacccucagguugaucugcaagcuauggaccgcgcccaccggaucggccagaagaaacccgugagagucuuucggcucauuacagauaauaccguggaggaacgcaucguugagagagcugaaauuaagcugcggcuugacagcaucgugauucagcaggggagacugaucgaucaacagucuaacaaacucgccaaggaggaaaugcugcagaugauucgccauggagcgacgcacgucuucgccuccaaagagagcgagcugacagacgaagauaucaccaccauccuugagcggggcgaaaagaagacagcugagaugaaugagagacuccagaaaaugggggaauccucucugcgcaacuuuagaauggacauugagcaaagccuguacaaguucgaaggagaggacuaccgggaaaaacagaagcucggcaugguggaguggaucgagccgccuaaacgcgaaagaaaggccaauuaugcuguggaugccuacuuucgggaggcccugcgcguuuccgaacccaagauuccuaaagcucccagaccucccaagcagccgaacguccaggacuuccaauucuuuccuccccggcuuuucgagcugcucgaaaaagagauccuguauuaccgcaagaccauuggguauaaagugcccagaaauccugauaucccgaaccccgcgcuggcccagcgggaggaacagaagaagaucgacggcgcugagccucuuacacccgaagagacggaagagaaagagaagcuccugacccaaggauuuacaaauuggaccaaacgcgauuucaaccaguuuauuaaggccaacgaaaaauacggcagagacgauaucgacaauauugcccgggagguggaagggaagucuccugaggaggucauggaauauagcgcuguguucugggagagaugcaacgaacugcaggauaucgagaaaauuauggcccagaucgaacgcggagaggcgcggauccaaagacgcauuuccaucaagaaggcucucgacgccaaaauugcccgguacaaggcucccuuucaucagcugagaauccaguacggcacaagcaaagggaagaauuauaccgaggaagaggaucgcuuccuuauuuguaugcugcacaaaaugggauuugaccgggaaaacguuuacgaggaacucagacagugcgugcgcaaugccccucaauuccgguuugauugguucaucaagucuagaacggcgauggaguuucagcggcgcuguaacacccugaucucccugauugagaaggaaaauauggagaucgaagagagagaacgggcugagaaaaagaaacgcgccacaaagacccccaugagccagaaaagaaaggccgagucugcuacagaauccagcggcaagaaagacgucaagaaagugaagucuuga

SEQ ID NO: 75953 - RNA, 4545 nt, Artificial Sequence
  derived and/or modified sequence opt5 from SMARCA2__Homo_sapiens__NP_001276326
augagcacccccacagacccuggcgccaugccgcaccccgggccuucccccggaccuggccccucuccugggccgauccugggacccagcccuggccccgggccuucccccggaucugugcauagcaugaugggcccguccccuggacccccuucugucagccaccccaugcccacgaugggguccaccgauuucccucaggagggaaugcaucaaaugcacaagccgauugacggcauccaugauaaagggauuguugaagacauccacugcggaagcaugaagggcacagggaugagacccccucaccccggaaugggcccuccccagucuccgauggaucagcauucccagggcuacaugagcccucaccccucuccucucggggcucccgagcauguguccagcccuaugucuggaggcgggcccaccccgccucaaaugccucccucccagcccggagcccugauuccgggcgacccccaggcgaugagccagccuaaccgggggcccuccccuuuuucucccgugcaacuucaccagcugcgcgcucagauccucgccuauaaaaugcuggccagaggacagccucuucccgaaacacugcaacucgcuguccagggcaagcggacccugccgggccugcagcaacagcagcagcaacagcagcagcaacagcagcagcaacagcagcagcaacagcagcaacagcagccucagcaacagcccccucagccccagacacaacagcagcagcaaccggcccucgugaauuacaaccgcccuagcgggcccggaccugagcuguccggccccagcacgccccagaaacuuccuguuccggcucccgggggaagaccuucucccgccccucccgcggccgcucagccuccggccgcugccgugcccggcccuuccgucccccaaccugcgcccgggcagccgagcccugugcugcagcuccagcaaaagcagucucggaucagccccauucagaagccccagggccuggauccuguugaaauccuucaagagcgcgaguauagacugcaggcccggauugcucaccgcauccaggaacucgagaaucugcccggaucccugccuccggaccucagaaccaaagccaccguggaacugaaggcccuucggcugcucaacuuccagcgccaacugagacaggaggucguggcuuguaugcggcgcgauacaacccuugagacagcccucaauucuaaggcuuacaaaagaagcaaacggcagacccugagagaagcgcgcaugacggagaagcuggaaaagcagcagaaaauugagcaagaacggaagagacgccagaaacaucaagaguaucugaacuccauccuccagcacgccaaggacuuuaaagaguaccaucggagcguggcuggcaagauucagaaacugucuaaggccgucgccacauggcacgcuaauaccgaaagagagcagaagaaagaaacagagcgcaucgaaaaggagcggaugagacgccuuauggccgaggaugaagagggguaucggaaacugaucgaccaaaagaaagauagacgccucgcguaccugcuucagcagaccgacgaauacguugcuaaccugaccaaucucgugugggagcauaagcaggcccaagccgcuaaggagaaaaagaaacggagacggcgcaagaaaaaggccgaagagaacgcugaaggaggcgaguccgcccuggggcccgacggagaaccuauugaugagagcucucagauguccgaccugcccgugaaggucacacacacggagaccggcaaaguucucuucgggccugaagcgcccaaggccagccagcuggaugcuuggcuugagaugaauccgggcuaugaaguggccccuagauccgacucugaggaaagcgauuccgacuacgaggaggaagaugaggaagaggaaucuagccggcaggagacagaggagaaaauccugcucgaccccaacuccgaagaagugagcgagaaggaugcuaaacaaauuaucgaaaccgccaagcaggacgucgaugacgaguauucuaugcaguacuccgcgagaggaagccaaucuuauuacacaguggcccacgcuauuuccgagcgcguugaaaagcagagcgcccugcugaucaauggcacccuuaaacauuaucagcuccaggggcuggaguggauggugucucuguacaacaauaaccucaacggaauccuggcugacgaaaugggccuugggaagacgauucaaacaaucgcccugauuaccuaccucauggagcacaaacggcugaauggaccuuaucugaucauugucccccuuagcacccucuccaacuggacauacgaguuugauaagugggccccuagcguggucaaaaucucuuauaagggcacccccgcuaugagacgcucccuggugccgcagcugagaagcgggaaauucaauguucuccugacaacguacgaauauaucauuaaggacaagcauauccuugcgaaaauucgguggaaguacaugaucguggaugagggccaccgcaugaaaaaccaccauugcaagcugacccaggucgaccucaaugaagaggaaacaauucugaucauuagacggcugcacaaagugcuucgcccuuuucuccugagacggcugaagaaggagguugagucccagcuccccgaaaaaguggaguaugucaucaagugugauaugucugcccugcagaaaauccuuuaccgccauaugcaagcuaagggcauucugcucaccgacggcagcgaaaaagauaagaaggggaaaggaggcgccaagacacugaugaacaccaucaugcagcugagaaaaauuugcaaucaccccuacauguuccagcauaucgaggaauccuuugccgagcaccuuggguauucuaacggagugauuaauggcgcugagcucuaccgggccagcgggaaguucgaacugcuggaccgcauccucccuaaacugagagcgacgaaccaccgggugcuucuguuuugucaaaugaccucccucaugacaaucauggaggauuauuucgcuuuuagaaauuuccuguaccugcgccuugacggcaccacaaagucugaagaucgggccgcccugcucaagaaauucaacgagccgggaagccaguauuuuauuuuccugcucuccaccagagcuggcgggcugggacuuaaucugcaggccgcggacacgguugucaucuuugauagcgacuggaacccccaucaggaccuccaagcucaggaucgcgcccaccggauuggccagcaaaaugaagugagagugcugcgccugugcacagucaacucuguggaggagaagauccuugccgcugccaaauacaagcugaacguugaccagaaagugauucaggcugggauguucgaucagaaguccagcucucaugaacggagagccuuucuccaagcgauccuggagcacgaagaggagaaugaagaggaagacgaggucccugaugacgaaacccucaaccagaugaucgcccgccgggaggaggaguucgaucuguuuaugagaauggacauggaucggcgcagagaagacgcucggaaucccaaacgcaagccuagacuuauggaagaggaugaacugcccuccuggauuaucaaggacgaugccgagguggagcggcucacaugugaagaggaagaggagaaaauuuucggaagaggcagccgccagcggagagacguugacuauucugaugcucugaccgaaaagcaguggcugcgcgccaucgaggacggcaaccuugaagagauggaagaggaggugcggcugaaaaagagaaaacgccggagaaaugucgauaaggacccugccaaggaagauguggagaaagcuaagaaacgcagagggcggccgcccgcggaaaagcucuccccuaaucccccuaaacugaccaagcaaaugaacgccauuaucgacacaguuaucaacuacaaggauagcuccggacgccagcucagcgagguguuuauucagcugcccucuagaaaagaacuuccggaguacuaugagcugauccggaagccugucgacuucaaaaagauuaaagaacgcaucagaaaucauaaguaccggagccugggcgaucucgagaaggacgugaugcugcuuugccacaacgcucagacguuuaaucuggaagggucccaaauuuaugaggauucuaucgugcuccagagcgucuucaaauccgccagacagaagauugccaaagaagaggagucugaagacgagagcaacgaagaggaagaggaggaagacgaggaagaguccgagucugaagcuaagagcguuaaagugaagaucaagcugaauaaaaaggaugacaaaggacgcgauaagggcaaagggaagaaacggcccaacagaggaaaggccaagcccguggucuccgacuuugauagcgacgaggaacaagaugagcgcgaacagucugagggcuccggcaccgacgaugaguga

SEQ ID NO: 75954 - RNA, 4944 nt, Artificial Sequence
  derived and/or modified sequence opt5 from SMARCA4__Homo_sapiens__NP_001122316
augagcacccccgacccuccgcugggcgggacacccagaccuggacccuccccuggccccgggccuucuccgggagccaugcucggccccagcccugggcccuccccuggaucugcucacagcaugaugggccccuccccgggcccucccucugccgggcauccuauccccacgcagggacccggcggguacccucaagauaacaugcaccagaugcauaagccgauggagagcaugcacgaaaaaggaauguccgacgauccccgguauaaucagaugaagggcauggggaugcgcagcggaggccaugcgggcauggggccucccccuucucccauggaccagcacucccaaggauacccgagcccucugggcgggucugagcacgcuuccagccccgugccugccucuggacccuccagcggcccucagauguccucugggcccggaggcgccccgcuugauggcgcugacccucaggcccuggggcagcaaaacagaggacccacccccuucaaucagaaccagcuccaucagcugcgggcucaaauuauggccuauaaaaugcuugcgcgcggccagccucugccggaucaccuccagauggccguccaagggaagagacccaugccuggaaugcagcagcagaugcccacacugccucccccuagcguuuccgcuaccggccccgggccgggcccuggacccggcccugggcccggaccgggcccugcucccccuaauuacagccggccccaugggaugggaggccccaacaugccuccgcccgggccuucuggcgugcccccuggaaugcccggccaaccucccgggggacccccuaaacccuggccugaaggccccauggccaaugccgcggccccgacauccaccccucagaagcugaucccgccccagccuacagggcgccccagcccugcuccgcccgccgugccucccgcugccucuccugucaugcccccgcagacccaaagcccuggacagcccgcccagccugcucccauggugccucuccaccagaagcaauccagaauuacgcccauccagaaaccgcggggccuggacccuguugagauucuucaggaacgcgaguauagacugcaggcgcggaucgcccaccgcauccaagagcucgaaaaccugcccgggucucuugcuggcgaucugagaaccaaggccacaauugagcucaaagcccugcggcugcucaauuuucagcgccagcugagacaagaaguggucgugugcaugcggagagacaccgcucuugagacagcccugaacgcgaaggcuuacaaacgcagcaagcggcagucccucagagaggcccgcaucaccgaaaagcuggagaaacagcagaagauugaacaagagcggaaaagacgccagaagcaucaggaauaucuuaauagcauccugcagcacgccaaagauuucaaggaguaccaucggucuguuacgggaaaaauucaaaagcucacaaaggcuguggccaccuaccacgcuaacacagagagagaacagaaaaaggagaaugaacgcaucgagaaagaacggaugagacgccugauggccgaggacgaggaaggcuaucggaagcugauugaucagaaaaaggacaagagacucgcguaccugcuucagcaaaccgacgaguaugucgccaaccugaccgaacucgugcggcagcauaaagcugcccagguggcuaaggagaaaaagaaaaagaagaaaaagaaaaaggccgaaaaugcggaggggcaaacacccgccaucggaccugauggcgagccgcuggacgaaacgucccagaugagcgaucuucccgucaaaguuauccacguggagucugggaagauucugaccggaacagacgcuccuaaggccggccagcucgaggcuuggcuggaaaugaaccccggguacgagguggccccucgcuccgauagcgaagaguccggcucugaagaggaagaggaggaagaggaagaggaacagccccaagccgcucagccuccgacccugcccgucgaggagaaaaagaaaaucccugaccccgauagcgacgauguguccgaaguugacgcgagacacauuaucgagaacgccaagcaggauguggacgacgaauauggagucucucaggcucucgcccggggccugcaaagcuacuaugccguggcucaugccguuacagagagaguggauaaacaguccgcgcuuauggucaauggggugcugaagcaguaccagauuaaaggacucgaauggcuggucagccuguacaacaauaaccuuaauggcauccucgcugacgagauggggcugggaaagaccauccaaacgauugcccugaucacauaucucauggagcacaagcgcauuaacggcccuuuucugaucauugugccccuuucuacccuguccaauugggccuacgaguucgauaaaugggcuccgagcguugugaaggucucuuauaaaggcuccccugccgcgcggagagcuuuugugccccagcuccgcagcgggaaguucaacguucugcugaccacauacgaauauaucaucaaagacaagcauauucuugccaagaucagauggaaauacaugauuguggaugaaggacaccggaugaagaaucaccauuguaaacucacccagguccugaacacacacuauguggcuccccgcagacugcuccugacgggcaccccucuucagaauaagcugcccgagcucugggcccugcugaacuuucuucucccuacaaucuucaaaucuugcagcaccuuugagcaaugguucaaugccccguuugcuaugacaggggaaaagguggaccugaacgaggaagagaccauucugaucauucggcgccuccauaagguucugagacccuuccuucugcggcgccucaaaaaggaagucgaggcccagcugccugagaaaguggaauacgugaucaagugugauauguccgcgcugcagagaguccuuuaccggcacaugcaagccaaaggagugcuccugacggacggcagcgagaaggauaagaaagggaagggaggcaccaaaacacugaugaauaccaucaugcagcuccgcaagauuugcaaccaucccuauauguuucagcacaucgaagagucuuucuccgaacaccugggcuucacagggggaauuguucagggccuugaccuguacagagcuagcgggaaauuugagcuccuggaucggauccugccuaaacuuagagccaccaaccauaaagugcuccuguucugucaaaugacgucccugaugacaauuauggaggacuauuuugcuuaccgcggauucaaguaucuccggcuggauggcaccacaaaggccgaagacagagggaugcuucugaaaaccuuuaaugagcccggaucugaauacuucaucuuucuccugagcacccgcgccggcggccuggggcuuaaccugcaguccgcugacacagucaucauuuucgauucugacuggaauccgcaccaggaucuccaggcgcaagaccgggcccauagaaucggacagcagaacgaggugcgcguucugcggcucugcacggugaauagcgucgaagagaagauucuggcugccgccaaauauaaacuuaacguggaucagaagguuauccaagcuggcauguuugaccagaaguccucuagccacgagagacgcgccuuccugcaggcgauucucgaacaugaggaacaagaugagucccggcacuguagcaccgggucuggauccgcuagcuuugcccacacagccccucccccugcuggcgugaaucccgaccuggaggaaccuccccugaaggaggaagaugaggucccggacgaugaaaccgugaaccagaugaucgccagacaugaggaggaguucgaccuuuuuaugcggauggaucuggaccgcagacgggaagaagcgcgcaauccuaaaagaaagccccggcucauggaggaagacgagcugcccucuuggaucauuaaagaugacgcugagguggaaagacucacaugcgaggaagaggaagagaagauguucgggcgcggaucccggcacagaaaagaggucgauuacagcgacucucugaccgaaaagcaguggcuuaaggccaucgaggaaggcacgcuggaggagauugaagaggaaguucgccagaaaaaguccagccggaaaagaaagcgcgauuccgacgccggcagcucuacaccuaccaccagcacacgguccagagauaaagacgaugagucuaagaagcaaaagaagcgcgggagaccgcccgcugaaaaacugagcccuaaucccccuaaccucaccaagaaaaugaagaagaucguggacgccgugauuaaauacaaggauuccucuagcggacggcagcuguccgaggucuucauccagcuucccucucgcaaagagcugccugaauauuacgagcucaucagaaagcccguggacuuuaaaaagauuaaagaacggauccgcaaccauaaguauagaagccugaaugaccucgagaaggauguuaugcugcuuugucagaacgcucaaacauucaaucuggaaggcucccugauuuacgaggacagcaucgugcuccagucugucuuuacguccgugcggcagaaaauugagaaggaagaugacagcgagggggaagagucugaagaggaggaagagggagaagaggagggcuccgaaagcgaguccagaucuguuaaagugaagaucaaacuggggcgcaaggaaaaggcccaggaucggcuuaaaggaggcagacgccggccgagcagaggcucccgggcgaagccugucgugagcgacgaugacucugaggaggaacaagaggaagaucgcuccgggagcggaucugaggaagacuga

SEQ ID NO: 75955 - RNA, 3159 nt, Artificial Sequence
  derived and/or modified sequence opt5 from SMARCA5__Homo_sapiens__NP_003592
augagcuccgccgcugagcccccuccgcccccucccccugaaucugcccccagcaagccugcggcuuccaucgccucuggcgggagcaacuccucuaauaaaggaggcccggaggggguggccgcucaggccgucgcuagcgccgcguccgccggacccgcugacgccgaaauggaggaaauuuucgaugacgcuagcccuggcaagcaaaaagagauccaggagcccgauccuaccuacgaagagaagaugcagacagacagagccaaccgguuugaauaucugcucaaacagacggagcuguucgcgcacuuuauucaacccgccgcucagaagaccccgacaucuccucuuaagaugaaacccgggcgcccuagaaucaagaaagaugagaagcagaaucugcucuccguuggagacuaccggcaucgcagaaccgaacaggaggaagaugaggaacugcuuacagagagcucuaaagccaccaacgugugcacacgguucgaggacucccccagcuaugugaaguggggcaagcugcgcgauuaccaagucagaggccucaauuggcugauuucucuguaugaaaacgggaucaauggaauccucgcugacgagaugggccuggggaaaacccuucagacgauuucccugcucggauacaugaagcacuaucggaacauccccggcccucauauggugcugguuccgaaaagcacccuucacaauuggauguccgaauuuaagcgcugggugcccacacugagaucugucugucucauuggggauaaagagcagcgggccgccuucgugcgcgacguucugcugccuggagaaugggaugugugcgucaccagcuacgagaugcucaucaaggagaaauccguguuuaagaaguucaacuggagauaccuggugauugacgaagcucaucggaucaaaaaugaaaagagcaaacuuucugaaauuguccgcgaguuuaagacaaccaacagacugcuccugacgggcacaccccuucagaauaaccugcacgaacucuggucccugcugaauuuccuccugccugacguuuuuaacagcgcggaugacuucgauucuugguuugacaccaacaauugucuuggcgaucaaaaacugguggagcggcuccacauggugcugagacccuuccuucugcgccggaucaaggccgacgucgaaaagagccucccgccuaaaaaggaggugaaaaucuauguugggcuguccaagaugcagagagagugguacacacgcauucugaugaaagauaucgacauucucaacucugcuggaaagauggauaagaugcggcugcuuaauauccugaugcagcucagaaaaugcuguaaccaucccuaucuguucgacggcgccgaaccugggcccccuuacaccaccgauaugcaccuggugacaaauagcggaaagauggucgugcuugacaaacuccugcccaagcugaaagagcaaggcucccgcguucucauuuuuagccagaugacgcgggugcuggacauccuugaggauuauugcauguggagaaacuacgaauauugucgccuggacgggcagaccccgcaugaugagcggcaggacucuaucaaugccuacaacgaaccuaauuccacaaaguucgucuuuaugcucagcaccagagcuggaggccugggcauuaaccuggccacagcggauguggucauccuuuacgacucugauuggaauccccaaguggaccuccaggcuauggaucgcgcccaccggauugggcagaccaagacgguuagaguguuccgguuuaucacagacaacaccgucgaggaacgcauuguggagagagccgagaugaaacugcggcuggauuccaucguuauccagcaaggaagacucguggaccagaaucugaacaagauuggcaaagaugaaaugcuucagaugauccgccacggggcuacccaugucuucgccagcaaggaguccgaaauuacagacgaggacaucgauggcauucuggaacggggagcuaaaaagaccgccgagaugaaugagaaacucucuaagaugggggaaagcucccugagaaacuuuacaauggacacggagucuagcguguauaacuucgaaggcgaggauuaccgcgaaaagcagaaaaucgcguuuaccgaguggauugagcccccuaagagagaacggaaagccaauuaugcuguggacgccuacuuccgcgaggcucugagaguuuccgaaccgaaggcccccaaagcgccucggcccccuaagcaacccaacguccaggauuuucaguucuuuccuccccgccuuuucgagcuccuggagaaggaaauccuguucuauagaaaaacaaucggauacaaggugccgcggaauccugagcuccccaacgccgcucaggcccaaaaagaggagcagcugaagauugacgaagcugagagccuuaaugaugaggaacuggaggaaaaagagaagcuccugacccagggcuuuacaaacuggaauaagcgcgacuucaaccaauuuaucaaagccaaugaaaagugggggagagaugacauugagaacaucgcccgggagguggaaggaaaaaccccugaggaagucauugaguauucugcuguguucugggaacgcugcaaugagcugcaggauaucgagaagaucauggcgcagauugaaagaggcgaggcccggauccagagacgcauuuccaucaaaaaggcucuugacacgaagauugggcgguacaaagcccccuuucaccaacucagaaucagcuacggaaccaacaagggcaaaaauuauacagaagaggaggaucgcuuccugaucuguaugcugcauaagcucggguuugacaaagaaaacguuuacgacgagcugcggcagugcauuagaaauucuccgcaguuccgcuuugauugguuccuuaagucccggaccgccauggaacugcagagacgcuguaacacacucaucacccugauugagcgggaaaacauggagcuggaggaaaaagagaaggcugaaaagaaaaagagaggcccuaaacccagcacgcaaaagcggaaaauggacggagccccugauggccgcgggagaaagaagaaacuuaagcuguga

SEQ ID NO: 75956 - RNA, 3087 nt, Artificial Sequence
  derived and/or modified sequence opt5 from SMARCAD1__Homo_sapiens__NP_001121901
augaaccuguucaaucucgacagauuucgguucgagaagcgcaacaaaaucgaagaggcccccgaagcuaccccucagccgagccaacccggcccuuccucucccauuagccuguccgccgaggaagagaaugcggagggggaagugucuagagcuaacacaccugauagcgacaucacggagaagaccgaagauuccucuguccccgagacaccugacaaugagcggaaagccagcauuuccuacuuuaagaaccagcgcggaauccaguauauugaucuuagcucugacuccgaagauguugugagcccgaauugcucuaacaccgugcaggagaaaacauucaauaaggacaccgucaucaucguguccgaacccagcgaggaugaagagucucaaggccugccuacaauggccagacggaacgacgauauuuccgagcucgaagaccugagcgagcuugaagaucugaaggacgcuaaacuccagacccugaaggagcuguuuccccagcgcuccgacaaugaucuccugaaacuuaucgaaucuacgagcaccauggacggggccauugcugccgcgcugcucauguucggagaugccggcgggggaccuagaaagcggaaacuguccucuagcuccgagcccuacgaggaagacgaguuuaacgaugaccagagcaucaagaagacacgccuugaucacggcgaagagucuaaugaaagcgcugaguccucuagcaacugggagaaacaagaauccauuguucugaagcuccagaaagaguucccgaauuuugacaagcaggaacugagagaggugcugaaagagcaugaauggauguauaccgaggcccucgaaagccugaaggucuucgcugaggaucaggacaugcaauacgugucucaguccgaaguuccuaacggcaaagaggugagcucucggucccagaacuaucccaagaaugccacaaagaccaaacuuaagcaaaaauuuagcaugaaggcgcagaacggguucaauaaaaagcgcaagaaaaacgucuuuaauccuaagagagugguggaggauuccgaauacgacucuggaagcgacgucggcuccucucuggaugaggacuauagcuccggggaagagguuauggaagauggauacaaaggcaagauccuccacuuccugcaggacgccagcauuggggagcuuacgcugaucccccaguguucucaaaagaaggcucagaagaucacagagcuccggcccuucaacuccugggaagcccuguuuaccaaaaugagcaagacaaauggacugucugaggaucucauuuggcauugcaaaacccugauccaggaacgcgacguggugauuagacuuaugaacaagugugaggauaucuccaauaaacugaccaagcaggucacaaugcucacgggcaacggcgggggauggaauauugaacaaccuagcauccugaaccagucucuuagccugaagccguaccagaaagugggccucaauuggcuggcucugguucacaagcaugggcucaacggaauccuggccgacgagaugggccuugggaaaaccauucaggccaucgcuuuccuggcguaucucuaccaagagggaaauaacggcccccaccugauuguggucccugccuccacaaucgauaacuggcugcgggaagugaaucuuuggugccccacccucaagguucuguguuauuacggcagccaggaggaaagaaaacagauucgcuuuaacauccacucucgguaugaggacuacaaugugaucgucacaaccuauaacugcgcuauuuccagcuccgaugacagaucucuguuccgccggcucaagcugaauuacgccaucuuugaugaggggcauaugcuuaaaaacaugggaagcauuagauaccagcaccugaugacgaucaaugccaacaaucgccuccugcugacaggcaccccugugcaaaacaaucuucucgaacugaugucccugcucaacuucgucaugccccauauguuuucuagcuccaccucugagauucggagaauguucagcuccaagacaaagagcgcugacgaacagucuaucuaugagaaagaacgcauugcccacgcgaagcagaucaucaaaccguuuauucugcggagagugaaggaggagguucuuaaacaacugccucccaagaaggaccgcaucgaacucugugcuauguccgagaaacaggaacagcuguaccuggggcuuuucaaucggcucaagaaaagcauuaacaaucuggugaccgagaagaacacagaaaugugcaacgucaugaugcagcugagaaaaauggccaaucacccucuccugcaucggcaauauuacacggccgagaaacuuaaggagaugucucagcugaugcucaaagaacccacccacugugaggcuaacccugaucugaucuuugaagacauggaggugaugacagauuucgaacugcauguucuuugcaagcaguaucgccacauuaauaacuuucagcucgacauggaucugauccuggacuccggaaaauucagagugcucggcuguauccugagcgagcuuaagcaaaaaggggaucgggucgugcuguucucucaguuuaccaugaugcucgacauucuggaggugcugcuuaagcaucaccagcacagauaccugcgccucgauggcaagacacagaucuccgaacggauucaucugaucgacgaguucaauaccgauauggacauuuuuguuuuccuccugagcacgaaagccggaggccuugggaucaaccugaccuccgcuaaugucgugauccuccacgauauugacugcaaccccuauaaugacaagcaagccgaagauagaugccaucgcgugggacagacaaaagagguccuggugaucaagcugauuagccagggcaccaucgaggaaucuaugcuuaaaauuaaccaacagaagcugaaacucgagcaggacaugacaaccguugaugaaggggacgagggaagcaugccggcggauaucgccacgcugcucaagacauccaugggccuguga

SEQ ID NO: 75957 - RNA, 2865 nt, Artificial Sequence
  derived and/or modified sequence opt5 from SMARCAL1__Homo_sapiens__XP_005246688
augagccugccccucaccgaggaacagagaaagaaaaucgaggaaaaccggcaaaaggcccuggcucgcagagccgagaaacuucuggcggaacagcaccagcggacauccucuggcacgagcauugcugggaauccuuuccaggccaagcaaggaccgucccagaacuuuccccgcgagucuugcaaaccugugagccauggcgucaucuucaagcagcagaaucucuccucuagcuccaacgccgaccaaagaccccacgauagccauucuuuucaggcuaaggggauuuggaaaaagccugaggaaaugcccaccgccuguccuggacacuccccgcggagccagauggcucugacaggcaucucucccccucuugcccaguccccucccgagguucccaaacaacagcugcucagcuacgaacuggggcagggacaugcgcaagccucuccggagauucgcuucaccccuuuugcuaaucccacacacaagccucuggccaaacccaaguccagccaggagacccccgcucacuccucuggccagccuccgagagacgccaagcucgaagcgaaaacagccaaggcuagccccuccggccagaacaucagcuauauccauucuuccagcgagucugugaccccucggacggaagggcgccugcaacagaaaagcggauccucugugcagaagggcgucaauagccagaaagggaagugcgugagaaacggagaucgguuccaaguucuuauuggcuacaaugccgagcugaucgcuguguuuaaaacccuccccuccaagaacuaugacccugauacaaagaccuggaauuucagcaugaacgacuacucugcccugaugaaagccgcucagucccuucccacagucaaucugcagccgcucgaaugggcguaugggagcucugaguccccuagcaccuccucugagggacaggccggccugcccagcgcuccuucccugucuuuugugaagggccgcuguaugcucauuagcagagccuacuucgaagccgauaucuccuauagccaagaccugauugcucuuuuuaaacagauggauucucggcgcuacgacguuaagacgagaaaaugguccuuccugcucgaggaacacagcaagcugaucgccaaggugcggugccuuccccagguccagcuggauccucuccccacaacccugacacuggcguuugcuucucaacucaaaaagaccucccugagccuuaccccggacgugccugaggccgaucugucugaaguggaccccaaacucgucagcaaccugaugcccuuccagagagccgggguuaauuucgcuauugccaagggaggccgccuucugcucgcugacgauauggggcugggaaaaacaauccaggccaucuguauugcggccuuuuaccggaaggaguggccucugcucgugguggucccguccagcgugagauucacgugggagcaggcuuuucugcgcuggcuucccucucuguccccugacugcaucaacguuguggucaccggcaaggaucggcucacagccgggcugauuaacaucgugagcuucgaccugcuuuccaaacucgaaaagcaacugaaaacccccuuuaagguugugauuaucgaugagucucauuuccugaaaaauagcagaacagcucgcugucgggccgcgaugccuguccucaagguggccaagagagucauccugcuuuccggaacccccgcuaugucucgcccugccgaacuguauacgcagauuaucgcugugaaacccacauuuuucccgcaguuucacgccuucggccuccgguacugcgacgccaagagaaugccuuggggcugggauuauagcggguccucuaaccugggagagcugaaacuucuccuggaagaggcuguuaugcugcgccggcucaagagcgacgugcugucccaacuucccgcgaaacagagaaagauugucgugaucgccccuggccggauuaaugcucgcaccagagccgcccuggaugcugccgcgaaagagaugaccacaaaggacaagaccaaacagcagcaaaaggaugcucucauccuguuuuucaaccggacagccgaagccaaaauccccagcguuauugaguacauccuggaccuucucgaaucugggagagagaaguuucugguguucgcucaccauaaagucgugcuggacgccauuacgcaggagcucgaacgcaagcacgugcagcauauccggauugauggauccaccagcucugcggagagagaagaccugugucagcaauuccagcuuuccgagcgccacgcuguugccguccugagcaucacagccgcuaauaugggccucaccuuuucuuccgccgaucuggugguguucgcugaacuguuuuggaacccggggguccuuauucaggccgaggacagagugcaucggaucggccaaacaagcuccguuggaauccacuaucucguggcgaagggcaccgccgaugacuaccuguggccucugauucaggagaaaaucaagguccucgcugaagccgggcugagcgagacgaauuucucugaaaugaccgagagcacagauuaucuuuacaaagaccccaagcagcagaaaauuuacgaucuguuucaaaaguccuucgaaaaggagggaucugacauggagcuccuggaagcugccgagagcuuugauccuggcuccgccucugggaccagcggauccucuagccagaacaugggcgacacacuggaugaauccagccuuaccgcuucuccccagaaaaagcgcagauucgaguuuuucgacaauugggacuccuuuacgagcccccuguga

SEQ ID NO: 75958 - RNA, 1131 nt, Artificial Sequence
  derived and/or modified sequence opt5 from SMARCB1__Homo_sapiens__NP_001007469
augaugaugauggcccugagcaagaccuucggccagaaacccgugaaguuucaacucgaggacgauggggaguucuacaugaucggauccgaggucggcaacuaucugagaauguuucgggggucucuuuacaaacgcuauccuagccuguggagacggcucgcuacaguugaagaacgcaagaaaauuguggccuccucucacgaccauggauacacgacccuggcgacaagcgugacccuucugaaggcuuccgaagucgaggagauccucgauggcaaugacgaaaaguauaaagccgugucuauuagcacagagccgcccaccuaccugagagaacagaaggccaaacggaacucccaguggguuccuacacugcccaauagcucucaccaucucgaugcugugccuugcuccaccacgaucaaccgcaauagaauggggcgggacaagaaacgcaccuucccccuguguuuugaugaccacgauccugccgucauucaugagaacgcuagccagccggaggugcuuguucccaucagacuggacauggaaaucgauggacaaaagcuccgggacgccuucacauggaauaugaacgagaagcugaugaccccugaaauguuuucugagauucuuugcgaugaccuggaccucaauccccugacauucgugccugcgaucgccuccgcuauucgccagcagaucgaaagcuaucccaccgauucuauucuggaggaccaguccgaucaaagagucaucauuaaacucaacauccacgugggcaauaucagccugguggaccaguuugagugggauauguccgaaaaggagaacucuccggaaaaauucgcccuuaagcuguguagcgagcucggccuugggggagaauuugucacgacaauugcuuacuccauccggggccagcugagcuggcaccagaaaaccuacgccuucucugagaauccucugcccacaguugagauugcgauccgcaacaccggggacgccgaucaauggugcccucuccuggaaacccugacagacgcugagauggaaaagaaaauuagagaucaggaccggaauacgagacgcaugcggagacucgccaacaccgcucccgccugguga

SEQ ID NO: 75959 - RNA, 3318 nt, Artificial Sequence
  derived and/or modified sequence opt5 from SMARCC1__Homo_sapiens__NP_003065
auggccgcugccgcgggcgggggaggccccgggaccgcugugggagccacaggcagcgggaucgccgcugccgcugccggacuggcggucuacagacggaaggacggcggcccugccacgaaauucugggaguccccggaaaccguuucucagcucgauagcgugcgcguguggcuggggaagcacuacaaaaaguacguccaugcugacgcccccacaaacaaaacccuugcuggacuggugguucaacuccugcaguuucaggaggaugccuucggcaagcacgugacaaauccugcguuuaccaaacuucccgccaaaugcuucauggacuuuaaggcugggggagcccugugucauauucucggcgcugccuauaaauacaagaacgaacagggguggagacgguucgaucugcaaaauccuucccgcauggacagaaacgucgagauguuuaugaauaucgaaaagacacuggugcagaacaauugccucacccggcccaacauuuaucugaucccugauauugaccuuaagcuggccaauaagcucaaagauaucaucaagcgccaccagggaacguucaccgacgagaaaucuaaggcuagccaucacauuuacccguauuccucuagccaggaugacgaggaauggcugagacccguuaugcggaaagagaagcaagugcuuguccacuggggcuuuuacccugauuccuacgacacaugggugcauagcaacgacguggaugcggaaaucgaggaucccccuauucccgagaaaccguggaagguccacguuaaguggauccuggacaccgacauuuucaaugaauggaugaacgaggaagauuaugagguggacgaaaaucgcaaaccugugucuuuuagacagcggaucuccacaaagaacgaggagcccguccgcagcccugaaagacgggaucgcaaagccucugcuaaugccagaaagcggaaacauucccccagcccucccccgcccaccccuacggagucuagaaagaaguccggcaaaaaggggcaggccagccucuacggaaaacgccggucccagaaggaagaggacgaacaagaggaucugacaaaagacauggaggaucccaccccugugcccaacauugaagagguugugcugccgaagaacgucaaucucaagaaagacucugaaaacacaccugugaagggcgggaccguugcugaccuggaugagcaggacgaagagaccgugacagccggaggcaaagaggaugaagaccccgcgaagggggaucagagcagauccgucgaccuuggagaggauaaugugacggaacaaaccaaccacaucaucauuccuagcuaugcuucuugguucgacuacaauuguauccacgucauugagcgccgggcccugcccgaguuuuucaacggcaaaaauaaguccaagacaccugaaaucuaucucgccuacagaaacuucaugauugauaccuaucgccugaauccccaggaguaccuuacaagcaccgcuugccggagaaaccugacgggcgacgugugugccguuaugcgcgugcaugcuuuucucgaacagugggggcuggucaauuaccagguggauccggagucucggccuauggccaugggacccccucccacaccgcacuucaacguucuggcggacacccccagcggccucgugccucugcaucuuagaucuccccaagucccugccgcucagcagaugcugaauuuucccgagaaaaacaaggaaaaaccuguggaucuccagaauuucgggcugcgcaccgacaucuauuccaagaaaacacuugccaagagcaaaggagcuuccgccggccgggaguggaccgaacaagagacacugcuccugcuggaagcgcucgagauguacaaggacgauuggaacaaggugagcgaacacguugggucuagaacgcaggacgagugcauccugcauuuucuucggcugcccauugaggauccguaucucgaaaacuccgacgccagccugggcccucuggcuuaccagcccgucccuuucucucaguccggaaaucccgugaugagcaccguggccuuucuugcuuccgucguggauccgcgcguugccucugccgcugcgaaagccgcucucgaggaguucagcagagugcgggaagaagucccucuggagcugguggaggcccacguuaagaaagugcaagaagccgcuagagccuccggcaaggucgaccccacauaugggcucgagucuagcuguaucgcgggaaccggcccugaugaacccgagaaacuggagggggcugaagaggaaaagauggaggccgaccccgauggacagcagccugaaaaggccgagaacaaaguggagaaugaaacagacgagggcgauaaggcucaggacggggaaaacgagaaaaauuccgaaaaggagcaagauagcgagguuucugaagacaccaaauccgaggaaaaggagacggaagagaacaaggagcuuaccgacacaugcaaagaacgcgagagcgauaccggcaagaaaaagguggaacacgagauuucugagggaaaugucgccacagcggcugccgccgcucuggccuccgcugccaccaaagcgaagcaucucgccgcuguggaggaacggaagaucaaaagccugguggcccugcuugucgaaacgcagaugaagaaacucgagauuaagcugagacacuuugaggaacuggagacaaucauggaccgcgaaaaagaggcucucgaacagcaaagacagcagcugcuuaccgagcggcagaacuuccauauggaacaacugaaguacgccgagcuccgcgccagacagcagauggagcagcaacagcacggccagaauccgcagcaagcucaccagcauucugggggacccggccuggcgccucugggggccgcuggacaccccggcaugaugccucaucagcaacccccuccguauccccuuaugcaccaucagaugccucccccucaucccccgcagccugggcagauccccggccccggaagcaugaugccuggccaacacaugcccgggcggaugauuccuacaguugccgccaacauccacccguccggaagcggccccaccccucccgggaugccucccaugccgggaaauauucucggcccucgcgugccccugaccgcuccuaacgggauguaucccccucccccgcagcagcagccucccccucccccgcccgccgauggcgugccucccccucccgcgccuggaccgcccgcuucugccgccccuuga

SEQ ID NO: 75960 - RNA, 3459 nt, Artificial Sequence
  derived and/or modified sequence opt5 from SMARCC2__Homo_sapiens__NP_001123892
auggccgugagaaagaaagacggcgggcccaacgucaaguacuaugaggcugccgauaccguuacacaguucgacaaugugcggcuguggcucgggaaaaacuacaagaaauauauccaagcggaaccuccgacgaauaagagccuguccucucuugugguccagcugcuccaguuucaggaggaaguguucggcaagcacguuagcaacgcuccccugaccaaacuuccuauuaagugcuuucuggauuucaaagccgggggaucccucugucauauccuggccgcugccuacaaguuuaaaucugaccaaggcuggcgcagauaugauuuccagaaucccagccggauggaccgcaacguggagauguuuaugacaauugaaaagucccugguccagaauaacugccucucuagaccuaauaucuuccugugucccgagauugagccuaaacuucuggggaagcucaaggauaucaucaaacggcaccagggaaccgugacagaagacaagaacaaugcuagccauguuguguacccgguccccggcaaccuggaggaagaggagugggugcgcccugugaugaaaagagauaagcaaguccuucugcacuggggcuauuaccccgacuccuacgauaccuggauuccugccagcgaaaucgaggcgucuguugaagacgcccccacaccggagaaaccucggaaggugcaugcuaaguggauucucgauaccgacacguuuaaugaauggaugaacgaggaggacuaugaagugaaugaugacaaaaaccccgucucccgcagaaagaaaaucagcgccaagacccugacagaugaggugaacucuccugacuccgaucggcgcgacaaaaagggaggaaauuacaagaaaagaaagcggagccccucucccuccccuaccccggaagcuaaaaagaaaaacgccaagaagggccccagcacaccuuauaccaaauccaagcgcgggcacagagaggaggaacaggaggaucugacgaaagacauggaugaacccucuccuguucccaauguggaggaagucacacucccgaagaccgugaacaccaaaaaggacagcgaguccgcgccuguuaagggaggcacaaugaccgaucuggacgaacaggaggacgagagcauggaaacaacggggaaagaugaggacgaaaauucuaccggaaacaagggcgagcagaccaaaaaucccgaucuucacgaggacaacgugacagaacaaacacaucacauuaucauuccuuccuacgccgcuugguucgauuauaauagcguccaugccaucgagcggagagcucugcccgaauuuuucaacggcaagaauaaaucuaagaccccugagaucuaccucgccuaucgcaacuuuaugauugacacguaccggcugaauccccaggaauaccuuacaagcaccgccugcagacgcaaccuggcuggggaugugugugcgaucaugcggguccacgccuuccucgagcaguggggacugauuaauuaucaaguggacgcugaguccagaccgaccccuaugggcccuccgcccacaucucacuuccauguucuggccgauacccccagcgggcucgugccccugcagccuaaaacaccccagggacgccaggucgacgccgauacgaaggcuggccggaaggggaaagaacuugacgaucuggugccugagaccgccaagggaaaacccgaacuccaaacauccgcgagccagcagaugcugaacuuuccugacaagggcaaagagaagcccaccgacaugcagaacuucggccuuagaacagauauguacaccaagaaaaauguuccgucuaaguccaaagcugccgccagcgcuacgcgcgaauggaccgagcaagagacacugcuccugcuggaagcccucgagauguauaaggacgauuggaacaaagugucugaacacgucgggucccggacccaggacgagugcauccugcauuuucuuagacugccuauugaagaucccuaccucgaggacagcgaggcuucccugggaccucuggccuaucagcccaucccguucucucagagcggcaauccugugauguccacaguggcguuucuugccucuguugucgauccccgcguggcuagcgccgcugccaaguccgcgcucgaagaguucagcaagaugaaagaagaggugccuaccgcccuggucgaggcucacgugcggaagguugaagaggccgcuaaagugacggggaaggccgaccccgccuuuggacuggaaucuuccggcaucgcugggacaaccagcgaugagcccgaaagaauugaggagucuggcaacgacgaagcgcgggucgagggacaagccacagaugagaaaaaggaaccuaaggaaccgcgcgagggcgggggagcuaucgaggaagaggccaaagaaaagaccuccgaggcccccaaaaaggacgaagagaaaggcaaggagggggauagcgaaaaagagucugaaaagagcgacggagacccuauuguggaucccgagaaggagaaagaaccuaaggagggccaggaagagguucucaaagaaguggucgaguccgagggggaaagaaagaccaaaguggagcgggacaucggcgaaggaaaucugagcacagcugccgcggcugcccuugccgcugccgcgguuaaggcuaagcaucuggccgccguggaggaaagaaaaauuaagucucucgucgcucugcugguggagacgcagaugaagaaacuugagaucaaacuccgccacuucgaggaacuggaaaccaucauggaucgggagagagaagcccuggaguaccagcgccaacagcuccuggcugacagacaggccuuucacauggagcaacuuaaguaugcggaaaugcgggcccgccagcagcauuuccagcaaaugcaccagcagcagcaacagcccccuccggcucugcccccuggcucccagcccauuccucccacaggggccgcuggaccgccugccgugcauggccucgccgucgcucccgcgagcguugugcccgccccugcuggguccggagcucccccuggcucucuggggccgagcgagcagaucggccaagccggauccaccgccggcccccagcagcaacagccugccggggcgccccagccuggagcugugcccccgggcgucccucccccugggccccacggaccuucucccuuuccgaaccagcaaacaccucccagcaugaugcccggcgccgugccuggguccggccacccgggaguugccgcucagucucccgccauuguggcggcuguccagggcaaucugcuuccuagcgccagcccccucccugaucccgggaccccucugccgcccgacccuacggcccccuccccuggaacagugacccccguuccgccuccccaguga

SEQ ID NO: 75961 - RNA, 1548 nt, Artificial Sequence
  derived and/or modified sequence opt5 from SMARCD1__Homo_sapiens__NP_003067
auggccgcuagagccggcuuccagagcguggcgcccuccgggggagcuggcgccucugggggagccggcgcugccgcugcccuggggccuggaggcaccccggggcccccuguccggaugggccccgcgccuggacaaggccucuaccgcagccccaugccuggggccgcuuauccgagacccggaaugcugccuggcucccggaugacaccccaggggccuucuaugggacccccgggcuacggcgggaacccuagcguucgccccggacuugcccaguccggcauggaccagucuagaaagcggccugcuccccaacagauccaacaggugcagcagcaggccgugcagaaucgcaaccacaaugcgaaaaagaaaaagauggccgauaaaauucugccccaaagaauccgggagcucgucccugaaagccaggcuuauauggaccugcuugccuuugagcgcaagcuggaucagacgauuaugagaaagcggcucgacauccaagaagcucugaaacgcccgauuaagcagaaaagaaagcugcggaucuucaucuccaacaccuuuaaucccgccaaaagcgaugccgaggacggggaaggaacaguggcuucuugggagcuccgcguugagggcagacugcuugaagauuccgcgcugagcaaguacgacgccaccaagcagaaacggaaguucucuuccuuuuucaaaagccucgugauugagcuggauaaggaccuuuaugggccugauaaccaucuggucgaauggcacagaacagcuaccacacaggagaccgacggauuucaagugaaacgccccggcgauguuaaugugcggugcacgguccuccugaugcuggacuaccagccuccccaguucaagcucgacccgagacuggcccgccuucugggcauccauacccagacacggccugugauuauccaagcccucuggcaguauauuaaaacccacaagcugcaggauccccaugagagagaauuugugaucugugacaaguaccuucagcaaauuuucgagucucagcgcaugaaauuuuccgaaaucccucagcggcugcacgcucuccugaugcccccugagcccaucauuaucaaccacgucauuagcguugauccgaaugaccagaagaaaacagccugcuacgauaucgacguggaaguggaugacacccugaagacgcaaaugaacuccuuccuccugucuacagcgagccagcaggagauugcuacccuugauaauaaaauccaugagacaaucgaaaccauuaaccaacugaagacccagagagaguuuaugcucuccuucgcccgcgacccucagggguucaucaaugauuggcugcagagccaaugucgggaccuuaagacaaugacggacgucgugggaaaccccgaagaggaaagacgcgccgaguuuuauuuccagcccugggcucaggaggccguuugccgguacuuuuauucuaaagugcagcaaagacggcaggaacuggagcaggcucucggcauucgcaauaccuga

SEQ ID NO: 75962 - RNA, 1452 nt, Artificial Sequence
  derived and/or modified sequence opt5 from SMARCD3__Homo_sapiens__NP_001003801
auggccgcugacgagguggccggcggggcgagaaaggcuaccaaaagcaagcuguucgaauuucucguccacggaguucggcccggcaugccuuccggggcccgcaugccgcaucagggagcccccaugggcccucccgggucuccuuacaugggaagccccgcugugagaccuggccuggccccggcuggcauggagcccgcccggaaacgcgcggccccucccccugggcaaucccaggcucagucucagggacaacccgugccgacagccccugcuagaagccgguccgccaagcgcagaaaaauggcggauaagauccuuccccagcggauucgcgaacuggucccugagucucaggccuauauggaccuccuggcuuucgaaagaaaacuugaucagacgaucaugcggaagcgcguggacauucaagaggcccugaagagacccaugaaacagaagcggaaacuccgccuguacaucagcaacaccuuuaaucccgcuaagccugaugccgaggacuccgauggcagcauugccucuugggaacugagaguugaggggaagcuccuggacgauccguccaaacagaagcggaaauucagcucuuucuucaagucccuugugaucgaacuggacaaagaucucuauggacccgacaaccaccuggucgaguggcauagaacaccuaccacacaggagaccgauggcuuucaagugaagcgccccggggaccuuagcguucggugcacacugcuccugaugcuggacuaccagccuccccaguucaaacucgauccgagacuggcucgccuucugggacuccacacccaaucucgguccgcgaucgugcaggcccuguggcaguaugucaagacgaauagacuucaggacagccaugauaaggaauacauuaacggcgacaaauauuuucaacagaucuucgauuguccucgccugaaguuuuccgagauuccccagcggcucaccgcucugcugcucccucccgacccuaucgugauuaaucacgugaucucugucgaucccagcgaccagaaaaagacagccugcuacgauauugacguugaaguggaggaaccgcugaaaggccaaauguccagcuuccuucugucuaccgccaaccagcaggagaucuccgcucucgauagcaagauccacgagacaauugaaucuaucaaucagcugaagauucaaagagacuuuaugcuuagcuucucccgcgacccuaaaggguacgugcaggaucugcuccggucucagagcagagaccugaaggucaugaccgauguggccggaaaccccgaggaggaacgccgggcggaauuuuaucaucagcccuggucccaagaggcuguuagcagauacuuuuauuguaaaauccagcagcggcgccaagagcuggaacagucucucguggucagaaauacguga

SEQ ID NO: 75963 - RNA, 1236 nt, Artificial Sequence
  derived and/or modified sequence opt5 from SMARCE1__Homo_sapiens__NP_003070
augagcaagagacccuccuacgccccuccgcccaccccugcucccgccacacagaugccuucuacgcccggcuucgugggguauaacccuuacagccaccuggcguauaauaacuaccggcucggaggcaauccggggaccaacucccgcgucacagcuucuagcggaaucaccauucccaaaccucccaagccucccgacaaaccgcugaugccuuauaugagauacucccggaagguuugggaucaagugaaagccucuaaucccgaccuuaagcugugggagaucggcaagauuaucgggggaauguggcgcgaucucacagacgaagagaaacaggaauaucugaacgaguacgaagccgagaagauugaguacaaugaaagcaugaaggcuuaucauaacuccccugccuaccuugcuuauaucaaugccaaaagcagagcggaggccgcucuggaagaggagucucggcagcgccaguccagaauggaaaaaggcgagcccuacaugagcauccaacccgccgaagauccugacgauuaugacgauggcuuuucuaugaagcacaccgcuacagcccgguuccagcgcaaccauagacucauuuccgagauccugagcgaaucuguggucccggacgugcgguccguugugaccacggcgcgcaugcagguccugaagagacaggugcaaagccucaugguucaccagcggaaacuggaggccgagcuucugcagauugaggaacgccaucaggaaaagaaaagaaaguuucucgaguccaccgauucuuucaauaacgaacugaaacggcuuugcgggcugaagguggaggucgacauggagaaaaucgcugccgaaauugcucaagccgaggaacaggccagaaagcgccaggaggaacgggagaaggaggcugcggaacaagccgagagaagccaguccagcaucgugcccgaagaggagcaggcugccaauaaaggagaagagaagaaagaugacgaaaacauuccuauggagacagaagagacccaccucgaggaaacaaccgagucucagcaaaauggcgaagaggggacguccacacccgaagacaaggagagcggacaggagggcguggauucuauggccgaagaggggaccagcgacuccaacacaggaucugaaagcaacuccgcuaccgucgaggaaccucccaccgauccgaucccugaggacgagaaaaaggaauga

SEQ ID NO: 75964 - RNA, 3636 nt, Artificial Sequence
  derived and/or modified sequence opt5 from SMC1A__Homo_sapiens__NP_001268392
augcuggaggugagcauccccaccccucacagauacguccggggcaaguccaaccucauggacgccauuucuuucguucugggggaaaagacaagcaaucuucgcgugaagacgcugagagaucucauccauggagcuccggugggcaaacccgccgcgaaccgggcuuuugucuccaugguguauucugaggaaggggccgaggaccgcaccuucgccagaguuauugugggaggcagcuccgaauacaagaucaauaacaaagucgugcagcugcacgaguauucugaggaacuugagaagcuggggauucucaucaaggcucggaauuuucugguuuuccaaggagccguggaaagcaucgcuaugaaaaacccuaaggagcgcacagcccuguuugaggaaauuuccagaagcggcgagcucgcgcaggaauacgauaaacggaagaaagagauggucaaggccgaagaggacacccaguucaauuaucaucgcaagaaaaacaucgcugccgagagaaaggaagcuaaacaggagaaggaagaggccgaucgguaccaacgccugaaagacgaaguggugagagcgcagguccagcuucagcuguuuaagcucuaucacaaugagguugagauugaaaaacugaacaaggagcuugccucuaagaauaaagaaaucgagaaggauaaaaagcggauggacaaaguggaagaugagcugaaggagaagaaaaaggaacucggcaaaaugaugcgcgagcaacagcagauugaaaaggagaucaaagagaaggacuccgaacugaaccagaagagaccccaauacauuaaagcuaaggagaauacaagccauaaaaucaagaaacuggaagccgcuaagaagucucuccagaacgcccagaaacacuacaagaaacggaagggggauauggacgagcuggaaaaagagaugcuuuccguggagaaggccagacaagaguucgaagaacgcauggaggaagagagccagucucagggacgggaucugacccucgaggaaaaucaggucaaaaaguaucacagacugaaggaggaggcuuccaaacgcgcggccacacuugcucaagaacuggaaaaguuuaaccgggaccagaaagccgaccaggauagacucgaccuggaggagcgcaagaaaguggaaaccgaggccaagaucaagcagaaacugcgggaaauugaggagaaccaaaagagaaucgaaaaacucgaggaauacauuacgaccagcaagcagucccuggaggaacagaaaaagcuggagggcgagcuuacagaagagguugaaauggcuaagcgccggaucgaugagauuaauaaagaacucaaccaggugauggagcaacugggggacgccagaaucgaucgccaggagucuagccggcagcagagaaaggcggaaaucauggaguccauuaaacggcuuuauccuggaagcgucuacggccgccugaucgaccucugccaacccacccagaagaaauaucagauugcugugacaaagguucuggggaagaauauggaugccaucauuguggacucugagaaaaccggaagagauuguauccaauacaucaaggaacagcggggcgaaccugagacguuccugccgcucgacuaucuggaggucaaacccacagaugaaaaacuuagagagcugaaaggcgccaagcucgugauugacgucauccgcuacgaaccuccccauauuaaaaaggcucugcaguacgccugcgggaacgcucuggugugugacaauguugaggaugcccggagaaucgcguuuggaggccaccagcgccauaagaccguggcccuugacgggacacucuuccaaaaauccggagucauuagcggcggggcuucugaucugaaggccaaagcuagacggugggacgagaaggccguggauaaacugaaggaaaagaaagagcgccucaccgaggaacugaaggaacagaugaaagcgaagagaaaagaggccgagcuucggcagguucagagccaagcucacggacugcagaugcgccucaaguauucccagucugaccuggaacagaccaagacaagacaccuggcccuuaaccuccaagagaaaagcaagcuggaauccgagcuggcuaauuuuggcccucggaucaacgauauuaaacgcaucauccagagcagagaacgggagaugaaggaccucaaagagaagaugaaucagguggaagaugaggucuucgaagaguucugccgcgaaauuggcgugagaaacauccgggaguuugaggaagagaaggugaaaagacaaaaugaaauugccaagaaacgccuggaguucgagaaccagaagacgcggcuugggauccagcuggacuuugagaaaaaucagcucaaggaagaucaagacaagguucauaugugggaacagaccgucaaaaaggaugagaacgaaauugagaaacugaagaaagaggaacagagacacaugaagaucaucgacgagacaauggcccagcugcaagaccuuaaaaaucagcaucucgcuaagaagucugaagugaacgauaaaaaccacgagauggaagagauucgcaagaaacugggaggcgcgaauaaggagaugacccaucugcagaaagaagugacagccaucgagaccaagcucgaacagaagcgguccgacagacacaaccugcuucaggcuuguaaaaugcaagauauuaagcugccccucagcaaagggacgauggacgauaucucucaggaggaaggauccagccagggcgaggacuccgucucugggagccaacgcauuuccucuaucuacgcccgggaggcccugaucgaaauugauuauggcgaccugugcgaggaucuuaaggacgcucaggccgaagaggagaucaaacaggaaaugaauacacuccaacagaagcugaacgagcagcagagcgugcugcaaagaauugcggcuccgaauaugaaggccauggaaaaacucgaguccguucgcgauaaguuccaggaaaccagcgacgaguuugaggccgcucggaaaagagccaagaaagcgaagcaggcuuucgaacagaucaagaaagagcgguuugaucgcuucaacgccuguuuugaaucuguggccaccaauauugacgagaucuacaaggcucuguccagaaacagcucugcccaggcuuuccuuggaccugaaaaucccgaggagccuuaucuggacggcaucaacuacaauugcgucgcccccgggaaacgguuucgccccauggauaaccucuccggaggcgaaaagacaguggcggcccuggcucugcuuuucgccauucacagcuauaaaccugcuccguuuuucguucuggacgagaucgaugccgcccucgacaauaccaacauugggaagguggcuaauuacaucaaagaacaaucuacauguaacuuccaggcgauugucaucagccugaaggaggaauuuuacacgaaggccgagucccucauuggaguguaucccgagcagggcgauugcguuaucagcaaagugcugaccuucgaccuuacaaaguacccugaugcuaaccccaauccuaacgaacaauga

SEQ ID NO: 75965 - RNA, 3486 nt, Artificial Sequence
  derived and/or modified sequence opt5 from SMC1B__Homo_sapiens__NP_001278430
auggcccaccuggagcuccugcuuguggaaaacuucaagagcuggagaggccggcaggucaucgggcccuuucgcagauuuaccugcauuaucggaccuaauggcuccgggaaaucuaacguuauggacgcucugagcuucgugaugggagagaagauugccaaucuccgggugaaaaacauccaagaacugauucauggcgcgcacaucgggaagccgaucuccucuagcgcuuccgucaaaauuaucuacguggaggaaucuggagaggagaagacauucgcccgcauuaucagaggcggcuguagcgaauuucgguucaaugauaaccuuguuucccgcagcguguauauugccgagcuggaaaagaucgggauuaucgucaaagcucagaauugccucguguuucagggaacgguugagucuaucuccgugaagaaacccaaggagagaacccaguucuuugaagagauuagcacaucuggcgaacugaucggggaguacgaagagaaaaagcggaagcugcaaaaagccgaggaagacgcucaguucaacuuuaauaagaaaaagaacauugccgcggagcgcagacaggccaaacucgaaaaggaggaagcugagcgguaucagucccugcuugaggaacugaaaaugaauaagauccaacuccagcuguuccagcuuuaccauaacgagaagaaaauucaucugcucaauaccaagcuggaacacgucaaccgcgaucugagcgugaaaagagagucucucucccaccacgaaaauaucgugaaggcccggaaaaaggagcauggaaugcugacacgccagcuucaacagaccgagaaggaacugaaaagcgucgagacacuccugaaccagaagagaccucaauauaucaaagcuaaggaaaacaccucccaccaucuuaaaaagcuggacguugccaagaaaucuauuaaggauagcgagaaacaguguuccaagcaggaggacgauaucaaagcgcucgaaacggagcuggccgaccuggaugcugccuggcggagcuuugaaaagcagauugaggaagagauccuccacaagaaaagagacauugagcuggaggcuucucaacuugaucgcuacaaggaacugaaagaacaggugcggaagaaaguggccaccaugacacagcagcucgagaagcugcaaugggaacagaaaaccgacgaggagagacuugccuucgaaaagcgccggcacggcgagguccaggggaaucugaagcagaucaaagaacaaaucgaggaucauaagaaaagaauugaaaagcucgaggaguauacaaaaaccugcauggacugucugaaggaaaagaaacagcaggaggaaacgcugguggacgagaucgagaagacaaaaucccgcaugagcgaaguuaacgaggaacucaaucugauucggucugagcuucagaacgcuggaaucgauacccacgaaggcaagagacaacagaaacgcgcggaggugcuggagcaucucaagcggcuguaccccgacagcgucuucggcagacuguuugaucuuugccacccuauucauaagaaauaccagcucgccgugacaaagguuuucgggcgcuuuaucaccgcuauuguggucgccuccgaaaaaguggccaaggacuguauccgguuccugaaagaggaaagagcugagcccgaaaccuuucuggcccucgauuaucuggacaucaagccuauuaaugagcggcuucgcgagcugaagggaugcaaaauggucaucgaugugauuaagacacaauucccgcagcucaaaaagguuauccaguuuguguguggcaacgggcuggucugcgaaacgauggaggaagcgagacacauugcucugucuggacccgagcggcagaaaaccguggcccuugacggcacacucuuccugaaaagcgggguuaucuccggaggcagcucugaucugaaauacaaggccagauguugggacgaaaaggagcucaaaaaucugcgcgaucggagaucccaaaagauccaggagcuuaaaggccugaugaagacccuccgcaaagaaacagaccugaagcagauucagacccugauccaagggacgcagacaagacuuaaguauagccagaacgagcucgaaaugauuaaaaagaaacaccugguggcuuuuuaccaggagcaaucucagcugcaguccgagcuccugaauaucgaaagccaaugcauuaugcuuuccgagggaaucaaggaacggcagcgcagaaucaaagaguuccaggaaaagauugacaaggucgaggaugacaucuuucagcauuucugcgaggaaauuggcguggagaacauccgggaauuugagaauaaacacgugaagcgccaacaggaaauugaucagaaaagacuggaguucgagaagcagaaaacccggcucaacguucaacuggaauauucucgcagccaucugaagaagaaacuuaauaagaucaacacccucaaagagacaauccagaagggguccgaagacauugaucaccugaaaaaggccgaggaaaauugucugcagaccgucaacgagcucauggcuaagcagcaacagcugaaagacaucagagugacacagaacucuagcgccgagaaggugcagacgcaaauugaagaggaacggaaaaaguuccuugcggucgaucgcgaggugggaaaacugcagaaggagguuguguccauccagaccagccucgaacaaaagagacuggagaagcacaaucugcuucuggacugcaagguccaggauauugaaaucauucuccugucuggcucccucgacgauaucaucgagguggaaauggggacagaggccgagagcacccaggcuacaauugacaucuacgaaaaagaggaagccuuugagauugauuauucuucccugaaggaagaccuuaaagcucugcagagcgaccaagagaucgaggcccaucuccggcugcugcuucagcagguugcgucucaggaagauauucugcucaagaccgccgcuccuaaccugagagcccucgagaaucugaaaacggugcgcgacaaguuccaagaaagcaccgaugcuuuugaggccucccggaaggaagccagacuuugucgccaggaguucgagcaggucaaaaagcggagauacgaccuguuuacacagugcuucgaacacgugagcaucucuaucgaucaaauuuacaaaaagcucugucgcaacaauuccgcucagguuagcuccuauaucaaagagcagacccaagaccaguuucagaugauugugaucucucugaaggaagaguucuacagccgggcggaugcccugauuggcaucuaucccgaguacgacgauugcauguuuuccagaguccuuacacuggaccucucucaguauccugauaccgaaggacaagagagcuccaagcgccauggcgaaucucgguga

SEQ ID NO: 75966 - RNA, 3594 nt, Artificial Sequence
  derived and/or modified sequence opt5 from SMC2__Homo_sapiens__XP_011516451
augcacaucaagagcauuauccuggagggcuucaaauccuacgcccagagaaccgaagugaacggguuugacccccucuucaaugcuauuacaggacugaacggcucuggaaagagcaauauccuugauuccauuugcuuucugcucgggaucucuaaccugagccaaguccgggccuccaaucuucaggaccugguuuauaaaaacggccaggcggggaucacgaaggcuucugugagcauuaccuucgauaauuccgacaaaaagcagagcccucucggauuugaggugcaugaugaaaucacagucacccgccaagugguuauuggcggcagaaacaaguaccugaucaauggggugaacgccaauaacacacggguccaggaccuguucuguucugugggacucaauguuaacaauccgcacuuucugauuaugcagggccgcaucaccaaagugcuuaacaugaagcccccugagauucuguccaugaucgaagaggccgcugggacaagaauguaugaguacaaaaagaucgccgcucagaaaaccauugaaaagaaggaggccaaacucaaggaaaucaaaacgauucuggaggaggaaaucacccccacaauucaaaaacuuaaggaggaacggagcucuuaucuggaguaccagaaggucaugcgcgaaaucgagcaucucuccagacuguauaucgcguaccaguuccugcucgccgaggauaccaaagugcggagcgcugaagaacugaaggaaaugcaggacaaggugauuaaacuucaagaggaacugucugagaacgauaagaaaaucaaggcccucaaucacgagauugaagaacuggaaaaacgcaaggacaaggagacaggaggcauccuuagaucccuggaagaugcucucgccgaggcgcagcgggucaacaccaaaagccaguccgccuuugaccugaagaaaaagaaucuggcuugcgaggaaucuaaacgcaaggagcucgaaaagaacaugguugaggauagcaaaacgcuggccgcuaaggagaaagaagugaagaaaauuacagacgggcuucaugcccugcaagaggccuccaauaaggacgcugaagcgcucgccgcugcccagcagcacuucaacgccgugagcgcuggacugucuuccaaugaggauggcgccgaagcgacccuugcuggccagaugauggccuguaagaacgacaucagcaaagcccaaacagaggcuaagcaggcccagaugaaacugaagcacgcucagcaagagcucaaaaauaagcaggccgaagucaaaaagauggauucuggguacagaaaggaccaggaggcgcuggaagccgugaaacggcugaaggagaaacucgaagcugagaugaagaaacugaacuaugaggaaaauaaggaggaaagccuucuggagaagcgcagacagcucucccgggauaucggaagacugaaagaaaccuacgaggcccugcuugcucgcuuuccuaaccuccgguucgccuauaaggaccccgagaaaaauuggaacagaaauugcguuaagggccugguggcgucucugauuagcgucaaagauaccuccgccacaacggcucucgaacugguggccggggagcgccuuuacaacguuguggucgacaccgaagugacaggaaagaagcugcucgagcggggcgagcugaaaagacgcuauaccaucauuccucugaacaagaucagcgcucgguguauugccccggaaacacuuagagucgcccaaaaucucguggggcccgauaacguucauguggcucugucucuggucgaguacaaaccugaacuccagaaggcgauggaguuuguguucggaaccacguucguuugcgacaauauggauaacgccaaaaagguggcuuuugacaagcgcaucaugacacggaccgucacccugggcggcgacguguucgauccccacgggacacuuuccggaggcgccagaagccaggccgcuucuauucugaccaaauuucaggaacucaaggacgugcaagaugagcugcgcaucaaagagaaugaacugcgggcccuugaggaggagcucgcggggcugaagaacacagcugaaaaauauagacagcugaagcagcaaugggagaugaaaacggaggaagccgaccuccugcagaccaaacuucagcaguccagcuaccauaagcaacaggaggaacuggaugcccucaagaagacaaucgaggaauccgaggagacccugaaaaauacaaaggaaauucagcggaaagcugaggaaaaguacgagguucuggagaacaagaugaaaaaugccgaagcggagcgcgaaagagagcuuaaggacgcucagaaaaagcucgauugugccaaaaccaaggccgacgcuucuagcaagaaaaugaaggaaaaacaacaggaggucgaggccaucacgcuggaacuggaggaacucaagcgggagcacaccuccuauaaacagcagcuggaagcugugaacgaggccauuaagucuuacgagagccaaaucgaagugauggcggccgaggucgcuaagaauaaagaauccgugaacaaggcccaggaggaaguuacaaaacagaaggaggugauuaccgcucaagauacagucaucaaagccaaguaugccgagguggcuaagcacaaagaacagaauaacgacagccagcuuaagaucaaagagcuggaucauaauauuucuaagcacaaaagagaagcggaggacggagccgcuaagguuuccaaaaugcucaaggauuacgacuggaucaacgccgagcgccaucuguucggccagccuaacagcgccuaugacuuuaagaccaauaaccccaaagaagcugggcaacggcugcagaaacuucaggagaugaaggaaaagcugggcagaaaugugaacaugcgcgccaugaauguccucacggaggcggaagagagauacaacgaucugaugaaaaagaagcggauuguggagaaugacaaaucuaagauccucacaaccauugaagaucuggaccagaaaaagaaccaagcucuuaauaucgccuggcagaaaguuaacaaggauuucggauccaucuuuagcacacugcucccgggcgccaaugcuaugcuggccccucccgaggggcagaccgugcuggacggacuugaguucaaggucgcgcugggcaacaccuggaaagagaaucucacagaacugucugggggacagcgcagccucguggcucugucccuuauucugagcaugcuccuguuuaagccugcccccaucuauauucuggaugagguggacgccgcucuugaucugucucacacgcaaaacaucggccagaugcucagaacccauuucacacacucccaguuuauugucguuagccugaaagaggggauguucaauaacgccaacgugcucuuuaagaccaaauucguggacggcgucuccacaguggcucgguucacccagugccaaaauggaaagaucucuaaggaagccaaaagcaaggcgaaacccccuaagggcgcccacguugagguguga

SEQ ID NO: 75967 - RNA, 3654 nt, Artificial Sequence
  derived and/or modified sequence opt5 from SMC3__Homo_sapiens__NP_005436
auguacaucaaacaggugauuauccaaggcuucagaagcuaucgggaccagaccauugucgaucccuuuuccucuaaacacaacguuaucguggggcgcaauggaagcggcaaguccaacuucuuuuacgccauucaguucgugcugucugacgaguuuagccaucucagaccugaacagcggcuggcucugcugcacgaggggacaggaccgcgcgucaucuccgccuucguggaaaucauuuuugauaauucugacaacagacuccccaucgauaaagaggaaguuagccugcggcgcgugauuggcgcgaagaaagaccaauauuuccuugauaagaagauggucacgaaaaaugacgugaugaaccugcucgaguccgcuggguuuagcagaucuaauccuuacuauaucguuaagcagggaaaaauuaaccagauggccaccgcccccgauucccagcggcugaagcugcuccgcgagguggcuggcacaagagucuacgacgaacggaaagaggaaagcaucucucugaugaaggagaccgagggcaagcgcgaaaagauuaaugagcuucugaaguauaucgaagagagacuccauacacuggaagaggagaaagaggaacuugcccaauaccagaagugggauaaaaugcggcgcgcucuggaauacaccaucuauaaccaggagcucaaugaaacaagagccaagcuggacgagcuguccgcgaaacgggagaccagcggggaaaagucuagacagcuccgcgaugcccaacaggacgcucgggacaagauggaggauauugaaagacaggugcgcgagcugaaaacgaagaucuccgccaugaaagaagagaaggagcaacuuagcgcugaacggcaggagcagauuaaacagagaaccaagcuggaacucaaggccaaagaccugcaagaugagcuugcgggaaacuccgagcagcgcaagcggcugcucaaagaaagacagaagcugcuggagaaaaucgaagagaagcagaaggaacucgccgagacagagccuaaauucaauucugugaaggaaaaagaggaacgcggcauugcucggcuggcccaagcuacccaggagagaacagaccuuuacgccaagcaggggcgcggaagccaguuuaccuccaaagaggaacgggauaaguggaucaagaaagagcuuaagagccucgaccaagccaucaacgauaaaaagagacagauugcugcgauccacaaagaccuggaagauacggaggccaauaaggaaaagaaccuugagcaguauaacaagcuggaccaggaucucaaugaagucaaggcucggguugaggagcuggaccgcaaauacuaugaagugaagaacaaaaaggacgagcugcaaucugaaagaaauuaccucuggcgggaggagaacgccgaacagcaggcccuggcugccaaaagagaggaucuugaaaagaagcaacagcugcuccgcgcggcuacaggcaaagccauucugaaugggaucgacuccauuaacaaggugcuggaucauuuccggagaaaaggaaucaaucagcacguccagaacggcuaucacggcaucgugaugaauaacuuugagugcgaacccgccuucuacaccuguguugaggugacagcugggaaucgccuuuucuaccauauugucgacagcgaugaggugucuaccaagauccucauggaauuuaacaaaaugaaucugccuggagagguuaccuuccugccgcucaacaagcuggacgugagagauacagccuaucccgaaacgaaugacgcuauuccuaugaucagcaaacuucgguacaacccccgcuuugauaaagccuucaagcacgucuuuggcaaaacccugauuugcagauccauggaggugucuacacaacucgcgcgggccuucaccauggacuguaucacacuggaaggggaucaggucagccaucgcggagcucugaccggcggguauuacgacacgagaaagucccggcuugagcuccagaaagaugugcgcaaggccgaggaggaacugggagaacuggaggcuaagcucaacgaaaaucugagacggaacauugagcgcaucaauaacgagaucgaccagcuuaugaaucaaaugcagcagauugaaacacagcaaagaaaauuuaaggccagccgggacucuauccuguccgagaugaaaaugcucaaggagaaaagacagcagagcgaaaagaccuucaugccuaaacaacgcucucugcagucccuggaggcgagccuucacgccauggaauccacccgggagucucucaaggcugaacugggcacagaucugcucagccagcugucccuugaggaccagaagagaguugaugcccugaacgacgaaauucgccaacuccagcaggagaaucggcagcugcugaacgagagaaucaaacuugaaggcauuaucacccgcguggagacauaucucaaugaaaaccugcggaagagacuggaucaagucgagcaggaacucaaugagcugcgcgagacggaagggggaaccgugcuuacagcuaccacaucugagcuggaagccaucaacaaacggguuaaggacaccauggccagaagcgaggaucucgacaauuccauugauaaaacggaagcuggcaucaaggagcugcaaaagagcauggagcgguggaaaaacauggaaaaggagcacauggacgcgauuaaucaugauaccaaagaacuggagaagaugacaaaccgccaggggaugcuucugaaaaagaaggaggaaugcaugaaaaagaucagagagcucggaucucugccccaggaagccuuugagaaauaccagacccucucccugaagcagcuuuuccggaaacuggaacaguguaacacagagcucaagaaguauagccacgugaauaaaaaggcucuggaccaauuugucaacuucucugagcagaaagaaaagcugauuaaacgccaggaggaacuugauagaggcuacaaguccaucauggagcugaugaaugugcucgaacugcggaaguacgaggccauccaacucaccuuuaaacaggugagcaagaacuucucugagguuuuccagaaacuggucccugggggcaaggccacgcuugugaugaaaaagggagacguggaaggcagccagucccaagacgagggggaaggaagcggcgagucugaaagaggguccggaagccaguccucugucccgagcguggaucaguuuacaggcguugggauucgcguguccuucaccggcaaacagggagagaugcgggagaugcaacagcugucuggcgggcaaaagagccucgucgcucuggcccugaucuuugcgauucagaagugcgaccccgcuccuuucuaucuuuuugaugaaaucgaccaggcccuggaugcccagcauagaaaagcuguguccgacaugauuauggagcucgccguucacgcgcaguucaucacaaccaccuuucgccccgaacugcucgagucugcugauaaguucuacggagugaaauuucggaauaaggucagccauaucgacgugauuacagccgagauggccaaagauuucguugaagacgauacgacccacggcuga

SEQ ID NO: 75968 - RNA, 3867 nt, Artificial Sequence
  derived and/or modified sequence opt5 from SMC4__Homo_sapiens__NP_005487
augcccagaaagggcacccagccuagcacagcccggcgcagagaggaagggccgcccccucccuccccugacggagcuucuagcgaugccgagcccgaaccuccguccggccggacggagucucccgcgaccgcugccgaaacagccagcgaggagcuggacaaccgcucccucgaagagauccuuaauucuauuccucccccucccccgccugcuaugaccaacgaagccggggcucccagacuuaugaucacacacauugugaaucaaaacuucaaaagcuacgccggagagaagauccugggcccuuuucauaaacgguucuccugcauuaucgggcccaauggaagcggcaagucuaacgucaucgauuccaugcucuuuguuuucggcuaucgcgcgcagaaaauuagaagcaagaagcugucugugcuuauccacaauuccgacgagcauaaagauauucagagcuguaccguggaaguccacuuucagaagaucauugacaaagagggggaugacuacgaagugauccccaacucuaauuucuauguuucccggacagccugccgcgauaacaccagcguguaccauauuuccggaaagaaaaagacguuuaaggacgucggcaaucugcucagaucucacgggaucgaucuggaccacaaccgguuccugauccuccaaggagagguggaacagauugcuaugaugaaaccuaagggccagaccgagcaugaugaggggaugcuggaauaucuugaggacaucauuggauguggccgccugaaugaaccgaucaaaguucucugcagacggguggagauucugaacgaacaccgcggcgagaagcugaauagagucaaaaugguggagaaggaaaaagacgcccuggagggggaaaagaacaucgcuaucgaguuucucacacuggaaaacgagauuuuccggaagaaaaaucaugugugucaguacuauaucuacgagcugcaaaagagaauugccgaaauggagacccagaaagaaaagauccacgaggauacaaaagagauuaacgaaaagagcaauauccucuccaacgagaugaaggcgaaaaauaaggacgucaaagauaccgaaaagaaacugaacaagaucacgaaguuuauugaggaaaauaaagagaaguucacacagcuugaccuggaggauguucaggugcgcgaaaaacucaagcacgccaccagcaaagcuaagaagcuggagaaacaacuucagaaggacaaagaaaagguggaggaauuuaaaucuauccccgccaaguccaacaauauuaucaacgagacaaccacccggaauaacgcucuggagaaagaaaaggagaaggaagagaaaaagcucaaagaagucauggauagccugaagcaggagacacaaggacugcagaaagagaaggaaucuagagagaaggaacucaugggcuucagcaaauccgugaaugaggcccgcucuaagauggacguugcccagagcgagcuggauauuuaccuuucccggcauaacacggcugugagccagcugaccaaagcgaaggaagcccucaucgcugccucugagacacugaaagaaagaaaggccgcuauucgcgacaucgaggggaagcugccucaaaccgaacaggagcugaaagagaaggaaaaagagcuccagaagcugacacaggaagagaccaauuucaaaucccugguccacgaucucuuucaaaagguggaagaggccaagagcucucuggcgaugaaccgguccagaggaaaaguucuugacgcuaucauucaggagaagaaaagcggccgcauccccgggauuuauggacggcugggcgaccucggcgccaucgaugaaaaguacgacguggccauuuccucuugcugucaugcucuggauuauaucgucguggacagcaucgauauugcccaggagugcgucaacuuccugaaaagacagaauaucgggguggcuacguuuauuggacuugacaagauggccguuugggcgaaaaagaugacagaaauccaaaccccugagaacacaccccgccucuucgaucuggugaaggucaaagacgaaaagauucggcaggccuuuuacuucgcucugagagauacccucguggccgacaaucuggaucaggcuacccggguugccuaucagaaagaccgcagauggcggguggucacacuucaaggccagaucaucgagcaguccgggacgaugaccggaggcgggucuaaggugaugaaaggcagaaugggaagcucccuggugauugagaucagcgaagaggaaguuaacaagauggagucucaacuccagaaugauuccaagaaagcgaugcagauucaggagcaaaagguccagcuggaggaacgcguggugaaacugcggcacagcgaaagagagaugcgcaacacacuugaaaaguuuaccgccucuauccagagacucauugagcaggaggaauaccugaauguccaagugaaagagcuggaagcuaacguucucgccacagcuccggacaagaagaaacagaagcugcuugaggaaaauguguccgccuucaaaaccgaguaugacgccgucgcugagaaggcgggcaaaguggaagccgagguuaagcggcugcauaacacgaucguggaaaucaauaaccacaagcucaaagcucagcaggauaagcuggacaaaauuaauaagcaacuggaugagugugccagcgccaucaccaaagcucaggucgccauuaagacagcggaccgcaaccuucagaaggcucaagauucugugcucagaaccgaaaaagagaucaaggacacagagaaagaaguugaugaccugaccgccgagcuuaagagccucgaagauaaagccgcugagguggucaagaauacgaacgccgcggaggaaucccugccugagauucagaaagaacaccggaaccuucugcaggagcucaaggugauccaggaaaaugagcaugcucugcaaaaggacgcccugagcauuaaacuuaagcucgagcagaucgaugggcacaucgccgaacauaacucuaaaauuaaguacuggcacaaagagaucuccaagauuagccugcaccccaucgaagacaauccuauugaggaaaucuccgugcugucucccgaggaucucgaggcuaucaagaacccugacagcauuacaaaucagaucgcccugcuugaagcucgcugccaugagaugaaacccaaccugggagccauugcggaauacaagaaaaaggaggaacucuaucugcagagagucgccgagcuggacaaaaucaccuacgagcgggauuccuuucgccaggcuuaugaagaccuuagaaagcaacggcugaaugaguucauggccggcuuuuacauuaucacaaacaagcucaaagaaaauuaucagaugcugacccucgggggagaugcugagcuggagcuuguugacucucuggauccguucagcgaaggcaucauguuuuccgugcgcccucccaagaaaucuuggaagaaaauuuucaaccucagcgggggcgagaagacccuguccagccuggcccuuguguucgcccugcaccauuacaagcccacaccucucuauuuuauggacgaaaucgaugcugcgcuggacuucaaaaaugucucuauuguggccuuuuacaucuacgagcagacgaagaacgcucaauucauuaucauuucccucagaaauaacauguuugaaaucagcgaucggcugaucggaauuuauaaaaccuacaauaucacaaagucuguugccgugaacccgaaagagauugccuccaagggccuuuguuga

SEQ ID NO: 75969 - RNA, 3306 nt, Artificial Sequence
  derived and/or modified sequence opt5 from SMC5__Homo_sapiens__NP_055925
auggccacccccagcaagaaaacauccacgccuucuccgcagcccagcaagagagcucugccucgggaccccuccucugaggugccuagcaaacgcaagaacuccgcuccccaacucccucugcuucagucuagcggcccguucgucgaaggguccaucguuagaauuagcauggagaauuuucugaccuacgauaucugcgaagugucucccggaccucaccucaacaugauugugggcgcgaaugggacaggaaaauccagcaucgucugugcuauuugccugggccuugccgggaagcccgccuucaugggacgggcugacaaggugggcuuuuucguuaaacgcggcuguucuagagggaugguggagaucgaacuguuucgggccuccggaaaccucgucaucacccgcgagauugauguggcuaagaaucagagcuucugguuuaucaacaaaaagucuacaacccagaaaauuguugaggaaaagguggccgcgcugaauauccaagucggcaaccugugccaguuccucccucaggacaaggugggggaguuugccaaacuguccaagauugaacuucuggaggcuacagagaaaagcaucggacccccggaaaugcauaaguaucacugugagcucaaaaaucugagagaaaaggagaaacagcuugaaaccuccugcaaggagaagacggaguaccugcagaaaauggugcaacggaacgaacgcuauaagcaggaugucgagagauucuacgaacggaaacgccaucucgaccugauugagaugcuggaagccaagagaccuuggguugaguaugagaaugugcggcaggaauacgaggaagugaaacucguccgcgauagagugaaggaggaaguucggaagcugaaagagggccaaauccccgugaccuguagaaucgaggaaauggagaacgaacgccacaaucuugaggcucggauuaaggagaaagccacagacaucaaggaagcgucucagaaaugcaagcagaagcaagaugucauugagagaaaagacaagcauaucgaagaacugcagcaggcccucauugugaaacagaacgaggagcuggaucgccaacggagaaucgggaauacccgcaagaugaucgaggaccuucagaacgaacugaaaacaaccgagaacugugaaaaucuccagccucagauugaugcuaucacgaacgaccugcggcggauucaagacgagaaggcccugugcgaaggagagaucauugauaagcgccgggagagagaaacacucgagaaagaaaagaaaagcguugacgaucacaucgugcgcuuugacaaucugaugaaccagaaggaggauaaacuucggcagagauuccgggacaccuaugaugcuguccuguggcuccgcaauaacagagacaaguuuaaacagcgggugugugaacccaucaugcugacaauuaauaugaaggauaacaagaaugccaaauacaucgagaaccacauucccuccaaugaccuuagagccuucgucuucgagagccaagaagauauggagguguuucugaaggaaguucgcgacaacaaaaagcuccgggugaaugcugucaucgcgccuaaaucuuccuacgccgacaaggcuccgagcagaucucugaacgagcugaagcaguauggcuucuuuagcuaccuccgcgagcuguucgaugcccccgacccugugauguccuaucuuugcugccaguaccauauucacgaaguucccgugggcaccgagaaaaccagagaacggaucgagcgcgucauucaggaaacaagacugaagcaaaucuauacggccgaggagaaauacguggugaagaccucuuuuuauagcaauaaaguuaucuccagcaacacaucucucaaggucgcucaguuccugaccgugacaguggaucuggaacagcggcgccaucuugaggaacaacucaaggagauucacagaaaacugcaggccgucgacuccgggcugaucgcgcuccgggaaaccagcaagcaccuggagcauaaagauaacgagcuucgccagaagaaaaaggaacugcucgagagaaagacgaaaaagcggcagcuggaacagaaaauuucuuccaagcugggaagccuuaaacucauggagcaagacacauguaaucuggaagaggaggaacgcaaggcuuccaccaaaaucaaggagauuaacgugcagaaggccaaacugguuaccgaacucacaaaucugaucaagaucugcaccucucuucacauucagaaaguggaucugauccuccaaaacacaacggucauuagcgagaagaauaaacuggaguccgacuacauggccgcuucuagccagcugagacuuaccgaacagcauuuuaucgagcucgaugaaaaccggcagagacugcugcaaaaguguaaggagcucaugaaacgcgccagacaggugugcaaucugggcgcugaacagacacuuccucaagaguaccagacccagguucccacaauuccgaacgggcacaauuccagccugccuaugguguuccaggaccuccccaacacccuggaugagaucgacgcccugcuuacggaagagagaucucgcgcguccuguuuuaccggacucaauccuacaaucguccaagaauauaccaagcgggaggaagagauugagcagcugacagaggaacugaaaggcaagaaaguggaacucgaucaguacagagagaacaucagccagguuaaggaacgcuggcugaauccccuuaaggagcugguggagaaaauuaacgaaaaguucucuaacuuuuucuccagcaugcaaugcgccggggaggucgaccuccauaccgaaaaugaggaggacuaugauaaauacggaauccggauuagagugaaguuucgcucuagcacgcagcugcacgaacugacaccucaccaucaguccggcggcgagcggagcgugucuaccaugcuuuaucugauggcucuccaggaacugaacagaugucccuuccgggucguugacgagaucaaucaagggauggauccgaucaacgaacgcagaguguucgagaugguggucaauacagccugcaaagagaacaccucccaguacuuuuucauuaccccuaagcuccugcagaaucuucccuauagcgaaaagaugacagugcuguuuguuuacaacggaccccacaugcucgagccuaauacguggaaccugaaagccuuccagcggcgcagacggagaaucaccuuuacacaaccguccuga

SEQ ID NO: 75970 - RNA, 3276 nt, Artificial Sequence
  derived and/or modified sequence opt5 from SMC6__Homo_sapiens__NP_001135758
auggccaagagaaaagaggaaaacuucagcucccccaagaaugcuaaacggccucgccaggaggaacuggaggacuuugauaaggacggcgaugaagacgagugcaaagggaccacacucacggccgcggaggugggaaucauugaaucuauccaccugaagaacuucaugugucauagcaugcuuggcccguuuaaguucggguccaaugucaacuuuguugugggaaauaacggcucugggaaaagcgcugugcugaccgcccucauugucggacugggcggcagagccguggcuacaaaucggggguccucucuuaagggauucguuaaagauggccaaaacagcgccgacaucuccauuacccugcgcaauagaggggaugacgcuuuuaaggccagcguguacggaaacucuauccucauccagcagcacauuuccaucgauggcagccggucuuauaaacugaaguccgcgacagggagcgucgugucuacccgcaaggaggaacugauugccauccucgaccauuucaauauucagguugauaaccccguguccguccugacacaagagaugagcaaacaguuucuucaguccaagaaugagggagacaaauacaaguucuuuaugaaagcuacccagcuggaacaaaugaaggaggauuauucuuacaucauggaaacgaaagagagaaccaaggaacagauucaccagggcgaggagcggcucacagaacugaagcgccagugcguggagaaagaagagagauuccaaagcaucgccggccuuuccaccaugaagacaaaccuggaaagccucaaacaugagauggcuugggccguggucaaugagaucgaaaagcagcugaacgcgauucgggacaacaucaaaauuggggaggaccgcgccgcuagacuggaucggaagauggaagaacagcaaguucgccucaaugaagccgagcagaaguauaaagacauccaggauaagcuggagaaaauuucugaagagaccaacgcuagagccccugaauguauggcccuuaaggcugacgugguggcgaaaaagcgggccuacaaugaggcugagguccuguauaacagaucccucaaugaauacaaggcccugaaaaaggaugacgagcagcuuugcaaacgcaucgaggagcugaagaaaagcacggaucaaucucucgaacccgagcggcuggagagacagaagaagaucagcuggcugaaagaacgcgugaaggccuuucagaaccaggaaaauuccguuaaccaagaaauugagcaguuccagcaggcuaucgaaaaagacaaggaggagcacggaaaaauuaagcgggaggagcucgaugugaaacacgcccugucuuacaaucaaagacagcuuaaggaacugaaggacagcaaaacagaucgccucaagcgguucggcccuaacguccccgcgcugcuugaggcuaucgacgacgccuauagacaggggcauuuuaccuacaaaccugugggaccgcugggcgccuguauucaccuccgcgaucccgaacuggcucuggccaucgaguccugccucaaggggcugcuucaggcuuauuguugccauaaucacgccgacgagcggguucugcaagcgcucaugaaaagauucuaccugccuggaacaagccggcccccuaucauugugucugaauuucgcaacgagaucuaugaugucagacaccgggccgcuuaccaucccgacuucccgaccgugcugaccgcccuugaaauugauaaugcugucguggccaacucccucaucgacaugcgcggcauugagacaguucugcugaucaagaauaacagcguggcgagagccgucaugcagucucagaagccucccaaaaacugucgggaggcuuuuacggccgauggcgaccaaguguucgcugggagauauuacuccagcgaaaauacccgcccuaaguuucucucccgggauguugacucugagauuagcgaucuggaaaacgagguggaaaauaaaacagcccagauccuuaaccugcagcagcaccucuccgcccuggagaaggacaucaaacauaaugaggaacugcuuaagagaugccaacuccacuacaaggagcugaaaaugaagauucgcaaaaacaucucugaaauuagagagcuggaaaauaucgaggagcaucagagcgucgauauugcuacccucgaagacgaggcgcaggaaaacaaguccaaaaugaagaugguggaggaacacauggagcagcaaaaggagaauauggaacaccugaaaagccuuaagaucgaggccgaaaacaaauaugacgcuaucaaguucaaaauuaaucagcugucugagcucgccgauccccugaaggacgagcugaaccuugccgauuccgaaguggacaaucagaaacggggaaagcgccauuacgaggaaaagcagaaagagcaccucgauacacugaacaagaaaaagagagaacuggacaugaaagagaaggagcucgaagagaagaugagccaagcucggcagaucugucccgaacgcauugagguugaaaaaucugccuccauccuggauaaggagauuaauagacuucggcagaaaauccaagcggagcaugcuagccacggcgaccgcgaagagaucaugagacaguaucaggaagcccgggagaccuaccuggaucucgacucuaagguccgcacgcugaaaaaguuuauuaagcugcuuggggaaaucauggagcacagauucaaaacauaucagcaauuucggagaugccucacccugcgcugcaagcuguacuucgauaaccuccugagccagcgggccuauuguggaaaaaugaacuuugaccauaagaaugagacccuuuccauuagcgugcagccuggcgaagggaacaaagcugccuucaaugauaugagagcgcugucuggcggagagcgcuccuucagcacagugugcuuuauccucucccuguggucuauugcugaaagcccguuccggugucuggacgaguuugacgucuacauggauauggugaacagacgcaucgccauggaccuuauccugaagauggccgauucccagcgguucagacaauuuauucuccugacaccccagucuaugagcucccucccuucuagcaagcugauccgcauucuucggauguccgaccccgagagaggccagaccacgcugccuuuccggcccguuacccaggaagaggaugacgaucaacgcuga

SEQ ID NO: 75971 - RNA, 6018 nt, Artificial Sequence
  derived and/or modified sequence opt5 from SMCHD1__Homo_sapiens__NP_056110
auggccgcugccgacggcgggggacccggcggggcgagcgugggaaccgaggaagauggcgggggagucggccacagaacaguuuaccuguucgaccggcgcgagaaggaauccgagcucggcgauagaccucugcaggugggggaacggucugacuaugcuggauuucgcgccugcgugugucaaacgcuuggcaucagcccggaggagaaauucgucauuaccacaaccuccagaaaggaaaucacaugcgauaacuuugacgagaccgugaaagaugggguuacacuguaccuccugcagucugugaaucagcuucugcucaccgccacgaaggaacggauugacuuccugccccauuaugauacccuggucaaaagcggaauguacgaguauuacgcuuccgagggccagaacccucuccccuuugcccuggcugaacuuaucgacaauucucugagcgccacaucccgcaacauuggggugagacggauccaaaucaagcuccuguucgaugagacccagggaaagccugcgguugccgugauugacaauggccgcggcaugacaagcaaacagcuuaacaauugggcugucuauagacugucuaaguuuacccggcagggggauuucgaauccgaccacagcggauacgugcgccccgugccugucccgagaucucucaacuccgacaucagcuacuuuggcguugggggaaaacaagccguguucuuugugggccagucugcucggaugauuuccaagcccgccgauagccaggacguccaugagcuggugcuguccaaagaagauuucgagaagaaggagaaaaauaaggaagcgaucuauucuggguacauucgcaacagaaaaccuagcgacuccguucacaucacgaaugaugacgagcgguuucuccaucaccugauuaucgaagagaaggaaaaagauagcuucacagccguggucaucaccggagugcagcccgagcacauucaauaucuuaagaacuacuuccaucuguggacaagacagcucgcucacaucuaucauuacuauauucacggcccuaaaggcaaugagauccgcaccucuaaggaaguugagcccuuuaacaauauugacaucgaaaucuccauguucgagaaggggaaagugccgaagauugucaaccugcgggaaauccaggaugacaugcaaacccuuuacgugaacacagccgcugauagcuuugaguucaaagcccacgucgagggagacggcgugguugaagggauuaucagauaccauccuuuucuguaugaccgcgagacguaccccgaugacccuuguuuccccucuaagcucaaagaugaagacgaugaggacgauugcuuuauucuggagaaggccgcucggggaaagagacccaucuucgaauguuuuuggaauggccgccugaucccuuauaccagcguggaggacuucgauuggugcacaccgcccaaaaagcgggggcucgcgccuauugaauguuacaacagaaucuccggcgcccuguuuaccaaugacaaauuccaggucucuacaaacaagcuuaccuuuauggaucuggagcucaaacugaaggacaagaauacgcuuuucacacgcauucugaacggacaggaacagcggaugaaaaucgauagagaguucgcucucuggcugaaggacugccacgagaaauaugacaagcaaauuaaauuuacccuguucaagggcgugaucacccgccccgaucucccuagcaagaaacaggggcccugggccacauacgccgcuauugaaugggacggaaagaucuauaaagccggccagcugguuaagaccaucaaaacacuuccgcuguuuuacggguccauugugcgguucuuucucuacggagaucaugacggcgaggucuaugcgacggggggcgaagugcagaucgcuauggagccucaagcccuguacgaugaagugagaaccguucccauugccaagcuggaccggacagucgcugagaaagccgugaagaaguauguggaggaugaaauggcucgccuuccugacagacucagcgucaccuggcccgagggagaugaacugcugccuaaugaggugcggcccgccggcacaccgaucggggcgcucagaauugaaauccugaacaaaaagggagaggccaugcagaaacuuccuggcaccucucacgggggauccaagaaacugcucguugagcugaaggugauccugcauagcucuuccggcaauaaggaaauuaucagccacauuucccagcacgggggcaaauggcccuacugguucaagaaaauggagaacauccagaagcuuggaaauuauacgcucaaacugcaagucgugcugaacgaaucuaaugcugacaccuacgccggccgcccccucccuagcaaggcuauuaaguuuuccguuaaagaggggaagccggagaaauucucuuuuggacugcuugaucugcccuuccgggugggcgucccuuuuaacaucccccucgaauuccaggacgaguuugggcauacaagccagcuggugaccgauauccagccuguucuggaagccuccggacuuagccuccacuaugaggaaauuacaaagggccccaauugugugaucagaggggucaccgcgaaaggcccugugaacucuugccaaggaaagaacuacaaucugaaggugacgcugcccggccucaaagaggacucccagauucugaagauccgccuucugccggggcauccuagacggcucaaagucaagcccgacagcgagauucugguuaucgaaaacggaacagccuucccuuuccagguggaggugcuggaugaaucugacaauaucaccgcucaacccaaacuuauuguccacuguaaguuuuccggcgccccgaaccucccuguguacguuguggauugcagcucuagcgggacauccauccugaccggaagcgcuauucagguccagaauaucaaaaaggaccagacccugaaggcccgcauugagauccccucuugcaaagauguggccccuguugaaaagacaauuaaacuccugcccuccagccacguggcuagacuucaaaucuucuccgucgagggccagaaggcgauccagauuaaacaucaggacgaggugaacuggaucgccggcgauauuaugcacaaucugaucuuucaaauguaugacgaaggggagcgggaaauuaacaucacgucugcucucgccgagaagaucaagguuaauuggacccccgaaauuaacaaagagcaucugcugcagggacuucugccugaugugcaggucccgacaagcgugaaggacaugcgcuacugucagguguccuuccaagaugaccacgucucucucgagagcgccuuuaccguuagaccccugccugacgaacccaaacaucucaagugcgagaugaaaggcgggaagacagugcagaugggacaggaacugcaaggcgagguggucaucauuaucaccgaucaguaugggaaucagauucaggcuuucuccccuucuagccuuuccagccugucuaucgccggagugggccucgacuccagcaaccugaagacgacauuucaagagaauacccagucuaucuccguucggggcauuaaauucauccccgggccuccgggaaacaaggaucuguguuuuaccuggcgcgaauucagcgacuuuauuagagugcagcuuaucucuggccccccugcgaaacugcuccugauugauuggcccgagcucaaggaauccaucccugucauuaaugggcgggaccugcagaaccccaucaucgugcaacuuugcgaucagugggacaacccggcuccuguucagcacgugaaaauuagccugacaaaggccuccaaucucaagcugaugcccagcaaccagcaacacaaaaccgaugagaagggacgcgccaaucugggcgucuucucuguguucgcucccagaggggaacauacacuucaggucaaagccaucuacaacaagagcauuaucgagggaccuauuaucaaacugaugauccuccccgacccugagaagccggugcggcugaauguuaaguaugauaaagacgcguccuuucucgcuggcggccuguucacggauuuuaugauuucugugaucagcgaagacgacuccauuaucaagaacauuaaucccgccagaaucucuaugaaaauguggaagcuuagcaccuccgggaaccgcccucccgccaaugcugagacauucucuuguaacaaaaucaaggauaaugacaaagaagauggaugcuuuuacuuccgggacaaggucauuccuaacaaggugggcaccuauuguauccaguuuggguucaugauggauaaaacaaauauucugaacagcgagcagguuaucguggaaguccugcccaaucaaccggugaagcucgugccuaaaauuaagcccccuacccccgccguuuccaacgucagaagcguggcuucucgcacgcuggugcgggaccuucaccuguccaucaccgaugacuacgauaaccauacaggaauugaccucgucggcaccaucaucgccacaauuaaagggagcaaugaggaggauaccgacacaccucuguuuaucggaaaggugagaacccucgaauuccccuuuguuaacggcucugcggagauuaugucccuggugcuugccgaaagcuccccgggccgcgauucuacggaguacuucaucgucuuugaaccucggcugccccugcucagcagaacacuggagcccuauauucuuccuuucauguucuacaaugacgugaagaaacagcagcaaauggcugcccugaccaaggagaaagaccagcucucccagagcaucguuauguauaagucucuguuugaagcuucccagcaacuccugaacgagaugaaaugccagguggaagaggcccgccuuaaggaggcccagcugcggaaugaacugaagauccacaacauugauaucccgaccacacagcaagucccccauauugaggcucuccugaaaagaaagcuuagcgaacaggaggaacugaaaaagaaaccucggcgcucuuguacccuccccaauuacacgaaggggagcggagacgugcugggcaagaucgcgcaccucgcccagauugaggaugacagagcugccaugguuaucuccuggcaccuggccucugauauggacugcguggucacacuuaccacagaugcugcccggcgcaucuaugacgagacccaggggagacaacaggugcugccucuggauagcauuuacaaaaagacacuccccgacuggaaacggucccugccucauuucagaaacggaaagcuuuauuuuaaaccgaucggcgaucccguguucgcgcgcgaccugcucaccuuuccugacaaugucgaacacugugagacgguuuucgggaugcugcugggagauaccauuauccucgacaaccuugaugcugccaaucauuaccggaaggaaguggugaaaauuacacacugccccacccugcugacaagagacggcgaucgcauccggucuaacggcaaguuugggggacuccagaauaaggccccucccauggacaaacugagaggcauggucuucggggcuccggugccuaagcaaugccuuauucugggagagcagaucgaucuccugcagcaguaccgcagcgccguuuguaaacuggacuccgugaacaaggaucucaauagccaacuugaauaucugcggacccccgacaugagaaaaaagaagcaggagcuggaugagcacgaaaaaaaccucaagcugaucgaggaaaaacuuggcaugacgcccauucgcaagugcaaugacucucugagacauuccccuaaagucgagacaaccgauugucccgugccuccgaagcggaugcgcagagaagcgacacggcagaaccgcaucauuaccaagaccgacguuuga

SEQ ID NO: 75972 - RNA, 180 nt, Artificial Sequence
  derived and/or modified sequence opt5 from SMCO4__Homo_sapiens__NP_064564
augagacagcugaagggcaaacccaagaaagagaccagcaaggacaaaaaggaacggaagcaagccaugcaggaggcucgccagcagaucacaacggugguccucccuacccuggccguuguggugcuucugauugucguguucguuuacguggcgacaagaccgaccaucacagaauga

SEQ ID NO: 75973 - RNA, 351 nt, Artificial Sequence
  derived and/or modified sequence opt5 from SMCP__Homo_sapiens__NP_109588
augugcgaccagaccaagcacagcaaauguugccccgccaagggcaaccaauguugcccuccgcagcagaaucaguguugccaauccaaagggaaccaguguugucccccuaagcagaaucagugcugccaacccaaaggaucucaguguugcccucccaagcauaaccacugcugucagccuaagccgcccugcuguauccaggcuagaugcuguggccuggagacaaaaccugaagugagcccccucaauauggaguccgaaccuaacucuccccaaacgcaggauaaggggugccagacccaacagcagccgcauagcccucagaaugagucccggcccucuaaauga

SEQ ID NO: 75974 - RNA, 2463 nt, Artificial Sequence
  derived and/or modified sequence opt5 from SMEK1__Homo_sapiens__NP_001271209
augaccgacacaagacggcgcgugaaggucuacacgcugaacgaggauagacagugggacgaucggggcaccgggcacguuagcuccggauauguggaacgccucaaaggcaugucucugcuugugagagccgagagcgacgggucccugcuccuggaaucuaagaucaaucccaacacagcuuaccaaaaacagcaggauacccuuauugucuggagcgaggccgaaaauuaugaccuggcgcucuccuuccaggagaaggcuggaugcgaugagaucugggaaaagauuugucaagugcagggcaaggacccuucuguugauaucacacaggaccugguggaugagagcgaagaggagcgguuugacgauauguccagcccggggcuggaacuccccucuugcgagcugucccgccuugaagagauugccgaacuggucgccagcucucucccuagcccccugagacgggagaagcucgcucuggcccucgagaacgaaggauacaucaaaaagcugcuggagcuuuuccaugugugugaagaccuggagaauaucgaaggccuucaccaucuguaugagauuaucaaaggcauuuuucuccugaaccgcaccgcucuuuucgagguuauguuuagcgaagagugcaucauggacgugauugggugucuggaauacgauccugcccucucucagcccagaaagcaccgggaguuccugacaaaaaccgcgaaguuuaaggaagucaucccuauuuccgacccggagcugaaacaaaagauccaucagacguaucgcgugcaguacauccaggauauggugcuccccaccccuagcgucuucgaggaaaauaugcuguccacacuucacucuuuuauuuucuuuaacaaaguugagaucgugggaaugcugcaagaagacgagaaguuccucaccgaucuguuugcccagcuuacagacgaggcuaccgaugaagagaaaagacaggaacuggugaauuuccucaaggaguucugcgccuuuagccaaacgcugcagccccagaaccgggacgcuuucuuuaaaacacuguccaauaugggcauucucccugcccuggaagucauccuugggauggaugacacccaggugcgcagcgcggccacagauauuuucucuuaccugguugaguauaaccccuccauggugagagaguuugucaugcaagaagcucagcagaaugacgacgauauccuccugaucaaccugauuaucgagcacaugauuugugacaccgauccggaacuuggaggcgccgugcagcucauggggcugcugcggacccucguugacccugagaauaugcuggcuacagccaacaagacggaaaagaccgaguuccuuggauuuuucuacaaacauugcaugcacgugcugacagcuccccuccuggccaacaccacagaggauaagccuagcaaagacgauuuucaaaccgcgcagcugcuugcccucguccuggaacugcucacguucuguguggagcaucacacauaucacaucaagaauuacauuaucaacaaagacauccugagacgcguccuugugcugauggcuucuaagcaugccuuucucgcccugugcgcucugcgguucaagagaaaaauuaucggccuuaaggaugaauuuuauaaucgcuacauuaugaaauccuuccucuucgagcccguugugaaggccuuucugaacaauggcucccgguauaaccugaugaacucugcgaucauugaaauguucgaguuuaucagagucgaggacauuaaaagccucaccgcucacgugaucgaaaauuacuggaaggcccuggaggauguugacuacgugcagaccuucaaggggcuuaaacugcgcuuugaacagcaacgggagagacaggauaaucccaagcucgacuccaugcgcagcauccugcggaaccauagauaucgccgggacgccagaacacuggaggaugaagaggaaaugugguucaauaccgacgaggaugacauggaagauggagaggcugucgugucuccuuccgacaaaacaaagaacgaugacgauauuauggacccgaucagcaaauuuauggagcggaagaaacuuaaagaaucugaggaaaaggaggugcuccugaaaacgaaucuguccggccgccagagccccuccuucaagcucucucugagcuccgggaccaaaacaaaccuuaccucucagagcuccacaaccaaucugccuggaagccccggcucuccugggucccccggaagcccgggcucuccuggcuccguucccaagaacacgagccaaaccgccgcuauuacaaccaaagggggacucgucggccugguggauuacccugacgaugacgaagacgaugacgaggaugaggacaaggaagauacacugccccuuucuaagaaagccaaguuugacagcuga

SEQ ID NO: 75975 - RNA, 2550 nt, Artificial Sequence
  derived and/or modified sequence opt5 from SMEK2__Homo_sapiens__NP_001116436
augagcgacaccagacggcgcgugaaggucuacacacugaacgaggauagacagugggacgaucggggcacggggcacguuuccucuaccuauguggaggaacucaaaggaaugagccugcuugugcgcgccgaauccgacggcucucugcuccuggagagcaagaucaaucccaacacagcuuaccaaaaacagcaggauacccuuauugucugguccgaagccgagaauuaugaccuggcgcucucuuuccaggagaaggcugggugcgaugaaaucugggagaaaauuugucaagugcagggaaaggacccuagcguugaagugacacaggaucugaucgacgaguccgaggaagagagauuugaagagaugccggaaaccagccaucugauugaucuccccacaugcgagcugaacaaacuugaggaaaucgccgaccuggucaccucugugcucuccagcccuauccggcgcgagaaacuggcccuugcucuggaaaaugagggcuacauuaagaaacuccugcagcuguuccaagccugugaaaaccucgagaauacggaggggcugcaccaucuuuaugaaaucauuagaggaauccuguuucucaacaaggcuacccuguucgagguuauguuuucugaugaaugcauuauggacguggucggcugucuugaguacgaccccgcccuggcgcagccuaaacggcaccgcgaguuccucacaaagaccgccaaguuuaaagaagugauccccauuacagauuccgagcugagacagaagauccaucagaccuaucgggugcaauacauccaggacauuauccugccuacgccgagcgucuucgaagagaauuuucucucuacacugaccuccuucaucuuuuucaacaaaguugaaaucgugagcaugcuucaggaggaugagaaguuucuguccgaaguguucgcucaacucacagacgaggccaccgaugacgauaaacgcagagaacuggucaauuucuuuaaggaguucugcgcuuuuucucagacccuucagccccagaaccgggacgccuucuuuaaaacacuggcgaagcucggcauucugccugcccuggaaaucgugauggggauggaugaccuccaaguucgcagcgcugccacggauaucuucuccuaccugguggaguuuagccccucuauggucagagaguucgugaugcaggaagcucagcaguccgacgacgauauucuucugaucaauguugugauugagcaaaugaucugugacaccgauccugaacucggaggcgccguccagcugauggggcugcuucggacacucauugaccccgagaacaugcuggccaccacaaauaagaccgaaaagagcgaguuucugaacuucuuuuauaaccacugcaugcacgugcucacggcuccgcugcuuacaaauaccucugaggauaagugugaaaaagacuucuuucugaagcauuacagauauagcugguccuucgucugcaccccuucucacagccauucccacagcacacccucuuccagcaucucucaggauaacaucgugggauccaauaaaaacaauaccauuuguccugacaacuaccagacagcgcaacuccuggcccugauccuugagcuccugacguucugcguugaacaccauaccuaucacauuaagaauuacaucaugaacaaggaucugcuccgccgggugcugguccuuaugaauagcaaacauacauuucuggcucucugcgcccugagauucaugcgccggauuaucggccugaaggacgaguuuuauaacagauacauuaccaaagggaaucuuuucgaacccgugaucaacgcccuccuggauaauggaacacgcuacaaccugcucaauuccgcuguuaucgagcuguuugaguucauucggguggaagacaucaagucucuuaccgcccacauugucgagaacuuuuauaaagcgcuggaaagcaucgaguacgugcagacguucaagggccucaagaccaaauaugagcaggaaaaggauagacagaaccaaaaacuuaauuccgugcccucuauucugcgcagcaaccgguuuagacgcgacgcuaaggcccuggaggaagacgaggaaaugugguucaaugaggaugaggaagaggaaggcaaagccguugucgcuccuguggagaagccgaagcccgaagacgauuuuccugacaacuacgagaaauucauggagacaaagaaagccaaggaauccgaggauaaagaaaaucuccccaagcggaccagcccugggggauuuaaauucacauucucucauuccgcuagcgccgcgaacggcaccaauucuaaguccguggucgcccagauucccccggcuacgagcaacgggucuagcuccaagacaaccaaucugccuacaagcgugaccgccaccaaaggaucucugguuggccucguggacuaucccgaugacgaggaagaggaugaggaagaggaauccagcccuagaaagcggccccgccugggguccuga

SEQ ID NO: 75976 - RNA, 10986 nt, Artificial Sequence
  derived and/or modified sequence opt5 from SMG1__Homo_sapiens__NP_055907
augucccggcgggcccccggaucccgccugucuagcgggggaggcgggggaggcaccaaguacccuagauccuggaacgacuggcagccccggaccgauucugcuagcgccgaccccgauaaucucaaguauuccucuagccgcgacagagggggauccagcucuuacggccugcaaccuuccaacagcgcgguggucucucggcagcgccacgaugacacgagaguucaugcugauauucagaaugacgagaagggcggguauuccgugaacggaggcagcggggaaaauaccuacggacggaagucucuuggccaggagcugcgcgugaacaaugucacaucccccgaguucaccagcgugcaacacggguccagagcccucgccaccaaggauaugcggaagucucaggagcgcagcauguccuauagcgacgaaucuagacuguccaaccuucugcggcgcauuaccagagaggaugaccgggauagacgccucgcuacaguuaagcagcugaaggaguuuauccagcaaccugaaaauaagcuggugcucgucaagcagcuggacaacauucuugccgcugugcaugacguucugaaugagagcucuaaacuccugcaggaacuucggcaggagggagccugcugucugggccuccugugcgcgagccuguccuacgaggccgaaaagaucuucaaauggaucuuuucuaaguucagcuccagcgcuaaggaugaggugaaacuccuguaucuuugugccaccuacaaggcucuggaaacggucggcgagaaaaaggccuuuucuuccgugaugcaacucgugaugaccagccugcagucuauccuugaaaacgucgacacacccgagcugcucugcaaauguguuaagugcauccugcugguggcgagauguuacccucacauuuucuccaccaauuuucgcgauacaguggacauccucgucggguggcauauugaucacacccagaaaccgagccugacgcaacagguguccggauggcuucagucucuggagcccuucuggguugccgaccucgcuuuuagcacaacccugcuuggccaguuccuggaagauauggaggccuaugcugaagaccucucccacguggccucuggggagagcgucgaugaagacgugccucccccuuccguuagccugcccaagcuggccgcucuccugcggguguuuucuacagucgugagauccaucggagagcgcuucagcccgauucggggcccucccaucaccgaggcguacgucaccgaugugcuuuauagaguuaugcgcugcgugacagccgcuaaccaagucuuuuucucugaagccgugcugacggccgcuaaugaguguguuggggugcuccugggaucccuggacccuagcaugaccauucauugcgacauggucaucacauacggccuugaucagcucgaaaacugucagaccugcggcacagacuauaucauuucugugcugaaccugcucacccugaucguggagcagauuaauacgaaacuucccagcuccuucguugaaaaacuguuuauccccagcucuaagcuccuguuccugcgguaccacaaagagaaggaggucguggccguggcgcaugcugucuaucaagccgugcuuucccucaaaaacauuccuguucuggaaacagccuacaagcugauccucggggagaugaccugcgcucugaauaaccuucugcacagccuccagcugccggaagccuguuccgagaucaagcacgaggcuuuuaaaaaucauguguucaacgucgauaaugccaaguuugugguuauuuucgaccugucugcgcuuaccacaaucggaaacgccaaaaauagccucauuggcaugugggcucugucccccaccguguuugcccugcucucuaagaaccugaugaucguccacagcgaucuugcugugcauuucccugccauucaguacgcgguucuguauacacucuacucccacugcacgagacaugaccacuuuaucucuagcucccugagcagcuccagccccucucuguucgauggggccgugaucuccaccgucacaaccgcuaccaaaaagcacuuuagcauuauccuuaaucuccugggcauucugcucaagaaagacaaccugaaucaggauacacgcaaacuucugaugacgugggcccucgaagcugccgugcugaugaaaaagucugagaccuaugccccucuguucucccuucccagcuuucauaaauucuguaagggccugcucgcuaacacacugguggaagacgucaauaucugccuccaagcguguuccagccugcacgcccuuucuagcucccugccggaugaccuccugcagcggugcguugauguguguagagugcagcugguccauucugggacccggauucgccaggcuuucggcaaacuucugaaaagcaucccucucgacgugguucuguccaacaacaaucacacagagauucaagaaaucucucucgcccugagaagccacauguccaaggcccccucuaacaccuuucauccucaggacuucagcgaugugaucuccuuuauucuuuacggaaauagccaccggacgggcaaagacaacuggcuggagagacucuucuauucuugccagcgccuggauaagcgggaccaauccacaauccccagaaaucugcuuaaaaccgaugcuguccuguggcagugggccauuugggaggcggcucaguuuacagugcucagcaagcugcgcaccccucucgggagagcccaggacaccuuccaaacaaucgaaggaauuauccggucucuggccgcucauacgcuuaaccccgaucaggacguuucccaguggaccacagccgauaaugacgagggccacgggaacaaucagcugcgccuggugcuccugcuucaauaccuggaaaaccucgagaaacugauguauaaugcguacgaaggaugugcuaacgcccucaccagcccgccuaaggucaucagaacauuuuucuacaccaaucggcagacgugccaggauuggcugacacgcauuagacuuuccaucaugcgggugggccugcuggccgggcagcccgcuguuaccgugcgccauggcuuugaccuccugaccgagaugaagacaaccucucuuagccaaggaaacgagcuggaagucacaauuaugauggugguggaggcccucugugaacugcacugccccgaggcuauccagggcauugccgucugguccagcucuaucguugggaaaaaucuccuguggaucaacuccguggcgcagcaagccgaaggaagauucgagaaggcuagcguggaguaucaggaacaccuuugcgccaugacgggcgucgauuguugcauuucuagcuuugacaaauccgugcugacccuggcuaacgccgggagaaauucugccagcccuaagcauucccucaacggagagucucgcaaaacaguucugagcaagccgaccgacuccagccccgaagugaucaauuaccuuggcaacaaggcuugugagugcuauauuucuaucgcggauugggccgcuguccaggaguggcagaaugccauucacgaccugaaaaaguccacaagcuccaccucucucaaccugaaagccgauuucaauuacaucaagagccucuccucuuuugaaagcgggaaauucguggaguguacggaacaacuggagcuucugccuggcgaaaacaucaaucugcucgcuggaggcuccaaggagaagauugacaugaaaaagcugcuucccaacaugcugagcccugaucccagagagcuccagaaaucuaucgaaguucagcugcugcgguccagcgugugccucgccaccgcgcuuaauccuauugagcaggaccaaaaguggcagucuaucacagaaaacgucgugaaauaucugaagcagaccuccagaauugcuaucgggccccugcgccucagcacacugaccgucucucagagccuuccggugcuguccacacuccaacuguacuguucuagcgcccuggagaauaccguuuccaaccggcucagcacggaagauugccuuauuccucuguucuccgaggcccugagaucuuguaagcagcaugacgugcgccccuggaugcaggcucuccgguauacaauguaccagaaucaacugcuugagaaaaucaaggaacagaccgucccuaucagaagccaccugauggagcucggacugaccgccgcgaaauuugcucgcaagcggggcaacgugucccuggccacaagacuccuugcccagugcucugaaguucaacuggggaaaaccacgacagcucaggaucuggugcagcauuucaagaaacucagcacccagggacaagucgacgagaaguggggccccgaacuggauauugagaagacaaaacuucuguacaccgccgggcaguccacacacgcuauggagaugcucucuagcugugccaucuccuuuugcaagagcgugaaagcggaauaugccguggcuaagucuauucugacccuggccaaauggauccaggcugaguggaaggaaauuuccggccagcucaagcaaguuuaccgcgcccagcaccagcagaacuucacgggacuuagcacccugucuaaaaauauccugacacucaucgagcugccguccgucaacaccauggaggaagaguauccucggauugaaagcgagucuacagugcauaucggcgugggggaacccgacuuuauucuuggacaacuguaccaccucuccagcguccaggccccugagguggcuaaguccugggcggcccuggcuagcugggccuauagauggggccggaaaguuguggacaaugccucucagggggagggaguccgccugcuccccagagaaaagagcgaggugcaaaaccuucugcccgauaccaucacggaagaggaaaaagagcggauuuacggcauccugggccaggcuguuugccgcccugccgggauccaggacgaggauauuacacuccagaucaccgaauccgaggacaaugaagaggaugacaugguggaugucauuuggagacaacugaucucuagcuguccguggcuuuccgaacuggacgagucugcgacagagggagugauuaagguuuggcggaagguggucgauagaaucuucagccucuauaaacuguccugcucugcuuacuuuaccuuccugaagcucaacgccggccagauuccccuugacgaagaugacccucgccugcaucugagccaccggguggagcaguccaccgaugacaugaucgugauggccacacucagacugcuucgccugcucgucaaacacgcuggggaacugcggcaguaccuggagcauggacucgagacgacccccacagccccuuggagaggcaucauuccccaacuuuuuagccgccugaaucacccugaaguuuaugugcggcagucuaucuguaaccugcucugcagaguggcgcaggacuccccgcaucugauucuuuaccccgccaucgucgggaccauuagccugucuuccgagagccaggcuuccggaaauaaguucucuacagccaucccuacccuccugggcaacauccaaggcgaagaacugcucgugagcgaaugugaagggggaucucccccugcuagccaggauucuaauaaagacgagcccaaguccggccuuaacgaagaucaggccaugaugcaggacugcuauagcaagauuguugauaaacugucuagcgcuaauccgacgauggugcugcaaguccagaugcucguggccgagcugcgcagaguuacagugcuuugggacgaacuguggcucgggguccugcugcagcaacacauguacgugcuccggcgcauccagcagcuugaggaugaagucaagagagugcagaacaauaacacccugcggaaagaggagaagauugcgaucaugcgcgaaaaacauaccgcccugaugaagccuauuguuuuugcucucgagcacgugagauccaucacagccgcucccgccgaaacaccccacgagaagugguuccaagacaauuauggagaugccaucgaaaacgcucuggagaaacuuaagacaccucugaaccccgcgaaaccuggcucuagcuggauuccguucaaggagaucaugcucucccugcagcagcgggcccagaaaagagcuucuuacauucugcgccucgaagagaucagccccuggcuggccgccaugacgaauaccgaaauugcgcuuccuggggagguguccgcccgggacacagucaccauccauagcguuggaggcacaauuaccauccugcccacgaagaccaaaccuaagaagcuccuguuucuuggcucugaugggaaauccuaucccuaccuguucaagggacucgaggaccugcaccuggaugaaagaaucaugcaauuucucagcauugugaacacaauguucgcgaccaucaaucgccaggagacaccgcgguuucaugccagacacuacuccgugaccccucugggcacacggucugggcuuauucagugggucgacggagcuacgccccuguucggccucuauaaacgcuggcagcaaagagaagccgcucugcaggcccagaaggcgcaagacagcuaccagaccccucagaaccccgggaucgugccucggcccuccgagcuuuauuacucuaaaauuggaccggcccugaagacaguuggccucagccuggaugugucccgcagagacuggccucugcacgucaugaaggcugugcucgaggaacugauggaggccacaccgcccaaucuucuggcuaaagaacucuggagcucuuguaccacaccugaugagugguggcgggucacgcaguccuaugcccgcagcaccgcugugaugucuaugguuggcuacaucaucgggcugggagacagacaucuugauaacgugcugauugacaugacaaccggcgaagucgugcacaucgauuauaauguuugcuuugagaaggggaaaucccuccgggugccggaaaagguccccuuccgcaugacacaaaacauugagaccgcccugggagugacgggcguggaggggguuuuuagacugagcugugaacagguccuccauaucaugcggagaggacgcgagacacugcuuacccugcucgaagcguucguguacgacccucugguggauuggaccgccggcggcgaggcuggguuugccggagcugucuacggcgggggaggccagcaggccgaaucuaaacaauccaagcgggagauggagagagaaauuacacgcagccuuuucucuagccggguugccgagaucaaggugaauugguuuaaaaacagagacgaaaugcuggugguccuccccaagcuggaugggucccuggacgaguaucucagccugcaggagcagcuuaccgacguggaaaaacugcagggaaagcuccuggaggaaaucgaguuccuugaaggcgcggagggcguugaucacccuucccauacacugcaacaccgcuacucugagcacacccagcuccagacgcaacagcgggcugugcaggaagccauucaggucaaacugaaugaguucgaacaauggaucacacauuaucaggcugccuuuaacaaucuggaggccacccagcucgcuagccugcuucaggaaauuuccacacaaauggaccuggggcccccuucuuacgugccggccaccgcguuccuccagaacgccggacaggcucaccugaucagccagugcgagcaacuugagggcgaaguuggggcccugcuccagcagagacgcuccgugcugcggggaugucuggagcagcuccaucacuaugcuacggucgcccugcaauaccccaaggcgauuuuucagaagcacagaaucgaacaguggaaaaccuggauggaggaacuuauuugcaauacaaccguggagcgcugccaagagcuguaucggaaguacgaaaugcaguacgccccucagcccccucccacagugugucaguucaucaccgcuacagagaugacccuccaaagauaugccgcugauaucaacucucgccugauuagacaggucgaacggcuuaaacaggaggccguuacggugccggugugcgaggaccagcugaaggaaaucgagcgcuguauuaaagucuuucuccaugaaaacggcgaggaagggagccugucccuggcuagcgugaucauuucugcccuuugcacacugaccagacggaaucucaugauggagggagcggccuccagcgcuggcgagcaacugguugaucucaccucuagagacggcgccugguuccuggaggaacuuuguuccaugagcgggaacgugacaugccugguccagcugcucaagcagugucaccuggugccucaggaucuugacauccccaaucccauggaggcuucugagaccguucaucuggccaacggaguguacacaucccuccaagaacugaauagcaacuuucggcagaucauuuucccugaggcccuccgcugccugaugaaaggcgaguauacgcuggaaucuaugcuucacgagcuggaugggcucaucgaacagaccacagacggagucccccugcaaacccuuguggagucccugcaggcguaccucagaaaugcugccaugggccuggaagaggagacacaugcccacuauauugauguugcucggcuccugcacgcccaguacggggaacugauccagccucgcaacggcagcguggacgagaccccgaagaugagcgcuggacaaaugcuucuggucgccuuugauggcauguucgcucagguggaaacggccuuuucccuccuggucgagaaacuuaauaaaauggagauucccaucgcuuggagaaagaucgacauuauccgggaagcccgcucuacccaggugaacuucuuugacgaugacaaucauagacagguucuggaggaaauuuucuuccucaaacggcugcaaacaaucaaggaguuuuuccgccugugugggaccuuuagcaaaacacucuccggaucuagcucccuggaagaucagaacaccgugaauggcccuguccagauugugaacgugaagacgcuuuucagaaauucuugcuuuagcgaggaccagauggcuaagcccaucaaagccuucacagcggauuuuguucggcaacugcucauugggcugccuaaccaggcccuuggacugacccucuguuccuucaucagcgcucugggcguggacaucauugcccaggucgaggcuaaggauuuuggggccgaaucuaaaguguccguugacgaucugugcaagaaagcuguggagcacaacauccagauuggcaaguucagccaacucgucaugaaucgcgccacagugcuggcgucuuccuaugacaccgccuggaagaaacaugaucuugucagacggcuggaaaccagcaucuccucuugcaagacaagccuccagcgcgugcagcugcacauugcuauguuucaauggcagcaugaggaccuucugaucaacagaccccaggccauguccguuacgccgccuccccggucugccauccucaccagcaugaaaaagaaacugcacacacugucccagauugaaaccagcaucgcuacagugcaagagaagcucgccgcgcuggagucuuccauugaacagagacuuaagugggcuggaggcgccaauccugcccuggcucccguccuccaggacuucgaggccaccaucgcugaacgccggaaccuggugcuuaaagagagccagagagccucucaaguuacguuucuguguagcaauauuauccacuucgaaucccuccgcacacggaccgcggaggcccugaaccuggaugcugcccucuucgagcugaucaagagaugccagcagauguguucuuuugcuagccaguucaauuccagcgugucugaacuugagcugcgccuccugcaacgggucgacaccgggcuugaacauccuauuggauccagcgaguggcugcucuccgcccacaaacagcugacacaggauaugucuacccaaagagcgauccagacagagaaggaacagcagauugagacggugugcgaaaccauccaaaaccugguggacaauauuaaaacaguucucaccggccauaaccgccagcugggggaugucaagcaccuucugaaagccauggcuaaggacgaggaagccgcucucgccgauggagaggacgugcccuacgagaauagcgugcggcaguuucugggcgaauacaaguccuggcaggauaacauccaaacaguccuuuucacccuggugcaggccauggggcagguuagaucucaggagcacguggaaaugcuccaagagaucacgccgacccugaaagaacugaagacacagagccaguccauuuauaauaaccucgucucuuuugcuagcccucuggugaccgacgcgacaaaugaguguuccagccccaccucuuccgccacauaccaacccagcuucgcugccgccguucgcucuaacaccggccagaaaacgcagccugaugugaugucccagaacgcucggaaacuuauccagaagaaucuggccacaagcgcggacaccccgcccucuaccgucccuggaacaggcaagagcguggcuugcucccccaagaaagccguuagagauccuaagacggggaaagccgugcaggagcggaacagcuaugcugucuccguguggaagagagugaaagccaagcucgaaggacgcgacgucgaccccaaucggagaaugucuguugcugagcaaguggauuacgugauuaaggaagccaccaaccuggacaaucuggcgcagcucuaugagggcuggacagccugggucuga

SEQ ID NO: 75977 - RNA, 993 nt, Artificial Sequence
  derived and/or modified sequence opt5 from SMG6__Homo_sapiens__NP_001269255
augagauuccggcugugccaccagcgcggcuguugcccccaugagagagaaaacaccuguacaugcaagaugaucauuagcucccuccaagugaucgccgcugacuguaaacgggucacgguucugaaguacuuucuugaggcccugugcgggcaggaagaaccucuccuggcguucaaaggaggcaaguaugugucuguggcuccgguccccgauaccauggggaaagaaaugggaagccaggagggcacacgccuugaggacgaagaggaagaugugguuauugaggacuuugaggaagauuccgaggccgaagggucuggaggcgaggacgauaucagagaacugcgggccaagaagcucgcucuggcccgcaaaauugcugagcagcaaagacggcaggagaagauccaggccgugcuggaagaccacagccagaugcgccaaauggagcucgaaaucagaccucuguuccuuguccccgauaccaauggcuuuauugaccaucuggcgucccucgcccggcugcuugagucucgcaaauacauccuggugguuccucucauugugaucaacgaacuggaugggcuggcuaagggacaggagacagaccacagagccggcggguaugcucgggucgugcaggagaaagcccgcaagagcauugaguuccucgagcagagauuugaaucccgggauagcugucugagagcgcuuaccucucgcggaaaugagcuggaauccaucgccuuccggagcgaggacauuacaggccaacucgggaacaaugacgaucugauccuuucuugcugucugcauuacugcaaggacaaagcuaaggauuuuaugcccgccuccaaagaggaaccuaucagacuccugcgcgaggugguccugcucaccgacgaucggaaccugagaguuaaggcucuuacgcgcaaugugccggugcgggacauucccgccuuccugaccugggcccaggucggauga

SEQ ID NO: 75978 - RNA, 2976 nt, Artificial Sequence
  derived and/or modified sequence opt5 from SMG8__Homo_sapiens__NP_060619
auggccggccccgugagccugagagaccuccugaugggggcuuccgccuggaugggaucugagagcccuggcggguccccgaccgaaggaggcgggucugcggcuggaggccccgagccucccuggcgggaagaugagaucugcgucguuggcauuuucgggaagacagcccuucgccugaacagcgaaaaauuuucccucgugaauacggugugugacagacaggucuucccucuguuucggcaccaagaucccggagacccuggcccggggauccgcaccgaggccggagcugugggcgaggccgggggagcugaagaucccggcgccgcggccggcgggucuguuagaggaagcggcgcuguggccgaggggaaccggacagaagcuggaucccaggacuacagccuucugcaggccuauuacucucaggaguccaagguccucuaucugcugcucaccagcauuugcgauaauucucaacugcuucgcgcguguagagcccugcaguccggcgaggcugggggaggccucagccugccucaugccgaagcucacgaguucuggaaacaucaggaaaaacuucagugccugucucuccuguaccuguuuuccgugugucacauccuccugcuuguucaucccacaugcagcuucgacauuaccuaugaucggguguuucgcgcccuggacggccucagacaaaagguccugccucuucugaagacagccaucaaggauugucccguggggaaagacuggaagcucaacugccggccguguccuccccgccugcuguuccucuuucagcugaauggagcucuuaaaguggagccucccagaaaccaggaucccgcgcacccugacaagccgaaaaagcacucccccaagcggcgccugcagcaugcccucgaagaccaaaucuacagaauuuuccggaaaucuagaguccugaccaaucagagcaucaacugccuuuuuacgguuccugcuaaucaggccuucguguauauugugcccggcucccaagaggaggauccugucgggaugcugcucgaccagcugcgcagccacuguaccgugaaggaucccgaaucucugcucguuccggccccucuguccggaccccggagauaccaggugaugcgccagcauagccggcaacagcuuucuuuucacaucgacagcuccucuagcuccagcucuggccagcuggucgauuucacacucagagaguuccuguggcagcacguggaacugguucuuuccaaaaagggguuugacgauagcgugggccgcaacccucaacccucucauuucgagcucccuaccuaccagaaauggauuuccgcugccagcaagcuguaugaagucgcgaucgacggaaaagaggaggaucugggcucccccacaggggaacucaccucuaagauucugagcuccaucaaggugcuugagggauuucuggacaucgauacgaaauucucugaaaaucggugccagaaggcucucccgauggcccacagcgccuaccaguccaaccugccucauaauuauacaaugaccguccacaaaaaccaacuggcucaggcccuuagaguguacagccagcaugcucgcggccccgccuuucacaaguaugcgaugcagcuccacgaggacugcuacaaauucuggucuaaugggcaucaacugugugaggaacggucccugacagaccagcacugcguucauaaguuucacagccuccccaagucuggagagaaaccugaagccgauagaaacccgcccgugcuguaucacaacucccgcgcucggagcaccggcgccuguaauugcgggagaaagcaggcuccucgggacgaucccuucgacauuaaagccgcgaacuacgauuuuuaccaacuucuggaggaaaaguguugcggcaaacucgaccauaucaauuucccugucuuugagcccucuaccccugaucccgccccggcuaagaacgagagcuccccugcucccccugacagcgaugccgacaagcugaaagaaaaggagccccagacacagggagaaucuacgucccugagccuugcccucucccugggccagucuaccgauagccuggggacauauccggccgacccucaagcuggaggcgauaaucccgaggugcacgggcagguugaagugaaaaccgagaagcgcccuaacuucgucgacagacaggcguccacaguggaguaccuccccggaaugcugcauucuaauugucccaaaggccuucugccuaaguuuagcuccuggucucucgugaagcuggggccggccaaaagcuauaacuuccacaccggccuggaccagcaaggauucauucccggcacgaauuaccuuaugccuugggauaucguuauucggacaagagcugaagacgagggggaucucgacaccaacuccuggcccgccccuaauaaggccauccccggaaaacgcagcgcugucgugaugggccgggggagacgcagagaugacaucgcccgggcguuugugggauucgaauaugaggauucucgcggcagacgguuuaugugcuccgggccugacaaggucaugaaagugaugggcagcggaccgaaggaaucugcucugaaagcccugaacuccgauaugccccucuacauucugucuagcucccagggccgcgggcuuaagccucauuaugcccagcugaugagacucuucguugugguccccgacgcuccucugcagaucauucugaugccccaagugcagccgggaccuccucccugucccguguuuuaccccgagaagcaggagaucacccuuccuccggauggccuguggguucuccgguuccccuacgccuaugucacagaacgcgggccuugcuuucccccuaaagagaaugugcaacugaugagcuacaagguucucagaggagugcugaaagcggucacccaguga

SEQ ID NO: 75979 - RNA, 225 nt, Artificial Sequence
  derived and/or modified sequence opt5 from SMIM15__Homo_sapiens__NP_001041714
auguucgacaucaaggccugggcugaguacguggucgaaugggccgcgaaagaucccuauggcuuucugaccacaguuauucucgcucugacgccucuuuuccuggccagcgccgugcucuccuggaagcuggcuaaaaugaucgaggccagagaaaaggagcagaaaaagaagcaaaaacggcaggaaaacauugcuaaggccaaacgccuuaagaaagacuga

SEQ ID NO: 75980 - RNA, 324 nt, Artificial Sequence
  derived and/or modified sequence opt5 from SMIM19__Homo_sapiens__NP_001129148
auggccggcggguacggagugaugggcgacgaugggagcaucgacuauaccguccacgaggcuuggaacgaagccacaaauguuuaccugauugugauccucguguccuucggacuguuuauguaugcgaagagaaacaaacggcgcauuaugagaaucuucucugugcccccuacggaggaaacccuuagcgagccgaauuuuuacgauacaauuuccaagauccggcugcgccagcaacucgaaauguauucuaucagcagaaaauacgacuaucagcagccccagaaccaagcugauuccguccagcugucucuugaguga

SEQ ID NO: 75981 - RNA, 204 nt, Artificial Sequence
  derived and/or modified sequence opt5 from SMIM20__Homo_sapiens__NP_001138904
augagcagaaaccugcggaccgcccucaucuucggcggguuuauuucccugaucggagcugccuucuaccccauuuauuuucgcccucuuaugagacuggaggaauacaagaaagagcaggcgaucaaucgggcuggcauugugcaagaagacguccagccgcccgggcucaagguuuggucugauccuuucggacgcaaauga

SEQ ID NO: 75982 - RNA, 306 nt, Artificial Sequence
  derived and/or modified sequence opt5 from SMIM21__Homo_sapiens__NP_001032408
auggaccaguacgugagcaccgcucccccuagauucccgaucgcccaacugggcacauuuaagcaggauuccgccgggaugggacggauuuucaaaggcaaccuccugcagaagaaagcgcuuacgaccuuugagaaugaacaccauauccgcuucuuuacacugcucguccuguuccacguuauggugcuucugagaaaccauucucggauucagggggugagcgaggacuggaagcgcgcuaauuccaucuuuagaaacuuccuccggcugaaaucuagccgcaauaccgccgaagccgaguga

SEQ ID NO: 75983 - RNA, 519 nt, Artificial Sequence
  derived and/or modified sequence opt5 from SMIM23__Homo_sapiens__NP_001276899
auggccacccagcaaguggacagcagacggcaggucgcugccgagcagguugcggcucagcugcucgaacgcagacggggcucccacugcgaugacgagaagcaaacacugcuugcccugcucauccuggugcuuuaccugucuacggaaauuugggggagcuccugggaggugucugaacgcaucagagaguguaacuauuaccagaaucucgccgucccccagggacuggaguaucagaccaacgaaccuagcgaggaaccgauuaaaacaauccggaauuggcugaaggagaaacuccauguguucuccgagaagcuggaagaggaaguucaacagcuugagcagcuggcuugggaucucgaacuguggcuugacgcccugcucggcgagccccaccaggaggaacauugcucuaccuacaaaagccaccugugggagugggcuugggcccuggggcgcgaacauaagggaggcgaggggcuccuggaaauuucccuuagcggagcggagcuguga

SEQ ID NO: 75984 - RNA, 720 nt, Artificial Sequence
  derived and/or modified sequence opt5 from SMIM5__Homo_sapiens__XP_011523418
augagacggcuggccggccgcgcugggcacagccaggugacccaagacuccaaguucucucccaaaacaccuagcgaugccgagagacauaagggacucccgcgggacuggcugcagucccuucugcucucucugcgcgggcccccugcgccccacugccuucugcucuuucugagagaagcucggggccgcgaucagccuggaagcggccagagagaccggcgcgggggacugcccgagggcagagucggcgccccugaucuccgggcccugcaagacuccccgccccaggcucagguugaaccuccccaggggccucccggacaagagggccgcgaaccgacgucuuucuuuagcucccagccuagacccagcccucggcgcgggucuagaggagagggcgaggaagaggaagggggaggcgagcgggagcuugugcugucccucagcucugcccugagagcugaagaugaccagcagcaaaaaucccaggccgagaccgcggccggcugucagcaacgcagcugggcugaagcccccagaggggcugccgcgcccacaaaggaggugcggggacagcaugucgaagccccucgcuggggcaccgcugcccagccgcccacaccugagcuucccggggcuuggccuacccacugcugguguucucagcugacagcccaacccggauccagcucccucggcccgucucggaccccuuga

SEQ ID NO: 75985 - RNA, 885 nt, Artificial Sequence
  derived and/or modified sequence opt5 from SMN2__Homo_sapiens__NP_059107
auggccaugagcuccggcgggucuggaggcggggugcccgagcaggaagacagcguccuguucagacggggaaccggccaauccgaugacucugauaucugggacgauacagcucucauuaaggccuacgacaaagcgguugcuagcuuuaagcacgcccugaaaaacggggauaucugcgagacguccggaaagccuaaaaccacaccgaagcgcaagcccgccaaaaagaauaaaucucagaagaaaaacaccgcugccagccuucagcaguggaaggugggcgacaaguguuccgcuauuuggagcgaagauggcugcaucuauccugccacaauugcgucuaucgacuucaaaagagagaccuguguggucguguacacaggguauggaaaucgggaggaacaaaaccuguccgaucuccugagccccaucugcgagguugccaauaacauugaacagaaugcucaggagaacgaaaaugagucucagguguccaccgacgagagcgaaaacucucgcuccccuggcaauaagagcgauaacaucaaacccaaguccgccccuuggaacucuuuucuuccgcccccucccccuaugcccgggccgagacugggaccuggcaaacccgggcucaaguucaauggaccucccccucccccgcccccucccccuccccaucugcugagcuguuggcucccgccuuuucccuccggcccucccauuaucccucccccgccucccauuugccccgacagccuggacgaugcugacgcccuuggcucuaugcugaucuccugguacaugagcggguaucacacgggauacuauaugggcuuccggcaaaaucagaaagaggggcgcuguucucauagccucaacuga

SEQ ID NO: 75986 - RNA, 1308 nt, Artificial Sequence
  derived and/or modified sequence opt5 from SMOC1__Homo_sapiens__NP_001030024
augcugcccgccagaugcgcucggcuccugaccccucaccuucugcucgugcugguccagcuuagcccggcccgcggccauagaacaacggggccccgguuccugaucuccgaccgcgauccucaauguaaccuccacugcucuagaacccagcccaagccuauuugugcgagcgacggacgguccuacgagucuaugugcgaauaucagcgcgcuaaauguagagaucccacacugggcguugugcaucgggggcgcugcaaggacgccggacagagcaaauguagacuggagcgggcccaagcucucgaacaggccaagaaaccucaggaggcuguguuugucccggaaugcggcgaggauggguccuucacccaggugcaaugucacacauacaccggauauugcugguguguuacacccgacggcaagccuaucucuggcagcuccgugcagaauaagacccccgucugcagcgggucugugacggauaaaccucugucccagggaaacagcggccgcaaggacgaugggucuaaacccaccccgacaauggagacccagccuguuuuugacggagaugaaauuacagcccccacccuuuggaucaagcaucuggugauuaaagacuccaagcucaauaacacgaauaucagaaacagcgagaaggucuacucuugcgaucaagaacggcaguccgcgcuggaggaggcccagcaaaauccucgcgaaggcaucgugauucccgagugugcucccgggggacuuuauaaaccugugcagugccaccagagcacaggcuacuguuggugcguccugguugacaccggcagaccgcuccccgggacauccacccgguaugugaugccuucuugugaaagcgacgccagagcuaagaccacagaggccgaugaccccuucaaagaucgcgaacugccuggaugccccgagggcaagaaaauggaguuuaucacgucccugcucgacgcgcugaccacagauauggugcaggccauuaacagcgcugccccgaccgggggaggccgguucucugaaccugaccccucccacacacuugaggaaagagucgugcauugguacuuuagccaacuggauucuaauagcuccaacgacaucaauaagcgcgagaugaaaccuuucaagcgguacguuaagaaaaaggcuaaacccaagaaaugugccagacgcuuuaccgauuauugcgaccucaacaaggauaaggugauuucucugccugaacuuaaagggugucugggagucagcaaggaggugggccggcucguuuga

SEQ ID NO: 75987 - RNA, 1341 nt, Artificial Sequence
  derived and/or modified sequence opt5 from SMOC2__Homo_sapiens__NP_001159884
augcugcucccccagcugugcuggcuuccucugcucgccggccugcuuccgcccgugccugcucaaaaguucagcgcccugaccuuucucagagucgaccaggauaaagacaaggauuguucccuggacugcgcggggucuccccagaaaccucugugugcuagcgauggacggacauuccucucccgcugcgaguuucagagagccaaguguaaagacccccaacuggaaaucgccuaccggggcaacugcaaggauguuucucgcuguguggcugagagaaaguauacgcaggaacaggcccggaaagaguuccagcaaguguuuauuccugaaugcaaugacgaugggaccuacagccagguccagugucacuccuauacaggauacugcuggugugugaccccgaacggccgccccaucucugggacagcuguugcccauaagaccccuagaugccccggaagcgugaaugagaaacuuccucagcgggagggcacaggcaagaccgacgaugcggccgcucccgcccuggaaacgcaaccgcagggggacgaggaagauauugcuucccgcuauccuacccucuggacagagcaggucaaaagcagacaaaacaagaccaauaagaacucuguguccagcugcgaccaggagcaccagucugcccuggaagaggcgaaacagcccaagaaugacaacguugugaucccugaaugugcccauggaggccuuuacaaacccguccaaugccaccccuccacaggguauuguuggugcgugcugguggauaccggacggccuauuccgggcacgagcacacgcuacgagcagcccaagugugacaauaccgcuagagcccauccugcuaaagcccgggaucucuacaaggggcgccagcugcagggaugccccggcgccaaaaagcacgaguuccugacaucuguccucgacgcucuguccaccgauaugguucacgcggccagcgacccuuccucuagcuccggcagacuuagcgaacccgauccgucucauacccuggaggaacggguggugcacugguauuuuaagcuccuggacaaaaacuccagcggggauaucggaaagaaagagaucaagccuuucaaaagauuucuucgcaagaagucuaaacccaagaaaugugucaagaaauucguggaauacugcgacguuaauaacgauaagagcauuuccgugcaagagcugaugggcugucucggggucgcuaaggaagacggaaaagccgacacaaagaaacggcauacgccuagaggccacgccgagucuaccagcaaucgccagccccggaagcagggguga

SEQ ID NO: 75988 - RNA, 2364 nt, Artificial Sequence
  derived and/or modified sequence opt5 from SMO__Homo_sapiens__NP_005622
auggccgcugccagacccgcgcggggcccugagcugccgcuccuggggcuucugcuccugcuucugcucggagaccccggccgcggggcugccagcuccggaaacgccaccggcccugggcccagaucugcuggaggcagcgcccggcgcuccgcugccgugacaggcccucccccuccgcugucucacugcgggagagcggcccccugugaaccucugcgguacaaugucugccucggaagcguucugcccuauggcgcuacguccacccuucuggccggggauucugacagccaggaggaagcucauggaaagcucgugcugugguccggccuucgcaacgccccuagauguugggcggugauccaaccccugcucugcgccgucuacaugccgaaaugugagaaugaucggguggaacugccuagccgcacacugugccaggcuaccagagggcccugugccauuguugagcgggagcgcggauggccugacuuccucagaugcacacccgaucgguuucccgaaggcuguaccaacgaggugcagaauaucaaguucaacucuuccggccagugcgaagucccucuggugcgcacagacaauccgaaaagcugguaugaggauguugagggguguggcauucaaugccagaacccccuuuuuaccgaagcugagcaccaggacaugcauucuuacaucgccgccuucggagcugugacggggcugugcacccucuuuacacuggcgaccuucgucgccgauuggagaaauuccaaccgguauccugcugugauucuguuuuacgugaaugccuguuucuuugucggaagcaucggcuggcuugcccaguucauggacggggcuagacgcgaaaucguuugccgggccgauggaacaaugagacucggcgagcccaccucuaacgaaacgcuguccugugugauuaucuuugugauugucuauuacgcgcugauggcuggcgugguuugguucgugguccucacauacgccuggcacaccagcuuuaaggcccuggggacaaccuaucaaccucuuuccggaaaaaccucuuacuuccaucugcucacauggagccugcccuucgugcuuacgguugcuauccuggccguggcucaggucgacggcgauuccgugagcgggauuugcuuugucggauauaagaauuaccgcuaucgggccggcuucgugcucgcgccgaucgggcugguucugauugugggcggauacuuucucaucagaggcgucaugacccuguucucuaucaaguccaaccacccugggcuucugagcgagaaagccgcuucuaagauuaaugagacaaugcuccgccugggaaucuuuggcuuccuggccuuuggguucgugcuuauuaccuuuagcugucacuucuaugacuuuuucaaccaggcugaaugggagcgguccuuuagagacuacguucucugccaggccaacgugacaaucggacugcccaccaaacaaccuauucccgauugugaaaucaagaaucgcccuucucugcucgucgagaaaaucaaccuguucgcgauguucggcacggggauugccaugagcacauggguguggaccaaggcuacccuucugaucuggcggagaacauggugccgccucaccggccaguccgacgaugaacccaagcggauuaaaaagagcaaaaugaucgccaaggcuuuuucuaaaagacaugagcugcugcagaauccgggacaagagcuuuccuucagcaugcacacagugucucaugacggcccuguugccgggcucgccuuugaucugaacgaacccuccgcugacgucagcuccgcgugggcccagcacgugacgaagaugguggcucggcgcggagccauucugccccaggauaucucugucaccccuguggccacaccgguucccccugaggaacaggcuaaucucuggcugguggaggccgaaaucagccccgagcuucagaaaagacugggccggaagaagaaaagacgcaagcggaaaaaggaggucuguccucucgcgcccccucccgaacugcacccgccugcucccgccccuuccaccauucccagacugccgcaacuuccucgccagaaaugccucguggccgcuggggccuggggagcgggcgacucuuguagacagggggcuuggacacugguuagcaaccccuucugcccugagcccuccccuccccaagauccguuucugcccagcgccccugcccccguggcuugggcccauggccggcgccagggacucggcccuauccacucuagaaccaaucugauggacacggaacuuauggaugcugacuccgacuucuga

SEQ ID NO: 75989 - RNA, 1668 nt, Artificial Sequence
  derived and/or modified sequence opt5 from SMOX__Homo_sapiens__NP_787033
augcagagcugcgaguccucuggcgacagcgccgaugacccccuguccagagggcuccggcgcagaggacaaccucggguggucguuaucggcgcugggcuggccggacuugcggcugccaaggcccugcucgaacagggcuucaccgaugugacagugcuggaggcuucuagccacauugggggacgcguccaguccgugaaacuuggccaugccacguuugaacugggcgcuaccuggauccacgggucucauggaaacccgauuuaccaccucgccgaggcgaauggccugcuggaagagacaaccgacggggagagaagcguuggacggaucucccucuauagcaagaacggcguggccuguuaccugacaaaucaugggcgccggauucccaaagaugucguggaagaguucucugaccuuuauaacgaaguuuacaaucugacccaggaguuuuucagacacgauaagccugugaacgcugagucccaaaauagcgucggaguguuuacacgcgaagaggugagaaaccggauccgcaaugaccccgaugacccugaagccaccaaaagacucaagcuggcuaugauccagcaguaucuuaaggucgagucuugcgaauccagcucucacuccauggaugagguuagccuguccgccuucggcgaguggacggaaauucccggcgcgcaucacaucauuccuucuggguuuaugcgggugguggagcuccuggccgaaggaaucccggcucaugucauucagcugggcaaacccgugcgcuguauccacugggaccaagccagcgcuagaccucgggggcccgagauugaaccuagaggagagggcgaucacaaccaugacaccggggagggaggccagggcggggaagaaccccgcggaggccggugggacgaagaugagcagugguccguuguggucgaaugcgaggacugugagcucaucccggccgaucacgugaucguuacagugagccuggggguccuuaagagacaguacaccucuuucuuucgcccuggacugcccacagaaaaaguggccgcuauucaucggcucggcaucgggaccacggacaagauuuuccuggaguuugaggagccuuucuggggccccgagugcaauucccuucaauuugucugggaagaugaggcggaaagccacacacugaccuaucccccugagcucugguacagaaaaaucuguggauucgacgugcuguacccgcccgaacgcuauggccauguucugucuggguggauuugcggagaggaggcccucgugauggaaaagugugaugacgaggcugucgccgaaaucugcacagagaugcugcggcaguucaccggcaacccuaauauccccaagccuagacgcauucuucggagcgccuggggguccaaccccuacuuuagaggaucuuauagcuacacccaggugggcuccagcggggcugauguugaaaaacuggccaagccgcucccuuauacagagucuuccaaaacggcgcccaugcaagugcuguucagcggcgaggcuacccaccgcaaguacuauucuacaacccacggagcccuucuguccggccagcgggaagccgcuagacucaucgagauguaccgggaccuguuucagcaggggacauga

SEQ ID NO: 75990 - RNA, 1896 nt, Artificial Sequence
  derived and/or modified sequence opt5 from SMPD1__Homo_sapiens__NP_000534
augcccagauacggcgccagccugcggcaguccugcccucgcucugggagagagcaaggacaggacggcaccgcuggggccccgggacuccuguggaugggccuugugcuggcgcucgcucuggcccuugcccuggcucucgcccugagcgauucccggguccugugggcucccgccgaagcgcacccucucucuccccaggggcauccugcccgccugcacagaaucguuccccggcuucgcgacguguucggauggggcaaccugacauguccuauuugcaagggccucuuuacggcuaucaaucuggggcuuaaaaaggagccgaacguggccagagucggaagcguggcuauuaaacuguguaaucuccugaagaucgcgcccccugccguuugccaguccauugugcaucuguucgaagaugacauggucgagguguggcggcgcucuguucucagccccuccgaagccuguggccugcuucuggggucuaccugcggacacugggauaucuuuagcuccuggaacaucagccucccuacagugcccaaaccgccucccaagccucccucucccccugcuccgggcgcccccgucuccagaauccuguuccuuaccgaccugcauugggaucacgacuaucucgaggggacagauccugacugugcugauccccugugcugucggcgcggaagcggccugccucccgccucuagaccgggcgccggguacuggggagaguauuccaagugcgaccucccucugcggacccuugaaagccugcucuccggccuggggcccgcuggaccuuuugauaugguguacuggacaggcgacauccccgcgcacgacguguggcaucaaacccgccaggaucagcuuagagcccugacgaccgucacagcucucguucggaaauuccuggggccugugcccguguauccggccgucggaaaucacgagucuaccccugugaacagcuuucccccucccuucauugaaggcaaucauuccagcagauggcuguacgaggccauggcuaaggccugggagccguggcuccccgcggaagcucugcgcacacuucggaucggcggguuuuaugcccugucuccuuaccccggacucagacugauuucccugaacaugaauuucuguagccgcgagaacuuuuggcuucucaucaauucuaccgacccugccggccagcugcaauggcugguuggggaacuccaggcugccgaggaucggggagacaaagugcacauuaucggccacauucccccugggcauugccuuaagagcugguccuggaacuacuauagaauugucgcucgcuacgaaaauacgcuugccgcgcaguucuuuggccacacacauguggaugaguucgagguuuucuaugacgaagagacccugucucggccccucgccguggcuuuucuggccccgagcgcuacaaccuacaucggacugaacccuggcuauagagucuaccagauugaugggaauuauuccggaagcucucacgugguccuugaccaugaaaccuacauccucaaccugacacaagccaacauucccggcgcgaucccucacuggcagcugcucuaccgcgcccgggagacguaugggcugcccaauacccuuccgacagcuuggcacaaccugguguacagaaugcgcggagauaugcaacucuuccagaccuuuugguuccuguaucauaaaggccacccucccuccgaaccuugcgggacacccugucggcuggccacccuuugcgcucagcucagcgccagagccgacucucccgcucugugucggcaucugaugccugauggcucccucccggaggcgcagagccuguggccccgcccucuguuuugcuga

SEQ ID NO: 75991 - RNA, 1272 nt, Artificial Sequence
  derived and/or modified sequence opt5 from SMPD2__Homo_sapiens__NP_003071
augaagcccaacuucagccugagacuccggaucuuuaaucugaacugcuggggcauuccuuaccuuuccaaacaccgcgccgacagaaugcggcgccugggggauuuccucaaucaggagucuuuugaccuggcccuucuggaagagguguggagcgaacaagauuuccaguaucucagacagaagcuguccccgaccuaccccgcugcgcaucacuuucggucuggaaucauuggcagcgggcugugugucuucuccaaacauccuauccaggagcucacacaacacauuuauacgcugaacggauaccccuauaugauccaucacggcgacugguuuucugggaaggcuguuggacuucuggugcuccaccugagcggcauggugcuuaaugccuacgucacccaucugcacgccgaauauaaccgccagaaagauaucuaccucgcucauagaguggcccaggcuugggagcuggcccaguucauucaccacacauccaagaaggcggacguugugcugcucugcggcgaucugaauaugcauccugaggaccuuggguguugccugcucaaagaauggaccggacugcacgaugccuaccuugagacacgggacuuuaagggcagcgaagaggggaacaccaugguccccaaaaauuguuaugugucucaacaggagcugaagccuuucccguuuggaguucgcaucgauuacgugcucuauaaagcugucuccggcuucuacauuagcugcaagucuuuugaaacaaccacgggguucgacccccauagaggaaccccucuguccgaucacgaggcccugauggcuacacucuucgugcggcauucucccccucagcagaaccccagcuccacccacggcccggccgaacgcagcccucugaugugugugcuuaaggaggcguggacagaacugggccucgggauggcccaagcuagauggugggccaccuuugcuuccuaugucaucggacugggccuucugcuccuggcccugcucugcguucuggccgcugggggaggcgcgggggaggccgcuauucuucuguggacgcccucugugggacucgugcugugggccggcgccuucuaccuguuucacguccaggaggugaauggccuuuaucgggcucaggccgaacuccaacauguucuggggcgcgcgagagaggcucaggaccugggaccugaaccccagcccgcccuccugcuuggccagcaagagggggaccggacaaaagaacaguga

SEQ ID NO: 75992 - RNA, 1968 nt, Artificial Sequence
  derived and/or modified sequence opt5 from SMPD3__Homo_sapiens__NP_061137
auggugcuguacaccacacccuucccuaacagcugccucuccgcccugcacugugucucuugggcucuuaucuuuccgugcuauuggcugguugacagacucgccgcgagcuucauucccacgaccuacgaaaagcggcagcgcgcugaugacccuuguugccugcaacuucuguguacagcccucuuuacccccaucuaucuggcccugcucguggcuucccugccuuucgccuuucuuggcuuccuguuuuggucuccccuccagagcgcuagacggccuuacauuuauucccgccuggaagauaaagggcuugccggaggcgcggcccugcucucugaguggaaggggacaggaccgggcaagagcuucugcuuugcuaccgccaaugugugucugcugcccgacucccucgcuagagucaacaaucuguucaacacacaggcccgggcgaaggaaaucgggcagcgcauuagaaauggagccgcucggccucaaaucaaaaucuacauugauagccccaccaacacgucuaucuccgccgcuagcuuuucuucccuugugagcccucagggcggcgacgggguugcccgcgccgugcccggaucuauuaagagaaccgcuuccgucgaguauaagggcgaugggggacggcauccgggcgacgaagcggccaaugggccugcuagcggagaucccguggacuccucuagcccugaggaugccugcaucguucgcauuggcggcgaggaagggggaagaccucccgaggccgacgaucccgugccgggcgggcaggcucggaacggagccggcgggggaccccgcggccagacaccuaaucacaaccaacaggacggcgacuccgggagccugggaucucccuccgcgagcagagaaucucucgucaaaggccgggcugggccugauaccagcgccuccggagagcccggcgccaauucuaagcugcuuuacaaagcuagcguggugaagaaagccgcugccagacgccggagacauccggacgaggcguucgaucacgaagucuccgccuuuuucccugcuaaccuggacuuccucugucugcaggagguuuuugauaagcgcgccgcuacaaagcugaaagaacagcuccauggguacuucgaguauauccuguacgacgugggcguguauggaugccaaggcuguugcagcuuuaagugccuuaauucugggcuccuguucgccucccgguaccccauuauggaugucgcguaucacuguuacccuaacaaaugcaaugacgaugcccuggcuagcaagggagcccuuuuucugaaagugcagguuggcucuacgccccaggaccaaagaaucgugggguauaucgcuuguacccaccuccaugccccucaggaagauuccgccauucgcugcggacagcuggaccugcuccaggacuggcuggcugauuuccggaaaagcacauccucuagcuccgcggccaaccccgaggagcuugucgcuuuugacgugguuuguggcgauuucaacuuugacaauugcucuagcgaugacaaacuggaacaacagcacucccucuucacccauuacagagauccgugucgccuggggccuggcgaggaaaagcccugggccaucggaacacugcuugacaccaacggccucuacgaugaggacgugugcacccccgauaaucugcagaagguccuggaaagcgaggaggggcggagagaauaucucgccuuuccuacaucuaaauccagcggacagaagggccgcaaagagcugcuuaaggggaacggacggagaauugacuacaugcugcacgcugaagagggccucuguccggauuggaaagccgaaguggaggaguucucuuuuaucacgcaacuguccgggcugaccgaccaccuucccgucgcgaugcggcucauggugagcucuggcgaagaggaggcuuga

SEQ ID NO: 75993 - RNA, 969 nt, Artificial Sequence
  derived and/or modified sequence opt5 from SMPDL3A__Homo_sapiens__NP_001273067
augaccacaacgauccagagccuguuccccaaccuccaaguguuuccugcccugggcaaucacgacuacuggccgcaggaucagcuucccgucguuaccuccaagguguauaacgcuguggccaaucuguggaaaccuuggcucgacgaggaagcgauuucuacacugagaaagggaggauucuacagccagaaagucaccacaaaccccaaucuucggaucauuucccugaacaccaaucucuauuacggcccuaacaucaugacacugaauaagaccgaucccgcuaaccaauuugaguggcuggaaucuacgcucaauaacagccagcagaauaaagagaagguguauauuaucgcccauguuccugugggguaccugccguccucucagaacaucaccgccaugcgcgaauauuacaaugagaaacuuauugacaucuuccaaaaguacagcgaugucauugcuggacaguuuuauggccacacacauagagacuccaucauggugcugagcgauaagaaagggucucccguuaacucccucuucguggccccugcugucacccccgucaagagcgugcuggagaaacagacaaacaauccugggauucggcuuuuucaguacgacccccgcgauuauaagcugcucgacaugcugcaauacuaucugaaccucaccgaagccaaucugaagggcgagucuaucuggaaacuugaauacauucugacgcagacauaugauaucgaggaccuccagccggagucccuguacggccuugcgaagcaauucaccauccuggauagcaaacaguuuauuaaguacuauaacuacuucuuugugucuuaugacuccagcguuacaugcgacaaaaccuguaaggccuuccagaucugcgcuauuaugaaucucgauaacaucuccuacgccgacugucugaaacagcuguauauuaagcacaauuacuga

SEQ ID NO: 75994 - RNA, 1458 nt, Artificial Sequence
  derived and/or modified sequence opt5 from SMPDL3B__Homo_sapiens__XP_011539561
augagacugcucgccuggcugaucuuccuugcuaacuggggcggggcccgggcggaacccgaagaggcucagggaccuugcgcccaagaaaagggcaaagggccgcccccuaccagcauucuggccucccucgcucccggacuggaggccggcaaguuuuggcacaucgcugaccuucaucuggauccugacuacaaagugucuaaggaucccuuccaggucuguccuagcgccgggucccagccgguucccgacgcgggaccuuggggcgauuaucucugcgacucucccugggcccugauuaauagcuccaucuacgcuaugaaagaaauugagccugagcccgauuuuauccuguggacaggcgacgauacgccgcacgugccugacgaaaagcucggggaggccgcugugcuggaaaucgucgagcgccuuaccaagcugauuagagagguguuccccgauacaaaaguuuaugccgcgcucggaaaccaugacuuucacccuaagaaucaguuccccgccggcucuaacaauaucuacaaccaaauugcugaacuguggaaacccuggcuuagcaaugaguccaucgcccuguuuaagaaaggggcuuucuauugugaaaagcucccuggaccgagcggcgccgggcggauugugguccugaacaccaaucuguacuauacaucuaacgcccucaccgcugauauggcggaccccggacagcaguuucaguggcuggaggacgugcuuacagaugccuccaaggcuggcgacaugguuuacaucgugggccaugucccucccggguucuuugagaaaacccaaaauaaggccugguuccgcgaaggauuuaacgagaaauaccugaagguggugagaaaacaccaccgggucauugccggccaguucuucgggcaucaccauacggauagcuuucgcaugcucuaugacgaugcuggaguuccuaucucugccauguucaucacccccggcgugacaccguggaagaccacacugccugggguggucaauggagcgaacaaucccgcuauuagaguguuugaauacgaccgggccacccuuucccugaaagauaugguuacguauuucaugaaccucagccaggccaacgcucagggcacaccucgcugggagcuggaauaccaacugaccgaggccuauggcgugcccgacgcuucugcccacuccaugcacacaguccucgauagaaucgcgggggaccagagcacccugcagcgguacuauguguacaauuccguuucuuacagcgccggagugugcgaugaggcuuguuccaugcaacaugucugcgccaugcgccagguggacauugacgcuuauaccacaugucuuuacgccagcggcacgaccccugucccccagcugccgcuccugcuuauggcgcugcucgggcugugcacacuggugcucuga

SEQ ID NO: 75995 - RNA, 267 nt, Artificial Sequence
  derived and/or modified sequence opt5 from SMPX__Homo_sapiens__NP_055147
augaacaugagcaagcagcccguguccaaugucagagccauccaagcuaacauuaauaucccuaugggcgccuuccggccgggggcgggacagcccccucgcagaaaagagugcacccccgaaguugaggaaggcgugccucccacaucugacgaggaaaagaaaccuauuccgggggcuaagaaacugcccggaccugccgugaaccucagcgagauccagaauauuaaguccgagcugaaguacguccccaaagccgaacaguga

SEQ ID NO: 75996 - RNA, 240 nt, Artificial Sequence
  derived and/or modified sequence opt5 from SMR3B__Homo_sapiens__NP_006676
augaagucccugaccuggauccucggccugugggcccuugcugccugcuucacacccggggagagccagagaggaccucggggcccguaucccccugggccccuggcgccuccccaaccuuuuggaccgggcuucgugcccccucccccucccccgccuuacgggcccggacgcauuccucccccucccccggcucccuacggcccuggcaucuuucccccucccccgccucagcccuga

SEQ ID NO: 75997 - RNA, 942 nt, Artificial Sequence
  derived and/or modified sequence opt5 from SMS__Homo_sapiens__NP_001245352
auggccgcugccagacacagcacccuggacuucaugcucggcgcgaaggcugauggggagacaauccugaaaggacuucaguccauuuuucaagaacagggcauggccgagucugugcauacguggcaggaccacggguaccuggccaccuauacaaacaagaauggacggcugcccccuaucguccgcggcggggcuauugauagauacuggccgaccgccgacggacggcugguugaauaugauaucgacgaggugguguacgaugaagacagccccuaucagaacauuaaaauccuucauuccaagcaauucggcaauauccugauucucucuggcgaugucaaccuggcugagagcgaccuggccuacacacgcgcgaucaugggguccggaaaagaggauuauaccggcaaggacgugcucauucucgggggaggcgaugggggaauccuuugcgaaauuguuaagcugaaaccuaagauggugacaauggucgagaucgaccagauggugauugacggcuguaaaaaguacaugagaaaaaccugcggcgauguucucgacaaucugaagggggauuguuaccaggugcuuaucgaagacugcauccccguccugaagcgguaugccaaagagggacgcgaguuugauuacgugauuaacgaccucacggcugugccuaucucuaccagccccgaagaggauuccacaugggaguuccugagacugauucucgaccugagcaugaagguccuuaaacaggauggcaaguauuuuacccaagggaauuguguuaaccugacagaggcccucucucuguacgaagaacagcuuggacggcuguauugcccuguggaguucuccaaagaaaucgugugugucccgagcuaccucgagcuguggguguuuuauaccguuuggaagaaagcuaagcccuga

SEQ ID NO: 75998 - RNA, 2754 nt, Artificial Sequence
  derived and/or modified sequence opt5 from SMTN__Homo_sapiens__NP_008863
auggccgacgaggcucuggccggccucgaugaaggggcgcugagaaaacuucuggaggugaccgcugaccucgccgaacggcgcagaauccggagcgccauucgcgagcugcagagacaagaacuugagcgggaggaagaggcucuggccuccaagcgcuucagagcugaacggcaggauaacaaggagaauuggcuccacucucagcagcgcgaggccgaacaaagagcggcccuggcucggcuggccggacagcucgagagcaugaacgacgucgaggaacugacagcccuucugcgcuccgccggcgaauacgaggagagaaaacucauccgggcggccauucgcagaguucgggcucaggaaaucgaggccgcuacgcuggccgggagacuuuauucuggacgccccaauagcggcucccgggaagauucuaaggggcuggccgcucauagacucgagcagugcgaagugccugagcgcgaggaacaagagcagcaggcggaagugagcaaaccgacccccacaccugagggaaccucccaggacgucacaaccgugacacugcugcuccgggcucccccuggcagcaccucuuccagccccgcuucuccuuccagcucuccgacgcccgccuccccugaacccccucuggagcccgccgaggcucaaugucuuaccgccgaaguuccgggcagcccugagcccccucccagcccucccaagacaaccucuccggaaccccaggagagcccuacacugcccuccaccgagggacagguggucaacaagcuccugagcgggccuaaagaaacgcccgcggcucaaucuccgacaagaggcccuuccgauaccaagcgcgccgacguggccgggccccggccuugccagagaagccuuucuguucugagcccccgccagccugcucagaaucgggaguccacaccccucgccucuggaccgagcuccuuucaaagagcuggcagcgugcgcgaucggguccacaaauucaccucugacuccccuauggccgcgagacugcaggaugggacaccccaggccgcucugagcccccucaccccugcccggcugcuuggaccgucucugacguccaccacacccgcuagcuccucuagcggcuccucuagccgcggcccuuccgacaccagcucuagauuuuccaaggaacagagagggguggcccaaccccucgcgcagcugcggagcuguccucaggaggaaggaccccgcggccgggggcuugccgcuagaccucuggagaaccgcgccggaggccccguggcuagaucugaggaaccgggggccccucuccccgucgccguuggaacagcugagccuggcggcuccaugaaaaccacguucacaauugaaaucaaggaugggcggggacaggcgagcaccggccgcgugcugcugcccaccgggaaucaaagagccgagcucacacugggacuucgggcuccgccuacccugcucucuacaagcuccggcggcaagagcacgaucacccgcgugaacucucccgggacacuggccagacugggauccgucacccaugugaccagcuuuucccacgccccucccucuagccggggcgggugcuccauuaaaauggaagcugagcccgccgagccucuugcggcugccguugaagccgcuaauggagccgagcagacacgcgugaacaaggcgccggaaggcagaucuccccucagcgcugaggaacugaugacgaucgaggacgaggggguccuggacaaaaugcucgaucaguccaccgacuucgaggaacggaagcugauucgcgccgcccuuagagaacugcggcagagaaaacgcgaucaacgggacaaggagagagagcgccggcuccaggaagcuagaggacgcccuggcgaggggcggggcaauacagccaccgaaacaaccacgagacauucucagcgcgcugccgauggaagcgcgguguccacaguuaccaaaacagagcggcuggugcacagcaacgacggcaccagaaccgcccggacaacgaccgucgaaucuuccuuugugcgcagaagcgagaaugggucuggauccacaaugaugcaaaccaagacauucuccucuuccagcuccagcaagaaaaugggcucuaucuuugaucgggaggaccaggcuagcccccgcgccgggucccuggcugcccuugaaaagagacaggccgagaaaaagaaagaacucaugaaggcucagucucugccuaagaccagcgcgucccaagcccggaaagcuaugauugagaagcuggaaaaagagggagccgccggcucucccgggggcccuagagcugccguccagcgcagcacguccuucggagugccgaacgcuaauucuaucaagcagaugcuccuggauuggugucgggcuaaaacaagaggcuacgagcacguugacauucagaacuuuagcuccagcuggucugaugggauggccuucugcgcccuugugcauaacuuuuuccccgaagcguucgacuauggacaacuguccccucagaaucgccggcagaacuuugaggucgccuucagcucugcggaaaugcucguggacuguguuccccugguggaggucgaugacaugaugaucaugggcaagaagccugaucccaaaugcguguuuaccuacgugcagucccuguauaaucaccuuagacgccaugaacuccggcugagagggaagaacguuuga

SEQ ID NO: 75999 - RNA, 1485 nt, Artificial Sequence
  derived and/or modified sequence opt5 from SMTNL1__Homo_sapiens__NP_001099035
auggagcagaaggaaggcaaacugagcgaggacgggaccacagugucccccgccgcugauaacccugaaaugucuggaggcggggccccggcggaggaaacgaagggaaccgcuggcaaagccaucaaugaggggcccccuacagagagcggaaagcaagaaaaagcccccgcugaggacggcauguccgccgaacuccagggcgaggcuaacgggcuggaugaggucaagguugaaucucagagagaggccggaggcaaggaagacgcggaggccgaacuuaaaaaggaggauggggagaaagaagagaccacagugggaagccaggaaaugaccggccggaaggaggaaacaaaauccgagccuaaggaggcugaagagaaggaaucuacccuggccagcgagaaacaaaaggcugaagagaaagaggccaagcccgaauccgggcagaaagcggacgccaaugaucgcgacaagccugagccgaaagcuacgguggaagaggaggaugccaagaccgcuagccaggaagagacaggacagagaaaggaaugcucuaccgagcccaaagaaaaggccacagacgaggaggccaaagcugaaucccaaaaggcggucguggaggaugaagccaaagcugagccuaaggaacccgacggcaaggaggaggccaaacacggcgccaaggaagaggcugaugccaaagaagaggcggaagacgcugaggaggccgaaccugggagccccucugaggaacaggagcaggacguugagaaggaaccggagggaggcgccggggugauuccuuccagccccgaagaguggccugaaucucccaccggagagggccauaaccucuccacggaugggcugggacccgacugugucgcuagcggccagacauccccuucugccagcgaguccagcccgucugaugugccccaauccccucccgaaagcccuucuagcggcgagaaaaaggaaaaggcucccgagcggcgcguuuccgccccggcgagaccucgggggccccgcgcccagaauagaaaagcuaucguggacaaguucggaggcgccgcuucugggccuaccgcccuuuuucggaacacaaaagcggccggagcugccauuggcggggucaagaauaugcugcucgaauggugccgcgcuaugaccaaaaaguacgagcacguggauauccagaacuucagcuccagcuggucuuccggcauggccuuuugugcccugauucauaaguucuuucccgacgcuuucgauuaugcggagcuggacccugccaaaagacggcacaauuuuacccucgcuuucagcacagccgaaaagcuggccgauugcgcucaacuucuggacguggaugacaugguccgccucgccguucccgacucuaaauguguguacacguauauccaggagcuguacagaucccuugugcagaagggacuggucaaaaccaagaaaaaguga

SEQ ID NO: 76000 - RNA, 1542 nt, Artificial Sequence
  derived and/or modified sequence opt5 from SMU1__Homo_sapiens__NP_060695
augagcaucgagauugaauccucugacgugaucagacugauuaugcaguaccucaaggagaacagccugcaccgggcccuugcuacccugcaagaagagacaacggucucccucaauaccguugauucuaucgagagcuucguggccgacauuaacuccggccauugggauacagugcugcaggcgauccagucucuuaaacugcccgacaagacccucaucgaucuguaugaacaggucgugcuggagcucauugaacugcgcgagcuuggggcugccagaagccugcuccggcaaacagacccuaugaucaugcugaaacagacccagccggaacgcuacauucaccuugagaaucugcucgccagauccuauuuugauccccgggaggcuuacccugacggaagcucuaaggaaaaacgcagagccgcuaucgcccaggcgcuggccggcgagguuuccguggugcccccuagccggcugauggcucuccuggggcaagcccuuaaguggcagcagcaucagggacugcugcccccuggcaugacaauugaucuguuccgcgggaaggcugccgugaaagacguugaagaggaaaaguuuccgacccaacuuucuagacacaucaaauucggacagaagucccauguggagugcgcgcgguuuagccccgauggccaguaucuggucacgggcucuguggacggguucauugagguguggaacuuuaccacaggaaaaauccgcaaggaucucaaguaccaagcccaggacaauuucaugaugauggacgaugcuguccuguguaugugcuuuuccagagacaccgaaaugcuggccacaggcgcucaggaugggaaaaucaagguuuggaaaauucagagcggacaaugucuccggcgcuucgagagagcccacuccaagggcgugaccugccugucuuuuagcaaagacuccagccagauccuuucugccuccuucgaucagacgauucggauccacgggcucaagagcggaaaaacacucaaggaauuuagaggccauucuagcuucgugaacgaggcuaccuucacacaggacggccacuauauuaucuccgcgucuagcgaugggaccgucaagaucuggaauaugaaaaccacagaauguuccaacacguuuaagagccugggaucuaccgccggcacagacauuaccgucaauuccguuauccuucugccuaaaaaccccgagcauuucguggucugcaaucgcagcaacacagugguuauuaugaauaugcaagggcagaucgugcggucuuuuuccagcggaaagagagagggcggggauuucgucuguugcgcucucuccccucgcggagaauggauuuacugugugggcgaggacuuuguccuguacugcuucucuaccgugacgggcaaacuggaacggacacucaccguucacgagaaggaugugaucgggaucgcccaccauccccaccagaaccugauugccaccuauagcgaagacggacuucugaagcucuggaaaccguga

SEQ ID NO: 76001 - RNA, 534 nt, Artificial Sequence
  derived and/or modified sequence opt5 from SMUG1__Homo_sapiens__XP_006719385
augccccaggccuuccugcucggcagcauccacgagccugcuggggcccugauggaaccgcaacccugcccuggaucccuugcggagucuuuucuggaagaggaacucagacugaacgcugagcuuagccagcugcaguucuccgagcccgugggcauuaucuacaauccugucgaauaugccugggagccccaucggaacuacguuacccgcuauugucaggggccuaaggaagugcucuuucugggaaugaauccgggccccuucgggauggcccaaacaggagugccuuuuggcgaggucucuauggugagagacuggcugggcauuguugggcccgugcucacgccuccccaggagcacccgaaacggccuguccugggacuugaaugcccccagagcgagggcccucgccaguccauggggcaugaaaucaagucugagcugcucaugggaggcuguagcuggauuagagggaaaauccaaugcgaucgggugcagguucgcagacccggauucuccagccagcuguga

SEQ ID NO: 76002 - RNA, 2274 nt, Artificial Sequence
  derived and/or modified sequence opt5 from SMURF1__Homo_sapiens__NP_065162
augagcaaccccggcaccagacggaauggguccucuaucaagauccgccugacagugcucugcgccaaaaaccuggcuaagaaagacuucuuuagacuuccugauccguucgccaagaucgucguugacggaagcggccagugucacuccacggauaccgugaaaaauacacuggaccccaaguggaaccaacauuacgaucucuauguggggaagaccgacucuauuacaaucagcgucuggaaucacaaaaagauucauaaaaagcagggagcgggcuuucuggggugcgugcggcuucuguccaacgcuaucucucgccucaaagauaccggauaccagagacuggaccuguguaagcucaauccuagcgauacagacgccguucggggccagaucguggucucccugcaaacccgcgauagaauuggcaccgggggaagcgugguugacugccggggccuucuggagaacgaagggacgguguaugaggauucuggacccggccgcccucucuccuguuucauggaggaacccgccccuuacacagacagcaccggggcugccgcuggaggcggcaauugcagauuugucgaaucuccgucccaggaccagcggcugcaggcccaacgccuuagaaaccccgaugugcgggggagccugcagacaccucagaaucgcccccacggacaucagucuccugagcuccccgagggcuaugaacaaagaaccacggugcaggggcaggucuacuuccugcacacacaaaccggaguuuccacauggcacgacccgcggaucccuagccccuccggcaccauuccugggggagaugcggccuuucuguaugaguuccuccugcagggccauaccucugaacccagagaccuuaacagcgugaauugugaugagcugggcccccucccuccggggugggaggugcgcuccacagucagcggacggaucuacuuuguggaccacaacaauagaacgacccaguucacagauccccgccugcaucacauuaugaaccaccagugccaacuuaaggaaccuucucagccccugccucuccccuccgagggcagccuggaagacgaggaacugccggcucagcgguacgagagagaucucguucagaaacugaaggugcuucgccaugagcugucucuccaacagccucaggccgggcacugucggaucgaagucagcagagaggaaauuuuugaggaauccuaucgccagaucaugaaaaugcggcccaaggaccugaaaaagagacuuauggugaaauuccgcggagaggagggccuggauuacgggggcguugcucgggaauggcucuaucugcugugccaugagaugcucaacccuuacuauggacuguuucaauacucuaccgacaauaucuauaugcuucagauuaaccccgacagcuccaucaauccugaucaccugagcuacuuccauuucgugggcagaauuauggggcucgccgucuuucacggacacuacaucaacggcggguucacagugcccuuuuauaagcagcugcugggaaagccgauucagcuuucugaccucgaauccgucgauccugagcugcauaaaagccugguguggauccucgaaaaugacaucacccccguucuggaucacacguucuguguggagcauaacgcguuuggccggauucuucaacacgagcugaagcccaaugggcgcaacgucccugugacagaagagaauaaaaaggaauacguuagacucuaugugaacuggcgguucaugagaggcaucgaggcccaguuucuggcucugcagaaaggauucaaugagcuuauuccgcaacaccuccugaagcccuuugaccagaaggaacuggagcucaucauuggcgggcuggauaaaaucgaccuuaacgauuggaagucuaauacccgccugaaacauugcgucgccgacuccaacaucgugcggugguucuggcaggcuguggaaaccuuugaugaggaaagacgcgccagacuccugcaguucguuacaggaagcacccgggucccucugcaaggcuuuaaggcccuucagggguccacaggagcugcgggcccccgccucuucacgauucaccugaucgacgccaauaccgauaaccugccuaaagcucauacaugcuucaacagaauugacauucccccuuacgagucuuaugagaagcucuacgaaaagcugcuuaccgccguggaggaaacauguggguuugccguggaguga

SEQ ID NO: 76003 - RNA, 2247 nt, Artificial Sequence
  derived and/or modified sequence opt5 from SMURF2__Homo_sapiens__NP_073576
augagcaaccccggcgggagacggaauggaccugugaagcugcgccucaccguccugugcgccaagaaccuuguuaagaaagacuucuuuagacugccggaucccuucgcuaaggugguggucgacggcuccgggcagugucacucuacagauacggugaaaaauacccucgacccuaaguggaaccaacauuacgaucuguauaucggaaagagcgacuccguuacaauuucuguguggaaucacaaaaagauccauaaaaagcagggcgccggguuucuuggaugcguccggcugcucagcaacgcgauuaaucgccugaaagauaccggcuaccagagacuggaccucuguaagcugggccccaacgauaaugacacagugcgggggcagaucguugugucccuucaaucucgcgauagaauuggaaccggcgggcaggucguggacugcagccggcuguucgauaacgaccucccugacggaugggaggaacgcagaacagcuuccggccggauccaguaucugaaucacaucacccgcacgacccagugggagagacccacacggccugccagcgaauacucuuccccggggcgcccccuuagcuguuuuguggaugagaacaccccuauuucuggaacaaauggcgcuaccugcggccaauccagcgaccccagacuggccgaacggagaguccgcucucagcggcauagaaacuauaugucccgcacgcaccuccacacaccucccgaucugccggagggguacgagcagcggaccacacagcaaggacagguuuauuuccugcauacccagaccggcgugagcacauggcacgacccuagagugccccgcgaucucuccaauaucaacugugaagaacuggggccucuuccucccggaugggaaauucggaacacggccaccggcagagucuacuuuguggaccauaauaaccgcacaacccaauucacagauccccggcugucugcuaaucuccaccugguucuuaacagacagaaucagcugaaggaccagcaacagcaacagguggucagccucugcccggaugacaccgagugucugacggugccccgcuacaaacgggaucugguucagaagcucaaaauccugagacaggagcuuucccagcagcaaccucaggccgggcacugccggauugaagugagccgcgaggaaaucuuugaggaaucuuauagacaggucaugaagaugcggcccaaagaccuguggaagagacucaugauuaaauuccgcggagaggagggccuggacuacggcgggguggcgcgggaauggcuuuaucugcucucccaugagaugcugaacccuuacuauggacuguuucaguacagcagagaugacaucuauacacuccaaaucaaucccgauucugccgucaacccggaacaccugagcuacuuccauuuugugggccgcauuauggggauggcuguuuuccacggacauuacaucgacggcggguucacccuuccuuuuuauaagcagcugcucggcaaguccauuacccuggaugacauggagcugguggaucccgaccuucacaauucucucgucuggauccuggaaaacgauauuacaggagugcuggaccacaccuucuguguugagcauaaugccuacggcgagaucauccagcacgaacucaaaccuaacggaaagagcauucccgugaaugaggaaaacaaaaaggaguaugucagacuguacgugaauuggcgguuucuucgcgggaucgaagcucaauuccuggcccuccagaaaggcuuuaacgaggugauuccucagcaucugcugaagacauucgaugagaaggaacuugagcucaucauuugcgggcugggaaaaaucgacguuaacgauuggaaggucaauacgagacugaaacacugcacccccgacuccaacaucgugaagugguuuuggaaagcgguggaguucuuugacgaggagcggcgcgccagacuccugcaguucgucacaggcagcucucgggugccgcuucaaggguuuaaggcucugcagggcgccgcuggaccucgccucuucaccauucaccagaucgaugccuguacaaauaaccugcccaaggcccauaccugcuuuaauagaauugacauucccccuuaugaauccuacgagaaacuguaugaaaaacuucucacggcuaucgaggaaaccuguggcuucgcgguugaguga

SEQ ID NO: 76004 - RNA, 1473 nt, Artificial Sequence
  derived and/or modified sequence opt5 from SMYD1__Homo_sapiens__NP_938015
augaccaucggcagaauggagaacguggaagucuucacagccgaggggaagggacggggccugaaagcuacgaaggaauuuugggccgcggacauuaucuucgcugagcgcgccuacagcgccguuguguuugauucccucgugaauuucgucugccacaccuguuuuaaaagacaggaaaagcugcaucggugcgggcaauguaaauucgcucacuauugcgaccgcacaugucagaaggaugccuggcuuaaccauaagaaugagugcucugcuauuaaaagauacggaaaggugcccaacgagaauauccggcuggccgcgcgcauuauguggagaguugaacgggagggcaccgggcucacagaaggaugucuggugagcgucgacgaucuucagaaccacguggagcauuuuggcgaggaggaacagaaagaccugcgcguugauguggacaccuuccuccaauauuggccuccgcagucccagcaguuuucuaugcaauacaucagccacaucuucggcgucauuaauugcaacggguuuacacuguccgaucagagaggacugcaggccgugggcguggggaucuuccccaaucucggacuggucaaccacgacuguuggccuaauugcaccguuauuuuuaacaauggcaaccaugaagcugugaagucuauguuccacacgcagaugcggaucgagcuucgcgcccuggggaaaauuagcgaaggagaggagcucaccguguccuauaucgauuuccugaaugucagcgaagagagaaagcggcaacuuaagaaacaguacuauuuugacuguacaugcgaacauugccagaagaaacugaaggaugaccucuuccugggcgugaaagacaaccccaagccuucucaagagguugugaaagaaaugauucaguuuuccaaggauacccuggagaagaucgacaaagcucgcagcgagggccucuaccacgaagucgugaagcuguguagagagugccuugaaaaacaggagcccguuuucgccgauacaaacaucuacaugcugcggaugcucucuauuguguccgaaguccugagcuaucuucaggcguuugaggaggccucuuucuacgcuagacgcaugguggacggguauaugaagcuguaccacccuaauaacgcccaacucggaauggcugucaugcgggccggccugaccaauuggcaugccgggaacaucgaagugggacacggcaugauuuguaaggcuuaugcgauccugcucguuacgcaugggccgucccaccccauuacaaaagaucuggaggccaugagagugcagaccgaaauggagcuucgcauguuucggcagaaugaguucauguacuauaagaugagagaagcugcccugaacaaucagccuaugcaagucauggccgagcccagcaacgaaccuucccccgcucucuuucauaaaaagcaguga

SEQ ID NO: 76005 - RNA, 1302 nt, Artificial Sequence
  derived and/or modified sequence opt5 from SMYD2__Homo_sapiens__NP_064582
augagagccgagggccuugggggacucgaacgguucugcagccccggcaaggggcgcggacugagagcucugcagccuuuucaagugggcgaccuccuguucuccuguccggccuacgcguauguccugaccguuaacgagcgggggaaucacugcgaauacuguuuuacacgcaaagagggacuuucuaagugcggcagauguaaacaggcuuucuauugcaacguggaaugucagaaggaggauuggcccaugcauaaacuggagugcagcccuaugguggucuuuggcgaaaauuggaaccccuccgagacggugcggcucaccgcccgcauccuggccaagcagaagauucacccugaaagaacacccucugagaaacugcucgcuguuaaggaguucgaaagccaucuggacaaacuugauaaugagaagaaagaccugauccaauccgauauugccgcucuccaccauuuuuacucuaagcaccugggguucccugacaacgauagccuugugguccuguuugcccaggugaauuguaacggauucaccaucgaagacgaggaacucucccaccugggcagcgcgauuuuuccggauguugcccugaugaaucauucuugcugucccaacgugaucgucacauauaaggggacccucgcugaggugcgggccgugcaggagaucaaaccuggagaagaggucuucacauccuacauugaccugcuuuaucccaccgaagaucgcaaugacagacugcgggauagcuacuuuuucacgugcgagugccaggaauguaccacaaaggacaaagacaaggcuaaaguugagauccgcaagcucucugauccucccaaagccgaggcgauuagagacauggugcgguacgcccgcaacgugaucgaagaguucagacgggcuaagcacuauaaguccccgagcgaacugcuugagauuugcgaacugucucaagagaaaauguccagcgucuuugaggauuccaauguguacaugcuccauaugauguaucaggccaugggcguuugucuguacaugcaggacugggaaggggcucugcaguauggacaaaagaucauuaaaccuuacucuaagcacuauccccucuacagccugaacguggccuccauguggcuuaaacugggcagacucuacaugggccuggagcacaaggccgcuggggaaaaggcgcuuaaaaaggccaucgcuaucauggaggucgcccauggaaaagaucacccuuauauuagcgagaucaagcaggaaauugagucucauuga

SEQ ID NO: 76006 - RNA, 1287 nt, Artificial Sequence
  derived and/or modified sequence opt5 from SMYD3__Homo_sapiens__NP_001161212
auggagccccugaagguggaaaaguucgccaccgcuaagagaggcaacgggcuccgggccgucacaccucugcgcccgggagagcuucuguuuagaagcgacccccucgcguacacgguuugcaaaggcucccgcgggguggugugugaucggugccugcuuggaaaggaaaaacugaugagauguucucagugccgggucgcuaaguauuguagcgccaagugccagaaaaaggccuggccugaccacaaacgcgaguguaagugccucaaauccuguaagcccagauacccucccgauucugugcggcugcugggccgcguuguguucaagcucauggacggggcuccuagcgaauccgagaaacuguauucuuuuuacgaucuugagagcaauaucaacaagcugaccgaagacaaaaaggagggacucagacaacuggucaugacauuccagcauuuuaugcgggaagagauucaggaugccucccaacuuccgcccgcuuucgaccuguuugaggccuucgcgaaagugaucugcaauagcuuuaccauuuguaacgccgaaaugcaggagguuggcgugggccucuauccuucuaucucccugcugaaucacagcugcgaucccaacugcucuauugucuucaaugggccucaucuccugcuucgcgcugugagagacaucgaagugggagaggaacugacaaucuguuaccucgauaugcugaugaccuccgaggagcggcgcaagcagcuuagagaccaguauugcuuugaaugugauugcuuccggugucaaacacaggacaaagacgccgauaugcugaccggcgacgagcaggucuggaaggaaguucaggagagccucaagaaaauugaggaacugaaggcucacuggaaaugggagcaagugcuggccaugugccaggcgaucauuucuuccaacagcgaaagacuccccgauaucaauauuuaccagcugaaggugcuugacugugccauggaugcuugcaucaaccuggggcuccuggaggaagcccuguuuuacggaacgcgcaccauggagccguaucggauuuucuucccuggcucccaucccgucagaggggugcaaguuaugaaagugggaaaacuucagcuccaccagggcauguuuccucaggcuaugaagaaucugcgccuggccuucgacaucaugcgggucacacacggcagagaacauucucucaucgaggaucugauucuucugcucgaggaaugugacgccaacauccgcgcuagcuga

SEQ ID NO: 76007 - RNA, 2415 nt, Artificial Sequence
  derived and/or modified sequence opt5 from SMYD4__Homo_sapiens__NP_443160
auggaccugcccguggaugaguggaaaagcuaccuccugcagaagugggccucccuuccuaccucuguccaaguuacaaucagcacggcugaaacccugagagacauuuuccuccacuccucuagccugcuucagccggaggaugaacuguuucucaagcggcuguccaagggcuaucugguggggaaggacucugaugcgccccucuucuaccgcgaggaaggaaacaaaaaguuucaggagaaggacuauacaggcgccgcugugcuguacagcaaaggggucucccauagcagaccuaauaccgaggauaugucucuuugccacgccaaccgguccgccgcucuguuccaucucggacaguaugaaacaugucugaaggacaucaaucgcgcccaaacccacggcuaccccgagagacuucagccuaaaauuaugcugcggaaggcugaaugccucguggcccuggggcgccugcaggaggcgagccagacaaucucugaucucgagagaaacuuuaccgccacgcccgcucuggccgacguucuuccucaaacccugcagcggaaucuccaucgccugaaaaugaagaugcaggaaaaggauucccuuacagagagcuucccggcugcccuggcgaaaacccucgaagacgccgcucugagagaggaaaacgagcagcugucuaaugccuccagcuccauuggacucuguguggauccccugaagggccggugccuugucgcuacaaaagacauccugccuggcgagcuccuggugcaagaagacgccuuuguuucugugcuuaaccccggggagcugccucccccgcaccacggacucgauagcaagugggacacccgcgucacgaauggcgaucuguauugucauagaugccugaaacacacacucgccaccgugccuugugacgggugcuccuacgcuaaguacuguagccaggaaugccugcagcaagcgugggagcuuuaucaucggacagaauguccccugggaggccuccugcugacccuugggguguucugccacaucgcccuccgccugacccugcucgucggauuugaggauguuagaaaaauuaucacaaagcugugcgacaagauuucuaacaaagauaucugucuuccugaguccaauaaccaggugaagacgcugaauuacggccucggcgaaagcgagaaaaacgggaauauuguggaaacccccauccccggaugcgacauuaacggcaaguaugagaacaauuacaacgcugucuucaaucugcugccucacacagaaaaccauucuccggagcacaaauuucuuugugcccucugcgugagcgcccugugucggcagcuggaggcugccucccuccaggcgauccccaccgaaagaaucguuaauucuagccaacugaaggcugccgugacaccugagcuuugccccgaugucaccauuuggggaguggccaugcugcgccauaugcuccagcugcaguguaacgcucaggccaugacgacaauccaacacaccgggccuaagggcuccauuguuaccgacagcagacaggugcggcuggcuacagggaucuuccccgucauuucucuucucaaucauuccugcagcccgaacaccucuguguccuuuaucagcacagucgccacgauccgcgcgucccagcggauuagaaaaggacaggaaauccugcacuguuauggcccucacaagucucgcaugggcguggccgagcggcaacagaaacugagaagccaguacuucuucgauugcgcuugucccgccugccagaccgaggcucaucgcauggccgcggggccucggugggaagccuuuugcuguaauuccugcggagcucccaugcaaggcgacgacguucucagaugugggucucgcagcugcgccgaguccgcugugagccgggaucaccuggucucuagacuucaggaccugcagcaacaggugcggguugcccagaagcuccugcgcgauggagaacuggagagagccgugcagcggcuuuccggcugucaaagagacgcugagagcuuccucugggcggaacaugccgucgugggggagauugcugauggccuggcccgcgccugcgcugcccugggagacuggcagaaaucugcgacacaccuccagcggucccuguaugugguugaagucagacacggcccuagcucuguggagauggggcaugaacuuuuuaagcuggcucagaucuucuuuaacggauucgccgugcccgaggcccucagcaccauucaaaaggcugaagagguccugucccugcacuguggcccgugggaugacgagauccaggaacuucagaaaaugaaaagcugccugcucgaucugccucccacacccguggggccugcccucuga

SEQ ID NO: 76008 - RNA, 1257 nt, Artificial Sequence
  derived and/or modified sequence opt5 from SMYD5__Homo_sapiens__NP_006053
auggccgcuagcaugugcgacguguucuccuuuugugucggcguugccgggagagcgcgggugucuguggagguccgcuucgugagcuccgcuaagggaaaaggccuguuugccacccagcucaucagaaagggggaaacaauuuucguugagcggccccugguggccgcucaauuucuuuggaacgcccuguaccgcuauagagcuugcgaucacugucuccgggcccuggaaaaagcggaggaaaaugcccagcgccuuacgggaaagccuggccagguccugccgcaucccgagcucugcaccgugagaaaagaccugcaccagaacuguccucauugccaaguuauguacuguucugcugagugccggcuggccgcuacagaacaguaucaccaggugcucugucccgggccuagccaggaugacccccugcauccucuuaauaagcugcaagaggccuggcgcuccauccacuacccgcccgaaaccgcgucuauuaugcucauggccagaauggucgcuacagugaagcaggccaaagauaaggaccgguggauccgccuguucagccaguuuugcaacaaaaccgcuaaugaggaggaagagauugugcacaaacuucugggagauaaguucaagggccagcucgaacugcugagacggcucuuuacagaggcccuguaugaagaggccgucucccaaugguucaccccugacggcuuucgcagccuuuucgcucugguugggacgaacggacagggcaucgggaccucuucccucagccagugggugcaugcgugugauacacuggagcuuaagccccaagacagagaacagcuggaugccuuuaucgaccagcucuacaaagauauugaggcugccaccggagaguuccugaauugcgaaggcucugggcuguucgugcuccaguccugcuguaaccacagcugcgucccuaaugccgaaacaucuuuucccgagaacaauuuccugcuucaugugaccgcucuggaggacaucaagccgggagaagagauuuguaucuccuaucucgacugcugucaacgggaaagaagccgccacucccggcacaaaauucugagagagaacuaccuuuuuguuugcucuuguccuaagugccuggccgaagcggaugagcccaaugugacgagcgaggaagaggaagaggaggaagaggaagaggaaggcgagccugaggacgcugaacucggcgaugagaugacagacgucuga

SEQ ID NO: 76009 - RNA, 795 nt, Artificial Sequence
  derived and/or modified sequence opt5 from SNAI1__Homo_sapiens__NP_005976
augccccggagcuuccuggugagaaagccuuccgacccgaaccgcaaacccaauuacucugagcuccaggauagcaacccugaauuuaccuuccaacagcccuaugaccaggcccaucugcuugcugccaucccucccccugagauucugaauccgacagcgucccuccccaugcugaucugggauucuguccuugcuccucaggcccaacccauugccugggcuagccugagacuccaggaauccccucggguugccgagcugacgucucugagcgacgaagauuccggcaaggggagccagcccccgucuccucccuccccugcucccagcucuuuuuccagcaccucuguguccagccucgaggccgaggcguacgccgcuuuccccggacugggccaggugccuaaacaacuugcccagcuguccgaagcuaaggaccuccaggcccgcaaagcguuuaacugcaaguauuguaauaaggaguaccugucucuuggggcccugaaaaugcacaucagaagccacacacucccgugcgucuguggaaccugcggcaaggcuuucucccggcccuggcugcugcaggggcaugugcgcacacacaccggagaaaaaccuuuuagcuguccccauugcucuagagccuucgcugaucgguccaaccuccgcgcccaucugcaaacacacagcgacguuaagaaauaucagugucaggccugcgcuagaaccuuuucucggaugagccuucugcacaagcaccaagaguccggcuguucuggcugcccucgcuga

SEQ ID NO: 76010 - RNA, 807 nt, Artificial Sequence
  derived and/or modified sequence opt5 from SNAI2__Homo_sapiens__NP_003059
augccccgcagcuuccuggugaagaaacacuuuaacgccuccaagaaaccuaauuacucugagcucgacacccauacagucaucauuagcccguaucuguacgaauccuauucuaugcccguuaucccucagcccgagauucuuagcuccggcgcuuacucuccuaucacgguguggaccacagccgcgcccuuccacgcucaacugccuaacgggcucagcccgcuguccggauauagcagcucccuuggccgggugucucccccucccccuucugauaccuccagcaaggaccauucuggguccgaaagccccauuuccgaugaggaagagagacugcagucuaaacucagcgacccgcacgccaucgaggccgaaaaguuucagugcaaucuguguaacaagacauacuccaccuucagcggacuggcuaaacauaagcagcuccacugcgaugcccaaucuagaaaauccuuuagcuguaaguauugcgacaaagaguacgucucucugggcgcucuuaagaugcacauccggacacauacccugccuugugugugcaagauuugugggaaagccuucagccgccccuggcuccugcagggacacaucagaacgcauaccggcgaaaagccuuuuuccugcccccacuguaaucgggcguucgccgaucgcucuaaccuuagagcucaucugcagacacacagcgacguuaaaaaguaccagugcaaaaauuguuccaagaccuuuagccggaugucucuccugcacaaacaugaggaguccggcugcugcguggcccacuga

SEQ ID NO: 76011 - RNA, 879 nt, Artificial Sequence
  derived and/or modified sequence opt5 from SNAI3__Homo_sapiens__NP_840101
augccccggagcuuccuggugaagacccacuccucucauagagucccuaacuaccgcagacucgagacacagcgggaaaucaauggcgccugcagcgcuugugggggacugguugugccgcuucugccccgcgacaaagaggccccuuccgugcccggcgaucucccucaacccugggacagaucuagcgcggucgcuugcauuucccugccucuucugccgcggaucgaagaggcccucggggccucuggacuggaugcucuggaagugagcgagguugacccccgcgccuccagagcugccauugugccucucaaggauagccugaaccaccuuaaucugcccccucuccugguccuucccacgcgguggucuccgacccugggcccugaccgccauggggcgcccgagaaacuccugggagccgaaagaaugccucgggcucccggcggcuuugaguguuuccacugccauaagcccuaucacacacuggccgggcucgcucgccacagacagcugcauugucaccuucaggugggacggguuuuuaccugcaaauacugugauaaggaauauacaucccugggcgcccucaagaugcauauccgcacccacacacugccuugcaccuguaaaauuugcgggaaggcguucagcagaccguggcuucugcagggacacgugcggacgcauaccggcgagaaacccuacgccuguucucacugcuccagagcuuuugccgaccgcagcaaccuccgggcucaucugcaaacacacucugaugccaagaaauauagaugccgccgguguaccaagacauucuccagaaugagccugcucgcccgccaugaggaauccgggugcuguccuggacccuga

SEQ ID NO: 76012 - RNA, 636 nt, Artificial Sequence
  derived and/or modified sequence opt5 from SNAP23__Homo_sapiens__NP_003816
auggacaaccugagcuccgaggaaauccagcaaagagcccaccagauuaccgaugagucucucgaaagcacacggcgcauccugggccuugcuauugagucccaggacgccgggaucaagacgauuaccaugcuggaugaacagaaagagcaacucaauagaaucgaggaaggacuggaccagaucaacaaggauaugcgggagacagagaaaacccuuacagaacugaauaagugcuguggccucugcgugugucccugcaaccgcaccaaaaauuucgagucugggaaggcguacaagacaaccuggggagacggcggggaaaacagcccuuguaaugucguuuccaaacagccgggacccgugacgaacggccagcugcaacagccuaccacaggcgcugccucugggggauauauuaagagaaucaccaaugaugcccgggaggacgaaauggaggaaaaccugacacaggugggcagcauucucgggaaucugaaagauauggcucuuaacaucggaaaugagauugacgcccagaacccccaaaucaagcgcauuaccgauaaagcugacacgaauagagaucggaucgacaucgccaacgcgcgcgccaagaagcugauugacuccuga

SEQ ID NO: 76013 - RNA, 621 nt, Artificial Sequence
  derived and/or modified sequence opt5 from SNAP25__Homo_sapiens__NP_003072
auggccgaggacgcugauaugagaaacgaacuggaggaaaugcagcggcgcgccgaccaacucgcggaugagagccuggaauccaccagacggaugcuucagcugguggaggagucuaaggacgcuggcauccgcacacucgucaugcuggaugaacagggggagcagcuugacagaguugaagagggaaugaaucacauuaaccaagauaugaaagaggccgaaaagaaucugaaagaccucggcaagugcugugggcuguucaucugccccuguaacaaacugaaaagcuccgaugccuacaagaaggcuuggggaaauaaccaggacggcgugguggccucucagccugcucgggucguggaugagcgcgaacagauggccauuagcgggggauuuaucagacggguuacgaaugacgcgcgcgagaacgaaauggaugagaaucucgagcaaguguccggcauuaucggcaaccugagacauauggcccuugacauggggaaugaaaucgacacccagaaccggcagauugaucgcaucauggagaaggcugacucuaauaaaacaagaauugaugaagccaaccagcgggcuaccaagaugcugggaagcggcuga

SEQ ID NO: 76014 - RNA, 777 nt, Artificial Sequence
  derived and/or modified sequence opt5 from SNAP29__Homo_sapiens__NP_004773
augagcgccuaccccaaguccuauaacccuuucgacgaugacggcgaggaugaaggggcuagaccggcccccuggcgggacgcgcgcgaucugccugacggacccgaugcuccugccgacagacagcaauaccuccggcaggaggugcugcgcagagccgaagcuaccgccgcuucuacaagccggucccuugcccugauguaugagucugaaaaagucggcguugcgagcuccgaggagcucgcccgccagagaggggugcuggaacggacggagaagaugguggauaaaauggaccaggaucuuaagaucucucaaaaacacauuaauagcaucaaguccgucuuuggaggccuggugaacuacuucaagagcaaacccguugaaaccccuccggagcagaaugggacacucaccucucagcccaacaaucgccugaaggaggcuauuuccacaagcaaagaacaggaggccaaguaucaggcuucucauccuaaccugagaaaacucgacgauaccgaccccgugccucggggagccggcuccgcgaugagcacagacgccuaccccaagaauccgcaucugcgcgcuuaucaccaaaagaucgauucuaaccuugacgaacuguccaugggccucgggagacugaaagauauugcccuuggaaugcagaccgagaucgaggaacaggacgauauccuggaccggcucacgaccaaggucgauaaacuggacgugaauauuaagagcacagagcgcaaaguuagacaacuguga

SEQ ID NO: 76015 - RNA, 1395 nt, Artificial Sequence
  derived and/or modified sequence opt5 from SNAP47__Homo_sapiens__NP_444280
augagagccgcucggcgcggccugcacugcgccggggcggagagaccccggcgcagaggacggcucugggacagcuccggcgugccucagcgccaaaagagaccggggcccuggcggacccagacacaggaacagaugucucgcgaugucuguauccauacguggccuugcaccuacuaucuggagcccaaaagacgguggguuacaggacaacuuagccugaccucccucucucugcgcuucaugacagacagcaccggcgaaauucuuguguccuuuccucugucuagcaucguggagauuaagaaagaggcuucccacuucaucuuuagcucuauuacaauccucgaaaaggggcaugccaaacacugguucuccagccugagacccucucggaacgucguguuuuccaucauugagcauuucuggcgcgaacugcuccugagccagccuggagccguugcugaugccucugugccgagaacccggggcgaggaacuuacgggccugauggcugggucccagaagagacucgaggacaccgcccgcguccugcaccaccagggacaacagcuugauagcgugaugcggggccuggacaagauggaguccgaucucgaaguugcggacagacugcugacagagcucgaaucucccgccugguggccuuuuagcuccaaacuguggaagacacccccugagaccaaaccccgcgaagaugugagcaugaccucuugugagccguucgggaaggagggaauccuuauuaaaaucccugcugucauuucccaucggacggaaagccacgugaagcccggcagacugacagugcucgucucugggcuggagauccaugacagcuccucucuucugaugcaccgcuuugaacgggaggauguugacgauauuaaggugcacagcccuuacgaaaucuccaucagacagcgcuucauuggaaaacccgacauggccuaucggcucaucagcgcuaagaugcccgaggugauuccuauccuggagguccaguuuucuaaaaagauggaacugcucgaggacgcccuggugcuuagauccgcgcgcaccagcucuccggccgaaaaauccugcagcguuuggcaugcugccuccggccugaugggccggacacuccacagagagcccccugcuggggaucaagaaggaaccgcccugcaucuucagaccucucugcccgcccucagcgaggcugacacacaggagcugacgcaaauucugcggcgcaugaagggccucgcgcuggaagccgaguccgaacuugagagacaggaugaggcucuggacgggguggccgccgcugucgaucgggccacccucacaaucgacaaacacaauagacgcaugaagcggcugaccuga

SEQ ID NO: 76016 - RNA, 2724 nt, Artificial Sequence
  derived and/or modified sequence opt5 from SNAP91__Homo_sapiens__NP_001229721
augagcggccagacccugacagacagaaucgccgcugcccaauacuccgugacggggucugcggucgcucgggccguuugcaaggccaccacacacgaggugaugggacccaaaaagaaacaucucgauuaucugauucaggcuaccaacgaaacaaaugugaacaucccucagauggccgacacccuuuucgagcgcgcuacaaauagcuccugggucgugguuuuuaaggcccuggugaccacgcaccaucucaugguccacggcaacgaaagauucauucaguaccuggcgucucggaauacccuuuuuaaccugagcaauuuccucgauaaauccgggucucauggauaugacaugagcacauuuauccgcagauacucccgguaucugaacgagaaggccuucagcuaccgccaaauggcuuuugauuucgccagagugaagaaaggcgcugacgggguuaugcggaccauggccccggaaaagcugcucaaaucuaugcccauucugcagggacagaucgaugcgcuucuggaguuugacgugcacccuaaugagcucacaaacggcgucaucaaugccgcuuucaugcugcuuuuuaaggaucugauuaaacucuucgccuguuauaacgacggcgugaucaaucugcuggaaaaguuuuucgagaugaagaaagggcagugcaaggaugcucucgaaauuuacaaacgcuuccugaccagaaugacgcggguguccgaguuucuuaaggucgccgagcaaguuggaaucgacaaaggcgauauucccgaccugacacaggccccuagcucucucauggaaacccuggagcagcaccuuaacacacuggaagggaagaaacccggaaauaacgagggcuccggggcuccuagcccgcucucuaaguccagccccgcgaccaccgugacauccccuaacucuacgcccgccaagaccaucgacacaagcccucccguggaucuguucgcuaccgccuccgccgcugucccggugagcacaucuaaaccuuccagcgaccugcucgaucugcagcccgacuuuucuagcggaggcgccgcggcugccgccgcuccugccccucccccuccggcuggcggggccaccgcguggggagaucuucugggcgaagacucccucgccgcucugucuagcguucccuccgaggcccaaauuagcgauccuuucgcucccgagccuacgcccccgacaaccaccgccgaaaucgcgacagccucugcuuccgccagcaccacaacgaccgugacagcugucaccgccgagguggaccuuuuuggggaugccuucgcugcgucuccuggagaagcccccgcugccuccgagggcgccgcugccccugcgacacccaccccuguugcugccgcccuggacgcuuguagcgggaaugaucccuuugccccguccgaaggaucugcggaggcugccccugagcucgaccuguucgccaugaagccucccgaaacgagcgugcccgucgugaccccgacagcuuccaccgccccucccguccccgcuacagcccccucucccgcgccugccguggcugccgcugccgccgcuaccacggcggccacagcugccgccaccacaaccaccacaacgagcgcugccaccgcgacaaccgcucccccggcccuggacaucuuuggcgaucucuucgaguccacaccugaaguugccgcugcccccaaaccugacgcggcucccagcauugaucuguuuucuaccgacgccuucuccagcccgccucagggcgccucucccgugccugaguccagccuuacggcugaucugcucucugucgacgccuuugcugcccccagccccgcgacaaccgccuccccugcuaagguggauagcucugggguuaucgaccuguucggagaugccuucggcuccagcgcuuccgaaccgcagcccgccucucaagccgcuagcuccucuagcgcguccgccgaccugcuugcuggguuuggaggcucuuucauggccccuagccccuccccugugacccccgcccagaacaaucuccugcagccuaacuuugaggcugccuucgggacaaccccgagcacaucuuccucuagcuccuuugaucccagcgucuucgacggccugggagaucuccugaugccuacgauggcgcccgcuggccagccugcccccgugucuauggugccgccuucccccgccauggcugccagcaaagcgcuuggguccgaccuggacagcucucucgccagccugguuggaaaucugggcauuuccgggaccacaaccaagaagggagaucuucaauggaacgcuggcgagaaaaagcucacagggggcgccaauuggcagcccaaagucgcuccugccaccuggucugcuggagugcccccuagcgccccgcugcagggcgcggugcccccuacguccucugugcccccugucgccggggcucccagcguuggacagccgggcgccggguuuggaaugccucccgcuggcaccgggaugccuaugaugccccaacagccugugauguucgcccagcccaugaugcgcccgccuuuuggcgccgcugcgguccccggaacacagcugucccccucuccuaccccggccagccaaucccccaagaaaccucccgcuaaggacccucucgccgaucugaacaucaaggacuuccuuuga

SEQ ID NO: 76017 - RNA, 1107 nt, Artificial Sequence
  derived and/or modified sequence opt5 from SNAPC1__Homo_sapiens__NP_003073
augggcacacccccugggcugcagaccgacugcgaggcccuccugagcagauuccaagaaacggauuccgugcgguuugaggacuucaccgaacuuuggcgcaacaugaaguuuggaacaaucuucuguggcagaaugcggaaucuggagaaaaacauguuuaccaaggaagcucucgcccuggcguggcgcuacuuccuuccgcccuauacauuucagauuagagucggggcucuguaccuccuguauggacuguacaauacccagcucugccagccuaaacaaaagauccggguugcccugaaagauugggacgaggugcuuaaguuccagcaggaucuggugaacgcccagcacuuugacgcugccuauauuuuccgcaagcucagacuggaucgggcuuuucauuucacagccaugcccaaacuucugucuuaccgcaugaagaaaaagauccacagagcggaggucaccgaagaguuuaaagacccuagcgaucgggugaugaagcucauuacguccgacguucuggaagagaugcugaaugugcaugaucacuaucaaaacaugaagcaugucaucucuguggacaaaagcaagcccgauaaagcccucucccugaucaaggacgacuucuucgauaauauuaaaaacaucguucuugagcaccagcaguggcacaaggaccgcaaaaauccuucucugaaaagcaagaccaacgauggcgaagagaaaauggaaggaaauucccaggagacagaaagaugugagcgggcugagagccucgccaagauuaaaucuaaggcuuuuuccguggucauccaagccagcaaaucucgcagacauagacaggugaagcuggacuccagcgauucugacuccgcgagcgggcagggccaagugaaggccacccggaaaaaggaaaagaaggagcgccuuaaaccggcuggccggaagaugucccugagaaacaaggggaauguccagaacauucacaaagaagauaagccccucucucugagcaugccuguuaucacagaggaagaggagaaugaaucccugagcggaaccgaguucacggccucuaaaaagcgccggaaacauuga

SEQ ID NO: 76018 - RNA, 4410 nt, Artificial Sequence
  derived and/or modified sequence opt5 from SNAPC4__Homo_sapiens__NP_003077
auggacguggaugccgagagagaaaagaucacccaggagauuaaagaacuggagcggauccucgaccccggcagcuccgggucucacgucgaaauuagcgaguccucucuggagagcgauuccgaagcugacucucuuccuagcgaggaucuggacccggccgaucccccuaucuccgaagaggagcgcuggggagaagcgagcaacgacgaggaugaccccaaggauaaaacacucccugaagaccccgagacgugccugcaacuuaauaugguuuaccaggaagugauucaggagaagcuggcugaggccaaccuccugcuggcccagaauagagaacaacaggaggaacucaugcgggaucuggcuggcucuaaagggaccaaggugaaggacggaaaaucccuuccuccgagcacauauaugggccauuucaugaagcccuacuuuaaagacaaggucaccggggugggaccucccgccaacgaggauacacgcgaaaaagcugcccagggcaucaaggcguucgaggagcugcucguuaccaaguggaaaaauugggaaaaggcccugcuuagaaaaucuguggucuccgaccggcugcagcgccuccugcaaccuaagcugcucaaacuggaguaucuucaccagaagcagagcaaagugucuuccgaacuggagagacaggcucucgaaaagcaaggccgggaggccgagaaggaaauccaggauauuaaccagcugcccgaggaagcccuucuggggaaucgccucgacagccaugauugggagaaaaucuccaacauuaauuuugagggaucuagaagcgcugaagagauccggaaguucuggcaaaacuccgaacacccgagcauuaauaaacaggaguggucucgcgaagaggaggaaagacugcaggcgaucgccgcugcccauggccaccuggaguggcagaagauugcugaggaacucgggacaucccggagcgccuuucaaugucugcagaaauuccagcagcacaacaaggcccuuaagcgcaaagaauggaccgaggaggaagacagaaugcugacgcaacucguucaggagaugcgggugggaucucauaucccuuacagacgcaucgucuauuacauggaaggccgggauagcaugcagcugauuuauagauggaccaagucccuugaccccgggcugaaaaagggauacugggcuccugaggaagaugcgaaacuccugcaggccguggcuaaguacggcgagcaagacugguuuaagauccgcgaggaagugcccggccggucugaugcccagugcagagaccgcuaucugcggagacuccacuucagccugaaaaaggggcgcuggaaucuuaaagaggaggaacagcugauugagcucaucgaaaaguacggagucggccauugggccaaaauugcuuccgagcugccccaccggagcgggucucagugucuguccaaguggaagaucaugaugggcaaaaagcaaggacuuagacgccggagacggcgcgccagacacagcguucgguggucuuccacaagcuccucugggagcuccucuggaagcuccggcggcagcagcuccucuucuuccagcucuagcgaagaggacgaaccugagcaggcgcaggcuggggagggagauagagcccuccuguccccgcaauauauggugcccgacauggaucugugggugccugcccgccagagcaccucucagcccuggcggggcggggcuggagccuggcucggcgggccugcugccucccugagcccgcccaaaggcuccucugcgagccagggaggcuccaaggaagccucuacaaccgcugccgcuccuggggaggaaacgagccccguccaagugccugccagagcgcauggacccguuccucgcuccgcccaggcuucucacagcgccgacacaagacccgcuggcgccgagaaacaggcccuugaagggggacggcgccugcucaccgugccggucgagacagugcugagaguucugcgggcuaacaccgcggcccgcuccugcacccagaaggagcaacuuagacagccuccccuccccacaagcucuccuggcguguccagcggggauucugucgcucggucccaugugcaguggcugcgccacagagccacgcagagcggccaacggcgcuggagacaugcccugcaccggagacuccugaaucgccggcuucugcucgcugucaccccgugggugggagacguugugguccccuguacacaggccucucagagaccugcggugguucaaacccaggcugauggccugcgcgaacagcugcagcaagcccggcuugccuccacacccguguuuacccucuucacgcagcuguuucacaucgacacagcugggugccuggaggucgugagagaacgcaaagcccucccuccccggcugccucaggcgggagcuagagaucccccggugcaucuucugcaggccagcuccagcgcccaaucuaccccuggccaccucuuccccaacguuccugcucaggaggccagcaaguccgcuucucauaaggggagccgccggcuggccuccucuagagucgaacggacccugccccaggcgagccuucucgccuccacaggaccgcgcccuaaacccaagaccgugucugagcugcugcaggagaaaagacuccaagaagcucgggcccgcgaggcuacaagaggcccugugguccugcccagccagcuucugguguccagcucuguuauucuccagcccccucugccgcacacgccccacgggcggccugcccccggcccuaccgugcugaacgucccccuuuccggaccuggcgccccggcugcggccaagcccgggacaagcggaucuuggcaggaagcuggcaccuccgccaaagacaagagacugagcacaaugcaagcccucccucuggcucccguguuuuccgaggccgaggggaccgcgccugcugccucucaggcccccgcucucggaccgggccagaucagcguuuccuguccugaaagcgggcugggccaaucucaggcccccgcggcuucccgcaagcagggacuucccgaggccccucccuuccugccugccgcuccgagccccacgccucuccccgugcagccucugucucugacccauauuggcgggccccacgucgccacaagcgugccgcuuccuguuaccugggugcugacagcucaaggacuccugcccgucccugugcccgccguggucucccucccucggcccgcgggcaccccggggccugccggacugcuugcuacgcugcucccuccccugacagaaaccagagccgcucagggcccccgcgccccggcccugucuagcuccuggcagcccccugcuaauaugaaccgggagcccgaaccuucuugcagaacagauacccccgcgccuccgacccaugcccuuagccagucccccgcugaggccgacggcagcguugccuucgugccuggggaggcucaaguggcccgcgaaauccccgagccucggacaucuucccacgcggaucccccggaagcugagccucccuggagcggaagacugcccgccuuuggcggggucauuccugccacggaaccccgcggaaccccuggcuccccgucugggacacaggagcccagaggaccucucggccuggagaaacucccccugcggcagccuggccccgaaaagggggcucuugaccuggagaaaccgccucugccccagccuggacccgaaaagggcgcccucgaccuggggcuucugagccaagagggagaagcggccacccagcaguggcucggcgggcaacgcggagugagaguuccucugcucggcucccggcugcccuaccagccgccugcucuuuguucucugcgcgcccugagcggccuccugcuucauaaaaaggcucuggagcacaaggccacaucccucguggucgggggagaggcugaaagacccgccggcgcgcugcaggccagccucgggcuggugcggggacagcuucaagauaaucccgcuuaucugcugcucagagcccgcuuccuggcugccuuuacccuuccugcccugcucgcuacgcuggcgccgcagggcguucggacaacccucucugugcccuccagagucgggagcgagucugaagacgaggaucugcuuuccgagcuggaacuggccgaccgcgauggacagccuggcugcaccacagcuaccugucccauccagggcgccccugacagcgggaaaugcucugccagcuccugccucgauacaucuaacgaccccgaugaccuggaugugcuucggacgagacacgcucggcauacccgcaagagacggcgccugguuuga

SEQ ID NO: 76019 - RNA, 297 nt, Artificial Sequence
  derived and/or modified sequence opt5 from SNAPC5__Homo_sapiens__NP_006040
augcugagcagacuccaggagcugcggaaggaagaggaaacccuucugcgccucaaagccgcucugcacgaccaacuuaacagacugaagguggaggaacucgcccugcaguccaugaucucuagccggcgcggcgaugagaugcuguccucucauacaguccccgagcagagccacgacaugcucguucauguggauaaugaagcguccauuaaccagacgacccuggagcuuucuacaaaaagccacgugaccgaagaggaggaagaggaagaggaagaggaguccgacagcuga

SEQ ID NO: 76020 - RNA, 339 nt, Artificial Sequence
  derived and/or modified sequence opt5 from SNCA__Homo_sapiens__NP_009292
auggacguguucaugaagggccugagcaaagccaaggagggggucguugcugccgcggagaaaaccaagcagggaguggcugaagccgccggcaaaacaaaggaaggggugcucuacgucggauccaagacgaaagagggcgugguucacgggguggcuaccgucgccgaaaagacaaaagagcaagugaccaacguuggaggcgcuguggucacaggcgugaccgccguggcgcagaagacagucgagggggccggaucuaucgcugccgcuaccggcuuuguuaaaaaggaucagcuggggaaggaaggauaucaggacuacgagcccgaagccuga

SEQ ID NO: 76021 - RNA, 1812 nt, Artificial Sequence
  derived and/or modified sequence opt5 from SNCAIP__Homo_sapiens__NP_001229864
augaccuaccugauccagagccaccauuccagacggucucaaaacugcgccgaggacgugauucgcaagacaaaaacggaucagaauggccagcucgaaugugucagauggaugguuagcgagaccgaagcuaucgccgagcuguccugcucuaaggacuuccccagccuuauucacuaugcgggguguuacggacaggaaaagauccugcucuggcugcuucaauuuaugcaggagcagggcauuucccuggaugagguggaccaggaugggaacucugcugugcaugucgccagccaacacggauaucucggcugcauccagacacugguggaauacggggccaauguuaccaugcagaaccaugcuggagagaagccuucccagagcgccgaacggcaaggccacacacuguguucucgcuaucucguggucguggagaccugcaugucccuggcuagccagguugugaaacuuacaaagcagcugaaggagcaaaccgucgaaagagugacgcuccagaaucagcugcagcaauuccuugaggcccagaaaucugaaggcaagucccugccgagcucucccuccagcccuuccucucccgcgagccggaaaucccaguggaaaagcccugacgccgaugacgauucuguggcuaaauccaagcccgggguccaggagggaauccaaguucucggcagccugucugccagcucccgcgcuagaccuaaggccaaagacgaagauucugacaagauucugcggcagcuccuggggaaagagaucagcgagaacguguguacccaggaaaaacuuucccuggaguuucaggaugcgcaagccagcucucgcaauuccaaaaagauuccgcucgaaaagagagagcugaaacuugcucggcugcgccagcucaugcagagaagccugucugaauccgacacagacagcaacaauuccgaggaucccaagaccacaccugugcggaaagccgaccgccccagaccucagcccaucgucgagucuguggaaagcauggauuccgcugagucucugcaccucaugauuaagaaacauacccuggccagcggaggccggagauucccguuuuccaucaaggccagcaaaucucuugacgggcacuccccuagccccacgucugaauccagcgagccugaucuggaaucucaauaccccggaagcggcuccauucccccuaaccagccgagcggcgacccccagcaaccuucucccgauuccacagcugcgcagaagguugccaccagcccuaaguccgcucucaaaucucccagcuccaagcgccggacaucucagaaucugaaacuuagagugaccuucgaggagccggucgugcagauggaacaaccuagccuggagcucaacggggaaaaggacaaagauaagggacgcacccugcagcggacauccacgucuaaugagagcggcgaccagcugaagagacccuuuggggccuuccgcuccaucauggagacccucagcggaaaccagaauaacaacaauaacuaucaagccgcuaaucagcugaaaacaucuacccuuccucugacaucccucggccggaagaccgaugccaaagggaaccccgcgagcucugcuuccaagggaaagaauaaggccgaaauguacagcucuugcaucaaccuguccagcaauaugcugauugaggaacaucuuuguaacgacacgagacacaaugacaucaaccgcaagaugaaaaaguccuacagcauuaaacacaucgccgagccugaaucuaaggagcucuuucuguga

SEQ ID NO: 76022 - RNA, 405 nt, Artificial Sequence
  derived and/or modified sequence opt5 from SNCB__Homo_sapiens__NP_003076
auggacguguucaugaagggccugagcauggccaaagagggggucguugcugccgcggaaaagaccaaacagggagugacagaggcugccgaaaagacgaaagagggcgugcucuacgucggguccaagaccagagaaggagugguucaaggcguggccucugucgcugagaagacaaaagagcaggccagccaccuugggggagcuguguuuuccggcgccggcaacaucgcggccgcuaccgggcugguuaagcgggaagaguuccccacagaccugaaaccugaagagguggcccaggaggcugccgaggaaccgcucauugaaccccugauggagccugaaggagagucuuaugaggaucccccucaggaagaguaccaagaauaugagcccgaagcguga

SEQ ID NO: 76023 - RNA, 384 nt, Artificial Sequence
  derived and/or modified sequence opt5 from SNCG__Homo_sapiens__NP_003078
auggacguguucaagaaaggcuuuagcaucgccaaggagggggucguuggagcuguggagaaaaccaagcagggcgugacagaagccgcggagaaaacgaaggaaggggucauguacgugggagcuaagaccaaagaaaacguugugcaauccgucacaucuguggccgagaagaccaaagagcaggccaaugcuguuagcgaagccguggucuccucugugaacacaguggcuaccaagacagucgaggaagccgagaauauugcgguuaccagcggcguggugagaaaagaggaucugcggcccuccgccccucagcaggaaggggaggcuucuaaggaaaaggaggaagucgccgaggaggcucaaagcggaggcgacuga

SEQ ID NO: 76024 - RNA, 2733 nt, Artificial Sequence
  derived and/or modified sequence opt5 from SND1__Homo_sapiens__NP_055205
auggccagcuccgcucagucuggcgggagcuccggaggccccgccgugccuaccguccaaagagggaucauuaagaugguucugucuggaugcgcgaucauugugcggggccagccgcgcgggggacccccucccgagagacagaucaaccucagcaauauucgggcuggcaaccuggcccgcagagccgcugccacacagccugacgcuaaagauacgcccgacgaaccuugggccuucccggcgcgggaguuucuucgcaagaaacugaucggcaaggaaguguguuucaccaucgagaauaaaacaccccaagggagagaauacggaaugauuuaucucggcaaggauaccaacggggagaauaucgccgagucccuggucgcugaaggacuugccacacggcgcgagggcaugagagcuaacaauccugaacagaaccggcugucugagugcgaggaacaggccaaggcggccaaaaaggggauguggagcgagggaaauggcucccacaccauucgcgaccucaaauacacaaucgaaaaccccagacauuuuguggauagccaccaucagaagccuguuaaugcuauuaucgagcacgugcgggacggcucugucgugcgcgcccugcugcuccccgauuauuaccugguuaccgugaugcuuuccgggauuaaauguccgacguucagacgggaagcugacggaagcgagaccccugagcccuuugccgccgaagcuaaguucuuuacagagucuagacugcuccaacgcgauguccagaucauccuggaauccugccauaaccagaauauucuuggcaccauccugcacccuaacgggaauauuacagagcuccugcugaaggaaggauucgcgcgguguguggacuggagcaucgccguguauaccagaggcgcugagaaacuccgcgccgccgagcgguuugcuaaggaaagacgccugcggauuuggagagauuacgucgcccccacggcgaaccuugaccagaaagauaagcaauucguugcuaaagugaugcaagugcugaacgccgacgccaucgucgugaagcucaauucuggggacuauaaaacaauccaccuguccagcauucggcccccucggcuugagggagaaaacacccaggauaagaauaagaaacugagaccgcucuacgacauccccuacauguuugaggcucgcgaguuccugcggaagaaacugauuggcaagaaaguuaacgugacagucgauuauaucagaccugccucccccgcuaccgaaaccgugccugccuuuucugagcggacaugcgcgacgguuaccauuggcgggaucaauaucgccgaagcucucgugagcaagggacuggccacagucauucgcuacagacaggacgaugaccagcgguccagccauuaugaugagcuucuggcugccgaagcgagagccaucaagaacggcaaagggcuccacucuaagaaagaggugcccauucaucgcgucgcugacaucuccggagauacccagaaggccaaacaguuccugccguuccuucaacgggcuggcagaagcgaggccgugguugaauacguguuuucugggagccgccugaagcucuaucugccuaaggagacaugucugauuaccuuccuccuggccggcaucgaaugccccagaggagcucggaaucuuccuggccugguccaggagggggaacccuuuuccgaggaggcgacacucuucacgaaagaacuggugcugcagcgcgagguugaaguggaggucgaaucuauggacaaggccggaaacuuuauuggcuggcuucacaucgauggggcuaaucucagcgugcugcugguggagcacgcccucuccaaaguucauuucaccgccgagagaagcucuuacuauaagucccugcuuagcgcugaagaggccgcgaaacagaagaaggaaaaagucugggcucacuacgaggaacaaccuguggaggaggugaugcccguccuggaagagaaggaacggucugccuccuacaaaccgguguuuguuaccgagaucacagacgaccuccauuucuaugugcaggaugucgagaccggaacacagcuggaaaagcugauggagaacaugcgcaaugacauugccagccacccucccguggaaggcuccuacgcucccagacgcggggaguuuuguaucgccaaauucguugauggcgaaugguaucgcgcgagaguggagaaggucgagucuccugcuaaaauucauguguuuuacaucgacuauggaaaccgggaaguucuuccgagcacgcgccucggcacccugucccccgccuucucuacaagagugcugccugcccaggcuaccgaguacgccuuugcuuucauucaagucccccaggaugacgaugcccggacagacgcgguggauagcguggucagagacauccagaauacccagugccuccugaacguugaacaccuuuccgccggguguccucacgugacgcugcaauucgcugauagcaagggagacgugggccucgggcuggucaaggagggacuggugaugguugaagugcgcaaagagaagcaguuucagaaagucaucaccgaguaucuuaaugcccaagaaucugcuaaguccgcccggcucaaccuguggagauacggcgauuuccgcgccgacgacgcugaugaguuuggguacagccgguga

SEQ ID NO: 76025 - RNA, 4242 nt, Artificial Sequence
  derived and/or modified sequence opt5 from SNED1__Homo_sapiens__NP_001073906
augagacacggcguggccugggcucugcucgucgccgcggcucuggggcuuggagcccggggcguucgcggggccguggcucuggccgacuucuaccccuuuggagcugaaagaggcgaugccgugaccccuaagcaggacgaugggggaagcggccuccggccgcuguccguccccuuccccuuuuucggcgcggaacauucugggcuuuaugugaacaauaacggaaucauuagcuuucugaaagagguuucccaauucacacccguggccuuuccuaucgcuaaggaccgcugcgucguggccgcuuucugggccgauguugacaauagacgggcgggcgauguguacuaucgcgaagccacggaccccgcuaugcucagacgggccaccgaggauguccgccacuacuuuccugaacugcuggacuucaacgcuacauggguguuuguggccaccugguauagagucacauucuuugggggaucuagcuccucuccgguuaauaccuuccagacagugcucauuaccgauggcaaacugagcuucacgaucuuuaacuacgaguccauuguguggaccacagggacccaugccagcucuggaggcaaugcuacaggccuugggggaaucgcggcccaggcuggcuucaacgccggggacggacagcgguauuuuuccauccccggcagccgcaccgccgauauggcugaggucgaaacgacaaccaauguggggguuccuggaagaugggccuuccggauugacgacgcgcaagugcgcgucggcggcugugggcacacaaccucugugugccuggcucucagacccugucugaacggaggcaagugcaucgaugacuguguuaccgggaauccuuccuacacaugcagcugucuuucuggauuuacgggccggagaugccaucuggaugugaacgagugugccucccagcccugccagaaugggggcaccuguacacacggaauuaacagcuuccgcugccagugcccggccggcuuugggggaccuaccugugaaacagcucaaucccccugcgacaccaaagagugucagcacggcgggcagugccaggucgagaauggaucugccgugugugucugccaagcuggcuacacgggggccgcgugugaaauggauguggacgauugcagcccugaccccugucucaacggcggauccugcguugaucuggugggcaacuauacaugucugugcgccgagcccuucaaggggcuccggugcgaaaccggagaccauccugucccggaugcuugucugagcgcccccugccacaauggcgggaccuguguggacgcugaccagggauacguuugcgaguguccugaaggcuuuauggggcuugauugcagagagcgcgugcccgacgauugugagugccggaacggcggaagaugucugggcgccaauacaacccucugccaguguccucugggguucuuuggacuucugugcgaguucgaaaucacagcgaugcccugcaacaugaauacgcaauguccggacggcggguauugcauggaacauggaggcucuuaccucugugucugccacaccgaucacaacgccucccauagccugccuucucccugugacagcgauccuugcuuuaaugggggcuccugugacgcucacgaugacucuuauacaugcgaguguccccgcggauuccauggcaagcacugcgaaaaagcccggccucaucuguguagcuccgggcccugcagaaacggaggaaccugcaaggaggcugggggagaguaccacuguagcugcccguaucgcuucacaggccggcacugugaaauuggcaaaccugauucuugcgccuccgggcccugucauaauggagggaccugcuuucacuacaucgggaaguacaaaugugacugucccccuggauucagcggcagacauugcgagauugccccgucucccugcuuucgcuccccuugugugaacgggggaacgugcgaagaucgggacaccgacuucuuuugccacugucaggcuggcuauaugggcagacggugccaggcggagguggauugugggcccccugaagagguuaagcacgccacacuccgcuucaauggaaccagacugggcgcugucgcccuuuacgccugcgaccggggguauagccuguccgcucccucuagaauccgcgugugucagccucauggaguguggagcgagcccccgcaaugccucgaaaucgaugagugucggucccagccuugccugcacggcgggucuugucaggacagagucgccggauaccuuugccuguguagcacaggcuaugaaggcgcgcauugcgagcucgagcgcgaugaaugcagagcucaccccugucggaacgggggauccugccgcaaucugccuggcgccuacguguguagaugccccgccggguuuguuggagugcauugugagaccgaagucgacgcuugcgauagcucuccgugucagcacggcgggcggugcgaguccggaggcggcgccuaucugugugugugcccugagagcuucuuuggguaccacugugaaacgguuucugaccccugcuucuccagcccuuguggaggccgcggguacugccucgcgucuaacggaagccauuccugcacauguaaggugggcuauaccggggaggauugcgcuaaagaacuguuuccucccacagcccuuaagauggagagagucgaagagagcggagugucuauuuccuggaauccuccgaacggccccgccgcucggcaaaugcuggacggcuacgccguuaccuaugugagcuccgaugggucuuaccgcagaaccgacuucgucgaucggacacgcagcucccaccagcuccaggcucuggccgcgggcagagccuauaacaucucuguguuuagcgugaaaagaaauuccaacaauaagaacgacauuucucggccugcuguccugcuugcccgcacgcggcccagaccuguugaaggcuucgaggugaccaaugugacagcuagcaccaucuccguccagugggcccuccaucgcauucggcacgccacagugagcgggguuagagugucuauccgccaucccgaggcucugcgggaccaagcgaccgaugucgacagauccguggaucgcuucacguuucgggcccugcucccuggaaaaagauacacaauccagcugaccacccuuagcggccugcggggcgaggaacacccgacagaaucucucgcuaccgcccccacacacguuuggacgcgcccucugcccccugccaaccugaccgcugccagagugacagcgaccuccgcucaugucgugugggacgcccccacaccgggaagccuucucgaggccuauguuauuaaugugaccacgucucaguccaccaagagccgguacgucccuaacggcaaacuggcuuccuacacagugcgcgaucugcuccccggcagacgguaucagcugagcgugaucgccguccaaucuaccgaacuugggccccagcacagcgagccugcgcaucuguacauuaucacaucccccagagacggagcugaucgccgguggcaccagggcgggcaccauccuagaguucucaagaaucgcccgcccccugcccggcugcccgagcugagacuucucaacgaccacucugccccugaaacccccacacaaccgccucgcuucagcgagcugguggauggacggggcagaguguccgcucgcuuugggggaucucccagcaaggccgcuaccgucagaucccagccuacggccucugcgcagcuggaaaauauggaggaggcccccaaacgggugagccucgcucugcagcuuccugaacauggcuccaaggacauuggcaacguucccgggaauuguagcgagaacccgugccaaaauggaggcacaugugugccuggggccgaugcucacucuugcgacuguggacccggcuucaaagggcgcagaugcgaacuggccuguaucaaggucucccggcccugcacccgccucuuuagcgagaccaaagccuucccugugugggaaggcggaguuugucaucacguguauaagagagucuaccgggugcaccaggacaucugcuuuaaggagucuugcgaguccacaagccugaaaaagaccccgaacagaaaacaguccaagucucagacgcuggagaaaagcuga

SEQ ID NO: 76026 - RNA, 777 nt, Artificial Sequence
  derived and/or modified sequence opt5 from SNF8__Homo_sapiens__NP_009172
augcacagacggggcgugggggccggagcuaucgccaagaaaaagcuggcggaggcuaaauacaaggaacgcggcaccguccucgccgaggaccagcuggcccaaaugagcaaacagcuugauauguucaagacaaaccuggaagaguuugcuuccaagcauaaacaggaaauuagaaagaaucccgaguuccggguucaguuucaagacaugugcgccacgaucgggguggauccucucgcuucuggaaaaggcuucuggagcgagaugcugggggugggagacuuuuauuacgaacuuggcguccagauuaucgaggugugucuggcccucaagcaccgcaacggcgggcugauuacccuggaagaacuccaucagcagguucugaaaggaagaggcaaguucgcgcaagaugugucccaggacgaucuuauccgggccaucaagaaacugaaggcucucgggacaggauuuggcauuaucccggucgggggaaccuaucugauucagucugugcccgccgagcuuaauauggaccacacaguugugcugcagcucgcugagaaaaacggcuacgucaccgugagcgagaucaaggccucccugaaaugggaaacagagcgcgcgagacaagugcuggaacaucuccugaaggagggccuugccuggcuggaucuccaggcuccuggggaggcccacuauuggcugcccgcucuuuucaccgaccuguacucucaggaaauuacggccgaggaagcccgggaggcucucccuuga

SEQ ID NO: 76027 - RNA, 948 nt, Artificial Sequence
  derived and/or modified sequence opt5 from SNIP1__Homo_sapiens__XP_011540462
auggaccugcaguuccacauggccggcgaggcuagccaauccuggugggaagccagacggucuaagagccauggguggcgccaggagagagaagaucacccccggcgcggaagagaggaccggcagcaucgcgaaccuuccgagcaggagcacagacgggcgcgcaacucugauagagaccggcaucgcggccacagccaccaaagacggaccuccaaugaacgcccggggucuggacagggccaggggagagaucgggacacacagaaccuccaagcucaggaggaagagagagaguuuuacaaugcccgccggagagaacaucgccagcggaacgaugugggaggcggcgggagcgagucccaggaacugguccccagaccuggaggcaauaacaaagagaaggaaguucccgccaaagagaagccuagcuucgagcuuucuggggcucugcucgaagacacgaauaccuuucgcggaguggugaucaaauauuccgagcccccugaagcccggauuccgaagaagagauggcgccuguaccccuucaaaaacgaugagguccuuccugugauguauauccaccggcaaagcgcuuaccugcucggcagacaucgccggauugccgacauccccauugaucacccuucuugcuccaagcagcacgcgguuuuucaguauagacugguggaauacacacgggccgacgggaccgucggacgcagagugaaacccuauaucaucgaucugggcagcggcaaugggacauuccucaacaauaagcggauugagccgcaaagauacuacgagcugaaagaaaaggacguucuuaaguuuggauucucuucccgcgaguaugugcugcuccaugaaagcuccgacaccucugagaucgaucggaaagacgaugaagacgaggaggaagaggaagaggucagcgauuccuga

SEQ ID NO: 76028 - RNA, 2298 nt, Artificial Sequence
  derived and/or modified sequence opt5 from SNRK__Homo_sapiens__NP_001094064
auggccggcuucaagagaggguacgacggaaaaaucgcuggccuguaugaucucgacaagacccuggggcggggacacuuugccguggucaaacuugcgcgccauguuuucacaggcgagaagguggcugugaaagucauugauaagacgaagcuggacacccucgccacagggcaccuguuucaggaagugagaugcaugaaacuuguucaacaucccaacaucgugcggcuguacgaggucauugauacccagacaaagcucuaucugauccuggaacucggagacggcggcgauauguucgacuacauuaugaaacacgaggaagggcugaaugaggaucuugccaagaaauauuuugcucagaucgugcaugccaucagcuacugucacaagcugcacguugugcaucgcgaccucaagccugagaacgucguguucuuugaaaaacagggacuggugaaacuuaccgauuucggcuuuuccaauaaauuccaaccggggaagaaacugacaaccucuugcggaagccucgcuuauuccgcccccgagauucugcugggcgacgaauacgaugcgccugccgucgacaucuggucucucgggguuauucuguuuaugcuuguguguggacagcccccuuuccaggaggcuaacgacagcgagacgcugaccaugaucauggauugcaaguacacagugcccucccacgucucuaaagaauguaaggaccucauuaccagaaugcugcagcgggauccuaagcgcagagccagccuugaggaaaucgagaaucauccguggcugcaaggcguggaccccuccccugcuacaaaauauaacauuccccucguuagcuacaagaaucugucugaagaggagcacaacuccaucauccagcggauggugcugggcgauauugccgaccgcgaugcgaucgucgaagcccucgagaccaauagauauaaccacauuacggcuacauacuuucugcuugccgaacggauccugcgcgagaaacaggaaaaggagauucagaccagaagcgcuucuccuuccaauaucaaagcccaauuccggcagagcuggcccacaaagaucgacgugccgcaggaucucgaggacgaucugaccgccaccccucuuucucaugcuacaguuccccaauccccugcgcgcgccgcugacagcgugcugaacgggcacagauccaagggacucugcgacucugccaaaaaggaugaccugcccgaacuggccggccccgcucucagcacggucccuccggccucccugaaacccaccgcgagcgggcggaagugucuuuucagaguggaggaagaugaggaagaggacgaggaagauaaaaagccuaugucucuguccacacaggucgugcuccgccggaagcccagcguuaccaauagacugacaucucgcaaaagcgcuccugugcugaaccagauuuuugaggaaggagaguccgacgaugaguucgacauggaugaaaaucuucccccgaagcucucucggcugaaaaugaacaucgccagcccuggcaccguccauaagagauaucaccgccggaaaucccaggggagaggaagcucuugcuccagcucugagacguccgacgaugacagcgaaucccgccggagacuggauaaggacucuggcuuuacauacagcuggcaucgccgggacuccucugaggggcccccugggagcgaaggagauggcgggggacaauccaagcccagcaacgccucuggcgggguggacaaggcuuccccuagcgagaauaacgccggcggaggcucucccuccagcgggucuggaggcaauccgaccaacaccagcgggacaaccagacggugugcuggaccuuccaauagcaugcagcucgccucucgcuccgcgggcgagcugguugaaagccuuaagcugaugucccucugccuggggucucagcugcacggcagcacaaaauauauuaucgauccccagaacggacuuuccuucucuagcgugaagguccaagagaaauccacguggaagauguguauuucuagcaccggcaaugccggccaggugcccgcugugggaggcaucaaauuuuucuccgaccacauggccgauacaaccacagaacucgagagaaucaagagcaagaaccugaaaaauaacguucugcagcucccucugugcgaaaagaccauuucugucaauauccagcggaacccgaaagaggggcuucugugcgcuuccagccccgccucuuguugccaugugauuuga

SEQ ID NO: 76029 - RNA, 6411 nt, Artificial Sequence
  derived and/or modified sequence opt5 from SNRNP200__Homo_sapiens__NP_054733
auggccgacgugaccgcuagaagccugcaguacgaguauaaggccaacuccaaucucguccugcaagcggaucggucucuuaucgaccgcacaagacgggaugaacccacgggcgagguucugagccucguggggaaacuggaaggaacccgcaugggcgacaaggcucagagaacaaaaccucagaugcaggaggaacggcgcgccaagagacggaaacgcgaugaggacagacacgauauuaacaagaugaagggguacacccuucuguccgagggaaucgacgaaauggugggcauuaucuauaaaccgaagacaaaagagacccgggaaacauacgagguccuccugucuuucauucaagccgcucugggggaucagccccgcgacauccucugcggagccgcugaugaggugcuggccguucuuaagaaugaaaaacugagagacaaggagcggcgcaaggaaaucgaucuccugcuuggccagaccgacgacacgagauaucaugugcuggucaaccucggcaaaaagauuaccgauuacgggggagacaaagagauccagaauauggaugacaacauugaugaaacauauggcgugaauguucaauuugagagcgacgaggaagagggggaugaagacguguacggagagguccgggaagaggcguccgaugacgauauggagggcgacgaagccguggugagauguacccugucugcuaaccuggucgccagcggggagcucauguccagcaagaaaaaggaccugcacccucgcgauaucgacgcuuucuggcuucagcggcagcugucuagauuuuacgaugacgccauuguuucccagaaaaaggcggaugaagugcucgagauccugaagacagccagcgacgaucgcgaaugcgagaaucaacuugugcugcuccugggauucaacaccuuugacuucauuaaaguccugcggcagcauagaaugaugauccucuauuguacgcugcuugcuucugcccaguccgaggcugaaaaggagcgcaucaugggcaaaauggaagccgaucccgagcugagcaaguuucucuaccaacugcacgagacagaaaaagaggaccuuauucgggaagagagaucucgccgggaaagagugcgccagucccggauggauaccgaccuggagacaauggaucucgaccagggcggggaggcccuggcuccuagacagguucuggaccucgaagaucugguguucacccaaggaagccauuuuauggcgaauaagcggugccagcuucccgacggcuccuuccgcagacagcggaagggguaugaggaaguccacgugccugcccugaaaccgaagcccuuuggaucugaggaacagcuccugccuguugagaaacugcccaaguacgcucaagccggcuucgagggguuuaaaacccuuaacagaauccagagcaagcucuaucgcgccgcucuggaaacagaugagaaucugcuccugugugccccuacgggagcgggcaagaccaacguggcucuuaugugcaugcugcgggaaauuggcaaacacaucaauauggacgggacaauuaacgucgaugacuucaagaucaucuacauugcccccaugagaucccucgugcaggagauggucggaagcuucggcaaacgccuggccaccuaugggaucacaguggcugaacugaccggagaucaucagcuuuguaaggaggagauuucugccacgcaaaucauuguuugcacaccggaaaaaugggacaucaucaccagaaagggcggggagcggaccuacacacagcucgugcgccugauuauccuggaugaaauucaccuccugcaugacgauagaggcccuguccuugaggcucugguggcccgggcgauccgcaacauugagaugacccaggaagacguuagacucaucggacuguccgccacacugcccaauuacgaggauguggcuacguuucuucgggucgacccugccaagggccucuucuauuuugacaacagcuuccgccccgugccccuggaacagaccuacguggggauuacagagaaaaaggcuaucaaaagauuucaaaucaugaaugaaauuguuuaugagaagaucauggagcacgccggaaaaaaccagguccugguguucgugcacucucggaaggaaaccggcaaaacagcgcgcgccauuagagauaugugucucgagaaggacacccuggggcuuuuucugcgggaaggaagcgcuuccacggagguccucagaaccgaagccgagcagugcaagaaucuggagcugaaagaucuucucccuuacggcuucgcuauccaucacgccgggaugacacgcguggaccggacccugguugaagaucuguuugccgacaagcauauucaagugcucgucucuacagcuacccuggcguggggcgugaaccuuccggcccacacgguuaucaucaaaggaacacagguguauagccccgagaagggcagauggaccgaacugggggcucucgauauucugcagaugcugggacgcgccggccggccucaguacgacacaaaaggggagggaauccuuauuaccucccauggcgaacugcaauauuaccucagccugcucaaucagcagcugcccaucgagucucagauggucuccaagcuuccugauaugcugaacgccgagauugugcucgggaauguucaaaacgcuaaggacgccgugaauuggcugggcuacgcguaucuguacaucagaaugcuucgcagccccacccuguauggaaucucucacgaugaccucaaaggcgacccgcugcucgaucagcggagacuggaccuuguccacacagcugcccugaugcucgauaagaacaaucuggugaaauacgacaagaaaacggggaacuuccaggugaccgaacugggacgcauugccucccauuauuacaucacaaaugauaccguccagacauauaaccaacuucugaagccuacccucagcgagauugaacuguuucggguuuucucccucucuagcgaguuuaagaacaucacggugagagaggaagagaaacuggaacuucagaagcugcuggagcgggugcccauuccugucaaagaauccaucgaggagcccucugcuaagaucaaugugcuccugcaggccuucauuagccaacuuaaacuggaaggcuucgcgcucauggcugacaugguuuacgugacacaguccgccgggcgccugaugagagccaucuuugagauuguccucaaccggggaugggcucagcugaccgauaagacccuuaaucuguguaagaugaucgacaaacgcauguggcagagcaugugcccucugagacaauuccggaagcuccccgaagaggugguuaaaaagauugaaaaaaagaacuuuccguucgagagacuguacgaucuuaaucacaacgagaucggcgaacugauucgcaugccuaaaauggggaagacaauccauaaguaugugcaccucuuucccaaacuggagcucucuguccaccugcagcccaucacccgguccacacuuaagguggaacugacgauuaccccugacuuccagugggaugagaaaguucauggcagcucugaagccuuuuggauccugguggaggacgucgauuccgaggugauucuccaccaugaauacuuccugcuuaaggcuaaauaugcccaggacgagcaccugaucacauuuuucgugccggucuuugaaccccucccuccccaauacuucauuagaguugugagcgaccgcuggcugucuugcgagacccagcucccugugagcuuucggcaucugauccuucccgagaaguauccucccccgacagaacugcuggaucuccagccucugcccgucuccgcgcuuagaaauagcgccuucgagucucuguaccaggacaaguucccuuuuuucaaccccauccaaacccagguguuuaauacgguuuauaacuccgaugacaauguguucgucggagcuccgaccggcagcgggaaaacaauuugugccgaauuugcuauccuccgcaugcugcugcaguccucugagggacggugcguguacauuaccccuauggaagcccucgccgagcagguuuacauggauugguaugagaaguuccaagacagacuuaacaaaaaggugguccugcugacaggcgaaaccagcacagaucucaaacugcuugggaagggaaauaucauuaucuccacccccgagaagugggacauccugucucgcagauggaaacagcggaagaacgugcagaauauuaaccucuuugucguggaugaaguucaccugaucggcggcgagaacgggccugugcuggaagucauuuguagccgcaugagauacaucuccucucaaauugagcggcccauccgcauuguggcucucagcuccagccuuucuaaugcgaaagacguugcccacuggcugggaugcuccgcuacgagcacauucaacuuucaucccaaugugagaccugucccgcuggagcuccacauccagggcuucaacaucucucauacccagacccggcugcuuuccauggccaagcccguguaucacgccauuacaaaacauagcccuaagaagcccgugaucguuuuugucccuucuagaaaacagacccgccugacggcuauugauauccucacaaccugugccgcggacauucaacggcagagauuccugcacugcacagaaaaggaucugauccccuaccucgagaaacuuuccgacagcacccugaaggaaacacugcucaauggggugggauaucugcacgagggccuuuccccuauggaacgccggcugguggagcagcucuucagcucuggggcuauccaggucgugguugccagcagaucccuguguuggggaaugaacguggccgcucaucuggucauuaucauggacacccaauacuauaauggcaaaauucacgccuacguggauuacccgaucuaugacguucuccagauggugggccaugcgaaccggccccuucaggaugacgaggggcgcugcgucauuaugugucagggaucuaagaaggauuuuuucaaaaaguuucuguacgaaccucugcccguggagagccaccucgaccacugcaugcaugaucacuucaaugcugaaaucguuacgaaaaccaucgagaacaagcaagacgccguggauuaucugacauggaccuuucuuuacagacggaugacacagaauccuaacuauuacaaucugcagggcauuucccaucgccaccucucugaccaucugagcgagcuggucgaacaaacccucuccgaucuugagcagucuaaauguaucagcauugaagacgagauggacguggccccccugaaccuggggaugaucgcugccuauuacuacauuaauuauacgacaaucgaacucuucuccaugagccugaacgcuaagaccaaagugagaggacuuauugagaucaucucuaacgccgcggaguacgaaaauauuccgauccggcaccacgaggauaaccugcuccgccagcuggcccagaaggucccucauaagcugaauaaccccaaauuuaaugacccccacguuaagacaaaccuccuucugcaagcucaucuguccagaaugcagcucagcgccgaacugcagucugauaccgaggaaauucuuuccaaagcuauccggcugauucaggccugcguggacgugcucagcuccaauggcuggcugucuccugcccuggcugcgauggagcucgcccaaauggucacccaggcuauguggagcaaggauuccuaucuuaaacagcugccccacuucacaagcgagcacaucaagcgcugcacggacaaggggguggaaucuguuuuugauaucauggagauggaagacgaggaaagaaacgcccugcuccagcugaccgauucccaaauugccgacguggcucgguucuguaauagauacccuaacaucgagcuuagcuaugaggucguggauaaagacucuauucgcagcggaggcccgguugugguccuggugcagcucgaacgggaggaagaggucacaggccccgugaucgccccucuguuuccccagaagagagaggaagggugguggguugugauuggagaugcgaaauccaauucucugaucagcaucaagcgccucacccuucagcaaaaagcuaaggugaagcuggacuucgucgccccugccacaggcgcucauaacuacacccuguauuuuauguccgacgccuacauggggugcgaucaggaguacaaauucucuguugacgugaaggaagcggagacggauagcgacuccgauuga

SEQ ID NO: 76030 - RNA, 468 nt, Artificial Sequence
  derived and/or modified sequence opt5 from SNRNP27__Homo_sapiens__NP_006848
augggcagaagccggucccgcucucccagacgggagcgcagacggagccgcuccaccucuagagaacgggagcgcagacggcgcgaaagaagccggucccgcgagagagaccggagacgcucucggagcagauccccucaccgccggagaagccgcucuccgcggagacaucgcuccacaagccccucuccuucccggcugaaggaaagacgcgaugaggagaaaaaggaaacgaaagagaccaagagcaaagaacggcagaucacagaggaggaccucgaagggaagaccgaggaagagauugaaaugaugaagcugaugggauucgccucuuuugauuccacaaaaggcaagaaaguggacgggagcgucaacgcuuacgccaucaauguuucccaaaagagaaaauaucggcaguacaugaaccgcaagggaggcuucaauagaccccuugauuuuauugcguga

SEQ ID NO: 76031 - RNA, 1287 nt, Artificial Sequence
  derived and/or modified sequence opt5 from SNRNP70__Homo_sapiens__NP_001287998
augacccaguuccugcccccuaaccuccuggcccuuuuugcuccgagagaccccaucccuuaccugcccccucucgagaagcugccccacgaaaaacaucacaaucaaccuuauugcggcauugccccguacauccgggaguucgaagauccccgcgacgcgccucccccuacaagagcugagacgcgggaagaacgcauggagagaaagcggcgcgagaaaauugagagacggcagcaggaaguggagaccgagcuuaagaugugggauccccauaacgacccgaaugcccagggggaugccuuuaaaacacuguucgucgcucgcguuaacuaugacaccacagaaagcaagcucagacgggaguuugaaguguacggaccuaucaagcgcauucacaugguguauuccaaaagaucuggcaagccccggggguacgccuucaucgaguaugaacaugagcgcgauaugcacagcgcuuacaaacacgccgacggaaagaaaaucgauggcagacggguccugguggacguugagagagggcgcaccgugaagggauggcggccuagacgccugggcggcgggcucggaggcacacggagagggggagcggaugucaauauucgccauuccggccgggacgauaccucuagauacgacgaacgcgaccgggauagagaccgcgagcgggaaagacgggagcgcagcagagaacgggauaaggagagagagcgccggagaucccgcucuagagaccggcgcagacggagccgcuccagagauaaagaggaacggcgcagaagccgggaacgcucuaaggacaaagauagagaccggaagagacgcuccagccggucuagagagcgcgcccggagagaacgcgagcggaaagaggaacugagagggggaggcggcgauauggcugagcccuccgaagccggggacgcucccccugaugacggaccgcccggcgagcuugggccugacggacccgauggcccugaggaaaaggggcgcgaccgggauagagagcggcgcagaagccaccggucugaacgcgagagacggagagaccgcgaucgggacagagaucgcgaccgggaacauaaaagaggagagcgcggcuccgagcggggcagagaugaagcccgcgggggaggcgggggacaagacaacggccuggaggggcucggcaaugauagcagagacauguauauggaauccgagggaggcgauggguaccuggcgcccgaaaacggauaucuuauggaggccgcuccggaguga

SEQ ID NO: 76032 - RNA, 849 nt, Artificial Sequence
  derived and/or modified sequence opt5 from SNRPA__Homo_sapiens__NP_004587
auggccgugcccgagaccagaccuaaccacacaaucuacauuaauaaccugaaugaaaagaucaaaaaggacgagcucaaaaagagccuguaugcuauuuucucccaguuuggccaaauccuugauauucuggucucucggagccucaaaaugcgcgggcaggccuucguuaucuuuaaggaaguguccucugcgacgaacgcucugagaagcaugcagggauucccguuuuacgacaagcccaugcggauccaguaugccaaaaccgauuccgacauuaucgccaagaugaaaggcacauucguggagcgcgauagaaagcgggaaaaacgcaagccuaagucucaagagacccccgcuaccaaaaaggccguccaagggggaggcgcuacaccugugguuggggccgugcagggacccgucccuggcaugccgcccaugacacaggcgccuagaauuaugcaucacaugcccggccagccucccuacaugccgccucccgggaugaucccuccucccggacuugcccccggccagauuccgcccggggcuaugccuccccagcagcugaugccuggacaaaugcccccggcccagccucucagcgagaaucccccuaaccauauccuguuucugaccaaucuccccgaagagacgaacgaacugaugcuuuccaugcuguucaaucaguuuccuggcuucaaagaggugcggcucguucccgggcgccacgacauugcuuuuguggaguucgauaacgaaguccaagccggagcggccagagacgcucugcagggcuuuaagaucacccagaauaacgccaugaaaaucagcuucgcuaagaaauga

SEQ ID NO: 76033 - RNA, 696 nt, Artificial Sequence
  derived and/or modified sequence opt5 from SNRPB__Homo_sapiens__NP_003082
augaccgugggcaagagcuccaaaaugcugcagcacaucgacuacagaaugcggugcauucuccaagaugggcgcaucuucauuggaacauuuaaggccuucgacaaacauaugaaccugauccuuugugauugcgacgaguuuagaaagauuaaacccaaaaauucuaagcaggccgaacgggaggaaaagcgcguccugggccucguucugcuuagaggggagaaccuggugagcaugacgguggaaggaccuccgcccaaggauaccggcaucgcccgggucccucucgcgggggcugccggaggccccggcaucgggcgcgccgcuggaagaggcauuccugccggggugcccaugccucaggcuccggccggacuggcgggccccguucggggagugggaggcccuucccagcaagucaugacaccccagggccgcgggaccguggccgcugccgcugccgcggccacagcuucuaucgccggagcuccuacccaguaucccccgggcagagggggaccucccccucccaugggccggggcgcucccccuccgggaaugauggggcccccucccggcaugcgcccucccauggggccgccuauggggauucccccuggcagagggacacccaugggaaugccucccccgggcaugcggccucccccucccgggaugcgcggccugcucuga

SEQ ID NO: 76034 - RNA, 480 nt, Artificial Sequence
  derived and/or modified sequence opt5 from SNRPC__Homo_sapiens__NP_003084
augcccaaguucuacugcgacuauugugauaccuaccugacacacgacagcccuuccgugagaaaaacgcauugcucuggccggaagcacaaagagaacgucaaggauuauuaccagaaauggauggaggaacaagcccagagccucaucgacaagaccacagcugccuuucagcaggggaagauuccgcccaccccuuucuccgcgcccccucccgcuggagccaugaucccuccgcccccuucucugcccggcccuccccgcccggggaugaugccugcuccccauaugggaggcccucccaugaugcccaugauggggccuccgcccccuggaaugaugcccguuggcccugcccccggcaugagaccgccuaugggcggacacaugcccaugaugccugggcccccuaugaugcggcccccggcccgcccuaugauggugcccacaagacccgggaugacccggccugaucgcuga

SEQ ID NO: 76035 - RNA, 360 nt, Artificial Sequence
  derived and/or modified sequence opt5 from SNRPD1__Homo_sapiens__NP_008869
augaagcuggugagauuccucaugaaacugagccacgagaccgucacaaucgaacuuaagaacggcacgcagguucaugggaccauuacaggaguggacguguccaugaauacccaccugaaagccgucaagaugacacucaaaaaccgggagcccgugcaacuggaaacccuuucuauccgcggcaauaacauuagauacuuuauccugccugauagccucccgcuggacacacugcucguugauguggagcccaaggucaaguccaaaaagcgggaagcuguggccgggcgcggaagaggccgggggcgcggaagaggccggggccgcgggagaggacggggcgggccucgcagauga

SEQ ID NO: 76036 - RNA, 381 nt, Artificial Sequence
  derived and/or modified sequence opt5 from SNRPD3__Homo_sapiens__NP_004166
augagcaucggcgugcccauuaagguccugcacgaggccgaggggcauaucguuaccugcgagacaaacacgggagaaguguacagaggcaaacucauugaggcugaagacaauaugaacugucagauguccaauaucaccgugacauaucgggaugggcgcgucgcccaacuggaacagguguacauuagaggaucuaagauccgguuccuuauccugccugacaugcucaaaaacgcgccgaugcuuaagagcaugaaaaauaagaaccagggcuccggggcuggacgcggcaaggccgccauucugaaagcucagguugccgcuagaggccgggggcgcggaaugggcagagggaauaucuuucaaaagcggcgcuga

SEQ ID NO: 76037 - RNA, 255 nt, Artificial Sequence
  derived and/or modified sequence opt5 from SNRPE__Homo_sapiens__NP_001291393
augagcggccugggggccaccgugguccagaaccucaucuucagauaccugcaaaaucggucccgcauucagguuuggcuuuaugaacaggugaacaugagaaucgagggaugcauuaucggcuuugacgaguacaugaaucuggugcucgaugacgcugaagagauucacucuaagacaaaaagccggaagcagcuggggcgcaucaugcuuaaaggagauaacaucacgcugcuccaauccgucucuaauuga

SEQ ID NO: 76038 - RNA, 261 nt, Artificial Sequence
  derived and/or modified sequence opt5 from SNRPF__Homo_sapiens__NP_003086
augagccugccccucaacccuaagccguuccugaauggccuuaccgggaaacccgugauggucaagcugaaauggggaauggaguacaagggcuaucucguuuccguggacggguacaugaacaugcagcuggccaauacagaagaguauaucgauggagcucuuucuggccaccugggggaagugcucauuagaugcaacaauguccuguacauccggggaguggaggaagaggaggaagacggcgagaugcgcgaauga

SEQ ID NO: 76039 - RNA, 723 nt, Artificial Sequence
  derived and/or modified sequence opt5 from SNRPN__Homo_sapiens__NP_073719
augaccgugggcaagagcuccaaaaugcugcagcacaucgacuacagaaugcggugcauucuccaagaugggcgcaucuucauuggaacauuuaaggccuucgacaaacauaugaaccugauccuuugugauugcgacgaguuuagaaagauuaaacccaagaaugcuaagcagcccgaacgggaggaaaaacgcguccugggccucguucugcuuagaggggagaaccuggugucuaugacgguggaaggaccgcccccuaaggauaccggcaucgcccgggucccccucgcgggggcugccggaggcccuggcguggggcgcgccgcuggaagaggcguucccgccggggugccuaucccgcaggcucccgccggacuggcgggcccuguccgcggggugggaggccccagccagcaaguuaugacaccucagggccgcgggaccguggccgcugccgcugucgccgcgacagccuccauugcuggagcccccacccaguauccgccuggcagagggacacccccuccucccgugggacgggcuaccccuccgcccggcaucauggccccucccccugggaugcggcccccgaugggaccucccauuggccugccucccgccagaggcacgccuaucgggaugcccccgccuggaaugcggcccccgccucccggcauucgcgggcccccuccucccggaaugagaccuccccggcccuga

SEQ ID NO: 76040 - RNA, 1518 nt, Artificial Sequence
  derived and/or modified sequence opt5 from SNTA1__Homo_sapiens__NP_003089
auggccagcggcagacgggcuccccgcaccgggcugcucgagcugagagccggagcgggcuccggggcuggaggcgaacgguggcagcgcgugcuucugucucucgccgaggacguccugacaguuagcccugccgauggggacccgggacccgaaccuggcgcucccagagagcaagaaccugcccagcuuaacggcgcugccgagcccggggcgggaccuccgcagcugcccgaggcccuccugcugcagcggcgcagagugacggugcggaaggcugaugccggcgggcucggaaucuccauuaaaggcgggcgcgaaaauaagaugccuauccugauuucuaaaaucuucaagggacuugcugccgaccaaaccgaggcgcuguuugucggcgaugccauucucagcgugaacggcgaagaccuguccucugcuacacacgaugaggccguucaggugcuuaaaaagaccgggaaggaggucgugcuggaaguuaaauacaugaaggacgugagccccuauuucaaaaauuccacaggaggcaccagcgucgggugggauucuccucccgcuuccccgcuccagagacagccuagcucucccggaccuacaccccggaacuuuuccgaggccaagcauaugagccugaaaauggccuacgugucuaagcgcugcacccccaaugacccugaaccgagauaucuggagaucuguuccgcugauggccaagacacccucuuccugcgggcgaaggaugaagccagcgcucgcuccugggccacggccauccaggcucaggugaacacacuuacccccagagucaaagacgagcugcaggcccuccuggcggcuacaucuaccgccgggagccaagacauuaagcagaucggauggcuuacggagcagcugccuuccggcggcacagcccccacccucgcucugcugacagaaaaagagcuccugcuuuaccugagccucccugaaacccgggaggcccugucuagacccgcucgcaccgccccgcuuauugcgacacggcugguucacuccgggccuagcaagggaucugugcccuaugaugccgaacucagcuuugcucugagaacgggcacccgccaugggguggacacacaccuguucuccgucgagucuccucaagagcucgccgcuuggacccggcagcugguggauggaugccauagagccgcggaaggcguucaggaggugagcacagccuguaccuggaaugggcgccccugcucccuuagcguccacaucgacaaaggcuuuacgcugugggcugccgaaccuggagcugcccgggccgugcuccugagacagcccuucgagaagcugcaaaugucuuccgaugacggcgcuagccuucucuuucuggauuucgggggagcggaaggcgagauucagcuggaccuccacucuuguccgaaaacaaucguuuuuauuauccauuccuuccugagcgccaaggugacccgccuugggcugcucgcuuga

SEQ ID NO: 76041 - RNA, 1617 nt, Artificial Sequence
  derived and/or modified sequence opt5 from SNTB1__Homo_sapiens__NP_066301
auggccguggcugccgcggcugccgccgcuggccccgccggggcuggaggcgggagagcccagcggagcggacugcucgagguccugguucgcgacagauggcacaaggugcuugugaaccuguccgaagaugcgcucguccugucuagcgaggaaggcgccgcugccuacaaugggaucggaaccgcuacaaacggcuccuucugccggggcgccggggcgggacauccuggcgccgggggagcucaaccgcccgacucuccugccggcgugcgcacggcuuuuaccgaucuucccgagcagguuccugaaagcauuuccaaucagaaaagaggggugaagguccugaaacaggagcucggaggccugggcaucucuauuaaagggggaaaggagaacaagaugcccauccugauuagcaagaucuucaaaggccucgccgccgaccaaacacaggcucuguaugugggggaugcgauccuuuccguuaauggagccgaccugcgggaugcuacccacgacgaagccgugcaggcccucaagcgcgcuggcaaagagguccugcuugaagugaaguacaugagagaggccacaccuuaugugaaaaaggggagcccggucucugagauuggaugggaaacacccccucccgaguccccucggcugggcggcagcaccucugaucccccguccagccagucuuuuuccuuccaucgcgacagaaagagcaucccucucaaaauguguuacguuacccgguccauggcgcuggcugaucccgaaaaccgccaacuggagauucacucuccugacgccaagcauacggugauccucagaagcaaagauuccgccaccgcucaggccugguuuagcgcuauucacucuaaugugaacgaccugcuuacacgggucaucgccgaagugcgcgagcagcuggggaagaccggaauugcgggcuccagagagauccggcaccucggguggcuggccgaaaaaguucccggagagagcaagaaacaguggaagcccgcucuugugguccugacagaaaaggaccuccugaucuaugauucuaugccuagacgcaaagaggccugguucagcccggugcauaccuacccccugcucgcuacgcggcugguucacuccggcccugggaagggcucuccccaagccggaguggaccuuagcuuugcgacaagaaccggcacacgccaggggauugaaacccaucuguuccgggccgagaccuccagagaucucagccacuggacacgcucuaucguccagggaugccacaauuccgcugagcugauugccgaaaucagcacggcuuguaccuauaaaaaccaagagugccggcuuacaauucauuacgaaaauggcuuuucuaucaccacagagccucaggaaggggccuuccccaagaccaucauucaguccccguacgagaaacugaagaugagcuccgacgauggaaucagaaugcucuaucuggacuuuggcgggaaggauggcgagauucagcuggaccuccacucuuguccuaaacccaucguguucauuauccauagcuuucuguccgccaagaucacgcgccuuggacuggucgcuuga

SEQ ID NO: 76042 - RNA, 1443 nt, Artificial Sequence
  derived and/or modified sequence opt5 from SNTG1__Homo_sapiens__NP_001274743
auggacuucagaaccgccugcgaggaaacaaagacgggcaucugucugcuccaggaugggaaccaagagcccuuuaaagugcggcugcaccuugcuaaggacauucugaugauccaggaacaggaugucauuugcguuagcggagagccuuucuacuccggcgaacgcaccgugacaaucagacggcagaccgucgggggauuuggccucucuauuaaagggggagccgagcauaauaucccgguggugguuagcaagaucuccaaagagcaacgcgcggaacugucuggccuucuguucauuggcgacgcuauccuccagauuaacgggaucaaugugagaaagugucggcacgaggaagucgugcagguucugcgcaacgccggagaggaggugacacugaccgucagcuuucucaagagagcccccgcuuuccugaaacuuccucugaaugaagauugcgccugugcucccuccgaccagucuagcggcacauccagcccucucugcgauucugggcugcaucuuaacuaucaccccaauaacaccgacacgcuguccuguagcucuuggccuaccuccccgggacuccggugggagaagcgcuggugcgaucugagacugauuccccuccugcauagccgguuuucucaauacgugccuggcacagaccuuucccgccagaaugccuuccaggugaucgcggucgaugggguuuguaccggaauuauccagugccugagcgccgaagacuguguggauuggcuccaagcuaucgccacaaacauuuccaaucugaccaaacacaacaucaagaaaauuaauagaaacuuucccgugaaucagcagaucgucuauaugggcuggugcgaggcucgggaacaagacccucuucaggaccgcguguacucucccacguuccuggcccucagaggcagcugccuguauaaguuucuggcgccgccuguuacaaccugggauuggacacgggccgagaagaccuucuccguguacgagauuauguguaaaauccucaaggacagcgaucugcuugacagacgcaaacagugcuuuaccguccagucugaauccggggaggaucuguauuucagcguggaacucgagucugaccuggcucaaugggaacgggccuuccagacagcuacguuucuugagguugagagaauccaguguaagaccuacgccugcgugcuggaaagccaccucaugggacugacaauugauuucuccaccggcuuuaucuguuucgacgccgcuacaaaagagcuggaauuuucuaaccucuucgcgguccugcauugcauucacagcuuuuucgccgcuaagguggccugucuugauccccuguuucucgggaaccaggccaccgcuuccacggccgcgagcucugcuacaaccuccaaagccaaguacaccacauga

SEQ ID NO: 76043 - RNA, 1620 nt, Artificial Sequence
  derived and/or modified sequence opt5 from SNTG2__Homo_sapiens__NP_061841
augggcaccgaggggcccccuccgcccgccgcuagcagaggacggcagggcugccugcucgugccugcccgcacaaagacgaccaucgcgcugcuuuacgacgaagaguccgaaaacgcuuaugauauuagacugaaacucacaaaggagguccugaccauccaaaaacaggacguugugugugucgggggaucucaccagggccggaaucgcagaacagugacccuucggcgccagcccguugggggacugggccucagcauuaagggcggguccgaacauaacgugccuguggucaucucuaaaauuuucgaggaucaagccgccgaccagacaggaaugcuguuugugggcgaugcuguucuucaggugaaugggauccacgucgagaacgccacccaugaagagguggugcaccuccugagaaaugcuggagacgaagucacgaucaccguugaguaccuucgggaggcccccgcguuccugaagcucccucugggcagcccggggcccuccucugaucauagcuccggagccagcucuccucuuuuugacuccggccugcaccucaacggcaauagcucuacaaccgcucccuccagcccuucuucccccauugccaaggauccgcgcuaugagaaaagauggcuggacacacugagcgugccucucuccauggcucggaucucucgcuacaaggccgggaccgaaaaacugagauggaacgcguucgaagugcuugcccuggauggagucagcuccggcauucuccgguuuuauacggcucaggacgggacagauuggcugcgcgccgugagcgcuaauaucagagagcuuacccugcaaaacaugaagauggccaauaaaugcuguucucccuccgaccagguugugcacaugggaugggucaacgaaaagcuccagggcgccgacagcucucagacauuccggccuaaguuucuggcucugaaagggcccagcuucuacguguuuuccacacccccuguuucuaccuucgauugggugagagcggagcgcaccuaucaucucugcgagguccuguuuaaggugcacaaauucuggcuuacggaagacuguuggcugcaagccaaucucuaccugggacuucaggauuuugacuucgaggaucagcggccguacugcuucagcauugucgcuggccauggcaagucccacguguuuaacguugaacuggggagcgagcucgccaugugggaaaaaucuuuccaaagagccaccuuuauggaggugcagcgcacaggaucccggaccuauauguguagcuggcagggcgagaugcugugcuucacagucgacuuugcucugggguucaccuguuuugaaucuaagacgaaaaaugugcucuggagauucaaguuuucccagcugaagggaagcuccgaugacggcaaaacacgcguuaagcugcuguuccaaaaccucgauaccaaacagaucgagaccaaggaacuggaguuucaggaccugcgggccgugcuucacugcauucauucuuucaucgcggcuaaagucgccagcguggaucccggguuuauggacucccagucucucgccagaaaguacauguauagcuccuga

SEQ ID NO: 76044 - RNA, 1083 nt, Artificial Sequence
  derived and/or modified sequence opt5 from SNUPN__Homo_sapiens__NP_005692
auggaggaacugagccaggcccucgcuuccucuuucagcgugucccaagaccugaacucuaccgccgcgccccacccuagacuuagccaguacaaguccaaauauucuagccuggagcaguccgaacggcgcagacggcuccuggagcuucaaaagagcaaacgccuggauuacgucaaucaugcuagacggcucgccgaagacgauuggacaggcauggagucugaggaagagaacaagaaagacgaugaagagauggacaucgauacgguuaagaagcugccgaaacacuaugccaaucagcugaugcucuccgaguggcugauugacgugcccagcgaucuugggcaggaauggaucguggucgugugcccuguuggaaagcgcgcucugauuguggccucuagaggcuccaccagcgcuuacacaaaaucuggguauugugucaaccgguuuuccagccuccugcccggaggcaaucgcagaaacuccaccgccaaggacuacacaauccuugauugcauuuauaaugaggugaaccagaccuacuacguucuggacgugauguguuggcgggggcauccuuucuaugauugccagacagacuuucgcuucuacuggaugcacucuaaacuccccgaagaggaaggacugggcgagaagaccaagcugaauccuuuuaaauucgucggccucaagaacuuuccguguacgcccgagagccugugcgacgugcuuuccauggauuucccuuuugaaguggacgggcuucucuucuaucauaaacaaacccacuacagccccggaucuacaccucuggucggcuggcuuagacccuauaugguuuccgaugugcuggggguggcggucccggccggaccucucaccacaaagcccgacuacgcuggccaccagcugcagcagaucauggagcauaaaaagagccaaaaagaagggaugaaggagaagcugacccacaaagccucugaaaauggacauuaugagcucgagcaccugagcacgccuaagcugaaaggcuccucucacagccccgaucaucccggcugucugauggaaaacuga

SEQ ID NO: 76045 - RNA, 216 nt, Artificial Sequence
  derived and/or modified sequence opt5 from SNURF__Homo_sapiens__NP_005669
auggagagagcccgggaccgccugcaccucagacggaccaccgaacagcaugugcccgaggucgaaguucaagugaagcgcagacggacggcuagccuguccaaccaggagugccagcuuuacccucgcagaucucagcaacaacaggugccggucguggauuuccaggccgaacugcggcaggcguuucucgcugagacaccccgcggcggguga

SEQ ID NO: 76046 - RNA, 1611 nt, Artificial Sequence
  derived and/or modified sequence opt5 from SNW1__Homo_sapiens__NP_036377
auggcccugaccagcuuccuccccgcuccuacacagcugucccaagaccagcuugaggccgaagagaaggcgagaucucagcggagccgccagacgucccuggugucuagcagacgggaaccgcccccuuacggcuaucgcaaaggguggauccccagacuccuggaggauuuuggagacggcggggcuuucccugaaauucacgucgcccaauacccccuugauaugggacggaagaaaaagauguccaacgcccuggcuauccagguugacucugagggcaaaauuaaguaugaugccaucgcucgccaggggcagagcaaggacaaagugauuuacuccaaguauaccgaucucgugccuaaagaggucaugaaugccgacgauccggaccugcaaagacccgaugaagaggcgaucaaggaaaucacagagaaaacccggguggcccuggaaaagagcguuucucagaagguggcugccgcuaugccuguccgcgccgcggacaaacucgcccccgcucaguacauuagauauacaccuucccagcaaggaguggccuuuaacagcggcgcuaagcagcggguuauccgcaugguggagaugcagaaagaucccauggagccgccuagauucaagauuaauaaaaagaucccccggggcccucccucucccccugccccggucaugcauucccccagccgcaaaaugaccgugaaggaacaacaggaguggaagauuccucccugcaucucuaacuggaaaaaugccaagggguacacaauuccucuggacaaaagacuugcugcggacggacggggccugcagaccgugcacaucaacgaaaauuuugccaagcucgcugaggcccuguacaucgccgauagaaaagcucgcgaggccgucgaaaugcgggcgcagguugagagaaagauggcucaaaaggaaaaagagaagcaugaagagaaacuucgcgagauggcccagaaggcccgggaaagacgcgcugggauuaaaacgcacguggagaaggaagacggagaggcccgggaaagagaugagauccgccaugaccggagaaaggagcgccagcacgaucggaaccuguccagagcugcccccgacaaacggagcaagcuccagcgcaaugaaaacagagauauuuccgaggugaucgcgcugggcgucccgaauccucggaccucuaacgaagugcaauaugaccagagacuguucaaucagagcaaagggauggauuccggauuugccggcggcgaggacgagauuuacaacguuuaugaucaggcuuggcgcgggggaaaggacauggcccaaagcaucuaccggcccucuaaaaaucucgacaaggauauguauggcgacgaucuggaagcuagaaucaagacaaaccgcuucgugccugacaaagaguuuuccgggagcgauagacggcagcgcggaagagaaggccccguccaguucgaggaagacccuuuugggcuugauaaguuccuggaggaggccaaacagcacggaggcucuaagcggcccagcgacuccucucgcccgaaagaacaugagcacgaaggcaagaaaagacggaaggaguga

SEQ ID NO: 76047 - RNA, 606 nt, Artificial Sequence
  derived and/or modified sequence opt5 from SNX10__Homo_sapiens__NP_001186764
auguuccccgagcagcaaaaggaagaguuugugagcgucuggguuagagacccucggauccagaaagaagauuucuggcacuccuacauugacuaugagaucugcauucauaccaacucuauguguuuuacaaugaagacgagcugcgugcgcagacgguaccgcgaguucguguggcugagacagcggcuccaguccaaugcccugcuuguccaacugccggaacuccccucuaaaaaccuguuuuucaauaugaacaaucgccagcacguggaucagagacggcagggccuugaggacuuucugcgcaagguucuccaaaacgcccugcugcucagcgauuccucucugcaucuuuuccugcagagccaccucaauuccgaagacaucgaggccugugugagcgggcagaccaaauauucugucgaagaggcgauucauaaguuugcucugaugaacagacgguucccugaggaagaugaggaaggaaagaaagagaaugacaucgauuacgacuccgaaucuagcuccagcggccuugggcacucuuccgaugacagcuccucucacggaugcaaggugaacacagcuccccaggagagcuga

SEQ ID NO: 76048 - RNA, 477 nt, Artificial Sequence
  derived and/or modified sequence opt5 from SNX12__Homo_sapiens__NP_001243117
augagcgacaccgccguggcugauacaagacggcugaacuccaagccccaggaccucacggaugccuacggcccuccgucuaauuuccuggagaucgacauuuuuaacccccaaaccgucgggguuggacgcgcgagauucacaaccuaugaaacaaaucuuccuaucuuuaaacugaaggagagcugcgugcggcgcagauacuccgauuucgaauggcucaaaaacgagcuggaacgggacucuaagauuguggugcccccucuucccggcaaagcucugaagcgccagcucccuuuuagaggggaugagggaaucuucgaggagagcuuuauugaagaacggcgccagggccuggagcaguucaucaauaagaucgccgggcacccgcuggcccaaaacgagagaugucuccauauguuucugcaggaagaggcuauugaccggaauuauguccccggaaaaguucgccaguga

SEQ ID NO: 76049 - RNA, 2814 nt, Artificial Sequence
  derived and/or modified sequence opt5 from SNX14__Homo_sapiens__NP_001284543
auggugcccugggucagaaccaugggccagaagcugaaacaacggcuccgccuggacguugggagagagaucugccggcaguacccucuuuucuguuuucugcuccugugccuuagcgccgcuucccugcuccugaaccgcuauauucacauccugaugauuuucuggucuuuuguggccggaguggucacauucuacuguagccucggcccggauucccugcuucccaauaucuuuuucacgauuaaguauaaaccuaagcagcuggggcuccaggaacuguuuccccaaggacauucuugcgcgguguguggcaaaguuaagugcaagagacaccggccuagccuucugcucgagaacuaccagcccuggcuggaccugaaaaucuccucuaagguggaugcuagccucuccgaaguccuggagcuugugcuggaaaauuucguuuauccuugguaccgcgacgugaccgaugacgagagcuuugucgaugagcucagaaucacacugcgguucuuugccucugugcuuauucgcagaauccauaaaguggacauuccguccaucauuaccaagaaacugcucaaggccgcuaugaagcacaucgaagucauuguuaaagcccggcagaaggugaaaaacacagaguuccugcagcaagcugcccuggaagaguaugggcccgagcuccauguggcgcugcgcagcagacgggaugaacuucacuaccugcgcaagcucaccgagcugcuuuuuccuuacauccugcccccuaaagccacagacuguagaucucucacccugcugauccgggaaauucucuccggaagcgucuuccugcccucucuugauuuccuggcugacccggauacggugaaucaccuccugaucauuuuuaucgacgacuccccucccgagaaggccaccgaaccugcuagcccccugguucccuuccuucagaaauuugccgagccuagaaacaagaagccguccgugcucaaacuggagcugaagcagauucgcgaacagcaagaucuccuguuccgguuuaugaauuuccuuaaacaggagggcgcgguccaugugcugcaguuuugccucacaguugaagaguucaacgacagaauccugcgccccgaacugucuaaugaugagaugcuuagccuccacgaggaacugcaaaagaucuauaaaaccuacugucuggacgaguccauugauaagauccgguuugacccuuucauuguggaagagauccagagaauugccgaaggccccuauaucgaugucgugaagcuccagacaaugcgcugccuguuugaggcuuacgagcauguccuuagccugcucgaaaacguguucaccccuauguuuugucacucugacgaguauuuccggcagcugcugagaggggccgaaucccccacgcgcaauagcaaacuuaaccggaauacacaaaagagaggagagucuuucggcaucagccgcauuggguccaaaaucaagggaguuuuuaaaucuaccacaauggagggcgcuaugcucccgaacuacgggguggccgaaggagaggaugacuucauugaagagggcaucgucgugauggaagaugacagcccuguugaggccguguccacccccaauaccccucggaaccuggcugcguggaagauuagcauccccuaugucgacuuuuucgaggauccuucuuccgaaagaaaggagaaaaaggaacggauucccguguuuugcaucgacguggagcgcaacgauagacgggccguuggccacgaaccggagcauuggagcgucuacagacgcuaccuggaguucuaugugcucgaaucuaaacugacagaguuucacggggcuuucccugacgcccagcuucccuccaagcggaucauuggacccaaaaauuacgaauuucuuaagagcaagagagaggaguuccaggaauaucuccagaaacugcugcaacauccugagcuuuccaacucucagcuccuggccgauuuucugagcccgaauggcggggaaacgcaguuccucgacaagauccugcccgaugugaaccuuggaaaaauuaucaaguccgucccuggcaaacugaugaaggagaaagggcagcaccucgaacccuuuauuaugaauuucaucaacucuugcgagagcccuaagcccaagccuucccgccccgagcugaccauccugagcccgacaucugaaaauaacaaaaagcuguucaaugaccuguuuaaaaacaaugcuaacagagccgagaauaccgaacggaagcaaaaccagaauuacuucauggaggugaugacaguugaaggaguguaugauuaccucauguaugucggccgcgugguuuuucaggugccugacuggcugcaucaccuccugaugggcacccggauucuuuucaaaaacacgcuggagauguacacagauuacuaucuccaguguaagcuggagcaacuguuucaggaacacagacuugucucccugaucacccuccugcgcgacgcgauuuucugcgagaacaccgaacccagaagccuccaggauaagcaaaaaggggcuaagcagacauuugaggaaaugaugaauuacaucccugaccugcuugugaaauguauuggagaggagaccaaguaugaaucuauccggcuccuguucgacggccugcagcagcccguucugaacaaacaacuuacauacgugcugcucgauaucgucauucaggagcuguuuccggaacucaauaaggugcagaaggaggugacguccgucaccagcuggauguga

SEQ ID NO: 76050 - RNA, 1035 nt, Artificial Sequence
  derived and/or modified sequence opt5 from SNX16__Homo_sapiens__NP_690049
auggccacccccuacgugccugucccgaugcccaucggcaacagcgcuuccucuuucacaacgaauagaaaccagcggagcuccucuuuugggagcguuuccaccucuagcaauuccagcaagggacaacuggaggacucuaacaugggcaauuucaaacagacauccgugccugaucagauggacaacaccagcucugugugcuccagcccccucauucgcacaaaguuuaccgggacagccucuuccaucgaauauagcaccagaccucgggauacggaggaacagaaucccgagaccgucaacugggaagaccgcccuuccacaccgaccauucugggauacgaggugauggaggaaagagcgaaauucacaguuuauaagauccuugugaaaaagacccccgaggaaucuugggucguguuucggcgcuacacggauuucagcagacugaaugacaagcucaaagagauguuuccuggcuuccggcuggcccuucccccuaagcgcugguuuaaagauaacuauaaugcugacuuccuggaggauagacaacucgggcugcaggccuuucugcagaaccucguugcucacaaggacauugccaauugucuggcugugcgggaguuccuuugccuggaugaucccccgggaccuuuugacucccucgaagaaagccgcgccuucugugagacacuggaagagaccaacuacagacuucagaaagagcugcucgaaaagcaaaaggagauggaaucucugaaaaagcugcucuccgagaaacagcugcauaucgacacacuugaaaaucggauccgcacccugagccucgagcccgaggaaucucuggacgucagcgagaccgaaggcgagcagauucuuaagguggaauccucugcgcuggagguggaucaggacguccucgaugaggaaagcagagccgacaacaaaccuugccuguccuucagcgagcccgaaaacgcuguuucugagaucgagguggccgaaguggcuuaugaugccgaggaagacuga

SEQ ID NO: 76051 - RNA, 1875 nt, Artificial Sequence
  derived and/or modified sequence opt5 from SNX18__Homo_sapiens__NP_001096045
auggcccugagagcucgggcccucuacgacuuccgcagcgagaaccccggcgaaaucucccugagagagcacgaagugcuuucucugugcagcgagcaggauauugaaggguggcucgagggagucaauucccggggcgaccgcgggcuguuuccugcgucuuauguucaagugaucagagcuccggagcccggaccugccggcgaugggggacccggcgccccugcucgguacgccaacgugcccccuggcggguucgaaccgcuucccgucgcuccucccgccagcuuuaagccucccccggacgcguuccaggcccugcuccagccucagcaagcucccccucccuccaccuuucagcccccuggagccggcuucccguaugggggaggcgcucugcagcccucuccucagcaacuguacgggggauaucaggccagccagggcuccgaugacgauugggacgaugagugggacgauagcucuacaguggcggacgaacccggcgcccucggguccggagcuuacccugaucuggacggcucuagcuccgccgggguuggagcugccggccgcuauagacuuagcacgcggucugaccugucccucgggagccgcggaggcuccgugcccccgcagcaucacccuucuggccccaaaagcuccgccaccgucagcagaaaucugaaccgguuuucuacauucgugaaguccgggggagaggcuuuuguucuuggcgaggcgagcggguucgugaaagauggagacaagcugugugucgugcucggcccuuacgggcccgaauggcaagagaauccuuaccccuuucagugcaccauugaugacccgacaaaacagaccaaguucaagggcaugaaaucuuauaucagcuacaagcuggugccuacacauacccaaguccccguucaccgcagauauaaacauuuugauuggcuguacgcccggcucgcugaaaaguuccccgugauuuccgugccucaucugccggagaaacaggccacgggacgcuucgaagaggacuuuaucucuaagagacggaagggccuuaucugguggaugaaccacauggccagccaccccguccuggcucagugugauguguuccagcacuuucuuaccugcccuuccagcacagacgagaaagccuggaagcaagggaaaagaaaggcggaaaaagaugagaugguuggagcuaauuucuuucugacccuuucuacacccccugccgccgcucuggaccuccaggaaguggaguccaagauugauggcuucaaauguuuuaccaagaagauggacgacagcgcccugcagcugaaccauacggcuaaugaguucgcccgcaaacaggucacaggguuuaagaaagaauaucaaaaggugggacagucuuuccggggccucucccaggcguuugagcuggaucagcaagccuucagcguugggcuuaaccaggcuaucgccuuuaccggcgacgcuuacgaugccauuggagaacuguucgcggagcagcccagacaggaccucgauccugugauggaccugcuugcccuguaucaaggccaccucgcuaauuuccccgauaucauucacguccagaaaggggcccugacaaaggugaaggaaucccgccggcaugucgaggaaggaaaaauggaggugcagaaggcugacggcauccaagauagaugcaacaccauuucuuuugccacccuggccgagauccaccauuuccaccagauccgcguucgggacuuuaaaagccagaugcagcauuuccuccaacagcagauuaucuuuuuccagaaggugacacaaaaacuggaagaggcucuccacaaguacgauuccgucuga

SEQ ID NO: 76052 - RNA, 1119 nt, Artificial Sequence
  derived and/or modified sequence opt5 from SNX19__Homo_sapiens__NP_001288018
auggacagcgauagaguggaggcccggaagucccugcucgaaucuuuccugaaacagcuuugcgcuauccccgagauugccaacagcgaagagguccaagaauuucuggcgcucaauaccgacgcucgcaucgccuucguuaagaaaccuuuuaugguguccagaauugauaagaugguggucucugccaucguggacacacugaaaacggcuuucccgcggagcgagccccaguccccuaccgaggaacuuucugaggccgaaacagagagcaagccccagaccgagggcaagaaagcuagcaagagccgccugagauuuucuuccagcaaaauuucuccugcccucuccguuacagaagcgcaggauaagauccuguacugucugcaagaggggaacguggaaagcgagacccucucuauguccgccauggaauccuucaucgagaaacagacaaagcugcuugagaugcagcccaccaaggcuccugaaaaagacccggagcagcccccuaagggacgggucgauuccugcgugucugacgccgcuguucccgcccaagauccuagcaauuccgaccccggcacggaaaccgagcuggcggauacagcccucgaccugcuucugcuccugcugaccgaacaguggaaauggcucuguacagagaacaugcagaaguuucugcgccuuauuuucgggacccuggugcagagauggcucgagguccaaguggcuaaucugacgagcccgcagcggugggugcaguaucuucugcuccugcaagaaucuaucuggccuggaggcguccugcccaaauuuccucgccccguuagaacacaggagcagaagcucgccgcugaaaaacaggcccugcaaucccuuaugggggugcugcccgaucucguggucgagauucugggagugaacaagugccggcuuagcuggggccugguucucgaaucucugcagcagccucugaucaaucgccaccucauuuacugucugggcgacaucauucuugaguuccuggaccucagcgccuccguggaggaaucugcugcgaccacaagcgccuccgauaccccggggaacagcaagagaaugggagucucuuccuga

SEQ ID NO: 76053 - RNA, 1569 nt, Artificial Sequence
  derived and/or modified sequence opt5 from SNX1__Homo_sapiens__NP_003090
auggccagcggcgggggaggcugcuccgcuucugagagacugcccccuccguuccccgggcucgaaccugagagcgaaggagccgcgggcggguccgagcccgaagcuggagacucugauaccgagggcgaggacaucuuuacaggcgccgccguggucagcaagcaccaguccccuaaaauuacgaccucucugcuucccaucaacaaugggagcaaggaaaacggcauucaugaggaacaagaucaggagccucaggaccuguucgcugaugccacaguugagcucucccuggacagcacccagaauaaccaaaagaaggugcuugcuaaaacacugaucucucucccgccccaggaagccaccaauuccagcaagccucagcccacauacgaggaacuggaggaagaggagcaggaagaucaauuugaccugaccgugggaauuacggauccugagaagaucggggacggaaugaacgcguaugucgccuacaaagugaccacacagaccucucucccccuguuccgguccaagcaguuugcuguuaaacgcagauucagcgauuuucuuggccuguaugaaaagcucucugagaaacacucccagaauggguucaucgugccgccucccccugaaaagagccugauuggaaugacaaaggucaaagugggcaaggaggacuccucuagcgccgaguuucuugaaaaacggcgcgcugcccuggagagauaccuccaacggaucguuaaccaucccaccaugcugcaggaucccgacgugcgcgaguuccuggagaaggaagaacucccuagagcggucggcacgcagacacuguccggggccggacuucugaaaauguuuaauaaggcuaccgacgccgugagcaaaaugacaauuaagaugaacgagucugauaucugguucgaagagaagcuccaagaaguggagugugaggaacagcggcugcgcaaacuucacgcugucguugagacccuggugaaucauagaaaggaacucgcccugaacaccgcccaguuugcuaaaucccuggcgaugcucggcagcucugaggacaauacagcccugagccgggcucuuucccagcuggccgaaguggaggagaagauugaacaacuccaccaggagcaggccaacaaugauuucuuccugcuugcugaacugcucucugacuauauccgccugcuggccauugucagagcggcuuuugaucagcggaugaaaacguggcaacgcuggcaggacgcccaggccacccuccagaagaagagagaggcugaagcccggcugcuuugggcuaacaaaccggauaagcugcaacaggccaaagacgagauccucgagugggaaagcagagugacacaguacgagcgcgauuucgaacggaucuccaccguugugagaaaggaggucauucgcuuugaaaaagagaaaagcaaggacuucaaaaaccacgugaucaaguaucuggagacacugcuuuacucucagcaacagcucgcgaaauacugggaagccuuucugcccgaggcuaaggccauuuccuga

SEQ ID NO: 76054 - RNA, 309 nt, Artificial Sequence
  derived and/or modified sequence opt5 from SNX20__Homo_sapiens__NP_001138444
auggccagccccgagcacccuggcuccccggggugcaugggacccaucacccaguguacagcuagaacgcaacaggaagccccugcgaccggccccgaccugccucaucccgggccugauggacaccucgacacacauucuggccugagcuccaacucuagcaugaccacacgggagcuucagcaguacuggcaaaaucagaagugccgcuggaaacacgugaagcuccuguucgaaauugcuuccgccagaaucgaggaacggaaagucucuaaguuuguugccccggcucccgaugccaccccuuga

SEQ ID NO: 76055 - RNA, 510 nt, Artificial Sequence
  derived and/or modified sequence opt5 from SNX24__Homo_sapiens__NP_054754
auggagguguacauccccagcuucagauaugaagaguccgaccuggaacggggcuacaccgucuuuaagauugagguucucaugaacgggcgcaaacacuucguggaaaagagauauucugaguuucaugcccugcacaaaaagcugaaaaagugcaucaagacaccugagauuccgagcaaacaugugcggaauuggguccccaaggugcuugaacagcgcagacaaggacucgagacguaccugcaggcuguuauccuugaaaacgaggagcugccuaaacucuuccuggauuuucugaaugugcggcaccuccccucccugccuaaggccgaaucuuguggcagcuucgacgagaccgaauccgaggaaucuagcaaacuuucccaucagcccguccugcucuuucugcgcgauccuuaugugcuuccggcggcuagcgacuuccccaacguugugauugaggggguccugcacggaaucuuuuacccucaccuccagcccagauga

SEQ ID NO: 76056 - RNA, 3015 nt, Artificial Sequence
  derived and/or modified sequence opt5 from SNX25__Homo_sapiens__XP_005263324
augcaccccgacgccaccgauagcggcggggcuggaccuuccccggccagagcggcuggcgccgggggacggcccgugucuggcuuccgcggggagagacggccugaaagccccggagacgccgaggcugccgcugccgcggccccuggcgcucccggcgggcgcuccugguggaagccugucgccguugcugcccuggcggccguggcucucucuuuucugggaccgggcagcggggaagccgcuggagccgccggccuuuccucugugcuguucagacucagccuguaccuuuccugcgcugcggccgcuuuucugcucgggauccuguucgcccuggucugucggagcccccgcgcccagccucccgauuuugcugccgcguggucuagacucgcugccacauccgccgcucggcgcccucccggaagcccgguguauggcaacucucaugaguccgcccaaagcagacggguugugauuucucacaauauggacaaagcucugaaggaagucuucgauuacuccuaucgcgacuacauccuuagcugguauggcaaccuguccagagaugaggggcagcucuaccaucugcuucuggaggacuuuugggaaauugcccggcagcuccaccaucgccugucucacguggauguugugaaagucgugugcaaugacguggucagaacgcugcucacccacuucugugaucugaaggcggccaacgcucggcaugaggaacagccuagacccuuuguucuucacgccugccugcgcaauagcgacgaugaggugcgguuccuccaaacauguuccagagugcuggucuuuugccuucugccuagcaaagacgugcagucucucucccugcgcaucaugcuggcugagauucucaccacaaagguucugaagcccguggucgaacuucugagcaaccccgacuauaucaaucagaugcuccuggcccagcuugcguaccgggagcaaaugaacgaacaucacaaaagagccuacaccuaugcuccuucuuacgaggauuucaucaagcugauuaauagcaacuccgacguggaauuucucaaacagcugcgcuaucagaucguuguggagauuauccaggccacaaccauuucuagcuucccgcaacugaagcggcacaaaggaaaggagacggcugccaugaaggccgaucuccugagagcucgcaauaugaaacgguacaucaaccagcuuaccgucgcgaagaaacagugugaaaagcgcauuagaauccugggcgggcccgccuaugaccaacaggaggauggagcucucgacgaaggcgaggggccucagucccagaaaauccugcaauucgaagauauucuggccaauacauuuuaccgggagcauuucggaauguauauggagagaauggacaagcgggcccuuaucagcuuuugggaaucuguggagcaccucaaaaacgcuaauaagaacgaaauuccccagcuggucggcgagaucuaccagaacuucuuuguggaauccaaggagauuagcguugagaaaucucuguacaaggaaauccagcaaugccucgugggcaauaaagggaucgaggucuucuauaagauucaggaagauguguacgagacccugaaagaccgcuauuacccuuccuuuaucguuagcgaucuuuaugagaagcugcucauuaaggaagaggaaaaacaugccucccagaugaucucuaacaaggacgagaugggacccagagacgaagcgggcgaggaggcuguggaugacgggacaaaucagauuaacgaacaagccagcuucgccgucaauaaacugcgggagcugaacgaaaaacuugaguacaagagacaggcucucaauuccauccagaacgccccgaagccugauaagaaaaucgugucuaagcugaaagacgaaauuauccugauugagaaggagcgcaccgaucuccagcugcacauggcgcggacggacugguggugugaaaaucuuggaauguggaaagcuagcaucacauccggcgaggugaccgaagagaacggggaacaacugcccugcuauuuuguuauggucagccuccaggaggugggcggaguggagacaaagaauuggaccgucccuagacgccugucugaguuccagaaccugcauagaaaacuuuccgaaugugugcccagccucaagaagguucaacugccuucucuguccaaacuccccuuuaagagcauugaucagaaauucauggaaaagucuaaaaaucagcugaacaaguuucuucagaaucugcucagcgacgagcggcugugccaauccgaggcccuguacgccuuccuuagcccgucuccugauuaccucaaggugaucgacguccagggcaaaaagaacuccuucagccuguccucuuuucuggaacgccuccccagagauuucuuuagccaccaggaggaagagaccgaagaggacuccgaucugucugacuauggggacgauguggacggacggaaagaugcucuugccgagcccugcuucaugcugauuggcgaaaucuuugagcuccgcgggauguucaaguggguuagacggacacugaucgcucuggugcaggucacguuuggacgcaccauuaacaaacaaaucagagacacagugagcuggauuuucuccgaacagaugcuuguuuacuauaucaauauuuuucgggaugccuucuggccuaacggcaagcuggcgccgcccaccacaauccgcucuaaggagcagagccaggaaaccaaacaaagagcccagcagaagcuccuggagaauaucccugacaugcuccaaucccugguggggcagcagaacgcucggcacggcauuaucaaaauuuuuaaugcccuucaggagacgagagcuaacaagcaucugcucuacgcccugauggaacugcuucugaucgagcucugucccgaacugcgcguccaccucgaucaacugaaagccggacagguguga

SEQ ID NO: 76057 - RNA, 2442 nt, Artificial Sequence
  derived and/or modified sequence opt5 from SNX29__Homo_sapiens__NP_115543
augagcggcucccagaacaaugacaagagacaauuccugcucgagcggcugcuugaugccgugaaacagugccagauccgcuuugggggaagaaaggaaauugcuucugacagcgauucccgggucaccugucugugcgcccaguucgaggcgguucuccaacacggccugaaacgcucuagagggcuugcucugacagccgccgcuaucaagcaggccgcuggauuugccagcaaaacggaaaccgagcccguguucugguacuaugugaaggaaguccucaacaagcaugagcugcagcgguuuuacucccugcgccacauugcgucugacgugggcagagggcgggccuggcuccgcugugcucugaaugagcauagccuugaaagauaucugcacaugcuccuggccgaucggugccgccuuuccacauucuacgaggacuggagcuuuguuauggaugaagagagaucuuccaugcugccuaccauggcugccggacucaacagcauccuguucgcgauuaauaucgacaacaaagaucugaauggccagucuaaguuugccccgacaguguccgaccuccugaaagagagcacccaaaacgucacaucucuucugaaggaauccacccagggcgugagcucccucuuccgggagaucacggcuucuagcgccguuuccauucugaucaaacccgaacaggagaccgauccucuucccguggucagccgcaaugugucugcugacgccaaguguaagaaagaaagaaagaaaaagaaaaaggugacaaacauuaucuccuuugaugacgaggaggacgaacagaauagcggggaugucuucaaaaagaccccuggagccggcgagucuagcgaagacaacuccgaucggucuagcguuaauauuauguccgcuuuugagagccccuucgggccuaacucuaauggaucccaaagcucuaacuccuggaagaucgacagccugucccucaacggcgaguucggguaucagaaacuggaugugaagucuauugacgaugaggacguggaugagaaugaagacgaugucuacggaaacagcuccggcagaaaacaucgcggccacucugagagcccggaaaagccccuggaggggaauacaugccucucccagaugcacagcugggcgccucugaaagugcuucauaacgacucugacauccuguuucccguuuccggagugggcagcuauucuccugccgaugcuccccucgggucccuggaaaauggaaccggcccggaggaccacguccuuccugaucccgggcugcgguacagcguggaggccucuagcccuggacauggcagcccccucuccucucugcugcccuccgccagcguuccugaauccaugacgaucucugagcucagacaagcuacaguggccaugaugaaccgcaaggacgaacuggaggaggaaaaucggagccuuagaaaccugcucgauggcgagauggaacacuccgcggcucugcgccaggaggucgacacccugaagcggaaaguggccgaacaggaggagagacaggggaugaagguccaagcccuugcucgcgaaaaugaggugcucaaaguucagcugaagaaauacgugggagccguccagaugcugaagcgggaaggccagacagcugaggugccgaaccucuggucuguugauggggaagugaccgucgccgagcaaaagcccggagagauugcggaagaacuggccagcuccuaugaaagaaaacuuaucgagguggcugaaaugcacggcgagcugauugaguucaaugaacgccuccaucgggcccugguggcuaaggaggcccugguuucucagaugagacaggaacuuaucgaccuccgggggccuguccccggcgaucugagccagaccuccgaggaccaaagccugucugauuuugagauuuccaaccgcgcgcucaucaauguguggaucccuagcguguuccugagaggaaaagccgcuaacgccuuucacgucuaccagguguauauucggaucaaggacgaugaauggaauauuuacagacgcuauacagaguuccggucucuucaucacaaacugcagaacaaguacccccagguuagagcuuauaacuuuccgccuaagaaagccaucggcaauaaggacgccaaauucguggaggaacgcagaaagcaacuccagaacuaccugcgguccgucaugaauaaagugauucagaugguucccgaauuugcugcgagcccuaagaaagagacgcugauccaacuuaugcccuucuuuguggacaucaccccucccggggagccggucaacucucgcccuaaggccgcuuccagauuccccaagcucagccggggacagccccgcgaaacaagaaauguggagccucaguccggcgaucuguga

SEQ ID NO: 76058 - RNA, 1560 nt, Artificial Sequence
  derived and/or modified sequence opt5 from SNX2__Homo_sapiens__NP_003091
auggccgcugagagagaacccccuccgcugggcgacgggaagcccaccgauuucgaggaccucgaagauggagaggaccuguuuacaagcacgguguccacccuugaaucuagcccuuccucucccgagccugccagccugcccgcggaggauaucuccgcuaacucuaauggcccuaaaccgacagaagucguucucgacgaugaccgggaggaucuguucgccgaagccaccgaggaggugagccuugacucccccgaacgcgagccuauucugagcucugaacccuccccugcugugacacccgucaccccgacaacccucaucgccccuagaauugagagcaagucuauguccgcucccgugaucuuugaucggagccgcgaagagauugaggaagaggccaacggggacaucuucgauaucgaaauuggaguuucugacccugagaaagugggcgacgggaugaaugcguacauggccuauagagucacgaccaagacaucccugagcauguuuuccaaaucugaguucagcgugaagcggcgcuuuuccgauuuccugggacuccacagcaagcuggcuucuaaauaccuucauguuggcuauaucgugccucccgcccccgaaaaguccauugucggcaugaccaaagugaagguggggaaagaggacagcucuagcacagaauuugucgagaagagacgggcugcccuggaacgcuaccuccagagaaccguuaagcacccgacgcugcuucaagaucccgaccugcggcaguuccucgaguccucugaacugccucgcgcggugaacacacaggcccugagcggagcuggcauccucagaauggugaauaaagccgcugaugccgucaacaagaugaccauuaaaaugaaugaguccgacgccugguuugaggaaaagcagcaacaguucgagaaccuggaucagcagcuucggaaacugcaugugagcguugaagcucucgugugccaccgcaaggagcugucugcgaauacagccgcuuuugccaaauccgccgcuaugcuugggaacagcgaggaccauaccgcccugucuagagcgcucucccaacuggcugaagucgaggaaaagaucgaucagcugcaccaggagcaggccuucgccgacuucuauauguuuagcgaacuccuguccgauuacauucggcuuaucgcugccgugaagggaguuuucgaccacagaaugaaauguuggcaaaagugggaggacgcucagaucacccugcucaaaaagcgcgaggccgaagcgaaaaugaugguggccaauaagcccgauaagauucagcaagcuaaaaacgagauccgggaaugggaggccaagguccagcagggcgaaagagacuuugagcagauuucuaaaacaauccgcaaggagguggggcgguucgaaaaagagagagucaaggauuuuaagacggugauuaucaaauaucuggaaagccuuguucaaacccagcagcagcugaucaaguacugggaggcuuuccucccugaagccaaagcgauugccuga

SEQ ID NO: 76059 - RNA, 1314 nt, Artificial Sequence
  derived and/or modified sequence opt5 from SNX30__Homo_sapiens__NP_001013012
auggccggcgggcccccuaaggcucugccgagcaccggaccccacucccucagagacaugccucauccccuggccggcucuagcuccgaggaagcggucgggggagauucuacaccuagccccgaccuucugauggcucgguccuucggcgauaaagaccucauccugccuaacgggggaacgccggccggcaccucuagccccgccuccucuagcucccuucugaaucgccuccagcuggaugacgauauugacggcgagacaagagaucuguuugugaucguugacgauccuaagaaacacgugugcaccauggaaacauacauuaccuaucggaucacaaccaagagcacgcgcguggaguucgaccuccccgaauacucugucagacggcgcuaucaagauuuugacuggcugagauccaaacuugaggagagccagccuacccaucugauucccccgcucccugaaaaguucgugguuaaggggguggucgaccgguuuucugaggaguucguggagacacgcagaaaagcucuggauaaguuucuuaaacggaucaccgaccaccccguucuguccuucaacgagcauuuuaauaucuuccucacagccaaggaucugaacgcuuacaaaaagcagggaauugcccugcucacccgcaugggcgaaagcgugaagcacgucacagggggauauaaacugagaacgcggccucuugaguuugcggccaucggcgacuaccuggauaccuucgcucucaagcuggggacaauugaccgcaucgcccagagaauuaucaaagaagagauugaauaucuuguggagcugcgggaguacggacccguguacuccaccuggucugcucucgaaggcgagcuggccgaaccccuggagggcgucagcgcguguaucgggaauugcuccaccgcccucgaagaacugacagaugacaugacggaggauuuucuuccuguucugagagaauauauccucuacagcgacucuaugaaguccgugcugaaaaagcgcgaucaagugcaggcugaguaugaagccaaacuugaggcugucgcccugcggaaggaagacagaccgaaggugcccgccgacguugagaaaugucaggaucgcauggagugcuucaacgcugaccucaaggcggauauggaacgguggcagaauaacaaaagacaagacuuccgccagcugcugaugggaauggccgauaagaauauucaguacuaugagaaaugucucauggcuugggaaagcaucauuccucugcuucaggagaagcaagaggccaaguga

SEQ ID NO: 76060 - RNA, 318 nt, Artificial Sequence
  derived and/or modified sequence opt5 from SNX3__Homo_sapiens__NP_001287857
auggccgagaccguggcugacacaagacggcugaucacgaagccccagaaccucaaugaugccuacggcccuccgagcaacuuccuggaaauugacgucuccaauccccaaaccguuggggugggacgcggcagauuuacaaccuaugagauccgggugaaaacaaaccuuccuauuuucaagcugaaagaaucuaccguccgcagacgguacagcgauuuugaguggcuccgcuccgaacuggagagagagucuaaggggcgguggagcuccucuggaacagaacgcacccuuagcucccacguguucacgagauga

SEQ ID NO: 76061 - RNA, 1215 nt, Artificial Sequence
  derived and/or modified sequence opt5 from SNX5__Homo_sapiens__NP_689413
auggccgcugugcccgagcugcuccagcaacaggaagaggacagaagcaagcugcgguccgucucuguugaucuuaacguggacccuagccugcagaucgauauuccggacgcccucuccgaacgcgauaaagugaaguucaccguccacacaaaaacgacccugcccacauuucagucuccugaguucagcgugaccagacaacaugaagacuuuguuuggcuucacgauacacugaucgagaccacagacuacgcgggccucauuauucccccugcucccaccaagccugauuucgacgggccgcgggagaaaaugcagaagcugggagaaggcgagggguccaugacgaaggaagaguuugccaaaaugaagcaggagcuggaagccgaguaucucgcuguguucaaaaagaccgucucuagccaugaaguguuucugcagcgccuuuccagccaccccguucugucuaaagauagaaauuuccauguguuucucgaguacgaccaagaucuguccguccggcgcaagaacacaaaggaaauguucggaggcuuuuucaaaagcguggugaagucugccgacgagguccuuuuuaccgggguuaaagagguggacgauuucuucgaacaggagaagaauuuucugaucaacuauuacaauagaaucaaagacuccugcgugaaggcugauaaaaugacacggagccacaagaacgucgccgacgauuauauccacaccgcggccugucuccauucucuggcucuggaggaaccuacggugauuaagaaauaccuccugaagguugccgaacuuuucgagaaacugcgcaagguggagggaagagucuccagcgacgaagaucucaaacugacagagcuucugcgguauuacaugcucaauaucgaagcugccaaggaccugcuguaccgcagaaccaaggcgcucauugauuaugagaacuccaauaaagcccuggacaaggcucggcuuaaaucuaaggaugugaaacuggccgaagcucaccagcaggagugcugucaaaaguuugagcagcucagcgaauccgccaaggaggaacugaucaacuucaaacgcaagagaguugccgcuuuucggaaaaaucuuauugagaugagcgagcuggaaaucaagcaugcgagaaacaaugugucucuccugcaguccugcauugaccuguucaaaaacaauuga

SEQ ID NO: 76062 - RNA, 1788 nt, Artificial Sequence
  derived and/or modified sequence opt5 from SNX9__Homo_sapiens__NP_057308
auggccaccaaggcuagagugauguacgacuucgccgcggagcccggcaacaaugaacugacagucaacgagggggaaaucauuacgaucaccaauccugauguuggaggcggguggcucgagggacggaacauuaaaggcgaacgcgggcuggugccgacagacuauguggagauccuucccagcgauggaaaggaccaguuuuccugcggcaauucugucgcugaucaagccuuccuggacagccucuccgccucuaccgcucaggccagcuccucugcugccagcaacaaucaccaggugggcuccgggaacgauccuuggagcgcguggucugccuccaaaagcggaaauugggagucuuccgaaggcuggggagcucagcccgagggggccggcgcucaaagaaacacaaauaccccuaacaauugggacacagccuuugggcauccccaggcguaccagggaccugccaccggcgaugacgaugacugggaugaagacugggacggcccgaagucuagcuccuauuucaaagauagcgaguccgcugacgccgggggagcucagcggggcaacucucgcgccagcuccagcucuaugaagauuccccugaauaaguuuccuggguucgccaaacccggaacggagcaauaccuucuggcuaagcagcucgcgaaaccuaaggaaaagauccccaucauuguuggcgauuaugggccgauguggguguacccuaccuccacauuugacugugucguggccgaucccagaaagggaagcaagauguauggccugaaaucuuacaucgaguaccagcugaccccuacaaacaccaaccggagcguuaaucaccgcuauaagcauuucgacuggcucuacgaaagacugcuugugaaauuuggcuccgcuauucccauccccucucugccugauaagcaggucacggggcgguucgaggaagaguuuauuaaaaugcgcauggagagacuccaagccuggaugacacggaugugccgccacccggugaucagcgaauccgagguguuccagcaguuucugaacuucagagacgaaaaggaguggaaaaccggaaagcggaaggccgaacgcgaugagcuugcuggcgucaugauuuucagcacaauggagcccgaagccccugaccuggaucucguugagaucgaacaaaaaugugaggcgguggggaaguuuaccaaagcuauggacgacggagugaaggaacugcugaccgucggccaggagcauuggaaaagaugcacagggccccucccuaaggaguaucagaagaucggcaaagcccugcagucucuugccacgguguucuccagcucuggauaccaaggcgaaaccgaucugaaugacgcuauuacagaggccgggaagaccuaugaagagaucgcuucccucguugccgagcagcccaaaaaggaucugcacuuucuuauggaauguaaccacgaguacaaaggauuccugggcugcuuuccggacauuaucgggacacauaagggagcgauugaaaaggugaaagagagcgauaagcucgucgccaccuccaaaaucacgcugcaggacaagcagaauauggugaaacggguuucuaucaugagcuaugcucugcaagccgaaaugaaccacuuccauuccaauagaauuuacgauuacaacucugugauccgccucuaucuggagcagcagguccaguuuuacgagacaauugcugaaaaacuucggcaagcccugagcagauucccugugauguga

SEQ ID NO: 76063 - RNA, 1479 nt, Artificial Sequence
  derived and/or modified sequence opt5 from SOAT1__Homo_sapiens__NP_001239440
auggagcugaagcccuucuuuaugaaagaagugggcagccacuucgacgauuuugucaccaaccucaucgagaaguccgccucucuggacaaugggggaugcgcucuuacaacguucagcguucuggaaggcgagaaaaacaaucauagagccaaggaucuccgggcgccuccggaacaggggaaaauuuuuaucgcucgcagaucccugcuugacgagcugcucgagguggaucacauucggaccaucuaccauauguucauugcccugcugauccucuuuauccugucuacacuuguggucgacuauauugaugaaggacgccuggugcucgaguucagccugcuuuccuacgccuuuggcaaguuccccaccguuguguggacaugguggaucauguuucugucuaccuucagcgucccuuauuuucucuuccaacacugggcuacaggguacuccaagagcucucauccccugauuagaucccuguuccacggauuucucuucaugaucuuucagauuggcgugcugggcuucgggccuaccuauguugugcuugccuacacgcugcccccugcuagccgguuuaucauuaucuucgaacagauccgcuuugucaugaaagcccacucuuucgugagagagaacgugccgcggguccucaauuccgcgaaggagaaaagcucuaccguucccauuccuacagugaaccaguaucuguacuuucuuuucgcccccacccugaucuaccgcgacuccuauccuagaaaucccacagugcgguggggauacgucgcuaugaaguuugcccaaguguucggcugcuuuuucuauguuuacuauauuuucgaacgccucugugcuccgcuguuuagaaacaucaaacaggagccuuucagcgcccgggugcugguccucuguguguuuaauuccauucugcccgggguucuuauccuguuccucaccuuuuucgcguuucugcauugcuggcuuaacgccuucgcugaaaugcugcgcuuuggagauagaauguucuacaaggacugguggaacucuacgagcuauuccaauuacuaccggacauggaauguggucgugcacgauuggcucuauuacuaugccuacaaggacuuucugugguucuuuagcaaaagauucaagucugcugccaugcuggccgucuucgcuguguccgcgguugugcaugaguaugcccucgcugucugucugagcuuuuucuacccugugcuuuuuguucuguucauguuuuucggcauggccuuuaacuucaucgugaaugauucucgcaaaaagcccauuuggaacguccucauguggaccagccuguuucuggggaacggagugcuucucugcuucuauucccaggaaugguacgcccggcagcacuguccccugaaaaauccuacauuucuggacuacgugagaccgcgcucuuggaccugccgguauguuuucuga

SEQ ID NO: 76064 - RNA, 1569 nt, Artificial Sequence
  derived and/or modified sequence opt5 from SOAT2__Homo_sapiens__NP_003569
auggagcccggcggggccagacugcggcuccagcgcaccgaaggacugggcggggagagagaacggcaaccuugcggagacggcaacacagagacgcaccgcgcuccggaucuugugcaguggaccagacauauggaagccgucaaggcgcagcugcucgagcaggcucaagggcagcugcgggagcuucuggaccgcgccaugagagaagccauccagagcuaccccucccaggauaaaccucugcccccucccccuccgggaucucucagccggacacaagagcccucccugggcaagcagaaaguuuucauuauccgcaagucucuccuggacgaacuuauggaggugcagcacuuuagaaccauuuaucauauguucaucgcuggccuguguguguuuauuaucagcacacucgccaucgauuucauugacgaggggcggcugcuucuggaauuugaucuccugaucuucuccuuuggacagcugccucucgcucuggucaccugggugcccauguuccuuucuacacugcucgccccuuaccaagcgcugcgccuuugggccagaggcaccuggacgcaggcuaccgggcugggaugcgcccuccuggcugcccacgcgguugugcugugugcccuccccguccauguggcuguugagcaccagcugccgccugccagccggugcgugcuugucuuugaacaagugcgcuuccugaugaaauccuauagcuuucucagagaggcugugcccggcacacugcgggccagacgcggggaaggcauucaggccccuucuuucuccagcuaccuuuauuuucuguucugucccacccucaucuaccgggagacauaucccagaaccccuuacguccgcuggaauuacguugcuaagaacuucgcgcaggcccugggaugcgugcuguaugcuuguuuuauucucggccggcugugcgugccggucuucgccaauaugucuagagagcccuuuuccacgcgcgcccuugugcugagcauccuccacgcuacacugccugggauuuucaugcugcuucucaucuuuuucgccuuucugcauuguuggcugaacgcguucgcugaaaugcuccgguuuggagacagaauguucuaccgcgauugguggaacucuaccuccuuuagcaauuauuaccggacauggaauguugugguccacgacuggcuguauuccuacguguaucaggauggccuuagacugcucggggcccgcgcccggggaguugcuaugcugggcguguuccuggucucugccguggcucaugaguacaucuuuugcuucguccuuggguucuuuuaccccgugaugcucauucuguuccugguuaucggaggcaugcucaacuuuaugaugcacgaccaaagaaccggcccugccuggaaugugcugauguggaccaugcuuuuccuggggcagggcauucaggucagccucuauugucaggaaugguacgcgcggcgccacugcccccugccgcaagccacauuuuggggacuggugacgccuagauccuggagcugccauaccuga

SEQ ID NO: 76065 - RNA, 2622 nt, Artificial Sequence
  derived and/or modified sequence opt5 from SOBP__Homo_sapiens__NP_060483
auggccgagauggaaaaggagggcagacccccugaaaacaaacggagccgcaagccggcucaccccgugaaaagagagaucaaugaagagaugaagaacuucgccgagaauaccaugaacgaacugcucgggugguacggauaugacaaagucgagcugaaggauggcgaagacauugaguuucgguccuacccuacagauggggagucucgccagcauaucagcguucuuaaggaaaauucccugcccaaaccuaagcuccccgaggacucugugauuagcccuuauaacaucuccacgggauacucuggccuggcgaccgggaauggacuuagcgauuccccggcuggcagcaaagaccacggcucugugcccauuaucgucccucugauucccccucccuucaucaagccgccugccgaagaugacguguccaacguucaaaucaugugcgccuggugucagaaaguggggauuaagagauauagccucucuaugggauccgaggucaagagcuuuugcucugaaaaauguuucgcugccugccggcgcgcuuacuuuaagagaaauaaagcccgggaugaggacggccaugcggagaacuucccccagcagcacuaugccaaggaaacaccucgccuggcuuuuaaaaauaacugugagcugcucgugugcgauugguguaagcauaucagacacaccaaagaauaccuggacuucggggauggagagcggcgccuucaauuuugcuccgccaagugucugaaucaguacaagauggacauuuucuauaaagaaacacaggcuaaccuccccgccggccugugcagcacccuucaucccccuauggagaauaaggcggaggggacaggaguucagcugcucaccccggacuccuggaacaucccccugacggaugccagacggaaagcuccuucucccguggccaccgcuggccaaagccagggcccugggcccuccgccagcacaaccgucucuccguccgacacagccaacuguagcgugaccaagauuccuacgcccgugccuaaaucuauccccaucagcgaaacaccuaauauucccccggucuccguucagccucccgcuucuaucggacccccucugggcgugccgccccgcagcccucccauggugaugaccaacagagggccugucccccucccuauuuuuauggagcagcaaaucaugcagcagauucggcccccguucaucagaggaccuccccaccacgcguccaauccuaacagcccccugucuaauccgaugcuuccuggcaucgggcccccucccggaggcccccgcaaccugggcccuacauccagcccgaugcaucggcccaugcucucuccucacauucaucccccuuccacccccaccaugccugggaauccgcccggacugcuuccucccccucccccgggcgccccucugcccagccuccccuuuccucccguguccaugaugccuaacgggccgaugcccguuccucaaaugaugaauuucggacugcccucucuggcuccucucgugcccccgccuacacugcuuguccccuacccugugaucguuccccugccugugcccauuccgaucccuauucccaucccccacgucagcgauuccaagccuccgaacggcuucucuagcaauggggaaaacuuuauccccaaugccccuggcgacuccgccgcugccggaggcaagcccagcgggcacucucucuccccuagagauagcaaacagggaucuuccaagagcgcggacucucccccuggcugcagcgggcaggcucugucccuugccccgacgcccgccgagcauggacgcagcgaaguggucgaucugacccggagagcuggcucuccucccgggccucccggcgccggaggccagcucggguucccgggagugcugcaaggcccucaggacgggguuauugaucugacagugggacaccgcgcucggcuccauaacgucauccacagagcccugcacgcgcaugugaaagccgagcgcgagcccuccgcugccgaacggagaaccugcggcgggugucgcgacggccacugcagcccucccgcugccggagaucccggcccuggggcgccggccggacccgaggcugccgcugccuguaauguuauugugaacggcacaagaggggccgcugcggaaggagccaaguccgcugagccucccccugagcagcccccgccucccccucccccugcucccccgaaaaagcugcuuucuccugaggaacccgccgucagcgaacucgaguccgugaaggaaaacaauugcgccucuaacugucaucuggacggcgaggccgcgaaaaagcugaugggggaggaagcucuugccggcggagacaaaagcgaucccaaucucaacaauccugccgacgaggaucacgcuuaugcccugagaaugcugccgaagaccggcugcgugauccagcccguuccuaaacccgcggaaaaggcugccauggccccuuguauuaucuccucucccaugcucagcgcugggccugaggaccuggaacccccgcuuaagcggcgcugccugcggauucggaaccaaaauaaauga

SEQ ID NO: 76066 - RNA, 636 nt, Artificial Sequence
  derived and/or modified sequence opt5 from SOCS1__Homo_sapiens__NP_003736
augguggcccacaaccaggucgcugccgacaaugcgguuagcaccgcugccgagcccagacggcgcccugaaccguccucuagcuccucuagcucccccgccgcuccugccagaccccggccuugccccgcugugccugccccggcgcccggcgauacacauuuccgcacguuuagaucucacgccgacuaccggcgcaucaccagagcuagcgcccugcucgaugcuuguggguucuauuggggaccucuguccgugcauggcgcccacgagcggcuucgcgcggaacccgucgggacauuucuggugagagacagccggcaacgcaacugcuucuuugcccucucuguuaagauggcuuccggaccuaccagcauuagagugcauuuccaggccggccgguuucaccuggaugggucucgcgaguccuucgacugucuuuuugaacugcucgagcacuacgucgcugcccccagacggaugcugggagccccgcugagacagcgccgggugagaccucuccaggagcugugccgccaacggaucguugcuacagugggcagagaaaaucuugcgcgcauuccccugaacccuguccuccgggauuaucugagcucuuuccccuuucagaucuga

SEQ ID NO: 76067 - RNA, 597 nt, Artificial Sequence
  derived and/or modified sequence opt5 from SOCS2__Homo_sapiens__NP_001257400
augacccugagaugccucgagcccagcggcaacgggggagaaggcacacggucccagugggggacggccggaucugcugaggaaccuagcccgcaagccgcgcgccuggcuaaggcccuuagagagcugggccagaccgggugguacuggggauccaugacagugaaugaagccaaagagaagcucaaagaggcucccgaaggcaccuuccugauccgggacucuagccacuccgauuaucuucugacaauuucugucaagaccagcgccggcccuacaaaccuccgcaucgaguaccaggacgggaaauuuagacuggauuccauuaucuguguuaagagcaagcugaaacaguucgacucuguggugcaucucauugauuauuacguccaaaugugcaaggacaaacggaccggacccgaagcuccucgcaauggcacggugcaccuguaucuuaccaagccccuguacacauccgccccuagccuccagcaucuguguagacuuaccaucaacaaaugcacaggggcgaucuggggacugccgcuccccacccggcugaaggauuaucuggaggaguacaaguuucagguuuga

SEQ ID NO: 76068 - RNA, 678 nt, Artificial Sequence
  derived and/or modified sequence opt5 from SOCS3__Homo_sapiens__NP_003946
auggugacccacagcaaguuccccgccgcuggcauguccagaccucuggacacaucucuccggcugaaaacguuuagcuccaagucugaguaccagcuugucguuaacgccgugcgcaaacugcaagaaagcggguucuauugguccgcggugaccggaggcgaggcuaaucuccugcuuucugccgaaccggccgggacauuucugaucagagauagcuccgaccagcggcauuucuuuacccucagcgucaagacacagucuggaaccaaaaaccugcgcauucagugcgagggcggguccuucagccugcaaucugaucccagauccacacagccugugccccgguuugacuguguucucaagcuggugcaccauuacaugccucccccuggagcuccgagcuuccccucuccucccaccgaaccuuccagcgagguccccgagcagccguccgcccagccucuucccggcucuccuccccgcagagcuuauuacaucuauagcggcggggaaaagauuccccuggugcucucccggccucugagcucuaauguugccacgcuucaacaccugugccgcaaaaccgugaacggacaucucgauuccuacgagaaggucacacagcugccgggccccaucagagaauuucuggaccaguaugaugcgccucucuga

SEQ ID NO: 76069 - RNA, 1323 nt, Artificial Sequence
  derived and/or modified sequence opt5 from SOCS4__Homo_sapiens__NP_543143
auggccgagaacaaugaaaacaucagcaagaauguggacgucagacccaaaaccucccggucucgcagcgcugauagaaaggacggcuacguuugguccgggaaaaagcugucuuggagcaaaaaguccgagucuuauagcgaugccgaaacagugaacggaauugagaagacggaagugucccuccggaaucaggagcgcaaacacagcuguucuuccaucgagcuggaccuugaucauagcugcggccacagauuccuggggcggucucucaagcaaaaacugcaggacgcggucggacagugcuuuccuauuaagaacuguuccagccgccauucuuccggccuuccgagcaaaagaaagauccacauuuccgaacugaugcucgauaagugccccuucccuccccggucugaccuggcuuuucgcuggcauuucaucaaaagacacaccgccccuaucaauagcaaguccgaugagugggugagcacagaccugucucagaccgaacuccgggaugggcaacugaaacgcagaaacauggaggagaauauuaacuguuuuucccacacaaauguucagcccugcgugaucaccacagacaacgcccuuugucgggaaggaccuaugaccggcagcgucaugaaucuggugucuaacaauagcauugaggauuccgacauggacucugaugacgaaauccucacgcugugcaccagcucccgcaagagaaacaaaccgaagugggaucuugacgaugagauucugcagcucgaaacacccccuaaauaccauacccagaucgacuauguucacugucuggugcccgaucugcuccaaauuaacaauaacccuugcuacuggggcgucauggacaaguaugcugccgaggcucugcuugaggggaagcccgaaggaacauuccugcuccgggauagcgcccaggaggacuaccuguuuucuguguccuucagacgcuauagccggucucuucaugcgagaaucgaacaguggaaucacaacuuuuccuucgaugcccacgacccguguguguuucauagcccugacaucaccggccugcucgagcacuacaaagaucccuccgcuugcauguucuuugaaccucugcugucuacgccccucauucgcacauuccccuucagccugcagcauaucugccggaccgucauuuguaauugcacaaccuacgacgggaucgaugcccuuccuauuccguccucuaugaagcuguaucucaaagaguaccacuauaagagcaaaguuagagugcugcgcaucgacgcucccgagcaacaguguuga

SEQ ID NO: 76070 - RNA, 1611 nt, Artificial Sequence
  derived and/or modified sequence opt5 from SOCS5__Homo_sapiens__NP_659198
auggacaaggugggcaaaauguggaacaauuucaaguacagaugccagaaccuguuugggcacgagggaggcagccgguccgaaaaugucgauaugaacucuaaucgcugucucagcguuaaagagaagaacaucuccauuggggacucuacaccccaacagcagagcuccccucugagagaaaauaucgcccuucagcugggacucucuccgagcaaaaacuccagccggcgcaaucaaaacugcgcuaccgagauuccccagaucguggaaauuucuaucgagaaggauaaugacuccugugugacgccuggcaccagacuggcccggcgcgauagcuauucuagacaugcgcccuggggagggaagaaaaagcacuccugcagcacaaaaacccagucuucccuugacgcugauaagaaauucggccggacacgcagcggccugcagagacgggagcgcagauacggggucuccucugugcaugacauggauagcguuuccagccggaccgugggaucucgcucccucagacaacggcugcaggacacagucggccuguguuuuccuaugagaaccuauagcaagcagucuaagccccucuucagcaacaaacgcaagauccaccuguccgaacuuaugcuggagaaaugcccuuuuccggccgggucugaucucgcccagaaguggcaucugauuaaacaacacacggcucccgugagcccucacuccaccuucuuugacacauucgaucccagccuuguuucuaccgaagacgaggaggaccggcugagagaacgccggagacucuccaucgaggaaggaguggauccucccccgaaugcccagauucauacauuugaggcuaccgcccaggucaacccucuguacaagcugggccccaaacucgcgccugggaugacggaaaucagcggagacucuuccgccauuccccaagcuaauugugauagcgaggaggacacaaccacacugugccuucagucccgccggcagaagcagagacaaaucucuggcgauagccacacccaugugucccgccagggcgccuggaaggugcacacccagauugacuauauccacugucugguccccgaucuccugcagaucacagggaacccuugcuacuggggaguuauggaccgguaugaagcugaggcccuucuggaaggcaaaccggaggggacguuccuccugagagauucugcgcaagaagacuaccuguuuagcguguccuuccgccgguacaacagaagccuccaugcccggauugagcaguggaaucacaacuuuucuuucgaugcucaugaccccuguguguuccacuccagcaccgucacaggacugcuugagcauuauaaggacccuucuuccugcauguuuuucgaaccccugcucaccaucagccugaaucgcacauuuccuuucucucuucaguacauuugcagagccgugaucugucggugcaccacguaugauggcauugacgggcugccccucccgagcaugcugcaggauuuucugaaagaguaccacuauaagcaaaaaguuagagugcgcuggcucgaacgggagccugucaaggcuaaguga

SEQ ID NO: 76071 - RNA, 1608 nt, Artificial Sequence
  derived and/or modified sequence opt5 from SOCS6__Homo_sapiens__XP_005266840
augaagaaaaucagccugaagacccucagaaaauccuucaaccugaauaagucuaaagaggaaacagacuuuauggugguccagcaacccagccuugccuccgauuucggcaaggacgauucucuguuugggagcugcuacggaaaggacauggcuuccugugauauuaacggcgaggacgaaaaagggggaaagaaucggucuaaaagcgagucccucaugggcacgcugaagcgcagacuuagcgccaaacagaagucuaaggggaaagcgggaaccccuuccggcagcucugcugaugaagacacauucuccuccucuuccgccccgaucguuuuuaaggaugugcgggcccagcgccccauuagaagcaccucccugcggucucaccauuauagcccugcucccuggccucuccgccccacaaacuccgaggagaccugcaucaaaauggaagugagagucaaggcccuggugcacucuagcuccccuagcccggcucugaauggcguucggaaagacuuccaugaucuccagucugagacaaccugucaagaacaggccaacagccugaaguccucugcgagccacaauggggaccuucaucugcaccucgaugagcacgugcccgucgugauuggacugaugccucaggacuacauccaguauacgguuccccuugacgagggcauguacccucuggaagggucccgcagcuauugccucgauucuuccagccccauggaggugucugccgucccgccucaagugggaggcagagcuuuucccgaagacgagucccagguggaucaggaccuggucguugccccugaaaucuucguggaucagagcgugaacgggcugcucauuggaaccacaggcgucaugcugcaaagcccccgggcuggccaugacgaugugcccccucuuucuccgcugcugcccccuaugcagaauaaccagauccaacgcaauuuuagcgggcucaccggaacagaggcccacguugcggaguccaugagaugucaucuuaacuucgaccccaauucugccccuggcguggcucgggucuacgauagcgugcaguccagcgggcccaugguugugaccucucugacggaggaacucaaaaagcuggccaagcagggaugguauuggggcccgauuacacgcugggaagcugaggggaaacuggccaacgucccugacggauccuuucucgugagagauagcucugacgaccgguaccugcuuucccugagcuucagaucucacggcaagacccuccacacacgcaucgaacauagcaauggccgguuuuccuucuacgagcagcccgaugucgaggggcacaccagcauuguggaccugaucgaacauucuauuagagauuccgagaacggagccuucugcuauagccgcucccggcuuccuggcucugcuaccuaccccguuagacugacaaacccugugagccgcuuuaugcaaguccggucccuccaguaucuguguagauucgugauccgccaguacacgcggaucgaccugauucagaaacucccccugccgaauaagaugaaagauuaucuucaagaaaagcacuacuga

SEQ ID NO: 76072 - RNA, 1746 nt, Artificial Sequence
  derived and/or modified sequence opt5 from SOCS7__Homo_sapiens__NP_055413
augguguucagaaacgucggccggcccccugaggaagaggacguugaagccgcuccggagcccgggccuagcgaacugcucugcccccgccacagaugugcccuggauccuaaggcgcuucccccuggacuggcucucgagcggaccuggggcccggccgccgggcuggaggcucagcuugccgcucugggacucggccaacccgccgggccuggagugaaaacagugggcggcgggugcugucccugcccuugucccccgcagccucccccuccccagccccagccuccggcggccgcuccccaagccggagaagacccuacggagaccuccgaugcucugcugguccucgaaggccuggagucugaggccgaaagccuugagacaaauuccugcucugaagaggaacugagcucccccgggcgcggaggcgggggaggcggcagacuccugcuucagccucccgggccggagcugccucccgugccuuuuccccuccaggaccugguuccucugggacggcucucucgcggcgagcagcaacagcagcagcaacagcagcccccgccucccccucccccgcccgggccucugagaccccuugcgggaccuagccggaagggcuccuucaaaauccgccugagcagacucuuucggaccaagucuuguaacgggggauccggcggcggggauggaacaggcaaacgccccagcggggaacuggccgcuucugccgcuucccuuaccgacaugggaggcagcgccgggagagagcuggaugccggccggaagccuaagcucacacgcacccaaucugcuuucucccccgugagcuuuuccccgcuguucacgggagaaaccgucucucugguggacguugauauuagccagagaggccucacauccccucaucccccuacacccccgccucccccucggagaagccugucucuucuggacgauaucuccgggacccuccccaccagcgugcuggucgcgcccaugggaucuagccuucaguccuuuccucugccgcccccucccccuccccacgccccugacgcuuucccgcgcauugcccccauccgggccgcugagucucuccauagccagccuccccaacaccuucagugcccucuguacagacccgauuccagcucuuuugccgcgucccuccgcgaacuggagaaauguggcugguauugggggccgaugaauugggaggacgcugaaaugaagcugaaaggaaagccugacggcagcuuccuggugcgggauucuuccgaccccagauacauucucagccuguccuuucgcucucaggggaucacgcaucacacacggauggagcacuauagaggcaccuucagccuguggugccaucccaaauuugaagaucgcugucaguccguggucgaguucaucaagcgggccauuaugcacucuaagaacggaaaauuccuuuacuuucucagaagccgcguuccuggccugcccccuacaccggugcaacugcucuaucccgugucccgguucagcaaugucaagucucugcagcaucuuugcagauuucggauccgccagcuggugagaauugaccacaucccugaucucccccugccuaaaccccugauuuccuacauccggaaguucuauuacuacgacccgcaggaagagguuuaucuuagccucaaagaggcccaacugauuucuaagcagaaacaggaaguggagccuuccaccuga

SEQ ID NO: 76073 - RNA, 465 nt, Artificial Sequence
  derived and/or modified sequence opt5 from SOD1__Homo_sapiens__NP_000445
auggccaccaaggcugugugcguccugaaaggcgacgggcccguucagggaaucauuaacuucgagcaaaaggaaagcaauggcccugugaaaguguggggguccaucaagggacucacagagggccugcacggguuucauguccacgaguucggagauaacacggccggcuguaccucugcgggcccgcauuuuaauccccuuagcagaaaacacgggggaccuaaggacgaagaacggcaugugggcgaucuggggaacguuacagcugacaaggauggaguggccgacgucuccauugaggauucugugaucagccucuccggcgaccacugcauuaucgggcgcacccugguugugcacgagaaagccgaugaccuuggaaagggcggcaaugaagagucuacaaaaaccgggaacgcuggaagcagacuggccuguggcgucaucgggauugcucaguga

SEQ ID NO: 76074 - RNA, 669 nt, Artificial Sequence
  derived and/or modified sequence opt5 from SOD2__Homo_sapiens__NP_001019636
augcugagcagagccgugugcggcaccucccggcagcucgcucccguccugggguaccuuggaucucgccaaaagcacagccugccugaccucccguaugauuacggcgcccuggagccccauaucaacgcgcagauuaugcagcuucaccauuccaaacaccaugcugccuauguuaauaaccugaaugugacagaagagaaguaccaggaagcccucgcuaaaggggacgugacggcccaaaucgcucugcagccugcccugaaguucaacggaggcgggcacauuaaucacucuaucuuuuggaccaaccucagccccaauggaggcggcgagccuaaaggggaacugcuugaggcgauuaagagagauuucggauccuuugacaaguucaaagagaagcugacagccgcuucugucggcgugcaggggagcggauggggcuggcucggguuuaacaaagaacggggacaucugcagaucgccgcuugucccaaucaagauccucuucagggcaccacaggccugaucccgcuccuggggauugacguuugggagcacgccuauuaccugcaguauaagaacgugcgccccgauuaccucaaagcgaucuggaaugucauuaacugggaaaaugugaccgagagauacauggccugcaagaaguga

SEQ ID NO: 76075 - RNA, 723 nt, Artificial Sequence
  derived and/or modified sequence opt5 from SOD3__Homo_sapiens__NP_003093
augcuggcccuccugugcagcugucuucugcucgcugccggcgcguccgacgcuuggaccggggaggauucugccgaacccaacagcgacuccgccgaguggaucagagauauguacgcuaaggugacagaaauuuggcaggaggucaugcaacggcgcgacgaugacggagcccugcacgcugccugccagguucagccuucugcgacgcuugaugccgcucagccgagagugaccggcgugguccuguuccggcaacucgcuccccgcgccaaacuggacgccuuuuucgcgcuggaaggguuuccuacagagcccaauagcuccucuagagccauccaugugcaccaguucggagaucucagccagggcugugaguccaccgggccucauuauaacccccuggcuguuccucacccgcagcaucccggagacuuuggcaauuucgccgugcgggauggcagccuuuggcgcuacagagcugggcuggccgccucucucgcuggaccucacuccauugucggccgggcggugguugugcacgccggggaagacgaucugggacgcggcgggaaccaagcuagcgucgagaauggaaacgccggcagacggcuugccugcuguguggugggcgucugcgggcccggacugugggaacgccaggcuagagagcauucugagcggaagaaacgcagacgggaauccgaguguaaggccgcguga

SEQ ID NO: 76076 - RNA, 987 nt, Artificial Sequence
  derived and/or modified sequence opt5 from SOHLH1__Homo_sapiens__NP_001012415
auggccagcagaugcuccgagcccuaccccgaagugucucggaucccgaccguccgcggcuguaacgggagccuguccggagcucucucuugcugugaggacagcgcccagggcuccgggcccccuaaggcgcccacaguugcugaaggaccuucuagcugccugagacggaaugugauuuccgagcgcgaaagacggaaacgcaugagccuuucuugugagagacugcgggcccuccugccccaauucgauggccgcagagaggacauggccuccgugcuugaaaugagcguccaguuucugcggcucgcuucugcccuggggccuucccaggagcagcacgcuauccuggccagcucuaaggaaauguggcauucccuccaagaggaugugcugcagcuuacgcugagcucccagauucaggcgggaguuccggaccccggcaccggcgccucuagcgggacacgcaccccugaugugaaggcuuuccucgagucccccuggagccuggacccugccucugcuucccccgaaccggucccucacauccuugccagcucuagacaaugggaucccgcgagcugcacaucccugggaaccgacaaaugugaggcccuccugggccugugccaggugcgcgggggacucccucccuuuucugaacccagcucccugguuccuuggccgcccggccggagccuuccuaaagcugugagacccccucugucuuggcccccguucucccagcagcaaacacucccugucaugagcggggaggcccugggauggcuuggccaggcuggcccccuggccaugggggccgcuccucucggagaacccgcgaaggaggauccuaugcuggcccaggaggcuggcucugcccugggguccgacguggaugacggaaccagcuuucuccugacggccggccccuccucuuggccgggggaauggggaccuggcuuccgggcuggcccucccgccuga

SEQ ID NO: 76077 - RNA, 1278 nt, Artificial Sequence
  derived and/or modified sequence opt5 from SOHLH2__Homo_sapiens__NP_060296
auggccagcuccaucauuugccaggagcacugucaaaucucuggccaggcuaagauugacauccugcucgugggggaugucaccguuggauaccuggccgacacagugcagaaacuuuucgcgaacauugcugaagugacgaucaccaucagcgauacaaaggaggccgccgcucugcucgacgauugcauuuuuaauaugguccugcuuaaagugcccuccucucugagcgccgaagaacucgaagcuaucaagcugauuagauucggcaaaaagaagaacacccauucccuguuuguuuucaucauuccugagaauuuuaaaggguguaucucuggacacggcauggacauugcccucacagagccgcugaccauggaaaagaugagcaacguggucaaauauuggacaaccugccccuccaauacggugaagaccgagaacgcgacagggccugaggagcuuggacugccccuccagcggagcuacucugagcaucugggcuauuucccuaccgaucuuuuugccuguuccgaaagccugcgcaauggcaacgggcucgagcugaaugcuucucuguccgaauuugagaaaaacaagaagaucagccuccugcacucuuccaaagaaaagcugagacgggagcgcaucaaauacugcugugagcaacugagaacacuccugcccuauguuaagggacggaaaaaugacgccgcuagcgugcuugaagccaccgucgauuacgugaaguauauucgcgagaaaaucuccccugcggugauggcccagauuacggaagcucugcagucuaacaugagauucugcaagaagcagcaaacaccgaucgagcucagccugcccggcaccgucauggcccagcgggaaaauuccguuaugagcacauacucuccugagcgcgggcugcaguuccucaccaacaccuguuggaauggaugcuccacacccgacgcugagagcucucuggaugaagccgugagagugccuagcuccucugccagcgagaacgcuauuggcgaccccuacaaaacgcauaucuccagcgcggcccuuucucugaacucccuccacaccguccgguauuacagcaaggugacaccgucuuaugaugcuaccgccguuacaaaucagaacaucuccauucaccuuccuagcgccaugcccccuguguccaaacuucugccccgccauuguaccucugggcucggacaaacgugcacaacccaccccaauugccugcagcaguuuugggcuuacuga

SEQ ID NO: 76078 - RNA, 6327 nt, Artificial Sequence
  derived and/or modified sequence opt5 from SON__Homo_sapiens__NP_001278340
auggccaccaacaucgagcagauuuucagaagcuuuguggucuccaaguuccgggaaauccaacaggagcugucuagcggccgcaaugaagggcagcucaacggagagacaaauacgcccauugaaggcaaccaggcuggggacgccgcggcuuccgccagaucucugccuaaugaggagaucguucaaaaaauugaagaggugcuuagcggagugcuggauaccgaacuccgguacaagccggaccugaaagagggcucccgcaagucuagaugcgucagcgugcagacagaucccaccgacgagaucccuacaaaaaaguccaagaaacacaagaaacauaagaacaaaaagaagaaaaagaaaaaggaaaaagagaagaaauauaagcggcagcccgaagagagcgaaucuaagaccaaaucccacgaugacgggaauaucgaucuugagagcgacucuuuucugaaguucgauuccgagccuagcgccguugcucucgaacugcccacacgcgccuuuggaccuucugagaccaacgaauccccggcugugguccuggagcccccugugguuagcauggaaguguccgagccccauauucucgagacgcugaaaccugccaccaagacagcggaacuuucugucgugagcaccuccgugaucagcgagcagucugaacaauccgucgccguuaugcccgagccgagcaugacaaaaauucuggacucuuucgcugccgcuccugugcccaccacgacacucgugcugaagagcuccgaaccugucgugaccaugucuguugaguaccagaugaagagcgugcuuaaauccgucgagagcacaucucccgaacccuccaagaucaugcugguggagccuccgguugccaaagugcucgaacccagcgagacccuggucgugucuuccgagaccccuacagaagucuaucccgagccuagcacguccaccacaauggauuuucccgaaucuagcgcgauugaggcccugagacucccggaacagccuguggacguucccuccgagaucgcugauucuagcaugacccggccucaggagcugcccgaacuuccuaagacaaccgcccuggagcuccaagaauccagcguggcuucugccauggagcugcccggcccgccugccacguccaugcccgaacuucagggccccccugucacaccggugcuggagcuccccgggccuagcgcuacccccguuccugagcugcccggaccucugucuacccccgugccggaacucccuggccccccugcgacagccguccccgagcugccggggccuuccgugacccccgugccucagcuuagccaagaacugcccggacuccccgcuccuucuaugggccuggagccgccccaggaaguuccugagcccccugucauggcccaggagcuucccgggcugccucucgugacagccgcuguggaacugccggagcagcccgccgucacgguggcgauggaacugaccgagcaaccuguuacaaccacagagcucgaacagcccgugggaaugaccacggucgagcacccuggccaucccgaagugaccacagcuaccggccugcuugggcagccggaggccacaaugguucuggaacucccuggacagcccguggccaccacggcucuggagcugcccggccaaccuagcgucacaggggugcccgagcuuccuggacucccguccgccacccgcgcucuggaacugagcggccagcccguugccacaggggcgcucgagcugccuggaccccuuauggccgcuggcgcccuggaauucucuggccaguccggggcugccggagcgcucgagcugcugggccagccucuugccaccggggugcucgaacugcccggacaaccgggcgcuccugagcugcccgggcagccugucgccaccguggcucucgagauuagcgugcaguccgucguuacaacgucugaacugagcaccaugacagugucccagucucuugaggugcccagcaccacagcccuggaauccuacaauaccgucgcccaagagcucccuacgacacuggugggcgaaaccucuguuaccgugggagucgacccccugauggcuccggagagccacauccuugcguccaacacaauggagacccacauccucgccagcaauacaauggacucucagaugcuggcuuccaacacgauggauagccagaugcuggccucuaauaccauggacucccaaaugcucgccagcucuacaauggauucccagaugcuggcuaccagcuccauggacagccagaugcuugccacaucuagcauggauucccagaugcuggcgaccucuacgauggacagccaaaugcucgcuaccuccucuauggauagccagaugcuggccacauccucuauggacagccagaugcuggccaccuccagcauggauucucagaugcuugcuacauccagcauggacucucaaaugcucgccaccuccacaauggauagccagaugcuggcgaccuccacgauggacucucagaugcuggcuacaagcuccauggacagccagaugcucgccucuggcaccauggauucccaaaugcuggccagcgggaccauggacgcucagaugcuugccucuggaacaauggaugcucagaugcuggccagcuccacccaagacucugcgaugcucggcagcaaauccccugaucccuauagacuggcccaggaccccuaccggcuggcucaggauccuuaucgccuugggcaugacccguacagacugggacacgaugccuaccggcucggccaggaccccuaucgccuggggcaugauccuuacagacucacgcccgacccuuaucggaugucucccagaccuuaccgcauugcuccgcggagcuauagaaucgccccccgcccuuaccggcuggcccccagaccucuuaugcuggcuucccgccggagcaugaugaugucuuaugcggccgaaagauccaugaugagcuccuacgagcgcucuaugaugagcuacgaacgguccaugaugucucccauggcugagagaagcaugauguccgccuaugagcgcagcaugaugucugccuacgaacgguccaugaugagcccgauggcugagagaucuaugauguccgccuaugaacggagcaugaugucugcguacgagcgcagcaugauguccccuauggcugauagaucuaugaugagcaugggcgccgaccgguccaugaugagcuccuauucugccgcugacagaagcaugauguccucuuacagcgccgcggaucgcuccaugaugucuagcuauacagcugaccgguccaugaugagcauggccgccgauucuuacaccgacuccuacacagauaccuauacagaagcuuacauggugcccccccucccucccgaggagccuccgaccaugcccccucugcccccugaagagcccccgaugacgccuccccugccucccgaagagccucccgaaggaccggcccuuccuaccgagcaaagcgcucugacagccgagaacaccuggcccacagaaguucccucucucccuuccgaggaaagcgugucucagccggagcccccugucucccagagcgaaauuuccgagcccagcgcggugccuaccgacuauucuguuagcgccuccgaucccucugugcuggucagcgaggcugccgugacggugccugaacccccgccugagcccgaauccucuaucacacucaccccugucgagagcgcuguuguggccgaggaacacgaggugguccccgaaagaccggugacauguaugguuuccgagaccccugccaugucugcugaacccaccgugcuggcgagcgagcccccugucauguccgagacagccgaaacguuugacagcaugcgcgcuucuggccacguggccuccgagguuagcaccucucuucuggugcccgccgucacaaccccugugcucgcugaauccauucuggagccgcccgccauggcggcuccugaaagcuccgccauggccguccuggagucuagcgcugugacaguucuugaguccagcaccgugacgguccuggaaucuuccacagugaccguucucgagcccagcguggucaccgugccugaacccccugugguugccgagccggauuacgucacaauccccgugccuguggucucugcgcuggaacccagcgugccuguucucgagcccgccguguccguccugcagccgucuaugaucgugagcgagccuuccguuucugugcaagaaagcaccgucacaguguccgagcccgcuguuacggugagcgaacagacccaggucauucccacagagguggccaucgagucuaccccuaugauucuugaauccagcaucauguccucucaugugaugaaggggauuaaucugagcuccggagaccagaaccuggcucccgagaucggcaugcaagaaaucgcccuccacucuggggaggaaccucaugcugaggagcaccugaagggagauuucuaugaaagcgagcauggcauuaacaucgaccuuaauauuaacaaucaccugaucgccaaagaaauggagcacaacacagucugcgcggccgggaccuccccgguuggcgaaauuggagaggagaagauccuccccacgagcgaaaccaaacagagaacagugcuggauaccuacccuggcgugucugaggcugacgccggggaaacacucuccagcaccggacccuuugcucuggagccugacgccacaggcacgucuaaggggauugaauucaccacagccuccacccuuagccuggucaauaaauaugauguggaccugucucucaccacacaggauacggagcaugacaugguuaucuccaccagccccucuggaggcagcgaggcugauaucgaagggccgcugccugcgaaggacauucaccuugaucugcccuccaacaauaaccucgugagcaaggacacagaggaaccucugcccgucaaagaguccgaucagacccucgccgcucugcuuucuccgaaggagagcuccggcggagaaaaagaggugccuccccccccuaaggaaacacugcccgacucuggcuuuagcgccaauaucgaggauauuaacgaagccgaccugguucggccucuccugccgaaagacauggagcgccuuaccucccugagagcugggaucgagggaccccuccuggccucugaugugggccgggaccgcagcgcggccuccccugucgugagcucuaugcccgaaagagcuuccgagagcucuuccgaagagaaggaugacuacgaaauuuucgucaaagugaaggauacgcaugagaagagcaaaaagaauaaaaaccgggacaagggggagaaagaaaagaagcgcgauucuucccucagaagccggucuaaacgcuccaagagcagcgagcacaaauccagaaagcggacaucugaaagcagaucccgcgcccggaaaagaucuagcaaguccaagucucaccgcagccaaacccgguccagaagccgcucucggagacgccggagauccagccggucucgcuccaaaagcagaggacggcgcuccguuucuaaggagaaaagaaagcggagcccuaaacauagauccaagucucgcgaacggaagagaaaacgcagcuccagccgggacaauagaaagaccgugcgcgcucggucuagaacacccucccgcagaagccggucucacaccccuagccgcagacggcgcuccagaucugugggccggagacgcagcuucuccaucagcccgucucggagaucccgcacacccagccggagaucccggaccccuucucgcagaagccggacgcccucccgcagaucucggacaccuagccgcagaucccggacccccucucgcagaagccggacaccguccagacgccggagaagccgcucugucguucggagacgcuccuuuagcaucucuccugugcggcugagacgcucccggaccccccuuagacgccgguucagcagaucucccauucgcagaaaacggagccgcuccagcgagagaggccgguccccuaagagacugacggaucuggacaaagcccagcuccuggagaucgcgaaggccaacgcugccgcuaugugugccaaagcuggggugccccuuccuccgaaucugaagcccgccccucccccuaccauugaagagaaggucgcgaaaaagucuggaggcgccacaaucgaagagcucaccgaguuuuga

SEQ ID NO: 76079 - RNA, 3456 nt, Artificial Sequence
  derived and/or modified sequence opt5 from SORBS1__Homo_sapiens__NP_001030127
augagcuccgagugcgacggcgggucuaaggccgugaugaacggacuggcucccggcagcaaugggcaggauaaagccaccgcggacccucucagagcucgguccaucucugccgucaagauuaucccgguuaaaacagugaagaacgccagcggacuggugcuucccacggauauggacccuaccaaaauuuguacaggcaagggggcugucacccugcgcgccuccucuagcuacagagaaacacccuccagcucuccugcuagcccccaagagacccggcagcacgaaagcaagccuggacucgagccggaacccucuuccgccgaugaguggcgccuguccucuuccgcggacgccaauggcaacgcucagccuagcucccuugccgcuaaaggcuauagaucugugcaucccaaucugccuagcgauaagucccaggacgccacauccucuuccgcggcccaacccgagguuaucguggucccgcucuaccuggugaacaccgaucgggggcaggaaggaacggcucgcccucccaccccucugggcccccucgggugcguucccacaauuccugccaccgcuagcgccgccucuccgcugacauuccccacccuugacgauuuuaucccuccccaucugcagagauggccucaccacagccagcccgcucgggcguccggaucuuucgccccgaucagccaaacgccucccuccuuuagcccucccccuccccucgugccgccugcucccgaggaccugcgcagagucucugaacccgaucuuacaggcgccguguccagcaccgacucuuccccucugcucaaugaggugagcuccucucugauugggacagacagccaggccuucccguccgucucuaaacccagcuccgcuuauccuagcaccaccaucguuaaccccacaauugugcugcuccagcauaaucgggagcagcaaaagcgccugucuucccuuagcgauccugugucugaaagacgggucggagagcaggacuccgcccccacgcaggaaaaaccuaccagccccggcaaggcgaucgagaagcgcgcuaaagaugacucuagacgggugguuaagagcacacaagaucuguccgacgugagcauggaugaagucggcauuccgcucagaaacaccgagcgcucuaaagacugguacaagacaauguuuaaacagauccacaagcugaaucgggauaccccugaggaaaaccccuauuucccuacguacaaauuucccgagcuuccggaaauucagcagacauccgaggaaaccaagagcuguuccgugaugucuccuagacuggagugcagcgggaccguuaucgcccacuguucccucaagcugcuggacucuagcaaucccccuacauccgccucucaaguggcuggaaccgccgaugacgacagcgaucucuauagcccccgcuacagcuucucugaggacacaaaaagcccccuguccgucccucggucuaaguccgaaaugagcuacaucgauggcgagaaaguggucaagagaucugcuacgcuuccgcugcccgcccgcuccagcucccucaaaagcucuagcgaacggaacgacugggagccucccgauaagaagguggacaccagaaaauaucgcgcggaaccuaaguccauuuacgaguaucagcccgggaaaucuagcguucugacaaaugagaagaugucccgggauaucucuccugaagagauugaccuuaaaaacgaaccgugguacaaguuuuucagcgagcuggaguuuggaaagcccccucccaaaaagaucugggauuauaccccuggcgacugcuccauucuccccagagaagaucgcaaaacaaaccuggacaaggaucugucucucugucagaccgagcuggaagccgaccuugagaaaauggaaacgcugaauaaggcuccgagcgccaacgugccucaguccagcgcuaucucucccacccccgagaucuccagcgagacaccuggguacauuuauucuuccaauuuccaugccgucaagcgggaaagcgacggagcgcccggcgaucucaccucccuggagaacgaaagacaaaucuacaaaucugugcuggagggcggggacauuccucuucagggacucagcggccugaagcggccguccagcucugccuccacaaaagauagcgaaucuccccgccacuuuaucccugcugacuaccuggagagcaccgaggaguucauuagacggagacaugaugacaaggaaaaacuccuggccgaucagcgccggcuuaagagagaacaggaggaagcugacaucgccgcccgcagacacacggggguuauccccacacaccaucaauucauuaccaaugagcgguuuggagaucugcucaacaucgacgauacagcuaaacgcaaguccggcucugagaugagaccugcgcgggccaaguucgacuuuaaagcucagacccugaaggaacugccccuucagaaaggggauauuguguauaucuacaagcagauugaccaaaauugguaugagggcgaacaccauggacgcgucggcaucuucccgagaaccuacauugagcuccugccucccgccgagaaagcccagccuaagaagcugacacccguucaggugcucgaauauggggaggcuaucgccaaauuuaacuucaauggagacacgcaaguggaaaugagcuuucggaagggcgagcgcaucacccugcuuagacaggucgaugaaaacugguacgaggggcggauuccuggaacaucccgccagggcaucuuccccauuaccuauguggacgugaucaaaagaccgcuggucaagaauccuguggauuacauggaccuccccuuuucuagcucccccagccggucugcgacagcuuccccucagccguggagagaggaaagcgggcaauacgagcgcaaagccgaacggggcgccggagagagaggccccgggggaccuaagauuuccaagaaaucuugccugaagcccagcgauguugugcgcugucuguccaccgaacagcggcuuucugaccucaacacgccugaggagagcagacccggcaaaccucugggguccgcuuucccgggaagcgaagccgagcagacagaacgccaccggggcggggagcaggcgggcagaaaggcugcccgccggggaggcucucaacagccccaggcccagcaaagacgggucaccccugaucgcucccagaccagccaggaccuguuuucuuaucaagcucucuacuccuauaucccccagaaugaugacgaacuggagcuuagagauggggacaucguggacguuauggagaaaugcgaugacggaugguucgugggcacaagccggcgcaccaagcaguuugggacauucccuggaaacuacgucaagccccuguaucucuga

SEQ ID NO: 76080 - RNA, 1935 nt, Artificial Sequence
  derived and/or modified sequence opt5 from SORBS2__Homo_sapiens__NP_001139142
augagcgugacccugacauccgucaagagaguucagucuagccccaaccuccuggccgcuggccgggacucccaaucuccugauagcgccuggcgcuccuacaaugacgggaaccaggagacgcuuaauggagaugcgaccuauucuagccuggcugccaaaggcuucagauccgugcggccgaaccuccaggacaagcgcagccccacacagucucaaaucaccgugaaugggaacuccggaggcgccgucagcccuaugucuuacuaucagagacccuuuuccccuagcgcuuacucucugcccgccucccuuaauagcuccauugugaugcagcacgggacaucucuggauagcaccgacacauauccucagcaugcucaaucccucgauggaaccacgucuucuuccaucccgcuguaccggagcucugaagaggaaaaacgcguuaccgugauuaaggcgccccacuauccuggcaucggccccgucgacgagagcgggauuccuacagccaucagaaccacaguggaucggcccaaagacugguacaagaccauguucaagcagauccauaugguucacaaaccgggacuguacaacccucccuauuccgcccagucucauccugcugccaagacgcagacauaccgcccccucagcaaaucccacagcgauaauucucccaacgcuuuuaaggacgccuccagcccugugccgcccccucacgugcccccucccgucccgccucugagaccccgggaucgcagcuccaccgaaaaacaugacugggacccucccgauagaaagguggacacacggaaguuccgcagcgagccuagauccauuuuugaguaugaacccggcaaaucuagcauccuucaacacgagcggccggcgucccuguaccagucuagcauugauagaucccucgaacgcccuaugagcucugccuccauggcuagcgacuuccggaagagacgcaaaucugagcccgccgucgggcccccucggggacugggcgaucaguccgcuagcagaaccucuccggggcgcguugaccuucccggaagcuccaccacacugaccaagagcuuuacgucuuccagcccuuccucucccagccgggccaaagauagagaguccccucgcucuuauagcuccacacucaccgacaugggccggucugcccccagagaacgccggggcacaccugagaaggaaaaacugcccgcuaaggcgguguacgauuucaaggcccaaaccagcaaagagcuguccuuuaagaaaggggacacgguguauauccucagaaagauugaucagaauugguacgaaggagagcaucacggccgggucgggaucuucccgauuagcuacguggagaaacugacaccucccgaaaaggcucagccugccagacccccgccucccgcccagccuggagagaucggcgaagcuaucgccaaguauaacuuuaaugcggacaccaacguugagcuuucucugcgcaaaggggaccgggugauucuccugaagagagucgaucaaaauugguacgaaggaaaaauccccggcaccaaccgccagggcauuuuccccguguccuauguugagguggucaagaaaaacacaaagggggcugaggacuacccugauccgcccaucccucacagcuauucuuccgaccggauucauagccuuucuuccaauaagccccagagaccuguguuuacccacgaaaacauccagggaggcggggagcccuuccaagcccuguacaauuauacaccucgcaacgaagaugagcucgaacugagagagagcgacgucaucgaugugauggagaaaugcgacgauggaugguucguuggcacgucccggcgcaccaaguuuuucgggacauuuccgggcaauuacgugaaaagacuguga

SEQ ID NO: 76081 - RNA, 2016 nt, Artificial Sequence
  derived and/or modified sequence opt5 from SORBS3__Homo_sapiens__NP_005766
augcaggggcccccuagaagccugcgggccggccucucccuggacgauuucaucccgggacaccuucaaucucauauuggcagcuccucucgcgggaccagagugcccgucauccggaacggaggcagcaauacacugaacuuucaguuccacgacccugcuccccgcacgguuugcaaugggggauacaccccuagacgggaugccucccagcaucccgacccugcgugguaucagacauggccgggccccggcucuaagccuagcgcuuccaccaaaauucccgccagccaacacacacagaacuggucugccaccuggacaaaggauuccaaacgcagagacaagcggugggugaaauacgaggggaucggaccuguggaugaaagcggcaugcccauugcuccgagaucuuccgucgaccgcccucgggauugguaucgcagaauguuucagcagauccaucggaagaugcccgaccuccaacuggauuggaccuucgaggaaccuccccgcgaccccagacaccuuggggcccagcagcggccugcucacagaccgggacccgccacguccucuuccggccgcagcugggaucauuccgaggaacugccucggucuaccuuuaauuacagacccggggcguucagcacagugcuccagccuuccaaccaaguucugcgccggagagagaagguggacaaugucuggaccgaggaaagcuggaaccaguuucugcaggagcucgaaacaggacaacgccccaaaaagccgcugguggacgauccuggcgagaaacccucucagccuaucgagguucuucuggaacgggagcucgccgaacuguccgcugagcuugacaaggaucugagagccauugaaacccgccuccccagcccuaaaucuagccccgcuccgcggagagccccugagcagcgcccucccgcgggccccgccuccgcuuggucuagcuccuauccgcacgcccccuaccuggggagcgcucggucucuguccccucauaagauggccgacggaggcagccccuuccucgggagacgggauuuuguguauccuucuuccacgcgcgaccccagcgccuccaauggaggcgggucuccugcuagacgggaggaaaagaaaagaaaggcggcccgccugaaauucgauuuucaggcucaaagccccaaggagcuuacacugcagaaaggagacaucgucuacauucacaaggaaguggauaaaaacuggcucgagggcgaacaccauggccggcuggggaucuucccggccaauuacguggagguccuuccugccgacgagauucccaagccuaucaagcccccgaccuaucagguucuggaauacggagaggcuguggcccaguauacauuuaaaggcgaucucgaaguggagcuguccuucagaaagggggaacacauuugucugauccgcaaagucaacgagaauugguacgagggaagaaucaccggcaccgggcggcaaggcauuuucccugcgucuuaugugcagguuagccgcgaacccagacuccggcugugcgacgacggaccucagcuucccacaagcccccgccugacggcugccgccagaagcgcucggcauccuucuuccccgagcgcccuccgcucucccgcugauccuaucgaccugggcgggcagaccucccccagacggacaggauuuagcuucccuacccaagagccccgcccucagacacagaaccuuggcaccccggggcccgcccugucucacagcagaggaccuucccauccccucgaucugggcacgagcucuccuaauacaucccagauucacuggacccccuaccgggcgauguaucaauacagaccgcagaacgaagacgagcuggagcuccgcgaaggggaucggguggacgucaugcagcaaugugaugacggcugguuugugggaguuagcagacgcacccagaaguucggcacauuuccugggaacuacguggcccccgucuga

SEQ ID NO: 76082 - RNA, 3597 nt, Artificial Sequence
  derived and/or modified sequence opt5 from SORCS1__Homo_sapiens__NP_001013049
augggcaaggugggggccggaggcgggagccaggcuagacuguccgcccuccuggcgggagcuggccuucugauccucugcgcccccggggucuguggaggcggcucuugcuguccuagcccgcaccccuccucugccccucggagcgcuuccacaccccgcggguucucucaucaaggaagaccuggccgggcccccgcuaccccucugccgcuuguugugcgcccccuguuuagcguggccccuggggacagagcgcucucccuggagcgggcccgcggaacgggcgcuagcauggccgucgcugccagaucugggcggcgcagacgguccggagcggaucaggaaaaagccgagcgcggcgaaggcgcuagcagaucuccccgcggggugcugcgggacggaggccagcaggagccugggaccagagaacgggaucccgacaaggccacaagauuccgcauggaggagcuccggcugaccuccacaaccuuugcucuuacaggagauagcgcccacaaccaagccaugguucauuggucuggccacaauuccagcgugauucugauccucaccaaacuguacgacuauaaccuuggguccauuacggaaucuagccuguggagauccaccgauuacggaacaaccuaugagaagcucaaugacaaagucggccugaagacaauccugagcuaccucuaugugugcccgaccaacaagcgcaaaauuaugcugcuuacggauccugaaaucgagucuucccugcucaucagcucugacgagggcgcuacauaccagaaguaucggcugaauuucuacauucagagccuucuguuucaucccaaacaggaagauuggauccucgcguacucccaagaccagaagcuguauucuagcgccgaguucgggagacgcuggcagcugauucaggaaggaguugugccuaaccgguuuuacugguccgucaugggcagcaauaaagagcccgaucucgugcaccuggaagcuagaaccguggacgggcacucucauuaucuuacaugucgcaugcaaaacugcaccgaggccaaucggaaccagcccuucccuggauacaucgacccggauucccugauuguccaggaccacuauguuuuugugcaacucaccagcggcgggagaccccauuacuaugugucuuaccgccggaaugccuucgcucagaugaagcugccuaaguacgcccuucccaaagauaugcacgucaucuccacagacgagaaccagguguuugcggcuguucaggaauggaaucaaaacgauacguauaaucuguacauuagcgacaccagaggcguguauuucacacucgcccuggagaacguccaguccucucggggaccugaaggcaacaucaugaucgaucuguacgagguggccgggauuaagggaauguuucucgcuaauaaaaagaucgacaaccagguuaaaaccuucauuacauauaauaagggccgcgauuggagacugcuucaggcccccgacaccgaucugagaggggacccggugcacugucuccugccuuacugcagccugcaucuucaccucaaagucuccgaaaaccccuauacgucuggaaucauugcuagcaaggacacagccccuuccaucaucguggcgagcggcaauauugggucugagcuguccgauaccgacaucagcauguucgucucuuccgaugccggcaacaccuggcggcaaauuuuugaggaggaacauagcgugcuguaccucgaccagggaggcguucugguggcuaugaagcacacaucucuucccauccgccaucuguggcucagcuucgaugaagggcgguccuggagcaaauacucuuuuaccuccauuccucuguucgucgacggagugcugggcgagcccggggaagagacacuuaucaugacgguuuuuggacacuucagccacagauccgaguggcagcucgugaaggucgauuauaaaucuaucuuugaccgcagaugugccgaagaggauuaccggccguggcagcugcauagccaaggcgaagccugcauuaugggggccaagcgcaucuauaaaaagagaaaguccgagcggaaauguaugcagggcaaguacgcgggagccauggagucugaaccuugcgugugcaccgaggcugacuucgauugugacuauggcuacgaacgccacagcaaugggcagugccugcccgccuuuugguucaaccccuccucucucagcaaagauuguucccugggacagagcuaucuuaauucuacaggcuacagaaaggugguuuccaacaauugcaccgacgggguccgggagcaauacacagcuaaaccucagaaguguccgggaaaggcuccccgcggccugagaauugugaccgccgacgggaaacucacggcugaacagggccauaacgugacccugaugguccaacuggaggagggagaugugcagcggacacuuauccagguugacuuuggcgaugggauugcggugagcuaugucaaucucucuuccauggaagacggaaucaagcacguguaccagaacguuggcauuuuccgcgugaccguccaaguggauaauagccuggggucugacuccgccguucuguaucuccacgugacaugcccucuggagcauguccaccuuagccugcccuuugugaccacgaaaaacaaggaagugaacgcuacagccguccucuggccuucccagguuggaacccugacauacguguggugguauggcaauaacaccgagccccugaucacccuugaaggcagcaucucuuucagauucacaagcgaggggaugaauacgauuaccgugcaggucuccgccggaaacgcuauccuccaggauacaaaaaccauugccguguacgaggaauuucggucucugagacugagcuucuccccuaaucucgacgauuauaaccccgacaucccggaguggcgccgggauauuggcagaguuaucaagaagucucugguggaagcgacaggggucccuggacaacauauccuuguggcuguucugcccggccucccuaccacggccgagcuguuugugcugcccuaccaggacccggccggggaaaauaaacgcagcacagaugaccuugagcagauuuccgagcugcucauccacacccugaaccaaaauucuguccauuucgaacucaagccuggagugcggguucuggugcacgcugcccaccuuaccgcggcuccccuggucgaccucacaccuacccauagcggcuccgccaugcugaugcugcuuagcgugguguuugucggccuggccguuuucgugauuuacaaauuuaagagaaaaauccccgggauuaacguguaugcucagaugcagaaugagaaggaacaggagaugaucucucccgucucccacagcgagucucgcccuaacgugccgcaaacagaacuccggagacccggacagcugaucgaugagaaaguugaaucccagcucauuggcagcaucuccauuguggccgagaaucagucuacgaaggaaaucccuaccuacgucaacguguga

SEQ ID NO: 76083 - RNA, 3480 nt, Artificial Sequence
  derived and/or modified sequence opt5 from SORCS2__Homo_sapiens__NP_065828
auggcccacagaggccccagccgggcuuccaaggggccuggaccgaccgcccgcgcgcccucuccuggcgcucccccucccccuagaagcccgcggucccgcccccugcuccugcuucugcuccugcuuggggccugcggagccgcuggcagaucuccugagcccgggcggcugggaccucaugcccagcucacacgcgugcccagaagcccgccugcuggccgggccgaacccggcgggggagaggaccgccaagcgagaggcacggaaccuggggcccccggacccuccccuggcccggcucccgggccuggagaggauggcgcccccgcugccggcuaccggcgcugggaaagagcggccccucuggcuggggucgccucucgggcucagguuagccugaucuccaccagcuucgugcucaaaggagacgccacacacaaccaggccauggugcauuggaccggcgaaaauucuuccgucauucugauccuuacaaaguauuaccacgcugauauggggaaagugcuggagagcucucucuggcgcuccagcgacuuuggaaccucuuauacaaagcugacccuucagcccggcguuacgaccgugauugauaacuucuacaucuguccgacaaauaaaagaaaggucauucugguguccagcucccucucugaccgggaucaaagccuguuucuguccgcggacgaaggggccaccuuccagaagcagccuauccccuuuuucguugagacacucaucuuucauccuaaagaagaggauaaggugcuggcuuauaccaaagagagcaaacuuuacgucucuuccgaccugggaaagaaguggacgcuccugcaggaaagagugacaaaggaucacguguucuggagcgucucuggcguugacgccgaucccgaccuugugcacguggaggcccaagaccugggcggggauuuucgcuaugugaccugcgcuauucauaacuguagcgagaaaaugcucacagccccuuucgcgggacccaucgaccacggcucccugaccgugcaggaugacuacaucuuuuucaaggcuaccucugccaaucagacaaaauacuauguuagcuaccggagaaacgaguuugugcugaugaagcucccgaaauaugcccugccuaaggaucuucagauuauuuccacggacgaaagccaagucuucguggcuguucaggagugguaccagauggauaccuauaaucuguaccaaucugacccccgcggggugcgguaugcccucguccugcaggaugugagauccagccgccaggcugaggaaucuguccuuaucgacauucuggaggugcggggaguuaaaggcguguuccucgccaaccagaagaucgaugggaaggucaugacacugaucaccuacaauaaaggcagagacugggacuaccugcggcccccuuccauggauaugaacggaaagccgacaaauugcaaacccccugacugucaucuccaucugcaccuucgcugggcggauaaccccuaugugagcggcaccguucacacgaaggacacagccccugggcugauuaugggagcuggcaaucucgggucccaacugguggaauacaaagaggaaauguauaucaccucugauugcggacacaccuggagacaggucuuugaggaggaacaucacauucuguaccuugaccauggcggggugaucguggccauuaaggauacaagcaucccccucaagauccugaaauucuccguugacgagggccugaccuggucuacacacaacuuuacgagcaccuccgucuucguggauggacuccugagcgaaccuggcgacgagacacuugugaugaccgucuuugggcacauuucuuuccgcuccgauugggaacuggugaagguugacuuucggcccagcuucucuagacaguguggagaggaggauuauuccagcugggaacucucuaaucugcagggcgaccggugcaucauggggcaacagcgcagcuuuagaaaacggaaguccacaagcugguguauuaaaggaagaucuuucaccuccgcucugacgagccgcgugugcgagugucgggacuccgauuuucuuugcgacuacggcuucgaaagaucuagcuccucugagagcuccaccaacaagugcucugccaacuuuugguucaauccgcucagcccucccgaugacugugcgcuggggcagacauauaccuccagccugggcuaccgcaaggucgugucuaacguuugcgagggaggcguggauaugcagcaaucccagguccagcuccaguguccucugacacccccgagagggcuucaagugagcauccagggagaagccguugcugugcggccuggcgaggacguccuguucguggugcgccaggaacaaggggauguccucaccacgaaauaccagguugaccugggagauggcuuuaaggccauguaugugaaucugacacuuaccggggagcccauuagacaucgguacgaaucuccuggcaucuaucgcguguccgucagagcugagaacacagccggacacgacgaggccguccucuucguucaggugaauagcccccugcaggcucuguaccucgaagucgugcccguuaucggccugaaccaagaggugaaucuuaccgcgguccugcucccucugaacccgaaucugaccguguuuuauugguggauugggcauucucuucagccccuccugucccuggauaacagcguuacaacgcgguucuccgacaccggagaugugcgcgucacagugcaggccgcuugcggcaauagcgugcuccaggacucuagaguccugcggguucuugaccaauuucaggugaugccucugcaguucagcaaagaacucgaugccuacaaccccaauaccccugaguggcgcgaagacguggggcuggucgugacaagacugcuuuccaaggagaccucuguuccccaggagcugcucgugacggucgugaaaccuggacugccgacacucgccgaucuguauguucuucugcccccuccccggccuaccagaaagcgcagccucuccucugacaagcggcuggcugccauccaacaggugcugaacgcgcagaaaauuagcuuucuucugagaggcggcguccgcgugcucgucgcucugcgggauaccgggacaggagccgaacaacucggcgggggaggcggguacugggccgugguugugcuguucgucaucggacuuuuugcugccggcgcguucauucuguacaaguuuaaaagaaagcgccccggccggaccguguaugcucagaugcacaaugagaaagaacaggagaugacauccccgguuucucacagcgaagacgugcagggggccguccaaggaaaccauuccggcguggugcucagcaucaacucuagagagaugcacuccuaccugguuagcuga

SEQ ID NO: 76084 - RNA, 3669 nt, Artificial Sequence
  derived and/or modified sequence opt5 from SORCS3__Homo_sapiens__NP_055793
auggaggccgcuagaaccgaacggcccgccggccgcccuggggcgccgcuggugagaacaggacuccugcuucugagcacguggguccucgcuggcgccgagaucaccugggacgccacagggggacccggccggccugcugcccccgcuucccgcccucccgcccugucuccucuuagcccgagagcgguugccucccaguggcccgaggaacuggcuucugcccggcgcgcugccgugcucgggagacgggcgggaccugaacugcugccccaacagggcggcgggcgcggaggcgagaugcaaguggaggccgggggaaccagcccugcuggcgaaagacgggggcgcgggauucccgccccggcuaagcucggcggcgccagacggucccgcagagcccagccucccaucacacaggagcggggagaugcuugggcgaccgccccugcugacggaucuagaggcagccgcccccuggccaaagggucccgggaagaggucaaggcccccagagcuggaggcagcgccgcggaggaucuucgccugccuucuacauccuucgcucucaccggggacagcgcccacaaccaggccauggugcauuggucuggacacaauuccagcguuauucugauccuuacgaaacuguacgauuuuaaccucggcucugugaccgaauccagccuguggcgguccacagacuauggcaccacauacgagaagcugaaugauaaagucgggcucaagaccgugcugucuuaucuuuacguuaacccgacgaauaagagaaaaauuaugcugcucagcgaccccgaaauggaguccagcauccugaucucuuccgaugaaggagcuacauaucagaaguaccgccuuaccuucuauauucagagccugcucuuucauccuaaacaagaggacugggugcuggccuacucucuggaucagaagcucuacagcuccauggacuucggccggagauggcagcugaugcacgagcgcaucacacccaaccgguuuuauuggucugucgcugggcuugauaaagaagccgaccuggugcauauggaggugagaaccaccgacggauacgcgcacuaucucacaugccgcauucaggaaugugccgagacgacccggagcggcccuuucgcuagauccaucgauauuagcucucuggucguucaagacgaauacaucuuuauucaggugacaaccuccgggcgggccagcuauuacgugucuuaucgcagagaggcuuucgcccagaucaagcugcccaaguacucccugccgaaagauaugcacaucauuagcacagacgagaaucaagucuuugcggccgugcaggaauggaaccagaaugauaccuacaaccucuauaucuccgacacgcggggcauuuacuucacacuggcuauggagaauaucaagucuagcagaggacugaugggcaacauuaucaucgaacucuaugagguugccgggauuaaaggaaucuuucuggcuaauaagaaaguggaugaccaggucaagaccuacauuaccuauaacaaaggccgcgauuggcggcuucugcaagccccugacguggaucucagagggucccccguucauugccugcugccuuucuguucucuucaccuccaucugcagcugagcgaaaaucccuacuccagcggacgcaucucuuccaaggagacagccccuggccucguggucgcuaccgggaacauuggccccgagcugagcuauacagacaucggaguguuuaucucuuccgacggcgggaacacguggagacagauuuucgaugaagaguacaaugucugguuccuugacuggggaggcgcgcugguggccaugaagcacaccccgcucccuguucggcaccugugggugagcuuugaugaagggcauucuugggacaaauacggauucacaagcgucccccuguuuguggauggcgcucuuguugaggccgggauggagacccacaucaugacaguguucggccauuuuucccuccgcagcgaauggcagcuggucaagguggacuauaaaucuauuuucuccagacacugcaccaaggaggauuaccaaacguggcaucugcucaaccagggagaacccugugugaugggcgagcggaaaaucuuuaagaagcgcaaaccuggggcccagugcgcucugggaagagaccacagcggcuccguugucucugaaccgugugugugcgccaauugggauuucgagugugacuauggguacgagcggcacggagaaagccagugcgugcccgcguuuugguauaacccugcuucccccucuaaggauuguagccuuggccaauccuaccuuaauucuaccggguaucgcagaauugucagcaacaauugcacagacggccuccgggagaaauacaccgccaaggcccagaugugcccuggaaaagcuccccgcggccugcaugugguuacaaccgaugggagacugguggccgaacagggacacaacgcgacguucaucauucuuauggaggaaggcgaccuccagcggacaaauauccaacuggacuuuggggauggaaucgcugucuccuacgccaacuucagcccuauugaggacggcaucaagcauguguauaagucugccggcauuuuucagguuaccgcuuacgccgagaauaaccugggguccgauacagcuguccucuuccugcacguggugugucccguugaacacgugcaucuuagagucccguucguggccauccgcaauaaagaggugaacauuagcgcggucguuuggccuucucagcugggaacccucaccuauuuuuggugguucggcaauuccacaaagccccugaucacgcuggacagcucuaucuccuuuaccuuccuugccgaagggacagauaccauuacagugcaaguggcugccggaaacgcucucauccaggacaccaaagagauugccguccacgaauacuuucagagccagcugcuguccuucagcccuaaccucgauuaucauaaucccgacaucccggaguggcggaaggauauuggcaacgugaucaaaagagcccugguuaaggugacgucugucccugaggaccaaauccuuauugcuguguuucccgggcugccuacaagcgcggaacucuucauccugccucccaagaaucugaccgagcgccggaaaggaaacgaaggcgaucuugagcagauuguugagacccuguuuaaugcccucaaccagaaucuggugcaguucgaacucaagcccggcguccaagugaucguuuacgugacacagcugacccuugcuccgcuggucgacuccucugccgggcacagcuccucugccaugcucaugcugcugagcgugguguuugucggacuugcuguuuuccugauuuauaaauuuaagagaaaaauccccuggaucaacauuuacgcccaggugcagcaugauaaggagcaagaaaugaucggcuccgugucucagagcgagaaugcgccuaaaauuacacucuccgacuucacggaacccgaggagcugcucgacaaggaacuggauacccgcgucaucgggggaauugcuacaaucgccaacagcgagucuaccaaggaaauuccuaauugcacauccguguga

SEQ ID NO: 76085 - RNA, 1074 nt, Artificial Sequence
  derived and/or modified sequence opt5 from SORD__Homo_sapiens__NP_003095
auggccgcugccgcgaagcccaacaaucugagccucgugguccacggcccuggggaccugagacuugagaacuacccgauccccgaaccuggacccaaugagguucugcuccggaugcauuccgugggcauuugcgggucugaugugcacuauugggaauacggacgcaucggcaacuucauugucaaaaagccuauggugcuggggcaugaggcuagcggaaccguugaaaaagugggcuccucugucaagcaccuuaaacccggcgacagaguggccaucgagccuggggccccgcgggagaaugaugaauuuuguaagaugggacgcuauaaccugagccccuccauuuucuuuugcgcuacaccucccgacgauggcaaucucuguagauucuacaagcauaacgccgcuuuuugcuauaaacugccugacaauguuacguucgaggaaggggcccugaucgagccccucucugugggaauccacgcgugucggcgcggcggggucacccugggacacaaggugcuugugugcggcgccggcccgauugggauggucacacugcucguugcuaaagccaugggagcugcccaggugguggucaccgaucugagcgcgacaagacuuuccaaggccaaagagaucggcgcugaccuggugcuccaaauuagcaaggaaucuccucaggagaucgcccggaagguugaagggcagcugggauguaaacccgaggugaccauugaaugcacaggcgcugaggccuccauccaggccgggauuuacgcuacccgcagcggaggcaaccugguccucgugggccuggggucugagaugacgaccguuccucuucugcaugcggccaucagagaaguggauaucaagggagucuuucgguauuguaauacauggcccguggcuauuuccaugcucgccagcaaaucugucaacgugaagccccugguuacccaccgcuucccucuugagaaagcccuggaggcuuuugaaacauucaagaaaggccucgggcugaagaucaugcugaagugcgacccguccgaucaaaaucccuga

SEQ ID NO: 76086 - RNA, 6645 nt, Artificial Sequence
  derived and/or modified sequence opt5 from SORL1__Homo_sapiens__NP_003096
auggcuaccagaagcucccggcgcgaaucuagacugcccuuccucuuuacacugguggcccuucugccuccgggcgcccucugcgaagucuggacgcagcggcugcacggcgggagcgcgccccuuccucaagaccgcggguuccugguugugcagggggaucccagagagcuccggcugugggcucgcggagacgccagaggcgccucccgggcugaugaaaagccucugcgcagaaaacggucugccgcucuccagcccgaaccuauuaagguguacgggcaggucagccugaaugacucccauaaucaaauggugguucacugggccggcgaaaaaucuaacgugauugucgcccuugcccgcgauagccuggcucucgccagacccaaguccagcgacguguauguuucuuacgauuauggcaaauccuuuaagaagaucagcgacaaacugaauuucggccuugggaaccggucugaggcugugauugcccaguuuuaccauucccccgcggauaauaagcgcuauaucuucgccgacgcuuacgcccaguaucuguggauuaccuuugauuucuguaacacacuccagggauuuagcaucccuuucagagcugccgaccugcugcuccacucuaaagccuccaaucugcuucugggcuuugaucggagccaucccaacaagcaacucuggaaauccgacgacuucgggcagaccuggaucaugauucaggagcacgucaagucuuuuagcuggggaaucgauccuuacgacaagcccaauacaauuuacaucgaaagacacgagccguccggcuauagcaccguguuccgcucuacagauuucuuucagucccgggaaaaccaagaggugauucuggaggaagucagagacuuccagcuucgcgauaaauacauguuugcuaccaagguugugcaucugcucgggagcgagcagcaaucuagcgugcagcugugggucuccuucggacggaaaccuaugagagcggcccaguuugugacgcgccaccccaucaaugaauauuacauugcugacgccucugaggaucagguuuucgugugcgucagccauuccaacaaucggaccaaccuguauaucagcgaagccgagggccucaaguuuucucugucccuugagaaugugcuguacuauagcccuggcggggcuggaucugacacacucguuagauacuucgccaacgaacccuuugcggauuuccaccgcguggagggccugcaaggggucuacaucgcuacccuuauuaacggauccaugaaugaagagaacaugcggagcgugaucacauuugacaaaggcgggaccugggaguuccugcaggcccccgccuuuacgggauauggcgagaagauuaauugugagcucucccagggcugcucucugcaccuggcucagagacucagccaacugcuuaaccugcagcuccgccggaugccuauccuguccaaagaaucugccccggggcugauuaucgcuacaggaagcgucggcaagaaucuugccuccaagaccaacguguacaucuccucuagcgcgggggccagauggcgggaggcucuccccggaccucauuauuacacauggggcgaucacgggggcauuaucaccgccauugcucagggaauggaaaccaaugagcugaaauauagcacaaacgaaggcgagacguggaagaccuucaucuucucugagaaacccguuuuuguguacgggcugcucacagaaccuggagagaaguccaccgucuucacaauuuuuggcagcaauaaagaaaacgugcauucuuggcugauccuucagguuaaugccaccgacgcgcugggggugcccuguacggagaacgacuauaagcucuggagcccguccgaugagcgcggaaaugaaugccugcugggccacaagacagucuucaaaagacggaccccucaugccaccuguuuuaacggggaggacuucgauagacccguggugguuagcaauugcucuuguacacgcgaagacuacgagugcgauuuuggcuucaagauguccgaagaccuuagccucgaggucugugugccugaucccgaguuuuccggaaaaucuuacagcccucccgugccgugcccugucggcuccaccuaucggagaacacgcggguacagaaagaucucuggagacacgugcagcggcggggauguggaagcucggcuggagggagaacugguucccuguccccucgccgaggaaaacgaguucauucuguaugcugugcgcaaauccaucuacagauaugaccuugccucuggcgccaccgagcaacugccucucacagggcugcgggcugcggucgcccuggauuuugacuacgaacacaacugccuuuauuggagcgaucucgcucuggacgugauucagcgccugugucucaauggcuccaccggacaggagguuaucauuaacagcggccuggaaacaguggaggcccuugccuucgaaccgcugucucagcuccuguacugggucgacgcuggguuuaagaagaucgagguggccaaucccgauggagacuucagacugaccauuguuaacuccagcgugcuugaucggccucgcgcgcucguccuggugccccaagagggcgugauguucuggacggacuggggagaucugaaaccuggaaucuacagaucuaauauggacggcuccgcugccuaucaccucgucagcgaagauguuaaguggcccaacgggaucucuguggacgaucaguggauuuacuggaccgacgccuaucuggagugcaucgaacggauuacauuuuccggccagcaacgcagcgugauccuugauaaucugccucaucccuacgcuauugccgucuucaaaaacgagaucuauugggacgauuggucccagcucagcaucuuuagagcgucuaaguacagcggaucccagauggagauucuggcuaaucagcugaccggccuuauggacaugaaaaucuucuauaaggggaagaacacaggaucuaaugccugugugccgcggccuugcagccugcucugucugcccaaagccaacaauuccagaucuugccgcuguccugaagacguuagcuccucugugcuccccagcggcgaucugaugugcgacuguccgcaaggguaccagcuuaagaacaauaccugcgucaaagaggaaaacacgugccugcggaaccaguacagauguuccaauggaaacugcauuaauagcaucugguggugugauuuugacaacgauugcggcgacaugucugaugagcgcaauuguccuacaaccauuugcgaccucgauacacaguuccggugucaagaauccggaaccugcaucccccugagcuauaagugugaccuggaggaugacugcggggacaacucugaugagucccacugugaaaugcaucagugcagaagcgacgaguacaauugcuccucuggaauguguauccgcagcuccugggugugcgauggcgacaacgauugucgggacuggagcgaugaagcuaauugcaccgccauuuaucacacaugugaggcuucuaacuuucagugcagaaaugggcacuguaucccucagcgcugggccugcgacggagauacggacugucaagauggcuccgacgaagaucccguuaacugcgagaaaaaguguaauggguuccggugccccaacggaaccugcauuccuagcucuaaacauugugacggccuuagagacugcagcgauggcuccgacgagcagcacugugaaccgcugugcacacauuuuauggauuucguguguaagaaucggcagcaaugccucuuucacucuauggucugugacgggaucauucagugccgcgauggaagcgacgaggaugcggccuucgcuggcuguucccaggaccccgaguuccauaaggugugcgaugaguuuggguuccagugucaaaacggaguuugcaucucucugaucuggaaaugcgacggcauggaugacuguggggauuacagcgacgaagccaacugcgagaauccuaccgaggcucccaacuguuccagauauuuucaguuccggugcgaaaauggacacuguauuccuaaccgcuggaagugcgacagagagaaugauuguggcgacuggagcgaugaaaaagacugcggcgauucucacauccuccccuuuuccacaccugggccgagcaccugucugcccaacuacuaucggugcuccucuggaacgugugugauggacacaugggucugcgauggcuacagagacugcgccgaugggagcgacgaggaggccuguccucuucuggcuaaugugaccgcggccuccacccccacacagcucggacgcugcgaucgguucgaauuugagugucaucagccuaagaccugcauucccaacuggaaaagaugugacggccaccaagacugccaggaugggcgcgacgaagcuaauuguccgacacauucuacgcugaccugcaugagccgggaguuccagugugaagauggagaggccugcaucgugcuguccgagagaugugacggcuuucuugauugcagcgacgaaucugaugagaaggccuguuccgacgaacugacagucuacaagguucagaaccuccaauggaccgcugauuucagcggcgacgugacacugaccuggaugcgcccuaaaaagaugcccucugccuccugcguguauaaugucuacuaucgggugguuggggagagcauuuggaaaacgcucgaaacccacucuaacaagacaaauaccgugcugaaaguccuuaagcccgauacaaccuaccaggugaagguucaggugcagugccugagcaaagcgcauaacacaaaugacuuugucacccugagaacgccugagggacuccccgaugcuccucgcaaccugcaacuuucccugccgagagaggccgaaggcgugaucgucgggcacugggcgcccccuauucacacacauggacucauccgggaguauaucguggaauacucucgcagcggcuccaagaugugggcuagccagagagccgcguccaauuucaccgagauuaaaaaccugcucguuaacacccuguauacagugcgggucgcugccgugaccucucgcgggaucggaaauuggagcgacuccaagucuauuacgacaaucaaaggcaagguuauucccccucccgacauccacaucgauagcuacggcgaaaacuaccuuuccuuuacccugacaauggagucugacauuaaggugaauggguaugucgugaaccuguucugggccuucgauacccauaaacaggagagacggacacucaauuuuagaggaagcauccugucccacaaggugggcaaccuuaccgcucacacgagcuacgaaauuucugccugggcuaaaaccgaccugggggauuccccgcucgccuucgagcauguuaugacacgcggaguccggccucccgcgccuagccugaaggccaaagcuaucaaucaaaccgccguggaauguacauggaccggccccagaaacguggucuaugggaucuuuuacgcuacgucuuuccucgaccuguaucgcaauccuaagucccuuacaaccagccugcacaacaaaacagugaucguuucuaaggaugagcaguaccuguuucucgugcgggucgugguucccuaucagggaccguccagcgacuacguggucgugaagaugaucccugauuccagacugccgccccggcaucuucacguugugcauaccggcaaaaccagcgucgugauuaagugggagucuccuuacgacagcccggaucaggaccugcucuaugccaucgccgugaaagaccugauucgcaagacagauagauccuacaaagucaagucucggaauagcacgguugaauauacccucaacaagcuggagcccggcgggaaauaccacaucauugugcaacuuggaaauauguccaaggacucuagcaucaaaauuacaaccgugucccugucugcuccugaugcgcugaagaucaucacagaaaacgaccacguccuccuguucuggaaaagccuugcccugaaggagaagcauuuuaaugaaucccgcggcuaugagauucacauguucgauagcgcuaugaacaucaccgccuaccucgggaacacgacagacaacuuuuucaaaauuucuaaccugaagaugggacauaauuauaccuuuaccgugcaggccagaugccuguucggcaaccagaucuguggggagcccgcuauucuccuuuacgaugaacugggauccggcgccgacgcgagcgcuacacaggccgcccggucuaccgauguugcugccguggucgugccuauccuguuucucauccugcuuucccugggcguuggguucgcgauucucuacacaaaacaccgcagacugcaaagcuccuucacggccuuugcuaauucucacuauagcucccggcugggaagcgccaucuucucuuccggcgacgaucucggggaggacgaugaagacgcucccaugauuaccggauuuagcgacgaugugccuauggucaucgccuga

SEQ ID NO: 76087 - RNA, 4002 nt, Artificial Sequence
  derived and/or modified sequence opt5 from SOS1__Homo_sapiens__NP_005624
augcaggcccaacagcugcccuacgaguucuuuagcgaagagaacgcuccuaaguggagaggccuccuggugccggcccuuaaaaagguccaggggcagguucaccccacccuggaauccaaugacgaugcgcuccaauauguggaggaacugauccuucagcugcucaacaugcugugccaggcucagccucggucugccagcgacguggaggagcgcguccaaaaauccuucccccauccuauugauaagugggccaucgcugacgcccagucugcuauugagaaaagaaagcggcgcaauccccugagccucccuguggaaaagauccacccgcugcuuaaagaaguucugggauacaagauugaucaucagguguccgucuauaucguggccguucucgaguacaucucugcggacauucugaaacuugugggcaacuaugucagaaauauccggcacuacgagauuacaaagcaggauaucaaaguggccaugugugcugacaaggugcugauggauauguuucaucaagacgucgaagauauuaacauccucagccugacggacgaggaacccuccaccagcggggagcagacauauuacgaucugguuaaggccuucauggcugaaauucgccaguacaucagagagcucaaucugaucauuaaaguguuucgggagccuuucgugucuaacuccaaacuuuuuagcgccaaugacgucgaaaacaucuucucucgcauuguggacauccacgagcuguccguuaagcuccugggacacauugaagauaccguggagaugacagacgaaggcagcccccauccucuugucgggucuugcuuugaggaucuggcggaggaacucgccuucgaccccuaugaguccuacgcuagagauauccugcggccgggauuucacgaccgcuuccugagccaacucuccaagccuggcgccgcucuguaucuucagucuaucggcgaaggguuuaaagaggccgugcaguacguucugcccagacuccugcuugccccuguguaucauugucugcacuacuucgaacuccugaagcagcuggaggagaaaagcgaagaucaagaggacaaggaaugccucaagcaggcuauuaccgcgcugcuuaauguccaguccggaauggagaaaaucuguagcaagucucuggccaaacggcgccucuccgagagcgcuugcagauucuauucucagcaaaugaagggcaaacagcuggccauuaagaagaugaacgaaauccagaaaaauauugaugggugggagggaaaggacaucggccaguguugcaacgaauuuaucauggaggggacacugacccgggugggagccaaacacgaaagacauauuuuccuuuuugauggccucaugaucuguugcaagagcaaucacggccaaccccgccugcccggggcuuccaacgccgaguaccggcugaaagagaaguucuuuaugagaaagguccagauuaacgacaaagacgauacgaaugaauacaagcaugcguucgagaucauucucaaagacgaaaacucugugaucuuuagcgcuaaguccgccgaggagaaaaauaacuggauggccgcucugauuagccuucaguaucgcucuacccuggaacggaugcucgauguuacaaugcugcaggaggaaaaggaggaacaaaugagacugccuuccgccgacguguaccgcuucgcugagccggauagcgaagagaauaucaucuuugaggaaaacaugcagcccaaggccggcauuccuaucauuaaagcgggaaccgucaucaaacuuauugagcggcucacauaucacauguacgccgaccccaauuucgugagaaccuuucugacgacauaucgcucuuucuguaagccucaggaacugcucucccugaucaucgagcgguuugagauucccgaaccggagccuaccgaagcugauagaaucgccauugagaacggggaccaaccccuuagcgcugaacugaagcgcuuccggaaagaguacauccagccuguucagcucagagugcugaaugucugccggcauuggguggagcaccacuucuaugauuuugaacgcgacgccuaccugcuucagagaauggaggaguucauuggaacagugcggggcaaggcgaugaaaaaguggguugaauccaucaccaagaucauucaacgcaaaaagaucgccagagauaacgggcccggacauaauauuaccuuucagucuagcccucccacagucgaauggcacaucucccggccgggccauauugagacguucgaccuccugacccugcacccuaucgagaucgcuagacagcucacacugcuugaaucugaucuguaccgcgccgugcagcccagcgagcucgugggcuccgucuggaccaaagaagacaaggagauuaacagccccaaucugcugaaaaugaucagacacacaaccaaccuuacgcucugguuugaaaagugcauuguggagacagagaaucuggaggaacggguugcuguggucucucgcaucauugaaauccugcaaguguuccaggagcucaacaacuuuaaugggguucuggagguggucuccgccaugaacagcucuccuguguauagacuugaccauaccuucgaacagauuccgucccggcagaagaaaauccuggaggaagcccacgagcucagcgaagaucauuacaagaaauaucuggcuaagcugcgcucuaucaaucccccuuguguucccuuuuucggaauuuaccuuaccaacauccugaaaacagaggagggcaauccugaagugcucaagagacacgggaaggagcugauuaacuuuagcaaacggcgcaaggucgcggaaaucaccggagagauucaacaguaucagaaucaacccuacugccucagaguggaauccgacaucaaacgguucuuugagaaccugaauccuaugggcaacagcauggagaaggaguucacagauuaucuuuucaauaaaucucuggaaaucgaaccccgcaacccgaagccucuccccagauuuccuaagaaauacuccuacccccuuaagagcccgggggugcggccuuccaaucccagaccuggcacgaugcgccaucccacaccccugcagcaggagccucggaaaauuucuuauagcagaaucccggaauccgagaccgagucuaccgccagcgcucccaacuccccucgcacaccccugaccccucccccugccucuggagccagcuccacgaccgacgucuguagcguuuucgauucugaccacuccagcccguuucacucuuccaaugauacaguguucauucaggugacccugccccauggcccucggagcgcuucugucuccagcaucucccucacaaaggggaccgacgaagugcccguuccucccccggugccucccagacgccggcccgagagcgccccugcggaaucuagccccuccaaaauuaugucuaagcaccuggauagcccuccggcuauucccccuagacaacccacguccaaagccuacucuccucgcuauagcaucuccgaccggacaucuaucagcgaucccccggaguccccuccccuccugccucccagagagccuguccggacccccgacguguuuucuagcuccccgcuucaucugcagccuccuccccucggcaaaaagagcgaucacggaaacgccuucuuucccaacucuccgucccccuucacaccucccccuccccagaccccuagcccgcaugggacccgcagacaucugcccuccccuccccugacacaggaaguugaccuucacucuaucgcuggaccucccgugccgccucggcaaagcacgucccagcacauucccaagcugcccccuaagaccuacaaacgcgagcacacacaucccagcaugcacagagacggcccuccgcuccuggaaaaugcccacucuuccuga

SEQ ID NO: 76088 - RNA, 3999 nt, Artificial Sequence
  derived and/or modified sequence opt5 from SOS2__Homo_sapiens__NP_008870
augcagcaagccccccagccuuacgaguucuuuagcgaagagaacuccccgaaguggagaggccugcucgugucugcucugcggaaaguccaggaacagguucaccccacccuuagcgccaaugaggaaucccuguauuacaucgaggagcucauuuuccaacugcuuaacaagcugugcauggcgcagccucgcacagugcaggacguggaagagagaguccagaaaacguuuccccauccuaucgauaagugggcuauugccgacgcccaaucugcuaucgaaaaacggaagcgcagaaauccccuccugcugccuguggauaagauucacccgagccucaaagagguucugggguauaagguggacuaccaugucucccuuuauaucguggccguucuggaguacaucucugcugauauucucaaacuggccggaaacuauguguucaauauccggcacuacgaaauuagccagcaggacaucaaggucuccaugugugcggauaaagugcuuauggacauguuugaucaggacgauauuggccuggugagccucugcgaggacgaacccucuuccagcggggagcugaacuacuaugaucugguccgcaccgaaaucgccgaggagagacaauaccuccgggaacugaauaugauuaucaagguuuuccgcgaggcuuuucuuucugacagaaagcuguucaaaccuuccgacaucgaaaagauuuuuagcaacaucucugauauucaugagcucacagugaaacugcuuggacugaucgaagacaccguggagaugacagaugaguccagcccccacccucucgccggcuccuguuucgaagaccuggcugaggaacaggccuuugaucccuaugagacccugucucaggacauucucagcccggaauuccacgagcauuuuaauaagcugauggcgcggccugccgucgcucuucacuuccaauccaucgccgauggguucaaagaggcugugcgcuacguucugcccagacucaugcuggugccugucuaucauugcuggcacuacuuugaacuucugaagcagcucaaagccuguagcgaggaacaggaggaccgggagugccugaaccaggccaucacagcucugaugaaucuccaaggaucuauggaucgcauuuauaagcaguacucccccagacggagacccggcgacccuguguguccguucuacagccaccagcugcgcucuaagcaucuugcgaucaaaaagaugaacgaaauucagaaaaauaucgauggcugggaggggaaggacauuggacaaugcuguaacgaauuuaucauggagggcccccugacccggaucggggccaaacacgaaagacauauuuuccucuuugacggacugaugaucagcugcaagccuaaucacggccagacgcgccugcccggguauuccucugcugaguaccggcuuaaggagaaauucguuaugagaaagauucagaucugugauaaagaagacaccugcgagcauaagcacgccuuugaacucgugagcaaagaugagaacuccauuaucuucgccgcuaagagcgccgaagagaagaacaauuggauggcggcucugauuucucugcacuaucgcuccacacucgaccggaugcuggauagcguccuucugaaagaggaaaacgagcagccucucagacugcccucuccggaaguguaccgcuuugucgugaaggacuccgaggaaaauaucguuuucgaggauaaccugcaaagccgguccggaaucccuauuaucaaaggcggcaccguggucaagcuuauugagagacucacauaucauauguacgccgaccccaauuuugugcgcaccuuccugacgacauaucggucuuuuugcaaaccucaggaacugcucagccugcuuaucgagagauucgaaauucccgagccugagcccaccgaugccgacaagcuggcuaucgaaaagggggagcagccgaucuccgccgaucucaaacgguuccgcaaggaauacguucagccugugcaacugagaauucugaacgucuuucggcacuggguggagcaucacuucuacgacuuugaaagagaucuugagcuccuggagcgccuggaaucuuucaucagcuccgugcggggaaaagcuaugaagaaauggguugagagcauugccaagaucauuagacgcaaaaagcaggcgcaggccaauggcgucucucacaacaucacauuugaauccccccccccuccgaucgaguggcauauuagcaagcccgggcaauucgaaaccuuugaccucaugacccugcacccuaucgagauugcuagacagcuuacacugcucgagucugaccuguaucggaaagugcagcccuccgaacuggugggaagcgucuggacgaaggaggauaaagaaaucaauucuccuaaccuucucaagaugauucgccauaccacaaaucugacccugugguucgagaaauguaucguggaagccgagaacuuugaggaaagaguugcugugcucagccggaucauugagauccugcaggucuuccaagaccuuaauaacuuuaauggcgugcuggaaauuguuuccgccgugaacagcgucucuguguaccgccucgaucacacauucgaggcgcugcaggagagaaagcggaagauccuggacgaagccguugagcuuucccaggaucauuuuaaaaaguaucuggugaaacucaagagcauuaaccccccuugcguccccuucuucgggaucuaccugaccaauauucucaaaacggaagagggaaacaaugacuuucugaagaagaaaggcaaggaucuuaucaacuucuccaaacgcagaaagguggcugaaaucacaggcgagauucagcaauaucagaaucagccguacugucugcggaucgagccugacaugcgcagauuuuucgaaaaccucaaucccauggggucugccagcgagaaagaauuuaccgauuaucuguucaacaagucccuggagauugaaccucggaauugcaagcagcccccgagauuuccucgcaaaucuaccuucagccuuaagucccccggaauccggccuaacacaggcagacacgggucuaccagcggaacacugcgcggccaccccacgccccucgagcgggagccuuguaaaauuuccuuuagcagaaucgcugaaaccgagcuggaaucuacaguguccgccccgaccagccccaauacaccuucuacccccccugucuccgccagcucugaccucuccguuuuccuggauguggaccuuaacagcuccugcgggagcaauucuaucuuugcucccgugcugcucccucauagcaaguccuucuucucuagcuguggcucccugcacaaacugucugaggaaccgcuuauucccccuccccugccuccccgcaagaaauuugaucaugacgcgagcaacuccaagggaaauaugaagucugacgaugacccgccugccauccccccccggcaaccucccccuccgaaagucaagcccagagugccuguucccacgggcgcuuucgaugggccucuccacagccccccgccucccccuccccgcgacccucugcccgauaccccgccucccgugccccuccggccuccggagcauuuuauuaacugccccuucaaccugcagccucccccucuuggacaccugcacagagacuccgauuggcugcgggacaucagcacaugucccaauucuccuuccaccccgcccagcacaccuucuccccgcgucccuagacggugcuacgugcucuccagcucccagaacaaucuggcccaucccccggccccucccguucccccucgccaaaacucuagcccccaccuuccuaaacugccgcccaagaccuacaaaagagagcucucccauccuccccuguaucggcucccucugcuugaaaaugcugagacgccccaguga

SEQ ID NO: 76089 - RNA, 621 nt, Artificial Sequence
  derived and/or modified sequence opt5 from SOSTDC1__Homo_sapiens__NP_056279
augcugcccccugccauccacuucuaccuccugccgcuugcuugcauucugaugaaaagcugucucgccuuuaagaacgacgcgaccgagauccuguauucccauguggucaagcccguuccugcucaccccucuagcaauuccacacuuaaccaggccagaaauggcgggcggcauuucucuaacacgggacuggaucgcaauaccagagugcaagugggcugccgggaacuccgcagcacaaaauacauuuccgacgggcaguguaccucuaucagcccucugaaggagcuggucugcgccggagaaugucucccccugccugugcuuccgaacuggauuggcgggggauauggcacaaaauacugguccagacggagcucucaggaguggcgcugcguuaaugauaagaccagaacacagcggauccaacugcagugucaggacggcuccacccgcacguauaagaucaccguggucacagcuugcaaauguaagagauacacccggcagcacaacgaaagcucucauaauuuugaguccaugagccccgccaaaccugugcaacaccaccgcgagagaaagcgggcuucuaaauccagcaagcauuccaugucuuga

SEQ ID NO: 76090 - RNA, 642 nt, Artificial Sequence
  derived and/or modified sequence opt5 from SOST__Homo_sapiens__NP_079513
augcagcugccccucgcccugugccuugugugucugcucguccacaccgcuuucagaguuguggagggccaaggguggcaggccuuuaagaacgacgcgacagaaaucauuccugagcugggagaauacccggagcccccucccgaacuugagaauaacaaaacgaugaaucgggcugagaacggcgggcgcccuccccaucacccuuucgaaaccaaggaugugagcgaguauuccugcagagaacugcauuuuacacgguacgucaccgacggaccgugucgcucugccaaacccgugacagagcucguuugcagcggccagugugggccugccagacugcugcccaaugcuaucggacggggcaagugguggcgcccuuccggccccgauuucagaugcauuccggaccgguaucgcgcccagagagugcaacuccuguguccugggggagaggcuccccgggcccgcaaagucagacuuguggcgucuugcaaguguaagcggcugacccgcuuucacaaccagagcgaacucaaagauuucggcacagaggccgcuagaccucagaaggggcggaaacccagaccccgcgcccgguccgcuaaggccaaucaggcggaacuggagaacgccuacuga

SEQ ID NO: 76091 - RNA, 1401 nt, Artificial Sequence
  derived and/or modified sequence opt5 from SOX10__Homo_sapiens__NP_008872
auggccgaggaacaggaccugagcgagguggaacucucccccgucggcucugaggaaccuagaugccugagcccgggguccgcucccucucuuggaccugauggcgggggaggcgggagcggacugcgggccucccccggcccuggcgagcucgggaagguuaaaaaggagcaacaggacggagaagcggaugacgauaaauuccccguguguauccgcgaggcugugucucagguccugagcggcuacgacuggacccuugugccuaugccgguuagagugaacggggccuccaagagcaaaccccacgucaagcggccuaugaaugccuuuauggugugggcucaggccgcucgcagaaagcuggccgaucaauauccccaucuccacaacgcggaacugucuaaaacacugggaaagcucuggcggcugcuuaaugaguccgacaaacgcccuuucauugaggaagccgagagacugcggaugcagcauaagaaagaucaccccgacuacaaguaucagccgcgcagacggaagaacggcaaagcugcccagggggaagcugagugcccuggaggcgaagccgagcaaggcgggacggcggccauccaggcucauuacaagagcgcccaccucgaucaccgccaucccggagagggcucuccuauguccgacgggaaucccgaacaccccagcggacagucucauggcccuccgacacccccuaccacccccaaaacagagcugcaguccgggaaggcugauccuaaaagagacggacggagcaugggcgaaggcgggaagccccacauugacuuuggaaacguugauaucggcgagauuucccacgaagugaugucuaauauggagaccuucgacgucgccgagcuugaucaauaucugccgccuaacgggcaucccggacacgugagcuccuacagcgccgcuggcuaugggcucggcucugcgcuggccguggcuuccggacauagcgccuggaucucuaaaccucccggcgucgcccugccuacaguuagcccgcccgggguggacgcuaaggcccaggugaagaccgaaacggcgggaccucagggcccuccccacuacaccgaucaacccuccacaucucagaucgcuuacaccagccucucccugccgcauuaugggagcgccuuucccucuauuucccgcccucaguucgacuacagcgaucaccagcccucuggaccuuauuacggccacuccgggcaagccagcggccuuuauuccgcuuuuucuuacaugggacccagccagagaccucuguauacagccaucuccgaccccucuccgagcggcccucagucccauagccccacccacugggagcagccugucuacacgacacucucucggcccuga

SEQ ID NO: 76092 - RNA, 1326 nt, Artificial Sequence
  derived and/or modified sequence opt5 from SOX11__Homo_sapiens__NP_003099
auggugcagcaagccgagagccuggaagcugaguccaaccuccccagagaagcccuggacaccgaggaaggcgaguucauggcgugcucuccugucgcucuugaugagagcgacccggauugguguaagacagccuccgggcacaucaaacggcccaugaaugccuuuaugguuuggucuaagauugaacgcagaaaaaucauggagcagagcccugacaugcauaacgcugaaauuuccaagcggcugggaaaacgcuggaagaugcucaaggauucugagaaaauccccuucauuagagaggccgaacggcugcgccuuaagcacauggcugacuacccugauuauaaauacagaccccggaagaaaccuaagauggacccgagcgccaagcccuccgcgagccagucuccugagaaauccgccgcuggcgggggaggcgggagcgccggaggcggcgcugggggagccaagacgucuaaaggcuccagcaagaaaugcgggaagcugaaagcgcccgccgcugccggagcuaaggccggcgccgggaaggcugcgcagucuggagauuauggcggcgccggggacgauuacgugcucggaucccugcgcgugagcggcuccgggggaggcggggcuggaaaaaccgucaaguguguguuucuggacgaagaugacgacgaugacgaugacgaugacgagcuccaacugcagaucaaacaggaaccugaugaggaggacgaggaacccccgcaucagcaacuucugcagccucccggccagcagccuucucaacuccugagacgguauaauguugccaaggugcccgccagccccacacuuuccagcucugcugaauccccugagggcgccagccuguacgaugaaguccgcgcgggggcuaccucuggagccggcgggggaagcagacucuauuacuccuucaaaaacaucacaaagcagcacccgcccccucuggcccagcccgcucugucuccugccagcucccggagcgugucuaccuccucuagcuccagcuccggcucuagcuccgggucuagcggcgaggacgcugaugaccucauguuugaccugucccuuaauuucagccaaucugcccauuccgcgagcgagcagcagcugggaggcggggccgcugccggaaaccucucucugucccuuguugauaaggaccuggauagcuuuucugaaggcagccucgggucccacuucgaguuucccgacuacugcacaccggaacugagcgagaugauugcuggagauuggcuggaagccaauuucucugaccucguguuuaccuauuga

SEQ ID NO: 76093 - RNA, 948 nt, Artificial Sequence
  derived and/or modified sequence opt5 from SOX12__Homo_sapiens__NP_008874
auggugcagcaaagaggcgcccgggcuaagcgcgacgggggacccccuccgcccggcccugggcccgccgaggaaggagcgagagagccuggcuggugcaaaacccccagcgggcacaucaagcggccuaugaacgcuuucauggucuggucccagcaugaacgcagaaaaauuauggaucaguggccggacaugcacaaugccgagaucucuaagcggcugggacgcagauggcagcuccugcaagauagcgagaaaauucccuuuguucgggaggccgagcgccuuagacugaagcauauggcugacuacccugauuauaaguaccggccccgcaaaaaguccaaaggcgccccugcuaaggccagaccccggccgccuggcgggucuggaggcgggagccgccucaaacccggaccucagcugcccggcagagggggacggagagcggccggcggcccccuugggggaggcgcugccgcuccugaagacgaugacgaggaugacgaugaagaacugcucgaggugcgccugguggaaacaccggggcgggagcuguggagaaugguccccgccggacgcgcggcccggggccaggcugaaagagcccaggggccuuccggagagggcgcugccgccgcugcggccgcuucucccacgccuagcgaagacgaggagcccgaagaggaagaggaagaggccgccgcugccgaggaaggcgaggaagagaccguggcguccggggaagagagccucggauuccugucucgccuuccgccuggccccgcugggcuggauuguuccgcccucgaccgggacccugaucugcaacccccuagcggaacaucucacuuugaguuccccgacuauugcaccccggaaguuacagagaugaucgccggcgauuggagaccuuccagcauugcugaccuuguguuuaccuacuga

SEQ ID NO: 76094 - RNA, 1869 nt, Artificial Sequence
  derived and/or modified sequence opt5 from SOX13__Homo_sapiens__NP_005677
augagcaugagaucccccaucucugcccagcuggcucucgacggcguggggaccauggucaacugcacaauuaagagcgaggagaaaaaggagccuugucacgaagccccgcaaggauccgcgacggcugccgagccccagccuggcgaucccgcccgggcuucucaggacagcgccgauccucaggcucccgcccaagggaauuuccgcggauccugggacugcucuagcccugaaggcaacggguccccggagcccaaaagaccuggaguuagcgaggcggccucuggcucccaggaaaagcuggauuuuaaucggaaccuuaaagagguggugcccgcuaucgaaaagcugcucagcucugacuggaaggagcgcuuccugggcagaaauuccauggaggccaaagaugucaaggggacccaggaaagccuugcugagaaagaacugcagcuccuggugaugauucaucaacugucuacacuccgggaccagcugcuuaccgcccacuccgagcagaagaacauggcggccaugcuguuugaaaaacagcaacagcagauggagcucgcucgccaacagcaggagcagaucgccaagcaacagcagcagcugauucaacagcagcauaagaucaaucuucugcagcaacagauccagcagguuaacaugccuuacgugaugauucccgcuuucccgccuagccaccaaccccucccugucacacccgauucccagcuggcccugcccauccagccuauuccguguaaacccguggaauauccucuccaacugcuucauucucccccugcccccguugugaagagaccgggagcuauggcgacccaccacccucugcaggagcccagccagccucucaaucugacagccaaacccaaggcuccugaacuucccaacaccuccagcucuccgucccugaaaaugagcucuugcgucccucggccucccagccauggcgggcccacgcgcgaccuccaguccucuccgcccagccugccucugggauuucucggcgagggggaugccgugaccaaggccauccaagacgcuagacagcugcuucacucccauagcggagcccuggauggcucucccaauacaccuuuccggaaagaccucauuucccuggacagcucucccgcgaaggaacgccuugaggauggcugugugcacccucuggaggaagcuaugcucuccugcgacauggaugggagcagacacuuucccgagucccggaacucuagccauaucaagcgcccgaugaaugccuucauggucugggccaaagacgaaagacggaagauucugcaggcuuuuccugauaugcacaacuccucuaucagcaaaauccugggauccagauggaagucuaugaccaaucaggagaaacaacccuacuaugaagaacaggcccgccucucucggcagcaucuggagaaguacccugacuauaaguacaaacccagaccgaagcgcacauguauuguugaaggcaaacggcuuagagugggggaguauaaggcucugaugcgcacccggagacaggaugcccgccaauccuacgugaucccuccccaggcgggacagguccaaaugagcagcuccgacgugcucuacccucgggccgcuggcaugccccuggcccagccccugguugaacacuaugugccuagaagccuugauccgaacaugcccgucauugugaacacgugcucucuccgcgaggagggggaaggaacagacgaucggcauagcguugcugacggcgagauguacagauauuccgaagacgaggauagcgaaggcgaggagaaaucugacggggaacuggugguccugaccgauuga

SEQ ID NO: 76095 - RNA, 723 nt, Artificial Sequence
  derived and/or modified sequence opt5 from SOX14__Homo_sapiens__NP_004180
augagcaagcccuccgaccacaucaaaagaccuaugaacgccuucaugguguggucucggggccagcgcagaaagauggcucaagagaauccgaaaaugcauaacagcgaaauuuccaagcggcugggggccgaguggaaacuccugucugaagcggagaagcgccccuacaucgaugaagcuaagagacuucgggcccagcacaugaaagagcauccugacuauaaguaccgccccagacggaaaccuaagaaucugcucaaaaaggaucgcuaugucuuuccccugccuuaccuuggagacaccgauccgcugaaggccgcuggccuccccguuggggccagcgacggacugcuguccgcuccugagaaagccagagcguuccugcccccugccucugcucccuauagccuccuugauccggcccaguuuuccagcucugcuauucagaagaugggcgaagugccucacacacuggccacgggggcgcuccccuacgccuccacccugggauaucaaaacggcgcuuucggcagccuuucuugcccuucccagcauacacacacccaccccagccccacaaauccuggguacguggucccguguaacugcaccgccuggucugcuuccacacugcagcccccuguggccuacauccucuuucccggaaugaccaaaacgggcauugacccuuauagcuccgcccaugcuaccgcgauguga

SEQ ID NO: 76096 - RNA, 702 nt, Artificial Sequence
  derived and/or modified sequence opt5 from SOX15__Homo_sapiens__NP_008873
auggcccugcccggcagcucccaggaccaggcuuggucucucgagccuccggccgcgaccgcugccgccagcuccucuagcgggccccaagaaagagagggagcuggcuccccugccgcucccgggacacugccucuugaaaaggugaaacggcccaugaacgccuucauggucuggucuagcgcgcagcgcagacagauggcccaacagaauccuaagaugcacaacuccgagaucagcaaacggcugggagcucaguggaagcuccuggaugaagacgagaaacgcccguuuguugaggaagccaagagacuucgggcucgccaucugagagauuaccccgacuauaaguaccggccucgcagaaaagccaagucuuccggcgcggggcccagccggugcggacagggccgcggcaaucucgccucugggggaccucuguggggccccggguaugcuacgacccaaccguccagaggauucggcuaccggccucccagcuauucuacagccuaccugccuggguccuauggaagcucccacuguaaacucgaggcucccucucccugcagccugccucaguccgauccgcgccuucagggcgaacugcuccccaccuacacacauuaccugccucccggcagcccuacccccuauaacccgccucuugccggggcccccaugccucugacacaccucuga

SEQ ID NO: 76097 - RNA, 1245 nt, Artificial Sequence
  derived and/or modified sequence opt5 from SOX17__Homo_sapiens__NP_071899
augagcucccccgacgccggcuacgcuucugaugaccagagccaaacccaguccgcccugccugcggugauggcugggcucggaccgugccccugggccgagucucugagcccuaucggcgauaugaaggucaaaggggaagcccccgcuaacuccggagccccugcuggcgccgcggggagagccaagggagagucucggauucgcagacccaugaaugcuuucaugguuugggccaaagacgaacggaagcgccuugcucagcagaacccugaucugcacaaugccgagcucagcaaaaugcugggcaaguccuggaaggcgcuuacacuggccgagaaaagaccguuuguggaggaggcugaacggcuccgcgugcaacauaugcaggaccaccccaacuauaaguacagaccucggcgcagaaaacaggucaagcggcugaaacgcguggagggcggguuccugcauggacucgccgaaccccaggcugccgcccugggcccugaagggggaagaguugcuauggauggccuugggcugcaauuucccgagcagggauucccggcgggcccuccccuccugccuccccacaugggcgggcauuaucgggacugucagagccuuggagcucccccucuggauggcuacccgcuccccacgccugacaccucuccccuggaugggguggacccugaucccgccuuuuucgccgccccgaugccuggagacugccccgcugccggcacauauuccuacgcgcaggucagcgacuaugcugggccucccgaaccucccgccggaccgaugcacccucgccugggccccgagcccgccggcccuucuaucccggggcuccuggcucccccuuccgcccuucacguguacuacggagcuaugggcagccccggggccggaggcgggagaggcuuucaaaugcagccucagcaucaacaccagcaucagcaccagcaccaucccccuggacccggccaaccgucuccucccccugaagcgcugcccugucgggaugggaccgacccgucccagccugccgagcuccugggagaaguugauagaacagaguucgagcaguaucuucacuuugugugcaagcccgaaaugggccugccuuaccaggggcaugacagcggagucaaucuccccgauucccacggcgcuauuucuagcgugguguccgacgccagcucugcugucuauuacuguaacuaucccgauguuuga

SEQ ID NO: 76098 - RNA, 1155 nt, Artificial Sequence
  derived and/or modified sequence opt5 from SOX18__Homo_sapiens__NP_060889
augcagagaagcccucccggcuacggggcccaagacgauccgcccgcucggcgcgacugcgccugggcgccuggacacggcgcugccgccgauaccagagggcuggcugccggacccgcugcccucgcggccccugcugcccccgcuuccccuccgucuccccagcggagcccuccccgcuccccugagcccggcagauaugggcugucuccggccggacggggcgaacgccaggcggccgacgagagcagaauccggcgcccuaugaacgcuuucauggugugggccaaggaugaaagaaaacggcuugcucagcaaaaucccgaccugcauaacgccguccucuccaagaugcugggcaaagccuggaaggagcuuaaugcugcggaaaaacgcccuuuuguugaggaggccgaaagacugcgggugcagcaccuccgcgaucaucccaacuacaaguauagaccccggagaaagaaacaggcucgcaaggcccggagacuggagccugggcugcuccugccgggacuugcucccccucagcccccucccgaaccguucccugcugccucuggcagcgcgcgcgcuuuucgggagcugcccccucucggggccgaguucgacggacugggccuucccacaccugaaagaagcccccuggaugggcucgagccgggagaagccgccuuuuucccuccucccgccgcucccgaggacugugcccugcgcccguuucgggcgcccuacgccccuacggaacuguccagagaucccggcggcugcuauggggcuccucucgccgaggcucugcgcaccgcgcccccugccgcuccccuugccggacuguacuauggcacacucgggaccccgggaccuuaccccggcccucugucucccccgccugaggcucccccucuugaauccgccgagccccuggggcccgccgccgaccucugggcugauguggaccugacagaguucgaccaauaccugaauuguagccggaccagaccugaugcgccgggacuccccuaucacgucgcccuggcuaaacuuggcccucgcgccaugucuugccccgaagaauccagccugauuucugcccucuccgacgcuagcuccgccguguacuauucugcguguaucagcggcuga

SEQ ID NO: 76099 - RNA, 1176 nt, Artificial Sequence
  derived and/or modified sequence opt5 from SOX1__Homo_sapiens__NP_005977
auguacagcaugaugauggagaccgaccugcacucccccggcggggcccaggcuccuacaaaccucucuggaccggccggcgcugggggaggcgggggaggcggcgggggaggcgggggaggcgggggagcgaaggccaaucaagauagagugaaacggcccaugaacgccuucauggucuggagccgcggccagagacggaagauggcucaggaaaauccuaaaaugcauaacuccgagaucucuaagcgccugggcgccgaauggaaaguuaugagcgaggcugaaaagagacccuuuauugacgaggccaagcggcuucgcgcgcugcacaugaaagagcauccugauuauaaguacagaccccggcgcaaaacgaagacccuccugaaaaaggacaaguauucccuugccgggggacugcucgcugccggcgcugggggaggcggggccgcgguggccaugggagugggcgucggcgugggggcugccgcuguuggacagagacuggaaucuccuggcggggccgccggaggcggguacgcucacgugaauggcugggcgaacggagccuauccgggcagcgucgcugccgccgcugccgcggcugccaugaugcaagaggcccagcuggcuuacgggcagcaucccggagccggcggggcucacccucacgcccaucccgcgcacccucauccccaccacccgcaugcccacccucauaauccccagccuaugcaccgguaugauaugggagcucuccaauacucccccaucagcaacucucagggcuacauguccgccagccccucuggguauggcggacugccuuacggcgcugccgcggccgcugccgcugccgccgggggagcucaucaaaauuccgcgguggccgcugccgccgcugccgcggcugccagcucuggcgcccuuggggcucugggaucccucguuaaaagcgaaccguccggcucucccccugcccccgcgcacagccgcgcuccuugccccggggaccugagagagaugauuuccauguaucuuccggccggcgagggaggcgauccugccgcugccgcugccgcggccgcucagagccggcugcacucucucccccagcauuaccagggggccggagcuggcgugaacgggacagucccucugacccacaucuga

SEQ ID NO: 76100 - RNA, 831 nt, Artificial Sequence
  derived and/or modified sequence opt5 from SOX21__Homo_sapiens__NP_009015
augagcaagcccguggaccacgucaaaagaccuaugaacgccuucaugguuuggucccgggcucagcgcagaaagauggcccaagagaauccgaaaaugcauaacucugaaaucagcaagcggcugggcgcggaguggaaacuccugaccgaauccgagaagcgccccuuuauugaugaagcuaagagacuucgggccaugcacaugaaagagcauccugacuacaaguaucgccccagacggaaaccuaagacacugcucaaaaaggauaaguucgccuuucccgugccuuacgggcugggaggcguggcugacgccgagcacccggcucuuaaagccggggcgggacugcaugccggcgcugggggaggccucguccccgaaucucugcuggccaauccugagaaggcugccgcggccgcugccgcugccgccgcucgcguguucuuuccccagagcgcggccgcugccgccgcugccgcggcugccgccgcugccggcuccccuuauucucuccuggaucuugggagcaaaauggcugaaaucuccucuagcuccagcggacugcccuacgccucuucccucggcuauccgacggcgggggccggagcuuuccacggcgccgcugccgcggccgcugccgcugccgccgcugccgggggacacacccauagccacccuucucccggcaacccuggcuacaugauucccugcaauuguuccgcguggcccagcccugggcugcagccgccccuugcuuauauccugcucccuggaaugggcaagccccagcuggacccuuaccccgccgccuacgcugccgcgcuguga

SEQ ID NO: 76101 - RNA, 954 nt, Artificial Sequence
  derived and/or modified sequence opt5 from SOX2__Homo_sapiens__NP_003097
auguacaacaugauggagaccgaacugaagcccccuggcccgcagcaaacaagcgggggaggcgggggaaauuccacggccgcugccgcgggcgggaaccagaaaaauucucccgacagagugaagcggccuaugaacgcuuucauggucuggagccgcggacagagacggaaaauggcccaggagaaucccaagaugcacaacuccgaaaucucuaaacgccucggcgccgaguggaagcugcuuagcgaaaccgagaagagaccuuuuauugaugaggcuaaacggcugcgcgcccuccauaugaaggaacaccccgacuauaaauacagaccucggcgcaagacaaaaacccugaugaagaaggauaaauauacacuuccgggcgggcugcucgcucccggaggcaauuccauggccucugggguuggagugggcgcggggcugggagccggcgugaaccaaagaauggacagcuacgcucauaugaauggcugguccaacgggagcuauucuaugaugcaggaucagcugggauacccucagcaccccggccucaaugcccauggggcugcccaaaugcagccuaugcaccgguaugacgucuccgcgcugcaguacaacagcaugaccucuucccagacauacaugaauggaagccccaccuauucuauguccuacagccaacagggcacgccggggauggcccuuggauccaugggcucugugguuaagagcgaggcuuccagcucuccucccguggucaccuccagcucucacagccgcgccccuugccaggcuggcgaucugagagacaugaucuccauguaucuccccggggccgaagugcccgagccugccgcuccgucucggcugcauaugagccaacacuaccaguccggacccguuccuggcacagcgauuaacgggacccuuccccugagccauauguga

SEQ ID NO: 76102 - RNA, 1341 nt, Artificial Sequence
  derived and/or modified sequence opt5 from SOX3__Homo_sapiens__NP_005625
augagacccgugcgggagaacuccuccggcgcccgcucuccuagagucccggcugaccuggcccggagcauccucauuucccugcccuucccucccgauucucuugcgcaccgcccucccagcuccgcuccuaccgaaucucaggggcuguuuacaguugccgccccggcucccggagccccuagcccucccgcuacgcucgcccaucugcuucccgcgccggccauguacucccugcucgagaccgaacugaagaauccugugggcacacccacccaagcugccgggacaggaggcccugcugcccccgggggagcgggcaaaagcucugccaacgcugccggcggggcuaauuccggaggcgggagcucuggaggcgccuccgggggaggcggcgggaccgaccaggauagagugaagcggcccaugaacgccuucauggucuggagccgcggacagagacggaaaauggcucuggagaauccuaagaugcacaacucugaaaucuccaaacgccucggcgcggacuggaagcugcuuacagaugccgagaagagaccguuuauugacgaggcuaaacggcugcgcgccgugcauaugaaggaauaucccgauuacaaauauagaccucggcgcaagaccaaaacgcuccugaagaaggacaaauacagccuucccuccgggcugcucccucccggagccgcugccgcggcugccgccgcugccgcugccgcggccgcugccucuagcccgguuggcguggggcagagacuggauaccuauacacacgucaauggaugggcuaacggcgccuacucccuggugcaagagcagcucggcuaugcgcagccucccagcaugucuuccccucccccucccccggcccugccucccaugcaucgguacgacauggcugggcuucaguacagccccaugaugccuccgggagcccaaucuuauaugaauguugcugccgccgcugcggccgcuagcggcuacgggggaauggcccccuccgccaccgcugccgcggcugccgccuauggccagcagccugcuacagccgcggcugccgccgcugccgcugccgcgaugucucuggggcccaugggcagcguggucaaguccgaaccuagcucucccccucccgccaucgcuucccacagccagagagccugccucggagaucugcgcgacaugauuucuauguaccuuccgccuggcggggaugcugccgacgccgcuagcccccugccuggaggccggcuccacggggugcaucaacacuaucagggagcgggcaccgccgugaacgggacggucccccugacacauaucuga

SEQ ID NO: 76103 - RNA, 1425 nt, Artificial Sequence
  derived and/or modified sequence opt5 from SOX4__Homo_sapiens__NP_003098
auggugcagcaaaccaacaaugccgagaacacagaagcucugcucgccggcgagagcuccgacucuggggcgggacuggaacuuggcaucgcuagcucccccacgccugggucuaccgccagcacaggaggcaaggccgaugacccguccuggugcaaaacccccucugggcacauuaagagaccuaugaaugcuuucauggucuggagccagaucgagcggcgcaaaauuauggaacagucccccgauaugcauaacgccgagaucagcaagagacugggaaaacgguggaagcuccugaaggacucugauaaaauuccuuuuauccgcgaggcugaaagacuucggcugaagcacauggccgacuaccccgauuauaaauaccgcccuagaaagaaaguuaaguccggcaaugcgaacagcagcuccagcgccgcugccucuuccaagccgggcgagaaaggggacaaggugggaggcagcgggggaggcgggcauggaggcggcgggggaggcggguccucuaaugcuggaggcgggggaggcggcgccagcgggggaggcgcgaacuccaaacccgcccagaagaaaagcugugggucuaagguggcuggaggcgccgggggcggagucuccaaaccucacgcuaagcucauccuggccggcgggggaggcgggggaaaggccgcugcggccgcugccgccagcuucgcugccgaacaagcgggcgcugccgcccugcucccccugggggcugccgcugaucaucacucucuuuauaaagcccggacaccuagcgcguccgccucugcuagcuccgccgcuagcgccucugcggcccuggcugcccccggcaagcaccucgcugagaaaaaggugaaacgcguuuaccuguuuggaggccuugggaccuccagcucuccggugggaggcgucggggccggagccgacccuuccgauccccugggccucuaugaggaagagggggcuggcugcagcccugacgcgcccucccugucuggaagaagcuccgccgcuucuagccccgccgccggccgguccccugcugaucaucgcggguacgccagccugagagcggcuucuccggcccccuccagcgccccuucucacgcuuccagcucugccagcucccauucuucuuccagcuccucuagcggauccucuagcuccgacgacgaguucgaagaugaccuccuggaucuuaaucccucuagcaacuuugaauccaugagccugggcucuuucuccucuagcuccgcgcucgaccgggaucuggacuuuaauuucgagccugggagcggaucucacuuugaguuccccgauuauuguacaccggaaguguccgagaugauuagcggcgacuggcuugaauccagcaucucuaaccugguuuuuaccuacuga

SEQ ID NO: 76104 - RNA, 1929 nt, Artificial Sequence
  derived and/or modified sequence opt5 from SOX5__Homo_sapiens__NP_001248343
augagcuccaagagacccgccucuccuuacggcgaggcugacggggaaguggccauggucaccagccggcagaaaguugaggaagaggaauccgauggacugccggcguuccaccucccccugcaugugucuuuuccuaacaagccccacagcgaggaguuccaaccugugucccuucugacacaggaaacgugcggccaucgcacccccacaucucagcacaauaccauggaggucgacgggaacaaagugaugagcuccuuugcuccucauaauagcucuacauccccgcagaaggccgaagagggaggcagacaaagcggggagucucucuccagcaccgcccugggaacacccgaacggcgcaaaggcucucuugcugauguuguggacacccugaagcagagaaagauggaggaacucaucaaaaacgagccugaagagacgcccuccauugagaagcugcugagcaaagauuggaaggacaaacuccuggccaugggcuccgggaauuucggagaaaucaagggcaccccugagucucuugcugaaaaggagcggcagcugauggggaugauuaaccagcucacaagccugcgcgaacaacuucuggccgcgcacgaugagcagaaaaagcucgccgcuucccagaucgagaaacagagacaacagauggaacuggccaagcagcaacaggagcagauugcucggcagcaacagcagcugcuccagcaacagcacaaaaucaaucugcuucagcagcaaauccagguccagggacagcugcccccgcucaugauuccuguguuucccccugaccaacgcacccuggccgcggccgcucagcagggcuuccuucugccucccggguuuagcuauaaggccggauguucugaucccuacccgguucaacucauccccacaaccauggcugccgccgcugcggccacgccuggccugggcccccugcagcuccagcagcuguaugcugcccaacuugccgcuaugcaaguguccccugggggaaaacugcccggcauuccgcaggggaaccucggagccgcggucagcccuacaucuauccauaccgacaagagcacaaauucucccccucccaaguccaaagaaaagaccacccuggagagccuuacacagcagcuggcugugaaacagaacgaagagggcaaguucucccacgccaugauggauuuuaaucucagcggggacucugauggauccgccggcgugagcgagucuagaauuuaccgggaaucccgcggcagagggagcaacgagccucauaucaaacggcccaugaaugcuuucauggucugggccaaggacgaacgcagaaagauucugcaggcuuuuccggacaugcacaacuccaauaucucuaaaauccugggaagccgguggaaggccaugacgaaccucgagaaacagccuuauuacgaggaacaagcgagacuguccaagcagcaccuugagaaauaucccgauuacaaguacaagccccgcccuaaacggaccugccugguugacggcaagaaacucagaauuggggaauauaaggccaucaugcgcaaccggagacaggagaugcgccaauacuucaaugugggacagcaggcucagauuccgaucgccacagcuggcguggucuaucccggggccauugcgauggccggcaugccuucuccccaucugccuagcgaacacuccagcgugucuuccagccccgagccuggaaugcccguuauccaaucuaccuacggcgugaaaggggaggaaccgcauaucaaggaggaaauucaggcugaggauaucaacggagaaauuuaugacgaguacgaugaggaagaggacgauccugacgucgauuauggcuccgacagcgaaaaucacaucgccgggcaggcuaacuga

SEQ ID NO: 76105 - RNA, 2406 nt, Artificial Sequence
  derived and/or modified sequence opt5 from SOX6__Homo_sapiens__NP_001139283
augagcuccaagcaggccaccucucccuucgcuugcgccgcggacggcgaggaugcuaugacacaagaccugacgagcagagaaaaagaggaaggguccgaucagcacguggccucucaucucccucugcacccgaucaugcauaacaagccccacagcgaggaacuuccuacccuggucuccacaauucagcaggacgccgauugggacucuguucucagcucccaacagcggauggagagcgagaauaacaaacuguguucucuuuacuccuuucgcaauaccagcacaucuccccauaagccugaugaaggauccagagaccgggagaucaugaccagcgugacauucggcacccccgaacgcagaaaagggucucuggcugauguggucgacacgcucaagcagaagaaacuggaggagaugacccggacagaacaggaggauuccagcugcauggaaaagcugcucuccaaagacuggaaggagaaaauggaacgccugaacaccucugagcuucugggagagauuaagggcacaccugaaagccucgccgagaaggaaagacaacuguccaccaugaucacgcagcuuauuagccugcgggagcagcuccuggcugcccacgaugaacagaaaaagcuggcggccucucaaaucgagaaacagcgccagcaaauggaccucgcuagacagcagcaggagcaaaucgcccggcagcagcagcaacugcuucagcagcagcacaagauuaaucugcuccaacagcagauccaggugcaagggcauaugccgccccugaugauuccuaucuuuccccacgaccagcgcacacuugcugccgcggccgcugcccagcaaggauuccuguuuccucccggcauuaccuauaaaccgggcgauaacuacccuguucaguucauccccuccacaauggcugccgccgcugcgagcgggcucucuccucugcagcugcagcaacucuaugccgcucagcuggccagcaugcaagugucccccggagccaagaugcccucuaccccucagccgcccaauaccgcuggcacagucagcccuacggggauuaaaaacgaaaagagaggaaccucccccgugacacagguuaaggacgaggccgcggcucagccucuuaaucugagcucucggcccaaaaccgccgaaccggugaaguccccuacaagccccacccagaaccucuuuccugccucuaaaacgucccccgucaaucugccuaacaagagcuccauccccucuccgaucggcgggagccuuggacgcggcuccucucugggcaaauggaaaagccagcaucaagaggaaacauacgagcucgauauucuguccagccuuaauucuccugcucucuucggggaccaggauaccgugaugaaggccauccaggaggcuagaaagaugcgggaacaaauucagagagagcagcagcaacagcagccccacggaguggacggcaagcuguccagcaucaacaauauggggcuuaacucuugucgcaacgaaaaagagcggaccagauuugagaaucugggaccccagcucacaggcaaguccaacgaagaugggaaacugggaccuggcgucauugaccugacccgcccggaggaugccgaaggcagcaaggcgaugaaugggucugccgcuaagcugcaacaguauuacugcuggcccacaggaggcgccacgguugcugaggcccggguguauagagacgcgcgcgggcgggccagcuccgaaccucacaucaaaagacccaugaacgcuuucauggugugggccaaggaugagcgccggaaaauccuccaggcuuuuccugacaugcauaauagcaacauuucuaagauccugggauccagauggaaaagcauguccaaucaggagaagcaacccuacuacgaggaacaggcccgccugucuaagauucaccucgaaaaauauccuaacuacaaguauaaaccccggccgaagagaaccuguaucgucgacggcaaaaagcugcggauuggggaguacaaacagcuuaugcgcagcagacggcaggaaaugagacaauucuuuacagugggccagcagccucaaauccccaucaccacaggaaccggcguuguguauccuggggccauuacgauggcuaccacaacccccuccccgcagaugacaucugauugcagcuccaccucugcgagcccugagcccucccugccugucauccagagcacguacggaaugaagacagacggcgggucucucgccggaaaugagaugauuaacggcgaagaugagauggaaauguaugacgauuacgaggacgaucccaaguccgacuacagcucugaaaaugaggcucccgaggccguguccgccaacuga

SEQ ID NO: 76106 - RNA, 1167 nt, Artificial Sequence
  derived and/or modified sequence opt5 from SOX7__Homo_sapiens__NP_113627
auggccagccugcucggcgcuuaccccuggccugaggggcuggaaugcccggcccuugacgcggagcuguccgauggacagucucccccugcugugcccagaccucccggcgacaaggggagcgaaucccggauccgcagaccuaugaacgccuucauggucugggccaaagaugagcggaagcgccucgcuguucaaaauccggaccugcacaacgccgaacuuucuaaaaugcugggaaagagcuggaaagcucucacccugucccagaagagacccuauguggaugaggccgagcggcugcgccuccagcauaugcaggacuacccuaauuauaaguacagaccccggcgcaaaaagcaagcgaaaagacuguguaagcggguggauccuggcuuucuucugucuagccucucccgcgaccagaacgcccugcccgagaaaagaagcgggucucggggagcucuuggcgaaaaggaagaucgcggcgaguauuccccggggacagcccugccuagccucagaggaugcuaccacgagggccccgcugggggaggcgggggaggcacgccuucuuccgucgacaccuaucccuacggccugcccacaccuccggaaaugagcccccuggaugugcucgagccugaacagaccuucuuuucuucccccugucaggaggaacaugggcacccucggcgcauuccccaucugccgggacacccuuacagccccgaguaugccccuucuccccuucacugcucccauccucugggcagccucgcgcuggggcaaucccccggaguuagcaugaugucuccggugccuggcuguccucccucccccgccuacuauagcccggcuacauaccacccccuucauucuaaucugcaggcccaccucgggcagcugagcccucccccugagcaccccggauucgacgcucuggaucagcucucccaagucgaacugcuuggcgacauggacagaaacgaguuugaucaguaucugaauaccccuggccaucccgacucugccacaggggccauggcucucagcggacacgugccgguuucccaggugaccccuacgggccccaccgaaacaagccugaucucuguccuugcggaugccaccgcuacauacuauaacuccuacagcgugucuuga

SEQ ID NO: 76107 - RNA, 1341 nt, Artificial Sequence
  derived and/or modified sequence opt5 from SOX8__Homo_sapiens__NP_055402
augcuggacaugagcgaggccagaucccagcccccuugcucuccgagcggcaccgcuuccucuaugagccacguggaagauuccgacucugaugcucccccuagccccgcgggguccgagggacucggccgggcuggggucgccguuggaggcgcccgcggggacccugcugaagccgcugaugagagauuccccgccuguauccgggacgcggugagccaagugcugaagggauacgauuggucucuugucccuaugccggugcgcggcggcgggggaggcgcccugaaagcuaagccccauguuaaaagaccuaugaacgccuuuauggugugggcucaggccgcgcggcgcaagcucgccgaccaguauccccaucugcacaaugcugaacuuuccaaaacacuggggaagcucuggagacugcugagcgagucugagaagcggccuuucgucgaagaggccgaacgccucagagugcagcacaaaaaggaucaucccgacuacaaauaucaaccgcggcgcagaaaguccgcuaaagccggacacagcgauucugacuccggcgccgagcuggggccucaccccggaggcggcgcuguuuacaaggcggaggccgggcuuggagauggccaucaccauggggaccacacgggacagacccacggcccucccacacccccuaccacaccgaagaccgaacugcagcaggcuggggccaaacccgagcucaagcuggaaggacggcgcccuguggacagcggcagacaaaacauugauuuuuccaaugucgacaucucugagcuuagcuccgaagugaugggcacaauggaugccuucgacgugcaugaguuugaucaguaucugccccucgggggaccugcucccccggagccuggccaggccuacgggggagcguauuuccacgcuggcgccagccccgucugggcccauaaaucugcuccuuccgccagcgcuucucccaccgaaacggggccuccccggccgcacauuaagaccgagcagccuagccccggccauuacggagaccaacccagaggcuccccugauuacgggucuugcagcggacaguccagcgccacaccggcggcccccgcuggcccuuuugccgggucucagggagacuauggcgaucugcaagccuccagcuacuauggggccuaccccggcuaugcgccuggacuguaccaguaucccuguuuccacucuccucgccggcccuacgccuccccgcuccugaacggccuugcucugccucccgcccacagcccuaccucccauugggaccagcccguuuacacaacccucacgagaccguga

SEQ ID NO: 76108 - RNA, 1530 nt, Artificial Sequence
  derived and/or modified sequence opt5 from SOX9__Homo_sapiens__NP_000337
augaaccugcucgaccccuucaugaagaugaccgaugagcaggaaaaaggccugagcggggccccuuccccgacaaugucugaggacagcgcuggaucccccugcccuucuggcagcggguccgauacggaaaauaccagaccccaagagaacacauuuccuaagggagaacccgaccuuaaaaaggagucugaggaagauaaauucccuguguguauccgggaggccgucagccagguucugaagggcuacgacuggacccucgugccgaugcccgugcgcgucaauggguccagcaagaacaaaccucacgugaagagacccaugaaugcguuuaugguuugggcucaggccgcccggcgcaaacuggcugaucaguauccucaucuucacaacgccgaacugucuaagacacucggaaaacuguggagacugcucaaugaguccgagaagcggcccuucguggaagaggcugaacgccugagaguccaacauaagaaagaccacccggauuacaaguaucagccucggcgcagaaaaagcgugaagaacggccaggccgaggcggaagaggccaccgagcagacacauauuucucccaaugcuaucuuuaaagcccuucaagcugacuccccucacucuagcuccggcaugagcgaaguucacucccccggggagcauucuggacagagccaggggcccccuaccccgcccacgaccccuaagacagaugugcagcccggcaaagccgaccugaagcgggaaggacgcccucuccccgagggcgggagacaaccgccuauugauuuccgggacgucgacaucggagaacuguccagcgaugugauuucuaacaucgagaccuuugacgugaaugaguucgaucaguaccuucccccuaacggccaccccggcgucccugcgacacaugggcagguuaccuauacgggauccuacggcaucagcucuacagccgcuacccccgccagcgcugggcacguguggauguccaagcaacaggccccgccucccccuccccagcagccgccccaagccccucccgcuccucaggcgcccccucagccccaggccgcuccgccucaacagcccgccgccccuccccagcagccgcaagcucacacacugaccacccucucuagcgaaccuggacagucccagcgcacacauauuaaaacggagcagcugagccccucucacuauuccgaacaacagcagcauagcccucaacagaucgccuacucucccuuuaaucugccccacuacuccccuagcuauccgcccauuaccagaucccaguacgacuauacagaucaucagaacucuagcuccuacuauucucacgcggcuggccaagggaccggacucuacagcacauucaccuauaugaauccugcccagcggcccauguacacgccuaucgccgacacauccggcgugcccagcauuccucagacccacucuccgcagcauugggagcaacccgucuacacccagcugacaagaccuuga

SEQ ID NO: 76109 - RNA, 2658 nt, Artificial Sequence
  derived and/or modified sequence opt5 from SP100__Homo_sapiens__NP_001073860
auggccggcgggggaggcgaccugagcaccagacggcucaacgaguguaucucccccguggcuaaugaaaugaaccaucugccugcccacucucacgaucuucagcgcauguucacagaggaccaaggggucgaugacagacugcucuacgauauuguuuuuaagcauuucaaacggaauaagguggaaaucagcaacgcgauuaaaaagacguuuccguuccuggagggacuucgcgacagagaucugaucaccaauaaaauguuugaagacucccaggauucuugucggaaccucgugcccguccagcgcgugguuuauaaugugcugagcgagcuggagaagacauucaaccucccuguccuggaagcucuuuuuagcgacgugaauaugcaggaguaccccgaucugauucacaucuauaagggcuucgaaaacguuauccaugacaaacucccucugcaagagucugaggaagaggaaagagaggaacggagcgggcuucagcugucccucgagcagggaaccggcgagaauagcuuucgcucucugacauggcccccuuccggcagcccgucucacgccgggaccacacccccugaaaacggacuguccgagcaccccugcgaaaccgagcagauuaaugccaagagaaaagauacgaccagcgacaaggacgauucucucggcucccaacagacaaacgaacagugugcucagaaagccgagccuaccgagagcugcgaacaaaucgcugugcaggucaauaacggggacgccggacgggagaugcccuguccgcugccuugcgaugaagagucccccgaagcggagcuucauaaccacggcauucagaucaauucuuguagcgugcgccugguggacauuaagaaggagaaaccuuucuccaacagcaaggucgaaugccaagcccaggcuagaacacaucacaaucaggccucugauaucauuguuaucuccagcgaggacucugaagggagcaccgauguggacgagccccucgagguguuuaucuccgcuccccggucugaaccugucauuaacaaugauaacccgcuggagagcaaugacgaaaaagagggacaggaagccacguguucccgcccccaaaucgugccugagcccauggauuucagaaaacuuagcacauuucgggagucuuucaagaagagaguuauuggccaggaccacgacuucuccgaaagcucugaggaagaggcgccugccgaggcuuccagcggcgcccugcgcuccaaacauggggaaaaggcucccaugaccucucggagcacauccaccuggagaaucccgucucgcaagcggagauuuagcuccagcgauuucucugaccucuccaacggagaggaacugcaggagaccugcuccucuucccugcgccggggcagcgggucucagccucaagaacccgagaauaaaaaguguagcugcgugaugugcuuuccuaaaggaguccccagaucccaggaagcccgcacagagagcucucaggccuccgauaugauggacacgauggauguggagaacaauagcacccucgaaaagcacuccggcaaacggagaaagaagcgccggcauagaucuaaaguuaacgggcugcagcggggacgcaagaaagacagaccucggaagcaccuuacacugaauaacaaagugcaaaagaagagauggcagcagcgcggccggaaagcuaauaccagaccccucaagcgcagacggaaacgcggcccgcggauuccuaaggaugagaacaucaacuucaaacagagcgaacugcccgucacauguggggaggugaagggaacccuuuacaaggagagauuuaaacaaggcacguccaagaaaugcauccagucugaagacaagaaaugguucacaccccgcgaguuugaaauugagggggauagaggagcgagcaagaauuggaaacuguccauccgguguggcggguauacccucaagguccugauggaaaacaaguuccugccugagccgcccucuacccgcaaaaagcggauucucgagagccauaauaacacacugguggacccuugccccgaaaauuccaacaucugugagguuugcaauaaauggggcagacuguuuuguugcgauaccuguccucgcagcuuccacgaacacugccauauucccucuguggaggccaacaagaauccuugguccuguaucuuuugcagaaucaaaacaauucaggaacggugccccgagagccaaucuggacaccaggaguccgaaguccuuaugagacagaugcucccggaggaacagcugaagugugaguuccugcuucucaagguguacugcgacagcaaaucuugcuuuuucgcuuccgaaccuuauuacaaccgcgagggcagccaagggccccagaagccuauguggcugaauaaaguuaagacgucccugaacgagcagauguacacccggguggaaggauucguccaggauaugagacucaucuuucauaaucacaaagaguucuaucgcgaagacaaguuuacacggcugggcauucaagugcaggacaucuucgagaagaacuuuagaaauauuuucgccauccaggagaccagcaaaaacauuaucauguuuaucuga

SEQ ID NO: 76110 - RNA, 1668 nt, Artificial Sequence
  derived and/or modified sequence opt5 from SP110__Homo_sapiens__NP_001171944
augggcagaggguuccggauguuuaccaugacacgcgccauggaggaagcucuguuccagcacuuuaugcaucaaaagcucggaaucgccuacgcgauucacaaacccuuccccuuuuucgagggccugcuugacaacagcaucauuacgaagagaauguauauggaaucccuggaggcuugccggaaucucaucccggugucucgcgucguucauaacauucugacccagcuugaaagaacauuuaaucugagccuccuggugacccuguucucccagaucaaccuccgggaguaccccaaucuggugacaaucuaucgcucuuuuaaaagagucggggccagcuacgaguggcagucccgggauaccccuauucuucuggaagcccccacaggacucgcugagggcucuagccugcacaccccucuugcccugcccccuccgcaacccccucagcccuccugcagcccuugcgcuccccgcgugucugaaccggggacguccagccagcagucugacgagauccucuccgagagcccuucucccuccgauccuguucugccccugcccgcccucauucaagaaggaagaagcaccuccgugacaaacgacaagcugaccucuaaaaugaaugcggaggaagauagcgaggaaaugccuucccuucugacaagcaccguccagguggccucugacaaccucaucccgcagauucgggauaaggaggacccccaggagaugccucauuccccucugggcagcaugccugaaauccgcgauaauucucccgagccgaacgacccugaggaaccccaagaaguuagcuccacgccuucugauaagaaaggcaagaaaagaaagcgguguauuuggagcacacccaaacgcagacacaagaagaaaucccuuccugggggaaccgcuagcucucggcacggcauccagaagaaacugaagagaguggaccaggucccccaaaagaaggaugacuccacaugcaauagcaccguggagacccgcgcccagaaagcucggacagagugugccagaaagucucgcuccgaagagaucauugacgggacgagcgaaaugaacgagggaaagcggucccagaaaaccccgucuacaccuagacgcgugacccagggcgcggccagccccgggcauggaauccaagaaaagcuccaggucguugauaaagugacacagcggaaggacgauuccaccuggaacucugaggugaugaugagaguccagaaagcucgcacgaagugcgcccggaaaagcagacugaaagagaagaaaaaggaaaaagacauuuguuccagcucuaagcgccgguuccaaaagaauauccacagacggggcaaacccaaguccgauacaguggacuuucauugcagcaaacugccuguuaccuguggcgaggcuaaggggauucucuauaaaaagaagaugaaacacggaucuuccgugaagugcauccgcaaugaagauggcaccuggcugacaccgaacgaguucgaggucgaagggaaaggaagaaacgccaagaauuggaaacggaacaucagaugugagggcaugacccuuggggaacugcucaagagcggacugcuucugugucccccucgcauuaaucucaaacgggagcugaacucuaaguga

SEQ ID NO: 76111 - RNA, 519 nt, Artificial Sequence
  derived and/or modified sequence opt5 from SP140__Homo_sapiens__NP_001005176
auggcccagcaaggccagcaggggcagauggcuagcggagacuccaaccugaauuucagaaugguggccgagauccaaaacgucgaaggccagaaucuccaggagcagguuugccccgaaccuauuuuucgguucuuucgcgagaacaagguggaaaucgcgucugcuauuaccagaccguuccccuuucugauggggcuucgggaucgcagcuucaucuccgagcaaauguacgagcacuuucaggaagccuucagaaaucuggugccugucacacgggugauguauuguguucucucugagcuggagaaaacguuuggauggagccaucuugaagcccuguucucccgcauuaaccucauggcuuaccccgaccugaaugagaucuauagaucuuuucagaacgaaaaucugagcuccagcgccgugcucugccagcuggucucuccuaacaaggauuggcggucccacgaggaaagccuugcucauaccggcacacugcgcagaucuuguauguga

SEQ ID NO: 76112 - RNA, 2358 nt, Artificial Sequence
  derived and/or modified sequence opt5 from SP1__Homo_sapiens__NP_612482
augagcgaccaggaucacuccauggacgagaugaccgccguggucaagaucgaaaaaggcguugggggaaacaauggcgggaacggaaauggcgggggagcuuucucucaagccagaagcuccucuacaggcagcuccucuagcacgggcgggggaggccaggagucccagcccagcccucuggcgcuccuggcugcuaccugcucucggauugaauccccgaacgagaauagcaacaauucucaggggcccucccaaagcggaggcacaggggaacuugaucugaccgccacacagcucucucagggagccaacggcuggcagaucauuuccagcuccucuggcgccaccccuacaagcaaggagcaauccgggagcucuaccaauggauccaacggcagcgagucuagcaaaaaucgcacgguguccgggggacaguacguggucgcugccgcgcccaaccugcagaaucagcaagugcuuaccggccugccugggguuaugcccaacauccaguaucaggugauuccucaauuucagacagucgacggacagcagcuccaauucgccgcuaccggcgcccaggugcagcaggauggcucugggcaaauccagaucauuccgggagcuaaucagcagaucauuacaaacagaggcagcgggggaaacaucauugccgcgaugcccaaucugcugcaacaggccguuccucuccagggccuggcuaacaaugugcuuuccgggcagacccaauacgucacgaacgugcccguggcccugaauggcaacaucacacuccugccugucaauagcguuucugcugccacccuuacacccuccagccaggccgugaccauuucuuccagcggaucccaggaaucuggcagccaaccggugaccuccgggacaacgaucucuagcgcuucccuggucagcucucaggcguccucuagcuccuuuuucaccaacgccaauagcuauucuacaaccacaaccacgagcaacaugggaaucaugaauuuuacaaccuccggcagcucugggaccaacucccagggacagacaccucaacgggugagcggccuccagggguccgacgcucugaauauucagcagaaccaaaccucuggcggaagccugcaggccggccagcagaaggagggggaacaaaaucagcagacacaacagcagcagauccucauucaaccccagcugguucagggaggccaggcccuucaagcucugcaggccgcgccucucuccgggcagacguucaccacacaggcuaucucucaagagacccugcagaaccuucagcugcaggccgugcccaacagcggacccauuaucauccgcacaccuaccgucggcccgaaugggcaaguguccuggcagacgcuccagcugcaaaaccugcagguucagaauccccaggcccaaaccauuacacucgcuccuaugcagggcgugucucugggacagaccagcuccagcaacacaacccuuacgcccaucgccucugcugccuccauuccugcgggcacagucaccgugaaugccgcucagcugagcucuaugcccgggcuccaaacaaucaaccuguccgcccuuggaaccagcggcauucagguccauccgauccaggggcugccucucgcuaucgccaaugcgcccggagaucacggcgcccagcuggggcugcauggcgcuggaggcgacgggauucacgaugacaccgccggaggcgaggaaggggagaacucuccugaugcucaaccccaggccggaagacggacacgcagagaagccuguacgugcccuuacuguaaagacuccgagggccggggcagcggggaucccggaaagaagaaacagcauaucugccacauucaaggcugugggaagguguauggaaaaaccucccaccuccgcgcucaucugagauggcacacaggcgaacggccguuuaugugcaccuggagcuacugugggaagcgcuucacaagaucugacgagcuucagcggcauaaacgcacccacacgggagagaagaaguuugcgugcccugaaugucccaaaagauucaugcggagcgaccaccuguccaagcauaucaaaacacaccagaauaagaaaggcggccccgggguugcccucucugugggaacccugccucuggauagcggcgcuggguccgagggaucuggcaccgccacaccgagcgcccuuauuaccacaaacauggucgcuauggaagccaucugccccgaggggauugcgagacucgcuaauuccggaaucaacgugaugcagguugccgaccugcaaucuaucaauauuagcggcaacggcuuuuga

SEQ ID NO: 76113 - RNA, 1842 nt, Artificial Sequence
  derived and/or modified sequence opt5 from SP2__Homo_sapiens__NP_003101
augagcgacccccagaccuccauggccgcuacagccgcggugucuccuagcgauuaccugcaaccggcugccuccacgacccaggacucucagcccagcccucucgcccugcuugcugccacaugcuccaagaucggacccccugcugucgaggccgcgguuacgcccccugccccgccccagccuacacccagaaaacuggugccuauuaagcccgcuccgcucccucugucucccgggaaaaacagcuucggaauccuuuccagcaagggcaauauucugcaaauccaggggucucagcucuccgccagcuauccuggaggccagcugguguuugcuauucaaaaccccaccaugaucaauaaagggacacggucuaacgccaauauccaguaccaggcggucccccagauucaagccuccaacagccagaccauccaggugcaaccuaaucugacgaaccagauucagaucauuccgggaaccaaucaggcuaucauuacacccucuccuuccagccacaagcccguuccuaucaagcccgccccgauccaaaaauccucuaccacaaccacgccugugcagagcggcgcuaacgucgugaagcucacaggcgggggaggcaauguuacccugacacuucccgugaacaaucuggucaacgccuccgauaccggggccccuacccagcuccugacagaaucucccccuacgccccuuagcaaaaccaauaagaaagcucgcaagaagucccugccggcgagccagccucccguggccguggcugagcaagucgaaacaguucucauugagaccacagccgacaacaucauucaggccggaaacaaucugcugaucgugcagucucccggcgggggacagccugcugugguccaacaggugcagguugugccgcccaaagccgaacagcaacaggucgugcagauuccucaacaggcgcucagaguugugcaggcugccagcgccacccugcccacggucccucagaagcccucccaaaacuuccagauccaggcugccgagccuacacccacccagguguauauccggaccccgucuggcgagguccaaacagugcuuguucaggauagcccucccgcuaccgccgcggccacauccaauacgaccuguagcucuccugcuucccgcgcuccccaucugagcggcacaucuaaaaagcacuccgccgccauucucagaaaagaacggccgcugccuaagaucgcgcccgccgggagcauuaucucccuuaacgcugcccagcuggcugccgccgcucaggcgaugcaaaccauuaauaucaacggagugcagguccagggcgugccuguuacaaucaccaauaccgggggacaacagcagcucaccgugcagaacgucucuggcaauaaccugacaauuagcgggcugucccccacccaaauccagcuccagauggagcaggcccuggcuggagaaacacaacccggcgagaaacgcagacggauggccugcaccuguccuaauugcaaggacggcgagaagcgcucuggggaacagggcaaaaagaaacaugugugucacauuccggauugcggcaagacguuuagaaaaacaagccuucugcgggcccaugugcgccuccacaccggggagagacccuucguuuguaacugguuuuucugcggaaagcgguuuacacgcuccgacgaacugcagagacacgcucggacccauaccggcgauaagagauucgagugugcccagugccaaaaacgcuuuaugcggagcgaccaccuuacaaagcauuacaaaacgcaccuggucaccaagaaucucuga

SEQ ID NO: 76114 - RNA, 2142 nt, Artificial Sequence
  derived and/or modified sequence opt5 from SP3__Homo_sapiens__NP_001017371
auggggcccccuagcccgggggacgaugaggaagaggccgcugccgcggcuggagcccccgccgcugccggcgcuaccggggaccuggccuccgcgcagcucggaggcgccccuaacagaugggaagugcugucugcuacacccacgaccaucaaggaugaggccgggaaucuuguccaaauuccuagcgcugccacauccucuggacaguacguucugccccuccagaaccugcagaaucaacagaucuucagcguggcgccuggcuccgacucuagcaacggcaccguguccagcguccaguaucaggugauuccgcaaauccagucugccgaugggcagcagguucaaauuggauuuacaggcuccagcgacaaugggggaaucaaccaggaaucuucccagauccaaauuauccccggcagcaaucagacccuucuggcuucugggacaccuuccgccaacauucagaaucucaucccccagaccggacaagugcagguccagggcguggcuauuggcgggagcuccuucccuggacagacgcaaguuguggccaacgucccccugggccugccggggaauaucaccuuugugccuauuaacucuguggaucucgacagccugggacuuuccggcagcucucagacaaugaccgccgggaucaaugcugauggacaccugaucaacacaggccaggcgauggacuccagcgauaauucugagcggaccggcgagcgcgucagccccgacauuaacgaaacgaacacagauaccgaccucuucguuccuacauccucuagcucccagcugcccgugaccaucgacagcaccgggauucuucaacagaauacaaacucucugacgaccuccagcggacaggugcauucuuccgaucuccagggcaauuacauccaaagccccgucuccgaggaaacacaggcccagaacauucaagugucuaccgcucagccuguugugcagcaucugcagcugcaagagagccagcagccgacaucccaggcccaaaucguccaggggaucacgccccagaccauucacggagugcaggccucuggccaaaauaucagccagcaggcucuccaaaaccugcagcuucagcugaauccugggacauuucucauucaggcccaaaccguuacccccuccggccaggugacauggcagaccuuccagguccaaggagugcagaaccugcagaaucuucagauccaaaacacagcggcucagcagauuacgcugaccccuguccagacacucacccugggccaaguggccgccgggggagcuuuuacaagcacccccguuucucuguccacgggccagcucccgaaucugcagaccgugacagucaacagcaucgacucugccgggauccaacuucacccuggagagaaugcugauucccccgccgacauuagaaucaaagaagaggaaccugaucccgaggaauggcagcugagcggcgacucuacccucaacacaaaugaucugacccaucuucgggugcagguuguggacgaggagggggaucagcaacaccaggaaggcaagcgccugagacgggucgcgugcacguguccuaacugcaaagagggaggcgggcgcggaacaaaccucggcaagaaaaagcagcacauuugucauauccccgggugcggaaagguguauggcaaaaccagccaccugagagcccaucugcgguggcacuccggggaacgcccguucguguguaauuggauguacugcggcaagagauuuacacggagcgacgagcuccagcgccacagacggacccauaccggagagaaaaaguucguuuguccugaaugcucuaaacgcuuuaugagauccgaucaccuggcuaagcauauuaagacacaccaaaacaaaaagggcauccauagcuccucuacgguccuugccagcguggaggcugcccgggacgacacccugauuacagcgggcggaaccacacucauccuggccaauauccagcagggcuccgugucugggauuggaaccgucaacacgagcgcuacauccaaucaggauauccugaccaacaccgaaauuccccuucaacucgugacaguuucuggcaaugagaccauggaauga

SEQ ID NO: 76115 - RNA, 2355 nt, Artificial Sequence
  derived and/or modified sequence opt5 from SP4__Homo_sapiens__NP_003103
augagcgaccagaagaaggaggaagaggaagaggccgcugccgcggcugccauggccaccgaaggcgggaagacauccgagcccgagaacaauaacaaaaagccuaaaacgucuggaagccaagauucccagccgucuccccuggcucuccuggccgcuaccugcagcaagaucggcacaccuggggaaaaucaggccaccggacagcaacagauuaucauugaccccucccagggccuugugcagcugcaaaaccagccucagcagcucgagcuggucacaacccaacuugcggggaaugccuggcagcugguugcuucuacacccccugccagcaaggaaaacaaugugucccagccggcuagcagcuccucuucuuccucuagcuccaacaauggaagcgccucccccaccaaaacgaagucuggcaacagcuccaccccuggccaauuccaggugauccagguccagaaucccagcgggucugugcaauaccagguuauuccucagcuccagacaguggagggacaacagauccagaucaaccccaccuccagcucuagccugcaggaucugcaaggccagauucagcucaucuccgcggggaauaaccaggccauucugacagcugccaauagaaccgcuucuggaaacauccuugcccaaaaccuggccaaucagacggucccggugcagauucggccuggcguuagcaucccccuccaacugcagacacuuccugggacccaggcucagguggucacaacccugcccauuaacaucggaggcgugacccucgcgcugcccgugaucaauaacgucgccgcuggcgggggaacaggccaaguugggcagccugccgccacggcugacuccggaaccagcaauggcaaccagcuggugucuacaccgaccaauacaaccacguccgccagcacaaugcccgagucuccuuccagcuccaccaccuguacaaccacagcgucuacgagccucaccuccucugauacacuggugagcuccgcugacaccgggcaguaugccagcacaucugccuccagcucugaacgcaccauugaggaaucccaaacgcccgcugccaccgagagcgaagcucagucuagcucccagcuucagccuaacggaaugcaaaaugcccaggaucagagcaacucucugcaacagguccagaucgugggccagcccauucuccaacagauccagauucagcaaccgcagcagcagaucauccaagcgauuccuccccaguccuuucagcugcagagcggccaaacaauccagaccauucagcaacagccucuucagaauguucagcugcaagccgugaaccccacacagguccucaucagagcuccuacccugacgcccuccgggcagauuucuuggcagacagugcaaguucagaauauccagagccuguccaaccuccaggugcaaaaugccggacugucucagcagcuuaccaucacaccggucagcuccucuggcgggaccacccuggcucaaauugccccuguggcggucgccggagcucccaucacacucaacacggcccagcuggcuagcgugcccaaccuucagaccguuuccguggccaaucugggcgccgcugggguccaggugcaaggcguuccugugacaauuaccagcgucgcgggacagcagcagggccaagacggggugaaagugcagcaggccacaaucgcuccgguuaccgucgccgugggaggcauugccaacgcuacgaucggggccgugucucccgaucagcucacacaaguccaucugcagcagggacagcaaaccuccgaccaggaggugcagccuggcaagcggcugcgcagaguugcgugcagcugucccaauugccgggagggggaaggccgcggaucuaacgagccuggcaaaaagaagcaacacauuugucacaucgaagggugcggaaaaguguacggcaagaccucccaucucagagcucaucugcgguggcacacaggggagcgccccuucaucuguaauuggauguuuugcggaaaaagauucacccggagcgaugaacuucagcgccacagacggacacacacgggcgagaagcgcuuugaguguccugaaugcucuaaaagauucaugcgguccgaccaucugagcaagcacgucaaaacccaucagaacaagaaagggggcggaacagcccucgccauugugaccuccggcgagcuggauagcucuguuacagaagugcuggggagccccagaaucgucaccguggcugccauuucccaggacucuaauccggcgacgccuaacguuagcaccaauauggaggaauuuuga

SEQ ID NO: 76116 - RNA, 1197 nt, Artificial Sequence
  derived and/or modified sequence opt5 from SP5__Homo_sapiens__NP_001003845
auggccgcuguggccguccugagaaacgacagccuccaggcguuccugcaagaucggacccccuccgcuucuccugaccuuggcaagcacagcccgcuggcccuccuggccgcuacaugcucccgcaucgggcagcccggagccgcugccccucccgauuuucuucagguuccuuacgaccccgcgcugggcucuccuagcagacucuuccauccguggacggccgauaugcccgcucacuccccuggggcccugcccccuccccauccgucucugggacucaccccucagaaaacacaucugcaacccagcuuuggcgcugcccacgagcuuccucugaccccucccgcggaccccuccuauccguacgaguucagccccgugaagaugcucccuucuuccauggccgcucugcccgccagcugugcuccugccuaugugcccuacgccgcucaggcggcccuuccgccuggguauucuaaucugcuucccccucccccucccccgccucccccucccacaugccggcagcuguccccgaaccccgcuccugaugaccugcccugguggagcauuccucaggccggagccggccccggcgcuucuggggucccuggauccggccucagcggggccugugcgggagcuccccacgccccgcgcuuuccugccuccgcugccgcugccgcggccgcugccgcugcccugcaaagaggccuugugcuggggcccucugauuucgcgcaguaccagagccagaucgccgcucuccugcaaaccaaagccccucuugcugccacagcccggcgcugcagacggugucgcugccccaauugucaggcugcgggaggcgccccggaagcugaaccuggcaagaaaaagcagcacguuugccaugugcccggguguggaaaggucuauggcaaaaccucccaccugaaggcccaucucagauggcacacgggggagcggccuuuugugugcaacuggcuguucuguggaaagagcuuuacccgcucugacgaacugcaaagacaccuccggacacauaccggcgagaaacgcuucgccugccccgagugcgggaaaagauuuaugcgguccgaucaccuggcuaagcauguuaagacacaccagaauaaaaagcucaaaguggccgaagcgggagucaagagagaggacgcucgcgaucuguga

SEQ ID NO: 76117 - RNA, 1131 nt, Artificial Sequence
  derived and/or modified sequence opt5 from SP6__Homo_sapiens__NP_954871
augcugaccgccgugugcggcagccucgggucccagcacacagaggcuccccaugccucuccuccgagacuggaccuucaaccccugcagacguaccagggacacaccagcccugaagcgggcgauuaucccuccccucuccagcccggggagcugcaaucucuuccucugggaccggaagucgacuucagccagggcuacgagcuccccggggcuuccucucggguuacaugugaagaucuggagagcgacuccccucuggcccccggaccuuuuagcaagcuccugcagcccgauaugucucaucacuaugaguccugguuccgcccgacccauccuggcgccgaagacggcagcuggugggaucuucaccccgggacaucuuggauggaccugccucacacccagggagcucucacaucccccggccaucccggggcccugcaagcuggacuuggcggguacgugggagaucaccagcugugcgccccuccgccccauccucacgcgcaccaucuccugcccgccgcuggcggccagcaucugcucgggccucccgacggagccaaagcucuggagguggccgcgccggaaagccagggccuugauucuucccuggacggggccgcuagaccuaagggaagccggcgcuccguccccagaucuagcggccaaaccgugugucggugcccuaacugucucgaggccgagcgccugggggcucccugcggaccugauggcggcaaaaagaaacaccuucacaauugucauauccccgggugcggaaaggccuaugccaagacgucccaccugaaagcucaccucagauggcauagcggcgaccggccguuuguuuguaacuggcuguucugcgggaagcgcuuuaccagaucugacgaacugcagcggcaccuccagacacauaccggaaccaaaaaguucccuugugcggugugcucccgcgucuuuaugagaagcgaucaccuggccaaacacaugaagacacaugagggcgcuaaggaagaggccgccggggcugccucuggcgaaggaaaagcgggcggggcuguggagccucccggaggcaaggggaaacgggaggccgaaggaagcguugcccccuccaauuga

SEQ ID NO: 76118 - RNA, 1296 nt, Artificial Sequence
  derived and/or modified sequence opt5 from SP7__Homo_sapiens__NP_690599
auggccagcucccugcucgaggaagaggugcacuacggcucuagcccccuggcuaugcuuaccgccgcgugcuccaaguucgggggaucuagcccucugagagacuccacaacgcucggcaaagcugggaccaagaaaccguauucugucggaagcgaucuguccgccagcaagacaaugggcgacgccuaccccgcuccuuuuaccucuacaaacgggcuucugucccccgccggaagcccucccgcuccuaccucuggcuaugccaaugauuacccgcccuucucccauagcuuuccuggccccacagggacccaggacccuggacuccugguucccaaaggccacucuuccagcgauugucugccguccguguauacgucucucgacaugacccauccuuacgggagcugguauaaggcgggaauccacgccggcauuucccccgggccuggaaacacacccacccccuggugggauaugcauccuggcggcaauuggcuugggggaggccaagggcagggagacggccugcaggggacacugccgaccggacccgcucagccuccccucaacccucaacugcccacguacccgagcgauuucgccccucuuaaucccgcuccuuaccccgccccucaucugcuccagcccggcccgcagcacgugcugccucaggacgucuauaagcccaaagcggugggcaacucugggcaacuggaaggauccggcggggccaagcccccucggggagcuagcacaggcgggucuggcggauacggcgggagcggagccggccgcuccucuugcgauuguccgaauugccaggagcucgaaagacugggggcugccgccgcuggacuucggaaaaagcccauccacagcugucacauuccuggcugcgggaaaguuuauggcaaggcgucccaucugaaggcccaccuccgcuggcacaccggagagagacccuuuguguguaacuggcuguucugcggcaaacgguuuacacgcagcgacgagcuugaaagacauguccggacccacacccgcgagaagaaauucacaugucugcucugcucuaagagauuuacgcgguccgaucaucugagcaaacaccagcgcacccauggggaaccuggacccggcccucccccgucugggccuaaggagcugggagagggcagauccacaggggaagaggaagcuagccagacaccccggccuuccgccucucccgccaccccggagaaagcuccuggcggaagccccgaacaauccaaucuccuggagaucuga

SEQ ID NO: 76119 - RNA, 1527 nt, Artificial Sequence
  derived and/or modified sequence opt5 from SP8__Homo_sapiens__NP_874359
auggccaccagccugcucggcgaggaacccagacugggguccacaccucuugcuaugcuggccgcgacgugcaacaagaucggaucuccgagccccuccccuucuagccucuccgacucuagcuccagcuucggcaaaggguuucaccccuggaagcggucuuccagcucuagcagcgcuucuuguaauguggucggauccagccuguccucuuucggcguuagcggggccucccgcaacggaggcuccucuuccgccgcugccgcugccgcggccgcugccgcugccgcggccgcucuugugagcgauucuuuuagcugcggcggguccccuggaucuagcgccuucucccugaccuccucuuccgcugccgccgcugcggccgcugccgccgcugccgcgucuagcucccccuuugcuaaugacuacagcguguuccaggccccuggcgucuccgggggaucuggcgggggaggcggcgggggaggcgggggaagcuccgcccauucucaagauggcagccaccagccgguguuuauuuccaaaguucauacaagcguggacgggcuccagggaaucuaucccagagucggcauggcucacccuuacgagucuugguucaagcccucccauccuggccugggggccgcuggagaagugggcagcgccggggcgucuuccuggugggauguuggagccggcuggauugacgugcagaaccccaauagcgcugccgcucugccggggucucuccacccugccgcgggcggacugcaaaccagccuucacagcccccugggcggguauaacagcgauuacucuggacucucccauagcgccuuuuccucuggcgcuagcucccaucugcuuucuccugccgggcagcaccugauggacggauucaaacccguccuccccggcagcuauccugauuccgcuccgucuccccuggccggggccggcggaagcaugcuguccgcuggcccuagcgcgccccucgggggaucuccucgguccagcgcccgcagauacucuggccgggcuacaugugacugccccaauugucaggaggccgaacgccuggggccggccggagcuucccuuagacggaagggccugcacagcugccacaucccuggguguggcaagguguauggaaaaaccucucaucucaaggcccaucugcgcuggcacacaggcgagagacccuuugugugcaacuggcuuuucugugggaaacgguuuacccgcuccgaugagcugcagagacaccuccggacgcauaccggagaaaagcgcuucgcgugcccugucuguaauaaaagauucaugcggagcgaccaccuguccaagcacguuaagacacauagcggcgggggaggcgggggcggaucugcuggcagcggguccggaggcaaaaaggggucugauaccgacagcgagcacuccgccgccggaucucccccuugccauagccccgaacugcuccaaccgccugagcccggccacagaaacggccuggaguga

SEQ ID NO: 76120 - RNA, 456 nt, Artificial Sequence
  derived and/or modified sequence opt5 from SPA17__Homo_sapiens__XP_011541172
augagcauccccuucuccaacacccacuaccggauuccucagggcuuugggaaucugcucgagggacugacaagagaaauccuucgcgagcaaccggacaacauucccgccuucgcugccgcguauuuugaaucucugcucgagaagagagagaaaacgaauuucgauccugcugaguggggcagcaagguggaggaccgguuuuacaacaaucaugccuucgaagaacaggaacccccugagaaauccgaucccaagcaggaggaaucucagaucagcgggaaagaggaagagaccuccgucacaauucuggacucuagcgaagaggauaaggagaaggaagagguugccgcugugaaaauccaagccgcuuuucgcggacacaucgccagagaagaggcgaagaaaaugaagaccaacucccuucagaaugaagagaaagaggaaaacaaguga

SEQ ID NO: 76121 - RNA, 885 nt, Artificial Sequence
  derived and/or modified sequence opt5 from SPACA1__Homo_sapiens__NP_112222
augagccccagaggcaccgggugcuccgccggacugcucaugacagugggcuggcugcuucuggcugggcuccagucugcccggggaacgaacgucaccgcggcuguucaagacgccggccuggcccacgagggggaaggagaggaagagacagaaaauaacgauagcgagaccgcugagaauuacgccccuccggaaacagaggacguguccaaccgcaauguggucaaggaaguggaguucggcauguguaccguuacaugcggcaucggggugagagaggucauucuuaccaacggaugucccggcggggaaucuaaaugcgugguucggguggaggaaugucgcggaccuacggauugcggcugggggaagcccaucagcgagucccuggaaucugucagacucgcuuguauucauaccagcccucugaaucgguuuaaauauauguggaagcugcuccgccaggaccagcaguccaucauucuggugaacgauagcgccauccuugaggugagaaaagagucucacccccuggcguucgaaugcgacacacucgauaauaacgagaucgucgccaccauuaaguuuacaguuuacaccuccagcgaacugcaaaugcggagaucuucccuuccugcuacggacgccgcucugaucuucgugcucacaauuggagugaucauuugugucuuuaucauuuuccugcugaucuuuaucauuaucaauugggccgcggugaaggccuucuggggcgcuaaagccagcaccccggagguucagucugaacaguccagcgugcgcuauaaggauuccacaucucucgaccagcugcccaccgagaugccuggcgaggaugacgcucuuagcgaauggaacgaguga

SEQ ID NO: 76122 - RNA, 648 nt, Artificial Sequence
  derived and/or modified sequence opt5 from SPACA3__Homo_sapiens__NP_776246
auggugagcgcccugagaggcgcuccccucauccggguccacuccucuccuguuagcuccccgucugugagcgggccccgcagacugguguccugccuuucuagccaguccagcgcccugucucaauccggaggcgggagcaccucugcggcuggaauugaggcccggucccgcgcccucagacggcgcugguguccugcuggcaucaugcugcuugcccuggucugccuccugagcugucugcuccccucuuccgaagcuaagcuguacgggagaugcgagcuugcccgggugcugcaugacuucggacucgauggcuaucgcggcuacagccuggcggacuggguuugucuugccuauuuuacauccggguucaacgcugccgcucuggauuacgaagccgacggaucuacgaauaacggcauuuuucagaucaauagcagacgguggugcuccaaccucaccccuaaugugcccaacgucugucgcauguauugcagcgaucugcugaauccuaaccucaaagacacagugauuugugcgaugaagaucacccaggagccgcaggggcugggauacugggaagccuggagacaccauugccaaggcaaagaucuuacagaguggguugacgggugugauuucuga

SEQ ID NO: 76123 - RNA, 327 nt, Artificial Sequence
  derived and/or modified sequence opt5 from SPAG11A__Homo_sapiens__NP_001075021
augagacagcggcugcuccccagcgugaccucccugcuucuggucgcccuccuguucccuggcucuagccaagcucgccacguuaaccauuccgccacagaggcgcuuggggaacugagagagcgggcuccgggacagggcacgaauggguuucagcuccugcgccacgccgugaagagagaccugcugcccccucggacacccccuuaccagggagaugugccccucggcauccgcaacaccauuugcagaaugcaacaggggaucugucggcuuuucuuuugccauucuggaaccggccagcagcaccgccaaagauguggcuga

SEQ ID NO: 76124 - RNA, 312 nt, Artificial Sequence
  derived and/or modified sequence opt5 from SPAG11B__Homo_sapiens__NP_057596
augagacagcggcugcuccccagcgugaccucccugcuucuggucgcccuccuguucccuggcucuagccaagcucgccacguuaaccauuccgccacagaggcgcuuggggaacugagagagcgggcuccgggacagggcacgaauggguuucagcuccugcgccacgccgugaagagagaccugcugcccccucggacacccccuuaccaggugcauaucucucaccgcgaagccagaggacccagcuuccggauuugcgucgauuuucucggcccucgcugggcuagaggguguuccaccggaaacuga

SEQ ID NO: 76125 - RNA, 552 nt, Artificial Sequence
  derived and/or modified sequence opt5 from SPAG16__Homo_sapiens__NP_001020607
auggccgcucagagaggcaugcccagcuccgccgugcggguccuggaggaagcgcucgggaugggacugaccgcugccggcgacgcccgcgauacagcugacgccguugcugccgagggggcguacuaucuugaacaagugacgaucaccgaggccucugaagaugacuacgaguaugaggaaauuccugaugacaacuucagcaucccggagggagaagaggaucuggcuaaggccauucagauggcucaggagcaggccacagacaccgaaauccucgagagaaaaacagugcugcccuccaagcacgcggucccugaagugauugaggauuuucuuugcaauuuccugaucaaaaugggcaugacccggacacucgacuguuuucaaucugaaugguacgagcugauccagaaggggguuaccgagcugcgcacggugggaaacguccccgauguguauacccagauuaugcuccuggaaaaugagaacaaaaaucuuaagaaggaccugaaacauuacaagcaggccgcugaauauguuaucuucuga

SEQ ID NO: 76126 - RNA, 2781 nt, Artificial Sequence
  derived and/or modified sequence opt5 from SPAG1__Homo_sapiens__NP_757367
augaccacaaaggacuaccccagccuguggggcuucgggacgaccaaaacauuuaagaucccuauugagcaccucgauuucaaauauaucgaaaagugcuccgacgugaaacaucuggagaagauucuuuguguccugagaucuggagaagagggcuacuauccggaacucaccgaguuuugcgagaagcaucugcaggcccuugcucccgaaagccgggcccugcgcaaagauaagccugcggcuacagccgccuccuucaccgcugaggaaugggagaaaaucgacggggauauuaagucuuggguuagcgagaucaaaaaggaagaggacaagaugcacuuucacgaaacagagaccuuccccgccaugaaagauaaccucccucccgugagaggauccaauucuugucugcaugugggcaaggaaaaauacagcaagcggccuacgaaaaagaaaaccccgcgcgacuaugcugagugggauaaguuugacgucgagaaggaaugccugaaaaucgaugaggacuacaaggaaaagacagugauugauaagucccaccucagcaaaaucgagaccagaauugacacagccgggcugaccgaaaaggagaaggacuuccuugcgacgcgggagaaagaaaagggaaacgaggccuuuaauucuggcgauuaugaagaggcuguuauguacuacacacgcuccaucagcgcccugcccaccguggucgcuuauaacaauagagcccaagcggaaauuaaacuccagaacuggaacucugccuuccaggacugugagaaggugcuggagcuugaaccuggcaauguuaaagcucugcuccggcgcgccacaaccuacaagcaccagaauaagcugagagaggcuaccgaagaucuguccaaagugcucgacgucgagcccgauaacgaccuggccaagaaaacacuuagcgagguggaacgggaucugaaaaauucugaggccgcuuccgaaacgcaaaccaaagggaagcgcauggugauccaggagauugaaaacagcgaggacgaggaaggaaaguccggcagaaaacaugaggaugggggaggcgacaagaaaccugcggaacccgccggggcugcccgggccgcucagccgugcgucaugggaaauauccagaagaaacucacaggcaaggccgagggcgggaaacgcccugcgagaggagcuccccaacggggccagaccccugaagccggggccgauaagagaucuccccgccgggcuagcgccgcugccgcggccggaggcggggcuacaggacaccccggcggcgggcagggagccgagaacccugcuggccugaagucccaggggaaugagcuuuuuagaagcggacaauucgccgaagcggccggcaaauauucugcugccaucgcucugcucgagccggccggguccgaaauugccgacgaccugagcauccuguacucuaaccgcgcugcguguuaucucaaggagggcaacugcagcggauguauucaggauugcaaucgggcccuggaacuucaucccuuuuccaugaaaccucugcucagacgcgcuauggccuacgagacccuggagcaguauggcaaggccuacguugacuacaaaacggugcuucaaaucgauugugggcugcagcucgcuaacgacucugugaaucggcugagccgcauucugauggaacucgauggacccaacuggagagagaagcuguccccuauccccgccgucccggcgagcgugccucuucaggcuuggcaccccgccaaggaaaugaucucuaaacaggccggcgacuccagcucucaccggcaacaggggauuacagaugagaagaccuucaaagcucugaaggaggaaggaaaucagugcguuaacgacaaaaauuauaaggaugcccucuccaaguacagcgagugccugaaaaucaacaauaaggaaugugcgauuuauaccaacagagcucugugcuaccuuaaacucugucaguucgaggaagccaagcaagacugcgaucaggcccugcagcuggcugacggcaaugugaaagccuuuuaucgccgggcucucgcccauaaggggcugaagaacuaccagaaaucccuuaucgaucugaauaaggucauucuccuggacccuucuaucaucgaggcgaaaauggagcuggaagaggugacaagacuucucaaccugaaggacaaaaccgcccccuucaauaaggaaaaagagcggcgcaagauugaaauccaagagguuaacgagggcaaggaagaaccuggaagacccgcuggcgaagugagcauggggugucuggccuccgagaaaggaggcaagucuagccgguccccggaagauccugagaaacuccccauugcuaagcccaacaaugccuaugaguuugggcagaucauuaacgcccugagcacaagaaaagacaaggaggcuugcgcgcaccuucuggccaucacggcuccuaaggaucucccgauguuccugucuaauaaacuggagggagacaccuuucuucuccugauucagucccugaagaacaaucucaucgaaaaagaucccagccuggucuaccagcaucuucuguaccucucuaaggccgagcgcuucaaaaugaugcugacacugaucuccaagggccaaaaggagcuuauugaacagcucuuugaggaccugagcgauaccccuaacaaucacuucacacuggaagacauccaggcccucaaacggcaauaugagcuguga

SEQ ID NO: 76127 - RNA, 1314 nt, Artificial Sequence
  derived and/or modified sequence opt5 from SPAG4__Homo_sapiens__NP_003107
augagacggagcucccgccccggcucugccagcuccucuagaaagcacaccccuaacuucuuuagcgaaaauuccucuaugagcaucacauccgaggacagcaaagggcugcggucugcugagccgggacccggcgaaccugaggggcgcagagcccggggacccuccugcggcgaaccugcgcucagcgcuggggugcccggaggcacgaccugggccgggucuucccagcaaaagccugccccgcgcagccauaacuggcagacagcuuguggcgccgcuaccgucagaggaggcgccucugagcccacaggguccccuguugugagcgaggaaccccuggaucuucugccuacccucgaccugcggcaggagaugcccccgccucgcguguucaaauccuuucuuucucuccuguuccagggacugagcguccugcucucccuggcgggcgaugugcuuguuagcauguacagagaagugugcucuauucgguuucuguucacagccgucucccuccugagccuuuuucugucugcuuucuggcucgggcugcuguaucucgugagcccccuggagaaugagccuaaggaaaugcuuacccuguccgaguaccacgaacgcguuagaucucaaggacagcagcuccagcaacugcaggccgagcuugacaaacugcauaaggaagugagcacgguccgggcugccaacuccgagcgcguggcgaagcucguguuucagagacugaaugaggauuucguccggaaacccgacuaugcccugagcucuguuggcgcuuccaucgaucuccagaagaccagccacgacuacgccgauagaaacacagcuuauuuuuggaaucgcuucucuuuuuggaacuacgcccggcccccuaccgugauucuggaaccgcauguguuccccggcaauuguugggccuucgagggggaccaaggacaggucgugauccagcuuccuggcagaguucaacuguccgauauuacacuccagcaucccccucccagcguggaacacaccgggggagcuaacuccgcgccgcgcgacuuugccgucuucggccuucagguguaugaugagacggaaguuucucuggggaaauuuacauucgacguggaaaagagcgagauccagaccuuucaucugcaaaaugacccucccgcugccuucccuaaagucaagauccagauucucuccaacuggggacacccccgguuuacaugccuguacagagugcgcgcccacggcguccggaccucugagggcgcugaggggagcgcccagggaccucacuga

SEQ ID NO: 76128 - RNA, 3582 nt, Artificial Sequence
  derived and/or modified sequence opt5 from SPAG5__Homo_sapiens__NP_006452
auguggagagugaagaaacugagccucucccugucucccagcccucagaccggcaagccguccaugcggacaccccuucgcgagcugacgcuccaaccuggggcccugaccaacucuggaaaaagaagccccgcuugcuccucucuuacaccuagccuguguaagcucggccugcaggaaggguccaauaacagcucucccgucgacuucguuaauaacaaacggaccgaucuguccagcgagcacuuuucucauuccagcaaguggcucgaaacaugccagcacgagucugacgaacagccucuggauccgaucccccaaauuuccagcaccccuaagacauccgaggaggccguggacccccuuggaaauuacauggugaaaaccaucguccuggugccuucuccccucggccagcagcaggauaugauuuucgaagcgcgccuggacacgauggcugagaccaacagcaucucccuuaaugggccgcugagaacagaugaccucguucgggaagagguggccccuuguaugggagaucgcuuuagcgaggucgccgcugugucugaaaagcccauuuuccaagaguccccuagccaucugcuggaagagucuccucccaaccccugcagcgaacagcuccacuguuccaaagagucucugagcuccagaaccgaggccguucgggaagaccuugugccgagcgagucuaaugcuuuucugcccuccagcguccucuggcugucuccuuccacagcccuugcggccgauuuccgcgugaaccauguggaccccgaagaggaaaucgucgagcacggcgcuauggaggaaagagagaugcgguuuccuacccaccccaaggaaagcgagacggaagaucaggcccugguuuccucuguggaggacauccucagcacaugccugaccccgaaucugguggagauggaaucccaggaggcuccuggccccgccgucgaagacguggggcgcauucucggaucugauacagagagcuggauguccccucuggcguggcuugagaaaggcguuaacaccagcgugaugcuggaaaaucucagacaaucucugucccuucccagcaugcugcgggacgccgcuaucgggaccacaccuuucucuacguguuccgucggaaccugguuuacacccagcgccccgcaggagaagucuaccaacacaagccagaccggccucguggggacgaagcauuccacaagcgaaaccgagcaacugcugugcggacgcccucccgaucucaccgcucugucuagacacgaccuugaagauaaucugcucuccagccugguuauucuggaggugcuuucccggcagcucagagacuggaaaucucagcuggccgucccccauccugagacacaggauagcuccacccaaacagacacgucucacagcggcaucaccaacaagcugcagcaccucaaagaaucccaugagaugggccaggcccugcagcaagcucgcaacgugaugcagucuuggguccuuauuagcaaggaacugaucucccuccugcaccugagccuucuccaucuggaggaagauaaaacaaccgugucucaggagucccggagagcggagacacugguuuguugcuguuucgaccuccugaagaaacuucgcgccaagcugcagagccucaaggcugaacgggaggaagccagacaccgcgaggaaauggcccugcgggggaaagaugcugccgagauugugcuggaggcguuuugcgcucaugccucucaaagaaucucccagcuugaacaggaccucgccagcaugcgcgaguuccggggacugcugaaggacgcucagacccaacucgucggccugcacgccaaacaggaagaacuugugcagcaaacgguuucucugaccuccacacuccagcaggauuggagaagcaugcagcuggacuauaccacauggaccgcucugcuuucccgcagccggcaacucacggagaagcugacagugaaaucucagcaggcccugcaggaaagagaugucgcgaucgaggaaaagcaagaggugagccgggugcucgaacagguuuccgcccagcuggaggagugcaaggggcagaccgaacaacuugagcuggaaaauucucgccucgcuacagaccugagagcccagcugcagauucuugcuaacauggauagccaacugaaagagcuccagucccagcacacccauugugcccaggaccuggcgaugaaggaugaacuccugugccaacuuacccagucuaaugaggagcaggccgcucaguggcaaaaagaagagauggcccugaagcacaugcaggcugaacuccagcagcaacaggccguccuggccaaagaggugcgggaccugaaggaaacacuugaguuugcugaucaggagaaccagguggcgcaucuggaacucggacaagucgagugucagcugaagacgacccucgaagugcugagagagcgcagccuucagugcgagaaucugaaagacacaguugaaaaccucaccgccaagcuggcuuccacaaucgccgauaaucaagagcaggaccuggaaaagacccggcaguacucucagaaacuuggccugcucacggagcaacugcagagccucacacuguuccuucagaccaaacugaaggaaaagaccgagcaggagacacugcuccuguccaccgccuguccgcccacacaagaacacccucuucccaacgauagaacguuccuggggagcauucucaccgcuguggccgacgaggaaccugagucuacacccgucccucugcucggauccgacaaaagcgcguuuacccgcguggcuucuaugguuucccugcagcccgccgaaacaccgggcauggaggagagccuugccgaaauguccaucaugaccacggagcugcagucucugugcagccuccugcaggaauccaaggaggaagcuauuagaacccuucaacggaaaaucugugagcugcaggcccgccuccaggcgcaagaggaacagcaccaggaggugcagaaggcuaaagaagccgauaucgagaagcugaaucaagcccucugccugagauauaaaaacgagaaggaacuucaggaggucauucagcagcaaaaugaaaagauccuggagcagauugacaaaagcggcgaacugaucucucuccgggaggaggugacacaucugacccgcucccuuagacgggcugaaacagagaccaagguucugcaggaagcccucgcugggcagcuggauagcaacugucaaccuauggccacaaauuggauucaggagaaaguguggcucucucaggaagucgacaagcugcgcgugauguuccuugagaugaaaaacgagaaggaaaagcugaugaucaaauuucagagccacagaaauauccuggaggaaaaccuccggcgcuccgauaaggagcuggaaaaacuugacgauauugugcaacauaucuacaagacccugcucucuauucccgaggucguuagaggaugcaaagagcugcagggccugcucgaguuccuuagcuga

SEQ ID NO: 76129 - RNA, 1455 nt, Artificial Sequence
  derived and/or modified sequence opt5 from SPAG6__Homo_sapiens__NP_001240783
augcacagccugaccauggaccucuggauccccaacggccaggccggggugaugucccugcuuagaacacugcuccuggaugucguuccuacgauucaacagaccgcugcccuugcgcugggacggcucgcuaauuacaacgacgaucuggccgaggccguggugaagugcgacauccugccgcagcucgucuauucucuggcugaacagaaucgcuucuacaaaaaggccgcugccuuugugcuuagagcgguuggcaaacauagcccccaacuggcccaggcuauuguggauuguggggcccucgacacacuggucaucugccuugaggauuucgacccuggagugaaggaagcugccgcgugggcccugcgguauauugcucgccacaacgccgagcucucccaggcuguuguggaugccggcgccgucccccugcuggugcucuguauccaggaaccugagaucgcucugaaaagaauugcggccucugcucuuagcgacaucgccaagcauucccccgagcuggcccaaaccguggucgaugcuggggccguugcgcaccucgcucagaugauucugaauccugacgccaaacuuaagcaucagauccugucugcccucagccagguguccaagcacagcguggaucuggcugaaauggucguggaggccgaaauuuuuccgguugugcugacaugccucaaagacaaggacgaguacgucaaaaagaacgcuucuacccugauccgggagauugccaagcacacacccgaacuuucccaacuggugguuaaugcgggaggcguggccgcugucaucgauuguaucggcagcugcaaagggaacacccgccucccuggaauuaugaugcugggcuauguggccgcucauucugagaaucuugccauggcggucaucauuuccaagggggugccccagcugagcguuugucucucugaggaaccugaagaccacaucaaagccgcugccgcuugggcccugggacagauuggcagacauacgcccgagcacgcccgggcuguggcggucaccaacacacugccggugcuccugucccuuuacaugagcaccgaguccucugaagaucugcaaguuaagagcaaaaaggccaucaaaaauauccuccagaagugcacauaucugccugcucuggagcccuuccuuuacgacgccccucccaacauucucaagcacguggucgggcaguuuuccaaagugcugccccaugauagcaaggcccgcagacuguucgugaccucuggaggccucaaaaagguucaggaaaucaaagcugagccuggcucccugcuucaagaauacauuaauagcaucaacucuuguuauccggaggagauuguccgguacuauagccccggguacuccgacacgcugcuccagcgcguggauucuuaucagccucugaauaacuga

SEQ ID NO: 76130 - RNA, 684 nt, Artificial Sequence
  derived and/or modified sequence opt5 from SPAG7__Homo_sapiens__NP_004881
auggccgaccugcucggcagcauccuguccucuauggagaagcccccuagccuuggggaucaggaaaccagacggaaagcucgcgagcaagccgcgagacugaagaaacuccaggaacaggagaagcagcaaaaaguggaguuccggaagcgcauggaaaaggaggucuccgacuuuauucaggauucuggacagaucaaaaagaaauuccagccgaugaacaagauugaaagaagcauccugcacgacguuguggagguggcuggccuuacauccuuuucuuucggggaagaugacgauugccgguacgucaugauuuuuaaaaaggaguucgcccccagcgacgaggaacuggauuccuaucgcagaggagaggaaugggacccucaaaaggccgaggaaaaacggaagcucaaagagcuggcucagcgccaggaggaagaggccgcucagcaaggccccgugguugugagcccugccucugauuacaaggacaaauauucccaucugaucgggaagggagcggccaaagaugcugcccacaugcuccaggcuaauaagacguacggcuguguccccguggccaacaagagagacacccggagcaucgaagaggcgaugaaugaaauucgcgccaaaaagagacugcggcagucuggcgaggagcuuccuccgacauccuga

SEQ ID NO: 76131 - RNA, 1458 nt, Artificial Sequence
  derived and/or modified sequence opt5 from SPAG8__Homo_sapiens__NP_001034681
auggagaccaacgaaagcacagagggcuccagaucucggagccgcucccuggacauccagcccucuagcgaagggcugggaccuacguccgagccguuccccucuagcgaugacuccccuagaagcgcccuggccgccgcgaccgcugccgccgcugccgcugccucugcggccgcugccacagcugccuuuaccacagcgaaggccgcugcccuuuccaccaaaacacccgcuccuugcagcgaguucauggagcccucuuccgauccuagccugcucggcgagccgugugccgggcccggauuuacccacaauauugcccauggcucucugggguucgaaccuguguacgucuccugcaucgcucaagacacguguaccacaaccgaucacagcuccaaccccggaccuguucccggcucuagcuccggcccggugcuugggucuagcuccggagcgggccaugggagcggaucuggcagcgggccuggaugcggcuccgugcccggcucugggagcggaccuggccccggguccggacccggcagcgggccuggacacggcucuggcucccauccggggcccgccagcggaccuggccccgacacagggccugauucugagcugucccccuguauuccgccuggauuucggaaucucgucgcugaccgcgugcccaacuauaccagcuggucccagcacugcccuugggaaccccagaagcagccucccugggaguuccugcaaguucuggagccgggcgccagagggcucuggaaaccucccgauaucaagggcaaacugaugguguguuacgaaacgcuuccccggggacagugccugcucuauaauugggaggaagaacgcgccacaaaccaccuggaccaggucccuucuaugcaggauggcagcgaauccuuuuucuuuagacaugggcaccggggacuucugaccaugcaacucaagucuccgaugcccagcuccacaacccagaaggacagcuaccagccucccggcaauguguauuggccucugcgcgggaaaagagaggcuaugcuggagaugcuccugcagcaucaaauuuguaaggaaguucaggccgagcaggaacccacccggaaacuuuucgagguggaaucugucacacaccacgauuaccgcauggagcuggcgcaagcuggaacgccugcccccaccaagccgcaugacuauagacaggagcagccugaaacauuuuggauccagcgggcuccccaacucccuggcguguccaacauccgcacccuggacacacccuuccggaaaaauugcagcuuuucuaccccggugccucuuucccuggggaagcuccugcccuacgagccugaaaacuaccccuaucagcugggcgagauuagcucucuccccuguccuggaggcagacucgggggaggcgggggaagaaugacgccguucuga

SEQ ID NO: 76132 - RNA, 3936 nt, Artificial Sequence
  derived and/or modified sequence opt5 from SPAG9__Homo_sapiens__NP_001123999
auggagcuggaagacggcguggucuaccaggaggaacccgggggaagcggcgccguuauguccgagagagugucugggcucgcuggaagcaucuaucgggaguucgagcgccugauuggcagauacgaugaggaaguggucaaggagcuuaugccucuggugguugccgugcucgaaaaccuggacuccgucuuugcgcaggaucaggagcaccagguggagcuugaacugcuccgggacgauaaugagcagcugaucacccaauaugaacgcgagaaagcucugagaaagcaugccgaagagaaauucauugaguuugaagacucucaggagcaggaaaagaaagaucuccagacacggguugagagccuggaaucccaaacgcgccagcuugagcugaaggccaagaacuacgcugaccagaucucuagacucgaggaacgggaggccgaacugaaaaaggaguauaaugcccuucaccagcgccauaccgaaaugauucacaacuacauggagcaucuggagagaacaaaacuccaccaacugagcggguccgaucagcuggaaagcaccgcucacucucggauccgcaaggagagaccgaucucccucggaauuuucccccugccugcgggcgacggccuucugacacccgaugcccagaaagggggagaaaccccuggcagcgagcaauggaaguuucaggagcucucucagccccggucccauacaagccugaaggacgaacuuucugaugugucccaagggggaagcaaagcuaccacgccugccuccaccgcuaauucugacgucgccacaaucccgaccgacacaccccugaaggaggaaaacgagggcuucgugaaagugaccgaugcgccuaauaagagcgaaauuuccaaacacaucgagguccagguugcccaggagacgcgcaacgugagcacagggucugcugaaaaugaggaaaaguccgaggugcaggccauuaucgaaagcacccccgagcucgacauggauaaagaccugucuggauauaagggcagcuccacaccuaccaagggcauugagaacaaggcuuuugauagaaauaccgaaucucuguucgaggaacucagcuccgccgggagcggacugaucggcgacgucgaugagggggccgaccuucugggaaugggccgggaaguggagaaccucauccuggagaauacacagcuucuggaaacgaagaacgcucucaauauuguuaaaaacgaucugaucgcgaagguggacgagcugaccugcgaaaaagauguccuccaaggggagcuggaggccgugaagcaggcuaaacuuaaacuggaagagaagaacagagaacucgaggaggagcugcgcaaagcccgggccgaggcugaagacgccagacagaaggcgaaagacgaugacgauucugacauucccacagcucagcgcaagcgguuuaccagaguugagauggcccgcgugcugauggaacggaaucaauacaaggagagacuuauggaacuccaggaggccguccgcuggacagagaugauccgggcuuccagagaaaacccggccaugcaggagaaaaagcgcagcucuauuuggcaguucgugccuacccgguuuuccagacuguucagcuccucuagcaauacgaccaaaaagcccgaaccucccgucaaccugaaauacaaugcucccacaucccaugugaccccuucuguuaagaagcggagcuccacacucagccaacugccgggagauaaaucuaaggccuuugacuuccuuuccgaggaaaccgaggcgagccuggccucucgcagagagcagaaacgggaacaguauagacaagugaaggcucacguccagaaagaggauggccgcgugcaggccuucggcuggucccucccccagaaguacaaacaaguuacaaacgggcagggagaaaauaagaugaagaaccugccugugcccgucuaucugcggccucuugacgagaaagauacgagcaugaagcucuggugugcugugggcgugaaucugucugggggaaaaaccagagacggcgggagcguugucggcgccuccguguuuuacaaggauguggcgggacuggacacagagggcagcaaacagcgcucugccucccagagcucccucgauaagcuggaccaagaacuuaaggagcagcagaaagaacugaagaaccaggaggaacucucuagccuggucuggaucugcaccuccacacacucugcuaccaaagugcugaucauugacgccguucaacccgggaauauccuugauagcuucacgguguguaacucccauguccucugcauugcuucugugccgggagccagagagaccgacuauccugccggcgaggaucugagcgaauccgggcagguugacaaggcuagccuguguggaucuaugacauccaauagcucugcggagaccgauucccuccugggcgggaucacaguggucggcugcagcgccgaaggagugaccggcgcugccacgucucccuccacaaacggggccagcccuguuauggacaaacccccugagauggaagcugaaaauuccgagguggaugaaaacguccccaccgccgaggaagcgacagaggcuaccgaaggaaacgccggcagcgccgaggacaccguggauauuucucagacagggguguacacggagcacgucuuuaccgacccgcuuggaguucaaaucccugaagaucugagccccguguaucaguccucuaaugacagcgaugcuuacaaggaccagaucuccgugcuccccaacgagcaggaccugguccgggaagaggcccaaaagaugucuagccugcuuccuacaauguggcucggcgcgcagaaugggugucuguacgugcauuccucuguugcucaguggcgcaaaugccugcacagcauuaagcucaaagauuccauccugagcauugugcaugucaagggcaucgugcuuguugcccuggccgacggaacccucgcuauuuuccacagaggcguggaugggcagugggaccugucuaacuaucaucugcuugaucugggacggccgcaccacuccauccgcuguaugacagucgugcaugacaaaguuuggugcggcuacagaaauaagauuuaugugguccaacccaaggccaugaaaaucgaaaagagcuuugaugcucacccucggaaagaaucucaggugcgccagcucgccugggugggggacggagucuggguuuccaucagacuggauagcacccuccggcuguaccacgcgcauacguaucagcaccuucaagacguggauauugagcccuacguguccaagaugcugggcacagggaaacucggcuucucuuuuguccgcaucaccgcccugauggugagcuguaacagacuguggguuggaaccggcaauggggugauuaucuccauuccucuuacagaaaccaacaagacaagcggaguccccggcaaucggccugggucugugaucagaguuuauggagacgagaacuccgacaaagugacgcccggcaccuucaucccguacugcagcauggcucaugcccagcugugcuuucacggccaucgcgaugcugucaaguucuuuguggccgucccuggacaggugauuucuccccagagcuccucuagcgggacagaccucaccggcgauaaggccgggccuuccgcucaagaacccggaucucagacaccgcugaaaagcaugcucguuaucuccggcggggagggauacauugacuuccggaugggcgaugagggcggggaaagcgagcugcuuggagaagaccugccucucgagcccucugugaccaaggcggaaagaucccaccugaucgucuggcaagugauguauggcaaugaguga

SEQ ID NO: 76133 - RNA, 1536 nt, Artificial Sequence
  derived and/or modified sequence opt5 from SPAM1__Homo_sapiens__XP_011514825
augggcgugcugaaguucaaacacaucuuuuuccgcagcuuugucaaguccucugggguuagccagauuguguucaccuuucuccugauccccugcugucuuacacugaacuuccgggccccuccggugauucccaaugucccuuuucucugggcuuggaacgcccccuccgaguucugccugggaaaauuugacgaaccucuugauaugucucuguucagcuuuaucggcucccccagaauuaaugcgacggggcaaggagugaccaucuucuacguugacagacucggcuauuacccuuauaucgauucuauuacaggggugaccgucaacggaggcaucccgcagaagauuagccugcaggaccaucuggauaaagcuaagaaggacaucacauuuuacaugcccguggauaaucucggcauggccguuauugacugggaggaauggcggccuaccugggcccgcaacuggaaacccaaggauguguauaaaaauagauccaucgagcugguccagcaacagaacgugcagcuuagccugacagaagcuaccgagaaggccaaacaggaguucgaaaaggcugggaaggacuuccucguggagacgauuaaacugggaaaacuucugcggccuaaucaccucuggggcuacuaucuguuucccgauuguuacaaccaucacuacaagaagccgggguauaauggaucuugcuucaacgucgaaaucaaacgcaaugacgaucuguccuggcucuggaacgagagcaccgcccuguacccuucuaucuaucuuaauacacaacagucccccguugcggccacccuguacgugagaaaccgggugcgcgaggcuauuagagucagcaagaucccugacgccaaaucuccccuccccguguuugcuuauacacggauuguuuucaccgaccaggugcugaaguuucuuucccaggaugaacuggucuacacguucggcgagacaguggcccucggggcgagcggaaucguuauuuggggcacccuguccaucaugcgcucuaugaaaagcugucugcuccuggacaacuauauggaaacaauccuuaauccuuacauuaucaacgugacccuggccgcuaagaugugcucccaaguccucugucaggagcagggcgugugcauuagaaagaauuggaacagcucugauuaccugcaucuuaauccggacaacuuugccauccaacuggaaaaagggggaaaguucaccguccggggcaaacccacacucgaggaucuggagcaguuuuccgaaaaguucuauuguagcugcuacucuacgcugagcuguaaggagaaagcugacgugaaggauaccgacgccguugaugugugcauugccgacggggucugcaucgaugcuuuucucaaaccucccauggaaacagaggaaccucagaucuucuauaaugcgucccccucuacccugagcgccacaauguuuauuuggcgccuugaggugugggaccagggaaucuccagaauuggcuucuucuga

SEQ ID NO: 76134 - RNA, 294 nt, Artificial Sequence
  derived and/or modified sequence opt5 from SPANXA2__Homo_sapiens__NP_663695
auggacaagcagagcuccgccggcggggugaaaagaucuguccccugcgauagcaacgaggcuaaugaaaugaugccugagaccccgacaggagacuccgauccccaaccugcccccaagaaaaugaagacgucugaaagcuccaccauccugguugugcgguaccgcagaaacuucaaacggacaucuccugaggaacuccugaaugaccacgcgcgcgagaacagaauuaauccccuucagauggaggaagaggaauuuauggagaucaugguggagauuccugcuaaguga

SEQ ID NO: 76135 - RNA, 312 nt, Artificial Sequence
  derived and/or modified sequence opt5 from SPANXB1__Homo_sapiens__NP_115850
augggccagcaaagcuccgugagacggcugaagcgcucuguccccugcgagagcaacgaagccaaugaggcuaacgaagccaauaaaaccaugccugagacaccgacgggggacuccgauccccagccugcgcccaagaaaaugaagaccucugaaagcuccacaauccucguugugagauaccggcgcaacgugaaaagaaccucuccugaggagcugcuuaaugaccacgcucgggaaaaccgcauuaaucccgaucagauggaggaagaggaguucaucgaaauuacaaccgagagaccuaagaaguga

SEQ ID NO: 76136 - RNA, 294 nt, Artificial Sequence
  derived and/or modified sequence opt5 from SPANXD__Homo_sapiens__NP_115793
auggacaagcagagcuccgccggcggggugaaaagaucuguccccugcgauagcaacgaggcuaaugaaaugaugccugagaccuccucuggauacagcgacccgcaacccgccccuaagaaacugaagacauccgaaucuagcacgauccucguugugcgguaucgcagaaacuucaaacggaccucccccgaggaacuggugaaugaucacgcgcgcaagaacagaauuaauccucuucagauggaggaggaagaguuuauggaaaucauggucgagauucccgcuaaguga

SEQ ID NO: 76137 - RNA, 300 nt, Artificial Sequence
  derived and/or modified sequence opt5 from SPANXN4__Homo_sapiens__NP_001009613
auggaggaacccaccagcuccacaaacgagaauaagaugaaaucuccuugcgaaagcaacaagagaaaaguggacaagaaaaagaagaaucugcaccgggccuccgcuccggagcagucucucaaagaaacggagaaggccaaauaccccacccuggucuucuauugucgcaagaacaaaaagagaaauagcaaccaacuugagaauaaccagccuacagaauccucuaccgaucccaucaaggagaaaggcgaccuggauauuagcgcgggguccccucaggacggaggccagaauuga

SEQ ID NO: 76138 - RNA, 912 nt, Artificial Sequence
  derived and/or modified sequence opt5 from SPARC__Homo_sapiens__NP_003109
augagagccuggaucuucuuucugcucugccuggcuggccgggcccuugcggcuccccagcaagaggcccugccugacgaaaccgagguggucgaagagacaguugccgaagugacggaggugagcgucggggcuaacccggugcagguugaggugggagaauuugaugacggcgccgaggaaaccgaggaggaagucguggcugagaaucccugucagaaccaccauugcaagcacgggaaaguuugugaacucgaugagaauaacacaccuaugugcgugugucaggaccccaccuccugcccugcccccauuggagaauuugagaaggucuguucuaaugauaacaaaacauucgacagcuccugccauuucuucgcgaccaaguguacacuggagggcaccaaaaaggggcacaaacuucaucuggauuacaucggaccuugcaaauauauuccgcccugucucgacucugaacugacggaguuuccucugcgcaugagagauuggcucaagaaugugcuggugacccuuuacgaacgggacgaggauaacaaucugcucacagaaaaacaaaagcugcgcgucaaaaagauccacgagaacgagaagagacuugaagccggcgaccaccccguugagcugcucgcucgggauuucgaaaagaauuauaacauguacauuuuuccugugcauuggcaguucggccagcuggaccagcaccccaucgacggguaucugagccauaccgagcucgccccgcugcgcgcuccucuuauccccauggaacacugcacaaccagauuuuucgagacgugcgaucuggacaaugauaaguacauugcccucgacgagugggcgggauguuuuggcaucaaacaaaaggauauugacaaagaucuggugaucuga

SEQ ID NO: 76139 - RNA, 1995 nt, Artificial Sequence
  derived and/or modified sequence opt5 from SPARCL1__Homo_sapiens__NP_001121782
augaagaccggccuguucuuucucugccugcuugggacagccgccgccauccccacgaacgcgagacugcucagcgaccacuccaaaccuaccgcugagacaguggccccggauaauaccgccauucccucucugcgggcugaagccgaggaaaacgagaaggaaacagcugucagcaccgaggacgauucccaucacaaagccgagaagucuagcguucuuaaauccaaggaagagucucaugaacagagcgcggagcaaggaaaguccagcucucaggagcugggccucaaagaccaggaagauuccgacgggcaccugagcgugaaucuggaguacgccccuacagaaggaacccucgauaucaaggaggacaugucugaaccccaggagaaaaagcuguccgagaacacggauuuccuugcuccuggcgugagcucuuuuaccgacuccaaucaacaggaaagcauuacaaaacgcgaggaaaaccaggagcagcccagaaauuauucccaucaccaacugaaccggucuagcaagcacucccaggggcuccgcgaucagggaaaucaggaacaagacccuaacaucagcaauggcgaggaggaagaggaaaaggagccgggcgaagucgggacccauaacgauaaucaggagagaaaaacagagcugccccgggaacacgccaacucuaagcaggaggaagacaauacccaauccgacgauauucuugaggagagcgaccagccuacacaggugucuaaaaugcaggaagaugaguucgaccaaggaaaccaggaacaggaggauaacagcaaugcugaaauggaggaggaaaacgccuccaauguuaacaagcauauccaggagacagaauggcaaucucaggagggcaaaaccgggcuggaagcgaucagcaaucacaaggagacagaggagaaaaccguguccgaagcccuccugauggaacccaccgacgauggaaacacaacgccucgcaaucacggcgucgacgaugacggggaugacgacggagaugacggcggcaccgaugggcccagacauagcgcuucugacgauuacuuuauuccgucccaggccuuccuggaggcugaacgggcccagagcaucgccuaucaccucaagauugaggagcaacgcgaaaaggugcaugagaacgaaaauaucggaacaaccgagccuggcgagcaccaggaagcuaaaaaggcggagaacucuuccaaugaagaggaaacaagcuccgaggggaacaugagaguucaugccguggacucuuguaugagcuuucagugcaaacggggacacauuuguaaggcugaucagcaaggcaaaccccacugcgucugucaggacccugugaccugcccucccacgaagccccuggaucaggugugugggacagacaaucaaaccuacgccuccucuugccaucuuuucgccaccaagugucgccuggagggaacgaaaaagggccaccagcuccagcuggauuauuuuggcgcuugcaaaagcaucccgaccuguacagacuucgaagucauucaguuuccccuuagaaugcgggauuggcugaagaacauccucaugcaacuguacgaggccaauuccgaacaugcgggguaucugaacgagaaacagcgcaacaagguuaagaaaaucuaccucgacgaaaagagacugcuugcuggagaccacccuauugaucugcuccugcgggacuucaaaaagaauuaccacauguauguguaccccgugcauuggcaguuuagcgagcuugaucagcacccuauggacagaguccugacgcauucugagcucgcuccccugcgcgccucccuggugccgauggaacacugcaucacccgguucuucgaggaaugcgauccuaacaaagacaagcauauuacacucaaggaguggggccacuguuuugggaucaaagaagaggauauugacgagaaucugcuuuucuga

SEQ ID NO: 76140 - RNA, 1851 nt, Artificial Sequence
  derived and/or modified sequence opt5 from SPAST__Homo_sapiens__NP_055761
augaacagccccggcgggagaggaaagaaaaagggcuccgggggagccucuaauccugugccgccccggccucccccucccugccuggcuccugccccgcccgcggcuggcccugcucccccucccgagagcccgcacaaacgcaaccucuacuauuucuccuacccucuguuugucggguucgcccuucugagacucguugcuuuucaucugggacuucuguucguguggcucugucagcgguuuucucgcgcccugauggcugccaagagaagcuccggcgcggcccccgcuccugccucugcuagcgcccccgcgcccgugccuggcggggaagccgagcggguccgcguguuccacaaacaagccuuugaauauaucuccauugcccugagaaucgacgaggaugaaaaggcuggacagaaggagcaggccguugagugguacaaaaagggcauugaggaacucgaaaaagggaucgccgugauugucaccggacagggcgagcaaugcgagcgggcucgcagacugcaggcgaagaugaugacaaaucuugugauggccaaagaccggcugcagcuccuggaaaagaugcagccgguucuucccuucagcaagucucaaacggauguguauaacgacuccaccaaucuggcuugucgcaacgggcaucuccagagcgagucuggagccgucccuaaaagaaaggauccccugacacacaccuccaauagccugccucggucuaaaacagugaugaagaccggcuccgccggccucagcgggcaucaccgcgcucccuccuacucuggacugagcaugguguccggcgucaaacaggggagcggaccggccccuacaacccacaagggcacgcccaaaaccaacagaacaaauaagccuucuacccccacaaccgcgacgcggaagaaaaaggaccuuaaaaacuuuagaaauguugauuccaaccuggcuaaucucaucaugaacgaaaucguggacaaugggacagccgugaaguucgaugacauugccggacaggaucuggcuaaacaagcccuucaggagaucgucauucugccuagccuccgccccgaacuguuuaccggccugcgggcuccggccagaggccuccugcuuuucgggccucccggaaacggcaagacaaugcuggcgaaggccguggcugccgagucuaacgcuaccuuuuucaauaucagcgccgcgucccucaccucuaaauauguuggggagggagaaaagcuggugcgcgcccuuuucgcugucgcccgggagcugcagcccagcauuaucuuuauugacgaaguggauucccuccugugcgagagacgcgaaggcgagcaugacgcuagccggagacugaaaacagaguuccucaucgaauuugacgggguucaaucugccggcgaugaccgcgugcuggucaugggagccacgaaccggccucaggagcuugaugaagcugugcugagacgcuucaucaagcgggucuacgugucccucccgaaugaggaaaccagacugcugcuucucaaaaaccugcuguguaagcagggcagcccccucacacagaaggagcuggcgcaacuugcccggaugaccgacggguacucuggauccgaucugacagcucucgccaaagacgccgcucugggcccuauucgcgagcugaagcccgaacagguuaaaaauaugagcgccuccgagaugagaaacauccggcuuucugauuuuaccgaaagccucaagaaaauuaagagauccgugucuccucagacgcuggaggcguauauccgcuggaauaaggacuucggggauacaaccgucuga

SEQ ID NO: 76141 - RNA, 3834 nt, Artificial Sequence
  derived and/or modified sequence opt5 from SPATA13__Homo_sapiens__NP_001159743
augacccaggccgcugugagacccugggccccuugccuggagaacaugacaacggcgccgaauggccucgggcccggaccugcugcccccugugccggcagcgaccugaaggaugcuaaaauggucaccucccuugccugcgggaacggaguuuguggcugcucuccugggggagacacagauacccaagaagcuaagcugagccccgccaaacucgugcggcuguucuccacaucucgcaagagaaccggcgcgcacccugagcggccgcauagcauggugcuugucggcaauuccucuacauggaacacccuggccagcuuucgcaaaaugggguccuucaagaagcucaaaagcucugugcugaagggaauccaguccagagaaggcagcaaugcuuguucuaaaggggaggccuccgaacacggacugggcaagagcauucccaacggggcuguuccuggagcccaggcgucucggggcagcccccucgccccuggccccgcuugcggggcccugcgcccggcugaguggggaacgcuugacggcagcgaucuggaggacaccgaugacgccuuucagagauccacacaucggucucgcagccucagacgggccuacgggcugggacgcaucugucuucuggaugcuccucaaaaucacgcgacccccacaauugccaccggccaggugccugcugucugcgaaauccucgugagagaccccgagaacaauuccaugggguaucggcgcagcaaaucuacggauaaccuggccuuccugaagaaguccagcuuuaaaagaaagucuacaagcaaucucgccgaccugcggaccgcucaugaugccagaguuccccagcgcacacuuuccucuagcuccaccgacagccagaaacugggaucuggccggaccaagagauggcgcuccccuauucgggcgaaagacuucgauagaguguuuaagcucgucagcaacgugacagaagcugccuggcgccgggagucuccgagauccggcgcccccagcccuggggaggcuucccugcgccuucaagcccacucucggcugcacgacgauuacagcagacgcgugucccggucuacggaacaggacagcagacggggaggcgcugucaugcaugggaccacagccaccuguacaguugcgcccggauucggcuccgccaccagcaaagggccucaccucgaugcugacacggccguguuuccccuggagacaaagucuuccugggcuguggaaagcgauucuuccugcaccuguagcucucugccgagcccuaucguccaggacgugcucuccaaggauagcugcgaccccaaugccggcucucagcugaccuucgauccugagcaacccccuacaccccuucgcccgaccacaccuaaaccccagagcccccaguccccucaauccccgggagcgggcucugccagcugccauuccaaccacucugcucugagcgccaauuccgaagagucugaggggagagcugaagaacccgcccagcgggaaccuggacccguuagccuccaggacccucuggaggccacgcacggcgacgaaggguccaaggaucuucuggugaacaucggagucgcugcgggccccgaggagaaagaaaaggaggaagugguuccugacgggcccuggagacgcuccucuucccaggaugaggaacggaccgaggcccaaagaacaccgaaacgcagauggggcagcggacggcgcccuagaccccggccuuuuucugacuauggccagcucgcuucccgcagccugucuauucccgaggauuccguggccgccgacccgcagaaggaagauagagucgacgaggauccucaggcuagcaugaccuccgccagccccgaagaccaaaacgcgccuguggggugucccaagggagcucggcgcagacggcccaucucugucauuggcggggugagccuguacggaacaaaucagaccgaggagcucgauaaccugcuuacgcagccugccucccgcccgcccaugccugcccaucagguucccccuuauaaagcugugucugccagauuccggcccuuuaccuucagccaauccacaccuaucggccuggacagagucgggcgccggagacagaugcgcgcgucuaaugugagcuccgauggcggaaccgaaccgucugcucucguugacgacaacggcagcgaggaagauuucuccuacgaggaccugugccaggccagcccccgguaucugcagccugggggagaacaacuugccauuaaugagcucaucucugauggcaacguggucugugcugaggcccugugggaccacgugacaauggaugaccaggaacugggguuuaaggcuggagaugugauucagguucucgaggccuccaauaaagacuggugguggggcagaagcgaagauaaggaggcgugguuccccgccucuuuuguccgccugcgggugaaccaagaggagcuuuccgagaauagcuccucuaccccuagcgaggaacaggacgaagaggcuucccagagcagacaucgccacugcgaaaacaaacagcaaaugcggacgaaugugaucagagagaucauggauacagagcgggucuacauuaagcaucugcgcgacaucugugaaggguacauuagacagugccggaagcacaccggcauguucacaguggcccagcucgcuaccaucuuuggaaacauugaggauaucuauaaauuccagcgcaaguuucugaaagaccuggaaaagcaauacaauaaagaggagccccaccuuucugaaaucggcuccuguuuccuccagaaccaggagggguuugccauuuauagcgaauacugcaauaaccauccgggagccugucuggagcuggcuaaccucaugaagcagggcaaguauagacacuucuuugaagcgugccggcugcuucaacagaugaucgacauugccaucgauggguuccugcucaccccuguucagaaaauuuguaaguacccccugcaacuggcugagcuucucaaauauacaacgcaggagcauggagacuacucuaauaucaaggccgccuacgaagcuaugaaaaacguggccugccugaucaaugagagaaagcgcaaacuggaaagcauugauaagaucgcgcgguggcaggucuccauugugggcugggagggccucgacauccuggauagaucuagcgaacuuauucacuccggggagcugaccaagaucacaaaacagggaaagucucaacagcgcaccuuuuuccucuucgaccaccagcugguuagcugcaaaaaggaucugcuucggagagacaugcucuauuacaaaggccgccuggauauggacgagauggaacugguggaucucggggacggacgggacaaggauuguaaccuguccgucaagaaugcuuuuaaacuugugagcagaacaaccgacgagguuuaucuguucugcgccaagaaacaggaagauaaggcccgcuggcuccaggcuugugccgacgagagacggcgcgugcaagaagauaaagagaugggcauggagauuucugaaaaccagaagaagcuggcgaugcugaaugcucagaaagccgggcauggaaaguccaaaggcuacaacagaugccccgucgccccuccccaccaaggccuucauccuauccaccagcggcauaucacgaugccgacaagcgugccccagcagcaaguguuugggcuggcugagccuaagcgcaaauccucucucuucuggcacaccuuuaauagacugacccccuuccggaaguga

SEQ ID NO: 76142 - RNA, 1710 nt, Artificial Sequence
  derived and/or modified sequence opt5 from SPATA16__Homo_sapiens__NP_114161
auggacgccggcagcuccagaucucuggagaacgcugugaaucggaucuaccacgaucagcucguccccaagauuaacaccagcaaaaagauguccacacuggcccauccuccgaauauccuugaaaugucucaagagauuaaaaagaacugcgggggaaaacagguugaaaucacgcuggagcgcaccaagaugacaaagggcauuaaagaaaagcagagcaaugaccucgagaaagcggcuuucaagagaaaagccgagggggaagagaagcccacccggaagaaacaggccaagaucacagaacuggauaaccaacuuaucaccaugccucugccccacauuccucucaaaaauaucauggacguggagaugaagcugguguauauugaugagaugggaguccgcuacgaauuuguggaguccuucaugucuacaggcagccagcccaccugucaggcugccgaaaucguugacccucuguccgugcauaacuuuagcuuccucccgcagauugauaaauggcugcaagucgcucuuaaggacgccucuuccugcuauagacagaaaaaguacgcgcuggccgcugggcaguuucggacggcccucgagcuguguagcaagggagcugugcuuggcgaacccuucgaugccccugcggaggacaucgccucuguugcuuccuuuauugagaccaaacuggugacaugcuaucuccgcaugagaaagcccgaucuggcccugaaucacgcucaucggagcaucguccucaacccugccuacuuccgcaaucaccugagacaggccaccguguuucggugucuugaacgcuauucugaggcugcgagauccgccaugaucgcugacuacauguucuggcugggcgggggacgggaagagagcauuuccaaacucaucaagcuguacuggcaagccaugauugaagaggccaucacacgcgcugagucuuuuagcgugauguauacccccuucgccacgaaaauuagagcggauaagaucgaaaaggucaaagacgcuuuuacaaagacccacccggccuacgccgaguauauguacacagaccuucaggcucugcauaugcucccucagaccguugauugguccagcuuucccccucaacaguaucugcugacccucggcuucaaaaacaaggacgaugggaaauuccuggaaaagaucucuucccggaaacuucccauuuucacagagcacaagacgcccuuuggacugaccagagaagacacagugcgccagauggagaccaugggcaagcggauccucccuauucuggauuucaucagaagcacacagcuuaaugggucuuuuccggccagcuccggagugauggagaaacugcaauacgcuucucuccugagccagcugcagcgcgucaaggaacagucccaagugauuaaccaggccauggcggagcucgccaccauccccuaucugcaggacaucagccagcaagaagcugagcuucugcagucucucauggccgaugcuauggacacgcuggagggccggagaaauaacaacgaacgcguuuggaauaugauucagaaagugggccagaucgaggauuuccuguaccaacuugaagacuccuuucucaagacaaagaaacugcggaccgccagacgccagaagaccaaaaugaagcggcugcagacaguccaacagagauga

SEQ ID NO: 76143 - RNA, 1086 nt, Artificial Sequence
  derived and/or modified sequence opt5 from SPATA17__Homo_sapiens__XP_005273109
auggccacccuggcuagacuccaggcccggagcuccacagugggcaaccaauacuauuuccgcaauucugucguugaccccuuuagaaagaaagagaacgaugcggcugugaagauccagagcugguuccgggggugccaggugcgcgccuacauuagacaccugaaucggaucgucacgauuauccagaaaugguggcgcuccuuucuuggaagaaagcaauaucagcugaccgugcagguugccuacuauacaaugaugaugaaccucuacaaugcuauggccgugcggauucagcgcagauggcggggcuaucgcgucagaaaauaccuguucaacuacuauuaccuuaaggaauaucugaaggugguuucugagaccaaugacgcuauccggaaagcccucgaagaguuugcggaaaugaaggagcgcgaggagaaaaaggccaaccuggagagagaagagaaaaagcgggauuaccaagcuagaaagaugcauuaucugcucagcacaaaacagaucccugggauuuacaauuccccguuccgcaaggagcccgacccuugggaacugcagcuucagaaagccaagccccugacccaccggagaccuaaagugaagcaaaaagauucuacaagccucaccgacuggcuggcuuguacguccgcccgcagcuuuccccggucugagauccuuccuccgauuaacagaaagcagugccagggacccuuccgcgauaucaccgaaguccuggagcaacgguauagaccucucgaacccacacugcgcguggcggagccuauugacgagcugaagcucgcccgggaagaacugagacgcgaagaguggcuucagaaugugaacgauaauauguuucugcccuucuccagcuaccauaaaaacgaaaaguacaucccgucuaugcaccucuccagcaaauauggcccuauuucuuacaaggagcaguuucgguccgagaaucccaaaaaguggaucugugacaaggauuuccagaccguccugccuagcuuugaacuuuucuccaaauaugggaagcuguacucuaaagcuggacaaaucguuuga

SEQ ID NO: 76144 - RNA, 1617 nt, Artificial Sequence
  derived and/or modified sequence opt5 from SPATA18__Homo_sapiens__NP_660306
auggccgagaaccugaagagacucgugagcaaugaaacccugcggacacuucaggagaaacuggacuucuggcucaaggaauacaacacgaauaccugcgaucaaaaccugaaucacugucuugagcugaucgaacaggucgcuaaaguucagggccagcucuuugggauucugacagccgcggcucaagagggaggccgcaacgacgggguggagaccaucaaguccagacugcuccccuggcuggaagccucuuucacagccgcuagccuuggaaaauccguggauucuaaggucccuagccugcaggacaccuuugaucgggagcgccauaaggacccgucccccagagaucgggacaugcagcagcucgauucuaaucugaacagcacacgcucccaaugcaaucaggugcaggacgaucuuguugaaaccgagaaaaaccuggaggaaagcaagaauagaucugccauuucccuccuggcugccgaggaagagaucaaccagcugaaaaagcaacucaaaagccugcaggcgcaggaagacgcccggcaccgcaauacggaucaaagaucuuccgagaaccggcgcagcgagccuuggucucuugaagagagaaagcgggaacaguggaacucccugaagcagaaugcugaccagcaagacaccgaggccaugagcgauuauaaaaagcagcuccgcaaccugaaagaagagauugcugugcuuuccgccgagaagucugcgcugcagggcagaagcucccggagcagaucucccuccccugcuccccgcagccggucuuguagcagaucccgcucugccagcccuuccacagccgucaaagugcggagaccgagccccaaucgcucuaagcucuccaacguugcucggaaagccgcccugcugagcagauucucugacuccuacagccaggcucgccucgaugcgcaaugccugcuucggagauguaucgacaaggccgaaaccgugcagcgcaucauuuauaucgcuacagucgaggccuuucauguggccaagauggcuuuccggcacuuuaaaauucaugugagaaagucccugaccccuucuuacgucgggagcaaugauuucgaaaacgccguucucgacuaugugaucugccaccuggaucuuuacgacucccagucuagcgugaaugaugucauucgggcgaugaacgugaaucccaaaaucuccuuuccucccguuguggacuucugucugcucagcgauuuuauucaggagaucugcuguaucgcuuucgccaugcaagcccuggaaccgccucuggacauugcuuauggagccgacggcgaggucuuuaacgauugcaaguaccgcagaucuuacgacuccgauuucacggcuccccucgugcuguaucacguuuggccugcccuuauggagaaugacugugugaucaugaaaggcgaagcggucacacggagaggggccuucuggaacagcgugcgcucugucucccggugcagaagccgcucucugagccccauuugccccagaucccagaucggacucaauaccaugagccggucucgcuccccuagcccgauuagauguggccugccccgguuuuga

SEQ ID NO: 76145 - RNA, 504 nt, Artificial Sequence
  derived and/or modified sequence opt5 from SPATA19__Homo_sapiens__NP_001278921
augaucauuaccacauggaucguguacauucuggccagaaagggcgucgggcuccccuuccugccuaucacgagcuccgacauugauguuguggagucugaagcugugagcguccuucaccauuggcugaaaaagaccgaggaagaggccucccggggaaucaaagaaaagcucucuaucaaccacccgagccagggcgugcgcgagaaaauguccacagacucucccccuacccaugggcaagauauucacguuacaagagacguggucaagcaucaccugagcaaguccgaucuucuggcgaaucagagccaggaggugcucgaggagcggacccgcauccaguuuauuagauggucucacacacggaucuuccaaguucccuccgaaaugaccgaggacauuaugcgcgauagaaucgaacaggugcggcgcagcauuucuagacugacggacgucuccgcucaggauuuuagcaugcggccuucuuccagcgacugcuga

SEQ ID NO: 76146 - RNA, 2361 nt, Artificial Sequence
  derived and/or modified sequence opt5 from SPATA20__Homo_sapiens__NP_001245301
augcugggcgccagagcuuggcucgggcgggugcugcuucugccccgcgccggagcgggccucgcugccagcagacggggguccucuagccgcgacaaggauagauccgccaccgucucuagcuccguuccuaugccggcuggaggcaaagggucucaccccagcuccacaccucagcgggugcccaaccgccugauccaugaaaagagcccuuaccuucugcaacacgccuauaaucccguggacugguacccuuggggacaggaggcuuucgauaaagccagaaaggagaacaaaccgauuuuucucucugucggcuauuccacgugccauuggugucacaugauggaagaggaauccuuccagaaugaggagaucggccggcugcugucugaagacuuuguguccguuaagguggaucgcgaggaaagacccgacgucgauaagguguacaugaccuucguucaggcgacaagcucugggggaggcuggccuaugaacguguggcucacccccaaucugcaaccuuuugucgggggaacauauuuucccccggaggacggccuuacccgggugggguuccgcacagugcugcuccggauuagagagcaguggaaacagaacaagaauacccugcuugaaaacucccagcgcgucacgaccgcccugcucgcuagaagcgagaucuccguuggagaucggcaacugccucccucugccgcuacagugaauaacagaugcuuccagcagcuggacgaaggcuacgaugaggaauauggcggguuugccgaggcgccuaaauuccccacccccgugauucucagcuuucuguucuccuacuggcuuagccaucgccugacacaggacggaucucgggcccaacagauggcucuccacacccugaagaugauggccaauggcgggaucagagaucacgucggacagggcuuucaucgcuacuccacggaccggcaauggcacgugccucauuucgagaaaaugcuuuaugaccaggcucagcuggccguugccuacagccaggcuuuccaacucucuggggaugaauuuuauagcgacguggcgaagggaauccugcaguacgucgccagaucccugucucaccgcagcggcggcuucuauuccgcugaggaugccgacagcccgcccgaacgggggcagagaccuaaggagggagccuacuauguguggacaguuaaagaagugcagcaacuccugcccgagccuguccuuggcgcuaccgagccccugacaucugggcagcuccugaugaagcacuacggacuuaccgaagccggcaacauuuccccgagccaggauccuaaaggggagcugcagggccaaaaugugcucaccguccgcuacucucuggaacugacagcggcucgguuuggacucgacguggaggccguuagaacgcugcuuaacuccggccuggaaaaacucuuccaggcccgcaagcaucggcccaagccucaccuggauagcaaaaugcuggcugccuggaaugggcuuaugguguccggauaugcugucaccggcgccgugcucgggcaggacagacugaucaacuacgcgacaaacggagccaaguuucugaagcggcauauguucgauguugcuucuggccgccucaugagaaccuguuauacagggcccggcggaaccguggagcacagcaauccucccugcuggggcuuucuggaggacuacgccuucgucgugcgggggcuucuggaucucuaugaagcuagccaggagucugccuggcuggaaugggcgcugagacuucaagacacgcaggacaaacucuuuugggauagccagggaggcggguacuucuguuccgaggccgagcugggagcuggccugccgcuccgccugaaggacgaucaagacggggccgaaccuagcgcuaacucuguguccgcccauaaucuucugcggcuccacggcuuuacaggacacaaagauuggauggacaagugcguuugucugcugaccgccuucagcgagagaaugcgcagaguccccguggcgcuucccgaaauggugcgggcucucucugcccagcagcagacccugaaacaaauugucaucugcggcgaucgccaggcuaaggacacaaaggcccuggugcaguguguucauuccguguauauuccuaacaaaguccucauccuggccgauggggacccgagcucuuuucuuagcagacagcugcccuuccucuccacccugcggcgccuggaggaucaagcuacagccuacgugugcgaaaaucaggcguguagcguuccuauuacggaccccugcgagcuuagaaagcuccugcacccuuga

SEQ ID NO: 76147 - RNA, 2088 nt, Artificial Sequence
  derived and/or modified sequence opt5 from SPATA21__Homo_sapiens__XP_011539714
auggacaacagaaauacccagauguacacagagggccggacgaaggcccccgggacccaaccuagcccgggacugcgcaucacaauuaaaagagcuggcguggaacccaucauuccuggggucuccaagguuauguuccccgaugccucugaggugggaagcaaaaagcaccucuccucugcgagccggggcccugaaaaagggccccgccugagagacgcuuuugagaagggaccuuccgaacuucggauccaggagcagggcccgcccgcccgcccuggcaagaaacagcccucuugggugccucaagaggggagccaggaacugcaggccggacaggaucaauccgagcucggccugcuucccagcugggucccggaagugccugaggggcugcagcagcucggaucuggcaaggagauuaaagggcagcaaggaagacagcggaaccgcggcaucggcgaagaccagcccccugaguccugccaagggagcggauaucagucuacccccucccaucaggcugauaugguucagcccgccgaaccuuguugcagacuggcuagccacggccaaccgcuugggggaaagcaucccaaagaggccggcgugccucacauccggccccaggaagcgccucccgagccgucuccugggggacauggcgacuccagccaggaggccaugcccccuauguccgucguggcucccgaagagaagacaguuaauccuuuccuccccucuaccccgggcccuaagaaagccaaagggggaggcgaagcuguggagacacaccccgcccccgggccucugccgcccccugaaguccgcgauauuggagagagacgggagcccgaccgcgcgcagcaacagccucagaaacccgccguggcugccggcacccagagccuugggaacuuuagacaaggcuucaugaagugucugcucgaaguggagaaaauggaggcuucccaccggagagccagcaaggcccgcucucagacggcucagaaauccccucggacccugacacccgucccgaccagcgcgccuucucuuccccagaccccugccagcguucccgcuuccggaccgucuugggccagacugccugcccccggcccugagcccgcucccaugggggccccugugccgacaagcaugcccugcccugugcuccugggacccgcgcuggaucucggcuggcgccggauggaacugcuucaucaauccagcgagagaacgcugucuuacgcuaaggcccgccaggagccugaagaacagucccuccaaaagcuguaucagaaucgggaaaagagcgaggagcagcuuacacugaagcaggaagaggccuuuagaucuuacuucgaaaucuuuaacgggcccggagaggucgacgcucaaucccucaaaaauauucugcugcucaugggcuucagcgugacccuggcccagguugaagaugcucuuauguccgccgacgugaacggggauggccgcgucgacuuuaaggacuuccuggcggugaugacagauacccggagauuuuucuguucuguugagcagaaugcccucagcgacauggcuccucacaacccgcauacccugcuuuuugagauccugucccuccugguggaaaugcuggcccuccccgaggcuguccuggaagagauuacaaauuauuaccagaaaaagcugaaggaaggaacgugcaaagcccaagagauggaggcggccgugggccgccugcggcuccagaagcugccuuauaacccccagcaggaagagucuagcgaagucccugagagaaaagugcuguccauccuuagccggcucaagcaacagaauuacgcucccaaccugcagucuccguacgcccaaguuccuuguauucugcucugcccccagcuggauaaaaagauggugcgcagacagcccuccaaucacuaugcucuugaccaguguaccccucccgggcuggauccugacauccggagcccguucuuccaaucuggaucccagggcaacagagaacacaacagcgauucucgcaaguggcucagcuccguccccgcccggacacauuga

SEQ ID NO: 76148 - RNA, 1092 nt, Artificial Sequence
  derived and/or modified sequence opt5 from SPATA22__Homo_sapiens__NP_001164166
augaagagaagccugaacgaaaauuccgcccggucuaccgcuggcugccuccccgugccucuguucaaccagaaaaagcgcaauagacaaccgcuuacaagcaacccccugaaagacgauuccgggaucucuacgccuagcgacaauuacgauuuucccccucuccccaccgacugggccugggaggcggucaacccugagcuggcuccgguuaugaagacaguggauaccggacagauuccccacuccgugucucggccucuucgcagccaggacuccgucuucaauagcauccagucuaacacaggcagaucccaagggggauggagcuaucgggauggcaauaaaaacaccucucugaagacauggaauaagaacgacuuuaaaccccaguguaagcgcaccaaucucguggccaacgaugggaaaaauuccugcccuguuagcucuggagcccagcagcaaaagcagcugcggauucccgaaccgccuaaccuguccagaaacaaagagacggaacuccugcgccagacccauagcuccaagaucucuggcuguacaaugagaggccuugacaagaauagcgcucugcagacccucaaacccaacuuccaacagaaucaguacaagaaacaaaugcuggaugacauuccugaggauaacacacuuaaggagaccucccuguaucagcuccaguuuaaagaaaaggccagcucucugcggaucaucuccgcugugauugagagcaugaaauacuggcgcgaacacgcccagaagacgguccuccuguucgaggugcuggcgguucuugacucugccgugacacccgggcccuauuacagcaagaccuuucugaugagagacggcaaaaauacacucccuugcgucuucuaugagaucgaucgggaacugccgcgccuuauuagaggacgggugcauagauguguggggaacuacgaccaaaagaaaaauaucuuucagugcgucuccguucgccccgcuucugugagcgagcagaagaccuuccaggccuuugugaaaauugcugaugucgaaaugcaauacuauaucaacgugaugaaugagaccuga

SEQ ID NO: 76149 - RNA, 684 nt, Artificial Sequence
  derived and/or modified sequence opt5 from SPATA25__Homo_sapiens__NP_542175
augagcuacuucagaacaccccagacccacccuggcccgcugcccuccgggcaaggaggcgccgcuucuccugggcucagccugggacuuugcucccccguggagccugucguuguggccucuggcgggacgggaccccugagccagaaggcggaacagguggcuccugccgcccaggcuuggggcccggcccucgcuaugccccaagcccggggcuguccugggggaaccuccugggagacacugcgcaaagaauauucuagaaacugccauaaguuuccccacguccggcagcuugagagccugggcugggacaauggguacucccgcagcagagcgccugaucucggaggccccucucggccgcgcccucugaugcugugugggcucucccccagagugcugccuguucccagcgaagccgugggaaaagaggcuucuucccagcccgacaucugcauucuuacccuggccaugaugaucgcuggcauuccuacagucccggugcccggcguucgggaggaagaucucaucugggccgcgcaggccuucaugauggcucauccugagcccgaaggggccguggagggagcucgcugggagcaagcccacgcccauaccgcuagcggcaagaugccucuggucagaucuaaacgggggcagcccccgggauccugucuuuga

SEQ ID NO: 76150 - RNA, 1563 nt, Artificial Sequence
  derived and/or modified sequence opt5 from SPATA2__Homo_sapiens__NP_001129245
augggcaagcccagcuccauggacaccaaauucaaggaugaccuguuuagaaaauacgugcaguuccacgagucuaaggucgauacaacgaccagccggcaacgcccuggguccgacgaaugccucagaguugccgcuucuacacugcuuagccugcauaaaguggauccguuuuaucgguuccgccucauccaguuuuacgagguggucgaauccucucugagaagccuuuccucuucuucccugcgggcccuccacggagcguucagcaugcuggagaccgugggcauuaaccuguuucucuaucccuggaagaaggaguuccgcucuaucaaaacauacaccgggccuuuuguuuauuacgugaaguccacacugcuugaagaggacauuagagcuauccugagcuguaugggauauacccccgaacucggcacggccuacaaacugcgggagcuugucgaaacccuccaggugaagaugguuucuuucgagcuguuucuggccaaaguggagugcgaacagaugcuggagauucauucccaagucaaggauaagggguacagcgaacucgacaucguguccgagcgcaaaucuagcgcugaagaugugagaggauguuccgacgcccugcggcgcagagcugagggccgggagcaccuuacagccagcaugucucgcgucgcgcugcagaaguccgccagcgaaagagcugccaaagauuauuacaagccucggguuaccaaacccucuagaagcguggacgcuuaugauuccuacugggagucucgcaagccuccgcucaaagccagccugucccuucggaaggaacccguggcgacagacgucggcgacgaucugaaggacgagaucauuagaccuagccccucucuccugaccauggccuccagcccucaugggucucccgaugugcugccgccugcuucccccagcaauggaccugcccuccugcgcggcacguauuucuccacacaggacgauguugaccuuuacaccgauucugaaccccgggcuacauauagacgccaggacgcccugcggcccgauguguggcuccugagaaacgacgcccacagccuuuaccacaaacgcuccccuccggcuaaggagucugcgcugagcaaaugccaauccugugggcucagcugcagcuccagccugugucagcggugcgauucucugcucaccugucccccugccuccaagcccagcgcuuuuccuucuaaagccagcacccaugacucccuggcccacggagcuagccuuagagagaaguaccccggccagacacaggggcuggaccgccucccgcaucugcacucuaaguccaaaccuagcacgacccccacaucccggugcggauucuguaauagaccuggcgccaccaacacaugcacccaaugcucuaaggucagcugugaugcgugccuguccgcuuaucacuacgaccccuguuauaaaaagucugaacuucauaaauucaugccuaauaaccagcucaauuacaagagcacgcagcugucccaccugguguaucgguga

SEQ ID NO: 76151 - RNA, 2682 nt, Artificial Sequence
  derived and/or modified sequence opt5 from SPATA5__Homo_sapiens__NP_660208
augagcuccaagaaaaacagaaagcggcugaaucagucugccgagaacggcagcucccuccccucugcugccagcuccugcgcggaagcucgcgccccuucugccgggagcgacuucgcugccaccuccggaacacugacggugaccaaucuucuggagaaagucgaugacaagaucccgaaaacauuucaaaacagccucauucaccugggccuuaauaccaugaagucugcuaacaucuguauugggagacccguucugcucacaucccugaauggaaagcaggaaguguacaccgccuggccuauggcgggcuuccccgggggaaaagugggccugagcgagauggcccagaagaacgucggcgugcggccuggggaugcuauccagguucaaccccucgugggagccguccugcaggcugaagagauggacguggcccuuucugauaaagacauggagauuaaugaagaggaacugacaggcugcauccuccgcaagcuggaugggaaaaucguucuuccuggaaacuuucuguauuguaccuucuacggcagaccguauaagcuccaggugcugcgggucaagggggcggacggaaugauucugggcggcccccaguccgauagcgacacggaugcccaacgcauggcuuuugagcagucuuccauggagaccagcucccucgaacugucucuucagcugagccagcucgaccuggaggauacacaaaucccuaccuccagaagcacacccuacaaaccuauugacgaccggaucaccaauaaggccucugaugugcuucuggacgugacgcagucccccggggauggaagcggccucaugcuggaagaggucacagggcugaaaugcaacuucgaaucugcucgcgagggaaaugagcagcucaccgaagaggaaagacugcuuaaguuuagcauuggcgccaaauguaacacagacaccuucuauuuuaucuccucuaccacacggguuaauuucacggagauugauaagaacagcaaagaacaagacaaccaguuuaaggugaccuacgauaugaucgggggacuguccagccagcucaaggccauccgcgagauuaucgagcugccgcuuaaacagccugaacuguucaagucuuauggcauucccgcuccuagaggcgugcuccuguacgggccucccggaacaggcaaaaccaugaucgcgcgggccgucgcuaaugaggugggggccuacguuuccgugauuaacggacccgaaaucaucagcaaguuuuauggcgagacagaagccaaacugcgccaaauuuucgcugaggccacccucagacauccgucuaucauuuucaucgacgagcuggaugcgcuuugccccaagcgggaaggggcucagaaugaggucgaaaagagagugguugccucccugcucacgcugauggacggcauuggaagcgagguguccgagggccagguccuggugcuuggggccacaaaccgcccucacgcucucgaugccgcucugcggagacccggacgcuuugacaaagaaaucgagaucggcgucccuaaugcccaggaccggcuggauauucuccaaaagcugcuuagacgcgugccccaucugcucaccgaagcggagcugcugcagcuugccaacucugcucacggguacguuggagccgaccucaaagugcuguguaaugaagcuggccugugcgcccuccggagaauccugaagaaacagccgaaccuuccugaugucaagguggcggggcugguuaagauuacccucaaagacuuccugcaggccaugaaugauauccgccccagcgcuaugcgggagauugccaucgacgugccuaacgucuccuggucugauauuggcggacuggagagcaucaaacuuaagcucgaacaagcuguggaguggccccugaagcauccugaauccuuuaucagaaugggcauucagcccccgaaaggggugcugcucuauggaccucccggcuguagcaagacaaugaucgccaaggcccuggcuaaugagucugggcuuaacuuccuggcgauuaaaggacccgaacucaugaauaaguacguuggcgaguccgagcgcgccguccgggaaaccuuuagaaaagcucgggccguggccccuagcaucauuuucuuugacgagcuggaugcucuggccguggaacgcgggucuucccuuggcgcgggaaacgucgcugacagagugcucgcccagcugcugacagagauggauggcaucgaacagcucaaggacguuacgauccuggccgcuaccaaucggccggauagaauugacaaagcccuuaugcgccccgggcggaucgacagaauuaucuaugugccucugcccgaugcggcuacacgcagagagauuuucaagcuccaauuucacagcaugccugucucuaacgagguggaccuggaugaacugauccuucagaccgacgccuacagcggagccgagaucguugcugugugccgggaagccgcucugcucgcccuggaggaggauauucaggcgaaccucaucaugaaacgccacuucacacaagcccuguccaccgucacgccccggauuccugaaagccuuagacgcuuuuaugaggacuaccaggaaaagucuggccugcauacccucuga

SEQ ID NO: 76152 - RNA, 1704 nt, Artificial Sequence
  derived and/or modified sequence opt5 from SPATA7__Homo_sapiens__NP_001035518
auggacggcagcagacgggugcgcgccaccuccguccugcccagauacgggccuccgugccucuucaagggacaccugucuacaaaaagcaacgcugccguugauuguuccgugcccgugucugucagcacguccaucaaguaugcggaccagcaacggcgcgagaaacuuaagaaagaacuggcucagugcgagaaggaauuuaagcucaccaaaacagccaugagagccaauuacaagaacaauucuaaaagccuguucaacacccuucagaagccuuccggcgagccccagauugaagaugacaugcugaaagaggagaugaauggguuuagcucuuucgcucggucccucgugccuagcucugaacgccugcaucugucccuccacaagagcucuaagguuaucacaaacggacccgagaaaaauuccagcuccucuccuagcuccguggauuaugccgcuagcggcccgagaaagcugucuuccggggcccuuuacggacggcgccccagaagcaccuuuccuaacucucaucgguuccaacuggucauuagcaaagcgcccuccggcgaccuccuggauaagcacucugaacuuuuuagcaauaaacagcugccuuucacaccccgcacccucaagacggaggccaaauccuuucugagccaguauagauacuauaccccggcuaagcggaagaaagacuucacagaucagcgcaucgaggccgaaacccaaacagagcugucuuuuaaguccgaacucggcaccgcugagacgaaaaacaugacagacagcgaaaugaauauuaagcaggccucuaacugugugaccuacgaugcgaaagagaagaucgccccucugccccuugaggggcaugacuccacaugggaugaaaucaaggacgacgcucugcagcacagcuccccuagagccaugugccaguacucucucaaaccucccagcacccggaagauuuauuccgaugaggaagaacugcuuuaccugucuuucaucgaagacguuaccgaugagauucucaaacugggacuguuuagcaauagauuccucgagcgccuguucgaacggcacaucaagcaaaacaaacaucuugaggaagagaagaugagacaucugcuccacgugcugaaggucgaccuuggcuguacauccgaagagaauagcgugaaacagaacgauguggacaugcugaacgucuuugauuucgagaaggcuggaaauucugaacccaacgagcucaaaaaugaauccgagguuacgauucagcaagagcgccagcaguaucagaaggcccuggacaugcugcucagcgccccgaaagaugaaaacgagaucuuucccucuccuaccgaguucuuuaugcccauuuacaaguccaagcacagcgagggggugaucauccaacaggugaaugacgaaacaaaccuggagaccucuacacuugaugagaaucacccuagcauuuccgacagccugaccgaccgggaaacgucugucaacgugaucgagggcgauuccgaccccgaaaaaguugagauuagcaaugggcucugcggacugaacacauccccgucucagagcgugcaguucuccucugucaagggcgauaauaaccaugacauggaacugagcacccuuaaaaucauggagauguccauugaggauuguccucucgacguguga

SEQ ID NO: 76153 - RNA, 318 nt, Artificial Sequence
  derived and/or modified sequence opt5 from SPATA8__Homo_sapiens__NP_775770
auggcccccgcuggcaugagcggggcccaagacaacuccugccuguaccaagagaucgcgccuucuuuccagagacucccguguccccggaccagcucccgccacuuuucugaagcuaugacaugcccuuguggauggagacccuucaagggcgggccuggaggccugaaagggcccguguggccugccaaggaggaaaauagcugcucccauggacggauucagcgcguccagagacggcgcguuccgucugccagcccccuuauccagaaaauuaacagacgguccgugcuguuucacccuuauuguuggagcuga

SEQ ID NO: 76154 - RNA, 765 nt, Artificial Sequence
  derived and/or modified sequence opt5 from SPATA9__Homo_sapiens__NP_114158
augcccaucaagccugugggcuggauuugcgggcagguccugaaaaacuucagcggaagaaucgagggcauucaaaaggccaucauggaccucguugaugaauuuaaagacgaguucccgaccauucugcggcuuucccagucuaaucagaagcgcgaacccgcucagaaaacaagcaagaucagaauggccaucgcgcuggcuaagauuaaccgggccacgcucauccgcgggcuuaauuccauuucuagaagcuccaaaucuguggccaagcugcugcacccucaacucgcuugucggcugcuggagcuccgcgauaucagcggaagacugcuucgggaagugaacgcuccccgccagccucuguacaauauucaggucagaaaaggcucccucuuugagaucauuagcuuccccgccaagaccgcccugacaucuaucaucuaugcguccuacgccgcucuuauuuaucuggccgugugcguuaacgcugugcucaaaaaggucaagaauaucuuucaggaggaagagagcauucggcaaaaccgcgaagagucugagaauuguagaaaagccuucuccgaaccugugcugagcgagccgauguuugcggaaggggagaucaaggccaaacccuaccggucucugccugaaaagcccgacauuuccgauuauccuaaacuccuggcuaacaagcagagcaauaacauccagguucuucauuccguguucgaccagucugccgagaugaaugagcaaaucuga

SEQ ID NO: 76155 - RNA, 1326 nt, Artificial Sequence
  derived and/or modified sequence opt5 from SPATC1__Homo_sapiens__NP_001127846
augagccugcucaccaacuacgagggccugagacaccagaucgaacggcuugugcgcgagaaugaggaacugaagaaacucgucagacugauucgggaaaaccaugagcuuaaguccgccaucaaaacacaagcugggggacugggcauuucuggguucacgagcggacucggcgaggccaccgcggggcuguccucucgccagaauaacggaguuuuucugcccccuagcccggcuguggccaaugaaagagugcucgaggaagucggcaucauggcccuggcuccccuugccgagaugcugacaucccuccagccuucugcuacccccggcagccugauguccccucuuacagggacccugagcacacuccugucuggacccgccccuaccucccagagcucuccgcugacguccuuccucaccagccccauugcgggcccucugacagggacccuugccucuucccugggacuccccagcacaggcacccugacgccuuccucucuuguggcugggcccguugccaugagccaauccagcccgcugaucgcuccugugaugggaacagucgccgugucucucuccagcccccugcugucuagcaccgcgacaccucccggcguuucccagaaccuccuggccaaucccaugucuaaccuugugcugccugaggcuccgcggcuccgccuggccgaaccccuuagaggcgggccuaccggaccccagagcccugcuugcgucgugcccaccgccacaacgaaggugccgcuguccaccgagccuccccagagcacacaagacccugaaccccucucuauggccuuugcuggcgcgccucugcagaccuccacacccaucggggccaugggaaccccggcuccuaaaacggccuucagcuuuaauacaucugauacccaggcccagcccuccgcugcccaagagcaggucguucccgcgagcgugccuaccuccccgacaaccucucccacagugacgguccuggcuagcgccccugcccucgcuccccagguggccaccuccuauacaccuucuagcaccacacacauugcucaaggcgcgccccauccucccucccggaugcacaacagcccgacccagaaucugccuguuccccauuguccuccccacaacgcccacucuccgccucgcacguccagcucucccgccuccgugaaugacagcagagggccucggaccacagaacccucuaccaagagcaugauggaggucgagcgcaaacuugcucauagaaagacauccaaguuccccgaaaacccucggggauuuccggagccccaguga

SEQ ID NO: 76156 - RNA, 594 nt, Artificial Sequence
  derived and/or modified sequence opt5 from SPC24__Homo_sapiens__NP_872319
auggccgcuuucagagacaucgaggaagugagccagggccugcucucccugcuuggggccaaccgggcggaggcucaacagcgcagacugcucggacggcacgaacaggucguugagcgccugcuugaaacccaggauggcgccgagaagcaacugagagagauucucacaauggaaaaagagguggcccagucucugcugaaugcuaaggaacaggugcaucaagggggagucgagcuccagcagcuggaggccggccuucaggaagcuggggaggaagacacgcggcugaaagccagccuccugcagcuuacccgcgagcuggaggaacucaaggagaucgaagcggaucuggagagacaagaaaaagagguggacgaagauacaaccguuacaauucccuccgccguguacgucgcucagcuguaucaccaggugucuaagaucgagugggacuacgagugcgaaccuggaaugguuaagggcauucaucacggcccgagcguggcccaacccauccaucucgauuccacccagcugucucggaaauuuaucagcgacuaucuuuggucccuggucgauacagagugguga

SEQ ID NO: 76157 - RNA, 675 nt, Artificial Sequence
  derived and/or modified sequence opt5 from SPC25__Homo_sapiens__NP_065726
augguggaggacgaacuggcccucuucgauaagagcaucaacgaguuuuggaauaaauucaaguccaccgacacaucuugccagauggcuggccugagagauacguacaaagacagcauuaaggccuuugcggaaaaacuuuccgucaagcugaaggaggaggaacggaugguugagauguuccucgaauaucaaaaccagaucucucgccagaauaaacugauucaggagaagaaagauaaccuucugaagcucaucgcugaagugaaagggaagaagcaagagcuggaggugcugaccgccaauauucaggaccucaaagaagaguacagcagaaagaaagaaacaaucuccaccgccaacaaggcuaaugccgagcggcugaaacgccuucagaagucugcugaucuguauaaagacagacucggacuggaaauccggaagauuuacggcgagaaacuucaguuuaucuucacaaacauugaucccaaaaauccugagagcccguuuauguucucccugcaccucaacgaagcccgcgacuaugaggucagcgauucugcgccccaucuggaagggcuggccgaguuucaagaaaaugugagaaagaccaacaauuucuccgcuuuucucgccaacguucggaaggcuuucacagccaccguguacaauuga

SEQ ID NO: 76158 - RNA, 543 nt, Artificial Sequence
  derived and/or modified sequence opt5 from SPCS3__Homo_sapiens__NP_068747
augaacaccgugcugagcagagccaauucccucuucgcuuuuucucugagcgucauggccgcgcuuacauucggcugcuuuaucacgaccgcuuucaaggaccgguccguucccgugcgccugcacgugucuagaauuaugcucaaaaacgucgaggauuuuacagggccucgggaacgcagcgaccugggauucaucaccuuugauauuacagccgaccuugagaauaucuucgauuggaacgugaagcagcuguuucucuaccuguccgccgaauauucuaccaaaaauaacgcucugaaucaaguugugcucugggacaagauuguccugagaggcgauaacccgaaacuucugcucaaggacaugaagacaaaauacuucuuuuucgaugacgggaauggacugaagggcaaccggaaugugacccuuacgcugagcuggaacguugugcccaaugccgggauccucccucuggucaccggauccggccaugugagcgugcccuuuccugauacauaugagaucaccaaaucuuacuga

SEQ ID NO: 76159 - RNA, 960 nt, Artificial Sequence
  derived and/or modified sequence opt5 from SPDEF__Homo_sapiens__NP_001239223
augggcagcgccucccccgggcugucuagcguguccccuucucaccuccugcuuccgcccgacaccgucagcagaacaggacuggagaaggcugccgcgggcgcuguugggcucgaacggcgcgauugguccccuucucccccugccacgcccgagcagggacugagcgccuucuaccuuuccuauuuugacaugcuguacccugaagauagcucuugggcugccaaagcuccgggcgccuccagcagagaggaacccccugaggagcccgaacaaugcccugugaucgacucucaggcgcccgccgggucccucgaucuggugccgggaggccugacccucgaggaacauagccuggagcagguccagucuauggugguuggcgaggugcuuaaggacauugaaacagcuuguaaacugcucaacaucaccgccgauccuauggacuggucccccagcaauguccaaaaguggcugcuuuggacagagcaccaguaucggcugccucccauggggaaggcuuuccaggaacucgccggaaaggagcugugcgcgauguccgaggaacaguuucgccaaagaucuccccugggcggggaugugcuccaugcccaccuggacauuuggaaaagcgcuuccaccagcgaggaaucuuggacagauuccgagguugacagcucuuguagcggacagccuauccaucuuuggcaguuccugaaagaacuccugcuuaagccgcacuccuacggccgguuuauucgcuggcugaacaaagagaaggggaucuucaaaaucgaagauucugcccagguggcuagacucuggggcauucggaagaaucgccccgccaugaacuaugacaagcugagcagauccauccggcaauacuauaaaaagggaauuauccgcaaaccugacauuagccagagacuggucuaccaguuugugcaccccaucuga

SEQ ID NO: 76160 - RNA, 1818 nt, Artificial Sequence
  derived and/or modified sequence opt5 from SPDL1__Homo_sapiens__NP_060255
auggaggccgacaucauuaccaaccugagaugccggcucaaggaagcugaggaagaacgccugaaagccgcgcaguacggccuucaacugguggaaagccagaaugagcuccagaaccagcuggauaaguguagaaaugagaugaugacaaugacggaauccuaugagcaagaaaaauacacccuucagcgggaggucgagcugaagucucgcaugcucgaaagccuguccugcgagugugaagcuaucaaacagcagcaaaagaugcaccuggagaagcucgaagaacagcugucuagaagccaugggcaggagguuaacgaacuuaaaacaaagauugagaaacugaagguggaacucgacgaggcccggcuguccgaaaaacagcuuaagcaccaaguggaucaucagaaggagcugcucucuugcaaaagcgaggaacugcgcgucauguccgagagagugcaggaaagcaugucuuccgagaugcuggcccuccaaaucgaacugaccgagauggagagcaugaagacaacccuuaaagaagagguuaaugaacugcaguaucggcaggagcagcucgagcugcuuauuacaaaccugaugcgccaaguggacagacucaaggaagagaaagaggagcgggaaaaggaggcugucucuuacuauaaugcccuggagaaagcucgcguggccaaccaggaucugcagguucagcucgaccaagcgcugcagcaggcccuugaucccaauuccaagggaaacagccuguucgcugaaguggaggacagacgggccgcuauggaacgccagcucaucucuaugaaggucaaauaccaaucccugaagaaacagaauguguuuaacagagagcagaugcagcggaugaagcugcaaaucgccacccugcuccagaugaaaggcagccagacggaguucgagcaacaggagagacugcuggcgaugcucgaacagaagaauggggagauuaagcaccuucuuggagaaauccgcaaccuggagaaauuuaagaaucucuaugauuccauggaaucuaaaccuagcguggacuccggcacccuggaggauaacacauacuacaccgaccugcuucagaugaagcucgauaaccugaauaaagagauugaaagcacaaagggggagcugucuauccaacggaugaaggcccucuucgaaucccagagagcucuggacauugagcgcaaacuuuuugccaacgagcggugucugcagcucagcgaaucugagaauaugaagcugagagcuaaacuggacgaacuuaagcucaaauaugagccggaagagaccgucgagguucccgugcugaagaagcgccgggaagugcugccugucgauaucacgacagccaaagacgccugcgugaacaauagcgcucucggaggcgagguuuacagacugcccccucagaaggaagagacccaauccugucccaacucucuugaagauaauaaccugcagcucgagaaaagcguguccauuuauacaccugucgugagccugucuccgcauaagaaucugcccguugacaugcagcuuaaaaaggagaaaaagugcgugaagcucaucggcgucccugcggaugccgaagcucuguccgagcgcagcgggaacacccccaauucuccucggcuggccgccgaauccaaacuccagaccgaggugaaggaaggaaaagagacaagcuccaagcuggagaaagaaacguguaagaaacuucaccccauccuguacgucucuagcaaguccaccccggagacacaaugcccucagcaguga

SEQ ID NO: 76161 - RNA, 861 nt, Artificial Sequence
  derived and/or modified sequence opt5 from SPDYA__Homo_sapiens__NP_001008779
augagacacaaccagaugugcugugagacacccccuaccgugacggucuacguuaagagcggcuccaaucggucucaucaaccgaaaaagcccaucacccugaaacgcccuauuugcaaggacaacuggcaggccuucgagaaaaauacacacaacaauaacaagagcaagagacccaaagggccuugucucgugauccagcggcaggauaugaccgccuuuuucaagcuguuugacgaugaccuuauucaagauuuccuguggauggacugcuguugcaaaaucgcugauaaguaucuccuggcgaugacauuuguguacuucaaacgcgcuaaguuuaccauuuccgaacauacaagaaucaauuucuuuaucgcccuuuaucuggccaacaccgucgaagaggacgaagaggagacgaaguacgaaauuuuccccugggcucucggcaaaaauuggcggaagcuguuuccuaacuuccugaaacuccgcgaucagcugugggacagaaucgauuaucgggccauugugucucgcagauguugcgaggaaguuauggcuaucgccccgacccacuacauuuggcagcgggagcgcagcgugcaucacuccggagcggucagaaauuauaaccgggacgaggugcagcuuccccgcgggccuucugccacacccguugauuguagccugugcggaaagaaaagacgguacgugagacucggccuguccucuagcuccagccuuucuucccacaccgcuggggucacagaaaagcauagccaagacucuuacaauucccugagcauggacaucauuggagauccuucccaggccuauaccggcucugagggcaugaucuga

SEQ ID NO: 76162 - RNA, 2130 nt, Artificial Sequence
  derived and/or modified sequence opt5 from SPECC1__Homo_sapiens__NP_001028726
augggcaaccacagcgggagacccgaggacccugaaccgggagccuucaccacaacgaagcggaccggcauccccgcuccucgcgaguuuuccgugacagucucuagagaacggagcguuccccgcgggccuuccaaucccagaaaaucugugagcuccccuaccucuagcaacacaccgacccccacaaagcaucugcggaccccuuccacgaaacccaagcaggagaaugaaggaggcgagaaagccgcgcucgagagccaagugcgcgaacugcuugcugaggccaaggccaaggauucugaaauuaacagacugcgguccgagcucaaaaaguacaaagagaagcgcacccugaaugcugaagggacagacgcccuuggaccuaacgucgauggcaccagcgugucucccggcgacacagagccgaugaucagagcucuggaagagaaaaauaagaacuuccagaaggaacucuccgaucuggaggaggaaaaucggguucugaaagagaagcucauuuaucuggaacacagcccuaacucugagggggccgcgucccauaccggagacagcuccugccccacgucuaucacacaggaaagcuccuuuggcagcccuaccgggaaucagaugucuuccgauauugacgaguacaaaaagaacauccacggaaaugcccuucgcacaagcggcucuagcuccucugaugugaccaaagcuagccugucccccgacgccagcgauuucgagcauaucaccgcugaaacacccucuagaccucucuccagcacgucuaacccguuuaaguccagcaaauguuccaccgccgggucuagccccaauuccgucucugagcugagccuugcgucccugacagaaaagauucaaaagauggaggaaaaccaccacagcaccgccgaggagcuccaggcuacacugcaggaacugucugaccagcaacagauggugcaggagcucaccgccgaaaacgagaaacugguugaugagaagacgauccuugaaacauccuuccaucagcaccgggagcgcgcugaacaacugagccaggagaaugaaaaacucaugaaccugcuucaggagagagugaagaaugaggaaccuaccacccaagagggaaaaauuaucgaacuggagcagaagugcacaggcauucucgaacagggccgguuugagagagagaagcugcugaacauccagcaacagcucaccuguucucugcgcaaagucgaagaggaaaaucagggggcccuugagaugauuaagcggcugaaagaagagaacgagaagcucaaugaguuccuggaacuugaaagacauaacaauaacaugauggccaaaacacuggaggagugccgcgugacgcucgaaggacugaagauggagaauggcucccuuaagagccaccuccagggggaaaaacaaaaggcuaccgaggcgucugccguggaacagacagcugagagcugugagguccaggaaaugcugaaaguugcccgggccgagaaggaccuucuggaacucuccugcaacgagcugagacaggaacugcuuaaagcuaauggagagaucaagcacgugagcucucuccuggccaagguggagaaagacuauuccuaccugaaggaaaucugugaucaucaagcggagcagcucagccgcaccucccugaaacuucaggaaaaggcuucugagagcgacgccgaaauuaaagauaugaaggagacaaucuuugagcuggaagaccaggucgagcaacaccgggccgugaaacuccauaacaaucagcugauuuccgaacuggagucuagcguuaucaagcuggaggaacagaaguccgaucucgagagacaacugaaaacccugacgaagcagaugaaagaagagaccgaagaguggcgccgguuccaggcugaccuccagacagccguggucguggcuaacgauauuaagugcgaggcccaacaggaacugagaaccguuaaacgcaaacuucuggaggaagaggaaaagaacgcgcggcuccagaaggagcugggcgacgugcaggggcacggaagagucgugacaucucgggccgcucccccuagccugggcuccgucagcuga

SEQ ID NO: 76163 - RNA, 3354 nt, Artificial Sequence
  derived and/or modified sequence opt5 from SPECC1L__Homo_sapiens__NP_001138940
augaagaaagccagcagauccgugggcucuguccccaagguuagcgcuaucuccaaaacccagacagccgagaagauuaaaccugaaaacucuagcuccgcgucuaccgggggaaagcuggugaagccgggcaccgcugccagccucuccaaaacaaagagcucugacgaucugcuugccgggauggcuggaggcgugaccgucacaaauggggugaaaggaaagaaauccacgugccccagcgccgcuccuucugccuccgcgcccgccaugacaaccguugagaacaagagcaagaucucuacgggcaccgcuuccagcacaaaacgguccaccucuacaggcaauaaggaaagcuccagcacccgcgagagacugcgggaacgcacgagacucaaccaaucuaaaaagcugccuuccgccgggcagggagcuaaugacauggcccuugcgaaacggagccgcucuagaacagccaccgagugugaugugcggaugagcaaguccaaaucugacaaccagauuagcgaucgcgcugcccuggaggcuaaggucaaggaccuccugacacuggccaaaaccaaggauguggaaauccuccaccugagaaaugagcuucgggacaugcgcgcccagcugggcauuaacgaagaucauuccgagggggacgagaaaagcgaaaaggagaccaucauggcucaccaacccacagauguugaaucuacgcuccugcagcuucaggagcagaauaccgcgaucagagaagaacugaaccaacucaaaaaugagaaccggaugcugaaggaccgccugaaugcccucggauucucccuggaacagagacuugauaacagcgagaagcuguuuggcuaccagucucucuccccugaaauuacaccggggaaucagagcgacggaggcggcacccugacauccucuguggaggggagcgcucccggauccgucgaagaccuucugucucaagaugagaacacccucauggaccaucagcacagcaacuccauggauaaucuggacagcgagugcucugaaguguaucagccucugacguccagcgaugacgcccucgaugcccccucuuccagcgagucugaaggcaucccuagcauugagcgguccagaaaagggagcucuggaaacgcuuccgaagugagcgucgccugucugacagagcgcauccaucaaauggaggaaaaucagcacuccaccucugaggaacuucaggcgacccugcaggagcucgcugaccugcaacagauuacacaggagcuuaacagcgaaaaugagcggcugggcgaagagaagguuauccucauggaaucccugugccagcaaucugauaaacuggagcacuucagcagacagauugaguacuuucgcucccuccuggacgaacaucacaucucuuaugugaucgaugaggacgucaagagcgggcgguacauggaacuugagcagagauauauggaccuggccgaaaacgcccgcuucgagcgggagcagcuccugggagugcaacagcaucuguccaauacccuuaaaauggcugaacaggauaacaaggaggcccaggaaaugauuggcgcucucaaggagagaagccaccacauggaacgcaucauugagucugagcaaaaaggcaaggccgcgcuggccgcuacacuggaagaguacaaagccacgguggcuuccgaccagaucgaaaugaaucggcucaaggcccagcuggagaacgagaaacaaaagguugcggaacuuuauagcauucauaauucuggggauaaguccgacauccaggaucugcucgagagcgugagacuggacaaagaaaaggccgagacccuggcuucuucccuucaggaagaucucgcccacacacgcaacgacgcuaaucggcugcaggaugccaucgccaaagucgaggacgaguacagagcuuuucaagaagaggcgaagaaacagauugaagaucugaacaugacccucgagaagcugcggagcgaccuugaugaaaaagagacagagcgcuccgacaugaaggaaaccaucuucgagcuggaagacgagguggaacagcauagagccguuaagcuccacgauaaucugauuaucagcgaccuggagaacacggugaaaaagcuccaggaucaaaaacaugacauggagcgggaaauuaagacccuucacagacgccugcgggaggaaucugcugaguggagacaguuucaggccgaucugcagacagccgucgugaucgcuaacgacaucaaaagcgaggcccaagaagagauuggagaucucaagcgcagacugcacgaagcgcaggagaagaaugaaaaacuuaccaaggagcuggaggaaaucaaaucccggaagcaggaggaggagcgcggcagagucuacaacuauaugaaugcuguggaacgggaccucgccgcccugcgccaagggaugggacugucuagacggagcuccacaucuagcgagcccaccccgacgguuaaaacacuuauuaaguccuucgauucugcuagccaggugccuaaccccgccgcggcugccaucccucgcacaccccucucccccagcccuaugaagaccccgcccgccgcugccgucucuccuaugcagagacauuccauuagcggccccaucucuaccuccaaaccucugaccgcucugagcgacaagcggcccaauuacggggagauuccggugcaggaacaccuccugcgcacauccucugccagcagaccugcgucccuuccccggguuccugccauggagagcgcuaaaacgcugucuguguccagacgcagcucugaagagaugaagcgggauaucagcgcccaagaaggcgcuucccccgccucucucauggccaugggaaccacaagcccucagcugucccugucuagcucccccaccgcuagcgucacaccgaccacgagaucucgcauccgggaggagagaaaagacccucuuuccgcgcuggcccgcgaauauggcgggagcaagcggaacgcucuccugaaguggugucagaaaaagacagagggauaccagaauauugauaucaccaacuuuuccucuagcuggaaugacggccucgccuucugcgcccugcuucauaccuaucugcccgcucacauucccuaccaagaacucaacucccaggacaaaagacgcaauuuuaugcuggccuuccaggcggcugagucuguggggaucaagagcacacuggauauuaacgagauggugcggaccgaaagaccugacuggcagaauguuaugcuuuaugucacagccaucuacaaauacuuugagacguga

SEQ ID NO: 76164 - RNA, 5469 nt, Artificial Sequence
  derived and/or modified sequence opt5 from SPEF2__Homo_sapiens__NP_079143
augagcgagauccugugccaauggcucaacaaggaacugaaaguguccagaaccgugucucccaagagcuucgcuaaggcuuuuuccucuggcuaccuucugggggagguucuucacaaguucgaacugcaagacgacuuuagcgaguuccuugacucccgggugucuagcgccaaacugaauaacuuuucccgccucgaaccuacacugaaucugcucggagugcaguucgaucagaacgucgcgcauggcauuaucacggagaagcccgggguggcuaccaagcugcuuuaucagcuguacauugcccuccagaagaagaaaaagagcgggcugacaggcguugagaugcagaccaugcagagacuuacaaaucugcggcuccagaacaugaaaucugacaccuuucaagaacgccugagacacaugaucccccggcagacagauuucaaucugaugcgcauuaccuauagauuucaggagaaguacaagcaugugaaagaagaccucgcccaucugcacuucgagaaacuugagcgguuucagaaacugaaggaagaacaacgcuguuucgauaucgaaaaacaguaucucaacagacggcgccagaaugagaucauggcuaagauucaagccgcuaucauucagaucccuaaacccgccuccaacagaacgcugaaggcgcuugaagcccagaagaugaugaaaaagaaaaaggaggcugaggacgucgccgaugaaauuaaaaaguuugaggcucugaucaagaaagaccuccaggccaaggaaagcgccucuaaaaccucccuggauacagccgggcaaaccacaaccgaccugcucaauacguacagcgaugacgaguauauuaagaaaauccagaagcggcuggaagaggacgcuuucgcccgcgagcagagagaaaagcggagacgcaaacuucugauggaucagcucaucgcucacgaggcccaagaagaggccuaccgggaagaacagcugauuaacagacuuaugcgccagucucagcaagagcggagaaucgcugugcagcugaugcacguucgccaugaaaaggaggugcucuggcagaaucggauuuucagagaaaaacagcacgaggagcgccggcugaaggacuuucaagaugcgcuggacagagaagccgcucucgccaaacaggccaagaucgauuucgaggaacaguuucugaaggagaaacgcuuccaugaccaaauugcugucgaacgggcccaggcgagauacgagaagcacuauuccgugugcgcugagauccuugaucagaucguggaccugagcacaaaagucgccgauuaccggaugcucaccaacaaucugauuccuuauaagcugaugcacgacuggaaagaacucuuuuucaacgccaagcccaucuacgagcaggcuuccguuaaaacacucccugccaacccgucucgcgaacaacugaccgagcuggaaaagagagaucuccuggacaccaaugacuaugaggaguacaagaacauggugggagaaugggcccuucccgaggaaaugguggauaaucugccucccagcaacaauuguauucucggccauauccugcaccggcuggcugagaaaucccuuccucccagagcggaaagcacaacgccggagcucccuucuuuugccgucaagggcugccugcuggggaaaacccucuccggaaagacaaccauucugcgcagccuucagaaagacuuccccauccagauccugucuauugauacacucgugcaggaggcuauccaagccuuucaugacaacgaaaagguuagcgaggugcugccuauucagaagaaugaugaagaggacgcucugcccguccuucaggaggaaaucaaagagucccaggauccccaacacguguucucugccggcccuguuagcgacgaagugcucccggagaccgaaggggagacgaugcuguccgcgaacgccgauaagacacccaaagcugaggaagucaagagcucugacuccuuucugaaacucaccacccgggcccagcugggagcuaagagcgagcagcuucugaagaaaggcaagucuauuccugaugugcuccuggucgacaucauugugaaugccaucaacgaaauccccguuaaucaagauuguauucuggacggguucccuaugacacuuaaccaggcccagcuccuggaggaagcucugaccggaugcaauagaaaccucacagagguggagcgcaaaaaggcgcagaaauccacgcuggccaucgaccccgcuaccagcaaggaaauuccgcuuccuucccccgccuuugauuucgucauccugcucgacgugucugauacaagcuccaugucuagaaugaaugacauuaucgccgaggaacugagcuauaagaccgcucaugaggauaucucccaacggguugccgcggaaaaccaggacaaagauggcgaccagaaccugcgcgaucagauucaacacagaaucauuggcuuccuugacaauuggccucugcucgagcagugguuuagcgagcccgaaaacauccugauuaagaucaaugcugagaucgauaaagaaucucucugugagaaggugaaagagauucugacaaccgaaaucgccaagaaaaagaacaaggucgagaagaaacuugaagagaaagaagccgagaagaaagcugccgcgucccuggcugagcucccucugcccacgccgccucccgcgcccccuccggaacccgagaaggaaaaggagauucaccagagccauguggccucuaaaaccccuacagcuaaggggaaaccccaguccgaagccccucacggaaagcaagagagccugcaggagggcaaagggaagaagggagaaaccgcucuuaaacggaagggcucucccaaaggaaagagcuccggaggcaaagugccuguuaaaaagagccccgccgacucuacagauaccuccccggucgcgaucgugccucagcccccuaaacccggcagcgaggaauggguguacgucaaugagccggugccugaagagaugccccuguuccucguuccuuacugggagcugauugaaaacuccuauaucaauacgaucaagacagugcuccgccaucugagagaggaccagcacaccguccuugccuaccuguaugaaauucggacaucuuuucaagaguuccucaaacgccccgaccacaagcaggauuuuguggcucaguggcaagccgacuucaacagccugcccgaugaccugugggaugacgaggaaaccaaagcugagcuucaucagagaguuaaugaucugcgggaccgccucugggauaucugcgacgccagaaaggaagaggccgaacaggagcggcuggauauuaucaacgaguccuggcuccaggacacccuggggaugacaaugaaucacuuuuucucucuuaugcaagcugaacugaacagauuucaggacacgaagcgccugcuccaggauuacuauuggggaauggagagcaaaauuccuguggaagacaauaagcgguucaccagaaucccgcugguccagcuugauuccaaagacaacucugagagccaacugcgcauuccccucgugccucggaucuccaucagccuggaaacaguuacccccaagccuaaaacaaagucugugcucaaaggcaagauggauaauucccuggagaacgucgagagcaacuuugaagcggacgagaaacuugugauggauaccuggcagcaggccucucuggcugugucccauauggucgccgccgaaauucaccagagacugauggaggaagagaaagagaaucaacccgcugacccuaaggagaaaagcccgcagaugggggccaacaagaaaguuaagaaggagcccccuaaaaagaaacaggaagauaagaaacccaagggaaagucuccucccauggcggaggcuacgccggugaucgugacaaccgaggaaauugccgagaucaaacgcaagaaugaacuccgggucaaaauuaaggaggaacaucuggccgcccuucaauucgaggagaucgccacccaguuuagacuggaacucaucaaaacaaaggcgcuggcucuccuggaggaccuugugaccaagguuguggaugucuacaaacugauggaaaaguggcugggcgagcgcuaucucaacgaaauggccuccacagagaaacugacggacguggcccgguaccacauugagaccagcacaaagauccagaaugaacuuuaccugucccaggaggauuucuucauuaacgggaauaucaaaguuuuuccugauccgcccccuagcauuagacccccuccgguggaaaaggaggaagacggcacccucacaaucgagcaacuggauucucuccgggaccaguuccuggauauggcucccaaaggaaucauuggcaacaaggccuuuaccgacauccuuauugaucuggucacgcugaaucucgggaccaacaauuucccuagcaacuggaugcaccugacacagcccgagcuucaggaacugaccucccuccugacagucaauucugaguuuguugacuggcgcaaguuccugcucgugaccagcaugccuuggcccaucccgcuugaagaggagcugcuggaaacacuccaaaaauuuaaggcugucgauaaagagcagcugggaaccauuacguucgaacaguauaugcaggccggccuuugguuuacaggggacgaggauaucaagauuccugaaaacccccuggagccucuccccuucaauagacaagagcaucugaucgaauuuuucuuccggcuguuugcggacuacgagaaagauccuccccagcucgacuauacccagaugcuucuguacuucgccugucacccggauaccguggaaggaguguaucgcgcucuguccgucgccguuggcacacauguguuucagcaagugaaggcuucuaucccuagcgccgagaagaccuccucuacggacgccgggcccgcugaagaguuccccgagccugaagagaacgcggccagagaagaacggaaacucaaggacgauacagagaagagagagcagaaggacgaggaaauuccggagaacgcuaauaacgagaaaaugagcauggagacccugcuuaaggucuuuaagggcggauccgaggcccaggauagcaaucgcuucgccucucaccugaaaaucgaaaacauuuacgcugagggcuuuaucaagacauuccaagaccucggggccaaaaaucuggaacccauugagguggcgguucugcucaagcauccuuuuauccaggaucuuaucuccaacuauagcgacuacaaauuccccgauauuaagaucauucugcagcggucugaacacgugcagggauccgacggcgagagaagcccuucccgccacaccgaggaaaagaaauga

SEQ ID NO: 76165 - RNA, 342 nt, Artificial Sequence
  derived and/or modified sequence opt5 from SPEG__Homo_sapiens__NP_001166947
augaagcccagcccuucccagaacagacggucuagcgacaccggcuccaaagccccgcccacauucaaggugucucugauggaucaaagcguccgcgaggggcaggacguuaucauguccauuagagugcagggagaaccuaaacccguggucucuuggcuccggaaucgccagccugugagacccgaucaacggcgcuuugcugaggaagccgagggcgggcugugcagacuucggauccuggcggcugaacgcggagacgccggcuucuacacguguaaggccguuaacgaguauggggcuagacagugcgaggcccggcucgaagugcgcggagaguga

SEQ ID NO: 76166 - RNA, 1053 nt, Artificial Sequence
  derived and/or modified sequence opt5 from SPESP1__Homo_sapiens__NP_663633
augaagccccuggugcuccuggucgcccuucugcucuggccuagcuccguuccggcuuaccccucuaucaccgugacaccugacgaggaacagaaccugaaucacuauauucaagugcuugagaaccuggucagaagcgugcccuccggcgaaccugggcgggagaaaaagucuaauagccccaaacauguuuacuccaucgccucuaagggaagcaaauucaaggaacucgugacgcacggcgaugcguccaccgagaacgacguccugacaaauccuauuagcgaggaaaccacaaccuuuccgacagggggauucacccccgagaucggcaagaaaaagcauacggaaucuaccccuuuuugguccauuaaacccaacaaugugagcaucguucugcacgcugaggagccuuauaucgaaaacgaggaacccgagccggaaccugagcccgccgccaagcagacagaggcuccucgcaugcuccccguggucaccgaaucuuccacaagccccuacgugaccucuuauaaauccccugugacgacacuggauaagagcaccgggauuggaaucuccacagagucugaagacgucccgcagcuuagcggcgagaccgccauugaaaagcccgaggaguucggcaaacauccugaauccuggaauaacgaugacauccugaagaaaauucucgauaucaauagccagguucaacaggcucugcuuucugacaccuccaaccccgccuacagagaggauauugaagcgagcaaggaccaccugaaacggucucucgcccuggcugccgcugccgagcacaagcugaaaacaauguauaagagccagcuccugccuguggggcgcacguccaauaagaucgaugacaucgaaaccgugauuaacaugcuuugcaauucuagaagcaaacuguacgaguaccucgauaucaagugugugcccccggagaugcgggaaaaagcggccacagucuuuaacacccugaagaacaugugccgcuccagacggguuacagcucugcuuaaaguguauuga

SEQ ID NO: 76167 - RNA, 6993 nt, Artificial Sequence
  derived and/or modified sequence opt5 from SPG11__Homo_sapiens__NP_001153699
auggcugcugaagaaggcguggccagcgcggcuuccgccgggggaucuuggggcaccgccgcuauggggcggguccugcccaugcuccugguuccugugccggccgaggcuaugggacagcuuggcagccgggcccaacugcgcacacagcccgaagcgcucgggucccugacggccgcuggaucucuucaggugcugagccucaccccuggcuccagaggcgggggacggugcugucuggagggccccuucuggcacuuucugugggaagauucucgcaacagcuccaccccuaccgagaagcccaagcuccuggcccuuggggagaauuacgaacugcucaucuaugaguucaaccugaaggauggaagaugcgacgcuacaauucuuuacagcuguucucgggaagcccugcagaagcucaucgaugaccaagauauuuccaucagccugcugucucuccgcauucuguccuuucacaauaacaccagccuucuguucaucaauaagugcgucauccuccacauuaucuuuccugagagagacgcggccauucgggugcugaacuguuucacacuuccgcugcccgcucaggccguugauaugaucauugacacccagcucugccgcggcauccuguuugugcugucuucccucggguggauuuauaucuucgaugucguggacggaacguacguugcucacguggaucuggcccuucacaaggaggacauguguaaugaacagcaacaggagccugccaagaucagcuccuuuaccucucugaaggucagccaggaucucgacguggcugugauugucuccagcucuaacuccgcgguugcccugaaucuuaaccuguauuucagacagcaucccggccaccuccugugcgaacggauccuggaggaccucccuauucaaggccccaaagggguggaugaagacgauccggugaauagcgcuuacaacaugaagcuggccaaauuuucuuuccagaucgaccgcagcuggaaggcccagcuuuccucucugaaugagacaauuaaaaacagcaagcucgaggucuccuguugcgcuccuugguuucaagauauccugcaccuggaaagccccgagucuggaaaucauuccaccagcgugcagucuugggccuucaucccucaggacauuaugcacggccaguauaacguucuucaaaaggaucaugcgaaaacauccgaccccgggagaagcuggaagaucaugcacauuuccgaacaggaggaacccaucgagcucaaaugugugucugucaccggauucacggcucuguuuacaugggagguggaacggaugggcuacaccauuacacugugggaucucgagacccaggggaugcagugcuucagccugggaaccaagugcaucccuguugacuccucuggcgaucaacagcuuuguuuugugcugacagaaaacggccucagccugauccuguucgggcuuacgcaggaggaauuucucaaucgccugaugauucacggauccgccagcaccgucgacacacugugccaucucaacggcugggggagauguucuaucccgauucacgcccuggaggcuggaaucgagaaucggcagcuugacaccgugaacuucuuucugaaauccaaggaaaaucucuucaaccccagcucuaaauccagcgucucugaucaauuugaccaucugagcucccaccuguaccuuagaaauguggaggaacucauuccugcccuggaucugcucugcagcgcuauccgcgagucuuauuccgagccccagagcaagcauuucuccgaacagcugcuuaaccugacacucucuuuucugaauaaccagauuaaggagcuguucauccacaccgaagaacuugacgaacaccuccaaaaaggcguuaauauccugacgagcuacauuaacgagcugcggacauuuaugaucaaguucccuuggaaacucaccgaugccauugacgaguaugaugugcaugaaaauguccccaaggugaaagaguccaacaucuggaagaagcugucuuucgaagagguuauugcgagcgccauccuuaauaacaaaaucccggaagcucagaccuuuuucagaauugacucccacucugcccagaagcuggaggagcucaucgggauuggccugaaccugguguuugauaaucuuaaaaagaacaauaucaaagaagcuagcgagcugcucaagaacaugggauucgacgucaagggccaacugcucaaaauuuguuuuuacacaaccaauaagaacauccgcgauuuccugguggaaauccuuaaagagaagaauuauuuuuccgaaaaagagaagcggacaauugacuucgugcaucagguugagaagcuguaccucgggcacuuucaggaaaacaugcagauccagagcuucccuagauauuggauuaaagagcaggacuuuuucaagcacaaaucuguccuggacuccuuucugaaguacgacugcaaagaugaguucaauaagcaggaccaucgcaucgugcuuaacugggcccuguggugggaucagcucacgcaagagagcauucugcucccccggaucucuccugaggaauacaaauccuauagccccgaggcgcuguggagauaccuuaccgcccgccacgacuggcugaauaucauucucuggaucggagaguuccagacacagcauucuuaugcuucccugcagcaaaacaaguggccucugcuuaccguggaugucauuaaucagaacacaagcuguaauaacuacaugcggaacgagauccuggacaagcucgccagaaauggcguguuucuggcuuccgaacucgaggauuucgagugcuuucugcuucgccugagccggauugggggaguuauccaggacacccugcccgugcaaaacuauaaaacgaaggaaggcugggauuuccacucucaguuuauucucuacugucuggagcauagccuucagcaucugcucuaugucuaccuggacugcuacaaacucuccccggaaaauuguccuuuccuggagaagaaagaacuucacgaggcccaucccugguuugaguuccuggugcagugcagacaaguugccucuaaccugaccgaucccaagcucaucuuucaggcuagccuggcgaaugcccagauccuuauuccuacaaaccaggcuuccgugucuagcaugcugcucgaagggcacacccugcucgcccuggccacaaccauguauuccccgggcggagucucucaagugguucagaaugaggaaaacgagaauugccuuaagaaaguggacccccagcugcugaagauggcucucacgccuuaccccaaacugaagacagcccuuuucccucaguguacacccccuagcguccugcccuccgauaucacaauuuaucaucucauccaaagccugucuccguuugacccuuccagacucuucggcuggcagagcgcgaacacccuggcuauuggggacgccuggucucaccuuccccauuucuccagcccugaucuggugaauaaauacgccaucguggaacgccugaacuuugcuuauuaccuccacaauggaagacccuccuucgccuuuggcaccuuccugguccaggagcuuaucaagucuaagacaccgaaacagcugauucaacagguugggaacgaggcguaugugaucggacucagcuccuuucacauuccuagcaucggcgcugccugcguguguuuccuggaacugcucgggcuugacucucugaagcugcgggucgauaugaaaguggccaauauuauccucuccuacaagugcagaaacgaggacgcucaguacagcuuuauccgcgaaucuguugccgagaaacugagcaaacuugcugauggcgagaagacgaccacagaagaacugcucgugcugcuggaagagggaaccuggaacuccauucaacagcaggaaaucaaacggcucucuagcgaguccucuagccagugggcccuugucgugcaauucuguagacugcauaauaugaagcuguccauuagcuaucuccgcgagugcgcgaaagccaacgacuggcugcaguuuaucauucacucucagcuucauaauuaccaccccgcugaaguuaagucccugauccaguauuucagcccugugauucaagaucaccucagacuggccuuugagaaccugcccuccguccccacaucuaaaauggacagcgaucagguguguaauaagugcccucaggaacuccagggcuccaaacaagagaugaccgaccuuuucgaaauccugcugcaguguucugaggagccggauagcuggcauuggcuccugguugaagcugugaagcagcaagcccccauccuuuccguccuggccagcugccuccagggggcuucugcgauuuccugucugugcguguggaucauuacgagcguggaggacaacgucgccacagaagcuaugggacacauccaggacucuaccgaggaucauaccuggaaucuggaagaccucuccguuauuuggcggacacuucugacccgccaaaagagcaaaacacugaucagaggcuuucaacucuucuucaaggauucuccucugcuucuggugauggagauguacgagcucugcauguuuuuccggaacuauaaagaagccgaggccaagcugcuggaauuucagaaaagccucgagacgcuuaauaccgcugccacaaaggugcaccccgucaucccugcgauguggcuggaggaccagguguguuuccugcucaagcugaugcuucagcaaugcaaaacccaguacgaacuggggaagcuccugcagcuguuuguugagcgcgaacaucucuucuccgauggacccgacgugaagaaacuuuguauucugugccagauccugaaagauacaucuauugcuaucaaccacaccauuaucacgagcuauuccaucgagaaucuccaacacgaauguagaagcauucuggagcggcuucagaccgacggccaguuugcccuggcccgcagagucgcugagcucgccgaacugccuguggauaaccugguuaucaaagagauuacacaggaaaugcaaacccucaagcauaucgagcaguggucccuuaaacaggcgcggauugacuucuggaagaaaugccacgaaaauuuuaagaaaaacucuaucagcuccaaggcugccucuagcuucuuuuccacacaagcccauguggcuugugagcacccgaccggguggucuagcauggaggaacgccaucugcugcucacacuggccggccauuggcuugcucaggaggaugucgugccccuggacaagcucgaagaacuggaaaaacagauuuggcugugcagaaucacccagcacacgcucggacggaaucaagaggagacagaaccuagauucucccgccagaucagcaccucuggcgagcuuuccuuugauagccuggccucugaguucuccuucagcaagcuggcggcccucaacaccucuaaauaccuggagcuuaauucccugcccagcaaggagacaugugaaaaccggcucgacuggaaagagcaggaaucccugaacuuucugauugggagacuccuugacgauggaugcguccaugaggcuagccgcgugugucgguacuuccacuuuuauaauccugacguugcccuggugcugcauugcagagcucucgccucuggcgaagccagcauggaggaucugcaccccgagauccacgcccuucugcaguccgcggaacuccuggaggaagaggccccggacauuccucugcgccggguccauucuagacacaagcaaauguucaaccccaccgaagagagccagacguuucuccagcugacaacccuuugccaggaucgcacacugguggggaugaagcuccuggacaaaaucuccucuguuccccauggagagcuuagcuguaccacagaacugcucauucuggcucaccacugcuucacccugacgugucauauggagggcaucauccgggugcuccaagccgcccacaugcugaccgauaaucaucuugcuccuuccgaagaguacggccuggucgugagacuccugacagggauuggacgguauaacgaaaugaccuacaucuuugaccuucugcacaagaaacauuauuucgaggugcucaugcgcaagaaacuggaucccucuggcacacugaagaccgcccuccuggacuacauuaaaagaugccggccuggggauagcgagaagcacaauaugaucgcgcuuuguuuuuccaugugccgcgaaauuggagagaaccacgaagcugccgccagaauccagcugaagcucaucgagagccagccgugggaggacucucugaaagauggccaucaacuuaagcagcugcuccugaaagcucugacgcucaugcuggacgccgcggaauccuaugccaaggacagcuguguucggcaggcucagcacugccaaagacuuacaaaacugauuacccuccagauccauuuccugaauacagggcagaacaccaugcuuauuaaucugggacgccacaagcucauggauuguauccuggcccugccccgguuuuaccaggcuucuauugucgccgaggcuuacgacuucgugccugauugggccgaaauccucuaucaacaggugauucugaagggcgacuuuaacuaccuugaggaguucaaacagcagagacugcucaaguccagcaucuucgaggagaucuccaaaaaguauaaacaacaucagcccaccgauauggucauggaaaaucugaagaaacuucugacauacugcgaggacguguaucucuacuauaaacuggcguacgaacacaaguuuuacgagauuguuaacgugcugcucaaagauccucagacgggcuguugccugaaggacaugcuugccggguga

SEQ ID NO: 76168 - RNA, 2001 nt, Artificial Sequence
  derived and/or modified sequence opt5 from SPG20__Homo_sapiens__NP_055902
auggagcaggaaccccaaaacggcgagccugccgaaaucaagauuaucagagaggcuuacaaaaaggccuuccuguuugugaauaaagggcucaacaccgacgaacugggacagaaggaggaggcgaaaaauuauuacaagcagggcauugggcaccuucugcggggaaucagcauuuccucuaaggaaagcgagcauacaggcccggggugggaauccgcucgccagaugcaacagaaaaugaaggagacgcuccagaacgucagaacccggcuggagauccuugaaaaaggacuggccacaucucuccagaaugaucugcaagagguucccaagcuguauccugaauuucccccuaaagacaugugcgagaagcuccccgaaccucagagcuucuccucugccccgcagcacgcugaggugaacggcaauaccagcacacccuccgccggcgcuguggccgcgccugccagccugucucuucccucccagagcuguccugcugaggcucccccggccuacaccccucaagccgcggaagggcauuauacagucucuuacggaaccgauuccggcgaguucagcucugugggggaagaguuuuaucgcaaccacucccagcccccuccccuggaaacgcucggacuggacgccgaugagcuuauccugauucccaauggcguucagaucuucuuugugaacccugcuggggaggucagcgccccguccuaccccggauaccucagaauugugcgguuccuggacaauucucuggauaccguucucaaccgcccucccggcuuucugcaagugugcgacuggcuuuauccucugguccccgauagaagcccggugcucaaguguacagcuggcgccuacauguucccugacaccaugcugcaggccgcugggugcuuugugggagucguucuuuccagcgaacugcccgaggaugaccgggaacucuucgaggaucugcugcgccagaugucugaccucagacugcaggcgaauuggaaccgggccgaagaggagaaugaauuucaaaucccuggccgcacaagacccuccagcgaccagcuuaaagaggcuucugggaccgaugugaagcagcuggaccagggaaacaaagaugugcggcauaagggcaaacgcgggaagagagccaaagacacgagcuccgaagaggucaaccucucucacauugugccuugugagcccguuccggaagagaagccuaaggaacugcccgaguggagcgaaaaaguggcccacaauauccuuuccggagcuagcugggucucuuggggccuggugaagggcgccgagauuacagggaaagcgauccaaaagggagcuuccaaacuccgggagagaauccagcccgaagagaagccuguugaagugagcccggccgucaccaagggccuguauauugccaaacaggcuacagggggagccgcuaaggugucucaguuccuggucgauggcgugugcaccguugccaacuguguggggaaagagcucgcgccccaugucaagaaacacggcuccaagcuggugccugaaagccuuaagaaagacaaggauggaaaaucuccccuggacggcgccaugguuguggcugccuccagcguccaaggguucuccaccguguggcagggacucgagugcgcugccaaguguaucgugaauaacguuucugcggagacaguccagacggugcgcuacaaauauggcuacaaugccggggaagcuacccaucacgccguggauagcgcugucaacgugggaguuacagccuauaauauuaacaauaucggcauuaaggccauggugaagaaaaccgcuacacagaccgggcacacgcugcuggaggacuaccaaaucgucgauaacucccagcgggaaaaucaggagggcgcggccaacgugaauguuagaggagaaaaggacgagcaaacaaaagaggugaaggaagcuaaaaagaaagacaaguga

SEQ ID NO: 76169 - RNA, 846 nt, Artificial Sequence
  derived and/or modified sequence opt5 from SPG21__Homo_sapiens__NP_001121362
augggcgagaucaaggugagccccgacuacaacugguucagagggaccgucccucugaaaaagauuaucguugaugacgaugacuccaaaauuuggucucucuaugaugccggaccgcggagcauccgcugcccccugauuuuucuuccucccguguccggcacagcugacguguucuuuagacagauccuggcccucacgggguggggauaccgggucaucgcggugcaccuguucggcgcuucucuugggggauuucuggcccaaaaguucgccgaauauacccauaaaagcccucgcguucacucccucauucuguguaauucuuuuagcgauacauccaucuucaaccagaccuggacagcuaauagcuuuuggcugaugcccgccuucaugcucaagaagauugugcugggcaacuuuucuuccggcccugucgacccgaugauggcugaugccaucgacuucaugguggauagacuugagagccuggggcagucugaacucgcgucccggcugacccuuaauugccagaacagcuacguugagccccauaaaauucgcgacaucccugugacaauuauggaugucuuugaccaaucugcccuguccaccgaagcuaaggaggagauguauaaacucuaccccaaugccagacgggcucaccugaagacgggaggcaacuucccuuaucugugucgcagcgccgaagugaaucucuacgugcagauccaucugcuucaguuccacgggaccaaauacgcggccaucgaccccuccauggucucugcugaggaacuggagguucagaagggaagccucggcauuucccaagaggaacaguga

SEQ ID NO: 76170 - RNA, 2388 nt, Artificial Sequence
  derived and/or modified sequence opt5 from SPG7__Homo_sapiens__NP_003110
auggccgugcugcuccugcuucugagagcucuccggcgcggccccgggccuggaccgagaccccuguggggcccugggcccgccuggagcccuggauuccccgcgcggccuggccgcgggagaccguacauggcuucccggcccccuggagaccuugccgaggccggcggccgcgcucugcagucucuccaacugagacugcucacccccacauuugaagggaucaacggacugcuucugaagcagcaccucguccagaauccuguucggcuguggcagcuucugggcgggacguucuauuuuaacaccagccgccucaaacaaaagaauaaagagaaggauaaauccaagggaaaggcccccgaagaggacgaagaggagagacggcgcagagaacgggaugaccagauguaccgcgagagacugcggacacugcucgugauugcuguggucaugucucugcuuaacgcccugagcaccuccggcgggucuaucagcuggaaugauuucgugcaugaaaugcucgcgaaaggagagguucagagagugcaggucgugccggaguccgacguuguggaagucuaucugcacccuggcgccgugguguuuggccgcccccggcuugcucugauguacagaaugcaagucgccaacauugauaaguucgaggaaaaacuccgcgcugccgaggacgaacugaauaucgaggcgaaggaucggauuccuguuagcuauaaaagaacaggguuuuucggaaacgcccuguacucugugggcaugaccgcuguggggcucgccauccugugguaugucuuucgccuugcuggaaugacaggccgggagggaggauucuccgccuuuaaucagcugaagauggccagauucaccaucguggacggcaagaugggcaaagggguuagcuuuaaggauguggcuggaaugcaugaagcgaaacucgagguccgcgaguucguggacuaccugaagucucccgagcgguuccuucagcugggcgccaaaguucccaagggggcucuccugcugggaccuccgggcugcgggaaaacgcuccuggccaaggccguggcuaccgaagcccagguccccuuucuugcgauggcuggcccugaguucguggaggucauuggaggccugggggccgccagagugcgcucccucuuuaaggaagcucgggccagagcucccuguaucguuuacauugaugagaucgacgccguggggaaaaagcggagcacaaccaugucuggcuucuccaacacagaagaggaacaaacccugaaucagcugcuugucgagauggacgggaugggaacgacagaucacgugauuguucucgcgagcaccaaccgcgccgacauccuggauggcgcucugaugagaccugggcggcucgacagacauguguuuauugaucugcccacacuucaggagcgccgggaaaucuucgagcaacaccugaaaucccucaagcugacccagucuagcaccuuuuauucccagagacuggccgaacuuacaccgggcuucagcggagcugacaucgccaauauuugcaacgaggcggcccuccacgcugcccgcgagggccauacgucuguccacacccugaauuuugaauacgcuguggagagagugcuggccgggacagccaaaaaguccaagauccucagcaaagaagaacagaagguugucgcuuuccaugaaucuggacacgcgcuggugggcuggaugcuugagcacaccgaggccgugaugaaagucagcauuacaccucggaccaacgcugcccugggguuugcccaaaugcucccccgcgaucagcaucuguucacgaaggaacagcuguuugagagaauguguauggcucuuggaggccgggccuccgaagcgcucucuuucaacgaggugacaagcggggcucaggacgaucugcgcaaaguuaccagaaucgccuauuccauggugaagcaauucggcauggccccuggaauuggccccaucagcuuuccugaagcucaggaggggcugaugggaaucggccggcgccccuucucucaggggcuccagcaaaugauggaccacgaggccagacugcuugucgcgaaggcuuaccggcauaccgaaaaagugcugcaggauaaucucgacaagcugcaggcccuggccaacgcccuucucgagaaagaaguuauuaauuaugaggacaucgaagcucugauuggaccgccuccccacggccccaagaaaaugaucgcuccucagcgcuggauugaugcccaaagagagaagcaggaccugggggaggaagagacagaagagacccagcaaccgccccucggcggagaggaaccuacauggcccaaguga

SEQ ID NO: 76171 - RNA, 1197 nt, Artificial Sequence
  derived and/or modified sequence opt5 from SPHK1__Homo_sapiens__NP_068807
auggaccccguggucggcugcgggagaggacuguucggcuuuguuuucagcgccgggggaccucggggcgugcucccgcgccccuguagagugcugguccuucugaacccucgcgggggaaagggcaaagcucuccagcuguuucggucccacgugcaaccccuucuggccgaggcggaaaucucuuucacccucaugcugacagagagacggaaucaugcucgcgaacugguuagaagcgaggaacucggccggugggaugcccugguggucauguccggggacggacuuaugcacgaggugguuaacggccugauggagcgcccugauugggaaacggccauucagaagccccucugcucucugccugcugggagcggaaaugcccuugcugccucccugaaccauuacgcgggcuaugaacaggugaccaaugaggaccuccugacaaacuguacccugcuccugugcagacggcuucugucuccgaugaaucuccugagccuucacacagccuccgggcugcgccucuuuagcguccugucucuggcuuggggauucaucgccgauguggaccucgaguccgagaaauacagacggcugggcgaaaugcgcuuuacccuuggcacauuccugagacucgcugcccugcggaccuauagagggcgccuugcguaccugcccgugggacgggucggcagcaagacgccugccucucccguuguggugcagcaagggccugucgaugcucaucucgugccccuggaggaaccgguuccuucccacuggaccgugguccccgacgaggauuuugugcugguucucgcccugcuucacagccaucugggaucugaaauguucgcugccccuaugggcagaugugccgcuggggugaugcaccucuuuuauguccgcgcgggagugucccgggccaugcugcugagacuuuuccucgcuauggagaaaggccgccauauggaguacgaaugccccuaucuggucuacgugcccguuguggccuuucggcuggagccuaaggacggcaagggggucuucgccguggauggagaacucaugguuagcgaggcugugcagggccagguccacccgaacuacuucuggaugguguccggguguguggaacccccucccucuuggaaaccucagcaaaugcccccgccugaggagccccuguga

SEQ ID NO: 76172 - RNA, 1788 nt, Artificial Sequence
  derived and/or modified sequence opt5 from SPHK2__Homo_sapiens__NP_001191087
augaacggccaccuggaggccgaggaacagcaagaccaggcucuccauauccagagacugcggcccaagccugaagcccgcccgagagggggacuugugccccuggcggaggucagcggcugcuguacccuccggucccgcucuccuagcgauuccgcugccuacuucugcauuuauacauaccccagagggcggcgcggagccagacggcgcgcuacgagaaccuuucgggccgacggcgcugccacauaugaagagaaucgcgcggaggcccagagaugggcuaccgcccugacaugucuucugcgggggcucccucugcccggagauggcgaaaucaccccugaccugcucccgcggcccccuagacugcuucugcucguuaaccccuucggcgggcggggacuggcuuggcaauggugcaaaaaucacgugcuuccuaugauuucugaggccggccugagcuuuaaccucauccagacagaaagacagaaucaugcgcgcgagcuggugcaggggcugucccucucugagugggauggaauugucaccgugagcggcgacgggcugcuucacgaaguucugaacggacuccuggaucggcccgacugggaggaagccgugaagaugccggucggcauccuuccuuguggcuccgggaaugcucuggccggagcugugaaccaacauggcggguucgagcccgcccucggacuggaucugcuccugaauugcagccuucugcucuguagaggcgggggacacccucuggaccuucugucuguuacgcucgccuccggcagccgcugcuuuucuuuccuguccguggcuuggggcuuugucagcgauguggacauccagucugaacgguucagagcgcugggguccgcccgcuuuacccucggaacagugcugggccuugcuacccugcacacauaccgggggagacucagcuaucugcccgccaccgucgagcccgccuccccuacgccggcucauucucugccccgcgccaaaagcgagcuuacacucaccccugaucccgcgccucccauggcucacuccccgcugcaucggagcguuucugaccugccucucccccugccucagcccgcccuugccuccccuggaagccccgaaccgcugccuauucucucucugaacggcgggggccccgagcuggcuggagacuggggcggggccggagaugcuccccuuagcccugacccgcuccuguccucucccccuggcagccccaaggccgcgcugcacuccccugugagcgaaggggcccccgugaucccucccucuuccggacucccgcugccuacacccgaugcuagagucggcgccagcaccugugggccucccgaccaccuucugccgccucucggcacaccccugccucccgauugggugacccuggagggagacuucguucuuaugcucgcuauuucucccucccaucugggcgccgaucugguggcggccccucacgcucgcuuugacgaugggcucguccaucugugcugggugcggagcggaaucuccagagccgcccuucugcgccucuuccuggcuauggaacgcggcucucacuuuagccugggguguccgcagcuuggauacgccgcugcgagagccuuccggcucgagccccugacgccuagaggcguucugaccguggacggggagcaagucgaauauggcccccuccaggcucagaugcauccuggaauuggcacacugcuuaccgggcccccuggaugcccgggccgcgagcccuga

SEQ ID NO: 76173 - RNA, 5103 nt, Artificial Sequence
  derived and/or modified sequence opt5 from SPHKAP__Homo_sapiens__NP_001136116
auggacggcaacagccugcucuccgugcccucuaaucuggaaagcuccagaauguacgauguccuugaaccucagcaagggcggggcugcggcucuagcggguccggacccggcaacucuaucaccgccuguaagaaaguucugcgcagcaauucccuccuggagagcacagacuauuggcuucagaaccagagaaugcccugccagauuggguucguggaagauaagucugagaauugugcuuccgugugcuuugucaaccuggacgugaauaaagaugaauguagcacggagcaccuccaacagaagcugguuaacgugucuccugaccugcccaaacucaucuccagcaugaauguccagcagccuaaggagaacgaaauugugguucugucuggacuugccuccggcaaucugcaagcggauuucgaggugagccagugccccuggcucccugacaucugucugguccagugcgcucggggcaaccgccccaauuccaccaacuguauuaucuuugaaaucaauaaguuccuuauugggcuggagcucgugcaggagagacaacugcaucuggaaacaaacauccucaaacuggaggaugacaccaacugcucucuuagcuccauugaagaggauuuucugacagccagcgaacaccucgaggaggaaucugagguggacgaaucccggaaugauuacgagaacaucaaugucagcgccaacguucuggaaucuaagcagcuuaaaggagcuacccagguggaguggaauuguaacaaggagaaauggcuguaugcccucgaagacaaguacauuaauaaguaucccacaccucugaucaaaaccgagcgcagccccgaaaaccugacgaagaauaccgcucuccaaucccuggacccuucugccaaacccagccaguggaagagagaggcggugggcaacgggcggcaggccacacauuacuaucacuccgaggcuuucaaaggacagauggaaaagagccaagcccuuuacauuccgaaagaugcuuacuuuucuaugauggacaaggaugucccuuccgccugcgcgguggccgagcagcgcagcaaucugaaccccggcgaccaugaagauaccagaaaugcucucccuccccggcaggacggggagguuacaaccggaaaguaugccacgaaccuggcugaaucugugcuucaggaugccuucauccgccugucccaaagccaguccacacucccccaggagucugccgucagcguguccguuggcucuagccugcugccuuccugcuacagcaccaaagacacaguggucucuagauccuggaaugagcucccgaagaucguggucgugcagagccccgauggcucugacgcugcgccucaacccgggauuuccagcuggccugaaauggagguuucuguggaaaccagcuccauccugagcggagagaacucuucccggcagccccagagcgcccuugaagucgcucuggccugugccgcuaccgugauuggcacaaucuccucuccgcaggccacggagcgccucaaaauggagcaaguugugagcaacuuuccucccggguccucuggagcgcugcagacccaggcuccucaaggccugaaggaacccagcauuaaugaguauuccuucccuucugcccuuugcgggaugacacaggucgccagcgcuguggccguguguggacucggcgaaagagaggaaguuaccugcuccgucgcucccagcggcucucugccgccugccgcggaggccuccgaggcuaugccgccccugugugggcucgccagcauggaacugggaaaagaggcuaucgccaagggccuucugaaggaagcggcccucgugcugacacggccuaacaccuacucuuccaucggggauuuucuggacagcaugaauagacgcauuauggagacggcuucuaaaucccagacacuuugcagcgaaaacgugguccggaaugagcucgcccacacccuguccaacgugauccugagacacagcauugacgagguucaucacaagaauaugaucauugauccgaacgacaaucgccauucuagcgaaauccucgauacccugauggaguccacaaaccagcuucugcucgacgugaucuguuucaccuuuaaaaagaugucucacauuguccggcugggagaaugccccgcugugcugagcaaagagacaaucagacgccgggagacggaaccuuccugucaacccucugauccuggcgccagccaggccuggaccaaggcuacagaguccucuagcuccagcccccuuucuaauucccacaacaccagccucguuauuaauaaccugguggacgggauguauucuaagcaggauaaaggcggagucagaccuggccuguucaagaaucccacacuccagucccaacugagccgcucccaucgggugccggacucuagcaccgcgacgaccuccagcaaagaaaucuaccuuaaggggauugccggagaggauacaaaaucuccucaccauuccgaaaacgagugcagagcuagcucugagggccagcgcagccccaccguuucccagucucggagcgggucccaggaagccgaggaaucuauccacccuaacacacaagagaaguauaauugugccaccagcagaauuaacgaagugcaggucaaucugucccuccugggagacgaucugcuucuccccgcucagagcacgcugcaaacaaagcauccggacaucuacugcaucaccgauuucgccgaggagcuggcggacacaguggugucuauggcuaccgaaauugccgccaucugccucgacaacuccagcggcaaacagccuugguuuugugcuuggaagcggggguccgaguuccugaugacccccaaugucccuugccgcucucuuaaaagaaagaaagaaagccagggcuccggaacagccguucggaagcacaaaccucccagacugucugagauuaagcgcaagacggaugaacaccccgagcucaaagagaagcugaugaaccgggugguggacgaaagcaugaaucuggaggaugucccggacuccgugaaccuuuuugcgaaugaaguugcugccaaaaucaugaaccugaccgaguucagcaugguggauggcauguggcaggcccaaggguaccccagaaaucgccuccugucuggagacagauggucccggcucaaggcuagcucuugugaguccauuccugaagaggauagcgaagcccgcgcuuaugucaacucucugggccuuaugagcacacugucccagcccgugucuagagccagcuccguuagcaaacaguccucuugcgagagcaucaccgacgaauuuucccgguucauggugaaucagauggagaacgaggggcgcggauuugaacuccugcuggauuacuaugcgggcaagaaugccucuagcauccuuaacuccgcuaugcaacaggccuguagaaagucugaccaucugagcguccggccuuccugccccagcaaacagucuuccacagagagcauuaccgaagaguucuaccgcuauaugcucagagauaucgaacgggacucucgcgaguccgcuagcucuagacgguccagccaggauuggacggccgggcugcucuccccuagccugagaucuccggugugucaccgccaaagcuccaugcccgacucucggagcccuugcuccagacuuacaguuaacgugcccauuaaggccaauucucuggacggcuuugcucagaacuguccucaggauuuccucagcguccagcccguguccucugcgagcuccagcggacugugcaaaucugacuccugucuguaccgccggggcgggaccgaucauaucaccaauaugcuuauucacgagacaugggccagcucuaucgaagcucugaugagaaagaacaaaaucauuguggacgaugccgaggaagccgacaccgagccggucuccggaggcagcccuucccaagcugaaaagugcgccaaucgccucgcggcuucucggaugugcagcgggcccacacugcucguucaggagucccuggauugucccagaaaggacagcgugacggagugcaaacagccucccgugucuucccuuagcaagaccgccucucugacaaaccacagcccucuggauuccaaaaaggaaaccucuagcugucaagacccgguccccaucaaucauaaacgccggucccucugcucuagagaggugccucugauucagaucgaaacagaucagcgggaggccugugcuggagagcccgaaccuuuucuuagcaaguccagccugcucgaggaagccgagggccacucuaacgacaagaauauucccgacguugugcgcgggggcgauaccgcggucuccgcuugccagauccauagcgacucccuggauacgagagacgugccggaagccgaggccucuaccgaggcucgggccccugaugaagcucccaacccucccagcuccucugaggaaagcacaggauccuggacccaacucgccaaugaggaagacaacccugaugacacaagcucuuuccugcagcuuuccgagcgcagcaugucuaauggcaacuccagcgcgaccucuucccuggggaucauggaucuggacauuuaucaggagagcaugcccucuagcccgaugaucaaugaacucguugaggagaaaaagauucugaaaggacaguccgagagcacagaagccccugcuuccggaccgcccaccgggacggccucuccucaaagaagccuucuggugaucaacuuugaucucgagccggagugucccgacgcugaacugcgggccacacuccaguggauugccgcuuccgagcugggaaucccuaccauuuacuucaagaaaucucaggaaaauagaaucgagaaguuccuugaugucgugcagcugguccaccgcaaaagcuggaaggugggcgacaucuuucaugcgguugugcaauacugcaagaugcacgaggaacagaaagacggccggcugucccucuucgauuggcugcuugagcugggguga

SEQ ID NO: 76174 - RNA, 816 nt, Artificial Sequence
  derived and/or modified sequence opt5 from SPI1__Homo_sapiens__NP_001074016
augcugcaggccugcaagauggagggcuucccccucgugccuccgcaacccagcgaagaccuggucccuuacgauaccgaccuuuaucagagacagacacacgaguacuaucccuaccuguccucugauggggaaagccauuccgaccacuauugggauuuucauccucaccauguucacucugaguucgagagcuuugcugaaaacaauuucacggagcuccaguccgugcaacccccucagcugcagcagcuuuaccggcacauggaacuggagcaaaugcaugugcucgacaccccgauggugcccccucaccccucucugggacaucaggucagcuaucugccucgcaugugucuccaguaccccucccugagcccggcccagccuucuuccgaugaagaggagggcgaaagacaaucucccccucuugagguuagcgacggggaagcggauggacuggagcccggccccgggcuccugccuggagaaacaggcuccaaaaagaaaauccggcuuuaccaguuucugcucgaccugcugcgcagcggcgauaugaaggacucuauuugguggguggauaaagacaaggggaccuuccaguuuuccagcaagcacaaagaggcucucgcccacagauggggaauccaaaagggcaaccggaaaaagaugacauaucagaaaauggcccgcgcucugagaaauuacgggaagaccggagaggucaagaaagugaagaaaaagcugacauaucaguucuccggcgaaguucuugggcggggaggccucgccgagcgcagacauccgccccacuga

SEQ ID NO: 76175 - RNA, 516 nt, Artificial Sequence
  derived and/or modified sequence opt5 from SPIB__Homo_sapiens__NP_001230927
auggccagcuccaugaccuggacagcugccucuauccccgcgacgcugauucagagaggccuccugacccuugugccuccggcuuacgcccccuauccuagccccguccuguccgaggaagaggaccucccucuggauucucccgcccuugaaguuagcgacuccgagucugaugaagcucugguggccgggccugagggaaagggcagcgaggcugggacacggaaaaagcuccgccuguaccaauuccugcucggacugcuuaccagaggcgacaugcgggaaugcguguggugggucgagccgggggccggaguguuucaguucuccagcaaacacaaggaacugcucgcgcgcagauggggccagcagaaaggcaaccggaagcgcaugacauaucaaaagcuggccagagcccuucggaauuacgcuaaaaccggggagauccgcaagguuaaaagaaagcugacauaucaguuugauucugcucuccugcccgccgugcggcgcgcguga

SEQ ID NO: 76176 - RNA, 747 nt, Artificial Sequence
  derived and/or modified sequence opt5 from SPIC__Homo_sapiens__NP_689536
augaccugcguggagcaggacaagcugggccaagccuucgaagaugcuuuugagguccucagacagcacagcacaggggaccugcaguacucccccgauuaucggaacuaccuugcccugaucaaucaucgcccucacguuaaaggaaacucuagcuguuauggcgugcucccgacggaggaacccguguacaauuggagaaccgucauuaacuccgcggcugacuucuauuuugaagggaauauccaucagucucugcaaaacauuacagagaaucagcuugugcagccuacccugcuccagcaaaagggaggcaaagggcggaagaaacugcgccuguucgaguaccuccacgaaagccuguauaaccccgagauggccuccugcauccaguggguugauaagacaaagggaauuuuucaguucgugucuaaaaauaaggaaaaacuugccgagcuguggggcaagagaaaaggcaaccggaagaccaugacauaccagaagauggcucgcgcccucagaaauuacgggcggagcggagagaucaccaaaauccgcagaaagcugacguaucaauuuuccgaagcuauucuucagcggcugagcccuucuuacuuccucggcaaagagaucuuuuauucccaguguguccaacccgaccaggaauaccugagccugaacaauuggaacgccaauuauaacuacaccuaugcgaacuaccaugagcucaaucaccacgauugcuga

SEQ ID NO: 76177 - RNA, 2748 nt, Artificial Sequence
  derived and/or modified sequence opt5 from SPIDR__Homo_sapiens__NP_001073863
augcccagaggcagccgggcccgcggguccaagagaaaacggucuuggaacaccgagugcccuagcuucccgggagaacgcccccuucaggugagacgggcuggccuccgcacagccggggcggcugccucccugucugaggccuggcuuagauguggagaaggcuuucaaaauacgagcgggaacccuucccugaccgcugaggaaaagacaaucaccgagaaacaccucgagcugugcccccggccuaagcaggaaacaaccacaucuaaaagcaccuccggacuuacggacauuaccugguccucuuccggcagcgaucugucugacgaggauaagacacucucccagcugcagcgcgacgaacugcaauucaucgauugggagauugacagcgauagagccgaggcuucugacugugaugaauuugaggacgaugaaggcgccgucgagaucuccgacugcgcgagcugugccuccaaucagucucucaccagcgaugaaaagcuguccgagcuucccaaaccuagcucuauugagauccuggaauacuccagcgacucugagaaggaagacgaucucgagaacguucugcuuaucgacagcgaauccccgcauaaauaucacgugcaguucgcuucugaugcccggcagauuauggagcgccugaucgaccccagaacaaagagcaccgagacgauucuccauacaccucaaaaacccaccgcuaaguuuccucggacacccgaaaauuccgccaagaaaaagcugcugcgcgggggacucgcggagagacugaacggccuucagaaucgggaaagaagcgccaucucucuguggcgccaccagugcauuuccuaccagaaaacccucagcgggcggaagucuggagugcugaccgucaaaauccuugagcugcaugaagagugugcuaugcaaguggccaugugcgagcagcuccugggcuccccggcuacaagcuccucucagagcguugccccuagacccggggccggacugaagguccucuucacgaaagaaaccgcuggcuaucugcgcggccggccucaagauacagugagaauuuuuccucccuggcagaagcugaucauccccuccgggucuuguccggugauucugaacaccuacuucugcgagaagguuguggcgaaagaagacagcgagaagacaugugaggucuauugccccgauaucccucucccccgccgguccauuagccuggcccagauguuugugaucaaaggacuuaccaauaacucuccugaaauucagguggucugcuccggcguugcuacgacagggaccgccuggacccacggacacaaggaggccaaacaaagaauccccacaagcaccccgcugcgcgacucucuccuggaugugguggaaucccagggcgcugccagcuggccuggggcgggaguccgggugguugugcagagagucuacucucugcccagccgcgacuccacacggggccagcaaggcgcuagcucugggcauacggauccugccggaaccagagccugucuccuggugcaggacgcuugcggcauguucggggagguucaccuugaauuuacaauguccaaggcccggcagcuggagggaaagagcuguucccucgugggcaugaaaguccugcagaaggugacccgcgggagaacagcuggcaucuucucucugauugacacccuuuggcccccugccaucccccucaaaacgccgggacgggaucaaccuugcgaggaaauuaagacccaucugcccccucccgcgcuguguuauauccucacagcccacccgaaucugggccagauugacaucaucgaugaggaccccauuuacaaacuuuaccagccucccgucaccagaugccugcgcgauauccuccagaugaacgaccuggggacacgguguagcuuuuaugcuaccgugauuuaccaaaagccucagcugaagucccuucuccugcuggaacagagagagaucuggcuccugguuacggaugugacacuucaaaccaaagaggaacgcgaccccagacugccuaagacacuccuggucuauguggcuccccugugcguucuuggaucugaggugcucgaagcccuggccggcgcggccccgcacagccuguucuucaaagaugcucuccgggaccaggggcgcauugucugugccgagagaaccgugcugcuucugcagaagccucuccuguccgugguuucuggagcuagcuccugcgaacugcccggcccugucaugcuugauagccucgacucugccacccccgugaauagcaucuguagcgugcaggggacagucgugggcguugaugagucuacggccuuuuccuggccggugugcgacaugugcggaaacggccggcuggaacaacgcccugaggacagaggggcuuucagcuguggagauugcucucgggucgugaccucccccguucugaaacgccaucuccagguguuucuggacuguagaagccggccucagugccgcgucaaggugaaacuucugcagagauccauuagcucucuccugcgguucgcggccggcgaggaugggagcuacgaaguuaaguccgugcugggaaaggaggucggccuucugaauuguuuugugcaaucugugacagcucaccccaccagcugcaucgggcucgaagagaucgagcugcucuccgccggcggagccucugcugaacauuga

SEQ ID NO: 76178 - RNA, 789 nt, Artificial Sequence
  derived and/or modified sequence opt5 from SPIN1__Homo_sapiens__NP_006708
augaagacccccuucggcaaaacaccugggcagagaagccgggccgacgcuggacacgccggcguguccgcgaacaugaugaagaaacgcacgucucauaagaaacacagaagcuccgucgggccgucuaagcccguuagccaaccucggcgcaauaucgugggaugccggauucagcauggcuggaaggaggggaacggacccgugacccaguggaaaggcacaguccuggaucaggugccuguuaaucccucccucuaccugaucaaguaugacggcuuugauuguguguacgggcuugaacugaacaaagacgagagagucucugcucucgaagugcugccugaucgcguugccaccagcagaauuuccgacgcccaccuugcugauacaaugaucggaaaggccguggagcauauguucgaaaccgaggacggcagcaaagaugaguggcgggggaugguccuggcucgcgccccggugaugaauacaugguuuuauauuaccuacgaaaaggaccccgugcucuauauguaccaacugcuggaugacuauaaggagggagaucucagaaucaugccugacucuaacgacuccccucccgcggaacgggagcccggcgaggucguugauagccugguggggaaacagguggaauacgccaaggaggacggaucuaaacgcacgggcauggucauccaccagguggaagcuaagccguccguuuacuucauuaaauuugaugacgauuuccacaucuauguguacgaccuugucaagaccagcuga

SEQ ID NO: 76179 - RNA, 777 nt, Artificial Sequence
  derived and/or modified sequence opt5 from SPIN2A__Homo_sapiens__NP_061876
augaagacccccaacgcccaggaggcugaaggccaacagacaagagccgcggcugggcgggccacgggaagcgccaauaugaccaaaaagaaagugucccagaagaaacagcgcggcagaccuucuagccaaccgcggcgcaacaucgucgggugcagaauuucccacggauggaaggagggcgacgaacccaucacacaguggaaggggaccguucuggaucaggugccuauuaaucccucucucuaccuggugaaauaugacggaaucgauugugucuacggccuugagcugcaucgggacgaacgcgugcucagccugaagauucuuuccgauagaguugcuucuagccacaucuccgacgccaaccuggcuaauacaaucauuggcaaagccguggagcauauguucgagggggaacacggaagcaaggaugaguggcggggcaugguccucgcgcaggccccuaucaugaaggcuugguuuuauauuaccuacgaaaaagaccccgugcuguauauguaccaacugcucgaugacuauaaggagggggaucugcgcaucaugccugagucuuccgaaagcccgcccacagagagagaaccuggaggcguuguggacgggcuuauuggaaaacaugucgaguacaccaaggaagauggcucuaaacggaucggcauggugauucaccagguggagacgaagcccuccgucuacuucaucaaauuugacgacgauuuccacaucuauguuuacgaccuggugaagaaaagcuga

SEQ ID NO: 76180 - RNA, 240 nt, Artificial Sequence
  derived and/or modified sequence opt5 from SPINK1__Homo_sapiens__NP_003113
augaaggugaccggcaucuuccugcucagcgcccuggcccuucugucccucucugggaacacaggagcugacagccugggcagagaggcgaaaugcuacaaugaacuuaacggguguacgaagauuuaugaucccgucugcggaaccgacggcaauacauacccuaacgaguguguucugugcuuugaaaaucggaaacgccagaccuccauccucauucaaaagucugggccguguuga

SEQ ID NO: 76181 - RNA, 405 nt, Artificial Sequence
  derived and/or modified sequence opt5 from SPINK2__Homo_sapiens__NP_001258647
auggcccugagcgugcucagacuggcccuucugcuccuggcugucaccuucgcgggcuccgcucggucugggcccggagagcgcggcccuccggaaaagagcggguuuggaucccagacaggcgggggacccugcccugcccccggcggccuuggggacggaacgagagccccuguuaccggcgggucucccgaggaucugccugcuagccucaucccgcaauucggacuguuuuccaaauaccggacacccaacuguucucaguaucgccugccuggcugccccagacacuucaauccugugugugggagcgacauguccaccuacgccaacgaaugcacacucuguaugaagauucgggagggaggccauaauaucaaaauuauccgcaacggccccugcuga

SEQ ID NO: 76182 - RNA, 261 nt, Artificial Sequence
  derived and/or modified sequence opt5 from SPINK4__Homo_sapiens__NP_055286
auggccgugagacagugggucaucgcucuggcccucgcggcucugcuuguuguggaccgggaggugcccgucgccgccggcaagcugccuuucagccgcaugccgauuugcgaacacaugguggagucccccaccuguucucaaaugagcaaccucguuugcgggacagauggacugacguacaccaaugaaugucagcuuugccuggcuagaaucaaaacaaagcaggacauucagaucaugaaagauggcaaguguuga

SEQ ID NO: 76183 - RNA, 3285 nt, Artificial Sequence
  derived and/or modified sequence opt5 from SPINK5__Homo_sapiens__NP_001121170
augaagaucgccaccgugagcguccugcucccccuggcucuuugccugauucaggacgccgcguccaaaaacgaggaucaagaaaugugucacgaguuccaggcuuuuaugaagaauggcaaacucuucugcccucaggacaagaaauuuuuccagucucuggaugggaucauguuuauuaacaagugugccacaugcaagaugauccuugaaaaagaggccaagagccaaaaacgggcucggcaucuggcccgcgcuccgaaggccacggcgcccaccgaacucaauugugacgauuucaaaaagggagagagagacggcgauuuuauuugcccugacuacuaugaggccguuugugggacagauggaaagaccuacgacaaccggugcgcucugugugccgaaaaugcuaaaacaggcucccagaucggggugaagucugagggagaaugcaaaagcuccaaccccgagcaggauguguguucugccuuccgcccuuuugucagagacggccggcugggcugcacccgcgagaaugaucccgugcucgggccugacggaaagacacacggcaacaaaugcgcgaugugugccgaacuguuccuuaaggaggcugaaaaugccaaaagagagggggaaacccggauccgcagaaacgcugagaaggacuuuugcaaggaguaugaaaaacagguucggaauggacgccuguucuguacgagagagagcgauccggugcggggccccgacgggcgcaugcauggaaacaagugcgcccucugugccgaaauuuuuaaacaaagauucuccgaggaaaauagcaagaccgaucagaaccugggcaaagcugaggagaagacaaaggucaaacgggaaaucgugaaacuuugcucucaguaccagaaucaagcgaaaaacggcauucuguucuguaccagagagaacgacccuauccgcgggcccgauggaaagaugcacggcaaucucugcuccaugugucaggccuauuuucaggcugaaaacgaggaaaagaagaaggccgaggcccgggcuagaaauaaacgcgagagcgggaaggccacaucuuacgcggaacugugcuccgaguaucggaaacugguuagaaacggaaagcucgcuuguacccgcgaaaaugacccuauucaaggccccgaugggaaagugcauggaaacacgugcagcaugugcgaggucuucuuucaggccgaggaagaggaaaagaagaaaaaggagggcaaaucucggaauaagagacaguccaaaagcacagccuccuucgaagaacuguguucugaguaccgcaagagccggaaaaacggcagacuuuucugcacccgcgaaaaugacccgauccaggggccugauggaaagaugcacggcaacacauguuccaugugcgaggcuuucuuucaacaggaggagcgggccagagcuaaggccaaacgggaagcggccaaggagauuuguagcgaguuccgcgaccaggugagaaaugggacccugaucugcacccgggaacacaaccccgugagaggaccugauggcaaaaugcaugggaauaagugugcuaugugcgccucugucuuuaaacucgaggaagaggaaaagaagaacgacaaagaggagaagggcaaaguugaagcugagaaggugaaacgcgaagccgugcaggagcuguguuccgaguaccggcacuaugucagaaauggacgccuucccugcacaagagaaaacgaccccaucgagggccuggaugggaagauucauggaaacacguguagcaugugcgaagcguucuuucaacaggaggccaaggaaaaagagcgggcugagccucgcgccaaggugaaaagagaagcugagaaggaaaccugcgacgaguuccggcgccuccugcagaauggcaaacuguuuuguacaagagaaaacgauccgguucgggggcccgacggaaagacccacggcaauaagugcgccauguguaaagccguguuccagaaggagaacgaggaacgcaaaagaaaggaggaagaggaucaacggaaugcugcggggcacggcucuagcggaggcgggggaggcaacacacaggacgaaugcgccgaguaccgcgagcagaugaaaaaugggagacucuccuguacccgggaaucugauccugucagagacgcugauggaaagagcuauaacaaucagugcacgauguguaaagccaagcuggagcgcgaagccgagcggaagaacgaguacuccagaagccgcucuaauggcacaggguccgaaagcggcaaagauaccugcgacgaguuccggucucaaaugaagaacggaaaacuuaucuguaccagagaauccgaccccgugcgcggcccugaugggaagacacauggaaauaaaugcaccauguguaaggagaagcuggaacgggaggcugccgagaaaaagaaaaaggaagacgaggacagaagcaacacaggcgaacgcuccaauacgggggagcggucuaacgauaaagaagaccucugcagagaguuucggagcaugcagcgcaacggaaagcugauuugcaccagagagaauaaccccguucggggcccguaugggaagaugcacaucaauaaaugugcgaugugccaguccauuuucgaucgcgaagcuaacgagagaaagaaaaaggacgaagagaaaucuagcuccaagccuagcaauaacgccaaggaucaauguagacaggugcagaaugaagccgaggacgcuaaauuuagacagcccggccgcucucuugccuccgucgcgcggaugagcacagaugagugcucugaauuuagaaacuacauccgcaauaacgagcugaucuguccucgggaaaaugaccccgugcauggagcugauggcaaguuuuauaccaacaaaugcuacauguguagagccgucuuccucacagaggcccuggagcgcgcuaagcugcaagaaaaaccuucccacgugcgggccagccaggaggaagacucucccgauagcuuuuccagccucgacucugagaugugcaaggauuacagaguucugccgcgcauuggguaucuuuguccuaaggaccugaaacccgugugcggagacgauggccagaccuacaauaaccccuguaugcucugccaugaaaaucugaucagacagacgaacacccacauucgguccacagggaagugcgaggagagcuccaccccuggaacaaccgcugccucuaugccgcccagcgacgaauga

SEQ ID NO: 76184 - RNA, 243 nt, Artificial Sequence
  derived and/or modified sequence opt5 from SPINK6__Homo_sapiens__NP_001182219
augaagcugagcggcauguuccuccugcuuucccuggcccucuuuugcuuccugaccgggguguuuucucagggaggccaagucgacuguggggaguuccaggaucccaaaguuuacugcacaagagaaagcaacccucacuguggauccgacggccagacguaugggaauaagugcgcuuuuuguaaagccaucgugaagucuggaggcaaaauuagccuuaagcauccgggcaagugcuga

SEQ ID NO: 76185 - RNA, 258 nt, Artificial Sequence
  derived and/or modified sequence opt5 from SPINK7__Homo_sapiens__NP_115955
augaagaucaccggcgggcugcuccugcuuugcacaguggucuacuucuguagcuccucugaggccgcuagccugucccccaaaaagguugacugcucuauuuauaaaaaguacccugugguggccaucccgugucccauuacguaucucccugucugcggaagcgauuacaucaccuauggcaacgaaugucaccugugcacagagucccuuaaaucuaaugggagagugcaguuucugcaugacggaagcuguuga

SEQ ID NO: 76186 - RNA, 1542 nt, Artificial Sequence
  derived and/or modified sequence opt5 from SPINT1__Homo_sapiens__NP_001027539
auggcccccgcuagaaccauggcccgggcgcgccuggcuccugccggcaucccggccguggcucucuggcugcuuugcacacuggggcuccagggaacgcaagccgggcccccucccgcuccucccgggcugccugccggagcggacugucuuaacagcuucaccgccggcgucccgggguuuguucuggauacaaaugcuuccgugucuaacggagccaccuuccucgagagccccacagugagacggggcugggacugcguccgcgcuuguugcaccacacagaauuguaaccuggcccugguggaacuccagccugauagaggcgaggacgcgauugccgcuugcuuucugaucaauugucuuuacgaacagaacuucguuugcaaguuugcuccccgggagggguucauuaauuaucugacccgcgaaguguacagauccuaucggcaacuccgcacgcagggauuuggcgggucuggaaucccuaaagccugggccggcauugaucugaagguccagccccaggagccgcuugugcugaaagacguugagaacaccgauuggagacuccugcggggcgacacagaugugcgcgucgaaagaaaggacccuaaucaaguggagcuguggggacucaaagaaggcaccuaccuguuccagcuuacagugaccagcuccgaucaccccgaggacacggccaacgucacaguuaccgugcugucuacaaagcagaccgaggauuauugucucgcuagcaauaaggugggccggugccgcggguccuuuccuagaugguacuaugaccccaccgaacagaucuguaagagcuucgucuacggaggcugccuggggaacaaaaauaacuaccuucgggaggaagagugcauccuggcguguagaggagugcaaggccccucuauggaacgccggcauccuguuugcuccgggacaugucagccgacgcaguuuagaugcagcaauggauguugcauugacucuuuccucgagugugaugacacccccaacugcccugaugccuccgacgaggcugccugugaaaaauauacaagcggcuuugaugagcugcaacgcauccacuuccccucugacaagggccauugcguggaucugccugacaccgggcucuguaaagaauccauuccccggugguacuauaacccguucagcgagcacugcgccagauuuacauacggaggcugcuaugggaauaagaacaauuucgaagaggagcagcagugucuggaauccugccgcggaaucucuaagaaagaugucuuuggccuucggagagagauuccuauccccagcaccggguccguggaaauggcuguugccguguuccuggucauuuguaucguggucgugguugcgauccucggcuacugcuuuuucaagaaccagcgcaaagacuuucauggacaccaccaucacccucccccuacgcccgcuagcucuacaguguccaccaccgaggauacagaacaucuggucuauaaucacaccacacggccgcuuuga

SEQ ID NO: 76187 - RNA, 588 nt, Artificial Sequence
  derived and/or modified sequence opt5 from SPINT2__Homo_sapiens__NP_001159575
auggcccagcugugcggccucagacggagccgcgcuuuccuggcccuucuggggucccuccugcuuucuggagugcuggcggcugacagagagcggagcauccacgaaaacgccaccggcgaucucgccacaucccgcaaugcugccgacucuagcguccccuccgcuccuagacggcaagauucugaggaccauagcuccgauauguuuaacuacgaagaguauuguacggccaaugcgguuaccgggccgugccgcgccagcuuccccagaugguacuuugacguggaacggaacucuuguaauaacuucauuuauggaggcugccgcgggaauaagaacuccuacagaagcgaggaggcuuguaugcugcggugcuuucgccagcaggaaaauccuccccugccucucggaucuaaaguggucgugcuggccggccuuuucguuauggugcugauccucuuucugggcgcuuccauggucuaucuuauuagaguggcccggcgcaaccaggagagagcgcugcggacaguuuggagcucuggggaugacaaggaacaacucgugaaaaauaccuacguccuguga

SEQ ID NO: 76188 - RNA, 1365 nt, Artificial Sequence
  derived and/or modified sequence opt5 from SPNS1__Homo_sapiens__NP_001135921
auggccggcagcgacaccgcucccuuccugucccaggccgaugacccugaugacgggccggugcccggaacaccuggccuccccgggucuacgggaaacccuaagagcgaggaacccgaggucccugaucaagaaggccugcagagaaucaccgggcuuuccccgggacggucugcgcugauuguugcugugcucugcuacaucaaucugcuuaacuauauggaccgcuuuacaguggccgucuucauuagcuccuacauggugcuggcccccguuuuuggcuaucucggcgauagauacaaucggaaauaucugaugugugggggaaucgcuuucuggucucuggugacccucggcagcuccuuuauuccuggggagcacuucuggcugcuucugcucacacgcggacuggucggcgugggggaagccagcuacucuaccaucgcucccacacuuaucgccgaccuguuuguugcggaucagagaucccggaugcucagcauuuucuauuuugccaucccugugggaucuggccugggcuacauugcuggguccaaggucaaagacauggccggagauuggcauugggcucugcgcgugacccccggccucgggguggucgccguucugcuucuguuccucguggugagagagccgccucggggagcggucgagcgccacagcgaccugcccccucuuaaccccacgucuuggugggccgaucugagagcucucgcccggaaucugaucuuuggccugauuaccugccucacaggggugcugggaguuggccuuggcguggaaaucucccgcagacugcggcauagcaacccccgcgcugacccucucgucugugccaccgggcugcuuggauccgccccguuccuguuucucucucuggcuugcgcgagaggcagcauuguggccacauacaucuucaucuucauuggggagacccugcucuccaugaauugggcuaucguugccgacauucugcuuuauguggucauccccacgcggagaagcacagccgaggcuuuucagauugugcugucucaccuccugggagaugccggcuccccuuaccugaucgggcuuaucagcgaccgccuccggagaaacuggcccccuucuuuccugagcgaauuucgcgcgcugcaauucucccucaugcugugugcuuuugucggcgcccuuggaggcgccgcuuuccuggggaccgccauuuuuaucgaggcugaucggagacgcgcccagcuccaugugcagggacugcugcacgaagcgggcucuacagacgaucggauuguugugccccagagagggcgcagcacccgggucccgguggccuccguucuuaucuga

SEQ ID NO: 76189 - RNA, 1650 nt, Artificial Sequence
  derived and/or modified sequence opt5 from SPNS2__Homo_sapiens__NP_001118230
augaugugccuggagugugccagcgcugccgcgggcggggcugaagaggaagaggccgacgccgaaagacggcgcagacggcgcggagcucagagaggcgccgggggauccggcugcuguggggcucggggagccggcggcgcgggggugucugccgcuggagaugagguccaaacccucagcggcuccguucgcagagcccccacagggccuccgggaacgcccggcaccccugggugcgcugccacagcgaagggacccggcgcccagcagccuaaacccgcuucucugggccgggggcgcggagccgcugccgccauccuuagccugggcaacgugcucaauuaccuggacagauauaccguggcugggguccuucuggauauucagcaacacuucggagugaaggaccggggcgcggggcuccugcaguccguuuuuaucuguucuuucaugguggccgcuccuauuuuuggauaccugggcgaucgcuucaacagaaaagucauccucagcugcggcauuuucuucugguccgccgugacauuuucuagcuccuucaucccgcagcaguauuuuuggcugcuuguucugagccgggggcucgugggaaucggcgaggccucuuacuccaccauugcucccacaaucauuggggaccuguucaccaagaauacgcgcacccuuaugcugagcgucuuuuauuucgccaucccucucggaucuggccugggguacauuacaggcuccagcgugaaacaagcggcuggagauuggcauugggcccugagagugucccccguccucggcaugaucaccgggacacugauucuuauccugguuccugccaccaagcggggacacgcugaccagcucggcgaucagcugaaggccagaacgucuuggcuucgcgacaugaaagcucugauccggaacagaagcuauguguuuuccagccucgccacaucugcgguguccuucgccaccggggcucugggaauguggauuccccuguaccuccaucgcgcccaggucgugcaaaagacagcugaaaccuguaauagcccgccuugcggcgccaaagauucucugaucuucggggcgauuaccuguuuuacaggcuuccuuggaguugugacgggcgccggggcuacccgguggugcagacugaagacacagcgcgccgacccccucgucugugcugugggaaugcugggcagcgccaucuuuauuugccuuaucuucguugccgcuaaauccucuaucgugggggcguacauuugcaucuuugucggagagacccugcucuuuagcaacugggccauuacagcugauauccugauguauguggucauuccuacccggagagccacggccguggcucugcaguccuuuacaagccaccuccugggcgacgccgggucucccuaccuuaucggcuucaucuccgaccugauucgccaaagcaccaaggauucuccccucugggaauuucugucccugggauaugcgcuuaugcucuguccuuucguugugguccugggcgggauguuuuuccuggcuaccgcccucuuuuucgugagcgaccgggccagagcugagcagcagguuaaucagcuggccaugccgcccgcguccgugaaggucuga

SEQ ID NO: 76190 - RNA, 1191 nt, Artificial Sequence
  derived and/or modified sequence opt5 from SPO11__Homo_sapiens__NP_036576
auggccuucgcucccaugggcccugaggccagcuuuuucgacgugcuggauagacaccgggaaucccuccuggcggcucuccgcagagggggacgggagccgcccaccggcgggucucgccuggccagcuccucugaaguccucgccagcaucgagaacauuauccaggacauuaucacaucccuggcuagaaaugaagccccugcuuuuacgauugauaaccggucuagcugggagaauaucaaguucgaggacuccguuggacuucaaauggugagccauugcaccacacgcaaaaucaagucugauucccccaaaagcgcccagaaguuuucucugauucucaaaauccuguccaugauuuacaagcuggugcagagcaacaccuaugcgacaaagagagacaucuacuauaccgauucucagcuuuucggcaaucaaacagucguggacaacauuaucaaugauauuuccuguaugcugaaaguuagccggcgcucccuucacauccugucuaccagcaaggggcucaucgccggaaaccugagauacauugaagaggacggcacgaaagugaauugcaccuguggcgcuacagccgucgcugugccuuccaacauccaggggauucggaaucuuguuaccgaugccaaguuugugcugaucgucgaaaaagacgcgacauuccagcgccuccuggaugacaacuuuugcaauaagcugagccccuguauuaugaucaccggaaagggcgugccugaccucaacacgagacugcuugugaaaaagcugugggauacauuccaugucccgguuuuuacccucguggacgccgauccccacgggaucgagauuaugugcaucuauaaauacggaucuauguccaugagcuucgaggcucaucaccugacagugccugccauucgguggcuuggccugcuccccucugaccugaagcgccugaaugucccuaaagauagccucaucccccugaccaagagagaccagaugaaacuugauuccauucugcggagaccguaugugaccugucaaccuuuuuggcgcaaggaaauggagaucauggcugacucuaagaugaaagccgaaauccaggcccucacauuccugagcuccgauuaccuuagccggguuuaccugcccaacaagcucaaauucgggggauggauuuga

SEQ ID NO: 76191 - RNA, 1320 nt, Artificial Sequence
  derived and/or modified sequence opt5 from SPOCK1__Homo_sapiens__NP_004589
augcccgccaucgcugugcuggccgcggcugccgccgcuuggugcuuccuccaggucgagagcagacaccuggacgcccuugcuggcggggccggaccuaaccauggcaauuuucuggauaacgaccaauggcucuccaccguuucucaguacgaucgggacaaguauuggaaucgcuucagagaugacgauuacuuucggaacuggaauccgaacaaacccuucgaccaggcgcuggauccuagcaaggaccccugucuuaaagugaagugcuccccucacaaagugugugucacacaggauuaucaaacggcccugugcgugucucgcaagcaucuccugcccagacagaagaaagggaauguugcucagaagcacugggugggaccuagcaaccuggucaaauguaagccgugccccguggcccaguccgcuaugguuuguggcucugacgggcauagcuacaccuccaaaugcaagcucgaauuucacgccuguagcacaggaaagucucuggcgacccuuugcgauggcccuugucccugccugccugagcccgaaccgccuaaacacaaggccgagcgguccgcuugcacagacaaagaacuccgcaaucuggccagcagacuuaaggacugguucggcgcucugcaugaggaugccaaccgggugauuaaacccaccucuuccaauacagcccaagggcgcuuugacaccagcauccucccuauuuguaaggauucucugggauggauguucaacaaacuggacaugaauuaugaucuccugcuugaccccuccgagaucaacgcuauuuaccuggauaaguaugaacccugcaucaagccucucuuuaauagcugugacuccuucaaagauggcaagcugucuaacaacgaguggugcuacuguuuucagaaacccgggggacuuccgugccagaaugaaaugaacagaauccagaagcugagcaaaggcaagucccuccugggggcguucauuccucgguguaaugaggagggauacuauaaggccacgcaaugccacggcagcaccggccaguguuggugcgucgacaaauacgggaacgaacuggcuggaucucgcaagcagggcgccguguccugugaggaggaacaagaaacaagcggggauuuuggaucuggcgggagcgugguccuccuggacgaccuugaguaugagagagaacugggacccaaagauaaggagggcaaacuccggguucauacccgcgccgugacagaagacgaugaggacgaagaugacgauaaggaggacgaggugggcuacaucugguga

SEQ ID NO: 76192 - RNA, 234 nt, Artificial Sequence
  derived and/or modified sequence opt5 from SPOCK2__Homo_sapiens__NP_001127906
augagagcccccggcugcgggcggcuggugcucccucugcuucugcucgcugccgcggcucuggccgagggagacgccaagggccuuaaagaaggggagaccccgggaaacuucauggaagaugagcaguggcugagcuccaucucucaauacagcggcaagauuaaacacuggaaucgcuuuagagacguccccuccucugauccucccagcacaacgcaggcuaccccuuga

SEQ ID NO: 76193 - RNA, 1302 nt, Artificial Sequence
  derived and/or modified sequence opt5 from SPOCK3__Homo_sapiens__NP_001035249
augcugaaggugagcgccguccucugcguuugugcugccgcguggugcucccagucucuggcugccgccgcugccguggcugccgcgggcgggagaagcgacggaggcaacuuccuugaugacaaacaauggcugaccacaaucucccaguacgauaaggagguggggcaguggaauaaauuucgggacgaugacuauuuccgcacguggucucccggaaagccuuuugaucaggcccucgacccggcuaaagaucccugucugaagaugaagugcagcagacacaaagucuguauugcccaagacucccagaccgcugugugcaucucucaucggcgccuuacacacagaaugaaggaagccggcguugaucaucggcaguggcgcgggccuauucugagcaccuguaaacagugccccguggucuacccuucccccguguguggaagcgacggccacacauauucuuuccaaugcaagcucgaguaccaggcguguguucugggcaaacagaucuccgugaagugcgaagggcauugcccuuguccgagcgauaagcccaccucuacauccagaaacgucaaacgggccugcagcgaccuggaguuucgcgaaguggcuaauagacuccgggacugguucaaggcccugcacgagucuggaucccagaacaaaaagaccaaaacgcuucugcgcccugagagaagccgguuugauaccuccauucuccccaucuguaaggacucucugggcuggauguucaaucgccuugauacaaacuaugaccugcuccuggaucaaagcgaacugagauccaucuaccucgacaaaaaugagcagugcaccaaggccuuuuucaacagcugugauacauauaaggacucucugauuuccaauaacgaauggugcuacuguuuucagcggcaacaggauccucccugccagaccgagcuuagcaauauccagaaaagacaaggggugaagaaacugcucggacaguacauuccgcugugugacgaggauggcuauuacaagccuacgcagugccacgggucugucggacaguguuggugcguugaccgcuauggcaacgaagugaugggcagccggaucaaugggguggcugacugcgccauugauuucgagaucuccggagacuuugcuucuggcgauuuccaugaauggacagacgaugaggacgaugaagacgauauuaugaacgacgaggaugagaucgaagacgaugacgaggacgaaggggaugacgaugacggaggcgaugaccacgaugucuacaucuga

SEQ ID NO: 76194 - RNA, 2424 nt, Artificial Sequence
  derived and/or modified sequence opt5 from SPON1__Homo_sapiens__NP_006099
augagacugagccccgccccucucaagcugucccggaccccggcccuucuggcccucgcgcugccccuugcugccgcccuggcuuucucugacgagacacucgauaaagugccuaagagcgaaggcuacugcucccgcauccugagagcccaggggacgcggcgcgagggauauaccgaauuuucucugagagucgagggcgaccccgauuucuacaaaccugggacaagcuaucggguuacccucuccgcugcucccccuucuuacuuucgcggauucacacugauugcgcuuagagaaaaccgggagggcgacaaggaggaagaucacgccgggaccuuucaaaucauugacgaggaagagacacaguucaugagcaauuguccgguggcugugaccgaguccacgccccgcagacggacccgcauccaggucuuuuggauugccccucccgcuggaacaggcugcgugauccugaaagccagcaucguucagaagagaauuaucuauuuccaagaugaaggcucucucaccaagaaacugugugagcaggacuccacauuugauggggugaccgacaagccuauucuugauugcugugcgugcggaacggccaaauaccggcugacauucuauggcaacuggagcgaaaagacccaucccaaagacuacccgcgcagagcuaaucacuggucugccaucauugggggaucccauagcaagaacuacguccucugggaguauggcggguacgcuucugaaggagugaagcagguugccgagcugggcuccccugugaaaauggaggaagagauccggcagcaaagcgaugaaguccugacagugauuaaggccaaagcucaguggcccgcguggcagccucucaaugugagagccgcucccuccgccgaguuuucugucgaccgcacccggcaccugaugagcuuccuuaccaugaugggccccuccccugacuggaacguugggcugagcgccgaagaucucuguacaaaggagugcggaugggugcagaaagugguccaagaccugaucccgugggaugcuggcacggacucuggggugaccuaugagucccccaauaagccuacaaucccccaggagaaaauuagaccucuuaccagccuggaucauccccagucuccguuuuacgacccugaaggaggcagcaucacacaaguugcccgcguggucauugaacggaucgcgagaaagggggagcaguguaacauugugcccgauaauguugacgauaucguggcugaccucgccccugaagagaaggaugaggacgacacccccgaaacgugcaucuauuccaacuggucuccuuggagcgccuguuccagcucuacaugcgauaaaggaaagcgcaugcggcagagaaugcugaaagcucagcuggaccucuccguccccugcccggauacccaagacuuccagccuuguaugggccccggcugcagcgaugaggacgggucuaccuguacaauguccgaauggauuaccuggagccccugcuccaucucuuguggaaugggcaugcgcagccgggagagauacgugaagcaguucccugaggauggguccgucugcacacugccgacggaagagaccgaaaaauguacagugaaugaggaaugcucucccagcuccugucuuaugaccgaguggggagagugggacgaaugcagcgccacauguggcauggggaugaagaagcgccaccggaugauuaaaaugaacccugcugauggcucuaugugcaaggccgagaccucccaggcggaaaaaugcaugaugcccgagugucacacgaucccuugccugcucagccccuggucugaaugguccgacuguagcguuaccugcggaaagggcaugagaacacggcaacgcaugcugaaaucucuugccgagcugggggauuguaaugaggaccucgaacagguggagaagugcaugcugccugaaugucccauugauugcgagcugaccgaauggagccagugguccgaguguaacaagagcugcggaaaaggccaugucaucagaacacggaugauccagauggagccgcaauuugggggagcuccuugucccgaaaccgugcagagaaagaaaugccgcauucggaagugccucagaaauccuucuauccagaaacugcgcuggagagaggcccgggaaucccgcagaagcgagcagcuuaaggaggaauccgagggcgaacaauuccccgggugucggaugcgcccguggacggcuuggucugagugcacaaagcuguguggcggaggcauucaggaaagauauaugaccguuaaaaagcgguuuaaaagcucccaguucacaucuugcaaggacaaaaaggagauccgcgccuguaacgugcacccuugcuga

SEQ ID NO: 76195 - RNA, 996 nt, Artificial Sequence
  derived and/or modified sequence opt5 from SPON2__Homo_sapiens__NP_001185950
auggagaaccccagcccugccgcugcccugggcaaggcgcucugcgcucugcuucuggccacccucggggccgcuggacagccgcugggcggggaauccaucuguucugccagagcucccgccaaauacagcauuacauucacgggaaaguggucccaaaccgcguuuccuaaacaguauccccuuuuccggccucccgcccaguggucuagccugcucggcgcugcccacuccucugacuacagcauguggcgcaagaaucaguauguguccaacgggcugagagauuuugcugagcggggagaagccugggcgcugaugaaagagaucgaagccgcuggcgaggcccuccaaagcguccaugcuguuuucucugccccugccgugccguccggcacagggcagaccagcgcugagcuggaagugcagcgcagacacucucuugucuccuuugugguucggauugugcccagcccugacugguucgucggaguggauucucuggaccucugcgauggcgaccgcuggagagagcaggcggcccuggaucuuuaccccuaugacgcugggacagauuccggauuuaccuucagcuccccuaauuuugccacaaucccccaagacaccguuacggaaauuaccucuagcuccccgagccauccugccaacucuuucuacuauccccggcugaaggcucucccucccaucgcccgcgugacacuggucagacugcggcagagcccccgcgcguuuaucccuccggcucccgugcucccuuccagagauaaugagauuguggacucugccagcguccccgagaccccucuggauugugaaguuucccuuuggucuagcuggggccugugcgggggacacuguggccggcucggcacaaagucccgcaccagauacgugcgggugcagcccgccaacaaugggagcccgugcccugagcuggaagaggaagcugaguguguccccgacaacugcguguga

SEQ ID NO: 76196 - RNA, 1125 nt, Artificial Sequence
  derived and/or modified sequence opt5 from SPOP__Homo_sapiens__NP_003554
augagcagagugcccuccccuccgcccccugccgagaugucuagcggccccgucgcugaauccuggugcuacacccagaucaagguugugaaauucucuuauauguggacaauuaacaauuuuagcuucugucgggaggaaaugggggaggugaucaaguccucuacguuuagcuccggagccaacgacaaacugaaguggugccuccgcgucaauccuaaaggccuggaugaagagagcaaggacuaccuuucucuguaucuccugcuuguguccugucccaagagcgagguuagagcgaaauucaaguuuucuauucugaacgcuaaaggggaagagaccaaggccauggaaucccaacgggccuaccgcuucgugcagggaaaagauuggggcuuuaagaaguucaucagacgggacuuucuccuggaugaggcuaaugggcugcucccugacgauaaacugacacuuuucugcgaggucagcgugguucaggacucugugaacauuuccggacagaauaccaugaacauggucaaggugccggaaugucgccuggccgaugagcucggcggccugugggaaaauagcagauuuacagacugcugucuuugcguggcugggcaagaguuccaggcccacaaagcgauccuggccgcucggucccccgucuuuucugccauguucgaacaugagauggaggaaagcaagaaaaaccgcguugagaucaaugauguggaaccugagguguucaaggaaaugauguguuuuauuuauaccggaaaagcucccaaccucgacaagauggccgaugaccugcuggcggccgcugacaaguacgcccucgagagacugaaagucaugugcgaggaugcucuuuguuccaaucugagcguggaaaacgccgccgagauccucauucuggcugaccuucacucugcggaucagcugaagacacaggccguugacuucaucaauuaucaugcuuccgaugugcucgaaaccagcggcuggaaaucuauggucgugagccacccucaucugguugccgaggccuaccggucccuggcuucugcccaaugccccuuucucgggccgccucgcaagagacugaaacagagcuga

SEQ ID NO: 76197 - RNA, 903 nt, Artificial Sequence
  derived and/or modified sequence opt5 from SPP1__Homo_sapiens__NP_000573
augagaaucgccgugauuugcuucugucugcucggcauuaccugcgcuauccccgucaagcaggccgacagcggguccucugaggaaaaacaacuguacaacaaguauccugaugcgguugcuacauggcuuaauccggaccccagccagaaacagaaccugcucgccccucagacgcugcccuccaagucuaaugagagccacgaucauauggacgauauggacgaugaagacgaugacgaucacguggacucccaagauucuaucgacagcaacgacuccgaugacguggaugacaccgaugacagccaucagucugaugagucccaccauagcgacgaaucugaugagcuugucacagacuuuccuaccgaucugcccgccacagagguguucaccccuguugugccgacagucgacaccuacgacggacggggcgauuccgugguuuaugggcuccgcagcaaaucuaagaaguuuagacggcccgacauucaguacccugaugcuacggacgaagauaucaccucccacauggagagcgaagaacugaauggagccuauaaagcuauccccguggcccaggaccugaacgcgccuuccgauugggacucucgcggcaaggauagcuacgagacaucccaacucgacgaucagagcgccgaaacccacucucauaaacaguccagacuguauaagcggaaagcuaaugacgagagcaacgaacacucugaugucauugacagccaggagcuuuccaaggugucucgcgaguuccauagccacgaguuucacucccaugaggacaugcugguggucgaucccaagagcaaagaagaggacaagcaccucaaauucagaaucucucaugaacuggauuccgccagcucugagguuaauuga

SEQ ID NO: 76198 - RNA, 636 nt, Artificial Sequence
  derived and/or modified sequence opt5 from SPP2__Homo_sapiens__NP_008875
augaucagcagaauggagaagaugaccaugaugaugaaaauucugaucauguucgcccucggcaugaacuacugguccugcucuggguuucccguguaugacuacgauccuagcucccugcgggacgcucuuucugccagcgucguuaaggucaauucccagucucugagcccguaucucuuccgcgcguuuagauccagccugaaacggguggaagugcuugaugagaacaaucuggugaugaaccucgaguucucuauucgcgaaacaacguguagaaaggacuccggagaagaucccgcuaccugcgccuuucaacgggacuacuauguuagcacagccgugugucgcucuaccgucaaaguguccgcucagcagguucagggcgugcacgccagaugcagcuggucuuccagcacauccgagucuuacagcuccgaggaaaugaucuucggggauaugcugggaagccauaaguggcggaauaacuaucuguuuggccucauuucugacgaguccaucagcgaacaauucuacgaucgcucucuggggaucaugagacggguccuuccucccggaaaucgcagauacccuaaccaccggcaucgcgcuagaauuaauaccgacuuugaguga

SEQ ID NO: 76199 - RNA, 1563 nt, Artificial Sequence
  derived and/or modified sequence opt5 from SPPL2A__Homo_sapiens__NP_116191
augggcccccagagacggcugagcccugccggggcugcccuccuguggggauuccuucugcaacucaccgcggcucaggaggccauccugcacgccuccggcaacgggacaacgaaggacuacugcaugcuuuauaauccguacuggaccgcucugcccucuacacucgaaaacgccaccagcauuucccugaugaaucugacaucuaccccucucuguaaccugagcgauauucccccugugggaauuaaauccaaggcugucguugugcccuggggcucuugccauuuucuugagaaagcccgcaucgcgcagaaagggggagccgaagcuaugcugguggucaauaacagcgugcuguucccuccguccggcaauagaagcgaguuucccgacguuaagauucugaucgccuucaucucuuauaaggauuuucgggacaugaaccagacacuuggcgauaauauuaccgugaagauguacuccccuagcuggcccaacuucgacuauacgauggucgugaucuuuguuauugcuguguucaccgucgcccucgggggauacuggucuggccucguggaacuggagaaucugaaagcggugacaaccgaggaucgcgaaaugagaaagaaaaaggaggaauaucucacauuuuccccucugaccgucguuaucuucguggugauuuguugcgucaugauggugcuucuguacuuuuucuacaaauggcucguuuaugugaugaucgccaucuuuuguaucgcuagcgccaugucucuguacaacugccuugcugcccugauccacaagauucccuaugggcaauguacgaucgccugccggggaaagaauauggagguccgccucauuuuccuguccggccuguguaucgcuguggcgguugugugggccgucuucagaaacgaggaccggugggcuuggauucuccaggauauccuggggaucgccuuuugccuuaaucugauuaaaacacucaagcugccgaacuucaaaagcugugugauccuucugggacuccugcugcucuacgacgucuuuuucguguuuauuaccccuuucaucacaaagaacggcgaauccauuaugguugagcuggccgcuggccccuuugggaauaacgaaaaacuuccuguggucauccgcgugcccaagcugaucuauuucucuguuaugagcgugugccucaugcccgucuccauucugggauuuggcgauaucauugugccugggcugcuuaucgccuacugcagacgguucgacgugcagaccggaagcucuuauauuuacuacguuuccagcaccgucgcguaugcuaucggcaugauucucacauuuguggugcugguccugaugaaaaaggggcagccggcccuccuguaccuugugcccuguacgcugaucaccgccucuguuguggcuuggcgcagaaaggagaugaaaaaguucuggaaaggaaauagcuaucaaaugauggaucaucucgacugcgccacaaacgaagagaauccugucaucuccggcgagcagauugugcagcaguga

SEQ ID NO: 76200 - RNA, 1536 nt, Artificial Sequence
  derived and/or modified sequence opt5 from SPPL2B__Homo_sapiens__NP_001070706
auggccgcugccguggcggcugcccuggccagacuccuggcugccuuccuucugcucgcugcccaggucgcgugcgaguacggcaugguucacguggugagccaagccgggggacccgaaggcaaggacuauuguauccuguacaacccucagugggcucaucuuccgcacgaucuguccaaagccucuuuucuccagcugcggaauuggaccgcuagccugcucugcuccgccgcggaccugcccgcccgcggguucucuaaccagauuccucuugucgcuagaggaaauuguacauuuuaugagaaggugcggcuggcccaaggcagcggggcucgcggacuccugaucguuuccagagaacggcuugugcccccuggcggcaacaaaacgcaguacgaugagauugggauccccgucgcccugcucucuuauaaggacaugcuggauauuuucacccgcuuuggaagaacagugcgggccgcucuguacgcgccuaaagaaccgguucucgacuauaauauggugaucaucuucauuauggccgucggcaccguggcuaucgggggauacugggccggcagccgcgaugugaagaagagauacaugaaacauaagcgggacgaugggcccgagaaacaggaggacgaagccgucgauguuacaccugugaugaccugcguguuugucgugauguguugcuccaugcugguucuucuguauuacuucuaugaccuccugguguacgucgugauuggaaucuuuugucuugcuagcgccacaggccuguauucuugccucgcgcccuguguucgcagacugccuuucggcaagugccggauucccaacaauucccugccguacuuucacaaacgcccucaggcuagaaugcuccugcuugcccuguucuguguggccgucagcguggucuggggaguguuucggaacgaggaucaaugggcuuggguucuccaggacgcccuggggaucgcuuucugccuuuauaugcugaagaccauuagacuccccacguucaaggccugcacccugcugcuccuggugcuuuuucuguacgacaucuucuuugucuucaucacaccuuuucucaccaaaucuggcuccagcauuaugguggaaguugcgacagggcccucugauuccgccacccgcgagaagcugcccauggugcugaaagucccucggcuuaauagcuccccgcucgcucugugugacagacccuucucucugcucggauuuggcgauauccuggugccugggcuucugguggccuacugccaucgcuucgacauucagguucagagcucccgggucuauuuuguggcuuguacgaucgccuacggagugggccuccuggucacauucguggcgcuggcccuuaugcaaagaggccagcccgcucuccuguaucugguuccuugcacccucgugacaagcugugccgucgcucuguggcgccgggagcuugggguguuuuggaccggaucuggcuucgccguuaacaccucccugcucuga

SEQ ID NO: 76201 - RNA, 2055 nt, Artificial Sequence
  derived and/or modified sequence opt5 from SPPL2C__Homo_sapiens__NP_787078
auggccugccugggcuuccuccugcccgugggguuucuucugcucaucagcaccgucgcuggaggcaaguacgggguugcccacgugguguccgagaacuggucuaaagacuauuguauucuguucagcuccgauuacaucacacuuccucgggaccugcaucacgcgccgcuccugccccuguaugauggaacgaaggcuccuuggugccccggcgaagacucuccucaucaggcccaacuccggagccccucccagcgcccucugagacagaccacagccauggucaugcgggggaauuguucuuuucacaccaaaggauggcuugcucagggccaaggcgcccaugggcugcucauugugagccgcguuuccgaucagcagugcagcgacacaacccuggcuccgcaggaucccagacaaccucuugccgaccugacaauccccguggcgaugcuccacuacgccgauaugcuggacauucugucucacacccggggagaggcugucgugcgcguugccauguaugcuccucccgaaccgaucaucgauuacaacaugcucgugauuuucauccuggccgucggcacgguggcggccgggggauauugggcuggccuuaccgaggccaauagacugcagcggcgcagagcucggcgcgggggaggcuccggcgggcaucaccagcuccaggaagccgccgcugcggagggagcccaaaaggaggacaacgaagauauuccuguggacuuuacacccgcuaugaccggcgucguugugacacugagcuguucucuuaugcugcuccuguacuucuuuuacgaccauuucguguaugucaccaucgggauuuuuggacugggcgccgggaucggacucuacuccugccugagcccucuuguguguagacugucucuccggcaguaucagcgcccuccccacucccugugggccagccuuccccugccgcuccugcugcucgcuucccugugcgccacgguuauuaucuucuggguggcguacagaaaugaggaucggugggcuuggcuucugcaagacacacucggcaucucuuauugucuguuuguccugcacagagugcgccuucccacccucaaaaacugcagcuccuuccugcuggcccuccuggccuuugauguuuucuucguguuugucacaccuuucuuuaccaagaccggcgaaagcauuauggcucagguggcccuugggcccgcugagucuuccagccaugagcggcugccuaugguccucaaggugcccagacugcgcguuucugcccugacacuuuguagccagccguucuccauccucggauuuggcgacauuguggucccuggguuccugguggcguacugcugccgguuugauguucagguguguucuagacaaaucuauuucgucgccugcacgguggcuuacgccgugggacugcucguuaccuuuauggcuaugguccugaugcagaugggccagcccgcccuucuguaccucgugagcuccacacugcugaccagccuugcgguggccgcuugucgccaggaacucucucuguucuggacagggcaaggccgggccaaaaugugcggacugggcugugcuccuuccgccgggagcagacagaagcaggagggagccgcugacgcgcacaccgccucuacgcucgaacgcggcacauccagaggggcuggagaucuggacagcaaucccggcgaggauaccaccgaaauugucacaaucuccgagaacgaggccaccaauccugaagaccggucugauagcuccgagggguggucugacgcccaucuugaccccaacgaacugccguuuaucccucccggcgcuagcgaggaacucaugccccugaugccuauggccaugcugauuccgcuuaugccccucaugccucccccuuccgagcugggacacgugcaugcgcaggcucaagcccacgagacaggccugcccugggccgggcuccacaaacgcaagggacugaaaguuagaaagagcaugucuacgcaggcuccucuuuga

SEQ ID NO: 76202 - RNA, 1155 nt, Artificial Sequence
  derived and/or modified sequence opt5 from SPPL3__Homo_sapiens__NP_620584
auggccgagcagaccuacagcugggcuuauucccugguggacucuagccaagucuccacauuccucaucucuauucugcuuaucguuuacggcagcuuuagaucccugaacauggauuucgaaaaucaggacaaggagaaagauucuaacagcuccagcgggucuuuuaauggaaacuccacgaauaacagcauucagaccaucgacucuacacaggcccucuuccugcccauuggcgcguccgugagccuucuggugauguuuuucuuuuucgauucuguccaagugguuuuuaccaucugcacagcugugcucgccaccaucgccuucgcuuuucugcugcucccuaugugucaguaucugacacggccgugcagcccccagaauaagauuuccuucggguguugcggacgcuuuaccgccgcugaacuucuguccuucucucucagcgucaugcuggugcuuaucuggguucugacgggccacuggcuccugauggacgcccuggcgauggggcucuguguggccaugauugcuuucgucagacugccuucccuuaaagugagcugccugcuccugucuggacuucugaucuacgauguguuuugggucuucuuuuccgccuauauuuucaacagcaauguuauggugaagguggcuacccagcccgccgacaacccucucgauguccugucucggaaacugcaucucggccccaaugugggccgcgacguuccuagacugagccuuccggggaagcugguguuucccuccucuacaggaagccacuucuccaugcucggcaucggggauauugucaugccuggacugcuucuguguuuugugcuccgguacgacaacuauaagaaacaagcgagcggcgauucuugcggggcccccggaccugcuaauaucuccggccgcaugcagaagguuagcuacuuccauuguacccugaucggcuacuuuguggggcugcucacagccaccgucgcuucucggauucacagagccgcccagcccgcucugcuuuaucuggugccguucacgcuccugccucugcuuacaauggcguaccucaaaggagaccugcgcagaaugugguccgagcccuuucauagcaaguccucuagcucccgguuccuggaagucuga

SEQ ID NO: 76203 - RNA, 1335 nt, Artificial Sequence
  derived and/or modified sequence opt5 from SPRED1__Homo_sapiens__NP_689807
augagcgaggaaaccgccacauccgacaacgauaauucuuacgcuagagugcgggccgucguuaugacgcgcgacgauagcuccggcggguggcugccccucggaggcucugggcugagcuccgugaccguguucaaggucccucaccaggaggaaaacggaugcgcggacuuuuucaucagaggcgagcggcuucgcgauaaaauggugguucuggaauguaugcucaagaaagaccugauuuauaauaaggugacaccgaccuuucaucacuggaaaaucgaugacaagaaguucgggcuuacauuucaaucucccgcugaugccagagccuucgaccggggcauucgcagagcuaucgaggauauuagccagggaugcccugaguccaaaaacgaagccgagggcgcugacgaucugcaggccaaugaagaggacucuagcuccagccucgucaaggaccaucuguuucagcaagagaccgugguuacaucugaacccuaccgguccagcaacauccgcccuucucccuucgaggaucugaaugcgagacggguguauaugcagucccaggccaaccagaucaccuuugggcaaccuggacucgacauucagagccgcuccauggaauacguccagagacagaucucuaaagaguguggcagccugaagucccaaaaucgggugccgcuuaaaagcauucgccacgugucuuuccaggaugaagacgagaucgucagaauuaacccccgggauauccugauuagacgcuaugcugacuaccggcauccugauauguggaagaaugaccucgagagagaugacgccgauuccagcauccaguuuucuaagcccgacagcaaaaaguccgacuaucuguacucuugcggggaugaaacgaaacuuagcuccccuaaggacagcguuguguucaaaacccaacccucuucccugaagaucaaaaagagcaagcgccggaaagaggauggagaaagaucucgcuguguguacugccaggagcgguuuaaccacgaagagaaugucagaggcaagugucaggacgcuccggauccuauuaaacgcugcaucuaucagguguccuguaugcucugcgccgagagcaugcuguaccacuguauguccgacucugaaggggauuucagcgaccccugcuccugcgauacaucugacgauaaguucugucugcgguggcucgcgcugguugcccuuagcuuuauugugccuugcauguguugcuaugucccccugagaaugugucaucgcugcggagaggcuuguggcugcuguggcgggaaacacaaggccgcuggauga

SEQ ID NO: 76204 - RNA, 1248 nt, Artificial Sequence
  derived and/or modified sequence opt5 from SPRED2__Homo_sapiens__NP_001121682
auggccagccccggcuccgacucuuacaucgugagagucaaggcuguugugaugacccgggaugacagcuccgggggaugguucccucaggagggcgggggaauuucucgcgugggcgucugcaaagugaugcacccggaagggaacggaagaagcggcuuucugauccauggcgagcggcaaaaggauaaacucguugugcuggaauguuauguccgcaaggaccuuguguacacaaaagccaaucccacguuccaccauuggaagguugauaacagaaaguuugggcugaccuuccaguccccugcggacgcucgggccuuugaucgcggagugagaaaagccauugaggaccucaucgaaggcucuacaaccagcuccagcacaauucacaaugaggcugagcugggggaugacgaugucuucaccacagccaccgacucuuccagcaacucuucccagaagcgggaacagcccacgcgcaccaucagcucuccuacauccugcgagcauagacggaucuauacccuuggacaucugcacgauagcuaccccacagaccacuaucaccucgaccaaccuaugccgcgccccuacagacagguguccuuuccugaugacgaugaagagauugugcggaucaauccccgcgagaaaauuuggaugaccggcuaugaagacuacagacaugcuccuguccgggggaaguaccccgauccgucugaggacgccgauagcuccuauguuagauucgcgaaaggagaagugccuaagcacgacuacaacuaucccuacguggauagcucugacuuuggccugggcgaggauccuaaggggcgcggaggcuccgucaucaaaacgcagcccagccgggggaagucuagacgccggaaagaagacggagagagaagccgcuguguguauugccgggacauguucaaucacgaggaaaacagacgcggccauugucaggaugcccccgacuccguucggacaugcauuagacgcgugucuuguauguggugcgcugauagcaugcuguaccacuguauguccgacccugagggggauuauaccgacccgugcagcugugauacaucugacgaaaaguuuugccuccgguggauggcccugaucgcucuuuccuuccuggcccccugcauguguugcuaccucccucugagagcguguuaccauugcggagucaugugucggugcuguggcggcaaacacaaggccgcugccuga

SEQ ID NO: 76205 - RNA, 1233 nt, Artificial Sequence
  derived and/or modified sequence opt5 from SPRED3__Homo_sapiens__XP_011525279
auggugagaguccgggccguugugauggcucgcgacgauagcuccggcggguggcugcccgugggaggcgggggacucucucaggucagcgugugcagaguucggggcgcccgcccugaagggggagcgagacaaggccacuacgugauccauggcgagcggcugcgcgaccagaagaccacacuugaguguacgcugaaaccggggcucgucuauaacaaggugaaucccauuuuccaccauuggucccugggagauugcaaauuuggccuuaccuuccagucuccugcugaagccgacgaguuucagaagucucugcucgccgcucuggccgcucuggggagaggaucccucacacccucuagcuccagcagcuccagcucuccuucccaagauaccgccgaaacacccuguccucugaccagccacguugacucugauuccagcuccucucauagccggcaggagacaccgcccuccgcggccgcugccccuaucauuaccauggagagcgcuucuggcuucgggcccacgaccccuccccagcgcagacgguccagcgcccagucuuacccgccucuucugcccuuuacaggaaucccugaacccagcgagccccucgcgggcgccggcgggcugggauggggcgggcgcggauaugaagacuacagacgguccggcccuccggcuccccuugcccugucuaccugcgugguccgcuucgcuaaaacaggggcccucagaggagccgcucugggcccucccgcggcccugccugcuccccucaccgaggccgccccgccugcucccccugcccggcccccucccggcccggggccuagcuccgcgcccgcuaaggccagccccgaggccgaagaggcugccagaugugugcacugccgcgcucuguuucggagacgcgccgauggacggggcgggagaugugcggaagccccugacccgggacgccuucuggugcggagacucucuugccuguggugugcugagucccuucuguaucacugccucagcgaugccgaaggcgacuucucugaucccugugcuugcgagccugggcauccccgcccugccgcgcggugggccgcucuggccgcucugucccucgccguccccugccuguguugcuacgccccucuuagagcuugucacuggguugcggcccgcugcggcugugcuggaugcggcgggcggcaugaggaagccgccagauga

SEQ ID NO: 76206 - RNA, 786 nt, Artificial Sequence
  derived and/or modified sequence opt5 from SPR__Homo_sapiens__NP_003115
auggagggcgggcugggcagagccgugugccuccugaccggagcuagccggggguucggacgcacacuugcgccccugcucgccucccugcuuucuccuggcagcguccugguucucuccgcuagaaacgacgaagcccugcggcagcuggaggccgaacucggggcugagcgcucuggacugagaguggugcgggucccggccgaucuuggcgcugaagccggccugcaacagcuccugggggcgcuucgcgagcugcccagaccuaagggacuccagcggcugcugcucaucaauaacgccggcagccugggggacguguccaaaggauuuguugaucuuucugacagcacccaggugaauaacuacugggcucugaaucucacguccaugcugugucuuacaagcucuguccugaaggccuuccccgauuccccuggccucaaccgcaccgugguuaauauuagcucucugugcgcucugcaacccuuuaaagggugggcccucuauugugcgggaaaggccgcuagagacaugcuguuccaggugcuugcccuggaggaaccuaacguccgggugcucaauuacgcuccgggcccccuggauacagacaugcagcagcuugcccgcgagaccuccguggauccugacaugagaaaaggccugcaagaacucaaggccaaggggaaacuggucgauugcaagguuagcgcucagaaacugcucucucugcuugagaaggacgaguuuaaauccggagcgcacguggauuucuaugacaaguga

SEQ ID NO: 76207 - RNA, 456 nt, Artificial Sequence
  derived and/or modified sequence opt5 from SPRN__Homo_sapiens__NP_001012526
augaacugggcccccgcuaccugcugggcccugcuccuggcggcugccuuccuuugugacagcggcgccgcuaagggagggagaggcggggcccggggauccgcucgcggcggggugagaggaggcgcccggggcgcgucucgcgucagaguucggccugcccagcgcuacggggcuccgggaagcucccugagaguggccgcugccggcgcggccgcuggggccgcugccggagccgcugcgggccucgccgcugggucuggauggcggcgcgccgccggccccggcgagagagggcuggaagaugaggaagacggagugccuggcgggaauggaacaggccccgggaucuauagcuaccgggcuuggacguccggagccggcccuacccgcggccccagacuuugccugguccucgggggagcgcugggcgcucuggggcuccugcggccuuga

SEQ ID NO: 76208 - RNA, 270 nt, Artificial Sequence
  derived and/or modified sequence opt5 from SPRR1A__Homo_sapiens__NP_001186757
augaacagccagcaacagaagcagcccugcaccccuccgccccagccucaacagcaacaggugaaacagcccugucagccucccccucaggagccgugcauccccaagacaaaagaaccuugucaccccaaggucccugagcccugccauccgaaaguuccugaacccugucagccuaaggugcccgagcccugccaaccuaaggugccggaacccuguccuuccacggucacccccgccccugcucagcagaaaacaaagcaaaaauga

SEQ ID NO: 76209 - RNA, 270 nt, Artificial Sequence
  derived and/or modified sequence opt5 from SPRR1B__Homo_sapiens__NP_003116
augagcucccagcaacagaagcagcccugcaccccuccgccccagcugcaacagcaacaggugaaacagccuugucagcccccuccccaggagccuugcaucccgaagacaaaagaacccugucacccuaagguccccgagccuugccaucccaaaguuccggaaccuugucagcccaaggugccugagcccugccaccccaaggugccugaaccgugucccucuauugucacgccugcccccgcucaacagaaaaccaagcagaaauga

SEQ ID NO: 76210 - RNA, 219 nt, Artificial Sequence
  derived and/or modified sequence opt5 from SPRR2A__Homo_sapiens__NP_005979
augagcuaccagcaacagcagugcaagcagcccugucaaccuccgcccgugugcccuacccccaaauguccugagcccugcccuccgcccaaguguccugaacccugcccucccccgaaauguccucagcccugcccuccccagcagugucaacagaaguaucccccugucacaccgucucccccuugccaguccaaauacccucccaagagcaaguga

SEQ ID NO: 76211 - RNA, 219 nt, Artificial Sequence
  derived and/or modified sequence opt5 from SPRR2B__Homo_sapiens__NP_001017418
augagcuaccagcaacagcagugcaagcagcccugucaaccuccgcccgugugcccuacccccaaauguccugagcccugcccuccgcccaaguguccugaacccugcccucccccgaaauguccucagcccugcccuccccagcagugucaacagaaguaucccccugucacaccgucucccccuugccagcccaaauacccucccaaguccaaguga

SEQ ID NO: 76212 - RNA, 510 nt, Artificial Sequence
  derived and/or modified sequence opt5 from SPRR3__Homo_sapiens__NP_001091058
augagcuccuaccagcaaaagcagaccuucacacccccuccgcagcugcagcaacaacaggugaaacagcccucucagccucccccucaggagaucuuuguccccacgaccaaggaaccuugccacagcaaaguuccgcagcccggcaacacaaagauuccugagcccggguguaccaaagugccugaacccggaugcacaaaggugccggagccuggcuguaccaagguccccgaaccugggugcacaaaagugcccgagcccggauguaccaagguuccugagccgggcugcacgaaagugcccgaaccuggguauaccaagguccccgagccuggauccaucaaagugcccgaccagggcuucauuaaguuuccggaaccuggcgccaucaagguucccgagcaaggguacacaaaagugccuguccccggauauaccaagcucccugagcccuguccgucuacagugaccccuggccccgcucagcagaaaacgaagcaaaaauga

SEQ ID NO: 76213 - RNA, 753 nt, Artificial Sequence
  derived and/or modified sequence opt5 from SPRTN__Homo_sapiens__NP_001010984
auggacgaugaccugaugcucgcccugagacuucaggaggaauggaaccugcaagaggcugaacgggaucacgcccaggagagccucucccugguggacgcgucuugggaacuugucgaucccaccccugaccugcaggcucucuucguucaguuuaaugaucaauucuuuuggggccagcuggaggccguggaggugaaguggagcguccgcaugacacugugcgccgggaucuguuccuacgaaggaaaaggcgggaugugcucuauuagacucagcgagccgcugcuuaagcugcggccccgcaaagaccucguggaaacgcugcuucaugagaugauccacgcuuaucuguucguuaccaacaaugauaaggacagagagggacauggcccugaauuuuguaaacacaugcaucggauuaacucccucacaggggccaauaucaccguguaccacacauuccacgaugaggucgacgaauaucgcagacauugguggcggugcaacggacccugucagcaccgcccucccuacuauggcuacgugaagagagcuaccaaucgggagccuucugcccaugauuauuggugggcggaacaccagaagacaugcggcgggaccuacauuaaaaucaaggagccggagaacuacagcaaaaagggaaaaggcaaggccaagcuggggaaagaacccguucuggcugccgagaauaagggaacguuuguguauauccuccugauuuucauguga

SEQ ID NO: 76214 - RNA, 960 nt, Artificial Sequence
  derived and/or modified sequence opt5 from SPRY1__Homo_sapiens__NP_001244968
auggacccccagaaccaacacggcagcggguccucucugguggucauccagcagccuagccucgauuccagacagcggcuggacuacgagcgcgaaauucaaccgaccgccauccuuucucuggaucagauuaaggcuaucagaggaagcaaugaguauacagaaggccccuccguugugaagcggccugcgccccgcacggccccuagacaggagaagcaugaacggacccacgagauuauccccaucaacgugaauaacaauuacgagcaucgccacacaucucaucucgggcacgcuguccugccuagcaacgccagaggaccgauucuuucccggagcaccucuacaggcuccgccgcuagcucuggguccaauagcucugccuccagcgaacagggacugcucggccgcucucccccuaccagacccgugccuggccaccgguccgagcgcgcuaucagaacacaacccaaacagcugauuguugacgaucugaaggggagccucaaagaagaccugacccagcauaaguucaucugcgagcaguguggaaagugcaaauguggcgagugcacggccccgcggacccuuccuuccugucuggcgugcaaccgccaaugucucugcagcgccgaaucuaugguggaguaugggacauguaugugccuggucaagggaaucuuuuaccacuguuccaaugaugacgaaggcgauagcuauucugacaaccccugcagcugcucccagucucauuguugcagcagauaccuuuguaugggggcuaugucccuguuccucccuugccugcuguguuauccucccgccaaaggaugccucaagcugugucggagaugcuacgauuggauucaccgccccggcugucggugcaaaaauagcaacaccguguacuguaaacuugagucuugcccguccagaggccaggggaagcccagcuga

SEQ ID NO: 76215 - RNA, 948 nt, Artificial Sequence
  derived and/or modified sequence opt5 from SPRY2__Homo_sapiens__NP_005833
auggaggccagagcucagagcggcaacgggucccaaccccugcuccagaccccucgggacggaggccgccagagaggggaaccggauccccgggacgcccugacacagcaagugcacguccuuucucuggaucagauccgcgcgauuagaaauacgaacgaguacaccgaaggaccuacaguugugccccggccuggccucaagcccgcuccucgcccgagcacccagcauaaacacgagagacugcaugggcuucccgaacaccggcagccuccccgccugcaacauucccaggugcacucuagcgccagagccccucucucccggucuaucagcacagucuccagcggaucucgcuccagcaccagaacaucuaccuccagcagcuccagcgagcagcggcugcugggcuccucuuucagcuccggccccguggcugacgggauuauccgcguucagccgaagucugagcucaaaccuggagaacugaagccccuuucuaaagaggaucugggccuccacgccuauagaugcgaagacugugggaagugcaaguguaaagagugcacguacccucggccccugcccuccgauuggauuugugacaagcaaugccuuuguagcgcucagaaugugaucgauuauggaaccugcgucuguugcgugaaaggccuguuuuaccauuguucuaacgacgaugaggacaauugcgccgauaacccuugcagcuguucccagucucacugcuguacaagauggagcgcgauggggguuaugucccucuuccugccgugccugugguguuaucuccccgccaagggaugccugaaacuuugucaaggcugcuacgaccgcgugaaucggccuggcuguagaugcaagaacagcaauaccgucuguugcaaggugcccacagugccuccccgcaacuuugaaaaaccgaccuga

SEQ ID NO: 76216 - RNA, 867 nt, Artificial Sequence
  derived and/or modified sequence opt5 from SPRY3__Homo_sapiens__NP_005831
auggacgccgcugugaccgaugacuuccagcaaauccugcccauugagcagcucagaagcacacacgccuccaacgauuacgucgaacggccuccggcgcccugcaagcaggcucugucuagcccuucccuuaucguucagacgcauaaaucugacuggagccuggccaccaugcccacaucccucccucgcucucugagccaaugucaccagcuucagccccugccucagcaucucucccaaagcucuauugccuccagcaugucucacuccaccacagcuagcgaucagagacugcuggccucuaucaccccgucccccagcggccaguccauuauccggacacagccuggggcuggagugcaucccaaggccgacggcgcgcucaaaggggaggccgaacaaucugcuggacacccuagcgagcaccuguuuaucugcgaagaguguggccgcugcaagugugugcccugcaccgccgcuagaccgcuuccuuccuguuggcugugcaaucagcggugucucugcagcgccgagucucugcuugauuaugggacgugucugugcugcgucaaaggacucuucuaccauuguuccaccgacgaugaagacaacugcgcggaugagcccuguagcugcggcccuucuagcuguuuugugcgcugggccgcuaugucccugauuucucuguuccuccccugccuguguugcuaucuucccacaagaggcugucugcaccucugccagcaaggguacgacagccugcggcgcccuggauguagaugcaagcggcauaccaauacaguuugccgcaagaucuccagcggcucugccccguuucccaaagcucaggaaaaguccguguga

SEQ ID NO: 76217 - RNA, 900 nt, Artificial Sequence
  derived and/or modified sequence opt5 from SPRY4__Homo_sapiens__NP_001280218
auggagcccccuaucccgcagagcgcuccccugaccccuaacuccgugaugguccaaccccuccuggacucuagaaugagccacucccggcuucagcauccucugacaauucuccccaucgaucagguuaagacgucucacguggaaaaugacuacauugauaacccuagccuggcccuuaccacaggcccgaaacgcaccagagggggagcccccgagcuggcgccuacacccgcucggugcgaccaggaugugacccaucacuggaucuccuucucuggccgcccuagcuccgucucuagcuccagcucuacauccagcgaccaaagacuccuggaucauauggcucccccgccuguggccgaccaggccucuccccgggccguucgcauucagccuaaggugguccacugucagccccuggaucucaaagggcccgcugugccuccggaacuggacaagcacuuucuucugugcgaggccuguggaaaaugcaaguguaaggaaugcgcgucccccagaacccucccuagcuguuggguuugcaaucaagagugucugugcuccgcccagacgcuugugaacuauggcaccuguaugugccugguccaggggaucuucuaccauugcacaaaugaggaugacgaaggaucuugugcugaucaccccugcagcuguucccggagcaacugcugugcccgcuggucuuuuaugggcgcucucuccguggugcugccuugccugcucuguuaucugcccgccaccggcugcgucaaacuugcgcagagaggguacgaccggcugcgcagaccgggaugucggugcaagcauacaaauagcguuaucuguaaagccgcuucuggcgacgccaagaccagccgcccugauaaacccuucuga

SEQ ID NO: 76218 - RNA, 474 nt, Artificial Sequence
  derived and/or modified sequence opt5 from SPRYD7__Homo_sapiens__NP_001120954
auggccaccagcgugcugugcugucucagaugcugucgggacggcgggacaggacacaucccccugaaggagaugccugcuguccagcuugauacgcaacauaugggcauuugggggaucggaguugccacccagaaagugaaccugaaucagauuccgcucggccgcgacaugcacucccuggugaugagaaacgauggggcgcuuuaccauaauaacgaagagaagaaucggcugcccgcuaacucucucccucaggaaggagacgucgugggcaucacauaugaucacguugagcugaauguguaccugaacggcaaaaauaugcauugccccgccagcgggauucgcggaaccgucuauccugugguuuacguggacgauuccgccauccucgacugucaauucucugaauuuuaucacacacccccuccgggcuucgagaagauccuguuugagcagcagauuuucuga

SEQ ID NO: 76219 - RNA, 1068 nt, Artificial Sequence
  derived and/or modified sequence opt5 from SPSB3__Homo_sapiens__NP_543137
auggccagacggccccgcaacagcagagcuuggcacuucgugcuguccgccgcgcggcgcgacgcugaugccagagccgucgcucucgccggcucuaccaauuggggguacgacagcgauggacagcauuccgacucugauagcgacccugaguauuccacacugccgcccucuaucccuagcgcuguucccgugacgggcgaauccuuuugcgauugugccgggcaaagcgaggcgucuuucugcuccagccuucacucugcccaucggggacgcgacuguagaugcggcgaagaggaugaauacuuugacugggugugggaugaccugaacaaguccagcgcuacccuccugucuugugauaaucggaaagucuccuuccacauggaguauagcugcgggacagccgcuauucgcggaaccaaggagcuuggcgaaggccagcauuuuugggagaucaaaaugacauccccuguguacgggaccgacaugaugguuggaauuggcacaucugacguggaucuggacaaguauagacacaccuucuguagccuccuggggcgggaugaagacuccuggggacugagcuacacgggccuccugcaccauaaaggggauaagaccucuuuuuccagccgcuucggacagggcucuaucauuggcguccaccuugacacauggcaugggacccugacauuuuucaagaacagaaaaugcaucggaguggccgcgaccaagcuccagaauaaacgguuuuaucccaugguuuguagcacggccgcucgcuccucuaugaaggugacaagaagcugcgccuccgcuaccagccugcaauaccuuuguugccaccggcugagacagcuccgcccugauucuggcgacacacuggaggggcugccgcugcccccuggacucaaacagguccuucacaacaagcugggcugggugcucuccaugagcugcucucggagaaaggcccccguguccgauccucaggccgcuaccagcgcgcaucccuccucucgcgagccgcggccuugucaaagaaaacgcugccggagaaccuga

SEQ ID NO: 76220 - RNA, 822 nt, Artificial Sequence
  derived and/or modified sequence opt5 from SPSB4__Homo_sapiens__NP_543138
augggccagaagcugagcgggucccucaaaucuguggaggucagagaacccgcccugcggccugcuaagcgcgagcuuagaggagccgaaccgggccggcccgcgcgccuggaccaacuccuggauaugccugcugccgggcuugccguucagcugagacacgcuuggaaccccgaggaccggagccucaauguguucgugaaagaugacgaucgccugaccuuucauagacacccugucgcccaguccacagacggaauccggggcaagguggggcaugcucgcggacugcacgccuggcagauuaacuggcccgcgagacaacggggcacgcaugccguugugggcgucgcuaccgcccgcgcuccucuccacucugugggguacacagcccugguuggaagcgaugcggaauccuggggcugggaccuugggagaucucggcuguaucacgauggcaaaaaucagccgggaguggccuaccccgcuuuccucgggccugacgaggccuuugcucugcccgauagccuucuggucgugcucgacauggaugagggaacccuguccuucaucguggacggccaguaucugggcgucgccuuucgcgggcucaagggaaagaaacuguacccuguugugagcgccguguggggccauugcgaagucacaaugagauauauuaacgggcuugaccccgagccgcugccucucauggaucugugucggagaucuauccgcuccgcucuuggacggcagagacugcaagacauuagcucucucccccugccucagucccugaagaauuaccuccaguaucaguga

SEQ ID NO: 76221 - RNA, 7260 nt, Artificial Sequence
  derived and/or modified sequence opt5 from SPTA1__Homo_sapiens__XP_011508218
auggagcaguuccccaaggaaaccguggucgagagcuccggcccuaaaguucuggaaacagccgaggaaauccaagagagacggcaggaggugcucacgcgcuaccagucuuuuaaggaaagaguggcugagcgggggcagaaacuggaagacagcuaucaccuucaagucuucaagcgcgaugccgacgaucugggaaaauggauuauggagaaggugaacauccucaccgacaaguccuacgaggauccgacaaauauucagggcaaauaucagaagcaucagucucuggaagcggagguucaaaccaaaagcagacuuauguccgaacuggagaagacacgggaagagcgcuuuaccauggggcacucugcucaugaggaaacaaaagcccacaucgaggaacucagacaucugugggaccugcuccuggagcuuacccuggaaaagggagaucagcuccugcgggcccuuaaguuccagcaguacgugcaagagugcgcugacauucuggaguggaucggcgauaaagaagccaucgcuacgagcgucgagcucggggaagacugggagcgcaccgaagugcugcacaagaaauuugaggauuuccagguugagcugguggccaaggaaggaagagucguggaggugaaccaguaugcgaaugaaugugccgaggagaaccaccccgaccucccucugauucaauccaaacagaaugaagucaacgcugccugggagcggcuucgcggccuggcucuccagagacagaaggcccugagcaaugcggccaaccuucaacgguuuaaacgcgauguuacagaagcuauccaguggauuaaggagaaggaacccgugcugaccucugaggacuacggcaaagaccucguggccuccgaggggcuguuccauagccacaagggacuggaaagaaaucucgcugucaugucugauaaagugaaggagcugugcgccaaagccgaaaagcuuacacugucccauccuagcgacgcuccccagauccaggagaugaaggaagaucucguuucuuccugggagcacauucgggcgcuggccaccagcagauaugagaaacuucaagcuacguacugguaccaccgcuuuuccucugacuucgaugaacugagcggcuggaugaacgagaagacagccgccaucaaugcugacgaacucccuaccgauguggccgggggagagguccugcuggaccggcaucagcagcacaaacaugaaauugauuccuaugacgauagauuucagagcgcggacgagacaggccaagaccucgugaacgcuaaucacgaggccucugaugaaguucgcgagaagauggaaauccuggacaacaauuggaccgcccuucuggagcucugggaugagcggcauagacaguacgaacagugucuggacuuccaccuguuuuaucgcgauuccgagcagguggacagcuggaugucucggcaagaagcuuuccuugagaacgaagaucucgggaacagccugggauccgccgaggcucugcuccagaaacacgaggacuucgaagaggccuuuaccgcgcaggaagagaagaucauuacagucgauaagacggccaccaaacugaucggcgacgaucauuacgacucugaaaauauuaaggcuaucagagauggccuucuggcccgccgggacgcucucagagagaaagccgcgacacgccggagacugcugaaggagagccuucuccugcaaaaacuguaugaagacuccgaugaccucaagaacuggauuaauaagaaaaagaaacuggccgaugacgaggauuacaaggacauccagaaccuuaaaagccgggugcagaagcagcaagucuucgaaaaagagcuggcugugaauaagacccagcucgaaaacauccagaagacagggcaggagaugauugagggaggccacuaugccucugauaauguuaccacgcgccuguccgaaguggcuagccugugggaggaacuucucgaggccacaaaacaaaaggggacccagcugcaugaggccaaccagcagcugcaauuugaaaauaacgcugaggaccuccagagauggcuggaagaugucgaguggcaggugaccucugaagacuacggaaaaggccuugcggagguucaaaaucggcugagaaagcacgggcuccuggaguccgccguggcugcccgccaggaucaggucgacauccugacagaucuugccgcuuacuucgaagagauuggacacccggacagcaaagacauccgggccagacaggaaucccucgugugccgcuuugaggcgcugaaggaaccccuggcuaccagaaagaaaaagcuccuggaucuucugcaucuccaacugauuugucgggacacagaggaugaggaagccuggauccaggagacggaaccuucugccaccagcacauaucugggcaaagaccuuaucgcuuccaagaaacugcucaaccgccacagagugauucuggagaauaucgccucucaugaaccccggauucaggagaucaccgagcgcggcaacaagaugguugaagaggggcacuucgcggcugaagaugucgccagcagagugaagucccucaaucagaacauggagagccugcgggcccgcgcugccagacggcaaaacgaccuugaggcuaaugugcaguuucagcaguaccuggccgaucuccaugaagcggagacauggauucgcgaaaaagagccuaucgucgacaacaccaauuauggagccgaugaagaggcugccggcgcucugcugaagaaacacgaggccuuccuucuggaccucaacucuuuuggggauuccaugaaggcccugagaaaucaagcuaacgcgugccagcagcagcaagccgcucccguggaaggaguugccggcgagcagcgggugauggcccucuacgacuuccaggcuagaagcccgcgcgaagucacgaugaaaaagggggacgugcugacccuucugucuuccauuaauaaggauugguggaaaguugaggccgcggaccaccaaggcaucgugccugcugucuaugugcggagacucgcccaugaugaauuucccaugcugccucagcgccggagagaggagcccggaaacaucacacagcgccaggaacaaauugagaaucaguaccggagccugcuugacagagccgaagagcgccggagacggcugcuccagcgcuauaacgaauuccugcucgcuuacgaggccggcgauaugcuggaguggauccaggaaaagaaagcggagaauaccgggguugaacuugacgaugugugggagcugcaaaagaaauuugacgaguuccagaaggaucugaacacaaaugaacccagacuccgggacauuaacaaagucgcugaugaccugcuuuucgagggacugcucaccccugaaggcgcccagauccgccaggagcugaauucuagaugggggagccuccaacggcuggccgaugaacagagacagcuucugggauccgcucacgccguggagguguuucaucgcgaggcugacgacacgaaggaacaaauugagaagaaaugucaggcccugagcgcggccgauccgggcucugaccucuucuccguccaggcucugcagcggagacacgaaggguuugagcgcgaucuuguuccccugggcgacaaggugacaauccucggagaaaccgccgagcggcugagcgagucccauccugaugcuacagaagaccuccaaagacagaaaauggagcugaacgaagccugggaggaucuucagggccgcaccaaggaccggaaagaaucucugaacgaggcccagaaguucuaccuguuucucagcaaggcuagagaucugcaaaauuggaucuccucuauugggggaauggugagcucccaggagcuugcggaagaccugaccggcaucgagauucuccuggaacgccaccaggagcacagagccgauauggaggcugaagcccccacauuccaggcccucgaggacuuuucugcugaacugaucgauagcgggcaucacgccuccccugagauugaaaaaaagcuucaagcggucaaacuggagcgggacgaccuggagaaggcuugggaaaaacgcaagaagauccucgaucagugccuggagcuucagauguuccagggaaacugugaccaaguggaaagcuggaugguugccagagagaauucucugcgguccgaugacaaaagcucucucgauucccuggaagcccugaugaagaaacgcgacgaucucgacaaggcuaucacggcccaggagggcaaaauuaccgaucuugagcauuuugcggaaagccugaucgccgacgagcacuaugcuaaggaagagauugccacaagacugcagcgggugcucgauagauggaaggcucugaaagcccaacuuaucgacgaacgcaccaagcugggggacuacgcuaaccucaaacaguucuaucgggaucuggaggagcuggaagaguggauuucugaaaugcuccccacagccugcgacgaguccuacaaggaugcgaccaauauccagagaaaauaucuuaagcaccagacguuugcccaugaggucgacggccgcagcgaacaagugcacggaguuaucaaccugggcaauucccugauugaguguagcgcuugcgaugggaacgaagaggccaugaaggaacagcucgagcagcugaaagagcauugggaccaccuucuggaacggacaaaugauaagggaaaaaagcucaacgaggcuucuagacagcaacgguucaauaccagcauccgcgacuuugaauucuggcuguccgaggccgaaacccugcucgccaugaaagaucaggcuagagaccuugcgucugccggcaaccugcugaagaaacaucagcuccuggagcgggagaugcuugcucgcgaagaugcccugaaggaccucaauacacuggccgaggaucugcucagcuccgggaccuucaacguggaccagauugucaagaaaaaggacaaugugaacaaaagauuucuuaacguucaagaacuggcugccgcgcaccacgagaagcugaaagaagccuacgcucucuuccaguuuuuccaggaucuggacgaugaggagucuuggaucgaagagaagcuuauucgggugagcucccaagacuauggacgcgaucugcagggcguccagaaucuccugaagaaacauaagagacuggaaggggagcucguggcccacgagccggcuauccagaacgugcuugacauggccgaaaaacugaaggauaaagcggccgucggccaagaggaaauucagcugcggcucgcucaguuuguugagcauugggaaaagcugaaggagcuugccaaagcucgcggacugaagcucgaggaaucucuggaguaccugcaguucaugcaaaaugccgaagaggaagaggcuuggaucaacgagaaaaaugcccucgcggugagaggcgacugcggggauacacuugccgcuacgcagagccugcugaugaagcacgaagcccucgagaacgacuuugcugugcacgaaacccggguccagaaugugugugcccagggagaggauauccugaacaaaguucuucaagaagagucccagaauaaggagauuagcucuaagaucgaagcccugaacgagaaaacaccuucccucgcgaaggcuauugccgcuuggaaacugcagcuggaagacgacuacgccuuccaagaguuuaauuggaaggccgauguggucgaggcuuggaucgccgacaaagaaaccagccucaagacaaacggcaauggggcggaucuuggagacuuccugacccugcucgccaaacaggauacgcuggacgcuucucuucaguccuuucagcaagagagacugcccgaaauuaccgaucucaaggacaagcugaucagcgcccagcauaaccaguccaaagcuaucgaggaacgcuaugccgcgcugcucaagcggugggagcagcuucuggaggccucugcugugcacagacaaaaacugcucgaaaagcagcugccucuucagaaagccgaggaucuguucguugaauucgcucauaaggccagcgcucucaauaacuggugcgagaagauggaagagaaucuguccgagcccgugcacugugucagccugaacgaaauucgccagcuccaaaaagaccaugaggauuuucuugccucucuggcgcgggcccaggcugacuucaagugccugcucgaacuggaucagcagaucaaagcccuuggcgugccuuccagccccuacacauggcugaccgucgaggugcucgaaagaacauggaagcaccugucugacauuaucgaggagcgcgaacaagagcugcagaaagaagaggcucggcagguuaagaacuuugagaugugucaagaauucgagcagaaugccagcaccuuucuccaguggauucuggaaacaagagccuauuuccuugacggcucccugcucaaggagaccgggacgcuggaaucucagcuugaggcgaacaaacgcaagcaaaaagagauccaggcuaugaagcggcagcugacaaaaaucguggaucucggagacaaucuggaagaugcccugauucucgacaucaaguacagcaccauuggccuggcccagcaaugggaucagcuuuaucagcuggggcucagaaugcagcacaaccuggagcaacagauccaggcuaaggacauuaaaggagucuccgaagagacccuuaaggaauuuucuacaaucuacaaacauuucgaugagaaucugaccggccgccucacgcacaaggaguuucggagcugccugagagggcugaacuauuaccucccgaugguggaagaggacgaacaugagccuaaauucgaaaaguuucuggaugccguugaccccggacgcaaaggcuacgugucccuugaggauuauacagcuuuccugauugacaaggagagcgaaaauaucaagucuuccgaugagaucgaaaacgccuuucaagcgcucgccgagggcaaaagcuacauuaccaaggaggacaugaaacaggcucugacacccgaacaggucuccuucugugccacccacaugcagcaauauauggacccuagagggcggucucaccuuagcggauacgauuaugugggcuucacaaauuccuacuuugggaacuga

SEQ ID NO: 76222 - RNA, 7434 nt, Artificial Sequence
  derived and/or modified sequence opt5 from SPTAN1__Homo_sapiens__NP_001123910
auggaccccagcggcgugaaggugcuggagaccgccgaagauauccaggagcggcggcagcagguucucgacagauaccacagauucaaagaacuguccacacuucggcgccagaagcuggaggauucuuauagauuucaguucuuucaacgggacgcugaggaacuggagaaauggauucaggaaaagcugcagaucgccagcgaugagaacuacaaagacccuacgaaucuucaggggaagcugcaaaagcaucaggcguucgaagcugaggugcaggccaacuccggagccauugugaaacucgaugagaccggcaaucugaugaucucugaagggcacuuugcuagcgagacaauucgcaccagacugauggaacuccaucggcagugggagcugcuucuggaaaagaugcgcgagaaaggaaucaagcuccugcaagcccagaaacuuguccaguaucugagagagugcgaagacgugauggauuggaucaacgacaaggaggcuauuguuacauccgaagaacucggccaagaucuggaacacguggagguccugcagaagaaauucgaggaauuucagaccgacauggccgcgcaugaggaacgggugaaugagguuaaccaguucgccgcuaagcucauccaagaacagcacccggaggaggaacugauuaaaacaaagcaggaugaggugaaugccgcuuggcagcgccuuaaagggcuggcccuccaaagacagggaaagcuguuuggcgcggccgaaguccagcgguucaaccgcgacguggacgagaccaucucuuggauuaaagagaaggaacagcuuauggcuagcgaugacuuuggcagagaucuggccuccgugcaagcucuccugcggaagcacgaggggcuggaaagagaccucgccgcccuggaggauaaagucaaggcucuuugugcggaagccgaccgccugcagcagagccauccccucucugcuacgcagauccaaguuaaacgggaggagcugauuaccaauugggaacagaucagaacacuugccgccgagcgccacgcucggcugaacgauuccuacagacuccagcgcuuccuggccgacuuucgggaucugaccagcugggugacagaaaugaaggcgcucaucaaugcugacgagcuggccucugauguggccggagcugaagcccuucuggacagacaucaagagcacaaaggcgagauugacgcucacgaagauuccuucaagagcgccgacgagucugggcaggcgcuccuggccgcuggacauuaugccuccgaugaaguccgcgagaagcugaccgugcuuagcgaagaacgggcugcccuccuggagcugugggaacucagacgccagcaguacgagcaaugcauggaccugcagcuuuucuaucgggauacggaacagguugacaacuggauguccaaacaggaggcguuucugcucaaugaggaucugggcgacucucuggauagcguggaagcccuucucaagaaacacgaggacuucgaaaagucccugagcgcucaagaggaaaagaucacagcccuggaugaguuugcuaccaagcucauucagaacaaucauuacgccauggaggacgucgccacaagacgggaugcucugcuuucucgcagaaacgcgcugcacgaacgggccaugagacgccgggcucagcucgccgacuccuuccaucugcagcaauuuuucagagacagcgaugagcugaagucuugggugaacgagaagaugaagaccgccaccgacgaggcuuacaaagauccuagcaaucuucaggggaagguucagaaacaccaagccuuugaagcggagcucuccgcuaaccagucucgcaucgacgcccuggagaaggccggacagaagcugauugaugugaaucacuaugcuaaagacgaagucgccgcgagaaugaacgaggugaucagccucuggaagaaacugcuugaagcuacagagcugaagggcaucaaacuccgggaagccaaucagcaacagcaguucaaccgcaaugucgaggauauugagcuguggcuguacgaaguggagggccaucuugccuccgacgauuaugggaaggaccucacgaacguucagaaucugcagaaaaagcacgcucugcucgaagccgauguggcugcccaucaggacagaaucgauggaauuaccauccaggcgcggcaguuucaagacgccggccacuucgacgcugagaacauuaagaaaaagcaggaggcccuggucgcucgcuacgaagcccuuaaagagcccaugguggccagaaagcagaaacuggcugauagccuccggcugcagcaacuguuucgcgacguugaagaugaggaaacauggaucagagagaaggagccuaucgcggccucuaccaaucgggggaaggaccuuauuggagugcagaaccugcucaaaaagcaccaggcucugcaagccgaaaucgccggccaugagccccgcauuaaagcugucacacagaaggggaaugccaugguggaagagggacacuucgcggcugaagaugugaaagccaagcuccaugagcugaaccagaagugggaggcccuuaaagcuaaggccucccagagacggcaagaccuggaagauagccuccaggcgcagcaguauuuugcugacgccaaugaggccgaaucuuggaugagagagaaagaaccuaucguuggcuccaccgauuacggcaaggacgaggauagcgcugaggcccugcugaaaaagcacgaagcucuuauguccgaccugucugccuaugggagcuccauucaagcgcuccgcgagcaggcccagucuugucggcagcaagucgcuccgacggacgaugaaacaggaaaggagcuggugcucgcccuguacgacuaccaggagaaaagccccagagaagugaccaugaagaaaggcgauauccuuacccugcucaacuccacaaacaaggacugguggaaagucgaggugaaugaucgccagggguucguuccugcugccuaugugaagaaacuggaccccgcccaaagcgcuucucgggaaaaccugcuugaggaacagggauccauugcgcugagacaggagcagaucgauaaucaaacccgcaucacaaaggaggccggcagcgucucucuccggaugaaacagguggaagaacuguaccauucccuccuggaacuuggggagaaaagaaagggcaugcuggagaaaagcugcaagaaauucaugcuguuucgcgaggcuaacgagcuccagcaguggauuaaugaaaaggaggccgcccugacgucugaagagguuggagcugaccuugaacaaguggagguccugcagaagaaauucgaugacuuucagaaggaucucaaagccaacgagagccggcugaaggacaucaauaaaguggcggaagaucucgaguccgaaggccugauggcugaggagguucaggccgugcaacagcaggaagucuaugggaugaugccuagagacgagaccgacagcaagacagccucucccuggaaguccgcucggcuuauggugcacaccguggccacauucaacagcauuaaagaacugaaugagcgcuggagaucccugcagcaacucgcggaagaacggucucagcugcuuggaagcgcccacgagguccagcgcuuucauagagaugcugacgaaaccaaggaguggaucgaagagaaaaaccaagcccugaauacggauaacuacggccacgaccucgcuuccguucaggcccugcagcggaagcaugaaggguucgagagagaucucgcugcccugggagacaaagucaauucucuuggcgagaccgcggaacgccugauucagagccacccggaguccgccgaagaucugcaagagaaguguacagaacucaaccaggcuuggucuagccuggggaagcgggccgaccagagaaaagcuaaacuuggcgauucccaugaccugcagcgcuuucucagcgauuuccgggaccugaugucuuggaucaauggaaucagaggccucguguccagcgaugagcuggccaaggacgucaccggggccgaggcccuucuggaacgccaccaagagcaccggacagaaauugacgcgagagccggaaccuuucaggcuuucgagcaguuuggccagcaacugcucgcccaugggcacuaugccucuccugagaucaagcagaaacuggauauucuugaccaggaacgcgcugaucuggagaaggccugggugcaaagacggaugaugcucgaccagugccuggaacugcaacucuuccaucgcgauugugagcaggcggaaaacuggauggccgcuagagaggccuuucuuaacacggaggacaagggagauucccuggacagcguugaagcucugaucaaaaagcacgaggauuucgacaaagccauuaaugugcaagaagagaagaucgcggcccuccaggcuuucgccgaucagcugaucgcugccggccacuacgcuaaaggggacauuucuucccggcgcaacgaaguccuugacagauggcggagacugaaggcccagaugaucgagaaacgcagcaagcucggcgagucccaaacacugcagcaguuuagccgggauguggacgaaauugaggcguggaucucugaaaagcugcagaccgccagcgaugaguccuauaaagaccccacaaauauucaacucucuaaacuucugagcaaacaucagaagcaccaggcuuucgaagccgagcugcaugcuaacgccgauagaauccgcggaguuaucgacaugggcaauucccucauugagagaggggcuugcgcgggaucugaagaugcugugaaagccagacuggcugcccuugccgaccaauggcaguuucugguccaaaagagcgcugagaagucccagaaacucaaggaagccaacaaacaacagaauuucaacaccggcaucaaggauuuugacuucuggcugucugagguggaggcgcugcucgccagcgaagauuacgggaaagaccuugcuuccguuaauaaccugcugaagaagcaccagcuccuggaggccgauauuagcgcucaugaagaccggcuuaaagaccucaauucucaggccgauucccucaugaccagcucugcguuugacacaucccaagugaaggauaaacgcgacacgaucaacggaagauuccagaagauuaaaagcauggccgcuucccggcgcgccaagcugaaugagucucacagacugcaccaguuuuuccgggauauggacgaugaagagagcuggaucaaggagaaaaagcuccuugucggcuccgaagacuacgggcgcgaucugaccggcgugcagaaccugcgcaaaaagcauaaacggcucgaggcugaacuggccgcucacgagccugccauucaaggagugcuugacacaggcaagaaacugagcgaugacaauaccaucgggaaggaagagauccagcagcgccucgcgcaguuugucgagcauuggaaggaacugaaacaacuggccgcugccagaggacagcggcucgaggaaucucuugaguaucagcaauucguugcuaacguggaagaggaggaagccuggauuaacgagaagaugacacugguggccuccgaagacuacggcgauacccuggcggcuauccaggggcuccugaaaaagcacgaggccuucgagacggacuuuacaguccacaaagauagagugaaugacguuuguaccaacggacaggaucuuauuaagaagaauaaccaucacgaagagaauaucagcucuaaaaugaagggccugaacggcaaagugagcgaccucgaaaaggccgcugcccagcgcaaagcuaagcuggaugaaaauuccgccuuccugcaauuuaacuggaaggcggacgucguggaaucuuggauuggggagaaagagaauagccucaagaccgaugacuauggacgggaucuuuccucuguucagacacugcugaccaaacaggaaacauucgacgccggccuccaggcuuuucaacaggaggggaucgccaacaucacggcucugaaggaucagcuucuggccgcgaaacaugugcagagcaaggccauugaagcuagacacgccucccucaugaagcgcuggagccaacugcuggcuaauucugccgcucggaaaaagaaacuccuugaggcccagucccauuucagaaaggucgaagaccuguuucugaccuucgcgaaaaaggccagcgcuuuuaacuccugguucgagaaugccgaggaagaccucacagaucccgugcgcugcaacucucuggaggaaaucaaagcccuucgggaggcucacgacgccuuuagaagcucccugucuagcgcgcaggcugauuucaaucaacucgccgaacuggaccgccagauuaaguccuuucgggucgccagcaaccccuacaccugguucacaauggaggcucuggaggaaaccuggagaaaucuccagaagaucauuaaagagcgcgaacuugagcugcagaaggagcaacggagacaggaagagaacgauaaacugcgccaggaguucgcccagcacgcuaacgccuuucaucaauggauccaggagacgagaaccuaucuccuggacggaucuuguaugguggaagaguccggcacacuugagagccagcuggaagcgaccaagcggaaacaccaggagauccgcgccaugagaucucaacucaagaagauugaagaucugggggcugccauggaggaagcucugauccucgacaauaaauacacagagcauuccaccguuggacuugcccagcagugggaucagcuggaccaacugggcaugcggaugcagcacaaccucgagcagcaaauucaggcgagaaauacaaccggcgugacggaagaggcccugaaggaguucagcaugauguuuaaacacuucgauaaggacaaaucugggcggcuuaaccaucaggaguuuaagagcugccugcgcucccucggauaugaucugccuauggucgaagagggcgagccggaccccgaguucgaggcuauccuggacacaguggauccuaauagagacgggcacguuucucuccaggaauacauggccuuuaugauuagccgggagaccgagaacgugaaguccagcgaagagaucgaauccgcuuuccgcgcccugucuagcgagggaaaacccuacgucaccaaggaggaacuuuaucaaaaucugacaagagagcaggccgauuacugcgugucccauaugaaaccuuauguggacggcaaggggcgggaacuccccaccgcuuuugauuacguugaguucacgcgcucucuguuugucaacuga

SEQ ID NO: 76223 - RNA, 6414 nt, Artificial Sequence
  derived and/or modified sequence opt5 from SPTB__Homo_sapiens__NP_000338
augaccagcgccacagaguucgaaaacgugggcaaucagcccccuuacuccagaaucaacgcucggugggacgccccggaugacgagcuggauaaugacaacucuagcgcgcgccucuuugaaagaucccggauuaaggcucuggccgaugagcgcgaagugguucagaagaagacguucaccaaaugggucaauucucaccuugccagagugagcugccggaucacagaccuguauaaggaucuccgcgacgggagaaugcugauuaaacuucuggagguccucuccggagagaugcugcccaagccuaccaagggcaaaaugcggauccacugucuggaaaacguggauaaggcucuccaauuucugaaagagcagcgcguucaccuugaaaauauggggucucaugacauuguggauggaaaccacagacugguccucggccugaucuggacaaucauucuucgguuccagauccaagacauugugguucagacccaggaggggcgcgagacaagaagcgccaaggaugcucugcuccuguggugccagaugaaaaccgccggauacccccaugugaaugucacgaacuuuaccuccagcuggaaggacggccuggcguucaaugcccucauccacaagcaccggccugaccugauugauuuugacaaacuuaaggauucuaacgcucgccauaaucuggaacacgccuucaacguggcugagagacaacucggcaucauuccccugcuugacccugaagauguguuuacagagaauccggacgaaaaauccaucaucaccuaugucguugccuucuaccauuauuuuagcaagaugaaagugcuggcgguggaggggaagcgggucggaaaagugauugaucacgccaucgagacagaaaagaugauugagaaguacucuggccucgcuuccgaccugcugaccuggaucgaacagacgauuacaguucucaacagcagaaaauucgccaacucucugaccggggugcagcagcaacuucaggcuuuuuccacauaucgcaccgucgagaagcccccuaaauuccaggaaaagggaaaucuggaggugcuccuguucaccauccaaagccggaugagagccaacaaucagaaaguuuacacaccccacgauggcaaacuuguguccgacaucaaccgcgccugggagucucuggaagaggcugaauaccggagagagcucgcgcugcgcaaugaacugauucggcaggagaagcucgagcagcuggccagacgcuuugaucggaaagcugccaugagagaaacguggcuuagcgagaaccaacgccuggucgcccaggacaauuucggguaugaccucgcugccguggaagcggcuaagaaaaagcaugaggccaucgagaccgauacagccgcuuacgaagaacgggucagagcccuggaagaccuggcucaggagcuugaaaaagagaacuaucacgaucagaagcggauuaccgcccgcaaggacaauauccucagacugugguccuaccugcaagagcuccugcagagccggagacagcgccuugaaacaacccuggcgcuccagaaacuguuucaagauaugcugcauucuauugacuggauggaugagaucaaggcccaccuucucuccgcugaguucggaaaacaucugcuggagguggaagaccuccugcagaagcacaaacuuauggaggccgauaucgcuauucagggcgacaagguuaaggccaucacggcggccacacugaaauuuaccgagggcaagggguaucagccuugugauccccaagugauucaggaccggaucagccaccucgaacagugcuucgaggaacugucuaacauggcugccggaagaaaagcucaacuggagcagagcaagcgccuuuggaaauuuuucugggaaauggaugaggccgaguccuggauuaaggaaaaagagcagaucuacucuagccucgacuauggcaaggaccugaccuccguccugauucuccagagaaagcauaaagccuuugaagaugagcugcgggggcuugacgcucaccuggagcaaaucuuccaggaagcgcauggaaugguggcccgcaagcaguuuggccacccgcagaucgaggcuagaauuaaagaaguuagcgcccaaugggaucagcucaaggaccuggccgcuuucuguaaaaagaaucugcaggaugccgagaacuuuuuccaguuccaaggggacgcggaugaccuuaaggcuuggcuccaggaugcccaccggcugcugucuggagaagacgugggccaggaugagggcgccacacgcgcucucgggaaaaagcauaaagacuuucuggaggaacuugaggaauccagaggagucauggagcaccuggaacaacaggcccagggcuucccugaggaguuucgggauagccccgacgugacccaucgccuccaggcgcugagagaacuguaccaacaggugguugcucaggccgaccuucggcagcaacgccugcaggaggcccucgaucuguacacagucuucggggaaacggacgcuugcgagcucuggaugggagaaaaggagaaauggcuggccgagauggaaaugccugauacccuugaggaccuggaaguggugcagcacagauuugauauccucgaccaggagaugaagacacugaugacccaaauugauggcgucaaucuggcugccaacucucuuguggaguccgggcauccccggagcagagaaguuaagcaguaucaggaccaccugaauacacgcuggcaggcguuccaaacccucguguccgagcggagagaagccgucgauucugcucugcgcgugcacaacuacuguguugacugcgaggaaacgagcaaauggaucaccgauaagacaaaaguggucgaguccaccaaggaccucggccgggaccuggccggaauuaucgcuauccagagaaaacuuucuggccuggagcgcgauguggccgccauucaggcucggguugacgcgcucgaaagagagagccaacagcugauggauucccaucccgaacagaaggaggacaucgggcagcgccaaaagcaccuggaagaacuuuggcagggacugcagcagagccuccaaggccaggaggaucugcucggggaagugucucagcugcaggccuuucuucaagaccuggaugacuuccaggcuuggcuguccauuacacagaaagccgucgccagcgaggauaugccugaaucucucccggaggcugaacaacugcuucagcagcaugccggaaucaaggacgagauugauggccaccaggacuccuaucaacgggugaaagagagcggggaaaaggugauccagggccagaccgaucccgaguaccugcuccugggacagagacucgaaggccuggacacgggguggaacgcgcuuggacggaugugggagucucgcagccauacacuggcucaaugucugggcuuucaggaguuccagaaagacgccaagcaggccgaagcuauccucuccaaucaagaguauacccuggcccaccuugaaccucccgauagccuggaggcggcugaagccgggauuagaaaauuugaggacuuccucggaucuauggagaacaaucgggauaagguccuguccccuguugacagcggcaacaagcucguggccgaagggaaucuguacuccgauaaaaucaaggagaaagugcagcuuauugaagaccgccacagaaagaacaaugagaaagcucaggaagccucuguccugcugcgggauaaccucgagcugcagaauuuucuucaaaacugccaggagcugacacucuggaucaaugacaagcugcucaccagccaggauguguccuaugacgaagcuagaaaccugcauaauaaguggcuuaaacaccaagccuucguugcggagcuggccucucaugaaggcuggcuggagaacauugaugcugaaggaaagcagcucauggacgagaaaccccaguucaccgcccuggugagccagaaacuugaggcucugcaccgccucugggaugaacugcaagccacaacgaaagagaagacccagcaccuguccgccgcucggucuagcgaccucagacuucagacacaugcggaccugaauaaguggaucuccgccauggaagaucagcugcgcagcgacgauccgggcaaagaccucaccucugucaaccggaugcuggcuaaacuuaagagaguggaggaucaaguuaacgugcgcaaggaggaacugggggagcucuuugcccaggucccuuccaugggagaagagggcggggacgccgaucugagcaucgaaaaacgguuccuggaccuccuugagccccugggaagacgcaagaagcagcuggagucuuccagagcuaaacuccagauuagccgggaucuggaagacgagacacuuuggguggaggaacgccugccucucgcccaaucugcggauuacggcaccaaucugcagacgguucagcuguuuaugaagaaaaaccaaacacuccagaaugaaauccuugggcacacccccagaguggaggacguccugcagcggggccagcaacugguggaggcugccgaaauugacugucaggaucucgaggaacgccugggacaucuucaguccagcugggacagacugcgggaggccgcugccggcagacuccagcgccugcgggaugcgaacgaagcccaacaguacuaucuggacgcugaugaggccgaggcuuggaucggggaacaggagcucuacgugauuuccgacgaaaucccuaaggaugaggagggagccauugucaugcuuaaaagacaucugcgccagcaacgggcuguugaagacuauggcagaaauaucaagcagcuggccagccgggcgcaggggcuccugucugccggacaucccgagggcgaacaaaucauucgccuucagggccagguggauaagcacuacgcugggcugaaagacguggccgaggaaagaaagcggaaacucgagaacauguaucaccuguuccagcugaagcgcgagaccgaugaccucgaacaauggaucagcgagaaagaacuugucgcuuccucuccggagaugggacaggauuuugaccaugugacacugcugagagacaaguuccgggauuuugcccgcgaaaccggcgccauugggcaggagagaguugacaaugugaacgcuuucaucgagcggcucauugaugcgggacacagcgaagccgcuacaaucgccgaguggaaagacggccugaaugaaaugugggccgaucuucuggagcucaucgacacgcgcaugcagcugcuggcugccuccuacgaucuccauagauauuuuuacaccggggcggaaauucuuggacugaucgacgagaagcaccgggagcugccugaagaugucggccucgacgccucuacagcugagagcuuccacagagugcauaccgccuuugaacgcgagcugcaccuucugggcguucaagugcagcaguuccaggaugucgcuacacggcuccaaaccgccuacgcgggggagaaggccgaagcuauucagaacaaagagcaggaaguguccgccgcuuggcaggcccugcuggacgcuugcgccggaagacgcacgcaacucgucgacaccgcggauaaguuccgguuuuucucuauggccagagaccuucugagcuggauggaguccaucauucgccagaucgaaacacaggagcggcccagagaugugagcucuguugagcugcucaugaaauaucaucaaggcaucaaugcugaaauugagacccgcuccaagaacuuuagcgccugccuggaacuuggggagucucugcuccagcggcagcaccaggcuuccgaagagaucagagagaaacugcaacaggugaugagccgccggaaggaaaugaaugagaagugggaagccagaugggagcgccugagaaugcuccuugaagucugucaguucucccgggacgccucuguggcggaggcuuggcugauugcccaggagcccuaccuggcuagcggagauuuuggccauacaguugacuccguggaaaaacucaucaagcgccacgaggccuucgaaaagagcaccgccucuugggcugagagauuugccgcgcuggagaagccuacaacccuugagcugaaagagcggcaaauugccgaaagaccggcugaggaaacggggccccaggaggaggaaggagagacagccggcgaagcuccugucucccaccaugccgcgaccgagcggaccagccccgugucucucuggagccgccuguccucuagcugggaaucccugcagccugagcccucucacccuuauuga

SEQ ID NO: 76224 - RNA, 6468 nt, Artificial Sequence
  derived and/or modified sequence opt5 from SPTBN1__Homo_sapiens__NP_842565
auggagcugcaaagaaccagcuccaucucuggcccccucagcccugccuacacagggcaagugccguauaacuacaaucagcuggaaggacgguucaagcagcuucaggacgagagagaagcuguccagaagaaaacguuuaccaaauggguuaacucccaccuggccagagugucuugccggauuacagaucucuauaccgaccugcgcgauggcagaaugcuuaucaagcugcucgaggugcugagcggggaacggcugcccaaaccuacaaagggacgcaugcgcauucauugucucgagaaugucgacaaggcgcugcaguuccuuaaagagcagcgggugcaccuggaaaacaugggcucccaugauaucguugacgggaaucaccgccucacccugggacuuauuuggacaaucauccugagauuucagauucaagauaucucuguggagaccgaagacaacaaggagaaaaagagcgcuaaagaugcccuccugcuguggugccagaugaagacggccggcuaccccaaugucaacauucauaauuucaccacauccuggcgggacggcauggcuuuuaacgcccucauccacaagcaccgcccugaucugauugacuucgauaaacuuaagaaaagcaaugcucauuauaaccugcagaaugccuuuaaccucgcggagcagcaccuggggcuuaccaagcugcucgaccccgaagacaucucuguggaucauccugacgagaaauccauuaucacauacguugugaccuauuaccacuacuucagcaagaugaaagcccuggcugucgaaggaaagagaaucggcaaggugcuggauaaugccauugagacggagaaaaugaucgagaaguaugagucucucgcuuccgaccugcuugaauggauugagcaaacaaucauuauccugaacaaccggaaauuugccaauagccucguggggguccagcagcaacugcaggcguucaacaccuaccgcacaguugaaaagccgcccaaauuuaccgagaagggaaaucuugaagugcuccuguucaccauccagucuaagaugagagccaacaaucagaaaguguauaugccucgggagggcaagcugauuuccgauaucaacaaggcuugggagagacuggaaaaggccgagcacgaacgcgagcucgcucugcggaaugaacuuauuagacaagagaaacuggagcagcucgcccgccgguuugacagaaaggccgcuaugcgcgaaacauggcugagcgagaaccagcggcuggucucccaggauaauuucggguucgaccuucccgcgguggaagccgcuacgaagaaacaugaggccaucgagaccgauauugccgcuuacgaagagagaguucaagccguggucgcgguggcucgcgaacucgaggccgaaaacuaucacgacaucaagcggaucacagccagaaaagauaauguuauucgccugugggaguaccugcucgagcugcuucgggcuagacggcagcgccuggaaaugaaccucggacugcagaagaucuuucaggagaugcuguauauuauggacuggauggacgaaaugaaagugcuuguccucucucaagauuacggcaagcaucugcugggcguggaggaccuccugcagaagcacacccuugucgaagccgauaucgggauucaggcugagagagugcggggaguuaaugccagcgcgcagaaauucgccacagacggcgagggguacaagccuugugauccccaagugaucagagaccgcgucgcucauauggaauuuugcuaucaggagcugugucagcucgccgcugaacggagagcccgccuggaggaauccagacggcuguggaaauucuuuugggagauggcggaggaagagggauggauucgcgaaaaggagaaaauccuuagcucugaugacuacggcaaggaucucaccuccgugaugagacugcugagcaaacaccgggccuucgaggacgaaaugucugggcgcagcggacacuuugagcaagcuaucaaggaaggcgaggauaugauugccgaggaacauuucggcuccgagaagaucagagaacggauuaucuauauucgcgagcagugggcuaaccucgaacagcugucugccauccgcaaaaagcggcuugaggaagccagccugcuccaccaguuucaagcugacgcggaugacaucgacgccuggaugcuggauauucugaaaaucguuuccagcucugacguggggcaugaugaguacuccacgcagagccuugucaagaaacacaaggacguggcugaggaaauugccaauuaucgcccgacacucgauacccugcacgagcaggccucugcucugccucaggaacaugccgagucccccgacgugagaggacggcucagcggcaucgaagagagauacaaggagguugcggaacugacccgccuucggaaacaagcucugcaggauacacucgcccuguauaagauguucuccgaggccgacgcuugcgaacuguggauugaugagaaagagcaguggcuuaacaacaugcagaucccugaaaagcuggaggaccucgaagucauccaacacagauuugagucucuggaacccgagaugaauaaccaggccagccgcguggcgguggucaaucagauugcucggcaacucaugcauuccgggcaccccucugagaaagaaaucaaggcccagcaggauaagcugaacaccagauggagccaguuccgcgagcuuguggaccggaaaaaggaugcccugcucuccgcucugagcauucaaaauuaccaucuggaauguaacgagacaaaaucuuggaucagagaaaagacgaaaguuauugaguccacccaggaccuuggaaaugaccuggccggcgugauggcucuccagcgcaagcugacagggauggagcgggaucucgucgccaucgaagcgaagcugagcgaccuucagaaagaggccgaaaagcuggagucugaacacccugaucaagcucaggccauccucuccagacuggcugagauuagcgacgugugggaggaaaugaaaaccacacugaagaaccgggaggccucucuuggcgaagccagcaaacugcagcaguuucuccgcgaucuggacgauuuccaauccuggcucagcagaacccagacggcuaucgcgucugaggacaugccgaauacccugacagaggccgaaaaacuucugacccagcacgagaacauuaaaaaugaaaucgauaacuacgaggaagacuaucagaagaugcgggauaugggagagaugguuacacaaggccagaccgacgcucaguacauguuccugcgccaaagacuccaggcccuggacacgggguggaaugagcuucauaagaugugggaaaaccggcagaaucugcucucccagagccacgccuaucaacaguuucugagagauacaaaacaggcugaggccuuccucaacaaccaggaauacgugcuggcgcauaccgagaugcccacaacccuugaaggagcugaggccgccauuaagaaacaagaggacuuuaugaccacaauggaugcuaaugaagagaagaucaacgccgucguggaaacgggccgccggcugguuuccgacgggaauauuaacucugauagaauccaggagaaaguggacagcaucgaugaccgccaccggaagaauagagaaaccgcguccgagcugcucaugcgccugaaggauaaccgggaccuucagaaauuccugcaggauugccaagagcucucucuguggauuaaugaaaagaugcucacagcucaggacaugagcuaugaugaggccagaaaccugcauuccaaauggcuuaagcaccaggccuuuauggcugaacuggccucuaauaaagaguggcuggacaagaucgagaaggaaggaaugcaacucauuagcgagaaaccugaaaccgaggcugucgugaaggaaaaacugacaggccuucacaagaugugggaggugcuggaguccaccacgcagacaaaagcccagcgccucuucgacgcgaacaaggccgaacuguuuacccagagcugugcugaucucgacaaguggcugcaugggcuugagucucaaauccaguccgaugacuacggcaaagaucugaccagcgucaauauucugcucaagaaacagcagaugcuggaaaaccaaauggagguuagaaagaaagaaaucgaggagcuucagucucaggcccaggcucugucccaagaaggaaagagcacagacgagguggauucuaagcggcucaccgugcagacaaaauucauggaacugcuggagccccucaaugaacgcaagcacaaccuucuggccuccaaagagauccaucaguuuaauagagacgucgaggaugaaauucugugggugggcgagcggaugccucucgccacgagcaccgaccacgggcacaaccugcagacaguucaacuucugaucaagaaaaaccagacccuccagaaggaaauucaaggacaucagccccgcaucgaugacauuuucgagagaucccagaauaucgugacagauagcucuagccuguccgcugaggcgauccggcagagacuggccgaccucaaacaacuuuggggccugcugauugaagagaccgaaaagcgccaccggagacucgaggaagcucaucgcgcccagcaguauuacuuugacgccgcugaggccgaggcguggaugucugaacaggagcuguacaugaugagcgaagagaaggcuaaagaugaacaauccgccgucucuaugcuuaagaaacaccagauccuggagcaggccguggaggacuaugcugaaacgguucaucagcucagcaagaccucccgggcccugguggcggauucucacccggagagcgaaagaauuuccaugcggcaaagcaaagucgacaagcuguacgccgggcucaaggaucuugcugaggaacgcagaggaaaacuggacgagcggcaccgccuguuccagcucaacagagagguggaugaccuggaacaguggaucgccgagcgggaaguuguggcuggcucucaugagcuugggcaagauuaugagcacgucacaaugcugcaggaacgcuuuagagaguucgcccgggacaccggcaauauuggacaggaacgcguggauacagugaaccaucucgcugacgagcugaucaauuccggccacagcgacgccgcgaccauugccgaauggaaggaugggcugaacgaggcuugggccgaccuccuugagcugaucgauacaagaacccagauccuggcugccucuuacgaacuccacaaauucuaucaugacgccaaggagauuuuuggacggauccaagauaaacacaagaagcugccugaggaacuuggcagagaccagaauacggucgaaacacugcagcgcaugcauaccaccuucgagcacgauauucaggcucucgggacacaaguucggcagcugcaggaggacgcggccagacugcaggcugccuacgccggagauaaagcugacgauauccaaaagcgcgaaaacgaggugcucgaagccuggaaaucccuucuggacgcgugcgagagccggagagugcgccuggucgauaccggcgacaaguuucgguucuuuuccauggugagagaccucaugcuguggauggaagauguuauucgccagaucgaggcccaggagaaaccccgggacgugucuagcgucgaacuucugaugaauaaccaucaagggaucaaggcugagauugaugccagaaaugacuccuucacgacauguaucgaacucggcaagagccugcuggcucgcaaacacuaugccucugaggagauuaaggaaaaacuccuucagcugaccgagaagcggaaagaaaugaucgauaagugggaggacagaugggaauggcugcgccucauucuggaggugcaccaguuuuccagagaugcgagcguugccgaggcuuggcuucugggacaggaaccuuaccucucuagccgggagaucggccaauccguggacgaagucgagaaacugaucaagcgccaugaagccuucgagaagucugcugccacaugggaugagagauuuagcgcucuggaacggcucaccacacuugagcugcuggaagugagacggcagcaggaggaagaggagcgcaaaagacggcccccuucccccgaaccgucuaccaaggucagcgaggaagccgagucccagcaacagugggacacgagcaaaggggaacaggugucucagaacggacucccugcggaacaaggcucccccagaguuagcuacagaucccagaccuaucagaauuacaagaacuucaauucucggcgcacagccagcgaucagcccugguccgggcuguga

SEQ ID NO: 76225 - RNA, 7173 nt, Artificial Sequence
  derived and/or modified sequence opt5 from SPTBN2__Homo_sapiens__NP_008877
augucuuccacccugucucccaccgacuucgauagccucgagauccagggccaauacuccgacauuaacaaucggugggaucugccugacucugauugggacaacgauagcuccucugcgcggcuuuuugaacgcagcagaaucaaggcucuggcugacgagcgggaagcggugcagaaaaagacguucaccaaaugggucaauucccaccucgcucgcguuacaugcagagugggggaucuguauagcgaccuucgggauggacgcaaccugcucagacugcuggaggugcucucuggcgaaauucugccgaagcccaccaaagggcggaugcgcauccauugucuugagaaugucgacaaggcccugcaguuucucaaggagcagaaagugcaccuggaaaacaugggaucccaugauauuguugacggcaaucacagacuuacacuggggcucguguggaccaucauccugcgguuccaaauucaggacaucagcgucgagacagaagauaacaaggagaaaaagucugccaaagacgcucugcuccuguggugccagaugaagaccgccggauacccuaaugugaacguucauaauuuuacgaccuccuggcgcgauggccuugcuuucaacgccauugugcacaagcacagacccgaccugcucgauuuugagagccugaaaaaguguaaugcgcauuauaaccuucagaaugccuucaaccuggcugaaaaagagcucggccugacaaagcugcucgacccugaagaugucaacguggaccaacccgaugagaaaucuaucauuaccuacguggccacauauuaccacuauuuuuccaagaugaaagcucuggccgucgaagggaagcggaucggaaagguucuugaccaugcgauggaggccgagcgccugguggaaaaauacgagagccucgcuuccgaacugcuucaguggauugagcagaccaucgugacgcugaaugauagacagcucgccaacucucugagcggcguccaaaaucagcugcaguccuucaacagcuaccggacaguggaaaagccuccgaaauuuaccgagaaggggaaucucgagguucugcuuuucacaauccaaucuaaacugagagcuaacaaucagaagguguauacaccccgcgaaggacggcucauuuccgacaucaacaaggccugggagagacuggaaaaagccgagcacgaacgcgagcuggcccuucggaccgagcucauuagacaggaaaagcuggagcagcuggcggcccgcuuugaccggaaagcugccaugagagaaacauggcucagcgagaaucaacgccuggucucucaggauaacuucggccuugagcuggccgcuguggaagccgcgguucggaagcacgaggcuaucgaaacggacauuguggccuacagcgggagaguccaggccguggaugcugucgccgcugagcucgccgcggaacgcuaucaugacaucaaacggaucgccgcuagacagcacaauguggcccggcugugggauuuccugcgccaaaugguugcugccagacgggagagacuucuccugaaccuggagcuccagaagguguuucaggaccugcuuuaccugauggauuggauggaagagaugaagggacgccuccagucccaagaccugggccggcaucuggcgggcgucgaagaucuucuccagcugcacgagcugguggaagccgacauugcuguucaggccgagagagugcgcgcugucucugccagcgcccucagauucugcaauccugggaaagaguaucggcccugugauccucagcugguguccgaacgcguggcuaaacuugagcaaagcuacgaagcgcugugcgagcucgccgcugccagacgggcccgccuggaagagucuagacggcuguggcgcuuucuuugggagguuggagaagcugaggccugggucagagaacagcagcaucuccuggcguccgcugacaccggccgggaucugacaggggcccuccgccugcuuaacaaacacaccgcccugagaggagagaugagcggccggcucgggccccugaagcugacacuugagcaaggacagcagcugguggcugaaggccacccgggcgccucucaggcguccgcuagagccgccgagcuccaagcucagugggaacgccuggaggcccucgcugaagaacgggcccagagacuggcgcaggccgcuagccuuuaucaauuccaggccgacgcuaaugacauggaggccuggcugguggaugcccuccgccuggucuccucuccugaacuggggcaugacgaguuuagcacccaggcucuugcgcggcagcacagagcccuggaagaggaaauccgcucccaucggcccacgcucgaugcucugagagagcaagccgccgcucucccucccacacugucucgcacccccgaggugcagggacggguuccuacccuugaaagacacuacgaggaacugcaggcccgggcgggcgagcgcgcuagagcccucgaagccgcucuggcccuguacacaaugcuuagcgaggcgggggcuuguggacuguggguggaggaaaaagagcaauggcucaacggccuggcccucccggaacggcuggaggaccuugaggucgugcagcagcgcuucgaaacccuggagcccgaaaugaacacacuggccgcucagauuacggccguuaaugauaucgcugagcaacuccugaaggccaacccucccgggaaggacagaauugugaauacccaggaacagcuuaaccaccgguggcagcaauuuagacgccuggcggauggcaaaaaggccgcucucacauccgcccugagcauccagaauuaucaucucgagugcaccgagacacaggcuuggaugcgggagaagaccaaggucaucgagucuacgcagggacugggcaacgaccuugccggggugcuggcccugcaaagaaaacucgcuggaaccgaacgcgaucuggaggcgauugccgcucggguuggcgaacuuacaagagaggccaaugcccuggcugccgggcacccugcgcaggcuguggccaucaacgcccgccuccgggagguccagaccggaugggaagaccugagagcuacaaugcgcagacgggaggaaucccucggcgaggcccgcagacugcaggauuuccuucggagccuggacgauuuucaagcguggcuggggcgcacccagacggccguggcuucugaagagggccccgccacacucccggaggcugaagcccugcuugcucagcaugccgcgcugagaggagagguggaacgggcccaauccgaguacagcagacuccgcgcucugggcgaggaagucacccgggaccaggccgacccucagugucucuuccugagacagcgccuugaggcucuggggacaggaugggaggaacugggccggaugugggaaucuagacaagggcggcucgcccaggcccacggauuucagggcuuccugcgcgaugcuagacaggcggaggggguucuuagcucccaagaguaugugcugagccauaccgaaaugcccggcacccuccaggccgcugacgccgccauuaagaaacuggaggauuuuaugucuacaauggacgcuaauggagaacggauccacggccugcucgaggccgggcgccagcuuguguccgaaggaaacauucacgcggauaagaucagagagaaggccgacagcauugagcggcgccauaaaaagaaucaggaugcugcccaacaguuccugggcagacugcgggacaaccgcgaacagcaacacuuccuccaggauugccaugagcugaaacuuuggaucgacgaaaagaugcugacggcucaggaugucuccuacgacgaggccagaaaucuccacaccaaauggcagaagcaucaagcguuuauggccgaacuggcugccaacaaggacuggcuggauaaaguggacaaggaggggcgggagcucacacuugaaaaaccugagcugaaggcucugguuucugaaaaacucagagaucugcaccgccggugggacgagcuugagaccacaacccaggccaaggcuagaagccuguucgaugccaaucgcgcggaacucuuugcccaguccuguugcgcucuggagucuuggcuggaaagccuccaggcccaacuucacuccgacgauuauggaaaggaccugacgucugugaacauccugcucaaaaagcagcagaugcuggagugggaaauggcuguccgggagaaagagguggaagccauucaggcccaagcgaaggcucuugcccaggaggaucagggcgcuggggaaguugagagaacaagccgcgccguggaagagaaauuccgggcccugugccagcccaugagagagcgcugucggagacuccaggcuucccgcgaacagcaucaguuucaccgggacgucgaggaugaaauccugugggugaccgagagacugccuauggccagcucuauggaacauggcaaggaccuccccuccguucaacuucugaugaagaaaaaccagacccugcagaaggagauucagggacacgagccgcgcaucgcggaucucagagaacggcaacgcgcccugggcgcugccgcugccgggccugagcuugcggaacugcaggagauguggaaaagacucggacacgagcuggaacugcggggcaagagacucgaggacgcccuucgggcucagcaguucuaccgcgacgccgcugaagccgaggcuuggaugggggaacaagagcugcauaugaugggacaggagaaagccaaggaugaacugagcgcgcaggccgaggugaaaaagcaccagguccucgaacaagcucuggccgacuaugcucagacaauucaucagcuugccgccucuucccaagauaugaucgaccacgagcaucccgaaagcaccagaaucucuauucggcaggcgcaaguggauaagcuguacgcuggccucaaagagcuggccggcgagcgcagagaacggcugcaggagcaccuccgccuuugccaacugagacgggaacuggacgaucucgagcaguggauccaggaacgcgagguggucgccgcuucccacgagcuggggcaggacuacgaacauguuacaaugcuuagagauaaguuucgggaguucagccgcgacacguccaccauuggacaagaaagaguggauagcgccaaugcucuggccaacggccucaucgccgggggacacgccgcucgggccacaguggcugaguggaaagacucucugaaugaggccugggcggaucugcucgaacuucuggacacccgcggccagguccuggccgcugccuaugagcuccagagauuucugcauggggcucggcaggcccuugcuagagugcaacacaagcagcagcaacugcccgacggaacaggccgcgaucucaacgccgcggaagcccugcagcggagacacugugcuuacgagcaugacauucaggcccugagcccucagguucaacaggugcaggaugacggccaccgccuccagaaagccuaugcuggggauaaggccgaagagaucggacggcauaugcaagcggucgcugaggccugggcccagcuucagggcuccucugcugccagacgccagcugcugcucgacaccacggauaaguuccgguuuuucaaagcugugagagaacugaugcuuuggauggacgagguuaaucugcaaauggaugcccaggaacgcccgcgggacgugagcuccgcggaucucgucaucaagaaccagcaggggauuaaagccgagaucgaagcuagagccgaccgcuuuucuagcugcauugacaugggaaaggagcugcuggcucggucccacuacgccgcggaggaaaucucugagaaacucagccaacuucaggccagacggcaggaaaccgcugagaaguggcaagaaaagauggauuggcugcagcuggugcucgagguccugguguucggcagagacgccgggauggcugaggccuggcuuuguucccaggaaccccugguucgcagcgccgagcucggaugcacaguggaugaagucgagucucugauuaaacggcaugaggcuuuccagaaguccgcgguggccugggaagagagauuuugugcucuggaaaaacucaccgcccuggaggaacgcgagaaggagagaaaacggaagcgcgaagaggaagagagacggaagcaaccucccgccccugaacccacagcuagcguuccucccggcgaccuugugggcgggcagaccgccucugauacaaccugggacggaacgcagccgcgcccucccccuuccacacaggcgcccagcgucaauggcgugugcaccgauggggagccgucccaaccucugcucggacagcagagacuggagcacucuagcuuccccgaaggcccugggcccggauccggcgacgaggcuaacggccccagaggggaacgccagaccagaacacggggaccugccccgagcgccaugccccaaucucgcuccaccgagagcgcucacgccgcuacgcuuccucccagaggcccugaacccucugcccaggagcagauggaggggaugcugugucggaaacaagaaauggaggcguuuggaaagaaagccgcuaaucgcagcuggcagaacguguauugcguucucagacggggcucccugggguucuacaaggaugccaaagcugccucugcgggagucccuuaucauggcgaagugccggugagccuggccagagcucagggcuccgucgccuuugacuaccgcaagcggaagcacguguucaaacucgggcugcaggauggaaaggaguaccuuuuucaagcuaaagacgaggccgaaaugucuagcuggcugagaguugugaaugccgcuaucgcgacagccuccagcgcuucuggcgagcccgaggaaccugucgugcccuccaccacacgcgggaugacccgggccaugacaaugccucccguuagcccggugggagccgaaggcccugucgugcucagauccaaggaugggcgcgagcgggagagagaaaaacgcuucagcuuuuucaagaaaaacaaguga

SEQ ID NO: 76226 - RNA, 7695 nt, Artificial Sequence
  derived and/or modified sequence opt5 from SPTBN4__Homo_sapiens__NP_066022
auggcucaggugcccggcgaggucgacaacauggaagggcugccugcuccgaauaacaaucccgccgcgcggugggagagcccugaucggggaugggaacgcgagcagcccgcugccuccaccgccgcugccucucucuucgaaugcagcagaaucaaggcucuggccgacgagcgggaggccguucagaaaaagacauuuacgaaaugggugaacucccaccuugcccgcgugggcugucauauuggggaucuguacgucgaccucagagauggauucgugcugacccggcuucuggaaguucucucuggcgagcagcugccucgccccaccagagggcggaugcgcauccacagccuggaaaauguggacaaggcucuccaguuucugaaagagcagagaguccaucuugagaacgugggaucccacgauauuguugacggcaaucaucggcugacccucggccugguguggacaaucauucuucgcuuccagauccaggucaucaagauugaaaccgaggauaacagagaaacacggucugccaaggacgcucugcuccuguggugccagaugaaaaccgccggguauccugaggugaauauccagaacuuuacgaccagcuggcgcgauggacuggcguucaaugcccucauucacagacaccggccggaccugguggauuuuuccaaacuuacaaaaagcaacgcuaauuacaaccugcagagagccuuccgcaccgcugaacagcaucucggccuggcccggcuucuggaccccgaggacgucaauauggaggccccugaugaaaagucuaucauuacauauguuguguccuuuuaccacuauuucagcaaaaugaaggcucucgcgguggaggggaagagaaucggaaaaguccuggaccaggugcuggaaguuggcaagauuaucgagcgcuacgaggaacuggccgcugagcugcuugccuggauccaucggaccguggggcugauuucuaaccaaaaauuugccaacucccucagcggaguccagcagcaacugcaggcuuucacggccuauuguacacuugaaaagcccgugaaauuucaggagaagggcaaucuggaaguucuccuguucucuauccaguccaaacugagagcgugcaaccgcagacucuucgugccuagagagggcugugggauuugggauaucgacaaggcuuggggagaacuggagaaggccgagcacgaacgcgaggccgcccuucgggccgaacugauuagacaagagaaacucgagcugcuggcucagcgcuuugaucacaaggucgccaugcgggaaagcuggcuuaaugagaaccagagacucgugucccaggacaauuucggcuacgaacugcccgcggucgaggccgcuaugaaaaagcaugaagccaucgaggcugauaucgccgcguacgaggaacgggugcaagggguugccgagcuggcucaggcccucgcugccgaaggauauuacgacauucgcagaguggccgcucagcgggauucuguccugagacagugggcgcuucugaccggccucgugggggcccgccggacaagacuggagcaaaaccuggcccuucaaaaaguuuuucaggaaaugguguauauggucgacuggauggaggagaugcaggcucaacuccugagccgcgaaugcggacagcaccugguggaggccgaugaccuccugcagaagcauggccuucuggaaggcgacaucgcugcccaauccgagagaguggaagcgcucaaugcugccgcccugcgguucagccagcugcagggguaccagccgugugauccucaaguuauuugcaaccgcgucaaucacgugcauggaugucuugcugagcuccaggagcaggccgcgagacggcgcgcugaacuggaggccucuagaucccugugggcccuccugcaggaacuugaggaggcugaaagcugggcccgggacaaggagcgccugcucgaagcugccggcgggggaggcgcggccggggcugccggcgcugccggaaccgccggcggggcucacgaucugucuagcaccgcgagacugcuugcccaacacaaaauccuccagggagagcugggcgggcggcgcgcucugcuccagcaggcccugagaugcggagaagaacuuguggccgcuggcggggccgucggccccggagcggacacagugcaucugguuggccucgcugagcgggccgccuccgcuagacgccgguggcaaagacuggaagaggccgcggcucgccgggaaagacgccugcaggaggcccgggcccuucaccaguuuggggcugaucuggacggacuccuggauuggcucagagacgccuaucgccuggcugccgcgggcgauuucgggcaugacgaagccucuagccggagacuugcucggcaacaccgcgcccugacgggagagguggaggcucacagaggcccugucuccgggcuccggcgccagcuggccacccugggcggagccagcggcgcugggccccuugugguugcgcuccaggugagagucguggaagccgagcagcucuuugcugaaguuacagagguggccgcccugcggagacaauggcuccgcgaugcucuggccgucuaccggauguucggagaagugcaugcgugugagcuuuggauuggcgagaaggaacaguggcugcucucuaugagagugcccgacucccuggaugacgucgagguugugcagcaccgcuuugaaagccuggaccaggagaugaacucucuuauggggcgggugcuggaugucaaucauaccgugcaagagcucguugaaggaggccacccuuccagcgacgaggugagauccugccaggaucaucugaacucucgcuggaaucggaucgucgaacucguggagcagagaaaagaagagaugagcgcuguucugcuuguggagaaccacguccuggaaguggccgagguucgcgcccaggugagagaaaagcggcgcgcugucgaguccgccccgagagccgggggcgcccugcaauggcggcucucuggacuggaagcugcccuucaggcucuggagccccgccaggccgcucuccuggaggaagccgcgcuccuggccgagagauucccugcucaggccgcucggcuucaccaaggcgccgaggaacugggggccgaauggggagcucuggcgagcgccgcucaggccugcggcgaggccguggcugccgcggggagacuccagcgcuuucugcaugaccuugaugccuuccuggacuggcucgugcgggcucaagaggccgcuggaggcuccgaaggcccccugccuaauagccucgaggaagccgaugcgcugcuugccagacacgcugcccugaaagaggaggucgaccagcgcgaagaggauuaugcucggaucguugccgcuucugaagcccugcucgcggccgacggggcugagcugggacccggccuugcccuggaugaauggcucccgcaucuggagcucggguggcacaagcugcuuggacugugggaggcuagacgggaagcccuggugcaggcccauauuuaccagcucuuucugcgcgaccuuagacaagcgcuggugguccuccggaaccaggagauggcucuguccggcgccgaacugccugggacaguggagagcguugaagaggcucucaagcagcaccgcgauuuccuuaccacgauggagcugucucagcagaagaugcaaguggccguccaggccgcugaaggacugcucagacagggcaacaucuacggcgagcaagcccaggaagcggugacacggcugcuugagaagaaucaggaaaaccaacugcgcgcccagcaguggaugcagaaacuccacgaccaacuggagcugcagcauuuccucagagacugucacgagcuugauggguggauucaugaaaagaugcugauggcucgggacggaacccgcgaggauaaucacaaacugcacaagagauggcuccggcaucaggccuuuauggcugaacuggcccagaacaaggaguggcuugagaaaaucgaaagagagggccaacagcugaugcaggaaaagcccgagcucgcggccuccguucgcaaaaagcugggggaaauucggcagugcugggcugagcuggagagcaccacacaagccaaagcuagacaacucuucgaagccucuaaggcugaccagcuugugcagagcuuugccgagcuggauaaaaagcugcuccacauggaaucccaacugcaggacgucgauccuggaggcgaccuugcgaccgugaauagccagcugaagaaacuccaaucuauggagucccaggucgaagagugguaucgcgaggugggggaacugcaggcccagacagcugcccugccccucgagccugcuagcaaggaacuuguuggagagcggcaaaacgccgugggcgaaagacugguccgccugcucgagccccugcaggagcggagacgccuucugcucgccuccaaagaacugcaucagguggcgcacgaucuggacgaugagcucgcuuggguucaggaacggcuuccgcuggccaugcaaacggagagaggcaaugggcugcaggccgugcagcagcauaucaagaaaaaccaaggacuccgccgggagauucaggcucacggcccuagacuggaagagguccuugaacgcgccggggcucuggccucucucagaagccccgaggcggaagccgugcggcgcggacuggagcagcugcaauccgcuugggccggccucagagaggcugccgaacggagacaacaggugcuugacgcggccuuccagguugagcaauacuauuuugacgucgcugaaguggaggccuggcugggggaacaggagcugcucaugaugucugaggauaagggaaaggacgaacagagcacccugcagcuucugaaaaagcaccuccaacuggagcagggcguggaaaauuacgaggaauccaucgcucagcugucucggcagugucgcgcccuccuugagaugggccaucccgauagcgagcaaaucuccagacggcagagccaggucgaccgccuguauguggcucugaaagaacucggggaggaaagacggguugcccuggagcaacaguacuggcuuuaucagcugucucgccagguguccgagcucgaacacuggauugcggagaaggaagucguggccggaagcccugagcugggccaagauuucgaacauguuucugugcugcaggagaaauuuuccgaguucgcuagcgaaacagggauggccggaagagagcggcucgccgcugucaaccagaugguggacgaacuuaucgagugcggccacaccgccgcggcuacaauggccgaauggaaggaugggcugaaugaggccugggcugagcugcucgaacugaugggaacccgcgcccagcuucuggcugccucuagagagcuccacaaguuuuucuccgacgcgcgggaacugcaaggccagauugaggaaaaacgcagacggcugccgcgccucacgacacccccugagcccagaccuagcgccuccagcaugcagcggacacuuagagcuuuugagcaugaucugcagcugcucguuucucaagugcgccagcugcaggaaggcgccgcucagcuucggaccgucuacgccggggagcacgcggaagccaucgcuagcagagagcaagaggugcugcagggauggaaggaacuccuguccgccugugaggacgcucgccugcaugugucuagcacagccgaugcccuccgguuccacucccaggucagagaccugcuuucuuggauggauggcauugcuagccaaaucggggcggccgacaaaccccgcgacguuuccucuguggaagugcugaugaacuaccaucagggacucaagaccgagcuggaagcucgggucccugagcuuacgacaugccaggagcugggcagaagccuccugcugaauaaauccgccauggccgaugaaauccaggcucaacucgacaagcuggggacccgcaaggaggaagugagcgagaaaugggaucggcacugggaauggcuucagcagaugcuggagguucaccaguuugcccaagaggcgguggucgcugacgccuggcucacagcccaggaaccccugcuucagucuagagagcugggauccagcguggaugaaguugagcagcucauucgccggcaugaggcuuucagaaaggccgcugccgcgugggaggagcgguucucuucccugagacgccugaccaccaucgagaaaauuaaggccgagcaaagcaaacagccgccuacaccccuccugggccggaaguuuuucggcgacccuacggaacuugcugccaaagcugcgccccugcucagacccgggggauaugagcgcggccuggagccucuugcgagacgggccuccgauacccugucugcugaagugcgcacaagagucggguacgugcggcaggagcucaagcccgaacgccugcaaccuagaaucgaccggcugcccgagauucccggacgcgucgaaccugccgcucucccggccgcccccgaggaugcugcggagaccccugccacacccgcugccgccgaacaggugagaccucggcccgagcgccaggaaagcgcugacagagccgaggaacugccucggcgcagacggccggagagacaggaguccguugaucaaagcgaagaggcggcucgccggagacgccccgaacggcaggagucugccgaacacgaggccgcucauucccuuacccugggcagauaugagcagauggaacgccggagagagcgccgggaaagacggcucgagcgccaggagagcucugaacaagagaugccuaucagaggggaccuggugaagggaaaagccacgcuugcugauaucguggaacagcugcaggagaaggaagccggccccggccucccugcggggcccagccugccgcagccucgggagcugccgcccggacgccucccuaacggccuggagcuucccgaaagaacaccucggccggacagaccccgcgcccgggacagaccuaaaccccgccggagaccucgccccagagaagggggagaaggcgggggcucccggcgcucuagaagcgcuccggcccaaggaggcuccgcuccugcgcccccucccccucccacccacaccguccagcacgagggguuucugcuccggaagcgcgaacuggaugcgaauagaaaaucuagcaaccgguccuggguuagccuuuacugugugcugucuaagggagagcucggcuucuauaaggacuccaaagggccggccagcggauccacacauggcggggagccucugcugucucuccacaaggcuaccagcgaaguggccuccgauuacaaaaagaaaaagcaugucuuuaagcugcagacacaggacggcucugaguuccuucugcaagcuaaagaugaagaggaaaugaacggauggcucgaggccguggccagcuccguugcugagcacgcggaaauugcccgcuggggccagacgcugcccaccacaagcucuaccgacgaggggaaucccaagagagaaggaggcgaucggagagcuuccgggcgccggaaauga

SEQ ID NO: 76227 - RNA, 11025 nt, Artificial Sequence
  derived and/or modified sequence opt5 from SPTBN5__Homo_sapiens__NP_057726
auggcuggccagccccacagcccucgggagcugcucggggcugcugggcaccggucccgcagacccucuaccgaacugcgggugcccccuagccccucccuuacaauggacucucaauacgagacgggccacauccgcaagcugcaggcgagacauaugcagaugcaggagaaaaccuucacaaaguggauuaacaauguguuucaaugcgggcaggcuggaaucaaaauucggaaccucuauaccgagcuggcugauggcauccaccuucugcgccuccuggaacugauuagcggggaggcccucccucccccuuccagaggacggcugcgcguucauuuccuugaaaauucuagcagagcucuggccuuucuccgggcuaaggugccggugccccugaucggcccugaaaacaucgucgacggcgaucagacacuuauucuggggcucaucugggugauuauccugcgcuuccagauuucccacaucagccuggacaaagaggaauuuggagccucugcggcccuccuguccaccaaggaggcccuucugguuuggugucaaagaaagacagccagcuacaccaaugugaacauuacggauuucucucgguccuggagcgacggccucggguuuaaugcucugauccacgcccaucgccccgaucuucuggacuauggaucucucagaccugaucggccccugcacaaccuggcguucgccuuucucgucgcugagcaggaacugggcaucgcccagcuucuggacccggaggauguggcugccgcccagccugacgaaagauccauuaugaccuacguuagccucuauuaccauuauugcucccgccugcaccaagggcagacagugcagcggagacuuaccaaaauccugcuccaacugcaggagacagaacugcuccagacccaguacgagcaacuggucgcugaucuucugcgcuggauugcggagaagcagaugcagcucgaagcccgggacuuccccgacucucugccugcuaugagacagcugcuugccgccuuuacgaucuuccgcacacaagagaaaccgccccggcuccagcagagaggagcugccgaagcgcugcuguuucgccuccagaccgcucugcaagcccagaaucggagaccuuuccuuccgcacgagggccugggccucgccgaacugagccaguguugggcugggcuggagugggccgaggcugcccgcucccaggcgcuucaacagcggcuccugcagcugcaaagacucgaaacacuggcccggcgcuuccagcauaaggcugcccuuagagagagcuuucugaaagaugcugaacaggugcucgaccaggcccgggcgcccccugccucucuggcuaccguggaggccgcuguccaaagacugggaaugcuugaagccggcauucucccccaggaggggcgcuuccaggcccuggcugagaucgcggauauccugcggcaggaacaauaccacuccugggccgacguugcuagacgccaggaggaagugaccgugagauggcagcggcuccugcagcaucuucaaggacagcgcaagcaggucgccgauaugcaagccgugcugagccuccugcaggagguugaggcugccucucaccagcuggaagaacuucaggaaccugcgagaagcacagcuugcggccaacagcucgccgagguggucgaacugcugcagcggcaugaccuccuggaggcccagguguccgcucacggggcccacguuucucaucuugcgcaacagacggcugagcuggauagcucccucggaaccagcguggaaguccugcaggccaaggcccgcacacuggcucagcuucaacagucucugguggcccucgucagagcucggcgcgcccugcucgagcagacccugcagagagcggaauuucuucggaacugugaggaagaggaggccuggcugaaagaaugcggccaacgcgugggcaaugcugcccucgggagagaccugucccagauugcuggagcccugcagaagcacaaagcccuugaggcugaaguucaucggcaccaagcggugugugucgaucuggugagacgcggccgggaccucagcgccagacggcccccgacacagccugaucccggggagcgcgcugaagccguucagggaggcuggcagcugcuccaaaccagaguggucgggcgcggcgcccggcugcagacggcccuucuggugcuccaguauuucgccgacgcggcugaggccgccucuuggcugagagagcgccgguccagccuggaaagagcuuccugcggacaggaccaagccgcggcugagacacuucugcggcgccacgugagacucgaacggguucugcgcgccuuugccgcugagcucagacggcuggaggaacagggcagagccgcuucugcccgcgcgagccuuuucaccgucaacuccgcccugucuccucccggggagagccugcggaauccuggacccugguccgaagcuagcugucauccgggcccuggggaugccuggaagauggcucuccccgccgagcccgacccugauuuugacccgaacaccauccugcagacacaggaucaccuuucucaagacuacgaaucccugagagcccucgcucagcugcgccgggcgagacucgaggaggccauggcucuguucggauuuugcagcucuuguggcgaacuucagcuguggcuggagaaacaaaccgugcuccugcagcgcgugcagccccaggccgauacacuugaagucaugcaacugaaguaugagaauuuccucacggcccuggcuguggggaaaggccucugggccgaaguuuccagcucugcggagcagcugcggcagagauacccuggaaacagcacccagauucaacgccagcaggaggaacuuucccagagauggggccaacuggaggcucugaagcgggaaaaggccgugcagcucgcccauagcgucgaggugugcucuuuucugcaggaaugcgggcccacacagguucaacuucgcgacgugcugcuccagcuggaggcucuccagccuggauccagcgaggauaccugucacgcccugcaacuugcgcagaaaaagacacugguccuggaaagacgggugcauuuccuccaguccguuguggucaaaguggaggaacccggcuaugccgagucucagccucugcaagggcaggucgagacccuucagggacugcucaagcagguccaagaacagguugcucagcgcgccagacggcaggcugagacgcaagccagacagagcuuucugcaggaaucccaacagcugcuccuuugggcugagucugugcaggcccagcugcgcagcaaagaaguguccgucgacguggcgucugcccaacggcugcucagagagcaccaggaucugcuugaggaaauccaccuguggcaggagcgccuccagcaacuggacgcucagagccagcccauggccgcucuggauugcccggacucccaggaaguuccuaacacccuccgggugcuuggccaacaggggcaggagcugaagguccugugggaacaaagacagcaguggcuccaggagggccuggagcuucaaaaguucggacgggaaguggacggcuucacagccaccugugccaaucaucaggcuuggcugcaccucgauaaccugggggaggacguucgcgaagcgcugagccuccuucagcagcauagagaguuuggacggcugcugucuacacucggcccccgcgccgaagcucugagagcccacggggagaaacuugugcaaucccagcauccugccgcucacaccguccgggagcagcugcagagcauucaagcccaguggacgcgccuccagggaagaucugaacagcggcgcagacaacugcuggcgucccuccagcuucaggaguggaagcaagauguggccgaacugaugcaguggauggaggagaaaggccugauggcugcccacgaacccagcggggcucggagaaauauccuccagacacugaagcgccaugaggccgcggaaucugagcuucuggccacccggagacacguugaagcucuccagcaagugggccgcgagcugcugucccggagaccgugcggacaggaggacauccagacacgccuccagggccuucggagcaaaugggaagcccugaacagaaagaugaccgagcgcggggaugaacugcaacaggcuggacagcaggagcaacuccugcggcagcuucaggacgccaaggaacaacuggagcagcucgagggcgcucugcaguccagcgaaaccgggcaggaucugagaucuagccaacgccuccagaaacggcaucagcagcuugaguccgaaucuagaacacuggccgcgaagauggccgcucuggccagcauggcucacggaauggccgccuccccugcgauucucgaggaaacgcaaaaacaucugcgcagacuugagcugcuccagggccaucuggcuauccggggccugcagcuccaggccucugucgagcuucaccaauucugucaucugagcaauauggaacuguccuggguggcugagcacaugccccaugggucuccuaccagcuacacagaaugccucaacggagcccagucccugcaccgcaagcacaaagagcuucagguggaggucaaggcccaucagggccaaguucagagagugcugagcucugggcggucccucgcugccagcggacacccccaggcgcaacauauuguggaacagugucaggagcuggaaggccacugggccgagcuggaaagagcuugcgaggcccgggcucagugucuccaacaggccgucaccuuucagcaguauuuccuugacgugucugagcuggaaggguggguugaggaaaagcgcccccugguguccagcagagauuacggacgggacgaggcggccacacuccgccugaucaauaaacaccaagcccuucaagaagaacuggcuauuuacugguccucuauggaggaacucgaucagaccgcucagacgcugacaggcccugaggucccggaacaacagagagugguucaggagcggcugcgcgaacaacucagagcccuucaggagcuggcugccacccgggaccgcgagcuggaaggcacccucagacugcaugaguuucuucgggaagcggaggaucugcagggguggcucgccagccagaagcaagcugccaaaggaggcgagucccugggggaagaccccgagcacgcucugcaucucugcacaaaguucgccaaauuucagcaccagguggaaaugggaagccagcgcgucgccgcguguagacugcuugcugagucucugcucgaacggggccauuccgccgggccuauggugcgccaaagacagcaggaccugcagaccgccuggagcgagcuuugggagcugacacaagcucggggacacgcccucagagauacggaaaccacacugcgcguccaccgggaccugcucgaggugcugacccagguucaggaaaaggcuacaucucuucccaacaauguggccagagaucugugcggccucgaggcgcaacugcgcagccaucagggccuugaacgggagcuggucgggaccgagagacagcuccaggaacugcuggagacggccggacgcgugcaaaaacucugcccuggcccccaggcucacgccguucagcagcggcaacaggcugugacccaggccugggcgguccugcagagacgcauggaacaacggagagcccagcuugagcgcgcucggcugcucgccagauuccggacagcugugagagacuaugccuccugggcugcccgcgugcggcaggaucugcagguugaagagucuagccaagagccuuccucugggccgcuuaagcugagcgcgcaucaguggcucagagccgaacuggaggcucgcgaaaagcuguggcagcaagccacccagcucggacagcaggcccugcuugcugccggcacacccaccaaagagguccaagaggaacugagagcgcuccaggaccagcgggaucagguguaccaaacaugggcucgcaagcaggagagacugcaggccgaacagcaagagcagcuuuuucugcgggaaugugggcgccucgaggagauccuggccgcucaggaagugucccugaaaaccagcgcccucggaucuuccgucgaggaaguggagcaacugauuagaaagcacgaaguuuuccuuaaagugcugacggcucaggacaagaaggaggccgcgcuccgggagcgccugaaaacacuuagacggccucgcgucagagaucggcugcccauccuccugcagcgcagaaugcgggugaaggaacuggccgagagcagaggccacgcucuccaugccucccugcuuauggcuucuuuuacccaggccgcgacccaagccgaagacuggauccaggcuugggcccagcagcugaaagagccuguucccccgggcgaucuccgcgacaagcugaaaccucuucugaagcaccaggcuuucgaagccgaggugcaggcccaugaggaagucaugacaagcguggcuaagaaaggggaggcgcuccuggcccagucccacccccgggcuggagaaguuucucagagacugcaaggccuccgcaagcauugggaggaccugcggcaggccauggcccuuagagggcaggagcuggaagaucgccggaacuuucucgaguuccugcagagaguggaccuugcugaagccuggauucaagagaaagaagucaagaugaaugugggagaucugggccaggaccucgagcacugccugcagcugcgccggagacuucgggaguuccgcgggaacagcgcgggagauaccgugggcgacgcuuguaucagauccauuagcgaucugucucuccaacugaaaaaucgggaccccgaagaggucaagaucauuugccagcgcagaucccagcucaacaaucggugggccagcuuucacggcaaccugcuuagauaucagcaacagcuggaaggggcccuggagauccauguucucucucgcgaacuggauaacgugacgaagcggauccaggagaaagaggcucuuauucaggcccuggacuguggaaaggaucucgaauccgugcaaagacugcuccgcaaacacgaggaacuggagcgggaaguccauccuauccaggcucagguggagagccuggagagagaaguuggccgccuuugccagagaucucccgaggccgcgcacgggcugcggcaucgccaacaggaaguggccgagagcugguggcagcucagaucccgggcucaaaagcgcagagaggcccuggacgcccuucaccaggcccagaaacugcaggcgaugcuccaagaacugcucgucucugcccagcggcugcgcgcucagauggauacaagcccugccccgagaucccccguggaggcucggagaaugcuggaggaacaccaggaauguaaggccgagcuugacagcuggaccgacuccauuucucuggcccgcagcacaggacaacagcuccugaccgcuggccauccuuucuccucugauauccggcagguucuugcggggcuggagcaggaacucagcucccuggagggagccuggcaagaacaccagcugcagcuccagcaagcucuggagcuucagcuguuucucucuagcguggagaaaauggagagauggcugugcuccaaggaggacagccuugccucugaaggccugugggauccccucgccccuauggagccccugcuguggaagcauaaaaugcucgaaugggaccuggagguccaggcuggcaagauuuccgcccuugaagcgacagcucgcgggcugcaccaaggaggccacccggaggcccagagcgcccucgggcggugucaggcuaugcugcuuagaaaagaggcccuguuccgccaggcuggaacccggagacaucggcucgaggaacugcgccaacugcaggccuuucuccaggauucucaggaaguggcggccuggcugagagagaagaaucuugucgcucuggaggaaggccuccuggacacggccaugcuuccugcucaacugcagaaacagcagaacuuccaagccgagcucgaugcguccaugcaccagcagcaagaacugcagcgggaggggcagcgccugcuccagggaggccaucccgccagcgaagcuauccaagagagacuggaggaacuuggcgcccuguggggagaacuccaggacaauucucagaagaagguggcuaaacugcagaaggccugcgaagcccuucggcugcgcagauccauggaggaacucgagaacuggcuggagccuaucgaaguugagcugcgggcucccaccgugggacaagcgcucccuggcgugggggaacugcuuggaacacagagagagcuggaagccgcugucgauaaaaaggcccgccaggccgaggcucuccugggccaggcccaagcguuuguucgggaggggcacugucuugcucaggacguggaggagcaggccagacgccugcuccaacgguucaaaagccugagagaaccccugcaggagcgccggaccgcccucgaggcuagaucccugcuucugaaguuuuuccgcgaugccgacgaagagauggcuugggugcaggaaaagcucccgcuggccgcggcccaggauuacggccaaagccugucugcuguccggcaucuccaggagcagcaccagaaucuugaaagcgagauguccucucacgaggcccugacaagagugguucugggaaccggcuauaaacucgugcaagcugggcauuuugccgcgcacgaagucgccgcucgcgugcagcagcuggagaaggccauggcucaucuuagagccgaagcggcccggcgcagacugcuccugcagcaagcucaggaggcccagcaguuccugacggaacuucucgaggcuggaagcuggcuggccgagcggggccacguccuggacuccgaagacauggggcacucugccgaggcuacacaagcccuccugagacgccuugaagcgaccaaacgggaucuggaggcuuucagcccuagaauugaacggcuccagcagacagccgcccugcuggagucccgcaagaaccccgagucucccaaagugcuugcucaacuccaggccguuagagaagcgcaugcugagcugcugcggcgcgccgaagccagaggacacggccuccaggagcagcugcaacuucaucagcuggagcgggaaacccuccugcuggacgcuuggcuuaccacaaaggccgcuacggccgagagccaggauuacgggcaggaccucgaaggcgugaagguccuggaggaaaaauuugaugcguuccgcaaggaggugcaaucccugggacaggccaaaguuuaugcucucagaaagcuggccggcacccuugagagaggggcuccucgcagauacccgcacauccaggcccagcggagccgcauugaagcggccugggagagacuggaccaagcuaucaaagcccggacagaaaaucucgcugccgcccaugaggugcacucuuuucagcaggcugccgcggaacugcaaggaagaaugcaggagaagaccgcucugaugaagggcgaggaugggggacacucccuuagcucuguccgcacacuccagcagcaacaucggagacuggaacgcgagcuggaagccauggagaaagaaguggcccggcuccagaccgaggcuugcagacugggccagcuucaccccgccgcgccugggggccuggcuaaggugcaggaggccugggccacgcuccaagcuaaagcccaggaacgcggacaguggcuggcucaggccgcgcaaggccaugccuuccuggggcggugccaggagcuucucgcuugggcccaggaaagacaggagcuggcuuccagcgaggaacuggccgaggacguugcgggagccgaacaacuccugggccagcacgaggaacuugggcaggagauucgcgagugucggcugcaagcucaggaucucagacaggaaggacagcaacuggucgacaacucccauuuuaugucugccgaggugacagaaugccugcaggagcuugaaggccgccuccaggagcuggaggaggcuugggcccugcgguggcagagaugugccgagagcuggggccuccaaaagcugcgccagcggcuugaacaggcugaggccuggcuggcgugcugggaagggcuccugcugaaacccgauuacggacacuccgugagcgacgucgagcuucuccugcacagacaucaggaccuggagaagcuccuggcugcccaagaagagaaauucgcccagaugcagaagaccgaaauggagcaagagcuucugcuccagccucaggaacugaagcccggcagagcugggucuucccugaccagcuuucaguggcggccuucuggacaccaaggccuuggggcccagcucgcggagacacgcgauccgcaggacgcuaaaggaacccccacaauggaaggcagccuggaguucaagcagcaucugcucccuggcgggagacaacccuccucuagcuccugggauucuugucggggaaaucugcagggcagcucccuuagccuguuucucgacgaacgcauggccgccgagaaaguugcuucuaucgcccugcuggaucuuacgggggcuagaugcgagcggcuccgcggaagacacggccggaagcacaccuucucccugcgccugacaagcggggccgaaauccucuuugcggccccuuccgaggaacaggcugagucuugguggagagcccugggaagcaccgcugcccagucccuuucucccaaacugaaggcgaagccggugagcucccucaacgaauguacaaccaaagacgcccggccuggcugccugcugcgcagcgaucccuga

SEQ ID NO: 76228 - RNA, 1422 nt, Artificial Sequence
  derived and/or modified sequence opt5 from SPTLC1__Homo_sapiens__NP_006406
auggccaccgcuacagagcagugggugcuggucgaaaugguucaagcccucuacgaggcgcccgcuuaucaccugauccuugaaggcauucugauccucuggauuaucagacugcuuuucagcaagacguacaaacugcaggagcgguccgaccucaccgugaaggaaaaagaggagcugauugaagaguggcagccugaaccgcuggugcccccuguccccaaggaucacccugcccucaacuauaauaucgugucugggcccccuagccacaaaacaguugugaacggaaaggagugcaucaauuuugccuccuucaacuuucugggccuucuggacaauccgcgcgucaaggcugccgcucucgccucucugaaaaaguacggggugggaaccuguggccccagaggguucuauggaacauuugauguucaucuugaccuggaggaucggcucgcgaaauucaugaagaccgaagaggccauuaucuacagcuauggcuuugcuacaauugccuccgcuaucccugccuacucuaaacgcggcgacauuguguucgucgauagagcggccugcuuugcuauccagaaggggcugcaagccagccgguccgacauuaagcuguucaaacacaacgauauggcugaccucgaacgccugcuuaaggagcaggaaaucgaggaucagaaaaaucccagaaaggcccgggugacccgcagauuuaucguggucgagggacuguacaugaacacgggcaccauuuguccucuccccgaacugguuaaacuuaaguauaaauacaaggcccggaucuuccuggaggaaagccucucuuuuggggugcugggagagcauggccgcggggugacagaacacuauggaauuaauaucgacgauauugaccugaucuccgcuaacauggagaaugcgcucgccagcaucggcggcuucugcugugggagaucuuucgucauugaccaccagcggcuguccggacaaggcuacugcuuuagcgcuucucuuccgccucugcucgccgccgcugccaucgaggcgcugaacauuauggaagagaaucccgggaucuucgcugugcuuaaggaaaaauguggacagauucauaaggcccugcagggcaucuccgggcucaaaguugugggagagagccuguccccugccuuucaucugcagcucgaagagucuaccggcagccgcgagcaagaugucagacugcuucaggaaaucguggaccagugcaugaaccgguccauugcucugacacaagccagauaucucgagaaggaagagaaaugucugcccccucccagcauccgcguuguggucaccguggagcagacggaagaggaacuggagcgggcugccucuacaauuaaggaagucgcgcaggccgugcuucucuga

SEQ ID NO: 76229 - RNA, 1689 nt, Artificial Sequence
  derived and/or modified sequence opt5 from SPTLC2__Homo_sapiens__NP_004854
augagacccgagccuggcgggugcuguugccggcgcaccgugagagccaacggaugugucgcuaauggcgaaguucggaacggguacgugcgcagcuccgccgcggcugccgccgcugccgcugccggacagauccaccaugugacacaaaauggcgggcuguauaagagaccguucaacgaggcguuugaagagacgcccaugcucgucgccgugcugaccuacguuggauauggcgugcuuacacuguucggcuaccuccgggacuuucugcgcuauuggagaauugaaaaaugccaccaugcuaccgagcgggaggaacagaaggauuucgucucucuuuaccaggacuuugagaauuucuauacacgcaaccuguacaugagaauccgggauaauuggaaccgcccuauuuguagcgugcccggggccagaguugacaucauggaacggcagucccacgauuacaauuggucuuuuaaauauaccggaaacauuaucaagggcgugaucaauauggggagcuacaacuaucucggauucgcucgcaauacaggcuccugccaagaggccgcggccaaaguccuggaggaauacggggcuggaguguguucuaccagacaggagauuggcaaccuggacaagcaugaagaacucgaggagcugguggcccgguuucuuggcgucgaggcugccauggccuaugggaugggauucgcuacgaauagcaugaacaucccugcgcugguuggcaaggggugccucauucuguccgaugaacuuaaccacgccagccuggugcucggagcuagacugucuggcgccaccauccgcauuuuuaaacacaauaacaugcagucccuggagaagcuccugaaagacgccaucguguacgggcagccccggacaagacgcccuuggaagaaaauucuuauccuggucgaaggaaucuauagcauggagggcucuauugugcggcucccggaaguuaucgcucugaagaagaaauacaaggccuaccuuuaucuggaugaggcgcauuccauuggcgcucucgggcccaccggaagaggcguggucgaguacuucgggcuggacccugaagauguggacguuaugaugggaacauuuaccaaaucuuucggcgccagcgggggcuauaucggaggcaagaaagagcugauugauuaccuccgcacgcacucccauagcgccguguaugcuacaucccugucucccccugucguggaacaaaucaucaccagcaugaaguguauuauggggcaggacggaacaucccuuggcaaagagugcguccagcagcuggccgaaaauacccgguacuucagacgccggcucaaggagaugggguuuaucauuuauggaaacgaggacagccccgugguuccgcugaugcuuuacaugccugcuaagaucggcgccuucgggagagaaaugcugaaacgcaauauuggcguggucgugguuggauuucccgcgaccccuaucaucgagucucgggccagauucugucucuccgcugcccacacaaaggaaauucuggauacggcucugaaagagaucgacgaggugggcgaucuccugcaacuuaaguacagccggcaccgccuggucccccuccuggacagacccuuugaugaaaccacauaugaggaaaccgaggacuga

SEQ ID NO: 76230 - RNA, 1659 nt, Artificial Sequence
  derived and/or modified sequence opt5 from SPTLC3__Homo_sapiens__NP_060797
auggccaaccccggcgggggagcugugugcaauggcaagcugcacaaccauaaaaagcagagcaaugggucccaaucuagaaacuguaccaaaaauggaaucgucaaggaggcccagcagaacggcaaaccucacuucuacgacaagcucauuguugagagcuuugaagaagcgccgcugcaugugaugguguucacauauaugggguacggaaucggcacgcuuuuuggcuaucugcgggauuuccuccgcaauugggggauugagaagugcaacgcugccgucgaaagaaaagagcagaaggacuuugugccccuguaccaagauuucgagaauuuuuauacccggaaccuuuacaugcgcaucagagacaauuggaaccggccuauuuguuccgcccccggaccucuguucgaucucauggaacgcguuucugacgauuauaauuggacauuuagauucaccggccgggugaucaaagacgucaucaacauggggagcuacaauuuucugggacuggcugccaaguacgaugaguccaugcgcacaauuaaagacgugcucgaaguuuauggcaccgggguggcuucuacaagacacgagaugggaacccuggauaagcauaaggagcuugaagaccuggucgccaaauuccucaacguggaggcggccaugguguuuggcaugggcuucgcuacgaacagcaugaauauccccgcccuggucgggaagggaugccuuauucuguccgaugaacucaaccacaccagccugguucugggcgcucggcucucuggggccacaauccgcauuuucaaacacaauaacacccagucccuggagaaacuucugagagacgcggugaucuacggacagccucggacacgcagagccuggaagaagauucucauccugguggaaggcgucuauagcauggaggggucuaucgugcaucuuccgcagauuaucgcucugaaaaagaaguacaaagccuaucucuacauugacgaggcucacuccaucggagccguuggccccaccggcagaggggugacggaauuuuucggacuggauccucaugaggucgacgugcugaugggcacauuuaccaagagcuucggggccucuggaggcuauauugcugggcggaaagaucucguugacuaccugcgcgugcacucccacagcgcggucuacgccuccucuaugagcccucccaucgcugaacaaaucauucggucccuuaagcugaucaugggccucgauggaacaacccagggccugcagagagugcagcaacuugccaaaaauacccgcuauuuucggcagagacugcaggagaugggguucauuaucuacggaaacgaaaaugccagcgucgugccccuccugcuguauaugccgggcaagguugcugccuuugcgcgccauaugcucgagaagaaaauugggguggucgugguuggauucccugcuacaccccuggccgaggcccgggcuagauuuugugugucugccgcucacacgcgcgaaaugcuugacaccguccuggaggcccucgaugaaaugggcgaccugcugcaacuuaaguacucccggcauaaaaagagcgcgagaccugagcucuaugaugaaacaucuuucgagcuggaggacuga

SEQ ID NO: 76231 - RNA, 231 nt, Artificial Sequence
  derived and/or modified sequence opt5 from SPTSSB__Homo_sapiens__NP_001035189
auggaccugagacgggugaaggaguacuucagcuggcucuauuaccaguaucaaaucauuuccugcugugccguccuggaacccugggagcgcucuauguuuaacaccauccuucugacaauuaucgcuaugguuguguacacggccuauguguucauuccuauccacaucagacucgcgugggaauuuuucagcaaaauuugcggcuaccauuccaccaucucuaauuga

SEQ ID NO: 76232 - RNA, 2058 nt, Artificial Sequence
  derived and/or modified sequence opt5 from SPTY2D1__Homo_sapiens__NP_919261
auggacuucagagagauccugaugauugccagcaagggccagggggugaacaauguccccaaacgguacucccucgcuguuggaccuccgaagaaagaucccaaggugaaaggcgugcaaucugccgcgguccaggcuuuucugaagcgcaaggaagaggaacuuagacggaaagcccuggaggaaaagcgcagaaaagaggagcucgugaagaaacggaucgaacugaagcacgacaagaaagcccgcgcuauggccaagagaaccaaagauaacuuccauggguauaauggcauuccuaucgaggaaaagagcaaaaagcggcaggcuacagagucccacacgucucagggcaccgaccgcgaguacgaaauggaggaagagaacgaauuucuugaguauaaucaugccgagagcgaacaagaguacgaagaggaacaggagcccccuaaaguugaguccaagcccaaggugccucugaaaucugcgccgcccccuaugaacuucacagaucuccugagacuggccgaaaagaaacaguuugagcccgucgaaauuaaggugguuaaaaagagcgaggaacggccuaugaccgcugaggagcuccgcgaaagagaguuccuggaacggaagcaccgcagaaagaaacuugagacagacgggaaacugcccccgaccguguccaagaaagccccuagccagaaggagucugucggaacaaagcucuccaaaggcagcggcgaucggcaucccucuuccaaggggaugccucugccccacgcugagaaaaagagcagacccucuauggccaaugaaaaacaccuugcgcuguccagcuccaagucuaugccuggagaacgcaucaaggccggcagcgggaacuccagccaaccgucucuccgggagggacaugacaaacccguguuuaauggcgcugggaagccucacuccagcaccucuagccccuccgugccuaaaacgucugccagcagaacccagaaguccgcugucgaacauaaagccaagaaaagccugucucaccccucccacagccgcccgggaccuaugguuacaccccauaacaaggccaagucuccuggcgugcggcagcccggcuccagcuccucuagcgcuccugggcagcccuccaccggaguggcgagaccgacagucucuagcggcccugugccccgccggcaaaauggguccagcagcuccggacccgagagaagcaucucuggcuccaaaaagccuaccaacgauagcaauccgucucgccggacgguuagcgggacaugcggacccggccagccugccuccagcucuggcgggcccggaagaccuauuuccggcagcguguccucugcucgcccccuggggagcucccggggaccuggcagacccgucucuagcccgcacgagcuccggcgcccuguguccgggcugggacccccuggaagaucuguuagcggccccgggcgguccaucagcggaucuauuccggccggcagaaccguguccaacagcgucccugggcgccccgugucuucccuuggaccuggccagacagucucuucuuccgggcccaccaucaaacccaaguguaccgugguuagcgaaacaauuuccagcaaaaauaucauuucucggagcuccaacggccaaaugaacggaaugaagccuccgcugucuggcuauagagccgcucaggggccccagcgccucccuuuccccacgggauacaagagacagcgggaguaugaagaggaagacgaugacgaugacgaguacgacagcgagauggaagauuuuaucgaggacgaaggcgagccucaagaagagaucuccaaacauauucgcgagaucuucggguacgauagaaagaaauauaaggacgaaucugauuacgcccugcgguauauggagagcuccuggaaagaacagcagaaggaggaggcgaagucucuucgccugggaaugcaggaagaccucgaggaaaugagacgggaggaagaggagaugcaacgcagacgggcuaaaaagcugaaacgcagauga

SEQ ID NO: 76233 - RNA, 1293 nt, Artificial Sequence
  derived and/or modified sequence opt5 from SPZ1__Homo_sapiens__NP_115956
auggccagcuccgcuaagucugccgagaugcccaccaucagcaaaacagugaacccuacgccggacccccaccaggaauaccuggauccuagaauuaccaucgcucucuucgagauuggcucccauucucccagcuccugggggucucugccuuuucuuaagaauagcucccaccaagucacagaacagcagaccgcgcagaaauucaacaaucugcucaaggagaucaaagacauucugaagaacauggccggauuugaagagaagaucacagaggccaaagaacuuuucgaggaaaccaauaucacagaggauguuagcgcucauaaggagaacauucggggccuggacaaaaucaaugaaaugcucucuaccaaccugcccgugucccuggccccugagaaggaagauaaugagaaaaagcaagaaaugauucucgagacgaacaucaccgaggacgugagcgcucacaaggaaaauauucgcgggcuggauaaaaucaacgagaugcuuucuacaaaucugccggucucccucgcccccgaaaaggaggacaacgagaaaaagcagcagaugauuauggaaaaucagaacagcgagaacaccgcgcaaguguuugccagagaucugguuaaucggcuugaagagaaaaaggugcugaacgaaacacagcagucucaggagaaagcuaagaaucgccucaacguccaagaagagaccaugaagaucagaaauaacauggagcagcugcugcaggaagccgagcauugguccaaacaacacacggaacucagcaagcugaucaaauccuaucagaagucucagaaagacauuagcgagacacuuggaaauaacggcgugggguuccagacccaaccuaauaacgagguuuccgcuaagcacgaacuggaggaacaggugaagaaacucagccaugauacauacucucugcagcuuauggccgcgcugcucgagaaugaaugccagauccugcaacagcgggucgagauucugaaggagcuccaccaucagaaacagggaacccugcaagaaaagcccauccagauuaacuauaaacaggacaagaagaaucagaaaccuuccgaggccaagaaaguggaaauguacaagcaaaacaaacaggcuaugaagggcaccuuuuggaagaaagaucgcagcuguagaucucuugacgugugccugaauaagaaagccuguaacacacaguucaacauccacgucgcucggaaggcccuccgcggcaaaaugagaagcgccuccucucugcgguga

SEQ ID NO: 76234 - RNA, 1725 nt, Artificial Sequence
  derived and/or modified sequence opt5 from SQLE__Homo_sapiens__NP_003120
auguggaccuuccugggcaucgccacauuuacguacuucuauaagaaauuuggggacuucauuacccucgcuaacagagaggugcugcuuugcguccugguuuuucucagccugggacuugugcuguccuaccggugucgccacagaaauggcgggcuccugggacggcagcaaucuggcagccaguucgcccuguuuuccgauauccucucugggcugcccuucauuggauuuuucugggcgaaaagcccuccggaauccgagaacaaagaacagcuugaggcucgcagacggcgcaagggcacaaauaucucugaaaccagccugauuggcacagccgccugcaccuccacaagcucucagaacgaccccgaggugaucaucgucggggcuggagugcucggcuccgcccuggcugccguucuuagcagagaugggcggaaagugaccgucauugagcgcgaccugaaggaaccugauagaaucgugggagaguuucuccaacccggcggguaucauguucugaaggaccugggacucggcgauacgguggaaggccuggacgcgcaggucgugaauggguacaugauucacgaucaggagucuaaauccgaggugcagaucccuuauccccuuagcgaaaacaaucaaguccagucuggacgggccuuccaucacggccgcuuuauuaugucccugagaaaggcugccauggcugagccuaacgccaaauucaucgaagggguugugcuccagcugcuugaggaagacgauguggucaugggagugcaguacaaggacaaagagaccggcgauauuaaggagcugcaugcgccgcucacaguuguggccgacgggcuguucagcaaguuucggaaaucccuggucucuaauaaggugagcguuuccagccacuucgugggauuucucaugaaaaacgcuccccaauucaaggccaaucacgcugaacugauccuugccaacccuucucccguccugaucuaucagauuuccagcucugagacccgcgugcucgucgacaucagaggcgaaaugccucggaaucugagagaguacaugguggaaaagauuuacccccagaucccggaucaucuuaaggagccuuuucuggaggccacagacaacagccaccuccgcuccaugcccgcuucuuuccugccucccagcuccguuaaaaagcggggcgugcugcuccugggggaugcguauaauaugagacauccccuuaccggaggcgggaugacggucgccuuuaaggacauuaaacuguggcgcaagcuccugaaaggaaucccugaucuguacgacgaugcugccaucuucgaagccaagaaaucuuuuuauugggcucggaagacaagccacuccuucgugguuaacauucuugcccaagcgcucuacgagcuguuuagcgcuaccgacgauucucugcaccagcucagaaaggccuguuuccuguauuuuaaacuuggcggggaaugcguggccggcccggucggacugcucuccgugcugagccccaacccucuggugcuuaucggccauuucuucgcuguugccauuuacgcugucuauuuuuguuucaaguccgagcccuggaucacaaaaccucgcgcccuccugucuagcggggcggugcuguacaaggccugcuccgugauuuuuccccucaucuacucugaaaugaaauauaugguccacuga

SEQ ID NO: 76235 - RNA, 1353 nt, Artificial Sequence
  derived and/or modified sequence opt5 from SQRDL__Homo_sapiens__NP_067022
auggugccccuggucgccguugugagcggcccuagagcucagcuguucgccugccugcuucggcuggggacccaacaggugggaccgcuccagcugcacacaggcgcgucccaugcugcccgcaaccacuacgagguccuugugcucgggggaggcucugggggaaucacgauggccgcuagaaugaagcggaaaguuggcgccgaaaauguggcuauugucgagcccagcgaacgccauuuuuaucagccuaucuggacccucgugggcgccggggcgaagcaacuguccucuagcggaagacccacagccuccguuauuccuucuggcguggaguggaucaaagcucgggucaccgaacugaaccccgacaagaauuguauucacacagaugacgaugagaaaaucagcuaccgcuaucucaucauugcccuggggauccagcuugacuacgagaagauuaagggacugccugaaggcuucgcucauccgaaaaucggguccaacuauagcgugaagaccguggagaaaacauggaaggcccuccaggauuuuaaagaaggaaaugcgauuuucaccuuucccaacacgccugucaagugcgccggcgcuccccagaagaucauguaccugucugaggccuauuucagaaaaaccggcaagcgguccaaagcuaauauuaucuuuaacacaagccuuggggccaucuucggaguuaagaaauacgccgacgcucugcaagagauuauccaggaacgcaaucucaccgugaacuacaagaaaaaucugauugaggugagagcggauaagcaggaagccgucuuugagaaccuggacaagccuggcgaaacacaggugaucucuuaugagaugcuccacguuacgcccccgauguccccucccgaugugcugaaaaccagcccugucgcugacgccgccggguggguggauguugacaaggagacacuucaacaccggcgcuaccccaauguguucggaauuggcgauuguaccaaccugcccacaucuaaaaccgcugccgcggucgcugcccaguccgggauccucgacagaaccaucagcgugauuaugaagaaucagacaccuacgaaaaaguaugacggauacaccuccugcccgcuggucacaggcuauaaccgggugauccuugccgaauuugauuacaaggcugagccccuggaaaccuucccuuuugaccaaucuaaagagcgccucagcauguaucugaugaaggccgaucugaugcccuuccucuacuggaacaugaugcugagaggcuacuggggagggccugcuuuccuucggaaacuguuucaucucggcauguccuga

SEQ ID NO: 76236 - RNA, 1071 nt, Artificial Sequence
  derived and/or modified sequence opt5 from SQSTM1__Homo_sapiens__NP_001135771
auggccaugagcuacgugaaggacgauaucuucagaauuuauaucaaagagaagaaagagugccggcgcgaccacagacccccuugugcucaggaggccccgcggaacaugguccaccccaauguuauuugcgauggcuguaacgggccuguggugggaacccgcuacaagugcuccgucugucccgacuaugaucugugcucugugugugaaggcaaagggcuccacagaggacauacaaagcuggcguuuccuagccccuucggccaccuuuccgagggguuuucucauagccgguggcugcgcaagguuaaacacggacacuucggcuggccuggcugggaaauggggccgcccggaaauugguccccuagacccccucgggcuggcgaggcccgccccgggccgacggccgagucugcuagcggaccuuccgaagaccccagcgugaacuuucucaagaaugucggcgagucuguggccgcugcccuguccccucuugggaucgaaguugauauugacguggagcauggaggcaaaagaagccggcugacccccgucucucccgaguccagcucuacagaagagaaguccagcucccaaccuucuagcugcuguuccgauccgagcaaacccggcgggaacguggaaggagcgacccagucucucgccgagcagaugcgcaagaucgcucuggaauccgagggcagaccugaggaacagauggagagcgacaauugcucugggggagaugacgauuggacacaccugagcuccaaggaaguggaccccucuaccggcgagcuccaaagccugcagaugccugaauccgaggggcccagcucucuugacccgucccaggagggaccuacaggccugaaagaagccgcucucuacccccaucugccucccgaggccgauccucggcuuaucgaaagccugucucagaugcucuccaugggcuucagcgacgaagggggauggcugacccgccugcuccaaacgaagaacuaugauauuggcgcggcccuggacaccauccaguacuccaaacaucccccgccucuuuga

SEQ ID NO: 76237 - RNA, 711 nt, Artificial Sequence
  derived and/or modified sequence opt5 from SRA1__Homo_sapiens__NP_001030312
augaccagaugccccgccggccaggcugagguggaaauggccgagcuguacgucaagccugggaacaaagaacggggauggaaugacccgccccaauucagcuauggccuccagacacaggccgggggaccucgcagaucccugcuuacgaagcggguugcugcgccccaggauggcucuccucgcgugcccgccagcgagaccuccccugggccgcccccuaugggacccccucccccgucuagcaaagcuccuagaucucccccugugggcuccggccccgccagcggggucgaacccacauccuuuccuguggagagcgaggcuguuauggaagacgugcugcggccgcucgagcaagcccuggaagauugucgcggacacaccagaaagcaggucugcgacgauaucucucggcgccuugcgcugcuccaggagcagugggccggcgggaaacuguccauucccgugaagaagagaauggcucugcucguucaagagcugagcucucaucggugggacgccgcugaugacauccaccgcucccuuaugguggaucaugucacagaagugagccaguggauggugggagucaaaagacugauugccgagaagcggucucucuucuccgaagaggcggccaacgaagagaaaagcgcugccaccgcugagaagaaucacacaaucccuggcuuucagcaggccuccuga

SEQ ID NO: 76238 - RNA, 2988 nt, Artificial Sequence
  derived and/or modified sequence opt5 from SRBD1__Homo_sapiens__NP_060549
augagcucccugcccagacgggccaaggugcagguccaagacguugugcucaaagaugaguucucuagcuuuuccgaacugucuagcgcuuccgaggaagacgauaaggaggacucugccugggaaccucagaaaaaggugccgcgcagcagaaaacagcccccucccaaggaguccaagccuaaacggaugccccgcgucaagaaaaacgcgccucagaucagcgauggcucugaggugguuguggucaaggaagaacuuaauuccagcguggcuauugccgacaccgcccuggaagaucggaaaaacaagcucgacacaguucaaacgcugaagaccgcuaaaacaaagcagaaaugcgccgcucagccgcacaccgugcggcgcacaaagaaacuuaaggucgaggaggaaaccucuaaagccuccaaucuggagggggaaagcaacucuuccgagacacccagcaccuccacgguguggggaggcaccuguaagaaggaagagaaugaugacgauuucacauuugggcagucugcgcucaaaaagaucaaaaccgagacauacccucaaggacagcccgugaaguucccugccaacgcuaauagcaccaaagaagaggucgaaaugaacugggacaugguucaggugcuguccgagagaacgaauauugaacccugggugugcgccaacaucauucggcuguuuaaugaugacaacacaaucccguucaucauucgcuauagaaaggagcucaucaauaaccuggacgcugauagccuucgggagguccagcaaacccuggaggagcuccgcgccguggcgaagaaaguucauucuacaauucagaagaucaaaaaggaaggcaaaauguccgagugucugcuuaaggccaugcugaauugcaagaccuuugaggaacucgagcacgugagcgcuccuuacaaaaccgggucuaagggaacaaaagcccagagagcucggcaacugggccuggaaggcgccgcccgcgcucuccuggagaagcccggggaacuuagccugcucuccuauauuagaccugacgucaaaggacugucuacgcuucaggauaucgagauuggcgugcagcauauccuggcggacaugaucgccaaggauaaggacacccucgauuucauucggaaccugugucagaaaagacacguuugcauccaaagcucccuggcuaaggugagcucuaaaaaggucaacgagaaagacguggauaaguuucuccuguaccagcauuucuccuguaauauucgcaacauccaccaccaucagauucuugccaucaauagaggggaaaaccugaaaguccucacagugaagguuaauaucagcgacggagugaaggaugaguuuugcagaugguguauucagaaccgcuggcggcccagaucuuucgcccgccccgaacugaugaaaauccuuuauaauucccugaacgacagcuuuaagcggcucauuuacccucugcugugcagagaguuccgcgcuaaacucaccuccgacgccgaaaaggagucugucaugauguucggccggaaucugagacaacuucugcucacaagcccggugcccgggcgcacccugaugggaguugauccuggcuauaaacacggcuguaagcuggcgaucauuucccccacgucucagauccuucauacagacguggucuaccuccacugcgggcagggauuucgggaggcugaaaagaucaaaacccugcugcucaacuucaauugcagcaccguggugauuggcaacgggacagccuguagagagaccgaagccuacuuugcugaucugaucaugaagaauuauuucgccccucuugacguugucuacugcauuguguccgaggcuggagccagcaucuauucugugucccccgaagcgaacaaagagaugccgggccuggauccuaaucuccggagcgccgucucuauugcucgcagagugcaggacccccuggccgagcugguuaagaucgaaccuaaacacauuggggugggaauguaccaacaugaugucucccagacacuucucaaggcuacgcuggacagcgugguugaggaaugugugucuuuugucggcguggauaucaacaucugcagcgagguucugcuccggcacauugccggccugaacgcgaauagagccaagaacaucauugaauggcgcgagaaaaaugggcccuucaucaaccgggagcagcuuaagaaagugaagggacugggcccuaaauccuuucagcaaugugcuggguucauuagaaucaaucaggacuauauccgcaccuuuugcagccagcaaacagaaaccucuggacagauucagggcgucgccgugacauccagcgcugauguggaggucaccaacgaaaagcaggggaagaaaaaguccaaaacggccguuaaugugcuccugaagcccaacccgcuggaccaaaccuguauccauccugagucuuacgauauugccaugagauuccuuagcuccaucggcggaacacucuaugaggugggcaaacccgaaaugcagcagaagauuaauucuuuucuggagaaagaagggauggagaagaucgcugaacggcugcagaccacaguccacacccuccaagugaucauugacggacugagccagcccgaguccuucgacuuucgcacggauuucgacaagccugauuucaaaagaucuaucguuugccuugaggaccugcagauuggcacagugcucaccgggaaggucgaaaacgcgacacuguuuggaaucuucguggauauuggcguugggaaaagcggccugaucccgauccggaaugugaccgaggccaaacuuuccaagaccaagaagcgcagaagccucggacugggccccggggaacgggucgaggugcagguucugaacauugacaucccucgcucuagaauuacacucgaucugauccgggugcuuuga

SEQ ID NO: 76239 - RNA, 9693 nt, Artificial Sequence
  derived and/or modified sequence opt5 from SRCAP__Homo_sapiens__NP_006653
augcagagcucccccucuccugcucacccgcaacugcccguccuccagacccagauggucagcgacggcaugaccggguccaacccuguuucucccgcuagcuccucuagcccugccuccagcggcgccggcgggauuucuccccagcauauugcucaagacuccagccuggacggcccuccgggacccccugauggggccacggugccccuugagggauucucucugucccaggccgcugaccucgccaacaagggcccuaaaugggaaaagagccacgcugagaucgccgaacaggcgaaacaugaggccgaaauugagaccagaaucgcugagcugcggaaggaaggcuuuuggucucuuaaacgccugcccaaggugccggagccucccagaccuaaggggcacugggauuaccucugcgaagagaugcaguggcuguccgccgacuucgcucaagagcggcgcuggaaaagaggagucgcccggaaggugguucgcauggugauuagacaucacgaagaacagcggcagaaagaggaacgcgcgagacgggaggaacaggccaagcugcgcagaaucgcuagcacaauggccaaagauguccggcaauuuugguccaacguggagaagguugugcaguucaagcagcaaucucgccucgaagagaaaagaaagaaagcucuggaccuucaccuggauuuuaucgucggccagaccgaaaaguauagcgaccuccugucccagagccuuaaucagccccugaccucuuccaaagccgggagcucucccugucucggaagcuccucugccgcuagcuccccuccgcccccugccagccggcuggaugacgaggauggcgacuuccaaccccaggaagacgaggaggaagaugacgaggaaaccauugagguggaagaacagcaggaggggaacgaugccgaagcucaaagacgcgagaucgaacugcuccggagagagggagagcugccucuugaagaacugcuccgcucucugcccccgcagcuucuggaaggcccuuccagccccucucagaccccuuccagccaugacuccgauacccgggacggccccgaggaaggggccgaggaggaaccuccccaggugcucgagauuaagccgccucccucugccgucacgcaaagaaauaaacagcccuggcacccugaugaagacgaugaggaauuuaccgcuaacgaggaggaagccgaggacgaagaggauacaaucgcggcugaggaacagcuggagggagaaguugaccaugccauggagcugagcgaacucgcccgcgagggcgagcuguccauggaggaacuucugcagcaauacgcuggggccuaugcuccgggaucuggcagcuccgaagacgaggaugaagacgagguggaugccaauagcucugacugcgagcccgaagggccuguggaggcggaggaacccccucaggaagauuccagcucucaguccgacagcgucgaggaucggucugaggacgaagaggaugaacacagcgaggaagaggagaccuccggaagcucugccuccgaagagagcgaauccgaggagucugaagacgcucaaagccagucccaggccgaugaggaagaggaagacgaugacuucggcguggaguaccuccuggcuagagacgaggaacagucugaggccgaugcgggcagcgggcccccuacacccggaccgaccacgcuuggcccuaagaaggaaauuacagacaucgccgcugccgcugagucccugcaacccaaaggguauacccucgccacaacccagguuaagaccccuauuccccugcugcuccgcggacagcugcgggaauaccagcacaucggccuugauuggcuggugacaauguaugagaaaaagcucaacgggauccuggccgacgagaugggccugggaaaaacgauucaaaccaucucucuucucgcucaucuggcgugugaaaagggcaauugggggccgcaccugauuaucgucccuacaagcgugaugcucaacugggagauggaacugaagagauggugccccuccuuuaaaauucuuaccuacuacggagcccagaaggagcgcaaacugaagcggcagggcuggacaaaaccuaaugcuuuccauguuuguaucaccagcuauaagcucgugcugcaggaucaccaagccuuuagacggaagaacuggcgcuaccugauccuugacgaagcccagaauauuaaaaacuucaagucucagagauggcaaucccuccugaauuuuaacagccagcggagacugcuccugacggggacaccccuucagaacucucugauggagcucuggucccugaugcauuuccugaugccccacgucuuccagagccaccgcgaguuuaaagaaugguucucuaauccucuuaccggaaugaucgagggcucccaagaauauaacgaggggcucgugaagcggcugcauaaaguccugagaccguuucuccugcgcagagugaagguugauguggagaagcagaugcccaaaaaguacgaacacgucauucggugccgccuuagcaaaagacagcggugucuguaugacgauuucauggcucagaccacaaccaaggagacacucgccacgggccauuuuauguccgugaucaauauucugaugcaacugcgcaaaguuugcaaccacccuaaucuuuucgaccccagaccugugaccagccccuuuaucacaccuggaaucuguuucucuaccgcgagccucguccugcgggcuacagaugugcacccgcugcagcgcauugacaugggcagauuugaucucaucgggcuggaaggacgggugucccgcuacgaggccgacaccuuccuucccagacaucggcugucuagacgcguucuccuggaagucgccacggcuccugaucccccuccccggccgaagccugugaaaaugaaggugaacagaaugcugcagcccguccccaagcaggagggccgcaccgugguuguggucaauaacccucgggcgccccuugggccugugccgguuagacccccucccggaccugagcugagcgcgcaacccacaccgggcccugugccccagguccucccugcuucccugauggugucugccagccccgccgggccuccccucauuccggcuucccgcccucccggccccguucugcuuccuccgcugcagcccaauucuggaagccucccucaggugcugcccuccccucugggcguccuuagcgggaccucucggcccccuacaccgacccugucccucaaacccacgccucccgccccugugagacugagccccgcuccgccucccggaucuuccagccuccugaagccccuuacagugccucccggcuauaccuuuccuccggccgcggccacaaccaccuccacaacgaccgcuacagccaccacaaccgcuguccccgccccuacgcccgccccucaacgccugauccucucucccgauaugcaggcucggcugccgagcggggaaguuguguccauuggacagcuggcgagccuugcccaaagaccuguggcuaacgccggcgggucuaaaccccugacauuccagauccagggcaauaagcucacccugaccggagcccagguccggcaacucgcugugggccagccucgcccccugcagagaaacguugugcaccuugucuccgccgggggacagcaucaccugauuagccaaccugcgcauguggcucugauccaggccguugcccccacaccgggcccuacccccgugucuguccuccccagcuccacaccuucuacgaccccggcucccacagggcugagccuuccucuggccgcgaaucaggugcccccuaccaugguuaacaauacaggaguggucaaaaucguggugcggcaggcuccccgcgacggccucaccccugugcccccgcuggccccugcccccagaccucccuccucuggccucccggcuguucugaacccucggcccacgcuuacccccgggagacugccuacacccacccugggaacagcccgcgcuccuaugccgacccccacacucgugcggccucugcuuaagcuggugcacagccccuccccugaggucagcgccucugcgcccggcgccgcuccucucaccauuuccagcccgcugcacgugcccuccucucucccugggcccgccagcuccccuaugcccaucccgaacucuagcccucuggcuucccccguuagcucuacgguguccgucccccuuuccucuucccugccuauuagcgugcccacaacccugccugccccggccucugcuccccucaccaucccuauuagcgcgccccugacaguuuccgccucuggaccugcccuucugaccagcgugacgcccccgcucgccccugucgugcccgccgcuccuggacccccgucccuggccccuagcggggcgucccccucugcuagcgcccucacacugggacuugccaccgcucccucccugucuagcucccaaacaccuggccauccccugcuccuggccccuaccucuagccacgucccgggccuuaauuccacaguggcgcccgccugcagcccuguucuggugcccgcuucugcccucgcuuccccuuuucccagcgccccuaacccggcucccgcccaggcgucucugcuggccccugcuuccagcgccucucaggcucucgccacaccccuugccccuauggcugcgccccaaacggccauccuggcuccguccccugcgccgccccuggccccucuccccguccuggcuccuagcccgggggccgcgcccgugcuugccuccagccagaccccuguucccgugauggcuccuucuagcacacccggaaccucccuggccucugcuagcccggucccugcccccacaccugugcucgcgcccuccucuacccagacgaugcugccugcccccgugccgagcccccugccuucccccgcuucuacacagacccucgcccuugcuccugcccuggcuccgacacugggcgggagcucccccagccaaacccucucucugggaaccggcaauccucaggggcccuucccuacacagacgcuuucccugacccccgccagcucucucguuccuacacccgcgcagacccugucccuggccccgggaccuccccucggcccuacacaaacccuuagccuggcucccgccccgccucuggcucccgccucccccgucggcccugcccccgcgcauacgcucacacuggcuccugccucuagcuccgcuagccuucuggccccggccucugugcagacccucacccugucccccgcuccugugcccacacuggggccugccgcggcccagacccucgcucuugcccccgcuagcacacagucuccggccagccaagcguccucucuggucgugagcgccuccggagcugccccucugcccguuacgauggugucuagacucccugucagcaaggaugaacccgacacccugacacuucgcuccggcccucccagcccgcccucuaccgcuacauccuucgggggaccucggcccagacgccagccucccccuccgccccggagcccuuuuuaccuggauucccucgaggagaaaagaaagcgccagagaucugagcggcuggagcgcaucuuccagcugagcgaagcccacggcgcucucgcccccguguacgggaccgagguucuugacuuuuguacgcugccucaacccguggcguccccgauuggaccuagaucucccggcccuagccaucccaccuucuggacauauaccgaagccgcucaccgggccguccuguuuccgcagcagcgccucgaucaacuguccgagaucauugaaagauucaucuuugugaugccucccguugaggcucccccucccagccuucacgccugccauccuccgcccuggcuggccccucggcaggcggcuuuccaggagcagcucgccucugaacuguggcccagagcccgcccucugcaccggauugugugcaacaugagaacacaauuucccgaccuccgccuuauccaguacgauuguggcaaacugcagacccuggcuguccuccugcggcagcuuaaggccgaggggcauagagugcugaucuucacacaaaugacgcggaugcucgacgugcuggaacaguuucugaccuaucacggacaccucuaccuucgccuggauggcuccacaagagucgagcagcggcaggcucugauggagcgcuucaaugccgacaaaagaaucuuuugcuucauccucagcacccggucugggggaguuggcgugaaccugaccggggcggacacaguggucuucuaugauuccgacuggaauccuacgauggaugcccaagcucaggaccgcugucauagaauuggacagacccgggaugugcacaucuaccgccuuauuagcgaaagaacaguugaggaaaacauccugaagaaggccaaucaaaaacggaugcucggcgacauggcuaucgagggcgggaacuuuaccacagccuauuucaagcagcagaccauuagagaacuguuugauaugccgcuggaggagcccucuuccagcucugugccuagcgcgcccgaagaggaagaggaaacggucgccuccaaacagacacauauccucgagcaagcucuuugccgcgccgaggacgaagaggauauucgggcugccacccaggcuaaggccgaacagguggcggagcuggccgaguucaaugagaacgacggauuuccugcuggcgagggggaagaggccggaagacccggcgccgaagaugaggagaugagccgcgcugaacaggagaucgccgcgcugguugaacaacucaccccgauugagcgguacgcuaugaaauuccuggaagccucccuugaggaggugucuagagaggaacugaagcaggccgaggaacaggucgaagcugcccgcaaggaccucgaucaggcuaaagaggagguguuucggcugccccaagaagaggaagaggggccuggagccggcgacgaaagcuccuguggcacagggggaggcacccacagacgcucuaagaaagcgaaggcccccgagcggccugggacaagagucagcgagcgccugcggggagcuagagccgaaacccagggcgcuaaucauacgcccgugaucuccgcccaccagacacgcucuaccacaaccccuccgagaugcagccccgcgcgggagcgcguuccuagacccgccccucggcccagaccgacgccugcuuccgcccccgcugccauuccugcccucgugcccgugccugucagcgcucccguuccgaucucugcgcccaacccuaucaccauucuucccgugcacauccugccuucucccccuccucccagccaaauuccucccuguagcucccccgccugcacacccccgccugcuuguacacccccucccgcccauacaccgcccccugcccagaccugccuggugacacccagcucuccucuccugcuugggcccccuuccgucccgaucagcgcuucugugaccaaucugccccucggacugcggccugaagccgagcugugugcgcaggcucucgccucccccgagagccuggaacuugccagcguugcuuccucugagacgagcucccugucucucgugccucccaaagaccugcuuccggucgccguggaaauucugccugucagcgagaagaaccucucccugacacccucugcuccuagccugacccucgaagccggcuccauccccaacggccaggagcaagaggcgccugauagcgccgaagggaccacacugaccgugcuucccgagggagaggaacugccgcucugcguuucugaauccaauggccuggagcuucccccuagcgcugccucugacgagccccugcaggaaccucucgaggcugaucgcacauccgaggaacugacggaagccaaaacccccacaagcuccccugagaagccgcaggagcuggugaccgcggaagucgccgcucccucuacaagcuccucugccaccagcuccccugaggggcccagcccugcuagacccccgcggcgcagaacgucugccgacguggaaauccggggacagggcaccgggcgcccuggccaacccccuggacccaagguucucagaaaacugccgggccggcuugugacagucguggaggagaaggaacuggugcgcagacggcgccagcagagaggggccgcuuccacccucguucccggagucagcgagacaucugcgagcccuggcucccccucugugcggagcauguccgggccugaaagcucucccccuauuggaggcccgugcgaggccgcucccuccagcucccugccuacacccccucagcaacccuucaucgcccgcagacacauugaacuuggggugacgggcggaggcucuccugagaacggggauggagcccugcucgcuaucacaccgcccgccgucaaacggagacgcggccggccucccaagaaaaauagaagcccugcggacgcugggcgcggaguugaugaggcccccuccucuacccugaagggcaagacaaacggggccgacccggugcccggcccugaaacccugauuguggcugaucccguccucgagccucagcugauccccggaccucagccgcuuggcccccagccugugcaucggcccaauccucugcucagccccguugagaaaagacgccgggggagaccgccuaaggcccgcgaccugcccaucccuggaaccauuuccucugcuggcgaugggaacagcgagucccggacacaacccccuccccacccgagcccccuuacgccucugcccccucuccuggugugucccaccgccacagucgcgaauaccgugacaaccguuacgaucucuacauccccgccuaaaagaaagcgcggacggcccccuaaaaaucccccuagccccagaccgucucagcugccugugcucgaccgggauuccaccagcguccuggaaucuugcggccuuggcagacgccggcagccccaagggcagggagagagcgagggcuccagcuccgacgaagacgggucuagaccucugacccgccucgccagacugcggcuugaggcugaaggaaugcgcggcagaaagagcgggggauccauggugguggccgucauucaggaugaccuggaucucgcugacucuggccccggcgggcuggagcugacaccgcccguugugagccucaccccuaagcugcgguccacacgccuuagacccggaucucuggugccuccccucgaaacggagaaacugccucggaagcgcgccggcgcgccggucgggggaagccccggccuugccaaaagagggcggcugcagccucccuccccucucggacccgagggcagcguggaagagucugaagcugaggccuccggcgaggaagaggaaggggauggaaccccgcgcagacggccuggcccccgcagacugguugggacaaccaaucaaggagaccagcggauccugagaagcucugcuccucccucccucgccggcccugccgugagccaccgcgggcggaaggcuaaaacauga

SEQ ID NO: 76240 - RNA, 1611 nt, Artificial Sequence
  derived and/or modified sequence opt5 from SRC__Homo_sapiens__NP_005408
augggcagcaacaaguccaaacccaaggacgccucucagagacggcgcagccuggagccugcugaaaaugugcacggggccggaggcggggcguucccggcuucccaaacccccucuaaaccugccagcgccgauggacauagaggccccuccgcugccuuugcuccugccgcggccgagcccaaacucuucgggggauuuaacucuagcgacacagucacguccccucagcgggcuggcccgcuggccggcgggguuaccacauucguggcucuuuacgauuaugaaagccgcaccgagacagaccugucuuuuaagaagggagaaagacuccagaucgugaauaacaccgagggcgauugguggcuggcccacucccuuagcacagggcagaccggauacauucccucuaauuaugucgcgccuuccgacagcauccaagccgaggaaugguacuucggcaagauuacgcggcgcgagucugaaagacugcuccugaacgcugagaauccccgggggaccuuucuggugcgcgaguccgaaacaaccaaaggagccuauugccucagcguuuccgauuucgacaacgcuaagggccugaaugugaaacauuacaagaucagaaaacuugauucuggcggguuuuauauuacaagccggacccaguucaacucccugcagcagcucgucgccuacuacagcaagcacgccgacggacugugucaucgccuuacgacagugugcccuaccucuaagccccaaacacagggccuggcuaaagaugcgugggagaucccgagagaaucccuccggcuggagguuaagcuggggcagggauguuuuggcgaaguguggauggggaccuggaauggaaccacacgcgucgccaucaaaacgcucaagccuggcaccaugagccccgaggcuuuccugcaggaggcccaagugaugaaaaagcugagacacgaaaaacuugugcagcucuaugccgucguuucugaggaaccuauuuacaucgugacagaguauaugagcaagggcucccugcuugacuuucugaagggggaaaccggaaaauaccuccggcugccccagcugguggauauggcugcccaaauugcgucuggcauggcuuaugucgagagaaugaacuacgugcaccgcgaccuccgggccgccaauauccugguuggggagaaccuugugugcaaggucgcugacuucggacuggccagacucauugaagauaaugaguauacagcucgccagggcgccaaauuccccaucaaguggaccgcgccugaagccgcucuguacgggcgguuuacgauuaaaagcgacgugugguccuucggcauccuucugacagagcucaccaccaagggaagaguuccguaccccggcauggugaaccgcgaaguccuggaucagguggagcggggguauagaaugccuugucccccugagugccccgaaagccugcaugaccucaugugucagugcuggcgcaaggagccggaggaacggccuacauuugaguaccugcaagccuuccuugaagauuauuuuaccucuacagagccccaguaccagccuggagaaaaccuguga

SEQ ID NO: 76241 - RNA, 3552 nt, Artificial Sequence
  derived and/or modified sequence opt5 from SRCIN1__Homo_sapiens__NP_079524
augggcaacgcccccagccaggacccugagcgguccucuccgcccaugcugagcgcugaugacgccgaauacccucgggaguaucgcacccucgggggaggcgggggaggcggguccggaggcagacgguucucuaaugugggccugguccacacaagcgaacgcagacauacgguuaucgcggcucaaucccuugaggcccugucugggcuccagaaggccgaugcugaccggaaacgcgaugccuuuauggaccaccuuaagagcaaauacccccagcaugcucuggcccugagaggacagcaagaucggaugcgcgaacagccuaacuauugguccuucaagaccagaagcucucggcacacacagggcgcgcagcccgggcucgccgaccaagcugccaaacuguccuacgcuagcgccgagucucuggagaccauguccgaagcggagcucccucugggauuuagccgcaugaauagauuccggcagucucuuccgcugucccgcagcgccucccagacaaagcucagaucucccggcgugcuguuucuucaguucggggaagagacccggagagugcauauuacacacgaggucagcucccuggauacccuccacgcucugaucgcccauauguuuccucaaaagcugacgaugggaaugcucaaaagccccaacaccgcuauucugaucaaggacgaagcccgcaauguguucuaugagcuugaagauguucgggacauucaggauagaucuaucaucaaaauuuaccgcaaggagccucuguaugccgcuuuucccggcucccaccucacaaacggcgaccugcggagagaaaugguguacgcgagccgcgagucuagcccgacccggagacuuaauaaccuguccccugcuccccaucucgccucugggagcccuccucccggacugcccuccggccugccgagcgggcuccagucuggaucccccagccgcucucggcuguccuacgccggcgggagaccucccagcuaugccggauccccuguccaccacgcugccgagcgccuuggcggcgcgcccgcugcccaaggggugucuccgagcccuuccgccauccuggaacggagagacguuaaacccgaugaggaccucgcuucuaaggccggaggcauggugcuggucaagggggaaggacuuuacgcugauccuuauggccugcuccaugaggggcggcugagccuggccgcggccgcuggcgaccccuucgccuacccuggagcuggcgggcucuauaaacgcggauccgugagaagccugucuacauacuccgccgcggcccuucagagcgaucuggaagacucucucuauaaggcugccggcgggggaggcccccuguacggggauggcuacggauuucggcugccgccuuccagcccccagaaacuugcugacguggccgcucccccuggcgggccgcccccuccccacucuccuuauagcggacccccuuccagaggcagccccguccgccagucuuuccggaaggauuccgggagcuccucuguuuuugccgagagcccgggaggcaaaaccagauccgcggggucugccagcacggcuggcgccccucccuccgaacucuucccuggacccggcgaacgcucucuggugggguucggaccgccugugcccgccaaggacacagagaccagagaacggauggaggcuauggaaaaacaaauugccagccugacaggccucguccaguccgcgcugcuucgcgggagcgagccugagacccccucugaaaagaucgagggauccaauggcgcugccacccccagcgccccuugcgggucuggcggaagauccagcggcgcuacaccggugucugggcccccucccccuuccgccagcuccacgcccgcgggacagccuaccgcuguuagccggcugcagaugcaacuccaucugcgcggccugcagaacucugccagcgaucuuagagggcagcuccagcaacugcggaagcugcagcuccagaaucaggaauccgugcgcgcccugcuuaaaagaacagaggcugagcugucuaugcgggucagcgaagccgcucgcagacaagaggacccgcuccagcggcagagaacccugguggaagaggaacgccugcgguaccuuaacgacgaggagcucauuacacaacagcugaaugaucuggaaaaguccguugagaaaauccagagagacgugucucacaaccaucgccucguccccggaccugaacuggaggaaaaggcccuugugcugaaacagcucggcgagacccugacggagcugaaggcgcacuuucccggccuucaaagcaagaugcgggucgugcucagaguugaaguggaggccgucaaauuccugaaggaggagccucagcgccuggaugggcuccugaaacgguguagaggagugacagacacccuugcucagauucgccggcagguugaugaaggcguguggcccccgccuaauaaccugcucucccaaucucccaagaaagucaccgccgagacagacuuuaacaagagcguggauuucgagaugcccccucccuccccuccgcugaaucugcacgaacuuagcgggcccgcugagggagccucucugaccccuaagggcgggaaccccacaaaaggacucgacacgccuggcaagagauccguggauaaagccguuagcgucgaagcugcggagcgggacugggaggaaaagcgcgccgcucugacccaguauucugccaaagauaucaauagacuccuggaggaaacacaggccgagcuucugaaggcuauccccgaccucgauugcgccuccaaggcgcauccgggcccugcucccaccccugaccacaaacccccuaaggcuccccaugggcagaaagccgccccgcggacagaaccuagcggacgcagaggcuccgacgagcugaccgugccccgguacagaacggagaagcccucuaaaagcccuccgcccccucccccucgccgguccuuucccagcucucacgggcugaccacaaccagaacaggagaaguggucgugaccuccaagaaagauagcgccuucauuaagaaggcggagucugaggaacuugaaguucaaaaaccucaggugaagcugcgccgggcugucagcgagguggccagaccggccuccacgcccccuaucauggcuucugccauuaaagacgaggaugacgaagaucgcaucauugcugagcucgaaagcggcgggggauccguucccccuaugaagguggucacacccggcgccucucggcugaaagcggcccagggccaagcugggagcccggacaaguccaagcacggaaaacagagagccgaguauaugcgcauccaggcucagcaacaggccaccaagccuagcaaagaaaugucuggcuccaacgagacaagcucccccgugucugagaagcccagcgccuccagaaccucuaucccuguucucaccagcuuuggggcuagaaauuccagcauuucuuucuga

SEQ ID NO: 76242 - RNA, 639 nt, Artificial Sequence
  derived and/or modified sequence opt5 from SRD5A1__Homo_sapiens__XP_011512405
auggagcacgccgcucagcccuggagauggcaacggcgcagaggcuggcggcgcagcgccugcuggccuagauccccgaccuguucugcgcccugggcugcccggagcucccgcgccaucgugagacggacacagugcacggcugccacccgcuguccugcuacagggucugaaugcagacggggacccccuggcuggugucgcagcugccccagauggccuugucgguccaccucuacaccggccagcccuccccgcgucuccgcggccagacccaccgcuagcucuuggccuugcuccagcucuacaaccgggauuggauucggccuguggcucacggggaugcugaucaacauucauuccgaccacauccuucggaaucugagaaagcccggagauaccggcuacaaaauuccgcgcggcgggcucuuugaguauguuacagccgcuaacuacuucggagaaaucauggagugguguggcuaugcccuggcgagcuggucugugcagggggccgcuuuugccuucuuuaccuucugcuuucuuuccggacgggcuaaggaacaucacgagugguaccugagaaaauucgaggaauauccuaaguuucgcaaaaucauuauccccuuccucuuuuga

SEQ ID NO: 76243 - RNA, 747 nt, Artificial Sequence
  derived and/or modified sequence opt5 from SRD5A2__Homo_sapiens__XP_011531370
augcaagugcagugccagcagagccccguccuggccggcuccgcuacccucguugcccugggggcgcuugcucuguacguggccaagccuucuggauauggcaaacacacagagagccucaagccggccgcuacgagacugcccgcccgggcugccugguuccuucaggaacugccuuccuuugcggugcccgccgggauccucgcucgccaaccucugucucuguucggacccccuggcaccguccuccuggggcuguuuugucuucauuacuuccacagaacauuuguguauagccuccugaaccggggacgcccguaccccgccauucuuauccugagaggcaccgcuuucugcacaggcaaugggguucuccagggauauuaccugauuuauugugccgaguacccugacggcugguacaccgauauccgguuuucccuggcgugccuccccgugguccugcuuuucauuacaucuuggcugcaggacguggauuguagcucccgccauuauaucuggcagagcagacaagaggaacggcgcucuagagggaccggacucgccugcacguuuuaccagaaauccaagcgguucccucgcaaaagccccaaccaggacuuuacccugcaccuuaucggcgggacaucuuccugugauccgcugagccagugcaaucucuguucuggaggcuggcaaaagaagagaggcuggaaccagcugcugcgguaugaaaccuccauuuga

SEQ ID NO: 76244 - RNA, 957 nt, Artificial Sequence
  derived and/or modified sequence opt5 from SRD5A3__Homo_sapiens__NP_078868
auggcccccugggcugaggccgaacacagcgcgcugaacccucucagagcuguguggcugacccuuacagccgccuuccugcucacgcugcuucugcagcuccugccgcccggccugcucccugggugcgcuaucuuucaagaccugauucgguacggaaaaaccaaauguggcgagcccucccgcccugccgcuugcagagccuucgauguccccaagcgguauuuuucucauuucuacaucauuagcguucuuuggaauggguuucugcucuggugucugacacagucccuuuuccugggagcgccuuuuccgucuuggcuccacggccugcugcgcauccucggggccgcucaguuccagggaggcgaacuggcccuuagcgcuuuucuggugcucguguuccuguggcuucauucccugagacggcucuuugagugccuguaugucucuguguucagcaacguuaugauucacgugguccaauacuguuuuggccugguguauuacguucucguggggcugaccguccuuucccaggugcccauggacggacgcaaugccuauaucacaggcaaaaaccugcucaugcaggcgagaugguuccauauccuggggaugaugauguucauuuggagcucugcccaccaguacaagugccacgugauccuuggaaaucugcggaaaaacaaggcuggcgucguuauucauuguaaucaccgcaucccuuuuggggauugguucgaauacguguccagccccaacuaucucgccgagcugaugauuuacgugucuauggcugucaccuuuggauuccauaaucugacaugguggcucgugguuaccaacguguuuuucaaucaagcccuguccgccuuucuuagccaccaguucuauaagucuaaauuugucuccuacccuaagcacagaaaggcuuuccugcccuuucucuucuga

SEQ ID NO: 76245 - RNA, 3534 nt, Artificial Sequence
  derived and/or modified sequence opt5 from SREBF1__Homo_sapiens__NP_001005291
auggacgagcccccuuucagcgaagccgcucuggagcaggcccucggcgaaccgugcgaucuggacgcggcucuccugaccgauaucgagggggaagugggagccggcagagggcgggccaacggacucgacgcuccccgcgccggcgcugauagaggggccauggacuguacauuugaggauaugcugcaacuuauuaauaaccaggacuccgauuucccuggacuguuugaucccccuuacgcgggcucuggcgccgggggaacggaccccgcuagcccugacaccuccucuccgggcagccucucucccccucccgccacacuguccagcucccuggaggcuuuccucagcgggccucaggccgcgcccucuccgcuguccccuccccagccugcccccacaccccuuaagauguauccuagcaugccggcuuuuucucccggaccuggcaucaaagaagaguccgucccccugagcauucuccaaacaccuacaccccagccgcugccuggggcccuucugccccagucuuucccugcucccgccccuccccaguuuuccagcaccccgguucucggauacccuuccccgcccggcggcuucucuaccgggagcccuccgggaaauacgcaacagccccugccuggccugccccucgccuccccucccggggugccucccgugagccugcacacccagguccagucugugguuccgcaacagcuucugacagugaccgcugcgccuacagccgcucccgucaccacgacagugaccucccagauccaacagguuccugugcuccugcagccccauuuuauuaaggccgauagccuucugcucacagccaugaaaaccgacggagcuaccgucaaggccgcgggccugucuccgcuggugagcgggacaacggugcagaccggaccucuccccacacuggucuccggcggcaccauccuugcuacaguuccucuggugguggacgccgaaaaacuccccaucaaccggcuggccgcugggucuaaggcccccgcuagcgcccaaucccgcggagagaagagaaccgcgcacaaugccauugagaaacgguaucgcagcucuaucaacgauaagauuaucgaacuuaaagaccuggucgugggcacggaggcuaagcucaauaaauccgccguucugagaaaggcuauugauuacauccgguuccugcagcauagcaaccagaagcucaaacaggaaaaucugucucuucgcacagccgugcacaaguccaaaagccugaaggaccucgucuccgcgugcgggucuggaggcaacaccgaugugcugauggaggggguuaaaaccgaaguggaggacacacugaccccuccgcccagcgaugccggcuccccuuuucaaucuagcccccuuucccucggaagcagaggcucuggguccggaggcagcgggucugacuccgagccugauagccccgucuucgaagacucuaaggcuaaaccugagcagcggccgagccugcauucccgcggaaugcuggauagaagccggcucgcccuguguacacuuguguuucugugccucucuuguaauccccuggcuucccugcuuggcgcccgcgggcucccuagccccuccgacacgaccucugucuaucacagcccuggcagaaacgugcugggaacagaaucccgggacggccccgggugggcccaguggcugcucccgccuguuguguggcugcuuaauggacugcucguccuggugucucugguucuucucuucguguacggcgagcccgucaccagaccccacagcgggccugcuguguauuucuggcgccaucggaagcaggcggaucuggaccuggccagaggagauuuugcucaagccgcccagcagcucuggcuggcucugcgcgcccugggccggccccucccuacaucccaccuggaccuggcgugcucucuucucuggaaccugauuagacaucugcuccagcgccuguggguggggcgguggcuugcuggcagagccggaggccugcaacaggauugugcccuccgcguugacgcuagcgccuccgcgcgggaugcugcccuggucuaccacaagcugcaccagcuucauaccauggggaaacacacgggaggccaucugaccgccacaaaucucgcucugagcgcccucaaccuggcugaaugcgccggggacgcggugucuguggccacccuugcugagaucuacgucgccgcugcccugagagugaagacaucccucccgcgcgcccugcacuuccugacccgguuuuuccuuagcucugcuagacaagcgugucuggcccaguccggaagcguucccccugcuaugcaguggcucugccaucccgugggccaccgguuuuucgucgauggggacuggucugugcuguccacgccuugggagagccucuauucccuggccggcaaccccguugauccgcuugcccaggugacacaacuguuucgcgaacaccuccuggagagagcucugaauugugucacccagccuaaccccagcccuggaucugccgacggcgauaaagaguucagcgacgcgcuuggguaccugcagcuccuuaauuccugcucugacgcugccggagcccccgcuuauagcuuuuccaucucuagcuccauggccacaaccaccggcguggauccuguugcgaaguggugggcuucucucacagccguggucauucauuggcugcggagagacgaagaagccgcugagcgccuuugcccccugguggagcaucugccgcgggugcuccaggaaagcgagagaccucugccccgcgccgcccuucacuccuucaaagcugcgagagcccugcucgggugugcuaaggccgaaagcggacccgcuucucugacgaucugcgagaaggccuccggcuaccuccaagauagccuggccaccaccccugcuucuuccagcauugacaaagcgguccagcuuuuucugugugaucugcuccugguugugcggaccucccuuuggcgccagcagcaaccgcccgccccugcucccgccgcccagggcacaucuagcagaccucaggcuuccgcccuggagcuccggggguuccaacgcgaccugagcucucucagacggcuggcgcaguccuuucgccccgcuaugagacggguguuccuucacgaagccaccgcccgccugauggcuggagccagcccuacgagaacacaccagcugcucgaucggucucugagacgccgggcgggccccgggggaaagggcggggccgucgcugagcuugaacccagaccuacccgccgggagcaugccgaagcucugcuccuggccagcugcuaucuucccccuggauuccuguccgcucccggccagagagugggcaugcuugccgaggcggcccgcacccuggagaaacugggggaccggagacuccugcacgauugucaacagaugcuuaugcgccugggaggcgggacaaccguuacaucuagcuga

SEQ ID NO: 76246 - RNA, 3426 nt, Artificial Sequence
  derived and/or modified sequence opt5 from SREBF2__Homo_sapiens__NP_004590
auggacgauagcggcgagcugggaggacucgaaaccauggagacacugacggaacuuggcgacgagcugacccucggggauaucgacgaaaugcugcaguucguguccaaccaagucggagaguuucccgaucuuuucucugagcagcugugcagcuccuuuccuggcucugggggaagcggcuccucuagcggcuccagcgggucuuccagcuccuccagcaauggaagagggucuuccagcggggccguugacccguccgugcagcggucuuucacacaggugacccuccccagcuuuuccccuagcgcugccucuccccaagcgccuacacugcaggucaaggugucccccaccagcguuccuacaaccccgcgcgcuacgcccauucugcagccuagaccccagccucaaccccagccgcagacccagcuccaacagcagacagugaugaucaccccuacauucucuaccacgccccaaacacggauuauccagcagccucugauuuaccagaacgccgccaccagcuuucaaguccuucagccccaggugcagucccugguuacaucuagccaagugcagcccgucaccauccagcagcaagugcagaccgugcaggcucagcgcguccucacacaaacggccaauggaacccugcagacacuugcuccugccaccguucagacaguggcggccccgcaagugcagcagguccccgugcugguucagccucaaaucauuaaaaccgauucccucgugcugacgacacugaagaccgacggcagccccgucauggcugccgugcagaacccugcucucaccgcccugacaacccccauccagacagcggcccuucagguuccgacgcugguggggucuuccggaaccauucucacaaccaugccugucaugaugggccaagaaaaagugcccaucaagcaggucccuggcggggugaaacagcuggagcccccuaaggaaggagagagacggacaacccacaauauuaucgagaagcgcuauagaagcucuauuaacgauaaaaucaucgaacuuaaggaccugguuaugggcacggaugcuaaaaugcacaaguccggggugcuccggaaagccauugacuacaucaaguaucugcagcaagucaaucacaagcugcgccaggagaacauggugcucaaacuggcuaaucagaagaacaaacuucugaagggaauugaucucggcagccugguugacaaugaaguggaccuuaaaaucgaggauuucaaccaaaauguccugcucaugucucccccggccucugacagcgggucccaggccggauuuucuccuuacagcauugauuccgaacccggcagcccccugcuggacgaugcuaaggugaaagacgagccugauucuccgcccguggcgcucggcaugguugacagaucccggauccugcuuuguguccugaccuuccucugccugagcuuuaacccucugacaucucuucuccaguggggcggagcccaugauuccgaccagcacccccauagcggcucugggcgcagcgugcuguccuucgagagcggaucuggcgggugguuugauuggaugaugccuacccugcuccuguggcuugugaauggcgucaucgugcuguccguuuucgugaagcuccugguccacggagaacccgugauuagaccucacagccgguccucuguuacauucuggcgccauagaaagcaagcugaccuggaccuugcccggggcgauuuugccgcugccgcggggaaccuccagaccugucuggcugugcuggggagagcccuccccacgagccgccuggaccuugccugcucccugucuuggaacgucauccgguauagccuccagaaacugagacuggugcgcuggcuucucaagaaaguuuuccagugucggagagcuacaccggccaccgaggcuggcuuugaagaugaggccaagacauccgcgcgcgacgccgcucuggccuaccaccggcugcaucaacuccacauuaccgggaaacugccugcuggaucugccugcagcgaugugcacauggcgcuuugugccgucaaucuggcugaaugcgccgaggagaagauucccccuuccacccucguggaaauucaucugacagcugccaugggccugaagacgagaugugggggcaaacuuggauuccucgccagcuauuuucugucucgcgcucagucccugugcggccccgagcacagcgcggugccggacucucuccgguggcugugucauccucuugggcagaaguucuuuauggaaagauccuggagcgucaaaucugccgcuaaggagucccuguacugcgcccagcgcaaccccgccgauccuaucgcucaaguucaccaggccuucugcaaaaaucuccuggaacgggcgaucgagagccuggugaagccccaggcuaagaaaaaggccggagaccaggaggaagaguccugugaauuuagcucugcccuugaguaccugaaacuccugcauagcuucguggauuccgucggcgugaugucucccccucucagcagauccucuguucuuaagagcgcucuggggccggacauuaucugccggugguggaccuccgccauuacaguggcgaucucuuggcugcaaggagaugacgcugccguccgcagccacuuuaccaaaguggagagaauccccaaggcccucgaaguuacagaguccccucuggugaaggcuaucuuccacgccugucgggcuaugcaugccagccugcccggcaaagcggaugggcagcagucuuccuuuugccacugugaaagagccagcggccaucuuuggucuucccugaacgucagcggagcuaccuccgacccugcccucaaucacgugguucaacugcucacgugcgaccugcuucugucucuccgcacagcucuguggcagaagcaggccagcgccucccaggcugugggcgagaccuaucacgcgagcggggccgaacuggcuggauuccaacgggaucuuggcucucugagacgccucgcccauuccuucagacccgccuaccggaaagucuuucugcacgaggcuaccgugcgccucauggccggggcgagcccuacaagaacccaucagcugcuugagcacucucugcggcgcagaacaacgcagagcaccaagcauggagaaguggacgcuuggccgggccagcgggagcgcgccacagccauucugcucgcuuguagacaucugccccuuuccuuccugucuagcccugggcaacgggccguccuccuggcggaagcugcccgcacccucgagaaaguuggcgauagacgguccugcaacgacugucagcagaugaucgugaagcugggaggcgggacagccaucgcugccucuuga

SEQ ID NO: 76247 - RNA, 1875 nt, Artificial Sequence
  derived and/or modified sequence opt5 from SREK1__Homo_sapiens__NP_001070667
augaacagcggcgggggauucggccuggggcucggauuuggccugacccccacauccgugauccaggucacgaaucuuucuagcgccguuaccuccgagcaaaugagaacacuguucucuuuucucggggaaauugaggaacugcggcuuuacccuccggacaacgcuccccuggccuucagcuccaaggugugcuaugugaaauuucgcgauccuucuagcgucggaguggcgcagcaccucaccaauacaguuuucaucgacagagcucugauugugguccccugugccgagggcaagaucccugaagaguccaaagcccugagccuccuggcucccgccccuaccaugacaucucuuaugccgggcgcugggcugcuccccauuccuacccccaacccucugacgacccuuggagugucccugagcucucucggcgccauccccgcggccgcucuggauccgaauaucgccacacugggggagauuccucagcccccucucaugggaaacguugaccccuccaagaucgaugaaauucggcgcaccguguacgucggcaaucugaacagccagacaaccacggcugaccaacuucuggaguuuuucaaacaggugggggaagugaaguuugucagaauggccggagaugagacacagcccacccgguucgcguuuguugaguucgccgaccagaauagcgugccucgcgcucucgccuuuaacggcgugauguucggcgauagaccgcugaagaucaaucauuccaacaaugcuauugucaaacccccugaaaugacaccccaagccgccgcuaaggagcuugaagaggugaugaaacggguucgcgaagcgcagagcuucaucuccgccgcuauugagccugagucugggaagucuaacgaaagaaaaggaggccggucccgcagccacaccagaucuaagucccggagcucuagcaagucccauucucgcagaaaacggagccaguccaagcacagaagccgcucucauaaucgguccagaagccgccagaaagaccggagacgcucuaagagcccccacaaaaagcggagcaaauccagagagcgccggaagucuagaagccgcucccacucucgggauaagagaaaagacacccgggaaaagaucaaagagaaggaacgcgugaaagagaaggauagagagaaggaacgggagagagaaaaagagcgcgaaaaggagaaagagcgggggaagaacaaagacagagacaaggaacgcgagaaggauagagaaaaagacaaggagaaagaucgggagcgcgaaagagagaaggaacaugagaaagaccgggauaaggaaaaggagaaagagcaagacaaggaaaaagagcgcgaaaaggauagaagcaaagagaucgacgaaaagcggaaaaaggauaagaaaucccgcacaccgccuagaagcuauaacgccucucggcgcuccagauccucuucccgggagagacgccggagacgcagccggucuagcuccagaagcccccgcacgucuaagaccauuaaacggaaguccagcagauccccuucuccccgcagccggaauaaaaaggacaagaaaagagagaaggaacgggaucacaucuccgagcgcagagaacgggagcgcucuacaagcaugagaaaauccucuaacgaccgggacggaaaggaaaaacuggagaagaauagcaccucccucaaggagaaagaacauaacaaggagccugauagcucugucuccaaagaaguggacgauaaggacgcccccagaacagaggagaauaaaauucagcacaacggcaauugccagcugaacgaagagaaucugagcaccaagacggaagcuguuuga

SEQ ID NO: 76248 - RNA, 468 nt, Artificial Sequence
  derived and/or modified sequence opt5 from SREK1IP1__Homo_sapiens__NP_776190
auggccgugcccggcugcaacaaggacagcgucagagcuggguguaaaaagugcggauacccuggccaccugaccuucgagugucggaauuuucuccgcguugauccgaaaagagacaucgugcuggauguguccucuacaagcuccgaagacucugaugaggaaaacgaggaacuuaauaagcugcaggcccuccaagagaaacggauuaacgaggaagaggaaaagaagaaagaaaagagcaaagagaagaucaaacugaagaagaaacgcaagagauccuauucuagcuccagcacggaggaggacaccucuaaacagaagaaacagaaguaccagaaaaaggaaaagaaaaaggagaaaaaguccaaaagcaagaaggggaaacaucacaagaaagaaaagaaaaagcggaagaaagagaagcauucuuccacacccaauagcucugaguucucccgcaaauga

SEQ ID NO: 76249 - RNA, 1290 nt, Artificial Sequence
  derived and/or modified sequence opt5 from SRFBP1__Homo_sapiens__NP_689759
auggcccagcccggcacccugaaccucaauaacgagguggucaagaugagaaaagaaguuaagcggauccgcgugcuggugauuagaaaacuuguccggagcguggggcgccugaaguccaaaaagggaacagaggacgcucuccugaagaaucaaagacgggcccagcgccuucuggaagagauccacgcgaugaaagaacucaagccugauauuguuacgaaaucugcucugggcgacgauaucaacuucgagaagauuuuuaaaaagccggacagcaccgccacagagagagccaucgcucggcuggccgugcauccccuccugaagaaaaagaucgauguccuuaaagcugccgugcaggcguucaaggaagcccgccagaauguugcugagguggaauccucuaaaaacgccagcgaggacaaucacuccgagaacacccuguacucuaaugauaacgggagcaaucuccaaagagaagcuacagucauuuccgagcagaaggugaaagaaaccaagauccuggccaagaaaccuauucauaacagcaaggagaaaaucgcgaagauggaacacggacccaaagccgugacaauugcuaauucuccuuccaagcccagcgagaaggacucugucguuucccuugagagccagaaaaccccugccgauccgaagcugaaaacgcucucucagaccaagaaaaacaagggcuccgacagcucccugucugggaauagcgauggaggcgaagaguuuugcgaagaggaaaaggaguauuucgacgauuccacagaggaacgguuuuacaaacaaagcucuauguccgaggacagcgacucuggcgaugacuucuuuaucgggaaggugcgcagaacccggaaaaaggaaagcuccugucauucuagcgugaaagagcagaagccccuggaaaaggucuuccucaaagaggauacaggagagacccacggcgacacgcgcaacgauaagauuaaaccuuccacagaaaccagaaagcuggagagcguguuuuuccacucucuuuccgggagcaaaucuucccggagaaacuuuaaggaacaggcucccaaaacacgcagccuggacuucccucagaaugagccccaaaucaagaaccaguuuaauaagaaacucuccggacggcuggagaacaccaagcagcaacuucagcugccgcuccauccuucuugggaagccagcagacgccggaaagagcagcaguccaauaucgccguuuuccaaggcaagaaaauuaccuucgaugacuga

SEQ ID NO: 76250 - RNA, 915 nt, Artificial Sequence
  derived and/or modified sequence opt5 from SRF__Homo_sapiens__NP_001278930
augaucaccagcgagacaggcaaggcccugauucagacgugccucaacucccccgacucuccuccgagaagcgaucccaccacagaccaacggauguccgcuaccggguucgaagagacagaucugaccuaccaggugucugaaagcgacuccucuggagagacaaaagauacccuuaagccugccuuuacggucaccaaucugcccggcacaaccagcacaauccagaccgcgccuuccacgagcacaaccaugcagguuucuuccgggcccagcuucccuauuacaaacuaucucgcuccggugucugccuccgugagccccucugccgucuccagcgcuaauggaaccgugcugaaauccaccggcucugggccuguuagcuccggaggccuuaugcaacugcccacgagcuuuacacucaugccuggcggggccguggcucagcagguccccgugcaggccauccaaguucaccaggcgccgcagcaggccucuccuucccgcgacagcucuaccgaucugacacaaaccagcuccucuggaacagugacccugcccgcuacgauuaugacaagcuccgucccuaccaccgugggcgggcauaugauguaccccagcccccacgccgugauguaugcuccuacaucuggacucggcgacgggucccugaccguccuuaacgccuucagccaggcgccgucuacaaugcagguuucccauagccaagugcaggaacccggaggcgugccucaggucuuucugacggccuccucuggcaccgugcagauccccguuagcgcugugcaacuccaccagauggccgucaucgggcagcaggcuggauccucuagcaaucugacagagcuucaagugguuaaccuggauaccgcccauuccacaaagagcgaguga

SEQ ID NO: 76251 - RNA, 3258 nt, Artificial Sequence
  derived and/or modified sequence opt5 from SRGAP1__Homo_sapiens__NP_065813
augagcacccccuccagauucaagaaagacaaggagaucauugccgaauacgagucucaggugaaagaaauccgggcucaacuggucgagcagcagaagugccucgaacagcaaacagagaugcgcguucagcugcuucaggaucugcaggacuuuuucagaaagaaggccgagauugaaacggaguauagccggaaccucgaaaagcuggcggagcgcuuuauggcuaaaaccagauccacaaaggaucaccaacaguacaaaaaggaccagaaucuucugucuccugugaacuguugguaucuccugcugaaucaggugcggcgcgagagcaaagaucaugccacccucuccgacaucuaccugaacaaugucauuaugagauucaugcaaaucucugaagauagcacacggauguuuaagaaguccaaagagaucgccuuccagcuucacgaagaccugaugaaggugcucaacgagcuguauaccguuaugaaaacauaccauauguaucacgcugaaagcauuucugccgaguccaaacuuaaagaggcugaaaagcaggaggaaaaacaaaucggccgcagcggggauccgguguuucauauuagacuggaggaacggcaccagcgcagaucuuccgucaagaagaucgagaaaaugaaggagaaacggcaggccaaguacagcgaaaauaaacucaagucuauuaaggcgcgcaacgaguaccugcugacccucgaagccacgaaugcuuccguguucaaauauuacauccacgaccugagcgaucuuauugacugcugugaucugggauaucaugccucccucaacagagcucugcggaccuaccuuucugccgaguauaaucuggaaacaagcagacacgagggccucgacaucaucgagaacgcgguugacaaucuggaaccccgcuccgauaagcagcgguuuauggagauguacccugccgcuuucugucccccuaugaaauuugaguuccaaagccauaugggggacgaagugugccaggucucugcccagcagcccgugcaagcugagcugaugcucagauaucagcagcugcagucccgccuugccacccugaagauugaaaacgaggaagugaaaaagacaaccgaggccacgcuccaaacaauccaggauauggucaccauugaagacuacgauguuagcgagugcuuucagcacucucggagcacagaguccgugaagucuaccgugagcgaaaccuaccuguccaaaccuagcaucgcuaagagacgcgcgaaucagcaagagacagaacaguucuauuucaugaaacuucgggaguaccuggaaggaucuaaccucauuacgaagcugcaggccaaacacgaccugcuccaaagaacccugggcgaggggcaucgcgcugaguauaugacaacccggccgcccaacgucccucccaagccucagaagcacagaaaaucccgcccccggagccaguacaauacaaaacuuuuuaacggagaucuggaaaccuucgugaaggacucuggccagguuaucccgcucaucguggaguccuguauuagauuuaucaaucuguauggccugcaacaucaggggauuuuccgggucagcggaucccagguggaaguuaacgauaucaaaaauucuuuugagcgcggcgaaaacccucuugccgacgaucagagcaaucacgacauuaacuccguggccgggguccucaagcuguacuucagaggacuggagaauccccucuuuccuaaggagcgguucaacgaccugaucucuugcaucagaauugauaaucuuuaugaacgcgcucugcauauccggaaacuccugcugacgcuucccagaagcgugcucauugucaugcgcuaccuguuugccuuccugaaccaccucucccaauacagcgacgagaauaugauggaucccuauaaccuggcgaucuguuuuggcccuacacuuaugccggugcccgaaauucaggaccagguuucuugccaggcucacgugaaugagaucauuaagaccaucaucauucaucacgagaccaucuucccugaugccaaggaacuggacgggcccgucuacgagaaauguauggccggagaugacuauugcgauuccccuuacagcgaacauggcacacucgaggaaguggaccaagaugcuggcaccgagccccacacaucugaggacgaaugcgagccgauugaagccaucgcuaaguuugauuauguugggagauccgcccgggagcugagcuucaaaaagggagcgucucugcuucucuaccaccgcgccagcgaagacuggugggagggcagacauaacgggauugacggacuggugccucaccaguauaucgucgugcaggauauggacgauacguucuccgacacccugagccaaaaagcugauucugaggccuccagcggccccgugacagaagacaaguccucuagcaaggauaugaacuccccuaccgaccggcaucccgauggguaccucgcucgccagagaaaacggggagagccucccccgccuguucgcagacccggccggacaucugacggccacuguccccugcauccuccgcacgcccuuagcaauuccucugucgaucuggggagccccucccucgcgagccacccucgcggacugcugcagaacagaggccuuaauaacgacucucccgaacggagacgccggccugggcauggaucccucaccaauaucagcagacacgauucucugaagaaaauugacuccccucccauccgccggagcacgucuuccggccaguacaccggguuuaacgaccauaagccccuggauccggagacaauugcccaagacaucgaagagaccaugaauacagcucucaacgagcugagagaacuugagcgccagagcaccgccaaacacgcuccugauguggugcuggacacgcucgaacaggucaaaaauucccccaccccugccacaagcacagagucucugagcccccugcauaacguggcccuucgguccucugagccgcagauuagacgcagcaccuccucuagcuccgauaccaugucuacauucaagccuaugguugcuccccggaugggcgugcaacugaagccucccgcgcucagacccaagccugccguccugccgaaaacgaaucccaccaucggaccugcucccccuccccagggcccuacagacaagagcugcaccauguga

SEQ ID NO: 76252 - RNA, 2370 nt, Artificial Sequence
  derived and/or modified sequence opt5 from SRGAP2__Homo_sapiens__NP_001287881
augaccagccccgccaaguucaaaaaggacaaagagaucauugcugaauacgauacacaggugaaggagaucagagcccaacugacggaacagaugaaaugccucgaccagcagugugagcugcggguccaacuucugcaggaucuccaggacuuuuuccgcaagaaggcggaaauugagauggauuauuccagaaaccuggagaaacuugcugaacgguuucuggccaagacccgcucuacaaaagaccagcaauucaagaaagaucagaauguucucagcccugugaacugcuggaaucugcugcucaaccaggugaagagagagucccgggaccacaccacacugucugauaucuaccuuaauaacauuaucccgcgcuuuguccaggugagcgaagacuccggcagacuguucaagaaaucuaaggagguugggcaacagcuccaggaugaccugaugaaagugcuuaaugagcuguauagcgucaugaagaccuaccauauguauaacgccgauuccaucagcgcucaaucuaaacucaaggaagccgagaaacaggaagagaagcagauuggaaaguccgugaaacaggaagaccggcaaacaccccgcagcccugacucuaccgcuaauguuagaaucgaggagaagcacgugcggcgcuccagcgucaaaaagauugagaaaaugaaggaaaagagacaggccaaauacacggaaaacaagcugaaagcgaucaaggcccggaaugaguaucugcucgcucuggaagccaccaacgcuucuguguuuaaauacuacauucaugaucuuuccgaccugaucgauuguugcgaccucggcuaucacgccagccugaaucgcgcgcuuagaacauuccuguccgccgagcucaaccuggagcagucuaagcaugaagggcuggaugcuauugagaaugccguggaaaaccucgacgcuaccagcgauaagcagcggcugauggagauguacaacaaugucuuuugucccccuaugaaauucgaauuucaaccccacaugggagacauggccucccagcuuugcgcccagcagccuguucaaagcgagcuggugcagagaugucagcagcuccaaucucgccuguccacacuuaagaucgagaacgaagaggugaaaaagaccauggaagcuacgcugcagacaauccaggauauugucaccguggaggacuucgauguuagcgacugcuuucaauauucuaauagcauggaguccgugaaaucuacagucagcgaaaccuucauguccaagccgagcaucgcgaagcggagagccaaccagcaggagaccgaacaguucuacuuuacaaaaaugaaggaguaucucgaaggccgcaaucugauuacgaaacugcaagcuaagcacgaccuccugcagaaaacccuuggggagucucagcggacagauuguucccuggccagacgcagcucuaccgugcggaagcaggacuccagccaagccaucccccucguuguggaguccugcauuagauucaucucucgccauggacugcagcacgaaggcaucuuucgggucagcggcucccagguggaggucaacgauauuaaaaaugcuuucgaaagaggggaggacccucuggccggagaucagaacgaccaugauauggacucuaucgcgggcgugcuuaagcucuacuuucgcgggcuggaacacccccuguucccuaaggauauuuuucacgaccucauggcuuguguuacaauggauaaucugcaagagcgggcccuucauaucagaaaagugcugcucguccugcccaagaccacgcugauuaucaugcgguaucuuuucgccuuucucaaccaccugagccaguucuccgaggaaaauaugauggacccguacaaccuggcuaucugcuuuggaccuagccucaugucugugcccgagggccaugaucagguuuccugccaagcccacgugaaugaacugauuaaaacaaucauuauccagcaugagaacauuuucccuagcccccgcgaacuugaggggcccgucuacucuagaggaggcuccauggaggacuauugugacagcccucacggcgaaaccaccucuguggaggauagcacacaggacgugaccgcugaacaccauacauccgaugacgagugcgagccgaucgaagccauugcgaaguuugauuacguugggcggacggccagagagcugagcuucaaaaagggagcuucucuccugcuguaucagcgcgccuccgacgauuggugggaaggccggcacaaugggaucgacggacuuaucccccaucaauacauugucgugcaggauacccucaucagcuga

SEQ ID NO: 76253 - RNA, 3228 nt, Artificial Sequence
  derived and/or modified sequence opt5 from SRGAP3__Homo_sapiens__NP_001028289
augagcucccagaccaaguucaaaaaggacaaagagaucauugccgaauacgaggcucaaaucaaggaaauuagaacacagcugguggagcaguuuaaaugccucgaacagcaaucugagagccggcugcagcuucugcaggaucuccaggaguucuuucgcagaaaggccgaaaucgagcuggaauauucccggucucuugagaagcuggcggagcgcuucagcuccaaaauuagaucuagccgggaacaccaauuuaagaaagaccaguaccuccugucccccgucaacuguugguaucugguucuccaucagacgcgcagagagagccgggaucacgcuacccugaaugacaucuucaugaacaaugugaucgugcgccuuucucagauuuccgaagaugucaucagacuguuuaagaaaagcaaggagauuggccuccaaaugcaugaagaacugcuuaaggugacaaacgagcuguacaccguuaugaaaacauaucacauguaccaugccgaaucuaucuccgccgagagcaagcucaaagaagcugagaagcaggaagagaaacaguucaauaagucuggggaccuguccaugaaccugcuccggcacgaggaucgcccucaaagacggagcuccgugaaaaagauugaaaagaugaaagagaagcgccaggccaaauauucugaaaauaagcugaaaugcaccaaggcuagaaacgacuaccuucugaaucucgccgcgacaaacgccgcuaucagcaaguacuauauucacgaugucuccgaccugaucgauuguugcgaccuuggauuucaugccagccuggcucggaccuucagaacguaccucucugccgaguauaaucuggaaaccucccgccacgagggccuggaugugaucgagaacgcgguugacaaucucgacagccggucugauaaacauacagugauggacauguguaaccaggucuuuugcccgccccugaaguucgaauuucagccucacaugggggaugaggugugucaagugagcgcccagcagcccguccagaccgaacuucugaugagauaccaccaacuccagucccgccuggcuacacuuaaaauugagaaugaggaaguucggaagacccuggacgccacgaugcagacacuccaggauaugcugaccguggaggacuucgaugugucugacgcuuuccaacauagcagauccacagaaagcgucaaaucugccgccuccgagaccuauaugagcaagaucaacauugcuaagcgccgggcgaaccagcaggaaaccgagauguuuuacuucacaaaauuuaaggaguaugugaauggaucuaaccugaucacgaaacuccaggccaagcacgaucugcuuaaacaaacccugggcgaaggggagagagcugaaugcggaacaacccgcggccggagaaaugcccgcacacggaaccaggacuccggccaggccauuccucucguuguggagagcuguaucagauacaucaaucuguacgggcugcaacagcagggaauuuuccggguccccggcucccagguggaaguuaacgauaucaaaaauucuuuugagcgcggggaggacccucuuguggacgaucaaaacgaaagagacauuaauagcgucgcuggagugcucaagcuguauuuccggggccuggagaacccgcucuuucccaaagaaagauuccaggaucugaucuccaccauuaaacuugagaauccugccgaacgcguccaucagauccagcaaauccuggugacgcucccccggguugugauugucgugaugagauaccuguuugcguuccugaaccaccuuucucaguauagcgacgagaauaugauggauccuuacaaccucgcuaucugcuuugggcccacacugaugcauauuccggacggacaggauccuguuuccugucaggcccacaucaaugaggugauuaagaccaucauuauccaccaugaagccaucuuccccagcccucgcgagcuggaaggccccgucuaugagaagugcauggcuggcggggaggaauacugcgacucuccccacuccgagccuggagccauugaugaaguggaccaugauaacggcaccgagccgcacacaagcgacgaagagguggagcaaaucgaagcuauugccaaauuugauuauauggggagaucuccccgggagcucuccuucaagaaaggagcgagccugcuucuguaccaccgcgccucugaagacuggugggagggcagacauaacgggguugacggacucaucccucaccaguacauugucgugcaggauauggacgaugcuuucagcgacucccugagccaaaaggccgauucugaggcuuccagcggcccccugcuugacgauaaggccuccucuaaaaaugaccuccagagcccuaccgagcauaucuccgauuauggcuuugggggagugaugggccggguccgccugagaucugacggggcggccaucccccggcgcagaagcggaggcgauacacacuccccgccucgggggcugggccccucuauugacacgccuccccgcgcugccgcuuguccuagcuccccgcauaagaucccccucaccagaggacggauugagagcccugaaaagagacgcauggccacauucggcucugccggguccaucaacuaccccgauaagaaagcucugagcgagggacacucuaugcggucuaccugcggcagcacaagacacucuucccuuggggaccauaagagccuggaagcggaggcccucgcugaagacauugagaagaccauguccacggcccugcacgagcugcgcgaacuugagcggcagaauaccgugaaacaggcccccgauguugugcucgacacacuggaaccucugaagaacccgcccggaccugucagcucugagcccgcuagcccucuccauaccaucgugaucagagaucccgacgccgcgaugcgccgguccucuagcuccucuacagagaugaugaccacguuuaaaccugcucugagcgccagacuugccggcgcucaacugcggcccccgccuaugcgccccguuagaccugugguccagcaccgguccucuagcuccagcuccuccggggugggcagccccgccguuacaccgaccgaaaagauguucccuaauucuuccgcggauaaaagcggaacaauguga

SEQ ID NO: 76254 - RNA, 477 nt, Artificial Sequence
  derived and/or modified sequence opt5 from SRGN__Homo_sapiens__NP_002718
augaugcagaagcugcucaaaugcagcagacuggugcuugcccuggcucucauccugguccuugaguccucuguucaaggcuaccccacccggcgcgccagauaucagugggugcgguguaacccugacagcaauuccgcgaacugccuggaagagaaggggccgauguucgaacuccugcccggagagucuaauaaaauuccucgccugagaacagaucucuuucccaagacgcggauccaggaccugaaccgcauuuucccucuuagcgaagauuacuccggcucuggguuuggaagcggcuccgggagcggaucuggcuccggcagcggguuccugaccgagauggagcaggacuaucaacucguggaugaaucugacgcuuuucacgauaaucugagaucccuugaccggaaccugcccagcgauucucaggaccucggacagcauggccuggaggaagauuucaugcuguga

SEQ ID NO: 76255 - RNA, 543 nt, Artificial Sequence
  derived and/or modified sequence opt5 from SRI__Homo_sapiens__NP_001243821
augcaguacggcggggcccccggaggcccugcuuucccggggcaaacccaggacccccuguauggauacuuugccgcgguggcuggccaggaugggcagaucgacgccgaugagcuccaaagaugccugacacagagcggaauugccggcggcuauaagccuuucaaccuugaaacgugucggcugauggucuccaugcucgaccgcgauaugucugggaccaugggauuuaaugaguucaaagaacugugggcuguucuuaacggcuggagacagcacuuuaucagcuucgacacagaucgguccgggaccguggacccccaggagcugcaaaaggcccucacaaccaugggauuucgccugucuccucaggcugugaauagcauugccaaaagauacuccacaaacggcaagaucaccuucgaugacuauauugcgugcugugucaaacugcgggcccucacggauucuuuucgcagacgggacaccgcucagcagggggugguuaauuuccccuacgaugacgugagccugcgcaacuga

SEQ ID NO: 76256 - RNA, 1422 nt, Artificial Sequence
  derived and/or modified sequence opt5 from SRL__Homo_sapiens__NP_001092284
augagagcccuggugcuccugggcugccuucuggcuagccuccuguucuccgggcaggccgaggaaaccgaggacgcgaacgaagaggcuccccuucgggaucgcucucacaucgaaaagacacugaugcucaaugaggacaaaccuagcgaugacuacuccgccguccugcaaagacugcggaagauuuaucauucuagcaucaaaccgcucgagcaguccuacaaguauaacgaacugcgccagcacgagauuacggauggagaaaucaccucuaaacccaugguucuuuuucugggcccuuggagcguggggaaguccacaaugauuaauuaccuccugggacuugagaacaccagauaucagcuguacacaggcgccgagcccaccacaagcgaguucaccgugcucaugcaugggccuaagcugaaaacgaucgaaggaaucgucauggcugccgacucugcucgguccuuuagcccccuggaaaaguucggccaaaauuuucucgagaaacugauuggcaucgaagugccucacaaacuucuggagcgcguuaccuucguggauacaccggggauuaucgagaacagaaagcagcaggaacggggauaucccuuuaaugacgucugucagugguucauugaucgcgccgaccucaucuuugugguuuucgauccuaccaagcuggacgugggccuugagcuggaaaugcucuuuagacaacugaaggggcgggagucucagauucgcaucauccugaacaaagcggauaaucucgccacacagaugcugaugagagucuacggagcucuuuucuggucccuggcuccccucauuaacgugaccgaaccuccccggguguacgucagcucuuuuuggccgcaggaguauaagccugacacgcaucaagagcuguuccuucaggaagagaucucccugcucgaagaccugaaucagguuauugagaaccgccuggaaaauaaaaucgcuuucauuagacaacacgccauccgggugagaauccacgcgcuccugguggaucgcuaccuucagacauauaaggacaaaaugaccuuuuucagcgauggcgagcuggucuuuaaggacauuguggaggaucccgacaaauucuacaucuuuaagacaauucucgccaagaccaacguuuccaaauucgaucugccuaaucgggaagccuauaaggacuuuuucgggaucaaccccauuucuagcuuuaaacugcuuucccagcagugcagcuacaugggaggcuguuuccucgagaagaucgaaagagccaucacccaagagcugcccggccugcucgggucucugggacuuggcaaaaacccuggggcucugaauugcgauaagacaggauguuccgagacgccgaagaaccgcuaucggaaacauuga

SEQ ID NO: 76257 - RNA, 1467 nt, Artificial Sequence
  derived and/or modified sequence opt5 from SRMS__Homo_sapiens__NP_543013
auggagcccuuccugagacggcgccucgccuuucugagcuucuuuugggacaagaucuggccugcuggcggggaaccggaucacggaacccccggcucccuugacccuaacacagaucccgugccuacgcugcccgccgagccuugcucuccguucccccagcucuuucuggcgcuuuacgacuucaccgcuagaugugggggagaacugagcguccggcgcggcgauagacucugcgcccuggaggaagggggaggcuauauuuuugcccggcgccuguccggccaaccuucugcugggcucguucccaucacacauguggccaaagcuagcccugagacccuguccgaccagcccugguacuucucuggagugagcagaacacaggcccagcaacuucugcucuccccgccuaaugagcccggcgcguuucugauucggccuagcgaaucuucccuugggggauauagccugucuguccgcgcccaggcuaaggugugucacuacagaguuuccauggccgcugauggcagccucuaucugcagaaagggcggcuguuccccggacucgaggaacugcuuaccuacuauaaggccaacuggaaacugauccagaauccccuccugcaaccuugcaugccgcagaaggcgccccgccaggacgugugggagagaccucauucugaguuugcccuuggccggaagcugggcgaaggguacuucggagaggucugggaaggccucuggcuggggucccugcccguggcuauuaaaguuaucaagagcgccaacaugaaacucacagaucuggcuaaggagauccagacccuuaaaggacugcgccacgaaagacucauucggcugcaugccguguguuccggcggggagccugucuacaucgugacggagcuuaugagaaagggaaaucugcaagccuuucucggcacccccgaaggccgcgcucugcggcugccgccucuccugggguucgcgugccagguggccgagggaaugucuuaucuugaggaacagagagucguucaccgcgaccuggcugcccggaacgugcucguggaugacggccuggccuguaaggucgcugauuucgggcuggccagacuucucaaagacgacauuuacagccccuccucuagcuccaagaucccugugaaauggacagcgcccgaagcugccaauuaucgcguuuuuagccaaaagucugauguguggagcuucggaguccugcugcacgagguguuuaccuacggccagugcccuuaugaggggaugacaaaccaugaaacccuccagcagauuaugcggggcuacagacugccccgcccggccgcuuguccugccgagguuuaugugcuuaugcuggaaugcuggcgguccucucccgaggaaagacccagcuucgcuacgcuccgcgagaaacugcacgccauccaucggugucacccuuga

SEQ ID NO: 76258 - RNA, 411 nt, Artificial Sequence
  derived and/or modified sequence opt5 from SRP14__Homo_sapiens__NP_003125
auggugcugcucgagagcgaacaguuccugaccgagcuuacaagacuguuucaaaagugccggacguccggcucugucuacaucacccucaaaaaguaugacgggcgcacaaaacccauuccuaagaaaggaaccguugaaggcuucgagccggccgauaacaagugucugcuuagagcuacagacgggaagaaaaagaucagcaccgugguguccucuaaagaagucaauaaguuucagauggccuacagcaaccugcuccgggcgaauauggauggacugaaaaagcgcgacaagaaaaacaagaccaaaaagacaaaagcugccgccgcugccgcugccgcggcccccgcugccgcugccacggcgccuaccacagccgcuaccacagccgcuaccgccgcccaguga

SEQ ID NO: 76259 - RNA, 333 nt, Artificial Sequence
  derived and/or modified sequence opt5 from SRP19__Homo_sapiens__NP_001191122
auggccugcgcugccgcgagaagccccgcugaccaggaucgguucaucuguauuuacccugccuaucugaacaauaagaaaaccaucgccgagggccgccggauuccgaucuccaaggcuguggaaaaccccacagccacggagauucaagacgucugcucugcuguugggcucaauguguuucuggagaaaaacaagauguacagcagagaauggaaucgcgaugugcaguauagaggacggguccgcgugcagcuuaaacaggaagacggcucccugugucucguucaauucccuucucacuacacccugagccuuacauccgggucuuga

SEQ ID NO: 76260 - RNA, 1770 nt, Artificial Sequence
  derived and/or modified sequence opt5 from SRP68__Homo_sapiens__NP_001247431
auggccgcugagaaacaggugcccggcgggggaggcgggggaggcagcgggggaggcggcggguccggaggcgggggaucuggcgggggaagaggcgccggcggggaagagaacaaggaaaaugagcggcccagcgcgggauccaaggcuaacaaagaguucggcgacucucugagccucgagauccugcaaauuaucaaggagucccagcagcagcacgggcuucgccauggagauuuucaaagauaccgguaucugcuccugguccuuauggacgccgaacgcgccuggucuuacgcuaugcagcugaaacaggaggccaauaccgaaccgagaaagcgguuccaccuccugagccgccugagaaaggcuguuaaacaugccgaggagcucgaacggcugugcgaguccaaccgcguggaugcgaagacaaaacuugaagcccaggcuuauacggccuaccugagcggcaugcucagauuugagcaccaagaauggaaggcugccauugaggcguucaauaaauguaagaccaucuaugagaagcuggccucugcuuuuacagaagaacaggccgugcuuuacaaccagcgggucgaagagauuucccccaauauccgcuauugcgcuuacaacaucggggaccagagcgccauuaaugaacugaugcaaaugagacuccggucuggaggcaccgagggccugcuggccgagaaacucgaagcucugaucacacagacccgcgcgaagcaggccgcuacaauguccgagguggaauggagagggcggaccguuccugugaaaauugauaaggucagaaucuuccuucugggacucgccgacaacgaggccgcuauugugcaagccgaaagcgaggagacgaaagaacgccuguuugagucuaugcuuuccgaaugucgggaugcgauccagguugugagagaggagcugaagcccgaccagaaacagcgcgauuacauucucgaaggcgagccugggaaggucagcaaucugcaauaucugcauuccuaccucaccuauaucaagcugucuacagcuaucaaacggaacgaaaauauggccaagggacuucagagagcccugcuccagcagcaacccgaggacgauagcaaacgcuccccucggccgcaggaccugauuagacuuuacgauaucauucugcagaaccucguggaacugcugcagcuccccggccuggaggaggacaaggcuuuccaaaaagaaaucgggcuuaagacccugguguuuaaggccuaucgcugcuucuuuauugcucagagcuacguccucguuaaaaaguggucugaggcccuggugcuguaugaccgggugcuuaaauacgcgaaugaagucaacuccgaugccggcgcuuucaagaacagccucaaagaccugccugaugugcaggagcugaucacacagguuagaucugaaaaguguagccuccaagccgcugccauccuggacgcgaaugaugcccaccagaccgagacguccucuagccaggugaaggacaacaaaccccuugucgagcgcuuugaaacauucugccuggauccuucccucgugaccaagcaagcuaaucugguucacuuucccccgggauuccagccuauucccuguaaaccucuguucuuugaccuugcccucaaccauguggcuuucccuccccuggaggauaagcuggaacagaaaacaaagagcggccucaccggguacaucaagggaauuuuuggcuuccggucuuga

SEQ ID NO: 76261 - RNA, 1833 nt, Artificial Sequence
  derived and/or modified sequence opt5 from SRP72__Homo_sapiens__NP_001254651
auggccagcggcggguccggaggcgugucuguccccgcucuguggagcgagguuaacagauacgggcagaauggagacuucacccgggcccucaagacagugaacaaaauccugcaaauuaauaaggaugacgugacggcgcuucacugcaaagucgugugucugauccagaacggcuccuuuaaggaagcucucaauguuauuaacacccauacaaaagugcuggccaauaacucucuuagcuucgagaaggccuauugcgaauaccgccugaauagaaucgagaacgcucucaagaccauugaauccgccaaucagcagacagauaaacugaaggagcuguaugggcaaguccucuaccggcuggagcgcuaugacgaaugucuugcuguguacagagaucugguucggaacucucaggacgauuaugacgaggaacgcaaaaccaaucucagcgccguggucgcggcccaguccaacugggagaagguggugccugagaaucugggacuucaggaaggcacacacgagcugugcuacaacaccgcuugugcccucaucggccaagggcagcugaaccaggcuaugaaaauccugcagaaggccgaagaucucugcagacggagccugucugaggacacggaucaaaaugucuuugacuccaagaaaaagguuaaacuuaccaacgcggaaggaguggaguucaagcugagcaaaaagcagcuccaggccauugaguuuaauaaagcucugcuugccauguacacaaaccaagcugaacagugucgcaagaucucugccucccugcagagccagucuccggagcaucuccugcccgugcugauucaagccgcucagcucugcagagaaaagcagcacaccaaagcgaucgagcugcuucaggaguucuccgaucaacauccugagaaugccgcugagauuaagcugacaauggcccagcucaaaaucagccagggcaacauuuccaaggccugucugauccuucggucuaucgaagaacugaaacacaagcccgggauggucagcgcucucgugaccauguauucccacgaagaggacauugacagcgccaucgaaguuuuuacgcaggcgauucaaugguaccagaaucaucagccuaagucucccgcucaccugucccugauccgcgaggccgccaacuucaaacucaaguauggacggaaaaaggaggcuauuagcgaucugcagcaacuuuggaaacagaauccuaaggacauccauacacuggcccagcucaucucugcuuacagccugguggauccggaaaaggccaaagcgcuguccaagcaccuucccucuagcgacuccaugagccucaaagucgauguggaggcccuggaaaacucugcuggcgccaccuauauuagaaagaaagggggaaagguuacaggcgacucccaaccuaaggagcagggccagggggaucugaaaaagaaaaagaaaaagaaaaagggaaagcuccccaaaaauuacgacccuaaggugacccccgauccggagcgcuggcugccuaugagagaacggagcuauuacagaggccgcaaaaaggggaaaaagaaggaccagaucggaaaaggcacccaaggggcuacagccggagcgucuuccgagcuugaugccagcaagacggucuccucucccccuaccagcccccggcccggcuccgcugccacagugucugcuagcaccuccaacauuaucccuccgagacaccagaaacccgccggcgccccugcuacaaagaaaaagcagcagcaaaagaaaaagaaagggggaaagggcgggugguga

SEQ ID NO: 76262 - RNA, 249 nt, Artificial Sequence
  derived and/or modified sequence opt5 from SRP9__Homo_sapiens__NP_001123912
augccccaguaccaaaccugggaggaguucagcagagccgcugaaaagcuguaucucgccgacccuaugaaagcgcgggugguccugaaguaccgccacuccgauggcaaccuuugcguuaaagugacagacgaucuggugagacagugucucgcucugcuucugcggcuccagugcucugggaugaucauugcccauuguauccuggaccugcucggaagcuccggcccgcuggccucugcuagcuga

SEQ ID NO: 76263 - RNA, 1968 nt, Artificial Sequence
  derived and/or modified sequence opt5 from SRPK1__Homo_sapiens__NP_003128
auggagagaaaggugcuggcccuccaggcucggaaaaagcgcaccaaagccaagaaagacaaggcgcaaagaaagagcgaaacacagcaccggggcuccgcuccccauucugagagcgaucugccugaacaggaggaagagauccuuggguccgacgaugacgagcaggaagauccgaacgacuacugcaaaggaggcuaucaccuggucaagauuggggaucucuucaauggacgcuaccauguuaucagaaaacugggcugggggcacuuuucuacgguguggcuuagcugggacauucaaggaaagaaauucguggccaugaaggucgugaaguccgccgagcauuauaccgaaacagcucuggaugagauccggcuccugaaaucuguucgcaacagcgaccccaaugauccuaacagagagauggugguccagcugcucgacgauuuuaagauuuccggcgugaauggcacccacaucuguaugguuuucgaagugcuggggcaccaucuucugaaauggaucauuaagagcaacuaccagggacucccccugccuugcgucaaaaagaucauucagcaagugcuucagggccuggacuaucuccacacaaaaugucggaucauucauaccgacaucaagcccgagaauauucugcugucugugaacgaacaguacauccgcagacucgccgcugaggccacagaauggcagcgguccggggcgccuccgcccagcggaucugccgucuccaccgcuccucaacccaagccugccgauaaaaugagcaagaauaaaaagaaaaagcugaagaaaaagcagaaacgccaggcugagcuucuggagaagagaaugcaagaaaucgaggaaauggagaaagaaucuggccccgggcagaagcggccgaacaagcaggaggaguccgaaagcccuguugagcgcccccucaaagaaaauccucccaacaagaugacgcaggagaaacuggaagaguccucuaccauuggacaagaccagacacuuauggagagagauaccgaaggcggcgccgcggagaucaauugcaacggggugauugaagugaucaauuauacacagaacagcaacaaugagacccugcggcacaaggaggaccuccacaacgccaaugauugugacguccagaaccugaaucaagaauccagcuuucugucuucccagaacggagauagcucuacgagccaggagacagacuccugcacccccauuacaucugaagugagcgauaccaugguuugucaguccagcucuaccgugggccaauccuucagcgagcagcauaucucucagcuccaggaauccaucagagcugagauuccuugcgaggacgaacaagagcaggaacacaaugggccgcuggauaacaaaggaaagagcacagccggcaauuuucuugucaacccccuggagccuaagaaugcugaaaaacucaaggugaaaaucgccgaccuggggaacgccuguuggguucauaagcacuucacggaggacauucagacccgccaauaccggucccuugaggugcugaucggaucuggcuacaauacacccgcugauauuuggagcaccgcgugcauggccuuugaacucgcuacaggcgacuaucuguucgagccucauuccggggaagaguacaccagagaugaagaccacaucgcccugaucauugagcuccugggaaaagucccccgcaaacuuaucguggccggcaaguauucuaaggaguuuuucacgaagaaaggggaucugaagcacauuacaaaacucaagccguggggacuguuugaaguccugguggagaaauacgaauggagccaggaggaggcugccggcuucaccgacuuccuucucccuaugcuggaacugauccccgagaagcgggcgaccgcugccgaaugucucagacauccuuggcugaacuccuga

SEQ ID NO: 76264 - RNA, 2067 nt, Artificial Sequence
  derived and/or modified sequence opt5 from SRPK2__Homo_sapiens__NP_872633
augagcgugaacuccgagaagucuagcuccucugaaagacccgagccucagcaaaaagccccgcugguucccccucccccucccccuccgcccccucccccucccccgcucccugaccccaccccucccgaacccgaggaagagauccugggcagcgaugacgaggaacaggaggauccugcugacuacugcaaagggggauaucacccggucaagauuggcgaucuuuucaaugggcgguaccaugugauccgcaagcugggauggggccacuuuuccacaguguggcucuguugggacaugcaggggaaaagauucgucgccaugaaggugguuaagucugcgcagcauuauacggaaaccgcucuggaugagauuaaacuucugaagugcgugcgggagagcgaccccuccgauccuaacaaagacauggucgugcaacucaucgaugacuuuaagauuagcggaaugaauggcauccacguuuguaugguguucgaaguccugggccaucaucugcucaaauggaucauuaagucuaacuaccaggggcugcccgugcgcugcgugaaguccaucauuagacagguccuucagggacuggauuaucuccacagcaaauguaagaucauucacacagacaucaaaccugagaauauucugaugugcguugacgaugccuacgugcggcgcauggccgcugaagccaccgaguggcaaaaggcuggcgcgcccccgccuucuggguccgccgugagcacagcuccccagcagaaaccuaucggaaagaucucuaaaaacaagaagaaaaagcugaaaaagaaacagaagagacaagccgaacuucucgagaagcggcugcaggagauugaagaacuggaacgcgaggccgaaagaaaaaucauugaggagaauaucaccuccgcugcccccagcaacgaccaggauggcgaauauuguccugaggucaagcucaaaacaaccgggcuggaagaggcggccgaagcugagacggccaaggacaauggagaggcugaagaucaagaggaaaaagaggacgccgagaaggaaaacauugagaaggaugaagacgauguggaccaggagcuugccaauaucgaucccaccuggaucgaauccccgaaaacaaacggccacauugagaauggcccuuuuucucuggagcagcagcucgacgacgaagaugacgaugaggaagacugccccaaccccgaggaauacaaucuggaugagccuaacgcugagagcgacuacaccuauuccagcucuuacgaacaauucaacggggagcuuccgaauggacggcauaagauccccgaaucccaguuuccugaguucagcacaucucuguuuagcggcucccucgaacccguugcgugugggucugugcugagcgagggauccccucugaccgagcaggaagagagcucucccucccacgaucgcagcagaacggucucugccuccagcacaggcgaccucccuaaagcuaagacccgggccgccgaucugcuugugaacccccuggacccgcgcaaugcugauaaaauuagaguuaagaucgccgaccucgggaacgcgugcugggugcacaagcauuucacagaagauauucagacccggcaauauagauccaucgagguccugaucggagcuggcuacucuaccccugccgacauuuggagcacagccuguauggcuuuugagcuugccacgggcgacuaucuguucgaaccccacuccggggaggauuacucucgcgacgaagaucauaucgcucacauuaucgagcuccugggaagcauuccucggcauuuugcccuguccggcaaauauagcagagaguucuucaaucgcagaggggagcuccggcacaucaccaagcugaaacccuggucucuuuuugacgugcuggucgagaaguacggauggccgcacgaagaugcggcccaguucacagacuuucucauuccuaugcuggagauggugcccgaaaaacgcgcuuccgccggcgagugccugcggcauccuuggcuuaacagcuga

SEQ ID NO: 76265 - RNA, 816 nt, Artificial Sequence
  derived and/or modified sequence opt5 from SRPRB__Homo_sapiens__NP_067026
auggccagcgcugacuccagacggguggccgauggcgggggagcgggcgggaccuuccagcccuaccuggacacacuccgccaagagcugcagcagacggauccuacccuucugucugucguuguggcugugcucgccguccugcuuacacugguguuuuggaagcucaucagaagccggcgcuccucucagagagccguucugcuggugggacucugcgacagcggcaaaacccugcuuuucguccggcugcucacagggcuguaucgcgauacccaaacauccauuaccgacucuugugcuguguacagaguuaacaauaaccggggaaauagccuuacgcugaucgaucucccgggccacgaaucccugcgccugcaguuucucgagagauucaagagcucugcccgggcuauuguguuugucguggacuccgccgcguuccagcgcgaagugaaagaugucgccgaguuucuguaucagguucuuaucgacagcaugggccugaagaacacccccucuuuccucauugcuugcaauaaacaagauaucgccauggcuaaguccgccaagcugauccagcagcagcuugaaaaagagcugaacacacucagagugacccggagcgcggccccuucuacacuggacuccagcuccaccgcucccgcccaacuggggaagaaaggaaaggaguuugaguucucucagcucccucugaaaguggaauuucuugaauguagcgcuaagggcgggcgcggagaugucggcuccgccgacauucaggaccuggagaaguggcucgccaaaaucgcuuga

SEQ ID NO: 76266 - RNA, 1833 nt, Artificial Sequence
  derived and/or modified sequence opt5 from SRPR__Homo_sapiens__NP_001171313
augcuggacuucuuuaccaucuucagcaagggcgggcucgugcuguggugcuuucagggagucuccgauucuuguacaggccccguuaacgcccuuauuagaagcgugcugcuccaagugggguuccagaaaauccugacgcuuaccuacgucgacaagcugauugaugacgugcaccggcucuuucgcgauaaauauagaacagagauccagcagcaauccgcucugucucugcucaauggaaccuucgacuuucagaacgauuuccugcggcuucugcgcgaagccgaggaaagcuccaagauuagagcgccuacaaccaugaaaaaguuugaggacucugaaaaggcuaaaaagccgguucggagcaugaucgagacacgcggcgagaaacccaaggaaaaagccaaaaauuccaagaagaagggggccaaaaaggagggaagcgauggcccucucgcuaccucuaaacccgugccugccgaaaaguccggccugcccgucgggccugagaacggaguggagcuuagcaaagaggaacugaucagacggaagcgcgaagaguucauucagaagcauggcagagggauggaaaaaucuaauaaguccacgaaaagcgacgcuccgaaggagaaaggaaagaaggcgccccggguuugggagcucggcgggugcgccaacaaagaagugcuggauuacucuaccccuacaaccaauggaacacccgaggccgcucuguccgaagacaucaaccucauucgcggcaccggcagcgggggacagcugcaagaucuugacuguuccucuagcgacgaugagggcgccgcucaaaauuccacgaagccuagcgccacaaaagggacccugggaggcauguuugggaugcucaagggacuggucggcucuaaaucccuuagcagagaagacauggagucugugcuggauaagaugcgggaccaccucaucgcgaagaacguggccgcugauauugccguccagcugugcgagagcguugcuaauaaacuggaaggcaaggugauggggacauucuccaccgugaccucuacagucaaacaggcccuccaggagagccuggugcagauccuucagccccaacgcagaguugacaugcugcgggauauuauggacgcccagagacgccagcggccguauguggucacguuuuguggagugaacggcguugggaaguccaccaaucucgcuaaaaucagcuucuggcugcuugaaaacggauucucugugcugaucgcggccugcgauacauuuagagcuggcgccgucgagcagcuccgcacccauacacggagacuguccgcccugcacccucccgaaaagcaugggggccgcaccauggugcaacucuucgagaagggauacggcaaagacgcugccgggauugcgauggaggcuaucgccuuugcccggaaucagggauucgaugucgugcugguugacacggcuggcagaaugcaggacaacgccccucuuaugacagcucuggccaagcucauuaccgugaacacccccgaucugguccuguuugugggggaagcgcuuguuggaaaugaggccguggaccagcucgucaaauucaaccgcgcucuggccgaucacagcauggcucaaacaccccggcugaucgacggcauugugcucaccaaguuugauacaaucgacgauaaagugggggccgcgaucucuaugacguauauuaccuccaagccuaucguuuucgucggcacaggacagaccuacugugaccugagaagccuuaaugccaaagcugugguggccgcucugaugaaggccuga

SEQ ID NO: 76267 - RNA, 1398 nt, Artificial Sequence
  derived and/or modified sequence opt5 from SRPX2__Homo_sapiens__XP_005262178
auggccagccagcugacccaaagaggcgcucucuuccugcuguuuuuccuuacacccgccgugacgccuaccugguacgcgggguccggauauuacccggacgagucuuauaacgaagucuacgcugaggaaguuccccaggccccugcccucgauuaucgggugccccgcuggugcuacacacugaauauccaggacggcgaggcuaccuguuauagcccuaaagggggaaacuaccacuccucucuuggcacaagaugcgaacugagcugugaucggggguuucgccucauuggaagacgguccgugcagugccugcccucucgcagauggagcggcaccgccuacugucggcaaaugcgcugccaugcucugccuuucaucacauccggcaccuauacguguaccaaugggguccuccuggacagcagaugcgauuacucuuguuccagcggauaucaccuugagggcgaccggucucgcauuugcauggaggaugggagaugguccggaggcgaaccgguguguguugacaucgaucccccuaagauucggugcccccauagccgcgagaagauggccgaaccugagaaacugacagcgagaguguacugggaucccccgcucgucaaggacucugccgacgggaccaucacacgggugacccugagaggaccugagcccggcucccacuuuccugaaggcgagcauguuauccgcuauacggcuuacgaucgggccuauaacagagcuagcugcaaauucauugugaagguccaggugcgccggugucccacacuuaagcccccucagcacggguaccugaccugcacauccgccggagacaauuacggcgcgaccugugaauaucacugcgacgggggauacgauagacagggcaccccgucucgcgugugucaaagcucccggcaguggagcgggucucccccuaucugcgcccccaugaaaauuaacgucaauguuaacuccgcugccggacuccuggaccaguuuuaugagaagcagagacugcucaucauuagcgcuccugaucccucuaaucgcuacuauaaaaugcaaaucagcaugcugcagcaguccacauguggccuugaccugcggcaugugacgauuaucgaacucgugggccaaccgccucaggaggucgggagaauccgcgagcagcagcugucugccaacauuaucgaggaacuucggcaauuccagagacugacccggagcuacuuuaauauggugcucauugauaagcagggaaucgaccgcgauagauauauggaacccguuacaccugaggaaauuuucaccuuuaucgacgauuaccugcuguccaaccaggagcucacacaacggagagagcagcgcgacaucugcgaauga

SEQ ID NO: 76268 - RNA, 1335 nt, Artificial Sequence
  derived and/or modified sequence opt5 from SRPX__Homo_sapiens__NP_001164221
augggcagccccgcccacagaccugcucugcuccugcuucugccgccccuccugcuucugcuccugcugcgggugccucccucccgcucuuucccugacacccccuggugcagcccuaucaaggucaaauacggggauguuuauuguagagccccgcagggaggcuacuauaagacagcgcucgggacgcggugcgacauucgcugucaaaaaggauacgagcugcauggcuccucucuucugaucugccagagcaacaagagaugguccgauaaagugauuuguaagcagaagcggugccccacccucgcuaugccugccaaugggggauuuaaauguguggacggcgccuauuucaacucucgcugcgaauacuauuguagccccggcuacacacugaagggggagagaaccgucacaugcauggauaauaaggcuugguccggacggccugccagcuguguggacauggaacccccgcgcaucaagugcccuucuguuaaagagagaauugcugaacccaacaaacuuaccgugcgggucuccugggagacaccugagggccgcgauaccgccgacgggauccugacggaugugauccucaagggacugccucccggcagcaauuuucccgaaggggaccacaaaauucaguacaccguuuaugauagagcggagaacaagggaacaugcaaauuccgggugaagguccgcgugaaaagauguggcaagcugaaugccccggaaaacggcuacaugaaauguucuuccgacggggauaauuauggagcuaccugcgaguuuagcugcaucggcggguacgagcuccaaggaucucccgcccgggugugucaguccaaccuggcuuggagcggcacagaaccuaccugcgccgcgaugaaugucaacguuggggugagaacggccgcugcccuucuggaccaguucuaugagaagcgccggcuccugauuguguccacacccaccgcuagaaaucuucuguaccgccuccagcugggaaugcugcaacaggcccaguguggccucgaccugcggcauaucacagucguggaacuuguuggcguguuuccuacccugauugggagaaucggagccaagauuaugcccccggcucucgcgcugcagcuucgccugcuccugcggaucccucuguauucuuucagcaugguccucguggauaaacacggcauggacaaggagagauacguuucccuggugaugcccgucgcccuuuuuaaccugaucgauaccuucccucuccgcaaagaagagauggugcugcaagcugagaugagccagacaugcaauacguga

SEQ ID NO: 76269 - RNA, 1023 nt, Artificial Sequence
  derived and/or modified sequence opt5 from SRR__Homo_sapiens__XP_011522276
augugcgcccaguacuguaucagcuucgcugacguggagaaggcccacauuaacaucagagauuccauucaucugacccccguccucacaucuagcauccugaaucaacuuacgggccggaaccuguuuuucaaaugcgaacucuuucagaagaccggguccuucaaaauucgcggagcgcugaaugcuguuagaucucuugugccugacgcccuggagcggaagccgaaagccguggucacacacagcuccggcaaccaugggcaggcucucaccuaugccgcuaagcuggaaggaauccccgccuacaucgugguuccucagacagcgcccgauuguaagaaacuggccauucaggcuuauggcgccucuaucguguacugcgagccuagcgacgaaucccgcgagaaugucgcuaagagagugaccgaggaaacagaggggauuaugguucaccccaaccaagaaccugccgugaucgcgggacagggcaccauugcccucgagguccugaaucaggugccgcuuguggaugcucuggucguucccgugggcgggggaggcaugcucgccgggaucgcuauuacggugaaagcccugaagccuagcgucaaaguguaugccgcugagcccucuaacgcggacgauuguuaccaauccaaacuuaagggaaagcugaugccuaaucucuaucccccggaaaccaucgccgacggcguuaagagcucuaucgggcugaacacauggccuauuauccgggaucugguggacgauauuuuuaccgucacagaggacgaaaucaaaugcgcuacccagcucgugugggagcgcaugaagcugcuuauugaacccacggccggaguuggcguggccgcuguccugucccagcauuuccagacagugagcccugaggucaaaaauaucuguaucgugcucucuggcgggaacguugaucugaccuccagcauuacaugggugaagcaagccgagagacccgcguccuaccagucugucagcguguga

SEQ ID NO: 76270 - RNA, 2751 nt, Artificial Sequence
  derived and/or modified sequence opt5 from SRRM1__Homo_sapiens__NP_001290377
auggacgccggcuucuuuagagggaccagcgcugagcaggauaaccgguucuccaauaagcagaaaaagcugcucaaacaacugaaguuugccgaaugccuugagaaaaagguggacaugucuaaggucaaccuggaaguuaucaaacccuggauuacaaagcgcgugacggagauccucggauucgaagaugacguggucauugaguuuaucuucaaucagcuggaggugaaaaacccugauagcaagaugaugcagauuaaucuuaccggcuuucugaacgggaaaaaugcgagagaguucaugggagaacucuggccgcugcugcucuccgcucaagaaaacaucgccggcauccccucugccuuucuggagcuuaagaaggaggaaauuaaacagcggcagaucgagcaggaaaagcuggcuagcaugaaaaagcaagacgaggauaaagacaagcgcgauaaagaagagaaggaguccucuagagaaaagcgggagcgcagcagauccccucggcgcagaaaaagccggucucccuccccucgcagacggagcucucccguucgcagagaacggaagagaucccacagccgcucuccucggcauagaacaaaaucccgcagcccgucccccgccccugagaagaaagaaaagacccccgagcucccugagcccucugugaaggucaaagaaccgagcgugcaggaggcuacauccaccagcgacauucugaagguuccuaaacccgaaccuauccccgagcccaaggaaccuucuccggagaaaaauuccaagaaggagaaagaaaaggagaaaacacggcccagaagccgcucucggagcaaguccagaucucgcacccggagcagauccccuagccacacgcgcccccggagacggcaucgcucuagaucccggagcuacucuccuagacgccggcccuccccgagacgcagaccuagcccccggcgcagaaccccuccccggcgcaugccucccccgccuagacaccggcgcuccagaucucccgugcggcgcagacggagaagcuccgccucucuuagcggguccagcagcuccagcagcuccagccgcucucggagcccucccaaaaagccgcccaagagaacauccagcccuccccgcaaaacccggagacugucuccuuccgcgagcccuccccgccggagacaucgccccuccccgccugccacacccccucccaagacccggcacucuccgacgccucagcagagcaacagaacacggaaaucccgcgucucugugagccccggaagaaccuccgugacaaagcacaaaggcaccgaaaagcgggagucuccuagccccgcucccaaaccucgcaaggucgagcucuccgaaagcgaggaagauaagggcgggaaaauggccgcugccgacucuguucaacagagacggcaguauagacgccaaaaucagcaguccagcucugauuccggaagcuccuccagcuccgaggacgaacggccgaagagaagccaugugaaaaacggcgagguggggcgccggagacgccacucucccagccgguccgcgucuccuagccccagaaagcgccagaaagagaccuccccuagaaugcaaaugggaaagcgguggcagucucccgucacaaagagcggccgcagacggcgcuccccuucuccgcccccuacgagacggagacgcagccccuccccugcucccccgccucggagacgccggacccccacacccccucccagacggcgcaccccuagcccgcccccuagacggcgcucucccuccccuagacgguacucucccccgauucagcgcagauauucuccuucucccccucccaaacggcgcacagccagcccucccccgccucccaagagacgggccucccccucuccuccgcccaaaagacgcgugagccauuccccucccccuaagcagcggagcucucccguuaccaaaagacgcuccccuagccugucuagcaagcaccggaagggguccucuccgagcagauccacgcgcgaagcucggucuccccaaccuaauaaaagacacagccccuccccucgcccccgggccccgcagacaucuucuuccccuccucccgugagacgcggagccagcuccucuccccagcggagacagagccccuccccuucuacccgcccgaucagacgggucagccgcacccccgagccuaagaaaauuaagaaagcugcgucccccagcccucaaucugugagacggguuuccagcucuagauccgugagcggcucucccgaaccggccgcuaagaagccucccgccccucccagcccuguccagucccagucucccagcacaaacugguccccggccgugccugucaaaaaggcuaaaagccccacccccuccccuucuccgccccggaauagcgaccaggagggcgggggaaagaaaaagaaaaagaagaaagauaagaaacauaagaaagacaagaagcacaaaaagcauaaaaagcacaaaaaggaaaaggccguggcggcugccgccgcugccgcuguuacgccugccgcgaucgccgcugccacaaccacacuggcucaagaggagcccguggccgcgccugaacccaaaaaggagaccgaauccgaggccgaagauaaccucgacgaucuggagaaacaucuucgcgagaaggcucugagaucuaugcggaaagcccaggucagcccucaguccuga

SEQ ID NO: 76271 - RNA, 8259 nt, Artificial Sequence
  derived and/or modified sequence opt5 from SRRM2__Homo_sapiens__NP_057417
auguacaacggcaucgggcugcccaccccuagaggaagcggcaccaauggguaugugcagcggaaccucucccuggucagaggaagacggggcgagcgcccggacuacaagggggaagaggaacuuagacggcuggaggcggcucucguuaaacgccccaauccugauauucuggaccacgaaagaaagcggcgcguggagcuuagaugccuggagcucgaagagaugauggaagaacagggauaugaggaacagcagauccaggagaaaguggcuacguuccggcugaugcugcucgaaaaggaugucaaccccggcggcaaagaggaaaccccugggcaacgccccgcggugacagagacccaccagcuggcugagcuuaaugaaaagaagaacgagagacugcgggccgccuuuggaauuucugacagcuacguugauggcuccucuuucgacccucagcgcagagcucgggaagccaaacagccggcucccgagccucccaagccuuauagccucgugagagaauccucuagcucccgcagccccaccccgaaacaaaagaaaaagaagaaaaagaaagaucgggggagacgcucugaguccagcucuccucggagagagcgcaagaaauccagcaagaaaaagaagcaccggucugaauccgagagcaaaaagagaaaacaucgcucccccaccccuaagucuaaacggaaguccaaggacaaaaagagaaaacgcucccggagcaccacccccgcccccaagucuagacgggcgcaccgcuccacgagcgccgauucugcuagcuccucugacaccagcagaucccggagcagaucugccgcugccaaaacccauaccaccgcgcuggccggacgcuccccuagcccggcuucuggccggagaggggaaggagaugcccccuuuuccgagccuggcaccacgagcacacagcgccccuccucuccugaaaccgcuacaaagcagcccagcuccccguacgaggacaaggauaaagacaagaaagagaagucugccaccagaccuagccccuccccugaacggagcucuaccggccccgagccucccgccccgacaccucuucuggcugaacgccacgggggaagcccccagccccucgcgacgaccccucugagccaagagccggucaaucccccuucugaggccucccccacaagagaccggagcccucccaaaucuccugaaaagcugccccagagcuccagcucugaguccagcccgccuagcccccagccuaccaaggugucucgccacgcuagcuccucucccgaaagcccgaaaccugcccccgccccuggcucccauagagagaucucuagcucccccacaagcaagaaccggucucacgggcgcgcuaaaagagauaagucccauagccacacccccucucggcgcaugggaagaucccggagcccugccacggcgaaaagaggccgcucucgguccagaacaccgaccaagcgcgggcacagccgguccagaagcccccaauggcgccggucuagaagcgcucagcgcuggggacgguccagaucuccucagcggcgcggcagaagccggagcccccagcgcccuggcuggucuagaagccggaauacccaaagacgcgggcgguccagaucugcccgccggggaagaagccauucccgcagccccgccacacggggcagaucucgcuccagaaccccugcucggcgcgggagaagccggucucgcacaccggccagacggagaucccgcagccggacgcccaccagacgccgguccagaucucggaccccugcucgcagaggacggagccgcuccagaacccccgcccggcgcagaagccggacacgcucuccuguuagacggagaucccgcagccggucucccgcgagacgcagcggccgguccagaucucgcaccccggcccggagagggcgcagccgguccagaacgccugcucgccggggcagaucucgcagcagaacccccgcccggcgcuccggaagaagccggucuagaacacccgcucggcgcggcagaucccggagccgcaccccuagacgggggcgcuccagaucucggagccucgugcgcagaggacggucccacucucgcacaccccagagacggggccgcagcggguccagcucugaacgcaaaaacaagucccggaccagccagagacgcucucgguccaauagcucuccugagaugaagaaaagcagaauuuccucucgccggagcagaucccugagcuccccgcgcucuaaggccaaaagccggcuuucccugagacgcucucucagcggauccucucccuguccuaagcagaaaagccaaacgcccccucggagaucccgcagcggaucuagccagcccaaggccaagucccggacaccgccuagacggucuagauccuccucuucucccccucccaaacagaaguccaaaaccccuucccgccagagccauucuagcuccucuccccacccgaaggucaaaagcgggacaccuccccggcaaggcuccaucaccucuccccaggccaacgagcagagcgugaccccucagagacgcuccugcuucgaaucuagcccggaccccgagcugaaguccagaacaccuagccggcauucuuguuccggaagcucucccccucgcgugaaguccagcacgcccccuagacaauccccgucucggagcuccagcccccagccuaaagucaaggcuaucauuagcccccgccagagaucccacagcggcucuagcuccccuucucccagccggguuaccucccgcacaaccccgagacggucucgcagcguguccccuugcagcaauguggaaucuagacuucugccccgguauucccacagcggguccucuagccccgauacaaaagucaagccugagacacccccucgccaaucccauucuggaagcaucuccccguaccccaaagugaaggcccagacgccucccggcccuagccucucuggguccaagagccccuguccgcaggaaaaaucuaaggacucccugguucagagcugcccuggaucucugucccucugugcuggcgugaaaagcucuacacccccuggggagagcuacuuuggcgucuccagccugcaacuuaagggacagucccagaccucucccgaucacagaagcgacaccuccucuccugaggugcggcagagccauuccgaaucucccagccugcaauccaaaagccagacaucuccgaagggcgggagaucccgcuccucuagcccuguuaccgagcucgccagccggucucccauuagacaggaucgcggagaguucuccgccagccccaugcugaaaucuggcauguccccugagcagagccgguuucaaagcgacuccucuagcuauccgacaguggauuccaacucucuucuggggcagagcagacucgaaacggcugaguccaaggagaagauggcgcugcccccucaggaagacgccaccgcuucucccccucgccaaaaagauaaguucagccccuuuccuguccaggaccggcccgaguccagccugguguucaaagacacacucagaaccccgccucgcgaacggucuggagccggcuccagccccgagacaaaggagcaaaauucugcccugccuaccuccagccaggaugaggaacuuauggaagucguggagaaauccgaggaacccgcugggcaaauccugucucaccucagcuccgagcugaaggaaaugucuacgagcaacuuugaguccagcccggaaguugaggaaagaccugccgugucucugacccuugaccagucccagagccaggcgucucucgaggcugucgaggugcccagcauggccuccucuuggggcggaccccacuucagcccugaacauaaggagcuguccaacagcccccugcgggaaaauucuuuuggcuccccucucgaguuccgcaacagcgggccgcugggaacagaaaugaauaccggcuucuccucugagguuaaagaggaucuuaacgggcccuuucugaaucaacucgaaacagacccuagccuggauaugaaggagcaguccaccagaucuagcggacacuccucuagcgaacugucccccgacgccguggagaaagcuggcaugagcucuaaccaguccauuagcucuccuguccuugaugccgugccccggacaccuucccgcgagagaagcucuagcgcguccagcccggaaaugaaggacggccucccccggaccccuuccagacgcucucggagcggguccucucccggacugagagauggcagcgggacgccuucccgccauucucugagcggauccagccccggcaugaaagacaucccgcggacaccuucuagagggcgcuccgagugcgauagcucucccgaacccaaggcucucccucagacccccagaccucggucccgcagcccgucuucccccgagcugaauaacaagugucuuaccccucaaagagaacggagcggaucugaguccagcguggaccagaaaacaguugcccgcacaccccugggccagagaucccggagcggcucuagccaggagcucgaugucaagccuuccgccucuccccaagaacgcagcgaguccgacucuagcccggacuccaaagcuaagacgagaacaccucugcggcagagaagccgcucuggguccagccccgaaguggauucuaaaucccggcugagcccuagacgcucucgguccggaagcucccccgaggugaaggacaagccgagagccgcuccucgcgcccagucuggcagcgauuccagccccgaacccaaagcgccugcgccccgggcccuuccuagacggucucgcuccgggagcucuagcaagggaagaggcccgucccccgaggggucuagcuccaccgagagcucuccugaacaucccccuaaaucccggacagcccgcagaggaagccggucuucccccgagccuaagaccaaaagccgcacaccgcccagacggagauccucucgcagcuccccugaacucacccggaaggcuagacugucucgccggagcagauccgccuccucuagccccgagacgcgcagccggaccccucccagacaucgccggucuccguccgucagcucuccugaacccgccgagaaguccagaagcagccgcagacggcgcuccgcuucuagccccagaacaaaaaccacaucccggagaggccgcucuccuagccccaagccucggggccugcaaagaucccggucucgcagcagacgggagaaaacccgcacgacaagacggcgcgacagauccgggucuagccaguccaccagccggcgcagacagcggucucgcuccagaagccgggugacaagacgccggagaggaggcucuggguaccacucccgcagcccggcgcggcaggaaucuuccagaaccagcucccgccggagacgcggacggagcagaacacccccuacaucucgcaagcggagcagaucccgcacgucucccgccccuuggaaacggagcagauccagagcuucucccgccacccaccggcgcagcagaucccggacaccgcucauuucucgcagacggagccgcuccagaaccagcccuguuucucggcgcagaucccggagccgcacaucugugaccagacggcgcuccagaagccgggccucccccgucucuagacgccggagcagaucccgcacgccucccgugacacggagacgcagccggucuagaaccccuaccacacgccggagaucccgcagccggacacccccgguuacaagacggcgcucuagaucccggacgcccccugugaccagacgccggagcagaucucgcacaagccccaucaccagacggcgcuccagaucucggacaagcccugucacccgcagacggucccgcagcagaacgucuccggugacccggcgcagaucccggagcagaacaucccccguuacccgccggagaucucgcagccggacaccucccgcuaucagacgccgguccagaucucgcaccccucugcuuccccggaagagaagccggucccgcagcccucuggccauuagacggcgcucuagaucccggacacccagaacggcgcgcggcaaacggagccucaccagaucuccgccugcuauccgccggagauccgccagcgggucuuccagcgaucgcucucggagcgccacacccccugcuaccagaaaucauuccggaagccgcacacccccgguggcccugaacuccucuagaaugagcugcuucucccggccuucuaugagccccacaccccuggaccgcuguagauccccuggcaugcuugagccccucggcucuagccggacgccuauguccguccugcaacaggccgggggcagcaugauggauggcccggggccccgcauuccugaccaccagagaaccucugugcccgaaaaucaugcucagucccggaucgcccuggcccucacagcuauuagccugggaaccgcccgcccucccccgucuauguccgcugccggccuugcggccagaaugagccaagugccugcucccgucccucugaugucucuccggacagcccccgcugccaaccuggccuccagaaucccugcugcgagcgccgcugccaugaaucuggccuccgcucgcacccccgccaucccgacggcgguuaaccuugcugauagccggacacccgccgccgcugccgcgaugaaucuggccucuccuagaaccgcuguggcccccuccgcugugaaccucgccgacccucgcacccccacagcuccugccgucaaccuggcgggggcccggaccccggcugcccucgcugcccugagccuuacaggaucuggcacacccccuacggccgcuaauuaucccagcuccucuagaacaccucaggcgcccgccagcgcuaaccuggugggcccgcgguccgcccacgccaccgcuccuguuaauauugccgggucucgcacagcggccgcucucgcccccgcuagccugaccuccgccagaauggcgccugcccugagcggagcuaaccuuacgucuccccgggugccgcuguccgccuacgagcgcgucagcggcagaaccucuccuccccuccuggaucgggcucgcuccagaacacccccuagcgcccccucccagucucggaugaccagcgagagagcuccuuccccgagcucucgcauggggcaggcccccucccaaagccuccugccucccgcgcaggaccagccucggucucccgugccuuccgccuuuagcgaucaaucuagaugccuuaucgcucagacaaccccgguugccggaagccagucccugucuagcggcgcuguggccacaaccacguccagcgccggggaccauaauggaaugcucucuguccccgcgccuggcgugccccacuccgacguuggcgaaccucccgcuagcacaggggcccagcaaccguccgcucuggccgcccugcagcccgcuaaggagcgccggucuagcuccucuagcuccuccucuagcuccucuagcuccucuagcagcucuagcuccagcuccucuagcuccucuggaagcuccucuagcgauuccgaaggcagcucucuuccugugcagcccgaggucgcccugaagagagugccuucccccaccccugcgccgaaagaagccgugcgcgaggggcggcccccugagcccaccccugcuaagagaaaacgccgguccucuagcuccucuagcagcuccucuagcuccagcucuagcuccucuagcuccucuagcuccuccucuagcuccucuuccagcuccucuagcuccucuagcuccuccucuuccagcucuagcucccccucuccggccaagccuggaccccaggcucucccuaaacccgccagcccuaagaagcccccgcccggcgaaagacgcucccggagcccuagaaaacccauugacucucugcgcgauuccagaagccucuccuauucuccugucgagcggcgcagacccagcccgcaaccuagcccccgggaccagcagucuagcuccagcgaaagagggucucggcgcggacagagaggcgauucccggagcccuucucacaagcgcagacgggagacacccuccccucgccccaugagacaucggagcucucgcuccccguga

SEQ ID NO: 76272 - RNA, 1836 nt, Artificial Sequence
  derived and/or modified sequence opt5 from SRRM4__Homo_sapiens__NP_919262
auggccagcgugcagcaaggcgagaagcagcuguucgaaaaauuuuggagagggaccuucaaggcugucgccacaccccggccugaguccaucauuguugcgucuaucacggcucgcaaaccgcuccccagaaccgaaccucagaacaaucccguggugccugcccaggacggacccagcgagaagcugggccaacaccuugccacagaaccucuggggaccaacuccugggagcgggauaaaacaugccgcgagcucggagcuaccagaggccauucugccagccacgacaaggaucugacaccgcccccuuccucucgggggaagaaaaagaaaaagaaaagcacccgcaagaagagacggcgcuccagcucuuacucccccagcccugucaaaaagaaaaagaaaaagucuuccaaaaagcauaagagacggcgcagcuuuucuaaaaagagacggcacuccagcuccucucccaaaagcaagcgcagagacgaaaaacggcauaagaagcaguccagaagccgcccgcggaaaucucacagacaccgccaucaccgguguccuuccagaagccagucuagcgagucccgccccucuagcugcgaaucccggcauagaggacgcagcccugaggagggccagaagucucggagacgccacucccggagauguagcaaaacgcuuugcaaggauucucccgaagcucaauccagccggcccccuucccagccgcugcagaugcucggcuaucugucugcccgcggggugauuaccggaagcggcuccgcggccgaccuguucacaaaaaccgcuucuccccucacaaccagcagagggcggucccaggaguacgauagcggaaaugacacgucuuccccucccagcacacaaaccucuuccgccagaagccgcggccaggaaaaggggucuccuagcggaggccuguccaagagccgggagcuuaacucuggcaauacauccgauagcgggaacuccuuuaccaccucuagcccccagaauaaaggagcuaugcuggaaaaccucuccccgacaucuagaggccgcgagagcagaggguuccaauccccuugucuggagugcgccgaaguuaagaaaucuagccuugugcccuccacggcgcggagcucuccuaugaagggauguucccgcucuagcuccuaugccagcaccagaucuuccagccacuccagccggucucccaauccucgcgcuagccccagauacacacagucccggucuaccagcuccgagaaacgcucuuauagcagauccccgucuuacagcuccaagagcggcaagcggucuccucccucccgcagcucuagaucccggagaagccccuccuauucucgcuacagcccuucccgggaaagagacccgaaauacagcgagaaggauucucagcagcgcgaacgggagagagcccgccggagacgccgguccuauagccccaugagaaaacggcgcagagacucuccuagccaucuggaggcucggcgcaucacauccgccagaaagcggcccauuccuuacuauagacccucuccuagcuccucugggagccucuccagcaccucuuccugguacagcuccucuagcucccgcucugccagccgguccuauagcagaucucgcucccggagcagaucucgccggagaucccgcacgagaacaagcucuagcuccucuagccggucccccagcccgggaucccgcucuagaagccggucccgcucuagaagccgguccagaucucgcagccaaucccggagcuacucuuccgcugauagcuauucuuccaccagacgcuga

SEQ ID NO: 76273 - RNA, 2652 nt, Artificial Sequence
  derived and/or modified sequence opt5 from SRRT__Homo_sapiens__XP_005250462
auggcccccagcgacagagcuaugggcgauuccgacgaugaguacgaccggcgcagacgggauaaguuccgcagagaacggucugacuaugaucgcagcagagagcgggacgaacgcagacgcggggaugacuggaacgaucgggagugggacagaggacgggaacgcagaucccggggcgaguacagagauuaugaccgcaaucggagagagcgcuuuucuccuccgcggcacgaacugagcccuccccagaaaagaaugcgccgggacugggaugagcauuccucugaccccuaccacagcggguaugaaaugccuuacgccggaggcgggggaggccccaccuauggcccuccgcaacccugggggcauccugaugugcacaucaugcagcaucacguccuccccauucaggcgagacugggauccaucgcugagauugaccuuggcguuccucccccggugaugaagacauucaaagaguuucugcucagccuggaugacucuguggaugaaacggaggccgucaagcgcuacaacgacuacaaacuugauuuccggagacagcaaaugcaggacuuuuuccuggcccacaaggaugaagagugguuucgcuccaaguaucauccugacgaaguggggaaacggagacaggaggcucggggagcccuccagaaucgccugagaguuuuccugagccucauggagaccggcugguuugacaaccugcuucuggauaucgacaaggcugaugccauugugaaaaugcucgacgcggccgucaucaagauggaagggggaacagagaaugaucugcggauccuugaacaagaggaagaggaggaacaggcuggcaaacccggcgagccuucuaagaaggaagaggggagagccggagcuggccugggggacggagaacgcaaaaccaacgauaaggacgagaaaaaggaggauggcaaacaggccgaaaaugacuccagcaacgaugacaagacaaagaagucugagggggauggagacaaggaagagaaaaaggaggacuccgaaaaagaggcgaagaaaagcuccaagaagcggaauagaaaacacucuggcgaugacagcuucgaugaaggcuccgugagcgagucugaauccgagagcgagucugggcaggccgaagaggaaaaggaggaagcugaggaggcccucaaagaaaaggagaaacccaaggaagaggaaugggagaagcccaaagacgcugccggacuggagugcaagccucgcccgcugcauaaaaccuguagccucuuuaugagaaacauugcccccaauaucucccgggcugaaauuaucucucugugcaagcgcuacccuggcuucaugagaguugcgcuuagcgagccccaaccugaacggcgcuuuuucagacgggggugggugacauucgaucgcuccgucaacauuaaagagaucuguuggaaucugcagaacauuagacuccgggagugcgaacugagccccggagugaaucgcgaccuuaccagacgggugagaaacaucaacggcaucacgcagcacaagcaaauuguccgcaaugauaucaagcuggccgcuaaacucauucacacccuggacgaucggacacagcugugggccucugagccggggaccccuccccucccuacaucccugcccagccagaacccuauccuuaagaauauuaccgacuaucugaucgaagagguuucugccgaagaggaggaacuccugggcuccagcggaggcgcucccccggaggaaccucccaaagaggggaaccccgccgaaaucaauguggagagagaugagaaacuuauuaaagugcuggacaagcuccugcuguaccuccgcaucguccauucccuggauuauuacaacacgugugaauauccuaaugaggacgaaaugccgaaccggugcggaauuauccacgugagaggccccaugccucccaaucgcauuucucauggggagguucuugaauggcagaaaacauuugaggagaagcugaccccucuccugagcgugcgggaaucccugucugaggaagaggcgcaaaagaugggaagaaaagaccccgagcaggaagucgagaaguucgugacaagcaacacccaggaacuuggcaaagauaaguggcucuguccucuguccgggaaaaaguuuaagggccccgaguucguucgcaaacacaucuuuaauaagcaugcugagaaaaucgaagaggugaagaaagaagucgccuucuuuaacaauuuccugaccgacgccaagcggccggcucucccugagauuaagcccgcccagccucccggaccggcucaaauccugccucccggccuuacaccugggcugcccuacccccaccagacgccucagggacucaugccguacggccagcccagaccucccauucugggguauggagccggcgcggugcggccugccguccccaccgggggcccuccguacccccacgcuccuuauggagccggccgcgggaacuacgaugcuuuuagaggacaaggcggguaucccggaaaaccucggaaucgcauggugagaggcgacccccgggccaucguugaauacagagaucuggacgcgccggaugacguggauuucuuuuga

SEQ ID NO: 76274 - RNA, 519 nt, Artificial Sequence
  derived and/or modified sequence opt5 from SRSF10__Homo_sapiens__NP_001287865
augagcagauaccugcggcccccuaacaccucccucuucgugcgcaaugucgccgacgauacaagaucugaggaccugcggcgcgaauuuggcagauaugggccgaucguugauguguacgugccccuugacuucuauacgcggcgcccuagaggauuugcuuacguccaguucgaggaugugcgggacgccgaagaugcgcugcacaaccucgaccgcaaguggauuugcggcagacaaaucgagauucaguuugcucagggggaucggaaaacccccaaucagaugaaggccaaagaaggacgcaacguuuauagcuccucuagauacgacgauuaugaccgguaccgcagaagccgguccagaucuuacgagcgccggagaagccgcucccggagcuucgauuauaauuacagacgcucuuauuccccucggaacagacccacaggccgcccucggagaagccgcucucauuccgacaaugacagccaagugucuaagaaaaagaacgagcgguga

SEQ ID NO: 76275 - RNA, 1455 nt, Artificial Sequence
  derived and/or modified sequence opt5 from SRSF11__Homo_sapiens__XP_011540729
augagcaacaccacagugguccccuccacggccggcccugggccgucuggaggccccgggggaggcgggggaggcggcgggggaggcgggggaaccgagguuauccaggugacaaaugugagcccuuccgcuucuagcgaacaaaugagaacccuguucggcuuucucgggaagauugacgagcugcggcuuuuucccccugaugacucuccccugccugucuccagccgcgugugcuucguuaaauuccacgauccggacuccgccguggucgcgcagcaucucacaaacaccguguuuguugauagagcucugaucgugguccccuacgccgaaggagugauuccugacgaggccaaggcucuuagccugcucgcccccgcuaaugccguggcgggccugcugccuggcgggggacuccugcccacaccgaacccucuuacccagaucggcgccgucccccuggcugcccucggggcuccuacgcuggaucccgcccuugcggcccugggacuccccggcgcuaaucugaacucucagucccuggccgcugaccaacuccugaaacuuaugagcaccguugauccuaagcugaaucacguggccgccgggcucgugucuccgucccugaaaagcgacacaucuuccaaggaaauugaggaggcuaugaagcggguccgcgaagcgcagagccuuaucuccgccgcuaucgagcccgauaaaaaggaagagaaaagacggcauucucgcagcagaucccggagccgcagacggcgcaccccuucuuccagcagacaccggcgcucuagaagccgguccagacgccggucucauagcaaguccagaagccgccggagaucuaaaagcccccgccggagacgcucccacucucgggagagaggacgccgguccagaagcacauccaagacccgggacaagaaaaaggaagauaaagagaagaaacgcucuaagacgccucccaaaagcuauuccacagccagacggucuagaagcgccucccgcgaacggagacgcagacggagccgcucuggcaccagauccccgaagaagccucggagccccaaacgcaagcugucuagauccccuagcccccggcgccacaaaaaggagaaaaagaaggacaaagacaaggaaagaucucgggaugagcgcgagagaagcacauccaaaaagaaaaagagcaaggacaaagaaaaggaucgggagagaaaaucugaauccgacaaggaugugaaacagguuacccgcgacuacgaugaggaggaacagggcuaugacagcgagaaggaaaagaaagaggaaaagaaaccuauugagaccgggucccccaagacaaaagaauguucuguggagaagggaacgggcgauagccuccgggaguccaaagucaacggggacgaucaucacgaagaggacauggacaugucugauuga

SEQ ID NO: 76276 - RNA, 786 nt, Artificial Sequence
  derived and/or modified sequence opt5 from SRSF12__Homo_sapiens__NP_542781
augagcagauacacccggcccccuaacacaucccuguucauccgcaauguggccgacgcuacgagaccggaggaucuccggcgcgaauuuggcagauaugggcccauugucgacguuuacaucccucuggauuucuauacccggcgccccagaggauuugccuacgugcaguucgaggacgugcgggaugcggaagacgcucuuuauaaccugaaucgcaagugggucugcggcagacaaauugagauccaguuugcccagggggaucggaaaacaccuggacagaugaagucuaaagaacgccaccccuguagcccuuccgaccauagacggucucgcagcccgucccaaagacggaccagaucucgcagcuccagcuggggccggaacagacgccggucugauucccucaaggagagcagacaccgccgguucucuuacucccagagcaaaucuagauccaagagccugccccgccgguccacaucugccagacagagccgcaccccucggagaaauuuugggucccggggacgcagcagaucuaagucccuucagaaacggagcaagucuauuggcaaaagccaauccucuagcccccagaagcagacauccagcggcaccaaaucuagaucccaugggcgccacagcgacucuaucgcucgguccccuugcaagagccccaagggauauacgaacuccgagaccaaagugcagacagccaagcauucucacuucagaagccacucccgcucuagaagcuaccggcauaaaaauuccugguga

SEQ ID NO: 76277 - RNA, 606 nt, Artificial Sequence
  derived and/or modified sequence opt5 from SRSF1__Homo_sapiens__NP_001071634
augagcggcgggggagugaucagaggccccgccgggaacaaugacugccggauuuacgucggaaaccugccuccggauauccgcaccaaggacauugaggauguuuucuauaaauacggcgcuaucagagacauugaucucaagaaucggcgcgggggacccccuuuugccuucguggaauuugaggaccccagagaugcggaagacgcuguguauggccgggauggcuacgacuaugauggguaccgccugagagucgaguucccucgguccggacgcggcacagggagaggaggcgggggaggcggcgggggaggcgcuccccgggggcgcuauggaccuccgucuagacggagcgaaaaccgcgugguuguguccggccuucccccuucugggagcuggcaggaccugaaagaucacaugagagaggccggagacgucuguuacgccgacguguaccgggauggcacgggcguuguggaguuugucagaaaggaagacaugaccuaugccgugcgcaaacucgauaauacaaaguuccggucccaugaggugggguacaccagaauccuguuuuucgaccaaaacuggauccaguggucuuga

SEQ ID NO: 76278 - RNA, 666 nt, Artificial Sequence
  derived and/or modified sequence opt5 from SRSF2__Homo_sapiens__NP_001182356
augagcuacggcagacccccuccggacguggaggggaugaccucccugaaggucgauaaccucacauaucggacgucucccgacacccugcgcagaguuuucgaaaaauacggacgggugggcgauguguauaucccucgcgacagauacacaaaggagagccggggguuugccuucguccgcuuucacgauaaaagagacgcugaagaugccauggacgcgauggauggagcugugcuugacggccgggagcugcgcguucagauggccagauaugggcggcccccugauucccaucacucucgcagaggacccccuccgcggcgcuacggcggcgggggauauggcagacggagcagaucuccccgccggagacgccgguccagaagccgcucccggagcagaucucgcucccggagcagaucucgcuacucccggagcaagucuagaucccggacccgcagcagaucccggucuacaagcaaauccagaagcgcccgccggucuaaguccaagagcucuagcguguccagaucucgcagcagaucccggagccgcucuagaucccggagcccucccccugucucuaaacgcgaauccaagagcagaucccggucuaaaagcccgcccaaguccccugaggaggaaggggcugugucuagcuga

SEQ ID NO: 76279 - RNA, 495 nt, Artificial Sequence
  derived and/or modified sequence opt5 from SRSF3__Homo_sapiens__NP_003008
augcacagagacagcugcccccuggauuguaagguguacgucggcaaccucggcaauaacggaaauaaaaccgagcuggaacgggccuucggcuauuacgggccucuucgcuccguuuggguggcuagaaacccgcccggauuugccuucguggaguuugaagacccucgggaugcggcugacgccguccgcgagcuggauggcagaacacucugcgggugucgggugcgcguugaacugucuaauggagagaagagaagccggaaccgcgggcccccucccuccuggggcagacggccucgcgacgauuauagacggcgcucuccgcccccuagacggagaagcccccgccggagauccuucucucgcagccgguccagaagccuuucucgcgaccggagacgcgagcggucccugagcagagaacgcaaucauaaaccuucucgguccuuuagcagaucucggucccgcagcagauccaacgagcggaaguga

SEQ ID NO: 76280 - RNA, 1395 nt, Artificial Sequence
  derived and/or modified sequence opt5 from SRSF4__Homo_sapiens__XP_011540253
augcccagaguguacaucggccggcugagcuaucaggcccgcgagagagacgucgaacgguucuuuaagggguacggaaaaauucucgagguugaucugaagaacggcuauggguucguggaauuugacgaucuucgcgacgcugaugacgccguguacgagcugaauggaaaagaucucugcggcgaaagagucaucguggagcacgcgcgggggccucgcagagacggauccuauggcucuggccggagcggguacggauaucgcagauccggccgggauaaguacgggccgcccacccgcacagaguacagacugauuguugaaaaccuuucuagccgguguuccuggcaagaccugaaagauuauaugcgccaggcuggagaggugacguacgccgacgcccauaagggcagaaagaaugaaggggucaucgaguucgugucuuauagcgauaugaaacgggcucucgagaagcuggacggaaccgaaguuaacggcagaaaaauucgccugguggaggacaagccuggcucccggagacgccggagcuacucuagaucccgcagccacucucgguccgggagcagaucucgcuccaaaagccgguccagaucucagagccgcucccggagcaagaaggaaaaaucuagaucccccagcaaggagaaaucucggagccgcucccauucugccggaaagagcagauccaaaagcaaggaucaggcugaagagaaaauccaaaauaacgacaaugucggcaagccuaagucucggucccccagcagacacaaaucuaaguccaaaagccgcucccggucucaggagagacgcguggaagaggaaaagagagggagcgugucccggggacgcucucaggagaaaagccucagacagucccggagccgcucuagauccaagggcgggagccggucucgcuccagaagccggucuaagagcaaagauaagcgcaaaggaagaaagcgguccagagaagagagccgcucucgguccagaagccgcuccaaaucugagcggagcagaaagcgcggcuccaagcgggacucuaaagccggcagcuccaagaaaaagaaaaaggaagauacagacagaucucaaagccgcuccccuagccggucugucuccaaggagagagaacaugcgaaaagcgagucuucccagcgggaagggcgcggagagagcgagaacgccggcaccaaucaggaaacaagaucucggucccgcagcaacuccaagagcaaaccgaaucugcccucugagagcagaucccggucuaagagcgcuuccaaaaccagaucucgcagcaagucccggucuagaagcgccucccgcagcccuucucgguccagaagccgcucucacucccggagcuga

SEQ ID NO: 76281 - RNA, 819 nt, Artificial Sequence
  derived and/or modified sequence opt5 from SRSF5__Homo_sapiens__NP_001307143
augagcggcugcagaguguucaucgggcggcugaaccccgccgcucgcgagaaggacgucgaaagauuuuucaaaggauacggccggauucgcgauaucgaccucaagagaggguuuggauucguugaguuugaagauccucgggacgccgaugacgcgguguaugagcuggauggcaaagaacuuuguuccgagcgcgugaccauugagcacgcuagagcccggucucgcgggggaagaggccggggccgcuacagcgacagauucuccucucggcgcccgagaaaugaucggagaaacgcucccccuguccgcacagaaaaucggcugaucguggagaaccucagcuccagaguuucuuggcaggaccugaaggauuuuaugcgccaagccggggaagugacguucgccgacgcucaucggcccaaacuuaaugagggagucguggaguuugccagcuauggcgaucugaagaacgcgauugaaaagcucuccgggaaagagaucaauggaagaaagaucaaacugauugaaggcagcaagcgccacucucgguccagaagccgcucucgguccagaacccgcagcagcucccggagcagaucccggucucgcagcagaucccggaaaagcuacucuagaucccgcagccggucuagaagccgcuccagaucuaagagccgguccguuagccgcucuccugugcccgagaagucccagaaaagagggucuucuucccggagcaaguccccugccucugucgaccgccagagaagccggucccgcucuagaagccgguccguggacagcggaaacuga

SEQ ID NO: 76282 - RNA, 1035 nt, Artificial Sequence
  derived and/or modified sequence opt5 from SRSF6__Homo_sapiens__NP_006266
augcccagaguguacaucggccggcugagcuauaacguccgcgagaaggacauucagagauucuuuuccggguacggacggcuccuggaaguugaucuuaaaaauggcuauggguucguggaguuugaagacucucgcgaugccgacgaugcuguguacgagcugaacggaaaggaacucugcggcgagagagucaucguggagcacgcccgggggccucgcagagaccgggauggauauagcuacggcucccgcucuggcgggggaggcuauagcuccagacggaccucugggcgcgacaaauacggaccgcccguuagaacagaauaccggcugauuguggagaaucuuagcucccgcuguagcuggcaagaucugaaggacuucaugagacaggcgggcgaagucacguaugcugaugcccauaaagagcggaccaacgagggggugaucgaauuuagaucuuacuccgacaugaagcgcgcccucgauaagcuggacggaacagagauuaauggccggaacaucagacugaucgaagacaaaccucgcaccagccaccggagaucuuauuccggcagccgcucucgguccagaagccgccggagaucccgcucucggagcagacgguccagccgcucuagaucccggagcauuucuaagagcagaucccgcucucggagcagauccaaagggcgcagcagaucucgguccaagggacgcaaaagcagaucuaaguccaagagcaaacccaaguccgaucggggcucucauagccacucccgcucuagaagcaaagacgaguacgaaaagucccggagccgcucuagaucccggagcccuaaagagaaugggaagggagauaucaaaucuaagucccgcagcagaucucagagccgguccaacagcccccucccuguuccgcccucuaaggcuagauccgugagcccucccccuaaacgcgccacaucccggucuagaagccgcucccggucuaagagcagaucccgcucucggagcuccagcagagacuga

SEQ ID NO: 76283 - RNA, 717 nt, Artificial Sequence
  derived and/or modified sequence opt5 from SRSF7__Homo_sapiens__NP_001026854
augagcagauacggccgguaugggggagagaccaagguguacgucggcaaccuggggacaggagccggcaaaggggaacucgagcgcgcuuucuccuauuacggaccccugagaacgguuuggaucgcccggaauccuccgggcuuugcguucguggaauuugaggacccccgcgaugcugaagacgccgugagaggccuugaugggaaggucauuugcggaucucgggugcgcguugagcugagcaccggcaugccuagacggucccgcuucgacagacccccugcccggcgccccuuugauccuaacgacagauguuaugagugcggggaaaaaggacacuacgcuuaugauugucaucgguacucucgcagacggagaagccgcucccggucuagaagccacucccgcagccggggcagacgcuacucucgguccagaagccgcucucgggggagacgcucccggagcgccucuccgagacggucccgcagcaucucccucagacggucuagaagcgcuucccugcgccggagcagaucuggauccauuaagggcagccgcuauuuccagucucccagcagaucccggucucgcagcagauccaucagccggccuagaucuucccgcagcaaaucucggucccccagcccuaagcgcuccagaucucccagcggcuccccgcggcgcucugccagcccugagagaauggacuga

SEQ ID NO: 76284 - RNA, 666 nt, Artificial Sequence
  derived and/or modified sequence opt5 from SRSF9__Homo_sapiens__NP_003760
augagcggcugggccgacgagagagggggagaaggcgaugggcggaucuacgugggaaaccugcccaccgacguccgcgagaaggaucucgaagaccuguucuauaaauacggccggauuagagagaucgaacuuaagaaucgccacgggcugguuccuuuugcuuucgugagauuugaggauccgcgggacgccgaggaugcgauuuauggacgcaacggcuacgacuauggccagugcagacuccggguggaguucccccgcacauacgggggaagaggcggguggccucggggaggccgcaaugggcccccuacgagacgguccgauuuucgcguccuggugucuggacuucccccuagcggcuccuggcaagaccugaaagaucauaugagagaagcuggcgacguuuguuaugccgaugugcagaaggacggggucggaaugguggaauaccuccggaaagaggacauggaguacgcccugagaaagcuggaugacaccaaguuccgcucucacgaaggcgagacaagcuauauccggguuuacccggaaagauccaccucuuauggguacagccgcucccggagcggaucuagaggccgcgauucccccuaucagagccgggggucuccucauuacuuuucccccuucagaccuuauuga

SEQ ID NO: 76285 - RNA, 414 nt, Artificial Sequence
  derived and/or modified sequence opt5 from SRXN1__Homo_sapiens__NP_542763
augggccugagagccgggggaacccucggccgggcuggggccggacgcggcgcgcccgaggggccuggaccgagcggcggcgcucaagggggauccauccacucuggcagaauugccgccgugcauaacgucccccugagcguucuuauccggccucugcccuccgugcucgacccugcuaaggugcagucucuggucgauacaauucgcgaagaccccgauagcgugccuccgaucgacguucuuuggauuaaaggggcccagggaggcgauuacuucuauuccuuugggggaugccacagauacgcugccuaucagcagcugcaacgggagacgauccccgcgaagcucgugcagucuacccugagcgaccugcgcgucuaccucggcgccuccacaccugaucugcaguga

SEQ ID NO: 76286 - RNA, 615 nt, Artificial Sequence
  derived and/or modified sequence opt5 from SRY__Homo_sapiens__NP_003131
augcagagcuacgccuccgcuaugcugucuguguucaacagcgacgauuauucccccgccguccaagagaauaucccugcgcucagacggucuagcuccuuucugugcaccgaaucuuguaacagcaaguaccagugcgagacaggcgaaaauuccaaagggaacguucaggaccgcgugaagagaccgaugaaugcuuucauuguguggagccgggaucagcgcagaaaaauggcccuugagaacccccggaugcgcaauucugaaaucuccaagcaacugggauaucaguggaaaaugcucacggaggccgagaaguggcccuuuuuccaggaagcucagaagcugcaagccaugcacagagagaaauaccccaacuauaaguaccggccucgcagaaaagcuaagaugcuucccaaaaauuguagccugcucccugccgacccggcgucuguccugugcuccgaagugcagcuggauaaccggcucuaucgcgacgauuguaccaaggccacacauagcagaauggagcaccagcugggccaucuucccccuauuaaugcugccucuuccccucagcaacgggaccgcuacagccacuggaccaagcuguga

SEQ ID NO: 76287 - RNA, 1257 nt, Artificial Sequence
  derived and/or modified sequence opt5 from SS18__Homo_sapiens__NP_001007560
augagcguggccuucgcugcccccagacagcggggcaagggggagaucaccccugcggcuauucagaaaaugcuggacgauaacaaucaccucauccaaugcauuauggacucccagaacaagggaaaaacaucugaauguagccaguaccaacagaugcugcauacgaaucuugucuaucuggccaccaucgccgauuccaaccagaauaugcagucucuccugccggcucccccuacacaaaacaugcccaugggcccugggggaaugaaucagagcgggcccccuccgcccccucgcucccacaacaugcccucugacgggaugguuggaggcggcccucccgccccgcauaugcagaaucagaugaacgggcaaaugccuggacccaaucacaugccuaugcagggccccgggcccaaccagcuuaauaugaccaacagcuccaugaauaugccuucuagcucccauggaagcaugggcggguacaaccacucugugccguccagccaaucuaugcccgugcagaaccagaugacaaugucccagggacaaccuaugggcaauuauggccccagaccuaacaugagcaugcagcccaaucaggggccgaugaugcaccagcaaccucccucccagcaguacaacaugccucagggaggcgggcaacauuaucagggacagcagcccccuaugggcaugauggggcaagucaaucagggaaaccacaugaugggccagcggcaaauucccccguaccgcccuccccagcaggggcccccucagcaauauucuggccaggaggauuacuacggagaccaguauagccauggcgggcagggaccgcccgaaggcaugaaucaacaguacuauccugaugggcacaacgacuacggcuaucagcagcccuccuacccugagcaaggauaugauagacccuacgaagacagcucucagcacuacuaugagggcggcaauucccaguacggacaacagcaggaugcuuaucagggcccucccccgcaacagggguacccuccccagcagcaacaguauccuggacagcagggcuaccccgggcaacagcagggcuauggaccgagccagggcgggccuggaccccaauacccuaacuacccccagggccaggggcaacaguauggaggcuaccggcccacccagccugggccgccccagccuccccaacagcgcccuuauggcuacgaccagggacaguauggcaauuaccaacaguga

SEQ ID NO: 76288 - RNA, 1191 nt, Artificial Sequence
  derived and/or modified sequence opt5 from SS18L1__Homo_sapiens__NP_945173
augagcguggccuucgcuuccgccagaccccggggcaagggggaggucacccagcaaacaauccagaaaaugcuggacgaaaaccaccaucucauucagugcauccuggaguaccagucuaagggaaaaacggcggaauguacccaauaucagcagauucuucaccgcaaucugguuuaccucgcuacaaucgccgauagcaaccagaauaugcaaucccugcuuccugccccgcccacccagaacaugaaucugggcccuggggcucucacacagucuggaagcucccagggccugcauucucaagggagccuguccgacgccauuagcaccggacugcccccuucuucccuccuucagggccagaucggcaacgggcccagccacgugucuaugcaacagacagcuccuaauacccugccgacgaccuccaugagcaucucuggacccggcuauucccaugccgggccugcgagccagggagugcccaugcagggccaagggacaauuggaaacuacgucuccagaaccaauaucaacaugcagucuaauccugugagcaugaugcagcagcaagccgcuacaucccacuauagcucugcccagggcggcucccagcacuaccaggggcaaagcucuauugcuaugaugggacagggcagccagggguccucuaugaugggacagcggcccauggccccguaucgcccuagccaacagggcuccagccagcaauaccucgggcaggaggaauacuauggagagcaguacucucauucccagggcgcggccgagcccaugggccaacaguauuacccugaugggcacggagacuaugcuuaccagcagagcucuuauaccgaacaauccuacgaucggagcuuugaggaauccacgcagcauuacuaugagggcgggaacucucaguacagccagcaacaggccggauaucagcaaggcgcugcccagcagcagacauacucccaacagcaguaucccucucagcaaagcuaccccgggcagcagcagggcuauggauccgcccaaggcgcuccuagccaguacccgggguaccagcagggacaaggccagcaguaugggucuuacagagcgccccaaaccgccccuuccgcucagcagcagcgccccuauggauacgagcaaggccaguaugggaauuaccagcaguga

SEQ ID NO: 76289 - RNA, 1227 nt, Artificial Sequence
  derived and/or modified sequence opt5 from SSB__Homo_sapiens__NP_003133
auggccgagaacggcgacaaugaaaagauggcugcccuggaggcgaaaaucugccaccagauugaauacuauuucggggauuuuaaccuccccagagacaaguuccugaaagagcaaaucaagcuggaugaaggaugggugccucuugagauuaugaucaaauuuaaucggcucaaccgccugaccacagacuucaaugucauuguugaggcucuuagcaaguccaaggccgaacugauggagaucucugaagauaaaacgaagaucagacggagcccguccaaaccccucccugaggugaccgacgaguacaagaacgaugugaaaaaucgcucugucuauauuaagggcuuucccacagacgccacccuggaugacaucaaggaauggcuggaggauaaaggacaggugcucaacauucagaugagacggacacugcauaaggcuuucaaagggagcaucuuuguuguguucgacuccauugaaucugccaagaaauuugucgagaccccuggccagaaguacaaagaaacagaucuucugauccucuucaaggacgacuauuuugcuaagaaaaaugaggagcgcaagcaaaacaaaguggaagccaagcugagagcgaaacaggagcaggaagccaagcagaaacuugaggaagaugcugagaugaaaagccuggaggaaaagauugggugucuccugaaauucuccggagaccuggaugaccaaaccugccgggaggaucuccacauccuguuuagcaaucauggcgaaaucaaguggauugacuucguucgcggcgccaaagaggggaucauucuuuucaaggaaaaggcuaaagaggcccugggaaaggcgaaagaugccaacaauggcaaccuccagcugagaaauaaggaggugacgugggaaguccuugagggggaaguggagaaagaggcucugaagaagaucauugaagaccagcaggagucucucaacaaauggaaguccaaaggacggcgcuuuaagggcaaagggaagggaaacaaagccgcucaacccggcagcggcaaggggaaggugcaguuccagggaaagaagaccaaauuugccucugaugacgaacacgaugagcaugacgaaaauggcgccacagggccugucaagagagcucgggaggagaccgacaaagaggaaccggcguccaagcaacagaagacagaaaacggagccggcgaucaguga

SEQ ID NO: 76290 - RNA, 447 nt, Artificial Sequence
  derived and/or modified sequence opt5 from SSBP1__Homo_sapiens__NP_001243442
auguucagacggcccgugcugcagguccuccgccaauuuguuagacacgagagcgaaaccacaacgucccuggugcuugagcggucucugaaccgcgugcaucuccugggcagagucgggcaggacccugugcuucggcagguugaaggaaagaauccggugaccaucuucagccuggccacaaacgagauguggcgcuccggcgauucugaagucuaccagcucggggacgugagccagaaaaccacauggcacagaauuuccguuuuucggcccggacugcgcgauguggcuuaucaauacgucaagaaaggcucuagaaucuaucuggaggggaagauugacuacggagaguauauggauaaaaauaacgugcggcgccaggccaccacaaucauugcggacaauaucaucuuccucagcgaucagaccaaggaaaaggaguga

SEQ ID NO: 76291 - RNA, 1026 nt, Artificial Sequence
  derived and/or modified sequence opt5 from SSBP2__Homo_sapiens__NP_001243662
auguacggcaaggggaaaagcaacuccucugccgugcccagcgacucccaggcuagagagaagcuggcccucuaugucuacgaauaucugcuucacguuggagcgcaaaaaucugcucagaccuuccugagcgagauccggugggaaaagaauauuacacucggcgagccuccgggguuucugcauuccugguggugcguguucugggaucuuuacugugccgcccccgaacgcagagagacgugcgagcacucuagcgaagcuaaagccuuucaugacuauuccgcugccgcggccccuagccccgugcugggaaacaucccucccggcgaugggaugccugucggaccggugcccccuggcuucuuucaggcucucggcgggguucccggaucucagccucugcugcccuccggcauggacccgacccggcaacaggggcacccuaauaugggaggccccaugcagcgcaugacaccucccagagggauggugccccucggaccucagaacuacggcggcgccaugcggccgccccugaaugcucuugggggaccuggcaugcccgggaugaacaugggaccuggcgggggacgccccuggccgaauccuaccaacgccaauagcauucccuauucuuccgcgagcccuggcaacuacgucgggcccccugggggaggcgggcccccgggaacaccuaucaugcccucucccgccgauuccaccaauagcggcgacaacauguacacacugaugaaugcugugccuccggggcccaacagaccuaauuuccccaugggcccuggauccgauggccccaugggcggacucggcgggauggagucucaucacaugaacggaagccugggcuccggggacauggauagcauuucuaagaacuccccuaauaacaugagccuuucuaaucaacccggcaccccgcgggacgauggagaaaugggcgggaacuuucugaauccuuuccagagcgaguccuauucucccagcaugacgauguccguuuga

SEQ ID NO: 76292 - RNA, 3780 nt, Artificial Sequence
  derived and/or modified sequence opt5 from SSFA2__Homo_sapiens__NP_001123917
auggacagaccccugagcuccucugccgaggcugaagaggaacucgaguggcaaguggccagccggcgcagaaaggcgugggcuaaaugccgguccucuuggcaagccagcgaaaccgaggaucuguccacagaggccacgacccaggacgaagaggaagaugaggaggaagaccuuccuggcgcucagcugccggccgcugggggacgcggcaacguccccaaugagaagaucgccauuuggcucaaagauuguagaacaccucugggggcgucucuugacgaacagagcuccagcacccugaagggaguucucgugcggaacggcgggucuuucgaggaugaccugucccugggagccgaagcuaaucaccuccaugagagcgaugcccaaaucgagaacugcaauaacauucuggcuaaagaacgcagacuucaguuucaccagaagggccggucuaugaacuccacaggcagcgggaagucuuccggaaccgugagcuccgucucugagcugcucgaacuguacgaggaagaccccgaggagauccuuuauaaucugggcuucgggcgcgaugaaccugacauugccagcaaaauccccuccagauuuuucaauuccucuuccuuugcgaagggaaucgauauuaaaguguuccucagcgcccagaugcaacggauggagguugaaaacccuaauuacgcucugacaucucgcuuuagacagaucgaggugcugaccacggucgccaacgcuuucagcucccucuauucucaggugagcggcaccccgcugcagcggauuggguccaugagcucuguuacauccaauaaggaaaccgaucccccucccccucuuacacgcagcaacaccgccaauagacugaugaaaacgcucucuaagcugaaccuuuguguggacaagacagagaaaggagaguccagcucccccucuccgagcgccgaaaagggcaaaauccugaacgucuccgugauugaggaaucuggcaauaagaacgaccagaaaagccagaagaucaugaaaaagaaggaguccagcucuaugcucgcuaccgugaaagaggaagucuccgggagcucugcggccguuacagagaaugcugacuccgaucggauuagcgacgaagccaacucuaauuuuaaccagggaaccgagaaugaacaaagcaaggagacccagucccaugagagcaaacugggcgaagagucugggaucguggaauccaagcuggauagcgacuucaacaucuccucucacagcgagcucgaaaauuccucugagcugaaaagcgugcauauuuccacaccugagaaggaacccugcgccccucuuacgauccccucuauuagaaacaucaugacccagcagaaggauagcuuugagauggaagagguccaauccacagaaggagaggcuccccacgugccugccaccuaccagcugggccucacaaaaagcaagcgcgaccaucugcuucggaccgcgucucagcacuccgauagcucuggguucgcugaggacuccacggauugucugagccucaaucaucugcagguucaagaaucucugcaggccaugggauccagcgccgacuccugcgacagcgagacaaccgugaccucucucggcgaagaucuggcuacaccgaccgcccaggaccagcccuauuuuaacgagagcgaggaagagucccuugucccucugcaaaaaggccucgaaaaggcugccgcgguggccgauaaaagaaagucugggagccaggacuucccccaguguaauacaauugagaacacgggaaccaagcaguccacaugcucuccuggcgaucacaucaucgaaauuaccgagguugaggaagaccuguuccccgcugagacaguggaacugcuucgcgaggccagcgcugaauccgaugucgggaaaucuagcgaguccgaguuuacccaauacacgacccaccacauccucaagagccuggccucuauugaagcgaaauguuccgacaugagcucugagaauacaaccggaccgccuuccagcauggaucgggugaacacagcccugcagagagcucagaugaaggucugcucccucucuaaccaacgcaugggccggagccugcuuaaauccaaggaccugcucaagcagagauaucuguucgccaaagcuggguacccccugcgccggagccagucucuuccuaccacgcuccugucccccgugagaguugugagcucugucaaugugcgccugagcccuggcaaggaaacacgguguagcccgcccucuuuuaccuacaaauauacaccugaggaggaacaggagcucgaaaagagaguuauggagcaugauggacaaagccuggugaaauccaccaucuucauuucucccagcuccgucaagaaagaagaggccccucagagcgaggccccgcggguggaagagugccaccauggccgcacccccacaugcucuagacuugcucccccucccaugucccagagcacguguucccugcacucuauccauagcgaauggcaggagcggccucucugcgaacacaccagaacacuguccacccacucugugcccaacaucagcggggcgacauguuccgccuuugcuagcccuuucggaugccccuacucucaucgccacgccaccuauccguaccggguuuguuccgucaauccucccagcgccauugagaugcaacugagacgcgugcuucaugacaucagaaacucucuccagaaucugucccaguauccuaugaugcggggccccgauccggcugccgcgccuuacagcacgcagaagucuagcgugcugccccucuaugagaacacauuucaagaacugcaggucaugcgcagaucccuuaaucuguuccggacccagaugauggaccucgagcuggcuaugcugcgccaacagaccaugguguaccaccacaugacagaagaggaaagauuugagguugaccagcuucaggggcuccggaacucugugcgcauggagcugcaagaucuggaacuccagcuggaggaaagacuucugggacucgaggaacagcugcgggccguccgcaugccuagccccuucagauccagcgcccugaugggcaugugcgggucccggucugcugacaaucuuagcugucccuccccucugaacgugauggagccgguuaccgagcucaugcaggaacaaucuuaccucaagagcgagcugggccugggacuuggcgaaaugggguuugagauucccccuggagaguccucugaaagcguguucucccaggccacaagcgagucuuccagcgucugcucuggccccucccaugcgaauagacgcacgggggugccuagcaccgcuucuguuggaaaauccaagacaccccugguggcccggaaaaaggucuuuagagccagcguggcucucaccccuacagccccgucccgcaccggcagcgugcagacgcccccugaucuggaaucuagcgaggaagucgacgcugccgagggggcgcccgagguugugggcccuaaauccgaaguggaggaaggacacggcaagcugcccucuaugccggccgcugaggaaaugcauaagaacgucgagcaggaugagcuucaacaggugauccgggaaauuaaagagagcaucguuggggaaauuagacgcgagaucguguccggacugcucgccgcugucucuagcuccaaggccucuaauagcaaacaggacuaucacuga

SEQ ID NO: 76293 - RNA, 2079 nt, Artificial Sequence
  derived and/or modified sequence opt5 from SSH1__Homo_sapiens__NP_001154802
auggcccuggugacccuccagagaagccccacaccuuccgcugccucuagcuccgcgucuaacagcgagcuggaagcuggcuccgaggaagaccggaaacuuaaucugucucucagcgaguccuucuuuauggucaagggggccgcccuguuccuucaacagggaagcucuccgcagggccagcgcucccugcaacacccccauaagcacgcuggggaucucccucagcaucugcagguuaugaucaaccugcucagaugcgaagaccggauuaaacuggccgugcgccuugagagcgcuugggccgauagagugcgguacauggucgugguuuauucuuccggacgccaggacacggaggaaaauauccugcucggcguggauuuuagcucuaaggaguccaaaagcuguaccauugggaugguccugagacuuugguccgacacaaagauccaccuggauggagacggcggcuucucugugagcaccgcggggcggaugcauauuuuuaagcccguuuccgugcaagccauguggagcgcucuccagguccugcacaaagccugcgaaguggcucgcagacacaacuacuucccuggaggcguggcccugaucugggcgacauauuacgagucuuguaucuccagcgagcagucuugcauuaaugaauggaacgccaugcaggaucucgagagcacccggcccgacuccccugcucuguuugucgauaagccgacagaaggggagcgcaccgaaagacuuaucaaagccaagcugcggucuauuaugaugagccaagaccucgagaauguuacguccaaagagauccgcaacgaacuggagaagcagaugaauuguaaccuuaaggaacugaaagaguucauugauaaugaaaugcuccugauccugggacagauggacaagcccagccucauuuuugaccaucuguaucuuggcucugaguggaacgcuuccaaucuggaggaacuccaagggagcggaguggauuacauccugaacgugaccagagagaucgacaauuucuuuccuggccuuuucgccuaucacaacauucgggucuacgaugaagagacaaccgaccugcucgcccauuggaacgaagcguaccacuuuaucaauaaagcuaagagaaaccacucuaaaugccuggugcauuguaagaugggcguuucccgcagcgccuccacagugauugcuuaugccaugaaagaguucggguggccccuggagaaggccuacaauuaugucaagcagaaacggucuaucaccagaccuaacgcuggauucaugcgccagcucagcgaauacgagggcauucuggaugccuccaagcagcggcacaauaaacuuuggagacaacagacggacucuagccugcagcagcccguggaugacccggcggggccuggagauuuucuccccgaaacaccugacggcacccccgagucccaacugcccuuccuggaugacgcugcccagccugggcuuggaccgccccucccuugcuguuuucgccggcugagcgacccccugcucccuucucccgaggaugaaacaggcucccugguucaucuugaggacccggaaagagaggcccugcucgaagaggcugccccucccgcugaggugcaccgcccugcccggcagccccagcaaggcagcgggcugugcgaaaaggaugucaaaaagaagcuggaguucggaucuccuaaaggcagauccgggagccuucuccagguggaagagaccgaacgcgaggagggacugggcgcggggcgguggggccagcugcccacccagcucgaccaaaaccugcuuaauucugaaaaccugaauaacaauagcaagagauccuguccgaacggaauggaggucggccgggcccgcccugcuggguggcauacacccagccuccccucucacuccaauuggccuacgagcgccuccgugguuggaaccacaggcaccagacaccauacacagcugaucuuuuucuauugccugcuuugggcuccgucuagccaccuccaggggcccgaaggauccuuuaccggcuga

SEQ ID NO: 76294 - RNA, 4353 nt, Artificial Sequence
  derived and/or modified sequence opt5 from SSH2__Homo_sapiens__NP_001269058
auggcccuggugaccguccagagaagccccacaccuuccacgaccucuagcccgugcgcuuccucuagccaccucgaggacuccgaaucugccgcgcugcuuuguugcgagugugaagagagcgaaaucuucacagauuccaacgaggcugacagcggcgaggaagagugccggucucaaccccgcuccauuagcgaaucuuuucugaccguuaagggggccgcccucuuccugccuagaggaaauggcuccagcacaccccggaucucucaucgcagaaacaaacacgcuggggaucuucagcagcaucugcaggccauguuuauucuccugcggccugaggacaauauccgccuggcugugagacucgaguccaccuaccaaaaccggacacgcuauaugguggucgugagcaccaauggaagacaggauacggaagaguccauuguucugggcauggacuucucuagcaacgauuccagcaccuguacaauggggcuugugcugccccucuggucugacacccugauccaccuugauggagacggcggcuuuuccgucagcacagauaaucgggugcauaucuucaagccuguuucugugcaggccauguggagcgcgcugcagucccuccacaaagccugcgaagucgcucgcgcccacaacuacuauccggggucucuguuucugaccugggugagcuacuaugagucccauauuaauagcgaccaaucuuccgugaacgaauggaaugcuaugcaggauguccagagccacagacccgacucuccugcccucuucacggacauccccacagagcgggagcgcaccgaaagacugauuaagacaaaacuucgggagaucaugaugcagaaggaucuggaaaacauuaccuccaaggagaucagaaccgaacucgagaugcaaaugguuuguaaucugcgcgaguuuaaagaguucauugacaacgagaugaucgugauccuuggacagauggauagcccuacacagauuuuugaacauguguuccugggcuccgaguggaaugcgucuaaccucgaagaccugcaaaacagagggguccgguacauccugaaugugacgcgcgagauugauaacuuuuuccccggaguuuucgaguaucacaauauccggguguacgacgaagaggccaccgaucuccuggcuuacuggaacgacacauauaaguuuauuagcaaagccaagaaacacggcuccaagugccuuguccauuguaagaugggggugucuagaagcgcuuccaccguuaucgccuacgccaugaaagaauauggauggaaucuggaucgcgcuuacgacuaugugaaggagcggagaacagucaccaaaccgaacccuagcuucaugcgccagcucgaggaauaccagggcauccugcuugcgucuaagcagcggcacaauaaacuguggagaucccauagcgauucugaccucuccgaccaccaugagcccauuugcaagccuggccuggaacugaacaaaaaggauaucacgacaagcgccgaccaaauugcugaggugaagaccauggaaucucacccgcccaucccuccggucuuuguggagcacaugguuccccaggaugccaaucagaaagggcucuguaccaaggagcgcaugauuugccuggaguucacaagccgggaguuucaugccggacagaucgaagacgagcuuaaccugaaugauaucaacggcugcuccagcggguguugccucaaugaaucuaaauucccucuggacaacugucacgcuuccaaggcccugauucaacccggacaugugccugagauggcgaauaaauuucccgaucuuaccgucgaggaccucgaaacagaugcucugaaggccgacaugaacgugcaucugcucccgauggaggaacugacgagcccucuuaaggaucccccuaugucccccgacccugagucucccagcccgcagccuuccugccagaccgaaaucucugauuucagcacagacagaauugacuuuuucuccgcccuggagaaauuuguugagcucucucaggaaacccggagccgcuccuucagccacucuagaauggaggaacugggcgggggacggaacgaguccuguagacugagcguggucgagguggcucccucuaaggugacagccgaugaccaacgcuccagcucucuuuccaauacgccccacgcuagcgaagaguccagcauggaugaggagcagucuaaagccaucagcgaacucguuuccccugacauuuuuaugcagucucacagcgagaacgcgaucuccgucaaggagauugugaccgaaaucgagucuaucagccagggcgugggccaaauucagcugaaaggggauauccugccgaaucccugccauaccccuaagaagaacuccauucacgaacuccugcuugagcgggcccagacacccgaaaauaaaccuggacauauggagcaagacgaggauucuuguaccgcucagcccgaacuggccaaggacagcggcaugugcaacccugaggggugucucacaacccacuccagcaucgcugaucuggaagagggagaacccgccgagggcgagcaggaacugcaggggucuggcaugcacccgggagcgaaaugguauccuggcuccgucagacgcgccacgcuugaguucgaagagagacuccggcaagagcaggaacaucacggggcugcccccacaugcaccagccugucuacacgcaaaaauuccaagaacgacagcuccguggcugaucuggccccuaagggaaagucugacgaggcucccccggaacauagcuucguucucaaagagccugaaauguccaagggcaaagggaaguacagcggaucugaggccggcucccugagccacucugagcagaaugcgaccgugcccgccccuagaguccuugaauuugaucaucugcccgacccccaggaggggccuggcagcgacaccggaacacaacaggaaggcgugcucaaagaucugcggacgguuauuccguaccaggaguccgaaacccaggcugugccccugccucuucccaagcgcgucgagaucaucgaguauacacacauugugaccucuccuaaccacacagggcccggaagcgaaaucgccaccuccgagaaaucuggcgaacaagggcucagaaagguuaauauggaaaagagcgugacgguccuguguacacuggacgaaaaccucaaucggacccuggauccuaaccaggugucccuucauccccaggugcugccccucccucacucuagcucccccgagcauaaucgcccuaccgaccaccccacaagcauucuguccucuccggaggauagaggaagcucccugucuaccgcccuugaaacagcugccccuuucgucagccacacgacccaucugcucuccgcgagccuggacuaccuccacccccaaacaaugguucaucuggagggcuuuaccgaacagucuuccacaaccgaugagcccagcgcugaacaggugucuugggaagagucccaggaaagcccucuuucuagcggguccgaggugcccuauaaagacucucaacugagcuccgccgaucucagccugaucuccaagcugggcgacaacacgggagaacuucaggagaaaauggauccucugccggucgccugccggcucccccacucuagcuccucugagaacauuaagagccugucccauucuccuggcgugguuaaagaacgcgcuaaggagaucgaaagcagaguggucuuccaggccgggcucaccaagcccucccagaugcggagaagcgcgucucuggcuaaacuuggauaccuggaccucugcaaggacugucugccugagcgcgaacccgccuccugcgagagcccgcaccugaaacuucugcaaccuuuucuccggacagauucuggcaugcacgccauggaggaccaggaaucccuggagaaucccggggcuccucauaaccccgaaccuaccaagagcuucguggagcagcucacaaccacagaauguaucguucagucuaaacccguggagagaccgcugguccaauaugccaaggaguuuggauccagccagcaguaccuucugccucgcgcuggccuggaacucaccuccagcgaagggggccugcccgugcuucagacgcaaggacugcagugcgccugucccgcgccuggccucgccguugcuccgcggcagcaacacgggagaacacauccccugcgccggcucaagaaagccaaugauaagaaaagaaccaccaacccuuucuauaauacaauguga

SEQ ID NO: 76295 - RNA, 735 nt, Artificial Sequence
  derived and/or modified sequence opt5 from SSMEM1__Homo_sapiens__NP_660311
augggcgaccuguucagccucuuuugggagguggaucccccuccgauccccgucaacugcgccauuccuaaucaggacuacgaauguuggaaggaugacuccugcgggaccaucggaucuuuccugcuuugguauuuuguuauuguguucgugcugauguuuuucagcagagcuuccgucuggaugucugaggauaaaaaggacgaaggcagcgggacauccacgucugugcggaaagccagcaaggagaccuccuguaaacgccaaagcaaggauucugcgugggaccccucccagacaaugaagaaaccuaagcagaaccagcucacccccguuacaaauagcgaaguggcucuggucaacgccuacccugagcaaagacgggcccgcagacagucucaguuuaaugaggugaaccagaaucaacacgauuccgacaccacagaauauggaagcgaggaaucuaacuccgaggcuagcuccuggaaagagucugaaagcgagcaucacccgucccccgauagcaucaagcggcgcaaaauggcccagagacagcggaaucuuggcucuuaccagauguccgaacgccauugccugcacuguaaggcucucagaaccaacgaguggcuggcccaucacagccggcaaaagccuucuguuacgcccccuaugaaacgcgacagccaggaagaguccucuauuagcgauaucaauaagaaauucuccaaguuuuga

SEQ ID NO: 76296 - RNA, 360 nt, Artificial Sequence
  derived and/or modified sequence opt5 from SSNA1__Homo_sapiens__NP_003722
augacccagcaaggcgccgcucugcagaacuacaauaacgagcucgugaagugcaucgaagaacugugucagaaaagagaggagcuuugccggcagauucaagaagaggaggacgaaaagcagcgccugcagaaugaggucagacagcucacagaaaaacuggcccggguuaacgagaaucuugcgcgcaagaucgcuagcagaaacgaguucgaucggacgauugccgaaaccgaggccgcuuaucugaaaauccucgaauccucucaaacacugcugagcgugcucaagcgcgaggccgggaaucugaccaaggcuacagcccccgaccagaaauccucuggaggcagagauagcuga

SEQ ID NO: 76297 - RNA, 732 nt, Artificial Sequence
  derived and/or modified sequence opt5 from SSPN__Homo_sapiens__NP_005077
augggcaagaacaaacagcccagagggcaacagcggcagggaggcccuccggccgcugacgccgcggggcccgaugacauggagccuaagaaaggaaccggcgcucccaaggaaugcggggaggaggaaccucgcacauguugcggauguagauucccccugcuccuggcccuucugcagcucgcccugggcaucgcugugacggucguuggcuuucuuauggccagcauuuccucuagccugcucgugcgggauaccccuuucugggcugggaucauugugugccuggucgccuaccugggacucuuuaugcuguguguguccuaucaaguugacgaacgcacaugcauccaguucucuaugaaacuucuguacuuucuccugagcgcgcuuggccugaccguguguguccucgccguggcuuucgccgcucaccauuauucccagcugacacaguuuaccugcgagacaacccuggauucuugucaaugcaagcucccgagcuccgagccccugagcagaacguucguuuaccgggacgugaccgauuguacaucugucaccgggacauuuaaacuuuuccugcucauucagaugauccugaaucuugugugcggacuggugugccuccuggccuguuuugucauguggaagcaccgcuaucagguuuucuacgugggcgugagaaucugcucccugaccgcgagcgaagggccucagcaaaagauuuga

SEQ ID NO: 76298 - RNA, 15444 nt, Artificial Sequence
  derived and/or modified sequence opt5 from SSPO__Homo_sapiens__NP_940857
augcuccuccccgcccuccuuuucggaauggcuugggcccuggccgacgggcgcuggugcgaguggaccgaaaccauccgggucgaggaagaggucgcuccucgccaggaagaucucguuccgugcgccucccuggaccacuacuccagacuuggauggcggcuggaucuccccuggucuggccgcagcgggcugacgagauccccugcccccggacugugcccuauuuacaagcccccugagacccggccggcuaaauggaaccgcacagugagaaccugcugccccggcuggggaggagcccauuguacagaggcucucgccaaggcgucuccugaaggccacugcuuugccauguggcaaugucagcugcaggcuggcagcgccaaugcuuccgccgggucucuugaggaaugcugugcccggcccuggggacagagcuggugggacggcuccagccaagccugccgcucuuguuccagcagacaucugccugggucugcuuccagccccgcccuccugcagccgcuugcuggagccgugggccagcuguggucucagcaccaacggccuuccgcuaccugcgcuagcugguccggguuccauuaccgcacauuugauggaagacacuaucacuuccucggccggugcaccuaccugcuggcgggcgccgcugacucuacgugggccguccaucucacccccggggaucgcuguccucagcccggacacugccagagagugacaaugggccccgaggagguucugauccaggccgggaacgugagcgucaaaggacaacuugugccugaaggccaguccuggcugcuccaugggcugagccuucaguggcugggagacuggcucguucugucuggcggccuggggguggucgugcggcucgauagaaccggauccauuagcaucucuguggaccacgagcuguggggccaaacacaggggcuuuguggacuguauaauggcuggccggaagaugacuuuauggagcccgggggcggacucgcuaugcuggccgcgaccuucggcaacagcuggcgccuuccuggguccgaaucuggaugccuggaugcugucgagguugcccagggcugugacccccucgggcugauugacgccgauguggagccuggacaccuccgggcugaagcccaggacgugugccaucaacuccuggagggccccuuugggcagugucacgcucaggucagcccggccgaauaccaugaggcgugccuuuucgccuauugugcuggcgccauggcuggauccggccaggaagggagacaacaggccgugugcgcgacguuugccagcuacguucaggcuugugcccgccggcacauccauaucagauggcgcaagccuggauucugcgagcggcugugccccggcgggcagcucuacucugauugugugucccugugcccucccagcugugaggcugucggacaaggcgaagaggaaucuugcagagaggaauguguguccgggugcgaguguccucgcggccuguuuuggaauggaacacuuugcguucccgccgcccacuguccgugcuauuacugucggcagagauaugugccuggcgacaccguccgccagcucugcaaccccugcgugugucgggaugggagauggcacugcgcucaggcgcugugucccgccgagugcgcugucggaggcgacgggcauuaccugacauucgauggacggagcuauuccuuuuggggcgggcaaggcugucgcuacucucucgugcaggacuauguuaaaggacagcugcuuauucugcucgaacacggcgccugcgaugccgggagcugucugcaugcuaucuccgugucucuggaggacacccacauucaacuuagagauagcggagccguccucgugaauggccaggacguugggcugccuuggaucggagcggaaggccuguccgugcggagagcuagcucugccuuccuccugcuucgcuggccgggcgcccagguccugugggggcucuccgaccccguggcuuacauuacccuggauccucggcacgcccaucaggugcaaggacugugcggcacauucacgcagaaccagcaggacgauuuucuuacccccgcgggggacguugagacaagcaucgcugccuucgccucuaaguuucaagucgcuggaaagggcagauguccuuccgaggauagcgcccuccugucucccugcaccacacacagccagcgccaugcuuucgccgaagcggccugugcuauucugcacuccagcguguuucaggagugccauagacucguggacaaagaaccuuucuaccugcggugccuugccgcugucugugggugcgaucccggaucugacugucugugcccggugcucuccgccuaugcccgcagaugugcucaggagggcgcgagcccucccuggcggaaucaaacccugugcccuguuaugugucccggcgggcaggaauaccgcgagugcgccccggcuuguggacagcacugcggcaagccugaggauuguggggaacugggauccugcguggccggcugcaacuguccccuugggcuccugugggacccugagggacaaugcgugccgcccucucuguguccuugccagcucggcgccagacgguaugcuccgggcagcgccacgaugaaagaauguaaucgcugcaucugucaggagagagggcuguggaacugcacagcgcggcacugucccucccaggcuuuuugcccucgcgaacuuguguacgcccccggagccugucugcugaccugcgauucuccuagcgcuaaucauuccugccccgccggcucuaccgacggguguguuugcccuccgggaacagugcugcuggaugagagaugugugcccccugaccuuugccccugucggcacagcggccaaugguaucugccuaacgcgaccauccaggaggacugcaauguguguguuugcagagggcgccaguggcauuguacaggacagcggagauccggccgcugccaagcuagcggcgcgccccacuacgugacguucgaugggcucgccuuuaccuauccgggagcuugugaauaccugcucguccgggaggccucuggccuguucacaguguccgcucagaaccuuccuugcggggccagcggacugaccuguacaaaggcgcucgccgugagacuggaaggcaccgucguucauaugcugcgcgggcgggcugugacggugaacggagucucugugacaccgcccaaaguuuacacaggcccuggccuuucccugagacgcgccgggcucuuucugcuccugagcacccaccuuggacugacacuccugugggacggcgggacccgggugcugguccagcuuucuccccaguucagaggacggguggcuggccugugcggggauuuugacggagaugccuccaaugaccuccgcagcagacaaggcguucuggagccuacggccgaacucgcugcgcacuccuggcggcugagcccgcuuugccccgagccuggcgaucugccccauccuuguacaaugaacacccaccgcgccgggugggcuagagcccggugcggagcccugcuccagccccuguucacacuuugucaugcugaggugccgccucagcagcacuaugaauggugccuguacgacgccuguggcugcgauucugggggagacugugagugccucuguagcgcgauugcuaccuaugccgaugaaugcgccagacacggccaucacguccgcuggcggucccaagagcuguguucucuccagugcgaagggggccagguguacgaggcuugcgggcccaccuguccucccacaugccaugagcaacacccugaacccggcuggcauugucagguuguggccugcgucgagggguguuucugcccggaaggaacgcugcuucacggcggggcgugucuggagccugccagcugccccugugaguggggaagaaauuccuuucccccuggcucugugcugcagaaggacugcgggaacuguaccugccaggaaggccaauggcacugcggaggcgaugggggacauugugaggaacucgugccggcuugcgccgagggcgaagcucugugucaggagaaugggcacugcgucccccauggauggcuuugugacaaccaggacgauugcggcgacgggagcgaugaggaaggcugugccgcuccuggaugcggcgaggggcagaugacauguuccucuggacacugccugccccucgcccugcucugugaccgccaagaugacugcggcgaugggaccgacgaaccuagcuaucccugcccucagggacugcuugcgugugccgauggccggugccugccgcccgcucugcucugugacgggcacccugauugccuggacgccgcugacgaggaauccugucuuggccagguuacaugcgugcccggagaggugagcugugucgauggaaccugccugggggccauccagcucugugacggagugugggauugcccugacggcgccgaugaggggcccggacauuguccgcugccuucucuccccacgcccccugcuuccacacugcccggcccuagcccgggcucucuugacaccgcguccagcccccuggccuccgcuucuccugcgcccccuugcgggcccuucgaauuuagaugcggaagcggcgaguguaccccgcgcggguggcggugcgaucaagaagaggacugugccgauggauccgacgagagaggcugcgggggaccuugugcuccccaccaugccccuugcgcgcgcggcccccacuguguuagcccugaacagcugugcgauggcgugagacagugucccgacgggucugaugagggaccggacgccugcggcgggcucccugcucugggaggccccaaucggacagggcuucccuguccugaauauaccugcccgaacggaacaugcauuggcuuccaacuggucugugacggccagcccgauugcgggcgcccuggacaggugggccccuccccugaggaacagggguguggagccuggggccccuggagcccuugggggcccugcucuagaacguguggaccguggggccaaggccggagccgcagaugcuccccucucgggcugcugguucuccagaauugucccggaccugagcaucagucucaggcuugcuuuaccgccgcgugucccguggacggcgaguggagcacaugguccccguggucugucugcagcgaaccuugucgggggaccaugacaagacaacgccagugccacagcccccagaacggaggccggaccugcgccgcccuucccgggggacugcacagcacgagacagaccaagccuuguccccaagauggcugcccuaaugccacauguucuggcgagcugauguuccagccgugcgcucccuguccucugaccugcgacgauaucuccgggcaggucacaugucccccugacuggcccugcggaagcccuggcuguuggugcccggaagggcagguccugggauccgagggcugguguguguggccccgccaaugcccuugccuuguugauggggcccgguauuggcccggacagagaauuaaagcugacugucagcugugcaucugucaagauggccggccucgcagaugccggcucaaccccgacugugccguggauugcggcuggucuagcugguccccgugggcgaagugucuggggccuugcggaucucagagcauccagugguccuuucgcagcucuaauaaccccagacccuccggccgggggcgccaguguagaggcauucaucggaaagcccgcagaugccaaaccgaaccuugugagggcugcgagcaccaggggcagguccaucgggugggagaaagauggcacggcggccccugccgcguuugucagugccugcacaaucucacagcucauuguagcccuuacugcccgcuugggucuuguccccaaggaugggugcuggucgagggcaccggggaauccugcugucacugcgcccugccuggagagaaccagacggugcagcccauggcuacacccgccgccgcgcccgcuccgagcccucagauccgguucccccucgccaccuacauucugccucccucuggcgacccguguuauagcccucuugggcuggcuggccucgccgaaggaucccugcaugccucuagccaacagcuggagcaccccacccaggcugcccuccuuggcgcgcccacacaagggccuagcccccagggauggcaugccggcggggaugcuuacgccaaguggcacaccagaccucacuaucugcagcuggaccuccugcagccgcgcaaccuuacgggaauccuggugcccgagacaggcagcuccaaugcuuacgccucuagcuuuucccuccaauucucuagcaacgggcugcauuggcacgacuaucgggaucugcucccuggcauucuuccccugccuaaacuguuucccagaaauugggacgaucucgacccugcgguuuggaccuucggacgcaugguccaggcccgguuugugagaguguggccgcaugauguccaccauuccgacgugccccugcagguugaacuucugggcugcgagccugggucucccccugcuccccucuguccgggagugggccugcgcugcgccagcggggaaugcguccugcggggaggcccuugugauggggugcucgacugcgaggauggcuccgacgaggaaggauguguucuucugcccgagggcacagggagauuccacagcaccgcuaagacacuggcccucucuuccgcucagcccggacaacugcuucacuggccucgcgaaggccuggccgagaccgaacauuggcccccugggcaggagagcccgacgucucccaccgagacacggccugugucccccggaccugcgagcggcgucccccaccauggggaaucugugcagaugguuaccacaaccccgaucccucagauggaggccagaacgcugcccccuggcauggcugccgugacagucgugcccccucaccccgugaccccggcuacacccgccggacaauccgucgccccuggccccuucccuccgguucagugcgggcccggacagaccccuugugaagugcugggcugcguggagcaagcgcaggucugugaugggcgcgaagacugccuggacggaagcgaugagagacacugugcucggaaccuccuuauguggcugcccucccugccugcccucugggccgcuagcaccgugcccuuuaugaugccuacaauggcccugcccggccuuccggcuucucgcgcccugugcagcccuucccagcucucuuguggcagcggggagugccuguccgcggaaagacggugcgaccugagacccgauugucaggacggaucugaugaggacggcugcguugauugugugcucgccccuuggagcgucugguccucuugcagccgguccugugggcuuggacugacguuccaacgccaggaacugcucagacccccgcugccuggcgggagcugcccccgggaccgcuuuagaucucaguccuguuucgugcaggcuugccccguugccggagcuugggccaugugggaggcguggggcccuuguagcgugucuugcggcgggggacaucaaucccggcagcgcagcugugucgaucccccuccgaaaaauggcggggcccccugcccuggagcuucccaggaaagagcccccugcggccuucagccuuguucugggggaaccgacugcgagcugggccggguguacgucagcgcugaucucugucaaaagggccuggugcccccgugcccucccuccugucuggacccuaaggccaaccgcagcugcucugggcacuguguugagggaugcagaugucccccuggccuccuucugcaugauacacggugccugccccucuccgaauguccgugccuggugggggaggaacuuaaauggcccggagugagcuuucugcucggcaauuguucucagugcgucugcgagaagggggagcugcugugucagccuggaggcugcccccucccuuguggcuggagcgcuugguccucuugggcccccugcgaccgcagcuguggguccggaguuagagcgcgguuccgcucuccuagcaacccgcccgccgcuuggggcggggccccuugcgaaggagacagacaggagcuucaaggcugucacaccgugugcgggacagaaguguuuggauggacccccuggacguccuggagcucuuguucccagagcugccuggccccuggcggcgggcccggauggcgguccagaucucgccuguguccgagcccuggcgauuccucuugccccggggacgcuacacaggaggaaccuugcuccccucccgucuguccugugcccuccaucuggggacucugggcccccuggucuaccugcuccgcgccuugugauggcgggauucaaacccggggaagauccugcagcucucuggcucccggcgacacaaccuguccuggcccgcauucccagacacgcgauugcaauacgcagcccuguaccgcccagugcccugagaacaugcuuuuccggagcgccgagcaaugucaccaggaagggggacccugcccuagacugugucucacacagggccccgggaucgagugcaccggauuuugcgcuccuggcuguacaugcccgcccgggcuguuccugcacaaugccucuugucucccucgcucccagugccccugucaacugcauggacagcuuuaugcuagcggcgccauggcgcggcuggacucuugcaacaauuguaccugcguuagcggcaaaauggccuguacguccgaaagaugcccuguggcuuguggguggagccccuggacccucuggucccugugcucuugcagcuguaacgucggcauucgccggagauuucgcgccggcacagcuccgcccgccgcguucgggggagccgagugccagggcccuaccauggaagcugaguucuguucccuucggcccugcccugggcccggcggagaguggggcccuuggucuccguguagcgugcccugcgggggaggcuacagaaaucggacaagaggguccucucgcagccugauggaauuuuccaccuguggacuccagccuugcgccggccccgucccugggauguguccccgggauaagcaauggcuggacugcgcucagggcccggccagcugugccgagcugucugcuccuagaggaacaaaccagacgugccaccccggcugccauuguccuuccgggaugcuccugcuuaacaaugugugcguucccacccaagauuguccuugcgcgcacgaaggacaccuguacccucccggcagcacagugguccgccccugugagaacugcucuuguguguccgggcucaucgccaauugcagcucuuggcccugugcugaaggagagcccaccugguccccuuggacccccuggagccagugcucugccuccuguggcccggccagaugccaucggcaccgcuucugcgcuagaagcccuagcgccguucccuccacaguggcgccucugccccuuccugcuacgcccaccccgcuguguucugggccugaggccgaagaggaacccugccuccugcagggcugugaccgggccggaggcugggggccuuggggacccuggagccauugcucccgcucuuguggcgggggacugagaagccggacacgcgcuugcgaucagccgcccccucaaggccucggggacuauugugagggccccagagcccagggagaggucugccaggcucugccuugucccgugaccaacugcacagccauugaaggcgcggaguacuccccuugugggccgcccugcccucggucuugcgacgaucuugugcacuguguuuggcgcugccagcccggauguuauugcccucccggccaaguccugagcuccaauggggccaucugugugcagccgggacauugcagcugucucgaccugcuuaccggccagagacaccacccuggcgcucggcuggcccgccccgaugggugcaaccauuguacgugccucgaaggaagacugaauuguacagaccugccuugccccgugccuggcggguggugccccuggucugaguggaccauguguucccagccgugccggggacaaaccagaagccgcucucgggcuugugccugccccacaccucagcacggcggggcgcccuguaccggagaagccggcgaggcuggcgcccagcaucagagagaggcuugcccuuccuacgccacaugucccgucgauggggccuggggaccuuggggcccguggagccccugcgacaugugucucgggcaaucccaccgcucucgggcuugcagcagaccucccaccccugaaggaggccgccccuguccggggaaccauacgcagucccggccuugccaggaaaauucuacacaaugcaccgauuguggaggcggccagagccugcaccccugcgggcagccuugucccagauccugccaggaccuuagcccgggaucuguuugucaacccggcuccguggggugccagccuacauguggaugcccccugggccagcucagccaggaugggcugugugugccucccgcgcacugccgcugucaauaucagccuggagccaugggcauuccggaaaaccagucucggagcgcuggcuccagauuuucuagcugggagucccuugaacccggggaggucgugaccggaccuugcgacaauugcacguguguugccggcauccugcagugccaagaggugcccgauuguccugaccccggggucuggagcucuuggggaccuugggaagauugcuccgugagcuguggcgggggagagcagcuccggucccgcagaugcgcccggccgcccuguccuggccccgcucgccagucuagaaccugcagcacacaaguuugucgggaagccggcugcccugcggggagacuguaccgcgagugucagcccggagaaggcugcccguucuccugcgcucaugugacccagcaggucggguguuuuucugagggaugcgaggaaggcugucacugccccgaggggacauuccaacaucggcuggccugugugcaggaaugcccuugugugcucaccgccuggcugcuucaggagcugggagcuacaaucggcgaccccggccagccucucgggcccggagacgagcuggauagcggccaaacccuuagaacguccugcgggaacuguucuugcgcccacggaaaacugagcuguucccucgacgauugcuuugaagcugacggcggguucggaccuuggagcccguggggccccugcucucgcuccuguggcgggcugggaacacggaccagaagccgccagugcguccugaccaugccuacacucucuggccagggguguagaggaccccggcaggaucuggagugcccuucccccgacuguccgggcgccgaagggagcaccguugagccugugacaggccuucccggaggcugggggccuuggucuagcuggucccccugcagccgcuccuguacggauccugcgagacccgccuggcggucucgcaccagacugugccucgcuaauuguacaaugggagacccgcugcaagaacggcccugcaaccuuccuagcuguaccgagcugcccgugugcccuggccccgggugcggagccggcaauuguuccuggacaucuugggcuccgugggagccuugcagccgcuccuguggggucggccagcagagacggcucagagccuauagacccccuggacccggcgggcacuggugcccuaacauucugaccgcguaccaagaacggagauuuuguaaccugcgcgccugccccgugccgggaggcuggucucgguggagcccuugguccuggugugauagaagcugcgggggaggccagucucuccgcucccggagcuguucuagcccucccagcaagaaugggggcgcucccugcgccggagagagacaucaggcucggcuguguaacccgaugcccugcgaagccggcuguccugccgggauggagguugugacgugcgcuaaucgcugccccagacgguguucugaccuucaggaaggaaucgucugccaagaugaccaggugugucagaagggcugccgcuguccuaaagggucccuggagcaggauggaggcugcguucccauuggccacugugacugcaccgacgcgcaagggcauagcugggccccuggaucucagcaccaggaugcuuguaacaauugcuccugucaggccggccaacucagcugcacagcccagccgugucccccucccacccauugugcuuggucccacuggagcgccuggucuccuugcagccacuccugugggcccagaggacagcagucucgguuccgcagcuccacaucuggcagcugggcgccggagugcagagaggaacagucccagagccagccuuguccccaaccuucuugucccccucugugucuucaggggacccgguccagaacgcugggagacagcuggcuccagggcgaaugccagcgcuguucuugcacacccgagggcgugaucugugaagauaccgagugcgcugucccggaggccuggacacugugguccagcuggucugacugccccguguccugugggggaggcaaccaaguucggaccagagccugccgcgcugccgcuccucaucaccggagcccucccugucuggggcccgauacccagacaagacagcagccuugcccgggacuucuggaagccuguuccuggggccccugggggccuugcucucgcagcuguggacccggccucgcgucccggagcggcucuugcccuugucugauggccaaggcugaccccacgugcaauuccaccuuucuccaucuggauacacaaggguguuacagcggaccgugcccugaggaaugcguguggucuagcugguccucuuggaccagauguagcugccgcguccuugugcagcagcgguauagacaccagggccccgccucccgcggggcuagagccggagcgccuuguacacggcuggacggccacuuccgccccugccugauuagcaacuguucugaggauuccugcaccccgcccuuugaguuccaugccugugggagcccuugcgcuggacucugugccacgcaccugucucaucaacuuugccaggaccugcccccuugucagcccggcugcuacugcccuaaaggccuccuggaacaagcugggggauguaucccgcccgaggaaugcaauuguuggcacacauccgccgcgggcgccgggaugacccucgcuccuggagauagacugcagcugggcugcaaggagugugaaugccggagaggggagcuucauuguaccagccagggaugccagggccugcucccccuguccgaguggucugaauggagcccuuguggccccugccuuccuccguccgcccuggcucccgccucucgcacagcccucgaggaacacuggcugcgggacccuaccgggcucagccccacacuggcuccucugcuugccuccgagcaacacagacaucggcugugucucgaccccgcgacgggacgcccguggaccggcgcuccccaccugugcacagccccucuuagccagcagagacugugccccgauccuggggccugucccgacucuugccaguggucccucuggggaccuuggagcccgugucaaguccccugcucuggcggguuccggcugcgcuggagagaagcugaggcccuguguggaggcggcugccgggagccuugggcgcaggaauccuguaacgggggacccugcccugagugugaagcucaggauaccguguuuacacucgacugcgccaaucaguguccccauagcugcgccgaucugugggaccgcguucaaugccuucagggcccguguagaccugggugccggugucccccuggacagcuggugcaggauggccgcugcguccccaucucuuccuguagaugcgggcucccuagcgcuaacgccagcugggagcuggcucccgcccaagcggugcagcuugacugucagaauugcaccugugugaacgaaucccugguuugcccgcaccaagagugucccgugcucggaccuuggucugccuggagcuccugcucugcucccugcggcggcgggacgauggagcggcaccgcaccugugaaggaggcccuggggucgcccccugccaggcucaggauacagagcagagacaagaauguaaucugcagccgugcccugagugucccccuggacaggugcugagcgccugcgcgaccuccugucccugccucuguuggcaucugcagccuggcgccauuugcguucaagagcccugucagccggggugcggcugcccuggaggccagcuucugcacaacgggacaugugugcccccuaccgcuugccccuguacacagcauucucucccguggggacugacccuuacgcuggaggaacaagcccaggaacugcccccuggcacaguccugacccggaauugcaccagaugugugugccacgggggagcuuucagcuguucccuggucgacugccaggugcccccuggcgagacauggcaacagguugcccccggggaacucggccugugugagcagacgugccuugagaugaacgccaccaaaacacagucuaacuguagcuccgcucgcgccagcggaugcgugugccaaccuggccauuuucggucucaggcggggccguguguccccgaagaucacugcgaguguuggcaccugggaagaccucaucuccccggcuccgaauggcaggaggcuugcgaaagcugucugugccuuucugggcgcccuguguguacccagcacugcagcccccucacaugugcccaaggagaggagaugguucucgaaccgggcuccugcuguccuucuugccggagagaggcccccgaggagcaguccccuagcugccagcugcugaccgaacuccgcaauuucacaaaggggaccuguuaucuggaccagguggaggucuccuacugcagcggcuauugucccucuagcacgcaugugaugccugaggaacccuaccuucaaucccagugcgauuguugcucuuaucggcuggacccggagagccccgugagaauccucaaccugcgcugucuuggaggccacaccgaaccuguuguccugcccgugauucauuccugccaguguucuagcugccaagggggagacuuuuccaagcgguga

SEQ ID NO: 76299 - RNA, 861 nt, Artificial Sequence
  derived and/or modified sequence opt5 from SSR1__Homo_sapiens__NP_003135
augagacugcucccccggcugcuucugcuccugcuucugguguucccugccaccguccucuuucgcggcgggccgagaggacugcuggcuguugcccaagaccucacagaggaugaagagacgguggaagacagcaucauugaggaugaagacgaugaggcggagguggaagaggacgaacccaccgaucuggucgaggacaaggaggaagaggauguguccggcgaaccugaggcuucucccagcgccgacacaaccauccuuuucguuaaaggggaagauuuuccugccaacaauauugugaaguuccuggucggauuuacaaacaaaggcaccgaggacuucaucguggagucccucgaugcuucuuuucgguacccccaagacuaucaguucuacauucagaauuuuacagcccugccucuuaacaccguugugccgccccagcgccaagcuacguucgaauauagcuuuaucccugccgagcccaugggagggagaccuuucggccuggucaucaaucucaacuacaaggaccugaauggcaacguguuucaggaugcgguguucaaucagaccgucacaguuauugaacgggaggacgggcuggauggagaaaccaucuucauguauauguuucucgccggccuggggcuucuggugauugugggacuccaccagcugcuugagucccgcaaaagaaagcggcccauccaaaaggucgagaugggcacaucuagccagaacgacguggauauguccuggauuccgcaggaaacccugaaucagaucaacaaagcuagcccucgcagacucccccggaagcgcgcccagaaaagaucuguuggguccgacgaguga

SEQ ID NO: 76300 - RNA, 609 nt, Artificial Sequence
  derived and/or modified sequence opt5 from SSR2__Homo_sapiens__XP_011508225
augcugacccucagcuccugccuguguggcucugggaaggccuucggaaugcccacaaugagacuucugagcuuugugguccucgcucuguucgccguuacgcaggcggaggaaggcgcucggcuucuggccuccaaaucucuccugaaccgcuacgccguggaggggagagaccugacccuccaauauaauaucuacaacgugggaagcuccgcugcccuggaugucgaacuuucugacgauagcuuuccuccggaggacuucggcauuguguccgggaugcugaauguuaagugggaucggaucgcucccgccagcaacgugucucacacagucgugcuccgcccucugaaagcgggauauuuuaauuucaccuccgccacaauuaccuaccuugcucaggaagacggccccguugugaucggcagcacaucugccccugggcagggaggcauucuggcucagagagaguuugaucggcgcuucagcccccauuuucucgacugggccgcguucggggucaugacccugccuuccaucggaaucccgcugcuccugugguauucuuccaagagaaaauacgauacgcccaagaccaagaaaaacuga

SEQ ID NO: 76301 - RNA, 2130 nt, Artificial Sequence
  derived and/or modified sequence opt5 from SSRP1__Homo_sapiens__NP_003137
auggccgagacccuggaguucaacgacguguaccaggaagucaagggcagcaugaaugaugggagacuccggcugucccgccaaggaaucauuuuuaaaaacucuaagaccggcaaaguugacaauauccaggcuggggaacuuacggagggaauuuggagacggguggcccugggccacgggcucaagcugcuuaccaaaaacggacauguguauaaguacgauggcuuccgcgaaagcgaguuugagaagcuguccgacuucuuuaaaacacacuauagacucgaacugauggagaaggaucugugcgucaaaggcuggaauugggggaccgugaaguucggaggccagcuccugucuuuugacaucggggaucagcccguuuucgaaauuccucuuagcaacgugucccaauguacaaccggcaaaaaugaggucacacuggaguuucaucagaacgacgaugcggaagugucucucauggagguucgguucuacgugccgcccacccaggaagacggagucgauccuguggaggcuuuugcccagaaugugcugagcaaggccgacgucauccaagcuacgggggaugccaucugcauuuuccgcgaacuucagugucugacccccagaggacgguaugacauccgcauuuacccuacauuucuccaucugcacggcaagaccuucgacuauaaaauccccuacacaaccguucugagacucuuccugcuuccucacaaggaucagcggcagauguuuuucgugauuucccuggacccgcccaucaaacaaggccagacgcgcuaccacuuucucauucugcuuuucagcaaggaugaggacaucucucugacacucaacaugaaugaggaagagguggagaaaagauuugaagggcggcugaccaagaacauguccggaagccuguaugaaauggucucucgcgugaugaaagcucucguuaauagaaagaucacagugccuggcaacuuccaggggcauuccggagcccaaugcauuaccuguagcuacaaggcgucuuccggccugcuuuauccccuggagcggggguuuaucuacguccacaaaccucccgugcauauuagauucgaugagaucagcuuuguuaauuucgcccgcggaaccacaacgacccgguccuuugacuucgaaauugagacaaagcagggcacccaguauacauuuucuagcaucgaaagagaggaauacggcaaacucuucgauuucgugaacgcuaagaaacugaacaucaagaaucgcgggcuuaaggagggaaugaacccguccuaugacgaguacgccgauagcgacgaagaucagcacgacgcuuaccuggagcggaugaaagaagagggcaagauuagagaggaaaaugccaacgacucuuccgaugacagcggggaggaaaccgaugagucuuuuaauccuggagaagaggaggaagacgucgcggaggaguucgauagcaacgccuccgcuucuagcuccagcaaugaaggcgacucugaucgcgacgagaaaaagcggaaacaacucaagaaggccaaaauggcuaaggauagaaaaucccgcaagaaacccguggaagucaagaaggggaaagacccuaacgcccccaagcggcccaugagcgccuauaugcuguggcugaaugcuucuagagagaaaaucaaguccgaucacccuggcauuagcaucacggaccucuccaaaaaggcgggagaaauuuggaaaggcaugucuaaggagaagaaagaagagugggaucgcaaggccgaagacgcucggagagacuacgagaaagccaugaaggaguaugaagggggacggggcgagagcuccaaacgcgauaagucuaagaaaaagaaaaaggugaaaguuaagauggaaaagaaaagcacaccguccagagggucuagcuccaagucuagcucccggcagcugagcgagucuuuuaaaagcaaggaguucguguccagcgacgaaucuuccagcggagagaacaaauccaagaagaaaagacgccggucugaagauagcgaggaagaggagcuugccuccacacccccuucuagcgaagacuccgcuucuggcagcgaugaguga

SEQ ID NO: 76302 - RNA, 600 nt, Artificial Sequence
  derived and/or modified sequence opt5 from SSSCA1__Homo_sapiens__NP_006387
auggcccugaacggcgcugagguggacgauuucagcugggaacccccuaccgaggccgaaacaaagguccuccaggcgagacgggagcgccaagacagaaucucccggcugaugggggauuaccuucugcgcggauauagaaugcucggcgaaacgugcgcugacugugggaccauucugcuucaggauaaacagcggaagaucuacugcguugccugucaggagcuggacucugauguggacaaagauaauccggcccucaacgcucaagccgcucugagccaggcccgcgagcaccagcuggcguccgccucugaacucccccugggaagcagaccugcuccccagccucccgugccucggccggagcauugcgaaggcgccgcugccgggcuuaaggcggcccaaggacccccugcucccgccgucccucccaauacagacgugauggcuuguacccagacagcccugcuccagaaacugaccugggccuccgcugagcuuggcucuagcacaucccuggagaccagcauucagcucugcggccugauccgcgcgugugccgaagcucugagaucucuccaacagcugcagcacuga

SEQ ID NO: 76303 - RNA, 351 nt, Artificial Sequence
  derived and/or modified sequence opt5 from SST__Homo_sapiens__NP_001039
augcugagcugcagacuccagugugcccuggcugcccuuuccaucgugcuggcgcucggcugcgucaccggggcucccucugacccucggcugcgccaauuccuucaaaagagccuggccgccgcugccggaaaacaggagcucgcuaaguacuuucuggccgaacugcucuccgagccgaaccagacagaaaaugaugcgcuggagcccgaagaccuuucucaggccgcugagcaggaugagaugagacuggaacuccagcggagcgccaacuccaauccugcuauggcgccccgcgagagaaaagccggcuguaagaacuucuuuuggaaaacguucaccucuugcuga

SEQ ID NO: 76304 - RNA, 1176 nt, Artificial Sequence
  derived and/or modified sequence opt5 from SSTR1__Homo_sapiens__NP_001040
auguuccccaacggcaccgccagcuccccuucuagcuccccgucucccagcccuggguccugcggagagggcgggggaucuagaggccccggggcuggagccgcggacggcauggaagaaccuggccggaaugcuagccagaacgggacacuguccgaaggacaaggcagcgccauccucauuucuuuuaucuacuccguggucugucugguugggcuuugcggaaauagcauggugauuuaugugauccugcgcuacgccaagaugaaaacggcuaccaacauuuauauccucaaucuggccaucgcugaugagcuucugaugcucucuguccccuuccuggugacauccacccugcucagacacuggccuuuuggcgcccugcuuugucggcugguucucagcguggacgcggucaacauguucacaucuauuuacugccugaccgugcuuuccguugaucgcuauguggccgucgugcauccgaucaaggcugccagauaccggcgccccacaguggcuaaagucguuaaucugggggugugggugcucagccugcuggucauucucccuaucgugguuuuuagcagaaccgccgcgaacucugacggaacgguggccuguaauaugcugaugcccgaaccugcucagcgguggcuugucggcuucgugcuguauaccuuucucaugggcuuccugcuucccguuggggccauuugccuguguuacgugcucaucauugcuaagaugcgcauggucgcccugaaagccggauggcagcagagaaagcggagcgagcgcaagaucacacugauggugaugauggucgugaugguuuuugugaucugcuggaugccguucuacgucgugcaacucguuaacguguuugcugagcaggaugacgcgaccgucucccagcugagcgugauucuuggcuaugccaauucuugugcuaacccuauccuguacggguuccucuccgauaauuuuaaaagauccuuccagcggauucugugccuuucuuggauggacaacgccgccgaggagcccguggauuauuacgcuacagcccucaagagccgcgcguauuccguugaagacuuccaaccugagaaucuggagucuggaggcgucuuuagaaacgggaccuguacgagccggaucacaacccuguga

SEQ ID NO: 76305 - RNA, 1110 nt, Artificial Sequence
  derived and/or modified sequence opt5 from SSTR2__Homo_sapiens__NP_001041
auggacauggccgaugagccccugaacggcagccacaccuggcucuccaucccuuucgaccugaaugggucuguggucagcacaaacacguccaaucagaccgaaccguacuaugaucuuacaucuaacgcuguucugaccuuuauuuacuucguggugugcaucauuggacucuguggcaauacacuggucaucuaugugauucuuagauacgccaagaugaaaaccaucacaaacaucuauauucugaaucucgcgaucgcugacgagcuguuuaugcuggggcuccccuuccuggccaugcaaguugcccuugugcauuggccuuuuggaaaggcuauuugccgggucgugaugaccguugauggcaucaaccaguucacgagcaucuuuugucugaccgugauguccauugaccgcuaccucgccgucgugcaccccauuaaaucugcuaaguggagacggccucgcacagccaaaaugaucaccauggcgguguggggagucagccugcuuguuauccugcccauuaugaucuaugccgggcucagauccaaucaguggggccggagcucuugcacaauuaacuggccuggcgaauccggggcuugguacaccggauucaucauuuacacguuuauccugggcuuccuggugccgcucacaaucauuugucugugcuaucuuuuuaucauuaucaaggucaagagcucugggauucgcgugggauccagcaaaagaaagaaaucugagaagaaagugacccggaugguuuccaucguggucgccguguucaucuuuuguuggcugcccuucuacauuuucaauguuagcuccgugucuauggcuaucagcccuacacccgcccucaagggcauguuugauuucgucgugguccugaccuaugcgaacuccugcgccaauccuauucuuuacgcuuuucugagcgacaacuucaagaaaucuuuucagaaugugcucugucugguuaagguguccgggaccgaugacggagaacgcagcgauucuaaacaagacaagagcagacugaacgagacaacggagacccagcggacacuccugaacggcgaucuucagaccuccaucuga

SEQ ID NO: 76306 - RNA, 1257 nt, Artificial Sequence
  derived and/or modified sequence opt5 from SSTR3__Homo_sapiens__XP_005261778
auggacaugcugcaccccagcuccgugucuaccacaagcgagccugaaaacgccuccucugcuuggccgcccgaugccacgcucggcaaugucagcgcggggccuucccccgcuggacuggccguuucuggcgugcuuaucccucugguguaccucgucgugugcguuguggggcugcuuggaaacagccuggucauuuaugugguucucagacauaccgccucccccagcgugacaaaugucuacauccugaaccuggcucucgccgacgagcuguucaugcuuggccugccuuuucucgcugcccagaaugcgcugucuuauuggccguucgggucccuuaugugucggcuggugauggccguggauggaauuaaccaauuuaccagcaucuucugccucacagucaugucuguugaccgcuaccuggcuguggugcaccccaccagauccgcccgguggcgcacagcuccugucgccagaaccgugagcgcggccguuuggguggcuucugccgucgugguucugcccguggucguguuuuccggcgucccucggggcaugagcacgugucauaugcaguggcccgaaccggcugccgccuggcgcgcuggguucauuaucuauaccgcggcccucggauuuuucggcccucugcuugugaucugccuguguuaccuccugauuguugugaaggucagauccgcugggcggcgcgugugggcccccucuugccagagacggcgcagaagcgagcggcgcguuacaagaaugguggucgccgugguggcucuuuuuguucuguguuggaugccuuucuauguccucaauaucgugaacguggucugcccccugcccgaggaaccugccuuuuucggacuguacuuucucgugguugcgcugccguacgcuaauuccugugccaaccccauucuuuauggcuuccugagcuaccgguucaaacagggguuuagacgcgugcuccugcggccuucuagacgcguccggucccaagagcccaccgugggaccucccgaaaagacagaggaagaggaugaggaagaggaagacggcgaggaaagcagagagggcgggaaaggaaaggagaugaauggccgcguuucucagaucacccagccggggacgagcggacaggaacggccucccuccagaguggccucuaaagagcaacagcuucugccucaggaagcuagcacaggcgagaaguccagcaccaugcgcauuucuuaucucuga

SEQ ID NO: 76307 - RNA, 1167 nt, Artificial Sequence
  derived and/or modified sequence opt5 from SSTR4__Homo_sapiens__NP_001043
augagcgcccccuccacccugccuccgggcggggaggaaggacucggcacagcuuggcccucugccgcgaacgcuagcuccgccccugccgaggcugaagaggccguggcugggcccggagacgccagagcggccggcauggucgcuauccagugcauuuacgcccugguuugucuuguggggcuggugggaaaugcucucgucaucuucgugauucugcgguaugccaagaugaaaacggcgaccaacaucuaccuucugaaucucgccguugcugaugaacuguuuaugcugucugugccuuucgucgccagcuccgcugcccuccgccacuggcccuuuggcucugugcugugcagagccguucuuagcguggacggccugaacauguucacauccgucuuuugucucaccgugcugagcguggaucgguaugucgcuguugugcauccucuucgcgcggccacauacagacggccgucuguggcuaagcugauuaaucucggggucuggcuggccucccugcucgugacccugcccaucgccaucuucgcugacacacgcccugccagaggaggccaagcgguugcuugcaaccuucaguggccccacccugccuggagcgccguguuugucguguauaccuuccugcucggguuucugcuucccguucuggcuauuggacucuguuaccugcugaucgugggcaaaaugcgggccgucgcucuccgcgccggguggcagcagagacggcgcucugagaagaaaauuacgagacuggugcuuauggucgugguuguguucguccugugcuggaugccguuuuaugugguucaacuccugaaucuuuucgugaccucccuggaugcgacagucaaccaugugagccucauccugucuuacgccaauuccugugcuaacccuauucuguacggauuucucagcgacaauuuccggcgcuucuuucagagagugcugugccuucgguguugccugcucgagggcgccggcggggcugaagaggaaccccuggauuauuacgccaccgcgcugaaguccaagggaggcgccggguguaugugcccuccccuucccugccagcaggaggcucuccaaccugagccgggaagaaaacgcaucccccugacacggaccacgacauucuga

SEQ ID NO: 76308 - RNA, 1095 nt, Artificial Sequence
  derived and/or modified sequence opt5 from SSTR5__Homo_sapiens__NP_001166031
auggagccccuguucccugccagcaccccguccuggaacgcuucuagccccggcgccgcguccgggggaggcgacaauagaacacucguggggccugcucccucugccggagcccgggcuguccugguuccugugcuuuaccugcucgugugcgccgcuggccugggcggaaacacgcuugucaucuaugugguucugcgcuuugccaagaugaaaaccgugacaaauauuuacauccucaaccuggcggucgccgaugugcuguauaugcucggccugcccuuccuugcuacccagaaugccgcuagcuuuuggccuuucggcccgguucuguguagacucgugaugacacuggacggggucaaccaauuuaccuccguguucugccuuacagugaugucugucgaucgguaccuggccguugugcacccccucagcuccgcgcgcuggagacggccucgcguggccaagcuggcuagcgccgcugccuggguccugucucucuguaugucccugccccuucugguguuugccgacguucaggaaggagggaccugcaaugcuagcuggccugagcccguggggcucuggggagcggucuucauuaucuauacggccgugcugggcuuuuucgcuccgcuucugguuauuugucucugcuaccugcugaucguggucaaagugagagccgccgggguccgggugggauguguucgcagacggucugaacgcaaggugaccagaaugguccucgugguugugcuggucuuugcuggcugcuggcuuccuuucuuuacagugaacaucgugaaucuggccguugcgcucccccaggagccugcuuccgccggccuguauuucuucgucgugauucuuagcuacgccaacucuugugcuaaucccgugcuguacggguuucucuccgauaacuuccggcagagcuuucaaaaaguccugugccugcgcaagggauccggcgccaaggacgcugaugccaccgaacccagaccugaccggaucagacagcagcaggaggcgacaccgcccgcccaucgcgcugccgcuaaugggcucaugcaaaccucuaaacuguga

SEQ ID NO: 76309 - RNA, 1128 nt, Artificial Sequence
  derived and/or modified sequence opt5 from SSUH2__Homo_sapiens__NP_001243677
auggacagagaucugaacgaggacgauagcguggucgaccucuccuucgaagccgagucuccccuggcuccuccgaccgaacuucuggagcggcuccccagcuacgauuggcugcuucagggcgggcgcggacaaaucuuuuucccuccccuggaagccccuggcagaccccaggagcagcgguccuggccuucuuuucucgagcaccgcguuccggcgaugacagaagagguggcuagagaagcccugcugagcuucguggacuccaagugcuguuauucuagcacggucgccggggaucucgugauucaggagcugaaacggcaaacccuuugccgcuacagacuggagacauuuuccgaaagccggaucucugaguggaccuuccagcccuuuacaaaucauuccguugacggaccucagcgcggcgcuagccccagacucugggauauuaaggugcaggggccucccauguuccaagaagacacccggaaauuucaggucccgcacucuucccuggugaaggagugucauaaaugccacggacgcggcagauauaaguguagcggcugccauggggccggaacaguucgguguccuucuugcuguggcgcuaagcgcaaagccaagcaguccagacggugccagcuuugugcggggagcggaagacgccggugcucuaccugcuccggcagagggaacaaaacgugugcuaccugcaagggagaaaagaaacugcuccacuucauccaacuggugauuauguggaagaauagccuguuugaguucgucuccgagcaccgccucaacuguccccgggaacugcuugccaaagccaagggcgagaaucuguuuaaagaugaaaacagcgugguguacccuaucgucgacuucccccucagagauaucucucuggcuucccagcgcggcauugccgagcauagcgcggcccuugcuucucgggccagaguucugcagcaacgccagacaaucgaacucauuccccugaccgaggugcacuauugguaccaggggaagacauauguguacuacaucuauggaaccgaccaucaggucuacgcuguggacuauccugagcgguacugcuguggcugcacgauuguuuga

SEQ ID NO: 76310 - RNA, 567 nt, Artificial Sequence
  derived and/or modified sequence opt5 from SSX1__Homo_sapiens__NP_005626
augaacggcgacgauaccuucgccaagagaccccgggacgaugcuaaagccagcgagaagcgcuccaaagcguuugacgauaucgcuacauacuucucuaagaaagaauggaagaagaugaaauauagcgagaagauuuccuacguguauaugaaaagaaauuacaaggccaugacgaaacugggguuuaaggucacccucccuccguucaugugcaacaagcaggccacagacuuucaaggaaaugauuucgacaacgaucacaaucggcgcauccagguugaacauccccagaugaccuuuggcagacugcaccggauuaucccuaaaauuaugcccaagaaaccugcugaggacgaaaacgauucuaagggggugagcgaggccuccggaccccagaaugacggcaaacaacuucauccuccggggaaggcuaacaucucugagaaaaucaauaagcgcagcggacccaagagaggcaaacacgccuggacacaucggcugcgcgaaagaaagcagcucgugauuuaugaggaaaucuccgauccugaggaggacgacgaauga

SEQ ID NO: 76311 - RNA, 567 nt, Artificial Sequence
  derived and/or modified sequence opt5 from SSX2B__Homo_sapiens__NP_001157889
augaacggcgacgaugccuucgcuagacggcccaccgugggggcccagaucccugagaagauucaaaaagcguuugacgauaucgcuaaguacuucagcaaagaagagugggaaaagaugaaagccuccgagaagaucuuuuaugucuacaugaagcgcaaauaugaagccaugacaaagcugggauucaaagcuacgcucccgcccuuuaugugcaauaagagagccgaggacuuccagggcaacgaucuggacaaugauccuaaccgggggaaucagguugagcgcccccagaugaccuuuggaagacuucaaggcauuucuccuaaaauuaugcccaagaagccugcugaagaggggaacgacagcgaagaggugccggaggccuccggaccccagaaugauggcaaagaacuguguccucccggcaagccuacaaccucugagaaaauccacgaacggagcgggcccaagcgcggagagcaugcguggacacacagacuccgggaacgcaaacagcuggugaucuacgaggagauuuccgacccggaagaggaugacgaauga

SEQ ID NO: 76312 - RNA, 1521 nt, Artificial Sequence
  derived and/or modified sequence opt5 from SSX2IP__Homo_sapiens__XP_011538914
augggcgacuggaugaccgugacagaucccgggcugagcuccgagucuaagacgaucagccaguacaccuccgaaacaaaaaugucuccuagcucccucuauucucaacagguccugugcagcuccauuccgcuuagcaagaacguucacucuuucuuuuccgccuucuguaccgaggacaauaucgaacagagcauuucuuaccuggaucaggagcucacaaccuuuggauuccccucccuguaugaagagagcaaaggcaaggagacaaaaagagaacuuaacaucguggcugugcugaauugcaugaacgagcuccugguccugcaacggaagaaucuccuggcccaggaaaacguggagacccagaaucuuaagcuggggucugacauggaucaucuccaguccuguuacagcaaacugaaggagcaacuugaaacgucccgcagagagaugauuggacugcaggaacgggaccgccagcuccagugcaaaaacagaaaucugcaccaacugcucaagaacgagaaagaugaaguucagaagcugcagaauaucaucgcgucucgggcuacccaauauaaccaugacaugaagcgcaaagagagagaguacaauaaacuuaaggaacggcugcaccagcucgugaugaacaagaaagauaagaaaauugccauggacauccugaauuaugucggccgcgccgaugggaagagaggaagcuggcggacaggcaagaccgaggcucgcaacgaagacgagauguacaaaauucuucugaacgauuacgaauauagacagaagcagauccucauggagaaugccgagcugaaaaaggugcugcaacagaugaaaaaggaaaugauuucccuccugagcccucagaagaaaaagccccgggagcgcguugacgacucuacaggcaccgugaucuccgaugucgaagaggacgcuggggaacuuagcagagagucuaugugggaucugagcugugagacggugcgggaacagcucacaaacuccauuagaaaacaauggcgcauccugaagucucauguggagaaacuugacaaucaggucagcaagguucaccuggaaggauuuaacgaugaggacgugaucucccggcaggaucacgagcaggaaaccgagaagcucgaacuggagauucaacagugcaaagaaaugaucaagacacagcagcaacugcuccagcagcaacuggccaccgcguacgacgaugacaccacaagccuucugagagauuguuaucuccuggaggagaaagaacgccugaaggaggaauggucucuuuucaaagagcagaagaagaauuuugaacgggagagacgcuccuucacggaggccgcuauucggcucggccuggaaagaaaagccuuugaggaggaacgcgcuagcuggcugaagcagcaguuccucaacaugaccacauuugaccaucaaaauucugaaaacgugaaacuguucuccgccuuuagcgggauccaguccauguacuga

SEQ ID NO: 76313 - RNA, 567 nt, Artificial Sequence
  derived and/or modified sequence opt5 from SSX4B__Homo_sapiens__NP_001030004
augaacggcgacgaugccuucgcuagacggccccgcgacgaugcccagaucagcgagaagcugagaaaagcguuugacgauauugcuaaguacuucuccaaaaaggaaugggagaaaaugaagucuagcgaaaagaucguguaugucuacaugaaacucaauuaugagguuaugaccaagcugggguuuaaagugacacuuccuccguucaugcgguccaagcgcgccgccgacuuucacggaaacgauuucggcaaugacagaaaccaucggaaucaaguggaacgcccccagaugacguuugggucucugcagagaauuuucccuaaaaucaugcccaagaagccugcugaggaggaaaacggacucaaagagguccccgaagccagcggcccucagaaugaugggaagcaacugugcccgcccggaaacccuuccacccuugagaaaauuaauaagacaucuggccccaaacggggcaagcacgcuuggacccaucgccugagagagcggaaacagcucgugguuuacgaagagaucagcgacccugaagaggaugacgaauga

SEQ ID NO: 76314 - RNA, 690 nt, Artificial Sequence
  derived and/or modified sequence opt5 from SSX5__Homo_sapiens__NP_066295
augaacggcgacgaugccuucgugagacggccccgcgucgggagccagaucccugagaagaugcaaaaacacccguggagacagguuugcgaccggggcauucaucuggugaaucucucccccuuuuggaaggugggacgcgaaccugcuucuagcaucaaagcccugcuuugugggagaggagaggcgcgggcuuucgaugacauugccaaguacuuuuccgaaaaagagugggaaaagaugaaggccucugagaaaaucauuuaugucuacaugaagcgcaaauaugaggcuaugaccaagcugggcuucaaagccacacugcccccuuuuaugagaaacaagcggguggcugauuuccaggggaaugacuuugauaacgaccccaaucgcggaaaccagguugaacacccucaaaugacguucggcagacuccagggcaucuuuccgaagaucacccccgagaaaccugccgaagaggggaaugauagcaagggagugcccgaggcguccggcccucagaacaaugggaaacagcuucggcccucuggaaagcugaacacaagcgaaaaagucaauaagaccuccggcccgaaacgcgggaagcaugccuggacacacagagugcgggagcgcaagcaacucguuauuuacgaagagaucagcgacccucaggaagaugacgaguga

SEQ ID NO: 76315 - RNA, 1110 nt, Artificial Sequence
  derived and/or modified sequence opt5 from ST13__Homo_sapiens__NP_003923
auggaccccagaaaggugaacgagcugcgggccuucgucaaaaugugcaagcaggauccuagcguucuccacaccgaagagaugcgcuuucugagagaauggguggaguccaugggcgggaaagugccgcccgcuacacaaaaggccaaaucugaagagaauacgaaggaggaaaagccugacagcaaaaaggucgaggaagaucuuaaagcggacgagcccuccucugaggaaagcgaucuggagaucgacaaggaaggagugauugagccugauaccgacgcuccccaggaaaugggcgaugagaacgccgagaucacagaagagaugauggaccaggccaaugauaaaaagguugcugccauugaagcucucaacgacggggagcugcagaaggccaucgaucuuuucaccgacgcgauuaaacugaauccucggcucgccauccuguacgcuaagcgcgccuccguguuugucaaacugcaaaagccgaacgcugccaucagagacugugaucgggcgauugaaaucaaucccgacucugcccagccuuauaaauggcgcggaaaggcucauagacuccugggccacugggaggaggccgcucaugaucuugcccuggccugcaaacucgacuacgaugaagacgcuagcgcgaugcugaaggaggugcagccccgggcccagaagauugcugaacaccgcagaaaauaugagcggaagcgcgaagagagagagaucaaagaacggauugagcgcguuaagaaagccagagaggaacaugagcgggcccaaagagaagaggaagcucgccggcaguccggggcccaguacgggagcuucccuggcggcuuucccgggggaaugccgggcaacuucccugggggaaugcccggcaugggaggaggcaugccuggcauggcggggaugcccggacuuaaugagauccugucugaucccgaagugcucgcugccaugcaggacccugaggucaugguggccuuucaagauguggcucagaacccggccaauauguccaaguaucagagcaaccccaaggucaugaaucugauuucuaaacuguccgcuaaguucggcgggcaagccuga

SEQ ID NO: 76316 - RNA, 2568 nt, Artificial Sequence
  derived and/or modified sequence opt5 from ST14__Homo_sapiens__NP_068813
augggcagcgacagagcccggaagggcggaggcgggcccaaagauuucggagcuggccugaaguacaacucccgccacgagaaagugaaugggcucgaagagggagucgaauuucugccuguuaacaaugugaagaaaguggagaagcauggcccgggcagaugggucgugcuugccgcgguucugaucgggcuccugcuugugcugcucggaauuggcuuccuggucuggcaucugcaguaucgggacgugcgcguucaaaagguguuuaacggguacaugagaaucaccaaugaaaacuucgucgaugcuuaugaaaauucuaacagcacagaguuugugucccucgccucuaaagugaaggacgcccugaaacuucuguacagcggaguccccuuccucggcccuuaucacaaggaauccgcuguuacggccuuuucugaggggagcgugauugcuuacuauugguccgaguucagcaucccccagcaccugguggaggaggccgaacgggucauggcggaggaacgcgugguuaugcuuccucccagagcccggucucugaaauccuuuguggucaccagcgugguugcuuucccuacagauucuaagaccgugcagcgcacacaggacaauuccugcagcuuuggacuccaugccagaggcgucgagcugaugcgguucaccacaccgggcuuucccgauucuccuuaccccgcucacgcccgcugucaaugggcgcugagaggggacgccgauuccgugcucagccugaccuuccgguccuucgaccuugcuucuugcgaugaacgcggaagcgaccuggucacgguguacaacacccucuccccuauggagccccacgcccugguucagcuuuguggcacauauccgccuagcuacaaucugaccuuucauucuucccagaacgugcuccugauuacacugaucaccaauacggagagacggcaccccggguucgaagcuacauuuuuccagcucccuagaaugagcucuugcggaggccgccugcggaaggcccaagggaccuuuaacagccccuauuaccccggacauuauccuccgaauaucgauuguacauggaacauugagguccccaacaaucagcacgugaaaguuagauucaaguuuuucuaccuucuggaaccuggcgugcccgccgggaccugcccuaaagacuaugucgagaucaacggggaaaaguacuguggagagcgcucccaguuuguggugaccucuaauagcaacaaaauuacaguucgguuccacuccgaccagagcuacacggauaccggcuuucucgcugaguaucugucuuacgacuccagcgaucccugcccggggcaauucacauguagaaccggacgcugcauccggaaggaacuuagaugugacggcugggcggauugcacagaccauucugaugagcugaauugcuccugugacgccgggcaccaguuuaccugcaaaaacaaguucuguaagccucucuucugggucugcgauagcgugaaugacuguggcgauaacuccgacgaacagggaugcucuugucccgcucaaacguuucgcugcagcaauggcaaaugucuguccaagucucagcagugcaacgggaaagacgauuguggagacggcagcgaugaggccuccugcccuaaggugaaugucgugacaugcaccaaacauaccuaucggugucugaacgggcucugccugagcaagggaaaucccgaaugugacggcaaggaggauugcucugacggguccgaugagaaagacugugauugcggccuucgcagcuucacaagacaggcccggguugugggaggcaccgacgcugaugaaggggaguggccuuggcaagucucucugcacgcccucggacagggccauauuuguggggcgucccugaucagccccaacuggcuggugucugcugcccacugcuacauugacgauagaggauuucgguauagcgacccgacacaguggacggccuuccuuggccuccacgaccagucccaacgcagcgcuccugggguucaggaaagacggcugaagagaaucaucucucaucccuuuuucaaugauuuuaccuucgacuacgauauugcccugcucgagcuggagaaacccgcugaauauuccagcauggugcgcccuaucugucuuccggacgccucccacgucuuucccgcgggcaaggccauuugggugacaggauggggccauacccaguacgggggaacaggcgcucugauccuccagaaaggggagauucggguuaucaaccaaaccacgugcgaaaaccugcugccucagcagaucacccccagaaugaugugugugggauuccuuucuggcggggucgauagcugccagggcgacuccggaggcccucucucuagcguggaggccgaugggcgcauuuuucaagcuggaguggucuccuggggcgacgggugcgcccagagaaauaagcccggaguuuacacacggcugccucuguuccgcgauuggaucaaggaaaacaccggcguguga

SEQ ID NO: 76317 - RNA, 3144 nt, Artificial Sequence
  derived and/or modified sequence opt5 from ST18__Homo_sapiens__NP_055497
auggacgccgaggcugaagauaagacccugagaacacggagcaaaggaacggaggugcccauggacucccucauccaggaacugucugucgccuacgauugcagcauggcgaagaaacgcaccgcugaggaccaagcccuugggguuccugugaacaagagaaaaucccugcucaugaagccgcggcacuauucucccaaggccgauugucaggaagaccgcagcgauagaacagaggacgauggaccucuggagacccauggccacuccacagcugaagagauuaugaucaaacccauggacgaaucucuucugagcaccgcccaggaaaauuccagccggaaggaggaucgcuacucuugcuaucaggaacucauggugaaaucccugaugcaucuggggaaguucgagaaaaacgucagcgugcaaacaguuucugaaaaucucaacgacuccggcauucagagccugaaggcugagucugaugaagccgacgaguguuuucuuauccacuccgacgauggaagagacaagauugaugacagccagccucccuucugcuccucugaugacaaugagagcaacuccgaaagcgcggagaaugggugggauucuggauccaacuuuagcgaagagaccaaaccuccgcgggugcccaaguacguccugacggaccauaaaaaggaucuccuggaagugccugagaucaaaaccgagggcgacaaguucauccccugugaaaaucgcugcgauucugagacagaaagaaaagacccucagaacgcccuugcugagccccuggacggcaaugcccaaccgagcuuuccugauguugaagaggaggacuccgaaucucucgcugugaugaccgaggaagggagcgaucuggagaaggccaagggaaaccugucccuccuggagcaggcgauugcccuucaggcugaacggggcugugucuuccacaauacauauaaagagcuggaccgcuuucuccuggaacaccuugccggggagagacggcagaccaaggugaucgauaugggaggccgccaaauuuucaacaauaaacauagccccagaccugaaaagcgggagacgaaaugccccauccccgggugugacggaacaggccacgugaccggccuguacccucaucacagaucucucuccgggugcccgcacaagguccgcguuccccuggagauucuggcuaugcaugaaaacgugcucaaguguccuacacccggaugcaccggccgggggcacgugaacagcaauagaaacacccaucgcucucuguccggaugcccuaucgccgccgcugagaaacuugcgaugagccaggauaagaaucagcuggacucuccccaaacaggccaguguccggaucaggcccaccggacgucccucgucaaacagauugaauuuaacuucccuagccaagcuaucaccucccccagagccacagugucuaaggagcaggaaaaauuugggaagguuccuuucgacuaugccagcuuugaugcucagguguucggaaagcgcccccugauccagaccguccaaggccggaaaacaccucccuucccggaguccaagcauuuuccuaaucccgugaaauuccccaacagacuuccuagcgccggcgcgcacacccagucuccggggcgcgcuuccagcuacucuuacggacagugcuccgaggacacgcacauugccgccgcugccgcuauccugaaucucagcacacgguguagagaagccaccgauauucugucuaacaagccccagagccugcaugcgaaaggcgccgagaucgaaguugacgagaaugggacccucgaccuguccaugaagaagaaccgcauucuugauaaaagcgcuccucugacaucuuccaauaccagcauccccacaccuuccucuagccccuuuaagacguccucuauccucgugaacgccgcuuucuaucaagcccugugcgaccaggaaggaugggauaccccuauuaauuacagcaaaacacacggcaagaccgaggaggaaaaagagaaggaccccgucuccucucuggaaaaccuugaggagaaaaaguuuccgggggaagcgagcaucccuucccccaagccuaaacuccaugcccgggaucugaagaaagagcugauuacaugucccaccccgggcugcgacggaagcggccacgugacggggaauuaugcuucucacagauccgucagcggauguccucucgccgauaagacccugaaaucucuuauggcugccaacucccaggaacugaagugccccacaccuggcugugacgggagcggacaugugaccggcaacuacgccucucaccggucccucagcgggugcccccgcgcuagaaagggcggaguuaaaaugacacccaccaaggaggaaaaagaggauccugagcugaaguguccggugaucggcugcgacgggcagggacauauuuccggcaaauauacgagccaccggacagcgucugggugcccccuggccgcuaagagacaaaaggaaaauccucuuaacggagccagccucuccuggaaacugaauaagcaggagcugccccauuguccucuccccggcugcaacgggcugggccacgucaauaacguguucguuacccaccgcucucuuagcggauguccucugaaugcccaggugaucaaaaagggcaaagucuccgaggagcucaugacaaucaagcugaaggcuaccgggggaauugaaucugaugaggagauccggcaucuggacgaagagauuaaagaacuuaacgagagcaaucucaagaucgaagccgauaugaugaaacugcaaacccagauuacauccauggagucuaaccugaagacgaucgaggaagagaauaaacucauugaacagaacaaugagagccugcuuaaggagcuggcgggccucucccaggcucugaucagcucucuggccgacauccaacuuccgcagauggggcccauuuccgaacagaacuuugaggccuacgugaauacccucacagacauguauagcaaccuggaaagagauuacucuccugagugcaaagcucugcucgaauccaucaagcaggccgugaagggcauucacguuuga

SEQ ID NO: 76318 - RNA, 240 nt, Artificial Sequence
  derived and/or modified sequence opt5 from ST20__Homo_sapiens__NP_001094349
auggccagaagccggcugaccgcuacauccgugucucagguccaagagaacggcuucguuaagaaacucgaacccaagagcggguggaugacguuucuggaggugaccggaaaaaucugcgaaaugcuuuucuguccugaggccauucugcucacacgcaaggacaccccguacugcgaaacaggccugaucuuucuuacccugacaaaaaccauugcgaauacguauuucuacuuuuga

SEQ ID NO: 76319 - RNA, 1023 nt, Artificial Sequence
  derived and/or modified sequence opt5 from ST3GAL1__Homo_sapiens__XP_005251082
auggugacccugagaaagcggacacucaaaguccugacguuccuuguucuguuuaucuuccucaccagcuuuuuccugaacuacucccacacaaugguggccaccacaugguuucccaagcagauggugcuugagcugucugaaaaucucaaacgccugauuaagcauagaccuugcaccuguacacacugcaucggccaacggaaacugagcgcuugguucgacgagcgcuuuaaccagaccaugcagccgcuccugacggcccagaaugcgcuucuggaagaugacaccuauagaugguggcuccggcugcaacgcgagaagaagcccaacaaucuuaacgauacaauuaaagaacuguucagagucgugccugggaauguugaccccaugcucgagaagcgguccgugggaugucgcagaugcgcugucgugggcaacucugggaaucugcgggagagcuccuacggaccugaaaucgauucucaugacuuuguucugcgcaugaacaaagcccccaccgccggcuucgaggcugauguggggacaaagaccacgcaccaucucgucuauccugagagcuuuagagaacugggagacaauguguccaugauucuugugccguucaaaacaaucgaucuggagugggucguuagcgccaucaccacaggcaccauuucucacaccuacauccccgugccugcuaagauucgggugaagcaggacaaaauccucauuuaucaccccgccuuuaucaaguacgucuucgauaacuggcugcagggccaugggcgcuauccuuccacaggcauucuuagcgugaucuucucuaugcacguuugugacgaaguggaucuguacggauuuggggcggacuccaaaggaaauuggcaucacuacugggagaacaaucccagcgccggcgcuuucagaaagacggggguccacgacgccgauuuugaaucuaacgugaccgcuacacucgccuccaucaacaaaauucggaucuucaagggaagauga

SEQ ID NO: 76320 - RNA, 1053 nt, Artificial Sequence
  derived and/or modified sequence opt5 from ST3GAL2__Homo_sapiens__NP_008858
augaagugcagccugagagugugguuccucuccgucgccuuucugcuuguuuucaucaugucucugcucuuuaccuacagccaccauuccauggcuacacugcccuaucuugacucuggcgcccuggaugggacgcaccgggugaaacucgugccuggauacgcgggccugcagcgccugagcaaggagagacucuccgggaaaucuugugcuugccggcgcuguaugggagacgccggcgccagcgauugguucgacucccauuuugaugggaacauuagcccggucuggaccagagaaaauauggaccugcccccugaugugcaacggugguggaugaugcuucagccccaguucaagucucacaacacaaaugagguucuggaaaaacucuuucagaucgugccuggagagaaccccuaucgcuucagagacccucaucaaugccggcgcugugcugucgugggcaauuccggcaaccugagagggagcggauacggccaggauguugacgggcacaauuuuauuaugcggaugaaccaggccccgaccgugggauucgaacaggaugucggcucucgcacaacccaccauuuuauguaucccgaguccgcuaagaaucuuccugccaacgugagcuucgugcugguccccuuuaagguucucgaccugcuguggaucgcgucugcccucuccacagggcaaauuagauucaccuacgcuccugugaaauccuuccugcggguggauaaggagaaaguccagaucuauaaucccgccuuuuucaaguacauccacgaccgcuggacggaacaucacggaagauacccgagcaccggcaugcuugugcuguuuuucgcucuccacguuugcgacgaggugaacgucuauggcuuuggggccgauucucggggaaauuggcaucacuacugggaaaacaauagauaugcgggcgaguuccgcaaaacaggggugcaugacgccgauuuugaggcucacauuaucgacaugcuggccaaggcuagcaagauugaaguuuaccggggaaacuga

SEQ ID NO: 76321 - RNA, 1002 nt, Artificial Sequence
  derived and/or modified sequence opt5 from ST3GAL4__Homo_sapiens__NP_001241687
auggugagcaaguccagauggaaacugcucgccaugcuggcucuuguccugguugugauggugugguacucuaucagccgggaggaccgcuauauugaacucuucuacuuucccaucccugagaagaaagaaccgugccugcagggcgaggccgaauccaaggcgucuaaacuuuucgggaacuauagcagagaucaacccauuuuucugcggcucgaggacuacuucugggucaagaccccuuccgcuuaugagcugcccuacggaacaaagggcucugaagaucugcuccugcgcgugcuugccaucacgagcuccagcauuccuaaaaauauccagucucugagaugucggcgcugcguuguggucgggaacggacacagacuccgcaauuccagccugggcgacgccaucaacaaguaugaugugguuauucggcuuaauaacgcucccguggccggguacgagggagacgucggcucuaaaaccacaaugagacuguuuuacccugaauccgcucauuucgauccgaagguggagaauaaccccgacacccuccuggugcuggucgccuuuaaagcgauggauuuccacuggaucgagacaauucucagcgacaagaagcggguucgcaaaggcuuuuggaagcagccuccccugaucugggaugugaauccuaaacagauuagaauccuuaaccccuucuuuauggaaauugccgcugacaagcugcucucucugccgaugcaacagccucggaaaaucaagcagaaacccaccacagggcuucuggccaucacccucgcucugcaucugugugaucucgugcacauugccggauucggcuauccugacgcguacaauaagaagcagacgauccauuauuacgagcaaauuacccugaaauccauggccgggagcggacacaacgucucccaggaagcucuugccaucaagcgcaugcuggagaugggcgcuauuaaaaaucucacaucuuuuuga

SEQ ID NO: 76322 - RNA, 1188 nt, Artificial Sequence
  derived and/or modified sequence opt5 from ST3GAL5__Homo_sapiens__NP_001035902
auggccagcgugcccaugccuuccgaauacaccuaugucaagcugagaucugacugcagccggccgucccuccagugguacacacgcgcucaaucuaaaaugagacggcccagccugcuucugaaggauauccucaaauguacgcugcuuguuuucggcguguggauucuguauauccucaagcugaacuacaccacagaagagugcgacaugaaaaagaugcacuauguggauccugaccaugucaagcgcgcccagaaauacgcgcaacaggugcugcagaaggaauguagacccaaauuugcuaagaccuccauggcccuccuguucgagcaccgguauucuguugaucuucugccuuuugugcagaaagcccccaaggacagcgaagcugaguccaaguacgauccuccguucggguuucgcaaauucagcucuaagguccagacacuccuggagcuucugcccgaacaugaccucccugagcaccugaaagccaagaccugcagacggugugugguuauuggauccggcgggauccugcauggacucgaacugggccacacacuuaaucaguuugauguggucauucgccugaacagcgcucccguggagggguacucugagcacgugggaaauaaaaccacgaucagaaugaccuauccugaaggcgcgccccucuccgaccuggaguacuauagcaacgaucuuuucgucgccguucuguuuaagucuguggacuucaauuggcuccaagccauggugaaaaaggaaacacugccguuuuggguccggcuguucuuuuggaaacagguggcugagaagaucccucuccagcccaagcauuuccgcauucugaacccuguuaucauuaaagaaaccgccuucgauauccuucaguacuccgagccccaaagcagauuuuggggccgggacaagaaugugcccacaauuggggucaucgcugugguucuggccacccaccucugcgacgaggugucccuggcgggauucggcuaugaucuuaaccagccucgcacgccgcugcauuacuuugacucucaguguauggccgcuaugaauuuccaaacaaugcacaacgucaccacagaaaccaaauuucuccugaagcuggugaaggagggggucgugaaagaucucagcggaggcauugacagagaguucuga

SEQ ID NO: 76323 - RNA, 1155 nt, Artificial Sequence
  derived and/or modified sequence opt5 from ST3GAL6__Homo_sapiens__NP_001258074
auguggcaggcccccagagaacggcaacagccugcuggcgccgcggcuccccaggugagcgaaccgggggccccucugcgcuccucucuccugggacuuggcgggagccugcuccccgccggauucgcugccggccugcacugcccuggggagcccgcuaugagaggauaccuugucgccaucuuucuguccgcgguuuuccucuauuacgugcugcauuguauucuguggggcaccaacguguauugggucgccccuguggaaaugaagcggcgcaauaaaauccagccgugccucucuaagcccgcuuuugccagccugcuuagauuccaccaauuucauccuuuccugugugcugccgacuuucggaaaauugcgucccucuacggcucugauaaguucgaccugcccuaugggaugcgcacaagcgccgaguacuuuagacuugcucuguccaaacuccagagcugcgaucuguucgacgaauuugauaacaucccuuguaagaagugcguuguggucggaaauggcggggugcugaaaaacaagacgcucggagagaaaauugacucuuaugauguuaucauccggaugaauaacggccccgugcuggggcacgaggaagaggucggacgcagaaccacauuccggcuguuuuacccggaauccguguucagcgacccuauucauaaugaucccaacaccacagugauccuuaccgccuucaagccucacgaccuccgcuggcugcuugagcugcucaugggcgauaaaauuaauacaaacggcuuuuggaagaagcccgcucugaaucugaucuacaaacccuaucagauuagaauccucgacccuuucauuauccggaccgccgccuacgagcugcuucacuuuccgaaggucuuccccaaaaaccagaagccuaaacaucccacgaccgggaucauugcuaucacacuggcguuuuauauuugucacgaaguucaucucgccggauucaaguacaauuuuucugaucugaaauccccucuucacuauuacggcaacgcuaccaugagccugaugaauaagaacgccuaucacaacgugacagccgagcaacucuuccugaaggacaucauugagaaaaaucuggugaucaaccucacccaggacuga

SEQ ID NO: 76324 - RNA, 3414 nt, Artificial Sequence
  derived and/or modified sequence opt5 from ST5__Homo_sapiens__NP_005409
augaccaugacagccaacaagaauagcuccaucacgcacggcgcugggggaaccaaagcccccagaggcacacugucucggagccaguccgugucuccuccgcccguccucagcccuccccgcuccccuauuuacccccugucugacagcgagaccuccgcgugcagauauccuagccauucuuccagccggguucuucugaaggaucgccacccgcccgcuccuucuccccaaaacccucaggaccccuccccggauacaagcccucccaccuguccuuucaaaacagccucuuuuggguaccucgacagaucccccagcgccugcaagcgggaugcucagaaagaauccgugcagggagccgcucaagacguggccggcgucgcggccugucugccccuugcucagucuaccccuuucccggggcccgccgcuggaccucgcggcgugcugcucacgagaaccggcacacgggcccauagccuggggauccgcgagaagauuuccgcgugggaaggaagacgggaggccagcccccgcaugucuaugugcggcgaaaagagagagggguccggaagcgagugggcugccucugaaggcuguccuagccuggggugccccuccguugugccgucuccuuguagcuccgagaaaaccuuugauuucaagggacuccggcgcaugagcagaacauuuucugaaugcuccuaucccgagaccgaggaagagggcgaagcucugccuguccgggacagcuucuacagacuugagaaacgccugggccggucugaacccuccgccuuucucagagggcacggaagccgcaaggaguccucugccgugcugagccggauccagaaaauugagcagguucuuaaggaacaaccuggcagagggcugccccagcucccguccucuuguuauagcguggaucgcggaaagcggaaaacgggcacacuggggucccuggaggaaccugcuggaggcgcgagcgucucugccggcuccagagcuguggggguggccggagucgccggcgaggcugggcccccucccgaacgcgagggaagcggcucuaccaagccggggacacccggcaauuccccuagcucucagcggcuccccagcaaauccagccuggacccugccguuaaccccgugccuaagcccaaaagaaccuucgaguacgaagcggauaagaauccgaaaucuaagccuuccaacggacuucccccuagccccaccccggcugccccucccccucugcccuccacacccgccccuccggugacgcgccggcccaagaaagacaugagaggccaucggaagucucagagccgcaaauccuuugaguucgaagaugcuucuagccuccaaucccuguauccuucuagccccaccgagaaugggacagaaaaccagccuaaguuuggauccaaaagcacccuugaggagaaugccuacgaagacaucgucggcgaccugcccaaggagaacccuuacgaagauguggaccucaagucuagacgggcugggagaaaaucccagcaacugagcgagaauagccuggauucccuccaccgcauguggagcccgcaggaccggaaguauaacucucccccuacacagcugucccuuaaacccaauagccagucccugagaagcggaaacuggucugagcgcaagagccacagacucccucggcugcccaaacgccauucccacgaugacaugcuucugcucgcccaacugucucugccgagcuccccuucuagccucaaugaagauucccugucuaccacgagcgagcuucuguccagcagacgggcgcgcagaauccccaagcucguucagcggauuaacucuaucuacaacgccaagcgcggcaaaaagagacugaaaaagcuguccaugagcucuauugaaacagcuucccuucgggacgagaauagcgaauccgagucugauagcgacgaucgcuucaaagcccauacccagagacucgugcacauccaguccaugcugaagcgggcucccagcuauagaacccuggagcucgaacugcuugaguggcaagaacgcgagcuguuugaauacuucgucgugguuucucucaagaaaaagccuucccggaacacauaucugcccgaggugagcuaccaguucccuaaacuggacagaccgaccaagcagaugcgcgaggccgaagaacggcuuaaagcgauuccccaguuuugcuucccugacgccaaggauuggcuccccgucucugaauauagcuccgagacauuuucuuucaugcugacgggggaagacggcagcagacgcuuuggauacugucggagacugcucccuuccggcaaagggccccgccugccggagguguacugcgucaucucucggcuuggaugcuucggccuguuuagcaaggugcucgaugagguugaaagacggcgcgggauuuccgcugcccugguguauccuuucaugagaagccugauggagucucccuuuccugcucccggaaagaccaucaaagucaagacauuccuuccuggcgccgggaaugaagugcucgagcugcggcgccccauggacuccagacuggagcacguugauuuugaaugucucuuuaccugccugagcgugcggcaacuuaucagaauuuucgccucccugcuccuggagcgccgggucaucuucguggcugacaaacugucuacacuuagcuccuguucucaugcggugguugcccuccuguacccguucagcuggcagcacaccuuuauuccuguccugcccgcuuccaugaucgauauugugugcugucccacgccuuuccucgugggccugcuuucuucuucccugccgaagcucaaagaacugcccgucgaggaagcccugauggugaaccuuggaagcgacagauuuauccgccagauggaugacgaggauacccugcucccucggaagcugcaggccgcucucgagcaagcccuggaaagaaagaaugagcuuaucucucaggacuccgauagcgacucugacgaugaaugcaacacacugaauggccucguuagcgagguguucauucgcuuuuucgucgaaaccguggggcauuauucccuguuucugacacagucugagaaaggagagcgggcguuccaaagagaggcuuuucgcaagagcguugccuccaaaagcaucagacgguuccuugagguguuuauggaaucccagauguucgccggcuuuauucaggaccgcgagcugagaaagugucgggcuaaaggacucuucgaacagcgcgucgagcaauaccuggaggaacuccccgauaccgagcagucugggaugaacaaguuccugagaggccuugggaauaagaugaaauuucugcacaagaaaaacuga

SEQ ID NO: 76325 - RNA, 1221 nt, Artificial Sequence
  derived and/or modified sequence opt5 from ST6GAL1__Homo_sapiens__NP_775323
augauccacaccaaccugaagaaaaaguucagcugcugugugcucgucuuucugcuuuucgccguuauuugcguguggaaagagaagaaaaagggcuccuacuaugacucuuuuaagcugcagacaaaagaauuucaagugcucaagagccuggggaaacuugcuaugggauccgauucucagagcgucuccucuagcuccacgcaggacccccauagaggccggcagacccuggggagccuccgcggacuggccaaggcgaaaccugaggcuucuuuccaaguguggaauaaggauuccagcucuaagaaccugaucccgagacuccagaaaauuuggaagaauuaccuguccaugaacaaauauaagguuagcuacaaaggccccgggccuggaaucaaguucucugccgaagcccuucggugucaccuucgcgaccaugugaaugucuccaugguggagguuacagauuuucccuucaacaccagcgaaugggagggcuaucucccuaaagaguccauuagaacaaaggcuggccccugggggcggugcgccguggucucuagcgcuggaucccugaaguccucucagcuuggccgcgaaaucgacgaucacgacgccgugcugagauuuaauggggcgccuaccgccaacuuccagcaagaugugggaacaaaaaccacgauccggcucaugaauagccagcuggucaccacagagaagcgcuuucugaaagacagccucuacaacgaaggcauucugaucguuugggauccgucuguguaucauagcgacauucccaagugguaccagaauccugauuacaacuucuuuaauaacuauaaaaccuacagaaagcugcaccccaaucagccuuucuauauccugaagccccaaaugccgugggagcucugggacauucugcaggagaucuccccugaagagauucagcccaacccucccucuagcgggaugcuuggaaucaucauuaugaugacacugugugaccaaguggauaucuacgaguuccuccccuccaaacggaagaccgacgucugcuauuacuaucagaaauuuuucgauagcgcuuguacgaugggcgccuaccacccucugcuguacgaaaagaaccucgugaaacaucugaaucagggcacagacgaagauauuuaucuucuggggaaggcuacccucccgggauuucgcacaauccacugcuga

SEQ ID NO: 76326 - RNA, 1401 nt, Artificial Sequence
  derived and/or modified sequence opt5 from ST6GAL2__Homo_sapiens__NP_001135824
augaagccccaccugaaacaguggagacaacggaugcuguucggcaucuuugccugggggcuccuuuuccugcucauuuuuaucuacuucaccgacagcaacccugcugagccggugcccuccucucugagcuuucuugaaacacgcagacugcucccuguccagggaaagcagcgggccauuaugggcgcggcucaugagcccuccccucccgggggacuggaugcccgccaggcccugccuagagcucacccggccggcucuuuccaugcugggcccggagaccuccaaaaaugggcccagagccaggauggcuuugaacacaaggaguucuuuuccucucagguuggccggaaaagccaauccgcguucuauccugaagacgaugacuacuuuuucgccgcugggcagcccggauggcauagccacacgcagggcacccugggguuuccuucucccggagagccgggcccucgcgagggggccuuccccgcugcccaggugcaaagacggcgcgugaagaagagacaccggcgccagagacggucccauguccuugaagagggagaugacggcgaucgccuguauagcucuauguccagagcguuccucuaccggcuguggaaaggcaaugugagcucuaagaugcuuaacccuagacugcagaaagccaugaaggacuaucucacagcuaauaaacacgggguucgcuuucggggaaagagagaagccggccugucccgcgcucaacugcucugccagcugcggagcagagcccgcgugcggacccuugaugggacagaggcccccuucuccgcucugggauggagacgccucguccccgcggugccucugucucagcuucauccgcggggccugagaagcugugccguugugauguccgcuggggccauccucaacagcucucugggagaggaaauugacucccacgaugccguccugcgcuuuaauagcgcucccacccggggcuacgagaaggacgugggcaacaaaacaaccaucagaaucauuaauucucagauccucacgaacccuagccaccauuucauugacuccucucuguauaaggaugugauccuugucgccugggaccccgcgccuuacagcgcuaaucugaaccucugguacaaaaagcccgauuauaaucuguuuaccccguacauucaacaccggcagcgcaacccuaaucagcccuucuauauccuucauccuaaauuuauuuggcagcugugggacaucauccaagaaaacacaaaggagaaaauucagcccaauccucccuccagcggguucaucggaucuuuuguuaagauuggccacaucagagccugcuccgaaccgcggagcagagauuguaccccugccuggacaaccgaguga

SEQ ID NO: 76327 - RNA, 1803 nt, Artificial Sequence
  derived and/or modified sequence opt5 from ST6GALNAC1__Homo_sapiens__NP_060884
augagaagcugccuguggcggugucgccaccucucccagggcgugcaauggucucugcuucuggccguccucguuuucuuucuguucgcccuucccagcuuuaucaaggagccucagaccaaaccguccagacaucagcggacagaaaacauuaaggagcgcucucugcagagccucgcuaaacccaagucccaagcgccuacgagagcucggcgcaccacaaucuacgccgaacccgugccugagaauaacgcccugaauacccagacacagcccaaagcucacaccacaggggacagaggaaaggaagccaaccaggcuccuccggaggagcaagauaaggugccccauaccgcccagcgggcggccuggaaaucuccugaaaaggagaaaacgauggucaauacccugagcccccgcggccaggacgcugggauggccuccggaagaacagaagcucagagcuggaagucucaagauaccaaaacaacccagggcaacgggggacagacgcggaagcucacagccucccgcaccgugagcgagaagcaccaaggcaaagcggccacaaccgcuaagacccugauuccuaaaucucagcauagaaugcuugcccccacaggcgcuguuuccacgcggacccgccagaagggggugacaaccgccgucaucccgccuaaagagaagaaaccccaggccacaccuccucccgcucccuuccaaagcccgaccacgcagagaaaucagcggcugaaggcggccaacuuuaagucugaacccagaugggacuucgaggaaaaauauuccuuugagauuggaggccuccagacaaccugcccugauagcgugaagaucaaggcuuccaaaucucuguggcuucaaaaacuguuccuccccaaucugacccuguuucucgacagccgccacuucaaccaguccgaaugggaucggcuggagcacuuugccccucccuucggguuuauggagcuuaauuacagccugguucagaagguggucacaagauucccgccugugccccagcaacagcuccugcuugccucucugccugcuggaucccuccgcuguauuaccugcgccguggucggcaacgggggcauucugaauaacagccauaugggacaggaaaucgacucucacgauuauguuuuccggcugagcggcgcgcucauuaagggguacgagcaggacgugggaacaagaacguccuuuuauggcuucaccgcuuuuucucugacacaaagccuucugauccucgggaaucgcggauucaaaaacgugccccugggcaaggauguccgguaccuucauuuucuggaagggaccagagacuaugaguggcucgaagcccugcugaugaaccagacagugauguccaaaaaucucuucugguuucgccaccggccucaggaggccuucagagaggcucugcacauggaucgcuaccuucugcuccaucccgacuuucugcgguacaugaagaacagauuccugcggagcaaaacccuugacggagcccacuggcgcauuuauagaccgacgaccggcgcucuccugcugcucacagcccugcaacuuugugaucagguuucugcguacggcuuuaucaccgaagggcaugagcgguucuccgaccacuauuacgauacaagcuggaagagacugaucuuuuauaucaaucaugacuucaagcucgaacgcgagguguggaaacggcugcacgaugaaggaaucauuagacuguaccagcgcccuggccccgggaccgccaaggcuaaaaacuga

SEQ ID NO: 76328 - RNA, 1125 nt, Artificial Sequence
  derived and/or modified sequence opt5 from ST6GALNAC2__Homo_sapiens__NP_006447
augggccugcccagagggagcuucuuuuggcuccugcuucugcucaccgccgcuugcuccggacugcuuuucgcccuguacuuuucugcggugcagcgguauccuggcccggcugccggggcccgcgacacaacgagcuucgaggcuuucuuccaauccaaggccucuaacagcuggaccggaaaaggccaggcuuguagacaccuccugcaucuggccauccagcggcacccccauuuucgcgggcucuuuaaucuguccauuccuguccuucuguggggagaucucuuuacacccgcgcugugggacagacuuucucagcacaaggccccuuacggcuggcggggccugagccaucaaguuaucgcuuccacccucagccugcugaacgggucugaauccgccaaacucuucgcucccccucgcgauacaccgcccaagugcauuagaugugccguggugggaaauggcgggauccugaacggaagccggcagggcccuaauauugacgcgcacgauuaugucuuucgccuuaacggggccgugaucaaaggauucgagagagacguuggcaccaagacaucuuuuuacggcuucaccgugaauacgaugaagaacucccuggucagcuauuggaaucucggguucaccucugugccccagggacaggaucugcaauacaucuuuauuccuuccgacauccgggauuauguuaugcuucgcagcgcuauucugggcgugcccgucccggaagggcucgacaaaggagauagaccucacgccuacuucggccccgaggcuuccgccucuaaguuuaaacugcugcauccugacuucaucagcuaccucacagaacgguuucugaaguccaaacuuauuaacacccacuucggggaucuguauaugcccagcacaggagcccucaugcugcuuaccgcucugcauacgugcgaccaggugucugcguacggcuuuaucacauccaauuauuggaaguucagcgaccacuacuuugagcgcaagaugaaaccccucauuuucuaugccaaccacgaucugucucuggaggcugcccucuggagagaccugcauaaggccggcauccuucagcuguaccagcgguga

SEQ ID NO: 76329 - RNA, 909 nt, Artificial Sequence
  derived and/or modified sequence opt5 from ST6GALNAC4__Homo_sapiens__NP_778204
augaaggcccccggcagacuggugcucaucauucugugcagcgucguuuucuccgcuguguacauccuucuguguugcugggccgggcucccucugugucuugcgaccugccuggaccaccauuuuccgacaggaucucggcccacggugccuggcccccuccacuucagcggguauuccucugucccugauggaaaaccccuggugcgcgagccuuguagaagcugcgcuguuguguccucuagcggccagaugcugggguccggacucggcgccgaaauugacagcgccgagugugucuuucggaugaaccaagcuccgaccgugggcuucgaagccgauguugggcagcgcucuacacugagaguggucucccauaccagcgugccccuucugcuccggaauuacucucacuauuuucagaaggcucgcgacacacuguacaugguguggggacagggcagacauauggaucggguccuugggggacgcaccuauagaacacugcuccaacugacccggauguacccuggccugcagguuuauacguucaccgagcgcaugauggccuacugcgaccagaucuuucaggaugaaacagggaaaaacagacggcaauccggcagcuuccucucuaccggaugguuuacaaugauucuggcgcuugagcugugugaggaaaucgugguguacggcauggucuccgacagcuauugccgcgagaagucccaccccucugugccuuaccacuauuucgaaaaagggagacucgaugagugucagauguaccuggcccaugagcaggcuccccggagcgcccacagauuuaucaccgaaaaggcuguuuucucccgcugggccaagaaacggccgauuguguuugcgcauccuagcuggagaacggaguga

SEQ ID NO: 76330 - RNA, 1125 nt, Artificial Sequence
  derived and/or modified sequence opt5 from ST6GALNAC6__Homo_sapiens__NP_001273928
auggccugcagcagacccccuucccagugugagccgaccucucugcccccugggcccccugcuggccggcgccaccucccccugagcagacggcgcagagaaauguccucuaacaaggagcaacggagcgccguguucgucauccuuuuugcgcugauuacaauccucauucuguacuccucuaauagcgcuaacgaaguuuuccauuauggaucccuucgcggcagaagccggcgcccugugaaucugaaaaaguggucuaucacggacggguacgugccgauucucggaaacaaaacccugcccuccagaugccaccagugugucaucgugucuucuuccagccaucugcucggcacaaagcuggggccugagaucgaacgggccgagugcaccauucgcaugaaugaugcccccacaaccggauauucugcugacguuggcaacaaaacaaccuacagaguggucgcccacuccagcguguuucggguucuucgcagaccucaggaguucgugaaucggacgcccgaaaccgucuuuaucuucuggggcccgccuuccaagaugcagaagccccaagggucucuggugagagugauucagcgcgcuggacucgucuuuccuaacauggaggccuaugcgguuagccccggccggaugagacaguucgaugaccuguuucgcggggaaacaggaaaagaucgggagaagucccauagcuggcuuucuaccggcugguucacaauggugaucgccguggagcugugugaccacguccacguguacgggaugguucccccuaauuauugcuccggaccggcuagcucugccugucccaccacgacaaccagcccuagaggccgcacaaacgugucccccaccucucggaugagcaccgucgcuagagccacaacgaccgcguccagcccucgcaaaggcagcucccaucgggggcccagcugcauggccucuccguccccuacacccccuggacccagaccucccagccucugggaucugcgccgggugagaggcgaagcugccuccgcucagccgcuggggcaaggaccuucuagcggccagucccggcucgccgggguuucucccagccaguccggacccuga

SEQ ID NO: 76331 - RNA, 1665 nt, Artificial Sequence
  derived and/or modified sequence opt5 from ST7__Homo_sapiens__NP_060882
auggccgaggcugccaccggcuuccuggaacagcucaagagcugcaucgugugguccuggacauaccuguggacggucugguuuuucauuguucuuuuucugguguauauccucagagugccccugaaaauuaacgacaaucuuucuaccgucagcauguuccugaacacacucaccccuaaguuuuacguggcgcugacagggaccuccucucugaucagcggacucauucugaucuucgaguggugguauuuucggaaauacggcacauccuucaucgaacaaguuucugugagccaccuucgcccgcugcucgggggagucgauaauaacuccagcaauaacucuaauuccagcaacggcgacucugauuccaauagacagagcgugucugaguguaagguuuggcggaacccccugaaucuuuuucgcggggcugaauauaacagauacaccugggugacgggacgggagccucugaccuauuacgacaugaaucucuccgcccaggaucaucagacauucuuuaccugcgacagcgaucaccuucgccccgccgacgcuauuaugcaaaaagccuggagagagcggaacccucaggcucgcaucuccgccgcgcaugaagcccuggagauuaaugaaugugcuacagccuacauccuccuggcugaggaggaagccaccacgauugcggaggccgaaaagcuguucaagcaggcucugaaagccggcgauggcugcuauagacggucucagcaacuccagcaccaugggagccaguacgaggcucagcaccgcagagacacaaacguccugguguauaucaagcggcgccuugccaugugugccagacggcugggaagaacccgcgaagcugugaaaaugaugcgggaucucaugaaggaguuuccccugcuguccauguucaacauucacgagaaucuccuggaagcgcuucuggagcuccaagccuacgcugacguccaggccguucuggccaaauaugaugacaucagccuuccuaagucugcuacaaucugcuacaccgccgcgcugcucaaggcuagagccguguccgacaaauucagcccggaagccgcuucucgccggggccugagcaccgccgagaugaacgcuguggaagccauucauagagcggucgaguuuaauccccacgugccuaaguaucugcucgagaugaaaucccugauccuucccccugaacauauucugaagcgcggggauucugaggccaucgcuuacgccuucuuucaccucgcucacuggaaacggguugaaggagcccugaaccugcuucauuguacaugggagggcacguucagaaugauucccuacccgcucgaaaaggggcaccuguuuuauccuuaccccaucugcaccgagacagcggaccgcgagcugcucccuagcuuccaugaaguguccgucuaucccaaaaaggagcugcccuuuuucauccuuuuuaccgccggacuguguagcuucacagcuaugcucgcccugcugacccaccaguuuccugaacuuaugggcguguucgcuaaggccuuucucucuacgcuguucgccccgcugaauuucguuauggagaaaguggaguccauucuccccagcucucuguggcaucaacuuacacggaucuga

SEQ ID NO: 76332 - RNA, 1560 nt, Artificial Sequence
  derived and/or modified sequence opt5 from ST7L__Homo_sapiens__XP_011539931
augagccccuuccuguuuagagacgauaugaaggaccucaccguguuccugaacucccuuacaccuaaauuuuacgucgcccugacgggcaccucuagccucaucuccgggcugauuuucaucuuugaguggugguauuuccacaagcauggaacaucuuuuauugaacagguuagcgugucccaccuucaaccgcugaugggcgggaccgagucuagcaucuccgaacccggaagcccuucucggaaucgcgagaacgaaacauccagacagaaucucagcgagugcaaaguguggcggaacccccugaaucuguuccgcggcgcugaguacagacgguauaccugggucacagggaaggaaccucucaccuacuaugauaugaaccugucugcccaggaccaucagacguuuuucaccugugauacagacuuucuucgccccuccgauaccgugaugcaaaaagcguggagagagcggaauccuccggcucgcauuaaggccgccuaccaggcucuggaacucaacaaugacugcgccacagcuuauguucugcuugccgaggaggaagcgaccacgaucguggaugccgagagacuguucaagcaggcucucaaagccggagaaacaaucuaccggcagagccaacagugucagcaccagucuccccaacaugaggcucagcugcgcagagacaccaacguccugguguacauuaagcggcgccucgccaugugcgcgagaaaacugggccggaucagagaagccguuaagauuaugcgcgaucuuaugaaagaguuuccuccccugacaaugcucaauauccacgagaaccugcuugaaucccugcucgagcugcaggcuuauccugacgugcaagccguccuggcuaaguacgaugacauuagccuccccaaguccgccgccaucuguuauaccgcugcgcugcuuaaaacccggacagugucugaaaaguucagcccggagacggccuccagacgcggccugagcaccgcugaaauuaaugccguggaggccauccaccgggcugucgaguucaacccucauguucccaaauaccuccuggaaaugaagucucuuauccugccucccgagcacauucucaaaagaggggacuccgaagccaucgcguaugccuuuuuccaucugcagcacuggaagcgcauugagggagcucugaaucuccugcagugcacaugggaaggcaccuuucggaugauccccuacccucuugagaaagggcaccuguucuauccguaccccagcuguacagagaccgccgauagagaacuccugccuacguuucaucacgugucuguguaccccaagaaggagcugccucuuuucauucauuuuacagcuggauucugcagcuccaccgccaugaucgcuauccucacccaccaguuucccgaaauuaugggcaucuucgccaaagcgguccuggggcugugguguccgcaaccuugggccucuagcggauuugaggagaacacacaggaccucaaguccgaagaucugggccuuagcucuggcuga

SEQ ID NO: 76333 - RNA, 642 nt, Artificial Sequence
  derived and/or modified sequence opt5 from ST8SIA1__Homo_sapiens__NP_001291379
augaccggcagcuucuacacacacucuccccugacgauccagcucacccuguccagccauagaugcaaccuuccuccgcuguccucugaguauacaaaggacguggggagcaaaucccaacucgucaccgccaaucccucuauuauccggcagcgcuuucagaaccugcuuuggagcagaaagacauucguugauaauaugaaaauuuacaaccacuccuauaucuacaugccugcuuuuagcaugaagaccggaacagaacccucucugcggguguauuacacccucuccgacgugggcgccaaucagacgguccuguucgcgaacccuaauuuucugcgcagcauugggaaauucuggaagucuagaggaauccaugcuaagcggcucuccaccggccuguuucuugugagcgccgcccuggggcucugugaggaaguugcuaucuauggauucuggcccuuuucugugaacaugcacgagcaaccuauuucccaucacuacuacgauaauguccugccguucagcggcuuucacgccaugcccgaagaguuccuucagcugugguaucuccauaaaaucggcgcucugcgcaugcagcuggacccuugcgaggauacaucccuccagcccaccucuuga

SEQ ID NO: 76334 - RNA, 1128 nt, Artificial Sequence
  derived and/or modified sequence opt5 from ST8SIA2__Homo_sapiens__NP_006002
augcagcugcaauucagaagcuggaugcucgccgcucugacccuucugguggucuuucucaucuucgccgacauuuccgagaucgaagaggaaauuggcaacucugggggacggggcacaauccgcagcgcgguuaauucccugcacucuaagagcaacagagcugagguggugauuaauggguccucuagccccgccgucguggaucgguccaacgaaagcaucaaacauaauauccagccugccucuuccaaguggcgccacaaccagacgcuuagccugcggauuagaaaacagauccucaaguuucuggacgcugagaaagauauuucuguucugaagggaacccucaagccgggcgacaucauucauuacaucuucgaucgcgacuccacaaugaaugugagccaaaaccuguaugagcuucugcccagaaccucuccucucaaaaauaagcacuuugggacaugcgccauugucggaaacuccggcgugcugcuuaauagcggcugugggcaggaaaucgaugcucauuccuucguuauccggugcaaccuggcccccgugcaggaguacgcgcgcgacgucggacucaaaaccgaucuggugacaaugaauccuucugugauucagagagccuuugaagaccuggucaacgcuaccuggcgggagaagcuccugcaacgccuucacagccugaauggcuccauccucuggauucccgccuucauggcuagagggggaaaagagcggguugaaugggugaacgagcugauccuuaagcaccaugugaacguccgcacggccuauccuagccugagacuccugcacgcggugcggggcuacuggcugaccaauaagguucauauuaaaagaccgacaaccgggcuccugauguauacacuugccacccgcuuuuguaagcagaucuaccuguauggauucuggcccuuuccucucgaucagaaccagaaucccgugaaauaccacuacuaugacucucugaaguacggcuauacgucccaagcuagcccucacacaaugccccuugaguucaaagcccugaagucucuccaugaacagggcgcucugaaacugaccgucgggcagugcgauggagccacauga

SEQ ID NO: 76335 - RNA, 1143 nt, Artificial Sequence
  derived and/or modified sequence opt5 from ST8SIA3__Homo_sapiens__NP_056963
augagaaacugcaagauggcccggguggcuagcguccugggccucguuaugcuguccguggcccuucugauccucucucugauuagcuacgugucccuuaagaaggagaauaucuucaccacacccaaauaugcgucuccuggggcuccgcgcauguacauguuucacgccggauucagaagccaguuugcccugaaguuccucgaccccuccuuugucccuauuacgaacucucugacccaagaacugcaggagaaacccagcaaguggaaguucaaucggacagcuuuucuccaucagcgccaggaaauccugcaacacguggauguuauuaaaaacuucucccuuaccaagaauagcgugagaaucggccagcugaugcauuaugacuacucuucccacaaauaugucuuuagcaucucuaacaauuuccggucccuccugccugaugugagccccauuaugaacaagcauuacaauaucugugccguuguggggaacucuggcauucuuacaggaucccagugcgggcaggagaucgacaaaagcgauuuugucuuccgcuguaauuuugcuccuaccgaagccuuccaaagagacgugggacggaagacaaaccugaccacguucaauccguccauucucgagaaguauuacaacaaucugcugaccauccaggaucgcaacaacuuuuuccucucucugaaaaagcuggacggcgcgauucuuuggauccccgccuuuuucuuucacacaagcgcuaccgugacaagaacccucgucgauuucuuuguugagcaccggggccagcugaaagugcagcuugccuggccugggaauaucaugcaacaugugaaccgcuacuggaagaauaaacaccugucccccaagagacucagcacgggcauucugauguauacacuggcuucugccaucugcgaagagauucaucucuacggauucuggccuuuuggguucgaccccaacacccgggaagaucugccguaucacuacuaugacaaaaagggaacaaaguuuaccaccaaauggcaggagucccaccagcuuccugcggaguuccaacugcucuaccgcaugcauggcgaagggcugacaaaacuuacgcugagccacugugccuga

SEQ ID NO: 76336 - RNA, 1080 nt, Artificial Sequence
  derived and/or modified sequence opt5 from ST8SIA4__Homo_sapiens__NP_005659
augagaagcauccggaagcgcuggaccauuugcacaaucucccugcuccugauuuucuacaaaacgaaggagaucgccagaaccgaggaacaccaggaaacacaacuuauuggcgacggggagcugucucucagccggucccuggugaacucuagcgauaaaaucauccgcaaggcuggauccucuauuuuucagcauaaugucgaaggcuggaaaaucaacagcucccuuguucuggagauuagaaagaauauccuccgguuccuggacgccgagcgcgaugugagcguggucaagucuuccuuuaaacccggggacgugauucacuauguucuggauagacggcgcacccucaacaucagccaugaccugcacucucuucugccugaaguguccccgaugaagaauagacgguucaaaacaugugcggucgugggaaacagcggcauucuccuggauucugagugcgggaaggaaaucgacucccauaauuuuguuauccgcuguaaccuugcucccguggucgaguucgccgccgaugugggaaccaaaagcgacuuuauuacaaugaauccuuccgugguccagagagcuuucggcggcuuucggaacgagucugaucgcgaaaaguucguucacagacugagcaugcucaaugacuccgugcuguggauccccgccuuuauggugaaagggggagagaagcacgucgaaugggugaacgcucugauucucaagaauaaacugaagguucggaccgccuacccuagccuuagacugauccaugcggugcgcggcuauuggcucacgaacaaaguccccauuaagcggccuucuaccgggcugcuuauguacacacuggccaccagauucugcgaugagauccaccucuauggauuuuggccguuccccaaagaccugaauggcaaggcugugaaguaccauuauuacgacgaucugaaauaccgcuauuucuccaacgccagcccucaccggaugccccucgaauuuaagacacugaacguucuucacaauagaggggcucugaaacucaccacgggaaagugugugaaacaguga

SEQ ID NO: 76337 - RNA, 1197 nt, Artificial Sequence
  derived and/or modified sequence opt5 from ST8SIA6__Homo_sapiens__NP_001004470
augagacccggcggggcccugcucgcucugcuugccagccugcuccugcuucugcuccugcggcugcucuggugcccugcggacgcuccgggacgcgccagaauccugguggaggaaucccgggaggccacccacggcacacccgcugcccuucgcacgcugagaucuccugcuaccgccgucccccgggcgacaaacagcaccuaccucaaugaaaagucccugcagcuuacagagaaauguaagaaccugcaauaugggauugaaucuuucagcaauaaaaccaagggauacuccgagaacgauuaucuccagaucauuacagacauccagucuugcccuuggaaacgccaggccgaggaauacgcuaauuuuagagccaagcuggcuagcuguugcgaugccguucaaaacuucguggugucccagaauaacacccccgucggcacgaauaugagcuaugagguggaaucuaagaaagagauuccuaucaagaaaaacaucuuucauauguucccgguuucccagcccuuuguggacuacccuuauaaucagugugcggucguggggaacggaggcauucugaauaagagccucugcggcaccgagaucgauaaaucugacuucguuuuucgguguaaccugcccccuacaaccggggauguguccaaggacgucggaagcaagacaaaucuugugaccauuaaccccucuaucauuacgcugaaauacggcaaccucaaggagaaaaaggcccuguuccuugaagauaucgcuacauacggggacgccuuuuuccugcucccggcuuuuuccuuccgcgccaauaccggaaccagcuuuaaaguguauuacacacuggaagaguccaaggccagacaaaaaguccuguucuuccacccuaaguaucucaaggaucuggcucuguuuuggcggaccaaaggcguuacagcguaccgccuuucuacggggcucaugauuaccagcguggccguggaacugugcaagaacgucaaacuuuauggauucuggcccuuuuccaagacaguggaggacaucccuguuagccaucacuacuaugauaauaaacugcccaagcauggcuuccaccagaugcccaaggaguacucucagauccuccagcugcacaugaaaggcauucugaagcuccaauuuuccaaaugugaaguggcuuga

SEQ ID NO: 76338 - RNA, 7713 nt, Artificial Sequence
  derived and/or modified sequence opt5 from STAB1__Homo_sapiens__NP_055951
auggccggccccagagggcugcucccucugugccuucuggcuuucugccucgccggauuuuccuucgugcggggccagguccuguuuaaggggugcgacguuaaaaccacauucgugacgcacgugccgugcaccuccugcgcggcuaucaagaaacaaacaugucccucuggauggcuucgcgaacugccugaucagauuacccaggacugcagauacgaaguccagcucggcgggagcaugguguccaugucuggaugucggcgcaagugcagaaaacaaguugugcagaaggccuguugccccggcuauuggggcucccggugucacgagugcccugggggagccgaaacacccugcaacggccacgggaccugucuggauggaauggaccgcaauggcacaugcgucugucaggagaacuuuagaggguccgcuugccaggaaugucaagauccuaaucgguucggaccggacugccagucuguguguagcugcguucacggcguguguaaccacggcccccgcggggauggauccugccuguguuuugccggcuacaccgggccucauugcgaccaggagcuccccgucugccaggagcugagauguccucaaaauacgcagugcagcgcugaagcccccucuugucggugccuuccgggauauacccagcaaggcuccgagugucgcgccccuaaccccugcuggccuagccccuguucucugcucgcccagugcuccgugagccccaaggggcaggcucagugucacugcccugaaaauuaccacggagauggcauggugugucugccgaaagaccccugcacagauaaccuuggcgggugcccuucuaauuccacccugugugucuaucaaaagcccggacaggccuucugcacauguagaccuggccucguuagcaucaacuccaaugcuucugccgggugcuuugcguucuguagccccuuuuccugcgaccggagcgccaccugucaggugacggcugauggaaaaacaucuugcgugugucgcgaguccgaggucggcgacgggagagccugcuacggccaucugcugcacgaagugcagaaggcuacccaaacaggacggguuuuccuccagcugagaguggccgucgccaugauggaccagggcugucgcgagauucuuaccaccgcugggccguuuacagugcugguuccuagcgugucuagcuucuccucucggacgaugaacgcgagccucgcccagcaacugugcagacagcauaucauugcuggacagcacauccuugaagauacccgcacacagcaaacccggagaugguggacacuggccggccaggagaucaccgucacguucaaucaguuuacaaaauauuccuacaaguacaaggaccaaccccagcagaccuucaacauuuauaaagccaauaacaucgcugccaacgggguguuucacgucgugaccggacuccgcuggcaggcgccuagcggcacacccggggauccuaagcggaccauuggccaaauccuggcuucuacagaagccuucuccagauuugagacgauucuggagaauugcggacuccccagcauccuggacggcccggggccuuucaccguuuuugcccccucuaacgaagcuguggauucccuucgcgacggacggcugauuuaccucuucacagccggccugagcaaacuucaggagcuggucagauaucauaucuacaaucacgggcagcucaccguggaaaagcugaucuccaaaggacgcauucugacaauggcuaaccagguucucgccgugaauaucucugaggaaggccggauucugcuugggcccgagggcgucccucugcaaagaguggaugugauggcggccaacggaguuauccauaugcucgacggcauucugcugccgcccaccauccuuccuauccuccccaagcacuguagcgaggaacagcauaaaauugucgcuggguccugcguggauugucaggcccugaauacgucuaccugcccucccaacagcgugaagcuggacaucuuuccuaaggagugugucuauauucacgaucccacaggacucaaugugcugaaaaagggcugcgcuuccuacuguaaccagaccaucauggaacaagggugcuguaaaggauucuuuggcccggacugcacacaguguccugggggcuucagcaaucccugcuauggaaagggcaacugcucugacgggauucagggaaauggcgccugucuuugcuuuccugauuacaaagggaucgcgugucacaucugcuccaaccccaauaagcauggagagcaaugucaggaagacugcggcuguguucacggccugugcgauaaccggccggggagcggaggcgugugucagcaggggaccugcgccccuggauucucuggccgcuucuguaacgaguccaugggggacugcggacccacgggccucgcucaacauugccaucugcacgccagaugugucagccaggagggcguggcucggugcagaugucuggauggguuugaaggagacggcuucucuugcacaccuagcaaucccuguucccaucccgaucgcgggggaugcagcgagaacgccgaauguguuccuggcucucuugggacccaccauugcacaugucacaagggaugguccggcgacggccgggugugcgucgccauugaugagugugagcucgacaugagagggggaugccauaccgaugcucuguguagcuacgugggcccggggcagucccgcuguaccugcaaacugggauuugcgggcgacggguaucaguguucucccaucgauccuugcagagccggaaauggcggcugucacgggcucgcuacaugccgggccguuggaggcgggcaacgcguguguacguguccgccuggauucggcggggacggauuuagcuguuacggcgacauuuucagagaacuggaggccaacgcucacuuuuccaucuucuaucaguggcuuaagucugccggcauuacccugcccgcggaucggcgcgucacagcucucgugccuagcgaagccgccgugagacagcuguccccggaggaccgggcuuuuuggcugcagccccgcacccuuccuaaucucgucagagcccauuuccugcaaggggcgcuguuugaagaggagcucgcucggcugggaggccaggaaguugccacacuuaaccccaccacgcgcugggagaucagaaauauuucugggcgggugugggugcagaacgccagcgucgauguggcugaccugcucgccacaaauggaguucugcacauccugucccaggugcuucucccucccagaggcgauguccccggcgggcaagggcugcugcagcagcucgaccuggugccugcuuucagccuuuuucgcgaacugcuccaacaucacggccugguuccccagaucgaggccgcgaccgccuacaccauuuucgugcccacaaaccggucucuggaagcucagggaaauuccagccaucuugaugccgacaccgucagacaccacgugguucugggagaggcucucucuauggagacacugcgcaaaggcgggcaucggaacucccuccugggaccugcccacuggaucguguucuauaaucauagcggccagcccgaagucaaccacgugccucuugaggggccgaugcuggaagcccccggaagaucucucauuggccuguccggcgugcugacggucgggagcucccgcugccuucacagccaugcugaggcgcugcgggaaaaguguguuaauugcaccagacgcuuucgguguacacaaggauuccagcuccaggauaccccuagaaaaucuugcguguaccggagcggcuuuuccuucucucgcgggugcagcuauacaugugccaagaagauccaggugcccgacugcuguccuggauuuuucggcacccugugcgagcccugucccgggggccucggaggcgucugcuccgggcacggacaaugucaggauagauuucugggcucuggggagugccauugucacgaaggauuccauggcacggcuugcgaggugugugaacuugggcgguacggcccuaacugcaccggaguuugcgacugugcccacggccugugccaggaggggcuccagggagauggcagcugugugugcaacgucggguggcaaggacugcgcugugaccagaaaauuacaagcccgcagugcccuagaaagugugaccccaaugccaacugcgugcaagauucugcuggcgccagcaccugugcgugcgcugccggguacuccggcaauggaaucuuuuguagcgagguugacccuugcgcccacggccaugggggaugcucuccccacgcuaacuguacaaaaguggccccgggccagcggaccugcacaugucaggauggguauaugggagacggcgaacugugccaggagaucaauuccugucuuauucaucacggcgggugccacauccaugcggaauguauuccuaccggaccccaacaggucagcugcucuuguagagagggcuacuccggggauggaauccgcacgugcgaacugcucgaccccuguagcaagaacaauggcgggugcuccccuuaugcuacaugcaaaucuaccggagauggccagcggaccuguacaugcgacaccgcccacacggugggcgaugggcugacauguagagcccgcgucggacucgagcugcuucgggacaagcaugcuagcuucuuuucccugagacugcucgaguacaaggaacugaaaggcgaugggccguucaccauuuucgugccccacgccgaccuuaugagcaaccugucucaggacgagcucgcucgcauccgggcccauagacaacugguuuuucgcuaucacguggucggaugcagacggcuccgcuccgaagaucugcuugagcagggcuacgcgacagcccugagcgggcacccucugagauucucugaacgggagggaagcaucuaucucaaugacuuugcucgcgugguuuccucugaucaugaggccgugaacggcauucugcacuucaucgacagaguccuucugcccccugaagcucuccauugggagcccgaugacgccccuauuccgcggagaaaugugaccgccgcugcgcagggcuuuggguacaagaucuucagcggacugcucaaaguggccggccugcuuccccugcugcgcgaggcuucccaccggccuuuuacaaugcucuggcccaccgaugccgccuucagagcucugccucccgaccgccaggccuggcuuuaccacgaggaucaucgggacaagcuggcggcuauucucagagggcacaugauccggaacguugaagcccuggccucugaucucccgaaucugggaccucuucgcacgaugcauggcacccccaucagcuuuuccuguagcagaacacgggcuggggagcugauggucggagaggacgaugcccgcauugugcaaagacaucugcccuucgaaggcggccucgcguaugggaucgaccagcugcuugagccucccggacugggcgcccggugcgaccauuuugaaacccgcccucucagacugaacacauguucuauuugcgggcuggagccgcccuguccugagggaucccaggaacagggcagccccgaggcuugcuggcgguucuacccuaaauuuuggaccucucccccgcuccacagccuugggcugcgcagcguguggguccacccuucccuguggggaagaccccaaggccucggccgggggugucauagaaauugcgugacgacaaccuggaagccuucuugcugucccggacacuauggcagcgaaugccaggccuguccugggggacccuccagcccgugcucugaucgcggcguuuguauggacgggauguccggaagcggccagugccugugucggucuggcuucgcugggacagccugcgagcuuugugcuccuggagccuucggcccccauugccaagcguguagaugcaccgugcacgggcgcugcgaugaaggacugggcggguccggaagcuguuuuugcgacgagggcuggaccggcccccggugugagguccagcucgaacugcagccugugugcacaccgcccugugccccugaggcuguuugcagagccgggaacucuugugaaugcagccugggauacgagggcgaugggcgcguguguacggucgcugaccucugccaggauggacauggcggguguuccgaacacgccaacugcucucaagugggcaccaugguuacaugcaccugucuucccgacuaugagggagauggcuggagcugccgggccagaaauccuuguacagacgggcaccgcggaggcugcuccgagcaugcuaacugucugagcaccgggcugaauacgcggagaugcgaaugucacgcgggauacgugggcgaugggcuccagugccuggaggaauccgagcccccugucgaccgcugucuuggccagcccccgccuugccauucugaugccauguguacagaccugcacuuccaggaaaaacgggcuggaguguuucaccuccaagccaccagcggccccuaugggcugaacuucuccgaggccgaggcugccugcgaagcgcagggagccgugcuggcuucuuuuccucagcucagcgccgcucagcaacuuggcuuccaucugugccugaugggguggcucgccaauggauccaccgcgcaccccgucguuuuuccgguggccgacuguggcaacgggagagugggcaucgucucucugggagcucgcaagaaucuuagcgagagaugggaugccuacugcuuccgggugcaggacguugcuugucgcugcagaaacggcuuugugggggauggaauuuccacauguaauggcaagcugcucgacguccuggccgcuaccgccaacuucagcacauuuuacgggaugcugcucggauaugcgaaugccacgcagcggggccuugauuuccuggacuuucuggaugacgaacucaccuacaaaacacuguucgugccuguuaacgagggguucguggauaauaugacccuuucuggccccgaccuggagcuccaugcuuccaacgccacacugcugagcgcuaaugccucucaaggaaagcuccuucccgcccacuccggccugagccugaucauuucugaugcggggccugacaacuccagcugggcucccgucgccccuggaaccguggucguguccagaaucaucguuugggacauuauggcuuuuaauggcaucauucaugcccucgccagcccgcugcuugcucccccucagccccaggccgugcuggcgccugaagcgcccccuguggcugccggggucggagcuguucucgccgcgggcgcccugcugggccucguggcuggggcccuuuaucugcgggcucgcggaaaaccgaugggcuucggguuuucugccuuccaggcugaggaugacgccgaugacgauuuuagccccuggcaagaaggaacgaacccuacccugguguccguccccaacccuguguucggcucugacacauuuugcgagcccuucgaugacagccuccuggaagaggauuuuccggacacccagagaauccuuacaguuaaguga

SEQ ID NO: 76339 - RNA, 7656 nt, Artificial Sequence
  derived and/or modified sequence opt5 from STAB2__Homo_sapiens__NP_060034
augaugcugcagcaccucgugaucuucugccugggccuugucguucaaaacuuuuguagccccgccgaaaccacagggcaggcuagacggugcgaccgcaagucccugcucacgauuagaaccgaaugucggucuugcgcccugaaucuuggcgugaaauguccugauggcuacacaaugaucaccagcggguccguggggguccgcgacugcagauauacauucgaggugcggaccuacucucugagccucccgggcugucgccauauuugcagaaaggauuaucugcagccccgguguugcccugggcgcuggggacccgacuguaucgaaugcccuggcggcgcggggucccccugcaacggaagaggcucuugugcugaggggauggaaggaaauggcacaugcagcugucaggagggguuuggaggcaccgccugcgagacgugugccgaugacaaccuguucggcccuuccugcagcucuguuuguaauugcgugcacggggucuguaacuccggacucgauggcgacgggaccugcgaauguuacagcgcuuauacaggaccgaaaugcgauaagcccauuccugagugcgccgcucugcuuugucccgaaaauucucggugcuccccuagcaccgaggacgagaacaaacuggaauguaagugccuccccaauuaccgcggcgaugggaaguauugugacccgaucaacccuugccugagaaaaaucugucauccccacgcccauugcacauaccuuggaccuaaucggcacucuuguaccugccaagagggcuaccgcggcgauggacaggugugucugcccguugaccccugccagauuaacuuuggaaauugcccuacgaaguccacaguguguaaauaugacggcccggggcagagccacugcgaauguaaggagcauuaccaaaacuucguccccggagugggcugcuccaugaccgauaucuguaaaucugacaauccuugccacagaaacgccaacuguacaaccguggcccccgggcggaccgaaugcauuugucagaagggcuaugucggagauggccucacaugcuacgggaauaucauggagagacugcgcgagcugaacacggaaccucggggaaaguggcagggcagacucaccagcuuuauuucccugcuugacaaggcuuaugccuggccccugagcaagcucgggccguucacaguucugcuuccuaccgauaaaggacugaagggcuuuaaugugaacgagcuccugguggacaauaaagcugcccaguacuucgucaagcugcauaucauugcggggcaaaugaacaucgaauauaugaauaacacagauauguuuuacacccucacgggcaaaucuggagagaucuucaauuccgacaaggauaaccagauuaagcugaaacuucacggcgggaagaaaaaggugaaaaucauucagggagacaucauugccagcaauggccugcuccacauccuggaucgcgcuauggacaaacuugaacccacauuugagucuaacaaugagcaaaccaucaugaccaugcugcagccucgguacagcaaguucagaucccuccuggaagagacaaaccuggggcaugcccucgacgaagauggaguuggcgggcccuauaccauuuucgugccuaauaacgaggcucugaacaauaugaaagacggcacacuugauuaccugcucucucccgaaggaagccgcaagcugcuggagcuuguccgguaucacaucgugccguuuacgcagcucgagguugccacccugauuuccacaccucauaucagaagcauggccaaccagcugauucaauucaauaccacagacaacggccagauccucgcuaaugauguggcgauggaagagaucgaaauuaccgccaaaaacgggcgcaucuacacgcugaccggaguccuuauuccgcccucuaucgugccuauucugccgcaccggugugacgagacaaagagagagaugaaacucggcacaugcgucuccugcagccugguguauuggucucgcugucccgcuaauuccgaaccuacagcccuguuuacccaucggugcguuuacagcgggagauucggaucccuuaagucuggcugugcccgguauugcaacgcuacggugaagauccccaaauguugcaagggguuuuacggcccugauuguaaucagugccccggaggcuucagcaacccuuguuccgggaauggacagugcgccgacucucucggcgggaacggaacauguauuugcgaggaaggcuuucaaggcagccagugccaguucuguuccgaucccaauaaauacgggccgcgcugcaacaagaaaugucugugcguccacggaaccuguaauaacagaaucgacagcgauggcgcgugccugacagggaccugucgggacggaucugcuggcagacucugcgauaagcagaccuccgccugugggccuuaugugcaauuuugccacauccaugccacaugugaguacagcaacggaacggcuucuugcauuugcaaggccggcuaugaaggcgacgggacccuguguuccgagauggaccccugcacaggacuuaccccuggcggguguagccgcaaugcugagugcaucaaaacaggaaccggcacgcacacauguguuugccagcagggguggaccggaaacggccgggauuguucugaaauuaauaacugccugcuccccagcgccggcgggugucaugacaaugcguccugccuguacgugggaccgggccagaacgagugugaaugcaagaaaggguucagaggaaauggcaucgauugugagccuauuaccagcugccuggaacaaacagggaagugccacccccuugccucuugucaguccaccagcuccggagucuggucuugcgugugucaggagggcuaugagggcgacggguuucucugcuacggaaacgcugccguggaacugagcuuccuguccgaggcugccaucuuuaaucgcuggaucaacaaugcgucucuccaaccuacacugagcgccacguccaaccuuaccguucugguccccucucagcaggcuacagaagauauggaccaggaugaaaagagcuucuggcucucccaaagcaauauucccgcccugaucaaguaucacaugcugcuuggcaccuacagaguggcugaccuccagacacugucuuccagcgauaugcuggccaccucucuccaggggaacuuccugcaucuugccaaaguggacggaaauauuacgaucgagggcgcuuccauugucgauggggacaacgcggccaccaacggagugauccacaucauuaauaagguucuggugccucagcggcgccucacaggcagccugccgaaccugcuuaugagacuggagcaaaugcccgauuacucuaucuuucggggcuauauuauccaguacaaucucgcuaacgccauugaggccgcugacgccuauaccgucuucgcgccuaauaacaaugcuaucgaaaacuacauccgcgagaagaaagugcugucccucgaagaggacguucugagauaucaugugguccuugaggaaaagcugcucaaaaaugaucugcacaacgggaugcaucgggagacaaugcugggauuuagcuacuuccuuuccuuuuuccugcacaaugaccagcucuaugugaacgaagcccccauuaauuacaccaacguugccacagauaagggcgugauccacgggcugggaaaaguccucgagauucagaagaaucgcugugacaacaaugauaccacgaucauuagaggccggugccgcacauguagcucugaacugaccugcccuuuugggaccaagagccuuggaaacgagaaaagacgguguaucuacacauccuauuucaugggcagacgcacccuguuuauuggcugccaacccaagugugugcggacggugaucacaagagagugcugcgcuggguucuuuggaccucagugucagccgugccccggcaacgcccaaaaugucuguuucgggaacggaaucugccucgacggcguuaaugggaccggagugugugaaugcggcgagggcuuuucugggacagcgugugaaaccugcacagagggaaaauacggcauucauugugaucaggcuugcagcugugugcacgggcgcugcaaccagggaccucugggcgacggguccugcgauugugacgucggcuggcggggagugcauugcgauaaugccaccacggaagacaacuguaauggaaccugccacacaucugccaacugucugaccaauagcgacgggacagcuuccugcaagugugccgcuggauuccagggcaacgggaccaucugcacggccauuaaugcgugugagaucucuaacggaggcugcagcgccaaagcugauuguaagagaacaacccccgggcgccggguuugcacaugcaaggccggcuauaccggagacggcauugugugucuugagaucaauccuugccuggaaaaccaugggggaugugauaaaaaugcugagugcacccaaacaggccccaaccaggccgccuguaacugccucccggcuuacacgggggacggaaaggucuguacccugaucaaugugugccucaccaagaacggcggguguuccgaguucgcgauuugcaaucacaccggccagguugagagaacauguaccugcaagccuaacuauaucggagauggcuuuacgugccgcgggagcauuuaccaggaacugcccaaaaaucccaagacaucucaauauuucuuucagcuucaggagcacuucgugaaggaccuggucggaccuggccccuuuaccguguucgccccucuguccgcugccuuugaugaggaagcccggguuaaagacugggauaaguacgggcucaugccccaggugcugagauaccaugucguggcuugucaccaacuucugcucgagaaccugaaacucaucagcaaugccaccucucugcagggagaacccauugugaucuccgucagccaguccacaguuuauaucaacaauaaggcgaaaauuaucucuagcgacauuaucuccaccaacggcauugugcauaucauugauaaacuucugagcccuaaaaaucugcucaucacacccaaggacaacucuggccggauccugcagaaucuuacgacccuggcuacaaacaauggguacauuaaguucuccaaccucauccaagauagcggacugcucucugugauuaccgacccuauccacacacccgucacccuguuuuggccgacggaccaggcccuucacgcccugccugcugagcagcaagauuuccuguuuaaccaggacaauaaagauaagcucaaagaguaucugaaguuccaugugauucgcgacgccaaaguucuugcgguggaucugcccaccagcacagcuuggaagacccuccagggcuccgaacugucugucaagugcggggccggaagagacaucggcgaucucuuccugaacgggcagacaugucggaucgugcaacgcgagcuucuguuugaccugggaguugccuacggcauugauugccuccugaucgacccuacccuuggcgggagaugugauacauucacgaccuuugacgcuagcggagaaugcggcuccugugugaauacacccucuugcccucgguggagcaaacccaagggggucaaacagaagugucuguauaaccucccguucaaaagaaaucuggagggaugccgcgaacgguguucccuggugauucagaucccuagaugcugcaagggcuacuuugggcgcgauugucaggccugccccggaggccccgacgcuccuuguaacaaucggggcgucugccucgaccaauauagcgccaccggggaguguaagugcaacaccggauucaauggcacagcgugugagaugugcuggccggggagauuuggacccgauugucuuccuugcggcuguucugaccacgggcagugcgaugacggaauuacgggcuccggccagugccugugugaaaccggguggacaggacccagcugcgauacccaggccgugcugccugcuguuuguacacccccuugcuccgcccaugcuaccuguaaagagaacaauacgugcgaauguaaccucgacuacgagggcgaugggaucacaugcaccguggucgacuucuguaagcaagauaauggaggcugcgccaaaguggcccgcuguucucagaaggggaccaaaguuagcugcuccugccagaagggauacaagggcgacggccacucuuguacagaaaucgauccgugcgcugacgggcugaacggaggcugucaugagcacgcgaccugcaaaaugacagggcccggaaagcacaaaugugagugcaagagccauuaugugggcgacgggcuuaauugugaaccugagcaacugcccauugaucggugccuccaggacaacggacagugucacgccgaugcuaaaugcgucgaccugcauuuucaggauaccacggugggcguguuccaccugagauccccucucggccaauacaaacuuacauuugacaaggcccgcgaagccugugcuaacgaggccgcgaccauggcuacauauaaucagcugagcuacgcccagaaagccaaguaucaccugugcucugcuggguggcucgaaaccggaagaguugccuaccccacggcguucgccucccagaacugcggcagcggggucgugggaaucguggauuauggcccgcggccuaauaaaucugagaugugggacgucuuuuguuaccgcaugaaggaugugaacugcaccuguaaaguuggguacgugggagacggcuucuccugcagcggcaaucugcuucaaguccugaugucuuuccccagccucacaaacuuucugaccgaggugcuggcuuauuccaauucuagcgccagagggcgggcuuuccucgaacaucuuacagaucuguccauucgcggaacccuguuuguuccccagaacagcggccucggggagaaugaaacacuguccggaagagacaucgagcaccaucuugccaacgugucuauguucuuuuacaaugaucuggucaacggcaccacgcuccagacacggcuggggagcaagcugcucauuaccgcuucccaggacccucuucaacccaccgagacaagauucguggacggccgcgccauccugcagugggauauuuuugcgucuaauggaaucauccacguuauuagccggccucugaaagccccgcccgcuccugugacccucacacauacgggccugggggccggaaucuucuuugcuauuauccuugucaccggcgccguggcccuggcugcguauuccuacuucagaauuaaccgccggacaaucggguuucagcacuucgaaucugaggaagacaucaauguggccgcucucggaaagcagcaacccgagaacauuagcaacccucuguaugaauccaccacaagcgcgcccccggagccuucuuacgaucccuuuaccgacuccgaggaaagacagcuggagggcaaugauccucuccggacgcuuuga

SEQ ID NO: 76340 - RNA, 978 nt, Artificial Sequence
  derived and/or modified sequence opt5 from STAC3__Homo_sapiens__NP_001273185
auggagcugcccccugaaccgcaggccaacggcgaggcugugggggccggaggcgggcccaucuacuauauuuacgaagaggaagaggaggaagaggaagaggaggaagaaccucccccugaacccccuaagcucgucaaugacaaaccgcacaaguucaaagaucacuuuuucaagaaacccaaguuuugcgacguuugugcgagaaugaucgugcugaacaauaaguucggacuucggugcaaaaacuguaagaccaauauucaugagcauugccaaagcuauguggaaaugcagcgcuguuuuggcaaaaucccucccggguuccacagagcuuacuccucuccucuguauagcaaccagcaguacgccugcgucaaggaucucuccgccgcuaaucggaacgaccccguguuugagacacugcgcacgggaguuauuauggccaauaaagagagaaagaagggccaagcugauaaaaagaacccgguggccgcgaugauggaagaggaaccugagucugcccggcccgaagagggcaaaccucaggacgggaaucccgagggagauaagaaagcugaaaagaaaacccccgacgauaagcauaagcagccuggcuuccagcaaagccacuauuuugucgcccuuuaccgcuucaaagcucuggagaaggacgaucucgacuuuccgcccggggagaaaaucacagugaucgaugacuccaacgaggaaugguggagaggaaagauuggcgagaaaguuggguucuuuccucccaauuucaucauucgggugcgcgccggagagagaguccaccgggugacccgcucuuucgugggcaacagagaaaucggccagauuacacugaagaaggaccagaucgucguucagaaaggggaugaggcgggaggcuacgugaagguguauaccgggcggaaagucggacuguuuccuacagacuuccucgaagagauuuga

SEQ ID NO: 76341 - RNA, 1209 nt, Artificial Sequence
  derived and/or modified sequence opt5 from STAC__Homo_sapiens__NP_003140
augauucccccuagcuccccgagagaggacggcguggaugggcugcccaaggaagccgucggagcugagcagccucccucuccugccagcaccuccucucaagaaagcaaacuccagaagcugaaacggucccuuucuuucaagacaaaaagccugcgcuccaagagcgcggacaacuuuuuccagagaacaaauucugaggauaugaagcuccaggcucacaugguugccgaaaucucccccuccucuuccccucugccggcccccggcagccuuaccucuacgccugcucgggccgggcugcaucccggaggcaaagcucacgccuuucaagaguacaucuucaagaaaccuaccuuuugcgacguguguaaccauaugauuguggggacaaaugcgaagcacggacuccgcugcaaagccuguaagauguccauccaucacaagugcaccgauggccuggcuccccagagauguaugggcaaacugccgaagggguuccggcgcuauuacagcuccccucuccugauucacgagcaguuuggaugcaucaaagaagucaugcccaucgccuguggcaacaagguggacccuguuuaugagacacuuagauucgggaccucucuggcucagcggacgaaaaagggaagcuccggcagcgggucugauagcccccaucgcaccagcacaucugaccucguggaaguccccgaggaggccaauggaccuggcggcggguacgaucugagaaaacggagcaacuccguguuuaccuauccggaaaauggaacagacgauuuccgcgaccccgcgaagaacauuaaucaccaaggcucucuuagcaaggauccucugcagaugaacaccuacguugcccucuauaaauuugugccccaggagaaugaagaccuggagaugagaccuggggacaucauuacgcugcucgaagauuccaacgaggacugguggaagggaaaaauccaggaucggauuggcuucuuucccgcuaauuucguccaacgccugcagcagaacgagaagaucuucagaugcgugcggacauuuauuggguguaaagaacaaggacagaucacccuuaaggagaaucagaucugcgugagcucugaagaggaacaggacggcuucauuagaguccuguccggcaagaaaaaggggcucaucccgcuggauguucuugagaacauuuga

SEQ ID NO: 76342 - RNA, 3777 nt, Artificial Sequence
  derived and/or modified sequence opt5 from STAG1__Homo_sapiens__NP_005853
augaucaccagcgagcugcccgugcuccaggacuccacaaacgaaacgaccgcccacucugaugcuggcagcgagcuggaagagacagaagucaaggggaaaagaaagcggggacgcccuggcagaccgcccuccaccaauaaaaagccucggaaaucucccggggaaaagagccgcauugaggccggaaucagaggcgcggggcggggacgcgcuaacggccauccucaacagaauggcgaaggggagcccguuacacuuuucgaaguggugaagcugggaaaauccgccaugcagucugucguggacgauuggauugagagcuacaagcaggacagagauaucgcccuccuggaccuuauuaacuuuuucauccaaugcuccggcugucgggggaccguucgcaucgagauguuuagaaauaugcagaacgcugaaauuauccggaaaaugacagaggaguucgaugaggacagcggagauuauccucugaccaugccgggcccccaguggaagaaauuucgcucuaauuucugcgaauuuauuggggugcucaucagacagugucaauacuccauuaucuaugacgaguacaugauggauacggucauuagccugcugaccggacucucugacucccaggugcgggccuuccgccacacaagcacccuggcugccaugaaacuuaugacagcgcugguuaacguggcccucaaucugucuauccaucaggauaacacccagagacaauaugaggcugaacggaauaagaugaucggcaagagagccaacgagcgccuugaacugcuccugcagaagcggaaagagcugcaggaaaaucaagacgagauugagaacaugaugaacuccaucuuuaagggcauuuucguccacagauaccgcgacgcuaucgccgaaauucgggcgaucugcaucgaggaaauugggguguggaugaaaauguauagcgaugccuuucucaaugacuccuaccugaaguacgugggauggacgcuucaugauagacagggcgagguccgccugaaaugucucaaggcucugcagucucuuuauacaaaccgggaacuguucccuaagcucgagcuguuuaccaauagauucaaagaccgcaucguuagcaugacacuggauaaggaguacgacguggccguggaagcuauucggcucgucacccugauccuucacggguccgaggaagcccugagcaacgaggauugcgagaauguguaucaccucguuuacucugcccauagacccguggcugucgcggccggagaguuccugcacaaaaagcuguuuucccgccaugacccucaggcugaagaagcccuugccaaacggagaggccggaacagccccaaugggaaccucauucgcaugcuggugcuguucuuucucgagucugaacugcacgagcacgcugccuaucuuguugauagccugugggaguccucucaagaacuccugaaggacugggaguguaugaccgaacugcuucucgaggaaccggugcagggagaggaggcgaugagcgauagacaggaauccgcucugaucgagcugauggucugcacaauccggcaggccgccgaagcucauccucccgugggcagaggcacggggaagcgcguccucaccgccaaagagcggaagacacaaauugacgacagaaauaaacugaccgaacacuucaucauuacacuuccuaugcugcucagcaaguacucugcugaugccgagaaaguggcgaaccugcugcagaucccccaguauuuugaccuugagauuuacuccaccggacgcauggaaaagcaucucgaugcccugcugaagcagaucaaauucguuguggagaagcacgucgaaagcgacgugcucgaggcuuguucuaaaacguacuccauucugugcagcgaggaauauacaauccaaaauagaguugauaucgcccggucccagcuuauugacgaguuuguggaucgcuucaaccauucugucgaagaccugcuccaggagggcgaagaggcugaugacgaugacaucuacaaugugcugagcacccugaagagacuuaccuccuuucacaacgcccacgaucucacaaaaugggaccuguucgggaauuguuaucggcugcucaagaccggaauugagcauggcgcgaugcccgaacagaucgugguucaagcccugcagugcucucacuacagcauucuuuggcagcuggucaagaucacagacggguccccuagcaaagaggaucuccuggugcugcgcaagacggugaaaucuuuucuugcugucugccaacagugucucuccaacgugaauaccccgguuaaggaacaggccuucaugcugcugugcgaccuccugaugaucuuuagccaucagcuuaugacaggcggaagagagggccugcaaccccucguguucaacccugauaccgggcugcagucugaacugcuuuccuucgucauggaccacguguuuauugaucaggacgaggagaaccagagcauggaaggagaugaggaagacgaggcuaauaaaaucgaagcccugcacaagcggcgcaaccuccuggccgcuuucucuaaacucauuaucuaugauauuguugacaugcaugcggccgcugauaucuuuaagcacuacaugaaguauuacaaugacuacggcgauaucauuaaagagacacugagcaagaccagacaaaucgacaaaauucagugugccaagacgcuuauccugucccuccagcagcuguucaacgagcuggugcaagaacaggggcccaaucuugaccggaccagcgcccaugucucuggaauuaaagagcuggcucgcagauuugcccucacauucggccuggaucagaucaagacccgggaagcgguggcuacacuccacaaggacgggaucgaguuugccuucaaauaucaaaaccagaagggccaggaguacccucccccgaaucuggccuuucuugaaguucuguccgaguucagcuccaaacuccugagacaggauaagaaaaccgugcauucuuaucuggaaaaguuucuuacggagcaaaugauggaacgccgggaggacgucuggcugccucucauuagcuacagaaacucccuggugacaggaggcgaggaugaccgcaugucugugaauagcggguccucuagcuccaagaccagcucuguccggaacaaaaagggaagacccccucuccacaaaaagcgcguugaagaugagucccuggacaauacauggcuuaaccggaccgauaccaugauccagacacccggcccucugcccgcuccgcagcugacgagcaccgugcucagagaaaauucucgcccuaugggggaccagauucaagagcccgaauccgagcacggaagcgagcccgauuuccugcauaacccucagaugcagaucucuuggcuuggccagccgaaacuggaagaccucaaucggaaggacagaacagggaugaacuauaugaaggugcggaccggcguccgccacgccgugagaggacugauggaggaagaugcggagcccauuuuugaagacguuaugauguccagccggucccaacucgaggauaugaacgaggaguucgaagacacaauggugaucgaucugccucccagccgcaauagacgggaaagagcugagcuucgcccugacuucuuugauucugccgccauuaucgaggacgauagcggcuucgggaugcccauguuuuga

SEQ ID NO: 76343 - RNA, 3807 nt, Artificial Sequence
  derived and/or modified sequence opt5 from STAG2__Homo_sapiens__NP_001036215
augaucgccgcucccgagauuccuaccgacuucaaccugcuccaggaaagcgagacacacuuuuccucugauacggacuucgaagauaucgagggcaagaaucaaaaacaggggaagggaaaaaccugcaagaaaggcaagaaggggccggccgaaaaaggaaagggcgggaacggaggcggcaaacccccuagcgggcccaauagaaugaacggacaucaccagcagaauggcguggagaacaugaugcuguuugaggucguuaagauggggaaauccgcgaugcaaucugugguggacgauuggauugaaagcuacaagcaugaccgggauaucgcccuucuggaccucauuaauuucuuuauccaguguuccggaugcaagggcgucgugacagcugagauguuccgccacaugcagaacucugaaaucauuagaaaaaugaccgaggaguuugaugaagacagcggggauuauccucugacaauggccggaccccaguggaagaaauucaaguccagcuuuugugaguucaucggcguucuugugcggcaaugccaguacucuauuaucuaugacgaauacaugauggauaccgucauuucccugcucacaggccugagcgacucucaggugcgcgcuuuuagacauaccuccacgcuggccgcuaugaaacucaugaccgcccugguuaauguggcgcuuaaccugagcaucaauauggacaacacacagcggcaauaugaggccgaacgcaauaagaugauugggaaaagagcuaacgagcggcucgagcugcuucugcagaagcgcaaggaacuccaggagaaucaagaugaaaucgagaacaugaugaacgccaucuucaaaggagucuuugugcacagauaccgggacgcuauugccgaaauccgcgcgauuuguaucgaggagauuggcaucuggaugaagauguauucugaugccuuccugaaugacuccuaccugaaauacgugggguggaccaugcacgauaagcagggagaagucagacucaaaugccugacagcccuucagggccuguauuacaacaaggagcucaauagcaagcuggaacuuuucaccucccgguuuaaagaccgcaucguuucuaugacgcuggauaaggaguaugacguggcugugcaggcuauuaaacuccugacacugguccuccaaagcuccgaagaggugcugaccgccgaggauugugaaaacguuuaccaucuuguguauagcgcccacagaccugucgcuguggcggccggggaguuccuguacaagaaacucuuuucucggagagacccggaagaggauggaaugaugaagcgccggggcagacagggccccaaugcuaaccugguuaagacacuuguguucuuuuuccuggaguccgaacuccaugagcacgccgccuaucuggucgacagcaugugggacugcgcuaccgaacugcucaaagauugggaguguaugaauagccugcuucuggaagaaccucucagcggggaggaagcccugaccgaccgccaggaguccgcgcugaucgaaauuaugcuuugcacaauccggcaggcugccgagugucaucccccugugggaagaggcacggggaagcgcguccucaccgccaaagaaaagaaaacacaacuggaugaccggaccaagauuacagagcuguuugcuguggcccucccccagcugcuugcuaaguacucuguugaugccgagaaagugaccaaccugcuccagcugccgcaguacuucgaccuggaaaucuauacgacaggaagacuugagaagcaccucgaugcgcugcugcgccaaauccggaauauugucgaaaaacacaccgacaccgaugugcucgaggccugcagcaagacauaccaugcucugugcaacgaagaguuuaccaucuucaauagaguugacauuucccgcagccagcuuaucgaugagcuggccgacaaauuuaaccggcuccuggaagauuuccugcaggagggcgaggagccugacgaggacgaugcuuaucaggugcuuucuacacucaagagaauuacggccuuucacaaugcgcaugaccuguccaaaugggaucuguucgccuguaacuacaagcuccugaagaccgggaucgaaaauggcgacaugcccgagcaaauugucauccacgcccuucagugcacacacuaugugauccuguggcagcucgcuaaaauuaccgaaucuucuuccacaaaggaggaucugcugcggcuuaaaaagcaaaugcgcguguucugucagaucugccagcauuaccucaccaacguuaacacgaccgucaaagaacaggcuuuuacaauucugugugacauccugaugauuuucagccaccaaaucauguccggaggcagagauaugcucgagccucugguguauacccccgacucuagccuucaguccgagcugcucucuuuuauccuggaucauguguucauugaacaggacgaugacaauaacagcgccgaugggcagcaagaggacgaagccuccaagaucgaggcucugcacaagcggagaaaucuucuggcggccuuuugcaaacucauugucuacacagugguugaaaugaacaccgcugccgacaucuucaagcaguacaugaaauauuacaaugauuauggagacauuaucaaggagacgaugagcaaaacacgccagaucgauaagauucagugugccaagacccugauccucucucugcaacagcuuuuuaacgagaugauucaggaaaauggcuacaacuucgaccgguccagcucuacauuuuccgggaucaaagagcuggcuagacgcuucgcccucaccuuuggacuggaucaacugaagaccagagaagcgauugcuaugcuucacaaagacggcaucgaguucgccuuuaaggaacccaauccucagggggagagccauccgccccugaaccucgccuuccuggauauccucucugaguucagcuccaaacugcuucggcaggacaagcgcacaguguaugucuaccuggaaaaguuuaugacguuccagaugagccucagacgggaggauguguggcugccucugaugucuuaucgcaauucccuucuggcuggcggagacgaugacaccaugagcguuauuuccggcaucucuagcagaggguccacagugcggucuaaaaagagcaaacccuccaccggaaagcgcaaagucguggaaggcaugcaacucucucugacagaggagagcuccagcucugacuccauguggcucagcagagaacagacccugcacacgccuguuaugaugcagacaccccagcuuaccucuaccauuaugcgggagccgaagcgccugagaccugaagauuccuuuaugagcguguaccccaugcaaacagagcaucaccagaccccucuggacuacaacacacaggucacguggaugcucgcccagcggcaacaggaagaggcgagacagcagcaagagcgcgcugccaugucuuaugugaaacugcggaccaaucuucagcaugccaucagacgcgggacaucccugauggaagaugacgaggaacccauuguggaggaugucaugaugagcuccgaaggacggaucgaggaccucaacgagggcauggauuucgacaccauggauauugaccugccucccagcaagaauagacgcgaacggacagagcucaagccggacuuuuucgauccugcuucuaucauggaugaaagcguucuggggguguccauguuuuga

SEQ ID NO: 76344 - RNA, 3681 nt, Artificial Sequence
  derived and/or modified sequence opt5 from STAG3__Homo_sapiens__NP_001269646
augagcucuccccugcagagagccgugggcgacaccaagcgggcucucucugccagcuccucuagcuccgcgucucugccuuucgaugaccgcgauagcaaccacacauccgaggggaauggagacagccuucuggcugaugaagacacggauuuugaggacucucucaacagaaaugucaaaaagcgggccgccaaacgcccgcccaagaccacaccuguugcuaaacaucccaagaagggcuccagaguggugcaccggcauagccgcaaacaaucugaaccucccgccaacgaucuguucaaugcugucaaggccgcgaaauccgacaugcagagccuuguggaugaguggcuggacucuuacaagcaggaucaggacgccggguuucucgaacugguuaacuucuuuauccaauccugcggauguaaaggcauugugaccccugagauguucaagaagaugagcaauuccgagaucauucagcaccugacagaacaguuuaacgaggacucuggggauuauccgcucaucgcucccggaccuagcuggaaaaaguuccagggcuccuuuugcgaguucgucagaacccuggugugucaaugccaguacagccuucuguaugacggcuuucccauggaugaccucauuucucugcuuacagggcuguccgauagccagguucgggccuuccgccauaccucuacgcucgcugccaugaaacugaugaccagccuggugaaggucgcgcuccagcuguccgugcaccaagacaauaaccagagacaguacgaagccgagcggaauaaaggaccuggccaacgcgcucccgaaagacuugagucucugcucgaaaagcggaaagagcugcaggaacaccaggaggagaucgaagggaugaugaacgcccuuuuucgcggaguguucguccauagauaucgggauguucugccggagaucagagcuauuuguaucgaagagauuggcugcuggaugcagagcuacuccaccagcuuccucaccgacucuuaucugaaguacaucggguggacacugcacgauaagcaucgcgaagugcggcucaaaugugugaaggcccugaaaggacuuuacggcaauagagaccugaccacgcgccucgagcuguuuacaucccgguucaaggauagaauggucagcauggugauggaccgcgaguaugacguugccguggaagcuguccggcuucugauucucauccugaaaaacauggagggcgugcugaccgaugcggacugcgaaucuguuuacccuguggucuaugccucccacagagggcucgcuagcgccgccggagaguuucuguacuggaaacuuuucuaucccgaaugugagauucgcaugaugggcgggcgggagcaaagacaguccccuggagcucagcgcacauuuuuccagcugcuccuguccuuuuucguggaaagcgagcugcacgaucaugccgcguaccuugucgacucccucugggauugcgcuggcgcccggcugaaggacugggaagggcugaccucucuccugcuugagaaggaucaaaaucugggagacgugcaggagagcacccucaucgaaauccugguuuccagcgccagacaggcuucugagggccacccucccgugggccgggucacagggcgcaagggacugacguccaaagaaagaaagacccaggccgaugaccgggugaaacuuacagagcaucucauuccccugcugccgcaacuccuggcuaaguuuagcgccgaugcggaaaagguuacaccccuucugcagcuccugucuuguuucgaccugcacaucuauugcacaggcagacuugagaaacaucucgagcuguuucugcagcagcuccaagaaguggucgugaagcacgccgagccugcugugcuggaagccggggcucacgcccuuuaccugcucugcaaccccgaguucaccuuuuucucccgcgcggauuucgcccggagccagcugguugaccugcuuacggacagauuucagcaagaacucgaggagcugcugcagucuagcuuccucgaugaagacgaggucuacaaccuggcugccacacuuaaacgccuguccgcuuuuuauaauacccaugaucucaccagaugggaacuguacgagccuuguugccagcugcuucagaaggccguggacacaggagaagugccccaccaagucauucugccggcccucacccugguguauuucagcauccucuggacacugacgcauauuucuaaauccgaugcuagccagaagcagcuuuccucucugcgggaccgcaugguugcguuuugugagcucugccagagcugucuguccgauguggacaccgagauccaagaacaggccuucguccugcuuucugaucugcuccugaucuuuagcccucagaugauugugggcgggagagacuuccuccggccccugguguuuuucccugaggcuacacuucaguccgaacuggccucuuuucucauggaucacguuuucauccaacccggcgaccugggaagcggcgauucccaggaggaccaucugcagauugagcgccuucaccaaagacggcgccugcucgccggguuuugcaagcugcuccuguacggaguccuugaaauggacgcugccagcgauguguucaaacacuauaacaaguucuacaaugacuauggcgauaucauuaaagagacccugacaagagcgcggcagaucgaccgcucucauuguuccagaauccugcuccugagccuuaagcagcuguacaccgaacuccugcaggagcacgggccucaaggacucaacgaacugcccgcuuuuauugagaugcgggaucuugccagacgcuucgcccugucuuuuggcccgcagcagcugcagaaucgggaccucguugugaugcugcauaaagaggggauccaauucucccuuagcgaacugccucccgcuggaucuuccaaccagcccccuaaucucgccuuucuggagcuccugagcgaguucuccccgagacuuuuucaccaggauaagcagcugcugcucagcuaccuggaaaaaugccuucaacacgucucucaggcgcccggccauccuuggggccccgugacgaccuauugucacagccuguccccuguggaaaacacagcugagaccucuccccagguccucccuagcuccaagcgccggagaguugaggggcccgccaagccgaaucgcgaagacgugucuagcucccaggaggaaucucugcaacucaacagcauuccucccacaccuacccugacguccacagccgugaaaagccggcagccccuuuggggacugaaggagauggaagaggaggauggcucugaacuggacuucgcucaggggucccaaccggucgccggaaccgagagaagccgcuuucucggcccucaguacuuccagacaccccauaauccuucugggcccggccugggaaaccagcuuaugcggcugucccucauggaagaggaugaggaagaggaacuggagauccaagacgaaagcaaugaggagagacaggacaccgauaugcaggcuuccucuuauagcuccaccagcgaacggggccuggaccuccuugauucuacagagcuggacauugaagauuuuuga

SEQ ID NO: 76345 - RNA, 1578 nt, Artificial Sequence
  derived and/or modified sequence opt5 from STAM2__Homo_sapiens__NP_005834
augccccuguucaccgccaacccuuuugagcaggacguggaaaaggcuacaaaugaguacaacacgaccgaagauuggagccucaucauggacauuugcgauaaagucggcuccacaccgaauggggccaaggacugucugaaagcgaucaugaagagaguuaaccacaaagugccccauguggcucugcaagcccugacccuccugggagccugcgucgcuaauuguggcaagauuuuccaccuugaggugugcucucgggauuuugccacagaaguucgcgcugugaucaagaacaaagcccauccuaaggucugugagaaacuuaagagccucaugguggagugguccgaagaguuccagaaagacccccaguuuucucugauuagcgcgaccaucaaguccaugaaggaagaggggaucacauucccucccgccggaucucagaccguuagcgcugccgcuaaaaauggcacguccagcaacaagaauaaagaggaugaagacauugccaaggcgaucgagcugucucuccaagaacagaaacagcagcacaccgagacaaagucccuguauccuagcucugaaauucaacuuaacaauaaaguggccagaaagguccgggcucuguacgauuuugaggccguggaggacaacgaacucaccuucaagcauggggagaucauuaucgugcuggaugacuccgaugcuaauugguggaaaggagaaaaccaccgcggcauuggccuuuuuccgagcaauuucgucacaaccaaccugaacaucgagacggaagccgccgcuguugacaagcucaaugugaucgacgaugacguggaggagauuaaaaagucugaacccgagccugucuauaucgaugaagacaaaauggauagagcgcuccaggugcugcaguccauugaccccacagauagcaagccugacucccaggaucugcuggaccuugaggauaucugccaacagauggggcccaugauugacgaaaagcuggaggagaucgaccggaaacacucugaacucagcgagcugaacguuaaggugcuugaagcccuggagcucuacaauaaacuggucaacgaggcuccgguguauuccguuuacagcaagcugcauccucccgcccacuauccucccgccucuuccggagugcccaugcagaccuacccuguccaaagccauggcgggaauuacaugggacagucuauccaccaggugacagucgcucagagcuauucccucggcccggaucaaauugggccccugcgcucucuuccucccaacgugaauagcuccguuaccgcccagccugcgcagaccagcuaccugucuacaggacaggacacgguguccaaccccaccuauaugaaucaaaacagcaaucuccagucugcuacaggcaccacagccuacacccagcagaugggcauguccgucgauaugagcuccuaucaaaacacgacaucuaaucugccgcagcuugccggguuuccugugaccguucccgcucacccuguggcccagcagcauaccaacuaccaccaacagccccugcucuga

SEQ ID NO: 76346 - RNA, 1275 nt, Artificial Sequence
  derived and/or modified sequence opt5 from STAMBP__Homo_sapiens__NP_998787
augagcgaccacggcgaugugucccugcccccugaggacagaguccgggcccucucucagcuggggagcgcuguugaagugaacgaggauaucccgccccgcagauacuuccgguccggaguggaaauuauccgcauggccucuauuuauagcgaggaaggcaauaucgagcaugcguuuauucuuuacaacaaguauaucacccuguucaucgagaaacucccuaagcacagagacuacaaauccgcugucauucccgaaaagaaagauacagugaagaagcugaaagagaucgccuuuccuaaggccgaggaacuuaaagcugagcugcucaagcgguauacgaaagaauacaccgaguauaaugaagagaagaagaaagaagccgaggagcuggcucgcaacauggccauucaacaggaacuggagaaggaaaaacagagaguugcgcagcaaaagcagcagcagcucgagcaagaacaguuccaugccuuugaggagaugauccggaaucaggaacuggagaaagaacgccuuaagauugugcaggaguucgggaaagucgaccccggacugggcgggccucucgugccggaucuggaaaagcccucucuugacguuuuuccuacacugaccgugagcuccauccaacccagcgauugccacacaaccgucagaccugcuaagcccccggugguggaccggucucucaaaccuggagcccuguccaacagcgagucuauucccacaaucgauggccugcgccaugucguugugccuggcagacucuguccccaguuccugcagcuugcuuccgccaauaccgcgcgcgggguggagacgugcggaauccuguguggcaagcucaugcggaacgaauuuaccauuacacacguccugauccccaaacaaagcgccgggucugacuacugcaauaccgagaacgaagaggagcuuuuccugauucaggaucagcagggacucaucacacugggcuggauucacacccauccuacgcaaacagcuuuucuguccagcguggaccuccacacccauuguuccuaccagaugaugcugccggaaucuguugccaucgugugcagccccaaguuccaggagacaggguuuuucaaacuuaccgaccacggacuggaagagaucuccagcuguagacagaagggcuuccacccucauucuaaggaucccccucucuuuugcuccuguagccacgucaccgugguugaccgggcugugacaauuacggaucugagauga

SEQ ID NO: 76347 - RNA, 1311 nt, Artificial Sequence
  derived and/or modified sequence opt5 from STAMBPL1__Homo_sapiens__NP_065850
auggaccagcccuucaccgugaacagccugaagaaacucgccgcuaugccugaucacacagacgucucccugucuccggaggaaagaguucgggcccuuagcaagcugggcugcaauaucacgauuuccgaggauaucacaccccgcagauacuuucggucugggguggaaauggagcgcauggcgagcguguaucucgaagagggaaaccuggagaaugcuuucguccuuuacaacaaauuuauuacccuguucguggaaaagcucccuaaucauagagacuaucaacagugugccguucccgagaaacaggauaucaugaagaagcugaaagaaauugccuuuccucggaccgacgagcugaagaacgaucuccugaaaaaguacaauguggaguaucaggaauaccuucaauccaaaaacaaguauaaggcugagauccugaaaaagcucgaacaccagcgccugaucgaggccgaaagaaaacggauugcucagaugcgccagcaacagcuugagucugagcaguuccuguuuuucgaagaccagcucaagaaacaagagcuggccagaggccagaugcggagccagcaaacauccgggcugagcgaacagaucgauggaucugcgcucuccugcuuuagcacccaucagaauaacucucugcuuaaugucuucgccgaccagcccaacaaguccgaugcuacaaauuacgccagccacucuccuccggugaaccgcgcucugacccccgccgcgacgcucuccgccguucaaaaucugguggucgagggccuuagauguguggugcugccugaagaccucugccauaaauuucugcagcuggcugagagcaacaccguccgggggauugagacauguggaauccucugcggcaagcugacccacaacgaguucacaauuacccacguuaucgugcccaagcaguccgccggcccugauuacugugacauggagaauguggaagaacuuuuuaacguccaggaccaacaugaucugcucacgcugggguggauucacacacaucccacccagacagcuuuccuuucuagcguggaccugcacacccacugcuccuaucagcucaugcugccggaagccaucgccaucguuuguagcccuaaacauaaggauaccggaauuuuccgccugacaaaugcuggcaugcucgaggugucugcgugcaaaaagaaaggguuucacccccauacgaaggagccuagacuguucuccaucuguaagcacguccuugugaaagacauuaagaucauuguucuggaucuccgguga

SEQ ID NO: 76348 - RNA, 1623 nt, Artificial Sequence
  derived and/or modified sequence opt5 from STAM__Homo_sapiens__NP_003464
augccccuguucgccaccaacccuuuugaccaggauguggagaaggcuacaagcgaaaugaauacggccgaggacuggggccucauccuggauauuugcgacaaagucgggcaauccagaaccggaccgaaggauugucuucggucuaucaugcgcagaguuaaccacaaagacccccauguggcgaugcaggcucugacacuccugggcgccugcgugagcaauugugggaagauuuuccaccuugaagucugcucccgggauuuugccucugaggugagcaacguucugaauaaaggacauccuaaggugugugaaaagcucaaagcucugauggucgaguggaccgacgaguucaagaacgauccccagcugucccucaucucugccaugauuaaaaaucugaaggaacagggcgugacauuuccugcuaucgggagccaagccgcggagcaggccaaggcuucccccgcccuuguugcuaaggacccuggaaccguggccaacaagaaagaagaggaggaucuggcgaaggccaucgaacucagccugaaagagcagcgccagcaaucuacaacccuuuccacgcuguacccgagcaccucuucccuccugacaaaucaccagcaugaaggcagaaagguccgggcuauuuaugacuucgaggccgcugaagauaacgagcugaccuuuaaagccggcgagaucauuacagugcucgacgacagcgaucccaauugguggaagggggaaacccaccagggaaucggccuguucccuucuaacuuugugacggccgaccuuacagcugagcccgaaaugauuaaaaccgagaagaagacaguccaguucuccgaugacguucaaguggaaaccaucgagccugagcccgaaccggcguuuauugaugaggacaaaauggaucagcugcuccagaugcugcaaagcaccgacccuuccgaugaccagcccgaucuuccugaacugcuccaccuggaggccaugugccaucagauggggccccugaucgacgaaaagcucgaggacaucgaucgcaaacacucugagcugagcgaacuuaaugugaaggucauggaggcucugucccucuacacaaaacugaugaacgaagaccccauguauagcauguacgccaaacuucagaaucaaccuuauuacaugcagucuuccggagugagcggcucucagguuuaugccgggccgcccccuagcggagcuuaccugguggccggcaacgcgcagaugucccaucuccaaucuuacagccugcccccugagcagcuguccagccucucucaggcugucgugcccccguccgccaacccugcccugcccagccagcaaacgcaggcugccuauccuaauaccaugguuucuuccgugcagggcaacacauaccccagccaggcuccugucuauucucccccgccugccgcgaccgccgcugccgcuacagccgaugugacccuuuaccaaaaugcggggcccaacaugccccaggucccuaauuauaaccugacguccagcacacucccgcagcccggaggcucccaacagccuccccagccucagcaacccuacucucagaaggcccugcuguga

SEQ ID NO: 76349 - RNA, 888 nt, Artificial Sequence
  derived and/or modified sequence opt5 from STAP1__Homo_sapiens__NP_036240
augauggccaagaaacccccuaagccggcucccagacggaucuuccaggagcgccugaaaauuaccgcccucccucuguacuuugaaggcuuccuucugaucaagagaagcggguaucgggaguacgaacacuauuggacagagcuccgcggaacgacccuguuuuucuacacagacaaaaaguccauuaucuauguggauaaacuugacauugucgaucugaccugccucacagaacaaaacucuaccgagaagaauugugcgaaguuuacacugguucugcccaaagaggaagugcagcucaagaccgagaacacggaaagcggcgaggaguggagaggguucauccugaccgugacagaacuuuccgucccucagaaugugucucugcuccccggacagguuaucaaacugcaugaggugcuugaacgggagaagaagcgcagaauugaaaccgagcaaagcacauccgucgagaaagaaaaggagccuaccgaagacuacguggauguucugaacccgaugcccgcuugcuuuuauacggugucucggaaagaggccacagaaaugcuccagaagaauccuagccugggcaacaugauccugcgccccggguccgacagcagaaauuacucuauuaccauccggcaggagauugauaucccucgcauuaaacacuacaaggucauguccgugggacagaacuauacaaucgagcucgaaaaacccgugacccugccgaaucuuuucagcgucaucgacuacuuuguuaaggagaccagaggcaaccugcggccuuucauuuguucuacagaugaaaauacgggccaagagcccuccauggaagggcgcagcgagaagcucaaaaagaacccucauaucgccuga

SEQ ID NO: 76350 - RNA, 1212 nt, Artificial Sequence
  derived and/or modified sequence opt5 from STAP2__Homo_sapiens__NP_001013863
auggccagcgcucugagacccccucgggugccgaagcccaaaggcguccucccuucccacuacuaugagucuuuccuggaaaagaaagggcccugcgaccgcgauuacaagaaauuuugggccggacuucagggccugaccaucuauuucuacaacagcaauagagacuuucaacauguugagaagcucaaccugggggcguucgaaaaacuuacagaugagauuccuuggggauccucucgggaccccggcacgcacuuuagccugauccuccgcgaucaggaaauuaaguucaagguggagacccuggaguguagagaaauguggaaaggguuuauccugacaguggucgagcuccgggugccuaccgaccugacacuucugccgggacaucucuauaugauguccgaaguucuggcuaaggaggaggcccgcagagcccuugaaacccccucuugcuuccugaaagugagccggcucgaggcucagcugcugcucgaacgcuacccugaguguggcaaucugcuucugagacccuccggcgauggggccgacggagucagcgugacaacccggcagaugcacaacggcacgcauguugugcgccacuauaaggucaagagagaagggccuaaauacgugauugauguggagcaacccuuuucuugcaccucccucgacgcugucguuaauuacuucgugagccacacaaagaaagcccuggugccguuucuucuggaugaggacuaugaaaagguccucggauacguggaggcggauaaagaaaacggcgagaauguuuggguggccccuucugcucccgggccuggacccgcccccuguaccggcggcccuaagccgcugucccccgcuagcucucaggacaaacugccuccccucccuccccugccgaaccaggaagagaauuaugucacaccuaucggggacggacccgccguggauuacgagaaccaggacguugcguccagcuccuggccugugauccuuaagcccaagaaacugccuaagcccccggccaaacucccuaagccucccgucggccccaaaccggaacccaagguguucaaugggggacugggccggaaacuuccugucucuagcgcucaaccccuguuuccuaccgccgggcucgcugauaugacggccgagcugcagaagaagcuggaaaaacgcagagcccucgagcauuga

SEQ ID NO: 76351 - RNA, 876 nt, Artificial Sequence
  derived and/or modified sequence opt5 from STARD10__Homo_sapiens__NP_006636
auggagaagcuggccgcuagcaccgaaccccagggcccuagaccggugcucgggcgggaguccguccaaguucccgacgaucaggacuuccgcucuuuuagaagcgaaugcgaggccgaagugggauggaaccugacauacucccgggcgggcgugucugucugggugcaggcuguugagauggaucgcacgcuucacaaaaucaaguguagaauggagugcugugacgugccugccgaaacccuguaugauguccuccaugacauugaguaccggaaaaagugggauagcaaugugaucgaaacauucgacauugcccgccugaccguuaacgcugaugugggguauuacuccuggagaugccccaaaccucuuaagaaucgggacgucaucacacugcgcucuuggcuccccaugggagccgauuauauuaucaugaacuacagcgugaagcacccuaaauauccgcccagaaaggaccuggugcgggcugucuccauccagaccggcuaccugauucaaagcacagggccuaaaucuuguguuaucaccuaccucgcccagguggaucccaagggaucccugccuaaauggguggucaauaagagcucucaguuucuugcgcccaaggccaugaaaaagauguauaaggcuugccugaaauacccggaguggaaacagaagcaucucccucacuucaaacccuggcugcauccugagcaaagcccccuucccucccuggcccucucugaacuguccgugcagcacgcugacagccuggagaacauugacgaauccgccguugcggagucucgcgaagagagaaugggcggcgccgggggagagggcagcgaugacgauacgucccucaccuga

SEQ ID NO: 76352 - RNA, 2064 nt, Artificial Sequence
  derived and/or modified sequence opt5 from STARD13__Homo_sapiens__NP_001230395
augcuggagcccagcuccgugcuccacgccaacgucaaucaggcuccucuguggugccuuguucugagauggugucgggaaugcaaggacaccguguguggcgggaaacaaaagucucgcgugaaccauacauuccagagacgggagaucgaagccaaagaggcgugcgauuggcuccgcgcugccggauuuccgcaguacgcccagcuguaugaagacagccaauuccccauuaauaucgucgcugugaagaacgaucacgacuuucuugagaaagaucugguugagccucucuguagacggcugaauacgcugaacaagugcgccuccaugaagcucgacgugaauuuccagcgcaaaaagggcgaugacucugaugaagaggaccuguguauuagcaacaaauggaccuuucagagaacaucccggcgcuggucuagagucgaugaccuuuacacccugcucccccgcggggaucggaauggaagcccuggcgggacaggaaugagaaacaccacauccagcgaaucugugcugaccgaccuuuccgagcccgagguuugcagcauccauucugaauccagcggcggcucugacucccggagccagccugggcaauguugcacggauaauccggugaugcuggacgcuccccucgucuccucuagccugccucagcccccucgcgaugugcugaaccaccccuuccauccgaagaaugagaaaccuaccagagcccgggcgaaguccuuucucaagagaauggaaacacugcgcggaaaaggcgcccacgggcggcacaagggaagcggcagaaccgggggacuugugauuucuggccccaugcugcagcaggagccugaauccuucaaagcuaugcaauguauccagauccccaacggcgaccuccagaauagcccucccccggccugccgcaaggggcugcccugcucuggaaaaagcuccggcgagucuagcccuuccgagcauuccucuuccggggucagcacacccugucuuaaggaacggaaaugccacgaggcuaacaagagaggaggcauguaucuggaagaucucgacguucuggccgggaccgcgcugccugaugccggagaccaaucucgcaugcaugaguuucacucccaggaaaaccucguggugcacauucccaaggaucauaaaccgggcacguucccuaaggcucugagcaucgagucccuuucucccacagacagcuccaauggcgucaacuggcggaccgggucuauuagccugggaagagaacaggugccuggcgcccgcgagccccggcucauggcuuccugucacagagccagccgcguuucuaucuacgauaaugugccugggucccaucuguaugccagcacaggagaccuucuggaccucgagaaagaugaccuguuuccccaccuggaugacauucuccagcaugucaacggccugcaagaagugguugaugacuggucuaaggaugugcuuccggagcugcagacccacgacacccucgucggggaaccuggccuguccacauuccccagccccaaucagaucacgcuggauuuugagggaaacucugugagcgagggccggaccacaccuuccgacgucgaaagagaugugaccagccuuaaugagucugaaccgcccgggguucgggaccgcagagauuccggagugggcgcuagccucacacggccuaacagacgccugcgguggaauagcuuccagcugucucaccaacccagaccugcgcccgccagcccucauauuuccucucagaccgcuagccagcucucccugcuucagcgcuucucucugcucagacugacggccaucauggagaaacacagcauguccaacaagcauggguggacauggagcguccccaaguuuaugaaacggaugaaggugccggacuacaaagacaaggccguuuucggagugccucugaucguccacgugcaacgcaccggccagccccuuccucagucuauucagcaagcucucagauaucugcgguccaauugccuggaucaggaguga

SEQ ID NO: 76353 - RNA, 1338 nt, Artificial Sequence
  derived and/or modified sequence opt5 from STARD3__Homo_sapiens__NP_001159409
augagcaagcugcccagagagcucacccgggaccuggaacgcucccuuccugccguggcuucucugggcagcucccucucucacagccagucccugucuagccaccuucugccgcccccugagaaaagacgggccaucuccgauguccgcagaacauucugccucuuuguuacguucgaccugcuguuuauuagccuccuguggaucauugaacuuaacaccaauacagggauccggaagaaccuggagcaagaaauuauccaguacaauuucaaaaccuccuuuuucgauaucuuugugcucgcguucuuucgcuucucuggacugcuucugggcuaugcugugcucagacugcggcacuggagccgcagauggugucccguccauucuucccugagccggucuuccagccucuccugcucugccaaggggcaccuggccacauguagcccuuccagccuucugucuucccccggauggcgcccuggcagccucaccucuaaaagcuacccgagaaagcugaagcgguccgacucugcucccccuggguaucuugccgcucagguggccguugcgcgcggaccccugcucuuuagcggcgcccuguccgagggccaguucuacagcccucccgagucuuuugcuggguccgauaacgaaagcgacgaggaaguggccggcaaaaagucuuucuccgcucaagagagagaguauauucggcagggaaaagaagccacagcggucguggaucagauccuggcccaggaggaaaauuggaaguucgagaaaaacaaugaauacggggacaccguuuauacgauugaggugccguuucauggaaagaccuucauccucaagacauuucugccuugccccgcugagcuugucuaccaagaagugauucugcagccugagagaauggugcucuggaacaaaaccgucacagccugucagauccugcagcgcguugaagauaauacccuuauuagcuacgacguguccgcuggcgccgccgggggaguggucucuccccgggauuucgugaacguuagacgcaucgagcggagacgcgaccgguaucugagcuccggcaucgcuacgucucacagcgcgaagcccccuacacacaaauacgugagaggcgaaaaugggccgggaggcuuuauuguccucaaguccgccagcaacccccgcgugugcaccuucguuuggauccugaauacagaucugaaagggcggcucccuagauaucugauucaucaaucucuugcugccaccauguuugaguucgccuuucaucugcgccagcggaucuccgagcucggagcuagagccuga

SEQ ID NO: 76354 - RNA, 705 nt, Artificial Sequence
  derived and/or modified sequence opt5 from STARD3NL__Homo_sapiens__NP_114405
augaaccaucugcccgaggacauggaaaaugcccucaccggcagccaguccucucacgcuagccugagaaacauccacuccauuaauccuacacaacuuauggcccggaucgagucuuacgaagggcgcgagaagaaaggaauuagcgaugugagacggacguucugccuguuugucaccuucgaccuccuguuuguuacacuucuguggaucauugaacucaacgugaauggcgggaucgagaacacccuggagaaggaagugaugcaguaugauuacuauuccucuuacuucgacaucuuucugcucgcggucuuccgcuuuaaagugcugauucuugcuuaugccguuuguagacugcggcauuggugggccaucgcucucacaaccgccgugacaagcgcuuuccugcuugccaaggucauucuguccaaacucuuuagccagggagcguucggcuacgugcugccgaucauuucuuuuauccuggccuggauugagaccugguuccucgauuuuaagguucugccccaggaagcugaggaggaaaaucgccuucugaucgugcaagacgccuccgagagagcugcccucaucccugggggacugagcgauggccaguucuauucucccccugaauccgaggcgggcagcgaagaggccgaggaaaagcaggacucugagaaaccccuucuggaacucuga

SEQ ID NO: 76355 - RNA, 642 nt, Artificial Sequence
  derived and/or modified sequence opt5 from STARD5__Homo_sapiens__NP_871629
auggaccccgcccuggcugcccagaugagcgaggcgguggcugaaaagaugcuccaauacagacgggauaccgccggcuggaaaaucugccgcgaggggaacggagucuccguuucuuggagaccuagcguggaguucccgggcaaucuguaucgcggggaaggaauuguguacggcacacuugaagaggucugggacugugugaagcccgccguugggggacugcgggugaaaugggaugagaacgucacgggcuuugaaaucauucaguccaucaccgacacacucugcgugucuagaaccagcacaccuuccgcugccaugaagcugauuucuccccgggauuucguugaccuugugcuggucaaacgcuaugaggauggcaccaucagcuccaaugcuacacacguggaacauccucucugucccccuaagccgggguuugugagaggauucaaccaccccugcggcuguuuuugcgagccucugcccggggagccuaccaagacgaaucuggucaccuucuuucauacagaccucagcggauaccugccccagaacguuguggauucuuucuuuccgcgguccaugacccgcuucuaugccaaucuucagaaagcggugaagcaauuucacgaauga

SEQ ID NO: 76356 - RNA, 1113 nt, Artificial Sequence
  derived and/or modified sequence opt5 from STARD7__Homo_sapiens__NP_064536
augcugcccagacggcuccuggccgcuuggcuugccggcacccgcgggggaggccugcucgcgcugcuugcuaaccagugcagauucgugacagggcugcggguccgcagagcccaacagaucgcccagcucuacggacggcuguauagcgaguccucucgcagaguucugcucggccggcuguggcgcagacuucacgggcggccuggacaugcuagcgcccugauggcugcccucgcgggcguguuugugugggacgaagaacgcauucaggaagaggaacugcaaagauccaucaaugagaugaagcggcuugaggaaaugucuaacauguuccagagcuccggcguccagcaccauccgcccgagccuaaagcccagacggaagggaaugaggauucugagggaaaggaacaacgcugggagauggugauggacaaaaagcacuuuaaacuguggagacggcccauuaccggcacacaucucuaccaguauagaguuuucgggaccuacacagaugugaccccucgccaguuuuucaacguccagcuggacacagaauaucggaagaagugggaugcucuggugaucaaacucgagguuauugaaagagacguggucagcggauccgaggugcugcacugggugacccacuuucccuacccuauguauagccgcgauuacgucuacguucggagauauucuguggaccaagagaauaacaugauggugcuugucucccgcgccguggaacauccgagcguucccgagucuccugaguucgugcgggucagauccuacgagagccagauggugauccgcccccacaagucuuuugaugaaaauggcuucgacuaucugcucacguacuccgauaacccucagaccguuuuuccccgguauugugugagcuggauggucuccucugggaugccggacuuccuggagaaacuucauauggcuacacugaaggccaaaaauauggagaucaaggugaaggauuacauuagcgcgaaaccucucgaaauguccagcgaggccaaggcuaccucucaauccagcgaacgcaaaaacgagggaucuugcggccccgccagaaucgaauaugcuuga

SEQ ID NO: 76357 - RNA, 3312 nt, Artificial Sequence
  derived and/or modified sequence opt5 from STARD8__Homo_sapiens__NP_001135975
augccccugcucgacguguucuggagcugcuuuagaaaggucaaauguuucccucugcuucagguuaagaaaaacgccgaggcugaagccaagcgggcgugcgaguggcugcaagcuaccggcuuuccgcaguacgugcaacucuucgaagagggguccuuuccccuggauaucggaucugugaaaaagaaucacggcuuccuugacgaagauagccugggggcccucugucgcagacugaugacacugaacaauugcgccuccaugaagcucgagguccauuuucagucuaaacagaacgaggacagcgaagaggaggaacaguguacgauuuccucucacugggcuuuccagcaggagagcaagugcugguccccuaugggaagcucugaucugcuugcucccccuucccccggccugccugccaccagcucuugugaauccgugcucacagagcugagcgccaccucucuuccgguuaucacagugucccugcccccugaacccgcggaccucccucugcccgggcgggccccgagcuccucugaucgcccucugcucagccccacccaaggacaggagggcccucaggacaaagcuaagaaaagacaucggaaucgcuccuuucugaagcaccuugaaagccugagacggaaggagaaaucuggcucccagcaagccgagcccaagcauagccccgcuacaucugaaaaagucagcaaggccuccucuuuccgcagcugcagaggguuucucuccgcgggauucuaucgggccaaaaacugggcugccaccagcgcuggcgggucuggagccaauacgcgcaaggccugggaggcuuggccuguggcguccuuuagacacccgcaguggacccaccggggcgauugucugguucaugugcccggggaccacaaaccuggaacauucccccgcagccuuucuauugaaucccugugcccugaggauggccauagacucgccgacuggcagcccggccggagaugggggugugaaggacgccggggcagcugcggguccaccggaucucacgcuagcacauacgauaaccugccggagcuguauccugccgagcccgucauggugggcgccgaagcugaggacgaagacgaugaggaauccgggggaucuuacgcccaccucgacgauauccugcaacauguguggggccuucagcagagagucgagcuguggagccgcgcgauguauccugaccucggccccggggaugaggaagaggaagaggcuaccuccagcguugagauugccacgguggaagugaagugccaggccgaggcucugucucaaauggaagucccugcccacggagagucccccgcuugggcccaggcggaagugcagccggccguucuugcuccugcccaggcucccgccgaggcggagcccguggcccaagaagaggcugaagccccugcuccggcccccgccccugcucccgcgcaggacagcgagcaggaagcccauucuggcggggagccuacauucgcuuccagccugucugucgaggaaggacacagcaucuccgauaccguggccucuagcuccgagcucgacagcuccggcaauucuaugaacgaagccgaggcugccgggccccuggcgggccugcaggcuagcaugccucgggaaagacgcgauuccggaguuggcgccucucucacacggcccuguagaaagcugcgcuggcauagcuuucaaaauucccaccggccgucucuuaacagcgagucccuggagaucaauagacaguucgccgggcagauuaaccuccugcacaaaggaagccugcuucgccucaccgcuuuuauggaaaaguacaccgugccucauaaacagggcugggucuggucuaugcccaaguucaugcggagaaauaaaacaccugacuaucgggggcaacacguguuuggagugcccccgcugauccauguccagcgcacgggccagccucugccccaauccauucagcaggccaugagauaccuccggagccagugccuggaucaaguugggaucuucagaaagucuggcgugaagucccgcauucagaaccuucggcagaugaacgagaccagcccugacaaugucuguuacgaaggacagucugcguaugacguggcugaucugcucaaacaauacuuuagagaccugcccgagcccaucuucacauccaagcugaccacaaccuuucuucagauuuaucagcuccugccuaaagaucaguggcuggccgccgcucaagccgcuacgcuccugcuuccggacgagaaccgcgaaguucugcagacacuccuguacuuccugagcgauaucgccuccgcggaggaaaaucagaugaccgccggcaaccuugcugugugccucgcccccagcaucuuucaccugaaugucucuaagaaagacagcccuucccccagaauuaagucuaagcggagccugaucgggcgcccuggacccagagaucucuccgacaacauggcugccacccaaggccugucucacaugauuagcgauuguaaaaagcuguuccaggugccucaggacauggugcuucagcucugcuccucuuauagcgccgcugagcuguccccgcccgggccugcgcuggccgaacuucggcaagcucaggccgccggaguuagccucucucuguacauggaggagaauauccaggaucugcuccgcgacgcugccgaaagauuuaaaggcuggauguccguccccgggccucagcauacagagcuggcgugucggaaggcucccgauggccacccgcuucgccuguggaaagccagcaccgaaguggccgcuccucccgccgugguccuccauagagugcugcgggagcgcgcgcugugggacgaagaccuucugagagcucaaguucucgaggcccugaugcccggaguggagcucuaucacuacgucacagauucuauggccccucaucccugccgggacuucgugguucugagaauguggcgcuccgaucuuccucggggcgggugucugcucgugagccagucccuggacccggaacagcccgucccugagucuggagugagagcucugaugcuuacgagccaguaccugauggaacccugcggccucgggcgcucccggcugacccacauuuguagagccgaucuccgcggacggagcccugacugguauaacaagguuuucggccaccugugcgcuauggagguggccaagaucagagauucuuuucccacacuucaagcggccgggccggaaaccaaacuguga

SEQ ID NO: 76358 - RNA, 14103 nt, Artificial Sequence
  derived and/or modified sequence opt5 from STARD9__Homo_sapiens__NP_065810
auggccaacgugcaggucgcuguuagagugcggccccuguccaagagagagaccaaagaaggcgggcggaucauuguggaggucgacggaaagguggccaaaauccggaaucugaagguugauaaccgcccugacggcuucggggauuccagagaaaaagugauggccuuuggauucgacuacugcuauuggucugucaauccggaggauccccaauacgcuagccaggacgugguuuuucaggaucugggcauggaagugcuuuccggggucgccaagggauauaacauuugucuguucgccuacggccagacaggcucugggaagacguauaccaugcugggaaccccugcuagcgugggccugacaccccggaucugcgaggggcuuuuugugcgcgagaaagacugugccucccugccuucuagcugcagaauuaaggucuccuuccuggaaaucuacaaugagcggguucgcgaucugcugaaacaaagcggacagaagaaaucuuauacacucagagugcgggaacaccccgagaugggcccuuacgugcaggggcugucccagcaugucgugaccaacuacaagcaaguuauccagcuucuggaggaaggaauugcuaaucgcaucacagccgcgacccacgugcaugaggccagcucuagaucccacgcuauuuuuacgauccauuauacccaggccauucucgaaaacaaucugccgagcgagauggcuucuaagaucaaccuugucgaccuggccggcuccgaacgggcggaucccagcuacuguaaagaccgcauugccgagggcgcuaauaucaacaagucccucgugacacuggggaucguuauuucuacccuggcccagaauagccaaguguucuccagcugccagucucucaacuccagcgucucuaauggaggcgauagcgggauccuguccucuccuagcggaacauccagcggcggggcucccucuagacggcaguccuauauuccuuacagagacagcgugcuuaccuggcugcucaaagacucucugggaggcaacuccaagacgaucauggucgccacagugagccccgcccacaccuccuauucugagacaaugagcacccuucgcuacgcuuccucugcgaaaaacauuaucaauaagccgcggguuaacgaagaugccaaucugaaacucaucagagagcugcgcgaagagauugaacggcugaaggcucuccugcuuagcuuugagcugagaaacuucuccagccucucugacgagaaucugaaggaacuugugcugcaaaacgagcucaaaaucgaucagcugaccaaggacuggacacagaaauggaaugauuggcaggcccugauggaacacuauuccgucgacauuaaccgccggagagccggcgugguuaucgauagcucucucccucaucugauggcucuugaggacgaugugcuguccacgggggucgugcucuaccaccugaaggaaggaaccacaaaaauuggccgcaucgacagcgaucaagagcaggacaucgugcugcaggggcaguggauugagcgggaccauuguaccaucacaucugccugcggaguugucgugcuuagacccgcgcgcggcgcucgguguaccgugaaugggagagaagucacggccagcugccggcucacacaaggcgccgugauuacccugggaaaggcucagaaguuucgcuucaaccacccugccgaggcugccguucugagacagcggagacaggugggcgaagcggccgcugggcgcggaucccucgaguggcuggaucuugacggcgaucuggccgcuagccggcucgggcugucuccccugcuuuggaaagagagacgcgcccucgaagaacaaugugacgaagaucaccagacccccagagacggagagacaucccaucgggcgcagauccagcaacagcagagcuacgucgaagaucugcgccaccaaauucuggccgaggagaucagagcugccaaggaacucgaguuugaccaggcuuggauuucccagcagaucaaagaaaaucaacagugccugcuucgggaggaaaccuggcuggccucucuccagcagcaacagcaggaggaucagguggccgagaaggaacuggaggcuagcguugcgcuggacgccuggcuucaaacagauccugaaauccagccgucccccuucgugcagucucaaaaacgcgucgugcaucuccagcugcugagacggcacacgcuccgcgcugccgagagaaacguucggcgcaagaaggugagcuuccagcuggaaagaauuaucaaaaagcagcggcuucuggaggcccagaaacggcucgagaagcugaccacacugugcuggcuucaggacgauuccacccaggaaccucccuaucagguccucucuccugacgcuacagugccccgcccgccuugucggagcaaacugaccuccugcagcucucugagcccccaaagacucuguagcaagcauaugccucagcugcacucuauuuuucuuuccugggaccccagcacgacccugccuccccgcccggauccuacacaccagaccucugagaagacauccagcgaagaacaccucccccaggccgcguccuaccccgcucggaccggcugccugcgcaaaaaugggcugcacagcucuggccauggacaaccuuguacggcccgcgccgcucuugcccggaagggcgcgagcgcuccggacgccugccugacaaugucccccaacucuguggggauccaggagauggaaaugggagucaaacagccucaccagaugguuagccaaggccucgccucccugagaaagucugcuaauaaacucaagccccgccacgagccuaaaauuuucaccagcacaacccagaccagaggggccaagggacuggcugaucccucccauacacaggccggcuggagaaaggaagggaaccuuggcacgcacaaagcggccaagggagcuucuuguaacagccuguauccucauggcccccggcaaaccgccgggcacggaaaagcugugaagacauuuuggaccgaguacaaaccgccuucccccagccgcgccucuaagagacaucagcgggugcucgccacacgcgucagaaauaucaccaagaaauccagccaccucccucugggcucuccccuuaagcggcagcagaacacgagagacccggauacaauggugccucugaccgacuucucccccguuauggaucacagccgcgaaaaagacaaugaucucuccgacaccgauucuaacuauagccuggacucccucagcugcguguacgcuaaggcgcugaucgagccucuuaaacccgaggaacggaagugggauuuucccgagccugaaaauucugaguccgacgacagccaacugucugaagauagccucgccgagaagagauaucaguccccgaaaaaccgccucgggggaaaucggcccacaaacaauagaggccagccucgcacccggacaagagcuucuguccgcggguucacggccgccagcgacuccgaucugcuugcucagacccauagaucuuuuagccuggacucccucauugaugccgaggaagaacugggcgaagaccaacaggaggaacccuucccuggaagcgcggaugagauccccacagagaccuuuuggcaccucgaagacucuucccugccugugauggaucaggaggcuauuugucggcuuggcccgaucaacuaccgcacagccgccagacuggacgcuguucugcccaugagcuccucuuucuaccucgauccucaguuucaaccccauugcgaacugcagccucacugugagcuucagccccauugcgagcugcaaccgcacugcgaacaggccgagagccagguggaaccuuccuauucugagcaggcggacagccuccaagggaugcagcugucccgggaaagcccccucaugucuauggacuccugguucagcugugauucuaagauuaaucccuccagcccucccggaaucgucggcucucugugcccuagcccggacaugcaggaguuucacuccuguaaaggggagcgccccggauacuggccuaacaccgaggaacuuaagcccucugaugcugaaacggugcugccuuauagcuccaaacugcaucagggcagcaccgagcuccugugcuccgccagagacgaacacacagccucugcugccgauaccagccggcuuucccuguggggcauccaaagacucauucagcccggggcugacggaacauuccagggccgcuguaucccggauaugacccagcaagggucuagcgaggccucccauaauucuagcguuuccaacgugcuggcggccagcgcuacaacccucacgcacgucggaucuacacacgagcgggacugguccgcccugcagcagaaguaccuucuggaacugagcugcccugugcucgaggcuauuggcgcccccaagccugccuaucccuaccuggaagaggauucugggucccuugcucaggcgagcucuaaaggaggcgacacccugcucccugugggccccagagucuccagcaaucugaaccucaacaauuucccgguucaucugucccgcauccggagacuucgggccgaaaaggagcaagauagccugaacgcuaaacuggagggggugucugacuuuuucagcaccuccgaaaaggaggccucuuaugaugaaacauacagcgccgaccucgagucccugucugcuagccgcuccaccaaugcccagguguuugcgacggagaacgcuauuccugacucuaugacagaagccugugaggucaaacagaauaaccuugaagagugccugcaaagcuguagaaagcccggacucaugaccuccagcgaugaagacuucuuucagaaaaaugccugccacucuaacgugacaaccgcuacaaaggccgaucauuggucccagggcugggcgccccugcggaagaauagcgccguucagccugggcaacugucuccggacucccacuacccccucgaggaggagaaaaccgauugucaggagagcuccaaggaagcugugcgcagacauaucaacgucucuuucgcccuuccuagcggacccgagcuguaucugcacuccgcuccuuggaauccccucuccucuucccugcagccuccgcuucuggaaacguuuuacgugaccaaaagccgggacgcccucacagagaccgcucuggagauccccgccugccgcgaaguuagagugccuucucccccuccccgggaggcguggggcuucgggcacaaccaucaggcccugcaaggagcuuaucucaagaauaaccuuccgguccugcugcagaaucagaacagcaaaauugccuccucucagcaagugacagcugaaaucccugucgaucucaacacccgcgaggugauuagagaaagcggcaagugccccggcaauaucacggaggagucccacgacucuguuuacagcuccgugacacagaaccggcauuuucugcccagcaccucuacaaaggucugugaguucgagaaucaggugguuauucuuaacaaaaagcacuccuuuccugcccuggaagggggagaggugaccgcccaaagcugcuguggcgcuuccucugauagcaccgaguccgggaaaucucuccuguucagagaaagcgaggcgcgcgaagaggaggaacuggaccagaauacaguccuccggcagacgaucaacgugucccuugagaaggauaugcccggagaaagcgccgugucucugaaauccagaagcguugaccgccgggucucuuccccugugaugguggcucagggcgggggaccgacccccaagugggagggcaagaaugaaacaggccugcucgagaaagggcugagaccuaaggauagcucugaagaguuuaaacuucccggaaccaagccugccuaugagcgcuuccaacuggucgccugcccccaggaacggaacccguccgaguguaaaagccaggaaaugcucaauccuaacagagagcccucuggcaagaagcagaauaaacgcgugaacaauacagacgaaauggcucggcugauuagaagcguuaugcaacuggagaacgggauccucgagaucgaauccaagcagaauaaacaggugcacgccagccauaccccuggaacggacaaggagcuugucuuccaggaucaaaaagaacaggagaagacagaccacgcguuucgccccgauuccucuggcaacccucugcccagcaaggaccagccguccucuccucggcaaaccgaugacaccguguucagagauagcgaggccggggcuauggaaguuaauuccauuggaaaccauccccaggugcagaaaaucacacccaacccuuuucgcucuagagagggcguccgggaaagcgagccggugcgcgaacacacccaucccgccggcuccgacagaccugcucgggauauuugcgacagccuggggaagcacacaacguguagagaguucaccaauacaucucuccacccccagcggaugaaagcccuggcgcgcgcccuuccucugcaacccagacucgagcgguccagcaagaacaauggacaguuuguuaaggcuucugccucccugaagggccagccuugggggcugggaagccucgaggaacuugaaaccgugaaaggcuuccaggagucucaagucgcugaacauguguccagcucuaaccaggaggagcccaaggcccaggggaagguggaagagaugccgaugcagcgcggaggcucccugcaagaagagaauaaagucacacagaaguuuccuagccugagccagcucugcagagauaccuucuuucggcaggaaacgguuagcccccugcuuucucgcaccgaguucuguacagcuccucugcaccaagaccucagcaacacccugccccucaauuccccgagauggccucggcgcugccuccaugugcccguggcccuuggcaucucuagccuggacuguguccuggaucucacaaugcugaaaauucacaacagcccccuugugaccgggguugagcaccaggaccagucuacagaaacgagaagccauuccccugagggaaaugugcggggccgcagcucugaagcgcacaccgccuggugcggguccgucagaagcauggcuaugggaucucauucccaaagcggcgugcccgaguccaucccucuggggacagaggaucggaucucugccagcaccuccccgcaggaccacggaaaggaucuccgcauuacccugcugggcuuuucuacaagcgaagacuucgcuuccgaggccgaaguugccgugcagaaagagaucagagucagcucucucaacaagguguccagccagcccgaaaagcgggucucuuucagccuugaggaggauuccgaccaagcgucuaaaccuagacagaaggcugaaaaagagacggaagaugugggccugaccagcgggguuucccuggcccccgugagccucccucgcgugcccucuccugagccgcggcugcuugaacccuccgaccaugcuagcaugugccuggccauucucgaggagaucagacaggccaaggcucagcgcaaacaacugcacgauuuugucgcccggggaacaguucuguccuacugugaaacccuccuugagccugaaugcucuagcagaguggcgggccgcccccaguguaagcagauugaccaguccucuagcgaucaaacacggaaugagggggaagccccuggauuccacguggcuucccugucugccgaggcuggccagaucgaccugcuccccgacgagagaaagguccaggccaccagccuguccgcggauagcuuugaaucucuuccgaacacggagacagaccgcgaaccuugggaucccgugcaagccuucucccaugcugcccccgcucaggaccggaaaagacgcaccggggagcugcggcaguuugccggcgcuagcgagccuuucaucugccacucuuccagcucugaaauuaucgagaagaaaaaggaugccaccagaacacccagcuccgcggacccucucgccccggauagcccccgguccucugcuccuguugaagaggugagacgcgucgugagcaaaaaggucguggccgcucugcccucccaggccccuuaugacgauccccggguuacccugcaugaacucucucaaagcgugccgcaggagacagccgagggcauuccucccggcucccaggacucuagcccugaacaccaggagcccagaacccuugauacgacauacggggaagucuccgacaaucugcuggugaccgcgcaaggagagaagacagcucauuuugaaagccagucuguuaccugugacgugcagaacuccacgagcgccucuggcccgaaacaggaucacguccaaugcccugaggccuccaccggguucgaggaaggacgcgcuagccccaagcaggacacaauccuccccggcgcccugaccagaguggcucuugaggccccuacacagcagugugugcaaugcaaagaaucuguuggguccggccugaccgaggucugucgggcgggaagcaagcacucucgccccauuccucucccggaucagagacccuccgccaauccuggcgggaucggagaagaggcucccugccggcauccucgcgaggcccuggacggccccguguuuagcagaaacccugaagggucccggacacugagcccgucucgcggaaaagagagcagaacccuccccugucggcagccuugcuccucucaacccguggcuacgcacgccuacagcucccauucuagcacacugcuuugcuuccgcgauggcgaccuggggaaggaaccuuuuaaagcggcgccccacaccauucacccgccuugugucguucccuccagagcuuaugagauggaugagaccggcgaaaucagccggggacccgacgugcaucucacacacggccuggagccuaaggaugugaaccgcgaguucagacuuaccgagucuuccacaugcgaacccagcacggucgccgcugugcugucucgggcccagggguguagauccccuagcgcuccggacguucgcaccggaucuuuuucccauagcgccacagauggcuccguggggcucaucggaguccccgagaagaaaguggcggagaagcaggccucuaccgaacuggaggcugccagcuucccugccggcauguacuccgaaccccugcggcaguucagagacagcucuguuggcgaucaaaaugcucaggugugccagacaaacccugagcccccggccaccacgcaggggccucacacccucgaccuguccgaaggaagcgcggagucuaaacuugucguggagccccaacaugaaugucuggagaauacaacccgcugcuuucucgaaaagccucaguucagcacagagcugcgggaccacaacagacuugauucccaggcuaaauuuguggcccgccugaagcacaccuguucuccccaggaagacagcccuuggcaagaggaggaacagcaucgggaucaggccuccggcgggggagagggcuucgcucaaggggucaauccccucccggacgaagauggacuggacggcugccagauucuggaugccggcagagaggagguugcuguggccaagcccccugugagcaaaauccucucucagggguuuaaggaccccgcgacggucucccugcgccagaacgaaacaccucaaccggccgcucagcggagcggacaccuuuauaccggcagagagcagcccgccccuaaucaucgggggucucugcccgugacaaccauuuucuccggaccuaaacacagccgcuccucucccaccccucaguuuagcguugugggcuccucuagaagccuccaagaacugaaccuuuccgucgagcccccgagcccuacagaugaagacacgcaggggcccaaucggcuguggaacccucaccuccgcggauacucuuccggcaagagcguggcuagaaccucucugcaggccgaggauuccaaucagaaagcgagcucucggcuggacgauggcacaaccgaccauagacaccucaagcccgccacaccgccuuaucccaugcccuccacccugagccauaugccuacgcccgacuucacaaccagcuggauguccgggacccuugagcaagcucagcagggaaagcgcgaaaaacugggcguucaagugcggccugagaacugguguucucagauggauaaggggaugcuccacuuuggaagcuccgacaucucuccguacgcccugcccuggagaccugaggaacccgcucgcauuagcuggaaacaguauauguccggcucugccgucgaugugagcugcucccagaagccucaagggcuuacacugucuaauguugcccgguguagcuccauggacaacggacucgaagaucagaauagccccuuccauucucaccuguccaccuacgcuaacaucugcgaccugagcacaacgcacucuuccaccgagaacgcgcagggcagcaaugaggccugggaaguguuuagaggaucuuccagcaucgcucucggggauccgcauauuccuacaucccccgagggagucgccccuaccagcggccacgaccgcagaccccaguuccgggggccuucuggagaagccgauugccugcgcagcaaacccccgcuugcuaagggcuccgccgcggggcccguggacgagaucaugcugcucuacccuucugaagcuggaugucccgucggccaaacaagaaccaacacguuugagcagggcacccagacacuggggagccggcgccauugguccucuaccgauauuagcuucgcccagccugaggccuccgcugugucugccuucgaccuugcuagcuggacauccaugcacaaucugagccuccaucugucucaacugcuccacuccaccagcgaacugcuuggaucucugucccagcccgacguugccagacgggagcagaacacaaagcgcgauaucccugacaaagcgccgcaggcccucaugauggauggcagcacccaaacgacaguggacgaagggucccagaccgaucugacccuucccacacugugccuccagacgucugaggcugagccucaaggagccaaugucauucuggaaggccuggggagcgacaccuccacagugagccaggaggaaggagaugugcccggcguuccucagaagagagaggcugaagagaccgcccagaaaauggcgcaacuccuguaucuucaggaggaaucuacacccuacaagccgcaguccccuagcauccccucuucccaucugcgguuucagaaagccccugugggccaacaucuccccagcgucucuccgagcguguccgacgcuuuccugccucccucuagccagcccgaggaauccuauugucuuguugugagcucuccuucccccagcuccccucacucuccggggcuguuucccagcaccuccgaguacccuggagauucuagaguccagaagaaacucggccccacaagcgcccuguucguggaccgcgcuuccagcccuauccugacccuuucugccuccacgcaggaacccgggcugagcccuggaucucucacccuguccgccccgagcacacaucccgucgagggccaccaaaagcucgauucuuccccugaccccguggaugcuccucggacccccauggacaacuauagccagacaaccgacgagcucgggggaucucagagaggccgcagcucccuucaacggagcaauggcagauccuuucuggaacugcacucuccgcauagcccccagcaguccccuaagcuccaguucucuuuucuggggcaacacccccagcagcuucagccucgcacgacaauuggaguucaaagccggcugcugcccccuccgcugagacaucggucccagcgccucggcaacucuuucgugcccgagaaagucgcgagcccugaacacugcccccuguccgggagagagccuagccaguggcagucucggaccgaaaauggaggcgaguccagcgccucucccggggagccgcaacgcacacuggauagaccuuccagcuggggcggacuucagcaucugucucccuguccuguguccgaacucaccgacacggcuggccugcgggggagcgcccuuggacugccccaggccugccagccugaggaacuccuguguuuuuccugccaaauguguauggcucccgagcaccagcaccauagccuccgcgaucugccgguucacaacaaguucucuaauuggugcggcgugcagaaagggucccccggaggccuggacaugaccgaggaggaacuuggggccagcggcgaucugucuagcgaaaagcaagagcaguccccuccccagccucccaacgaccauucucaggauagcgaaugguccaaaagagagcaaaucccgcuccaggucggagcgcagaaucugucucuuagcguggagcugacagaagcuaagcuccaccacggcuuuggggaggccgacgcccugcugcaagugcuccaauccggaaccggcgaagcucuggccgcugaugagccuguuacaagcaccuggaaggaacuuuacgcccggcagaaaaaggcgauugagacacugagacgcgagcgggccgaaagacucgggaacuucugucgcacccggucucugagcccccaaaaacagcuuucccugcucccuaauaaggaccuguuuaucugggaucuggaccuccccucuagacgccgggaguaucugcaacagcuuagaaaagaugucguggaaacgacacgcuccccugagagcgugucccggucugcucauacccccagcgacauugaacugaugcuccaggacuaccaacaggcccacgaggaggcuaaggucgaaaucgccagagcgcgcgaucagcugagagagcggaccgaacaggagaaacuucgcauucaucagaaaaucaucucccagcugcucaaggaggaagacaaacugcacacacuggccaacuccucuucccucugcaccagcucuaacggaucccugagcucuggcaugacaagcggguacaauuccucuccggcucuuagcggccagcugcaguucccugagaacaugggacauacgaaucuccccgauuccagagacguguggauuggcgaugaaagagggggacacagcgccguuagaaagaacucugcuuauucccaccgcgccagccugggcuccuguugcugcucuccuagcucccuuucuagccuggggaccuguuucuccagcucuuaccaagaccucgccaaacauguggucgauacauccauggcugacgugauggcggccugcagcgauaaucugcacaaccuguuuucuugucaggcuaccgccggauggaauuaucagggcgaggaacaggccguucaacucuacuauaagguguucucccccacacggcauggguuucugggcgcuggagucgugagccagccgcuuucuagaguuugggccgcgguguccgaccccaccgucuggccucuguacuauaagcccauccagacggcucggcuccaccagcgcgugaccaacagcauuucucugguguaccuugucugcaauacaacccugugugcccucaaacaaccuagagauuucugcuguguuugcguggaggccaaggagggccaccugagcgugauggcugcccaguccgucuacgacacaagcaugccccggccuucccgcaaaauggugagaggggaaauccugccgucugcuuggauucuccagcccaucaccguugagggaaaggaagugacgcgggucaucuaucuggcccaaguggagcuuggcgcgccuggguuucccccucagcugcucagcuccuucauuaaacgccagccccugguuaucgccagacuugcuucuuuucugggacgguga

SEQ ID NO: 76359 - RNA, 858 nt, Artificial Sequence
  derived and/or modified sequence opt5 from STAR__Homo_sapiens__NP_000340
augcugcucgccaccuucaagcugugcgcuggcagcuccuacagacacaugcggaacaugaaagggcuucgccagcaagccgugauggcgaucucucaggagcugaauagacgggcucucggaggccccacaccuagcacguggauuaaccagguccgcagacgguccucucugcuugggagccgccuggaagagacccucuauuccgaccaggaacuggccuaccugcaacagggagaggaagccaugcagaaggcucucggcauccugucuaaucaggagggguggaaaaaggagagccaacaggauaacggagacaaaguuauguccaagguggugccggaugucggcaagguguuuagacuugaaguuguggucgaccagcccauggagcggcuguaugaggaacucguggagcgcauggaagccaugggcgaguggaauccuaacguuaaagaaauuaaggugcugcagaaaaucgggaaggauacauucauuacccaugagcuugcugccgaagcggccggaaaucuggucggccccagagacuuugugagcgugcggugugcuaaacgcagagggucuacaugcguccucgccggaauggcuaccgauuucggcaacaugccugagcaaaaggggguuauccgggccgagcacggacccacauguauggugcugcauccucuggcgggcuccccgagcaagaccaaacucacguggcugcuuucuaucgaccugaagggcuggcuccccaaauccauuaucaaucaggugcugagccagacccaagucgauuuugccaaccaccuucgcaagagacuggaaucucauccugcuuccgaggcccggugcuga

SEQ ID NO: 76360 - RNA, 2253 nt, Artificial Sequence
  derived and/or modified sequence opt5 from STAT1__Homo_sapiens__NP_009330
augagccagugguacgagcugcaacagcucgacuccaaguuccuggaacaggugcaccagcuuuaugaugacucuuuucccauggagaucagacaauaccuggcccaguggcucgaaaaacaggauugggagcaugcugccaacgacgucagcuucgcgaccauucgguuucacgaucugcuuucccagcuggacgaucaauauucucgcuucagccucgaaaauaacuuucugcugcagcauaauaucagaaaguccaaacggaaccuccaggacaauuuccaggaggauccuauucaaaugucuaugaucauuuacagcugccugaaggaggaacgcaaaauccuugagaacgcucagagauuuaaucaggcccaauccggcaacauccagagcacaguuaugcuggacaagcagaaggaacucgauucuaaagugcggaaugugaaggacaaagucauguguauugagcacgagaucaagucccuggaagaucuucaggacgaguaugacuucaaaugcaagacgcugcaaaaccgcgaacaugagaccaaugggguggccaagagcgaucagaaacaggaacagcuccugcugaagaaaauguaccucaugcuggacaacaagagaaaagagguugugcacaagauuaucgagcuucugaaugucacagaacucacccaaaacgcucugauuaaugaugagcuuguggaauggaaacggcgccagcagucugccuguaucggaggcccgcccaacgcuugccuggaccagcuccaaaacugguuuacaauuguugccgagucccugcaacaggugagacagcagcugaagaagcucgaagaacuggagcagaaauauaccuacgaacacgauccuaucacaaagaauaaacagguccuuugggaccggaccuucagccuguuucaacagcucauccagucuuccuucgugguggagcgccagcccuguaugccuacgcauccccaaagaccucugguccuuaagaccgggguucaguuuacagugaaacugcggcuccuggugaagcugcaggaacucaacuacaaucugaaggucaaagugcuuuucgauaaggacguuaacgagcgcaauaccgugaaaggauucagaaaguuuaacauucugggcacacacaccaaagucaugaauauggaagagagcacgaacgggucccucgcggccgaguuccggcaucugcagcugaaggaacaaaagaaugcuggaacaagaaccaacgagggcccgcuuaucgugacagaggagcuccacucucugagcuuugagacccagcugugccagcccggccucguuauugaucuggaaaccacaucccuuccuguggucgugaucagcaaugucucucagcugcccuccgggugggccagcauucucugguauaacaugcugguggcugagccucgcaaucugucuuucuuucuuacgcccccgugugcccggugggcgcaacucagcgaaguucuguccuggcaguucucuagcgugaccaaaagaggacugaacgucgaccagcucaauaugcugggcgagaaacuucuggggccuaacgccucccccgauggacucaucccuuggacacgcuuuugcaaggaaaacaucaaugacaagaacuuccccuuuuggcuguggauugagagcauccuggagcuuauuaaaaagcaccuccugccccuguggaaugacggcuguaucaugggguucauuucuaaggaacgggagagagcucuccugaaagaucaacagccuggaaccuuucuucugcgcuucuccgaaagcucucgggagggcgccaucacauuuaccuggguggaaagaucccagaacggcggggagccggacuuccaugcuguugagcccuacacgaagaaagaacucagcgccgugacauucccugauaucauucgcaauuauaaggucauggccgcugagaacauccccgaaaauccucugaaauaccuguaucccaacauugacaaggaucacgcguuuggaaaauacuauucccggccgaaggaggccccugaacccauggagcuugacggcccuaaggggaccggauacaucaaaaccgagcucauuucugugagcgaagugcaucccuccagacugcagacaaccgauaaucugcucccuaugucucccgaggaguucgacgaaguuagccgcaucgucggcuccguggaguuugauagcaugaugaacacaguguga

SEQ ID NO: 76361 - RNA, 2556 nt, Artificial Sequence
  derived and/or modified sequence opt5 from STAT2__Homo_sapiens__NP_005410
auggcccagugggagaugcugcaaaaccucgacagccccuuccaggaucagcugcaccagcuuuacucccauucucugcucccuguggacaucagacaauaucuggcugucuggauugaagaucagaauuggcaggaggccgcgcuuggcagcgacgauuccaaggcuaccaugcuguuuuuccacuuucucgaccagcugaacuacgaaugcgggcgguguucucaagauccggagagccugcuccugcagcauaaucuucgcaaauucugcagagacauccagcccuuuucccaggauccuacacaacuggccgaaaugauuuucaaccuccugcuugaggagaagcggauccugauucaggcccagcgcgcucaacucgaacagggagagcccguucuggaaacgccuguggagucucagcagcacgagaucgaaagcagaauccuggaccuccgggccaugauggagaaacuggugaaguccauuagccaacuuaaagaucagcaggacgucuuuuguuuccgcuauaagauccaggcuaagggcaaaacccccucucuggauccucaucaaacaaaggaacagaaaauucuccaggagacccugaaugaacuugacaagagacggaaagaggugcuggacgccuccaaggcgcuccuggggcgccugacaacccucaucgagcugcuucugccgaagcucgaagaguggaaagcccagcaacagaaggcuugcauuagagcccccaucgaucacggacuggaacagcuugagacaugguuuaccgcuggcgccaaacugcuguuccaccuccggcagcugcucaaggaacugaaagggcuuagcugucugguuucuuaccaagacgauccucucacgaagggaguggaccugcgcaacgcgcaggucaccgagcugcuucagagacuccugcaucgggccuuugugguugagacacaacccugcaugccucagacaccccaccgcccgcugauucucaaaaccggcuccaaguucaccgugagaacgcggcugcuugucagacugcaggaaggcaaugagagccucacaguggaagugucuaucgaucgcaacccuccccagcugcaaggguuucggaaguucaauauccugaccuccaaccagaaaacacuuaccccugagaagggacagagccagggccucauuugggacuucggguaucugacccuggucgaacaaagauccggaggcucugggaaaggaagcaauaagggcccccucggcguuacagaggagcugcauaucauuuccuuuacggugaaauacaccuaucaggggcuuaagcaggaacugaagacagauacccuccccguggucaucauuagcaacaugaaucagcugucuaucgcuugggccuccgugcugugguucaaccuucucagcccuaaucugcaaaaccagcaguuuuucucuaacccgcccaaagcuccuuggagccugcucggacccgcccuguccuggcaauuuucuagcuacguuggccgcgggcuuaauuccgaccagcugagcaugcuccggaacaagcuguucggacagaauuguagaacagaggauccucugcuuucuugggccgacuuuaccaaacgcgaauccccgcccggcaagcucccuuucuggacguggcuggauaaaauccuggagcucgugcacgaccaccugaaggaccuuuggaacgaugggcggauuaugggauuugucagcagaucucaggagcgccggcugcucaagaaaacaauguccggcaccuuccugcugagauuuagcgaauccucugagggcgggauuaccugcagcuggguggaacaucaagacgaugacaagguucuuaucuacuccgugcagcccuauacaaaagagguccugcagucucucccucugaccgaaaucauucgccacuaccagcuccugacagaggagaauauccccgaaaacccucuucgguuccuguaucccagaaucccgcgggaugaggcuuuuggauguuacuaucaagaaaaggugaaucuccaggagcgcagaaaauaccugaagcaucggcugauugucgugagcaacagacagguugacgaacuucagcaaccucuggagcucaagcccgagcccgaacuggagucccucgaacuggagcuuggccuggugccugaaccggagcucagccuggaucuggagccccuucugaaagcggggcucgaccugggaccugaacucgagucuguccuggaauccacgcuugagcccgugaucgagccuacccugugcaugguuagccagacagugcccgaaccugaucagggccccgucucucagccggugccugagcccgaccugccuugugaucuccgccaccugaauaccgaacccauggagauuuuccggaacugcgugaagaucgaagagauuaugccgaauggggacccucuucuggccggccaaaacacaguugaugaggucuauguguccagacccagccauuucuacaccgacggaccucucaugcccucugacuuuuga

SEQ ID NO: 76362 - RNA, 2310 nt, Artificial Sequence
  derived and/or modified sequence opt5 from STAT3__Homo_sapiens__NP_003141
auggcccaguggaaccaacugcagcagcucgacaccagauaccuggagcagcuucaccaacuguauagcgauuccuuccccauggaacuccggcaguuucuggcuccuuggaucgagucucaggacugggccuacgcggcuagcaaggaaucccaugccacacuuguguuccacaaucugcucggcgagauugaucagcaauauucucgcuuucugcaggaaagcaacguccuguaccagcauaaucucagacggaucaaacaguuccugcaaucccgcuaucuugagaagccgauggagauugccagaaucguugcucggugccugugggaagagucucgccuccugcagacggccgcuaccgccgcgcagcaagggggacaggccaaccaccccacagcugccguggugaccgaaaaacagcagaugcuugagcaacaucugcaggacgucagaaagcgggugcaggaucucgagcagaaaaugaagguuguggaaaaucugcaagacgauuuugacuucaacuacaagacacugaaaagccagggcgauaugcaggaccucaaugggaacaaucaguccgucacccgccaaaagaugcagcagcuggagcagaugcuuacagcucuggaucaaaugagacggagcauugugucugaacucgccggacugcuuuccgcgauggaguauguucagaaaacccugacggacgaggaacucgccgauuggaagcgcagacagcaaaucgcuuguaucggcgggccucccaacauuugccuggaccggcuggagaauuggaucaccagccucgccgaaucucagcugcagacacgccagcaaauuaaaaagcuggaggaacuucagcagaagguguccuacaaaggagacccuaucguccagcacagacccaugcucgaggaacggauuguggagcuguuuagaaaccuuaugaaaagcgcuuucguggucgagcgccaaccuuguaugccgaugcaccccgaucggccucugguuaucaagaccggcgugcaguuuacaaccaaggugagacuccuggucaaauuccccgaacugaauuaccagcucaagauuaaagugugcaucgacaaggauucuggcgacguugccgcccugcgcgggucccggaaguuuaacauccuuggaacgaauacaaaagugaugaacauggaggaaagcaacaauggcucccugucugcugaguucaagcaucucacccugagagaacagcgcugugggaacggaggccgggcgaauugcgaugccagccugauugucacagaggagcuucaccucaucaccuuugaaaccgagguguaucaucaagggcugaaaauugaccuggaaacacacucccucccuguuguggucaucagcaacauuugucagaugcccaaugcuugggccucuauccugugguacaacaugcuuacgaauaacccgaagaaugugaacuucuucaccaaaccucccaucggaacaugggaucaggucgccgaggugcuguccuggcaauuuagcucuaccacaaagagaggccucagcauugagcagcugaccacgcuggcugaaaaacuucucggcccugggguuaauuauuccggaugccagaucacaugggccaaguucuguaaggagaacauggcgggcaaaggguuuucuuucuggguguggcuggacaauauuaucgaucuggucaagaaauacauucucgcucuguggaacgaaggauauaucaugggcuuuaucagcaaggagcgcgaacgggccauucuuuccaccaagccucccgggaccuuccugcucagauuuagcgagucuuccaaagagggaggcgugacauucaccuggguugaaaaggacaucagcggcaaaacacagauucaaucuguggagcccuacacgaagcagcagcugaauaacauguccuuugccgaaaucauuaugggguauaaaaucauggaugcuaccaacauucuggucagcccgcuuguguaccucuaccccgacaucccuaaggaggaagccuucggaaaguauugccgccccgagucccaggagcacccugaagcugaccccggcgccgcgccguaccugaaaacaaaguuuaucugugugaccccuacaaccugcucuaauacgauugaucugcccaugagcccucggacccucgacucccugaugcaauucgggaacaauggagagggcgccgaacccucugcugggggccaguuugagagccuuacauucgauauggaacugaccuccgagugcgccacaagcccuauguga

SEQ ID NO: 76363 - RNA, 2247 nt, Artificial Sequence
  derived and/or modified sequence opt5 from STAT4__Homo_sapiens__NP_003142
augagccaguggaaccaagugcagcagcuggagaucaaguuccucgaacaggucgaccaauuuuacgaugacaauuuccccauggagauuagacaucugcuugcccaguggaucgaaaaccaggauugggaggcugccuccaauaacgaaaccauggcgacaauucugcuccagaaucugcuuauccaacuggacgagcagcucggccggguuucuaaagagaagaaccugcugcucauucacaaucugaaacgcaucagaaaggugcuucaggggaaauuucacggaaacccuaugcauguggcugucgugaucagcaauugccugcgggaagaacgccggauucucgccgccgcuaacaugccgguucagggcccccuggaaaagucccuucaaucuagcuccgugucugagagacagcgcaaugucgagcacaagguggccgcuaucaaaaacagcguucagaugacggaacaagauaccaaguaucuggaggaccuccaggaugaguucgacuacagauauaaaacaauucagaccauggaucaguccgacaagaauagcgccauggugaaccaagagguccugacacugcaggaaaugcucaauucucuggauuuuaaacggaaggaggcgcuuuccaagaugacccagaucauucaugagacagaccugcucaugaacaccaugcugaucgaagaacuucaggauuggaaacgcagacaacagauugccuguaucgggggaccucugcacaacggccucgaccagcugcagaauugcuucacgcugcucgcugaaagccuguuucaacuucggcgccagcuggagaagcucgaggagcagucuaccaaaaugacauacgagggggaccccaucccuaugcagagaacccacaugcuggaacgggugacauuccuuauuuauaaccuguuuaaaaauuccuucguggucgagcgccaacccuguaugccuacccauccgcagagaccccucguucugaagacgcugauccaguuuacagugaagcuccggcugcuuauuaaacugccugaacucaacuaccaagugaaggucaaggccagcaucgauaaaaaugugucuacccuguccaacagacgcuucguucugugcggaacaaaugugaaggcuaugagcauugaggaauccucuaacggcagccuuuccgucgaguuucggcaccuccagcccaaagagaugaaaagcucugccggcgggaagggaaaugaaggcugucauauggugaccgaggaacugcacuccaucaccuucgagacacagaucugccuguaugggcucacgauugaccuggagaccagcucucuuccuguugugaugaucagcaacgucucccagcugcccaaugcgugggccucuauuaucugguacaacgugagcacaaaugauucccaaaaccucgucuucuuuaauaacccgccucccgcuacccugagccagcugcuugaagugaugucuuggcaguucuccagcuacguuggaagaggccucaacucugaccagcugcacaugcuggccgagaagcucacagugcaauccagcuauuccgaugggcaucugaccugggcuaaguuuuguaaagaacaccuuccuggaaagucuuucacguuuuggacauggcuggaggccauucucgaccugaucaaaaagcauauccugccccuuuggauugauggcuacgucaugggcuucgugagcaaagaaaaggagcgccuccugcugaaggacaaaaugcccgggaccuuucuccugcgguucuccgagucucaccuuggaggcaucaccuuuacauggguugaucauagcgaauccggggaggugagauuccacagcgucgaaccuuauaauaagggacgccugucugcccucccguuugcugacauucugcgggauuacaaagugaucauggcggagaacauucccgaaaauccucugaaguaucuuuaccccgacaucccuaaagacaaggccuucggcaagcacuauuccagccagcccugcgaggugucuagaccgaccgagcgcggggauaaaggauacguuccuuccgucuuuauucccaucagcacaauccggucugacagcacggaaccucauucccccagcgaucuccugccuaugucucccuccguguacgcugugcugagagagaaccucagcccgaccacaauugaaaccgccaugaaguccccuuauucugccgaguga

SEQ ID NO: 76364 - RNA, 2295 nt, Artificial Sequence
  derived and/or modified sequence opt5 from STAT5A__Homo_sapiens__NP_001275648
auggccggcuggauccaggcucaacagcugcagggggacgcccucagacagaugcaagugcuguacggacagcacuuccccauugagguccggcauuaucuugcgcaguggaucgaaagccagccuugggaugcuauugaccuggauaacccgcaagaccgcgcccaggccacccagcuccuggagggccuuguucaggaacugcaaaagaaagcugagcaccaggugggggaagauggauuucuccugaagaucaaacugggccauuacgccacacagcuccaaugcuccucucccgcugggauucugguggacgccaugagccagaagcaccuucagaucaaucagacguucgaggagcugagacucgucacccaagauacagaaaacgagcugaaaaagcugcagcagacccaggaauauuuuaucauucaauaccaggagucccuucggauccaggcgcaguucgcccaacucgcucagcugucuccucaggagcgccugagcagagaaacagcccuccagcaaaaacaggugucccuggaggcuuggcuucagcgggaagcccaaacccugcagcaguaucgcguugagcucgcggaaaagcaucagaagacacugcaacuucugagaaaacagcagaccauuauccucgacgaugagcugauucaguggaagcggcgccaacagcuggccggaaauggcgggcccccugagggcucucucgacgugcugcagagcuggugugaaaaacuugcugagaucauuuggcagaacagacaacagauccggcgcgccgaacaccugugccagcaacuccccaucccuggaccggucgaggaaaugcuggcugaggugaaugccacgauuaccgauaucauuuccgcccuuguuacaagcaccuuuaucauugagaagcagcccccucaggugcugaagacacagaccaaauucgcugcgacggucagacuccuggugggcgggaagcugaacgugcacaugaaucccccucaagucaaagccacaaucaucucugaacagcaggcuaagucccuccugaaaaacgagaauacccggaacgaauguagcggagagauucuuaauaacugcuguguuauggaauaccaucaggccacaggcacccugucugcccacuuucgcaauaugucccucaagagaaucaaacgggcugacagacgcggggccgagagcgugaccgaggaaaaguucacagugcuguuugagucucaauucuccgucggaagcaacgaacugguguuucagguuaagacgcuuucccuccccguggucgugauuguucauggcucucaggaucacaaugcgaccgcuacagugcugugggacaacgccuucgccgagccgggccgggucccuuuugcugugcccgacaaaguccuguggccucagcucugcgaggcccugaacaugaaguucaaagcugaagugcaaagcaauagagggcuuaccaaggagaaccugguuuuccucgcccagaaacuguuuaauaacuccagcucucaccuggaagauuauuccggacuuagcgugucuuggagccaguucaaucgcgagaaccuccccggcuggaauuacacauuuuggcagugguucgacggggucauggaagugcugaagaagcaucacaaaccccauuggaacgauggagcgauccugggcuuuguuaauaagcaacaggcccacgaccuccugauuaacaaaccugaugggaccuuccuucugcgguuuuccgacucugagaucggaggcaucacgauugcuuggaaguucgauagcccggagagaaaucucuggaaccugaaacccuuuacaacccgcgacuucuccauccggagccuggccgauagacuuggcgaccucucuuaccugauuuauguguuuccugaucgccccaaggacgaagucuucuccaaguacuauaccccugugcuggcuaaagccguggacggguacguuaagccccagaucaaacaagucgugccggaguuugugaaugcgagcgccgaugcuggagggucuuccgccacauauauggaccaggcuccuagccccgccgucuguccucaggcccccuacaacauguauccucagaaucccgaucaugugcucgaccaagauggcgaguucgaccuggaugagaccauggacguugcucggcacguggaagaacuucugagacgcccgauggauucccucgacucucggcugagcccucccgcgggacuguucacauccgccagaggcucucuuagcuga

SEQ ID NO: 76365 - RNA, 2364 nt, Artificial Sequence
  derived and/or modified sequence opt5 from STAT5B__Homo_sapiens__NP_036580
auggccguguggauccaggcucaacagcugcagggcgaggcccuccaccagaugcaagcgcuguacgggcagcauuuccccauugaagucagacacuaucuuagccaguggaucgagucccaggcuugggacucuguugaucuggacaacccucaagaaaauauuaaggccacccagcuccuggagggacuugugcaggaacugcagaaaaaggccgagcaucaagugggcgaggauggguuucuccugaaaaucaagcugggacacuacgcuacacagcuccagaacacguaugaccggugcccgauggaacugguccgcuguauuagacauauccuuuacaaugagcaacggcuggugcgcgaagccaacaauggcagcucccccgcugggucucucgccgaugcgaugagccagaaacaucugcagaucaaccagaccuucgaggagcuuagacugguuacacaagacaccgaaaaugagcucaagaagcugcagcagacacaggaauauuuuauuauccaauaccaggagucccugcggauucaggcccaguucggaccucucgcucaacugucuccccaggaacgccuuagcagagagaccgcccugcagcagaaacaagugucccucgaggcuuggcugcagcgggaagcccagacacuucaacaguaucgcgucgagcuggcggaaaagcaccagaaaacccuccagcugcugagaaagcaacagacgaucauucucgaugacgagcugauccaguggaaacggcgccagcaacuugccggcaacggcgggccucccgaaggaagccuggaugugcuccagucuuggugcgagaagcuggcugagauuaucuggcagaauagacagcaaauccggcgcgccgaacaccuuugucagcagcugccuauuccgggccccguugaggaaaugcucgcugaggugaacgccaccaucacagacauuaucuccgcccuggucaccagcacauuuauuaucgaaaagcaaccuccccaggugcugaaaacccagacgaaguucgcugcgacagugagacuccuggucgggggaaaacuuaauguucacaugaacccuccccaggugaaggccaccaucauuucugagcaacaggcuaaaucccugcucaagaaugagaacacacggaaugauuacagcggcgaaauccugaacaacugcugugugauggaguaccaucaggccaccgggacccugucugcccacuuuagaaauaugucccuuaaacgcauuaagcggagcgacagacgcggagcugaauccgucacagaggagaaguucacgauccucuuugaaucucaguucagcgugggcggcaacgagcugguuuuucaagugaaaacccugucccucccggucgugguuauugugcacgggagccaggauaauaacgccacagcgaccguccugugggacaaugcuuucgccgaaccuggacgggugcccuuugccgucccugacaaggugcuuuggccccagcugugcgaggcucucaacaugaaauucaaggccgaaguucagucuaauagaggccugacaaaagagaaccugguguuccuugcucaaaagcucuuuaauaacuccagcucucaucuggaggauuauagcgggcuguccgucucuuggagccaguucaaucgcgaaaaccuccccggacggaauuacaccuuuuggcagugguucgacggcgugauggagguucugaagaaacaccuuaagccucauuggaacgauggggccauccugggauuugugaauaaacagcaagcgcacgaccuccugaucaacaagccggauggcacguuccugcuuagauuuuccgacagcgaaauuggcgggaucacaauugccuggaaauucgauucucaggagcgcauguuuuggaaccucaugcccuucaccacccgggacuuuuccaucagaagccuggcugaucgccugggagaccucaauuaucugauuuacgucuucccugaucggcccaaggacgaaguguauucuaaguacuauacaccugugcccugugaguccgccaccgcuaaagccguugacggcuacgucaagccgcagaucaaacaaguggugccugaguuugucaacgcgagcgccgaugcugggggaggcuccgccacauacauggaccaggcucccucuccugccgugugcccccaggcccauuauaauauguacccucagaaccccgauagcguucuugacacggauggggacuucgaucuggaagacaccauggauguggcuagacgggucgaggaacuccugggccgcccgauggacucccaauggauuccucacgcgcagucuuga

SEQ ID NO: 76366 - RNA, 2544 nt, Artificial Sequence
  derived and/or modified sequence opt5 from STAT6__Homo_sapiens__XP_006719637
augagccuguggggccucguguccaagaugcccccugagaaaguccagagacuguacguugacuucccgcaacaccuucggcaucugcucggggauuggcuggaaucucagcccugggaguuucuugugggaagcgacgccuucugcuguaaccuggcuuccgcccuccugucugauaccgugcagcaucugcaggcgagcgucggcgaacaaggggagggauccacaauccuccagcacauuucuacgcuggaaagcaucuaucagcgcgacccucuuaagcugguggcuaccuuuagacagauucuccaaggcgagaaaaaggccguuauggagcaguuccggcaucugcccaugccuuuucacuggaaacaggaggaacuuaaguucaagacagggcugcgcagacuccagcaccgggugggagaaauccaucugcugcgcgaggcccuccaaaaaggcgcugaggccggccaggucucccugcacagccuuauugaaacccccgcuaaugggacaggaccuucugaggcccuggcgaugcuccugcaggaaaccacaggcgagcuugaagccgcuaaggcccuggugcucaaaagaauccaaaucuggaagcggcagcagcagcuggcugggaacggagccccguuugaggagucccuggcgccccuccaagaacgcugcgagagccugguugauauuuacucucagcuucagcaggaagugggcgccgcugggggagagcuggaaccuaaaaccagagccucccucacgggccggcuggacgagguccuucgcacccuggugacaagcuguuuccucguggagaagcaacccccucagguccugaagacccagacaaaauuucaggcuggcguuagauuccugcucgggcugcgguuucuuggagcccccgccaagccgccucuggugcgcgcugauauggugaccgaaaaacaagcgagagagcucucugucccccagggcccuggggccggagcugaauccacgggcgagaucauuaauaacacagugccccuggaaaauagcauccccgggaacugcuguuccgcccuguucaagaaucuucuccugaaaaagauuaaacggugcgagagaaagggaaccgagucuguuacagaagagaagugugccgugcuguuuagcgcuuccuucacccucggcccuggcaaacugccgauccagcuucaggcccugagccucccccuggucgugauuguucacgggaaccaagacaauaacgcgaaggcuaccauccugugggauaaugccuucucugaaauggaccgcgugccuuuugucguggccgagcggguccccugggagaaaaugugcgaaacacuuaaccucaaguucauggcugaggugggaacgaauagaggccugcugccugaacauuuucucuuccuggcccagaaaaucuuuaacgauaauucccuuagcauggaggcuuuccagcaccgcucuguuagcuggucccaauuuaacaaggaaauucugcucgggcggggauucaccuuuuggcagugguucgacggcgugcuggaucugacaaagagaugucuucgcucuuauuggagcgaccggcucaucauuggguuuaucuccaaacaguacgucaccagccugcugcucaacgagcccgacggcacauuccugcuuagauuuucugauuccgagauuggaggcaucaccaucgcccacgugauucgcgggcaggacggaagcccgcaaaucgaaaauauucagccuuucucugcgaaggaucuguccauccggagccucggcgaccgcauuagagaucuggcccagcugaaaaaccuuuaucccaagaaaccuaaggacgaggcuuuccggucccauuacaagcccgaacagauggggaaagauggaagaggcuauguuccugccacgaucaagaugacaguggagcgggaccaaccccucccgaccccugaacugcagaugcccaccaugguccccucuuacgaucuggggauggcuccugacagcuccaugucuaugcagcucggcccggauauggugccccagguguacccuccccacagccauuccaucccucccuaucaaggacugagcccugaggagucuguuaauguccuuuccgccuuucaggaaccccaucugcagaugccgccuagccucggccaaaugucucugcccuucgaccagccucacccccaggggcugcuuccgugccagccucaagagcacgcgguguccagccccgacccucugcucuguucugaugugacaauggucgaagacagcugccugucccagcccgugaccgccuuuccccagggaacauggauuggcgaggauaucuucccuccgcuccugcccccuacggaacaggaccuuaccaaacugcuccuggaggggcaaggagagagcggcgggggcucucugggagcucagccccuucugcagccuucccacuacggccagagcgggauuuccaugucucauauggaucuccgcgccaaccccagcugguga

SEQ ID NO: 76367 - RNA, 159 nt, Artificial Sequence
  derived and/or modified sequence opt5 from STATH__Homo_sapiens__NP_001009181
augaaguuccugguguuugccuucauccucgcucugauggucagcaugauuggcgccgacuccucugaggaauacggguauggacccuaccagccuguuccggagcaaccccuuuauccucagcccuaccagccucaguaucaacaguacaccuuuuga

SEQ ID NO: 76368 - RNA, 1713 nt, Artificial Sequence
  derived and/or modified sequence opt5 from STAU2__Homo_sapiens__NP_001157852
auggccaaccccaaggagaaaaccgcuaugugccuggugaaugaacucgccagauucaaccggguccagccucaauacaagcugcuuaaugagcgcggcccggcgcacagcaaaauguuuuccguucagcugucucucggggaacagacaugggagagcgaaggauccucuaucaagaaagcucagcaagccguggccaacaaggcucugacggagagcacccuucccaagccugugcagaaacccccuaaguccaaugucaacaauaaccccggcucuauuacaccuaccguggagcugaaugggcucgccaugaaaagaggagaaccggcuaucuaucggccccuggacccuaagcccuucccuaacuaccgcgccaauuauaacuuuagaggcauguacaaucagcgguaucauugucccguuccgaaaauuuucuacgugcagcugacagucgggaacaaugaguuuuucggagaaggcaagacccgccaagcggccagacacaacgcugccaugaaggcucuccaggcccugcagaacgagccuauccccgagcggagcccucagaauggcgaauccgggaaagauguggacgaugacaaggaugcgaacaaaagcgagauuucucuuguuuuugaaaucgcccugaagcgcaauaugcccguguccuucgaggucaucaaagaaagcggacccccucauaugaagucuuuugugacaagaguguccgucggcgaguucagcgcugagggggaaggaaacucuaaaaagcucuccaagaaacgggccgcuaccacgguucugcaagagcuuaagaaacugccgccccucccugugguggaaaagcccaaacuguuuuucaagaagcgcccuaaaaccauugucaaggccggccccgaguaugggcagggaaugaauccgaucagcagacuggcccagauucaacaggcuaaaaaggaaaaagagccugacuacgugcuccuguccgagcggggcaugccccgcagacgggaauuuguuaugcaagugaaggucggcaacgagguggcgacagggaccggaccuaauaagaaaaucgccaagaaaaacgcugccgaagccaugcuucugcagcucggcuacaaggcuucuacaaaucugcaggaucagcuugagaaaaccggggaaaacaagggauggagcggccccaagccuggguuccccgagccgacgaauaacacaccuaaaggcauucugcaccucucccccgacguuuaucaggagauggaagccagcagacauaaggugaucucuggaaccacacugggcuaccugucccccaaagauaugaaucagccuagcucuagcuucuuuuccauuucuccgaccagcaacuccagcgcgaccaucgcucgcgagcuccugaugaaugggacaucuuccacggccgaagccaucggacuuaagggcagcucucccaccccucccugcuccccuguccaacccagcaaacagcuggaguaucucgcucggauucagggguuccaggccgcucuguccgcccuuaagcaauuuucugagcagggacuggacccuaucgauggcgcgaugaacauugaaaaagggagccucgagaagcaggccaagcaccugagagaaaaagcugacaacaaucaggcucccccgggcuccaucgcccaagauuguaagaaaucuaacagcgccguguga

SEQ ID NO: 76369 - RNA, 1077 nt, Artificial Sequence
  derived and/or modified sequence opt5 from STBD1__Homo_sapiens__NP_003934
augggcgccguguggagcgcucugcucgucgggggaggccuggccggggcgcuuuucguuuggcugcucagaggaggccccggggacaccggaaaggauggcgacgcugagcaggaaaaagaugccccucugggcggggccgcuaucccgggaggccaccaauccgggucuagcggacuuucccccggcccuucugggcaggagcuggugacaaagcccgaacaucuccaggagagcaacggacaccugauuuccaaaacgaaggaccugggcaaacuccaggccgcuucuuggcggcugcaaaauccuagccgcgaagugugcgauaacuccagagagcauguccccagcggccaguuuccugacaccgaggccccggcgacaucugaaaccuccaauagccggucuuacuccgaggugagccgcaacgaaucucuugagucccccaugggggaguggggauuccagaagggccaggaaaucagcgccaaggcugccacauguuuugcugagaaacugccuuccucuaaucuccugaagaacagagccaaagaagagaugagccuuuccgaucugaauagccaagaccggguugaucacgaagagugggagauggugccccgccauucuuccuggggagacgucggggugggcgggagccucaaggcgccuguucugaaccugaaucagggaauggauaacggcagaucuacccucguggaagcccggggccagcagguccacgggaaaauggagcgcguggcugugaugcccgccggaagccaacaggucuccguuagauuccaggugcacuaugugacaucuaccgacguccaauuuauugcugugacgggcgaucaugaaugccuggggcgguggaauaccuacaucccgcuucacuauaacaaggacggauucuggagccauuccauuuuucugccugccgacacaguuguggaguggaaguucguccucguggaaaauggcgggguuacccgcugggaggaguguagcaacagauuucuggaaacaggccacgaggauaaagugguccacgccugguggggaauccauuga

SEQ ID NO: 76370 - RNA, 744 nt, Artificial Sequence
  derived and/or modified sequence opt5 from STC1__Homo_sapiens__NP_003146
augcugcagaacagcgccgugcuccugguccuuguuaucuccgcuucugccacccacgaggcggaacaaaaugacagcgugucccccagaaagucucggguggcugcccagaacagcgccgaggucgugcgcugccugaauagcgcucuccagguuggcuguggggccuucgcuugccuggaaaacucuacaugugauacggacggaauguacgauauuugcaaauccuuucuuuauuccgccgcgaaguucgacacccagggcaaagccuuugugaaggagagccugaaauguaucgcuaauggggucacaucuaagguguuccucgccauuagacggugcuccaccuuucaacgcaugaucgcugaaguucaggaggaguguuacagcaagcugaacgugugcucuauugccaaaagaaauccugaagcgaucacagaggucgugcagcugccgaaccauuucuccaaucgguauuacaaccgccucgugagaagccugcuugaaugugaugaggacaccgucucuacaauccgggauucccugauggagaagauuggacccaauauggccagccucuuucacauccugcagaccgaccauugcgcucaaacgcacccucgcgccgauuucaacagacggcgcaccaaugaaccccagaaacuuaagguucugcucagaaaccugcggggcgaggaagacuccccuucucauauuaaacgcacaagccacgaguccgcuuga

SEQ ID NO: 76371 - RNA, 909 nt, Artificial Sequence
  derived and/or modified sequence opt5 from STC2__Homo_sapiens__NP_003705
augugcgccgagagacugggccaguucaugacccucgcucuggugcuugccacauuugaccccgcgcgggggacggaugcuaccaacccuccggaaggaccccaagaccgcagcucccagcagaagggcagacugucucuccagaauacagccgagauccaacacugucuggucaacgccggggauguuggaugcggcguguucgaauguuuugagaauaacagcugcgaaauucgggggcuucauggaaucuguaugaccuuccugcacaaugcuggcaaauuugacgcccagggcaaguccuucauuaaagaugcucucaagugcaaagcccaugcgcugcgccacagauuuggguguaucucucggaagugcccugccauucgcgagauggugagccagcugcagagagaguguuaccucaagcaugaccugugcgcugccgcucaagaaaacacacgggucaucguggagaugauccacuucaaagaucuucugcuccacgaacccuauguugaccuggugaaucuucugcucaccuguggagaggaggucaaggaagccauuacacauuccgugcagguucagugcgagcagaacuggggcucucugugcagcauccuguccuuuuguaccagcgcgauucaaaaaccucccacggccccuccggaacgccagccccagguggauagaaccaagcucucucgggcucaccauggggaggccggacaccaucugccugaacccuccagccgcgagacaggcagaggggcuaaaggagagcggggcucuaagucccacccuaaugcccacgcccgcggcagagucgggggacuuggcgcucaagggcccagcggaucuuccgaaugggaggacgaacagagcgaguacuccgauauccggagauga

SEQ ID NO: 76372 - RNA, 1020 nt, Artificial Sequence
  derived and/or modified sequence opt5 from STEAP1__Homo_sapiens__NP_036581
auggagagcagaaaggacaucaccaaccaggaggaacuguggaaaaugaagccccggcgcaaucucgaagaggaugacuaccugcacaaagauacaggcgaaacguccaugcuuaagagaccugugcugcuccaucugcaccaaaccgcccaugcugacgaguucgauugcccgucugagcuucagcacacacaggaacuguuuccccaguggcaucucccuauuaaaaucgccgcgauuaucgcuagccugaccuuccuguauacacuccugcgggaggucauucacccccuugccaccucccaccaacaguacuuuuauaagaucccuauccugguuauuaacaaggugcuccccauggugucuaucacacugcuugcccuggucuaccucccuggggugauugcugccaucguucagcugcauaauggaaccaaauauaagaaauucccgcacuggcuggacaaguggaugcucacgcgcaaacaguuuggccugcuuagcuucuuuuucgcugugcugcaugccauuuacucccucucuuaucccaugagacggagcuaccgcuacaagcugcuuaacugggcguaucaacagguccagcagaauaaggaagaugccuggaucgagcacgacguguggagaauggagauuuacguuucccuggggaucgugggacucgcuauccuggcccugcucgcugucaccagcauuccuucuguguccgauagccugacauggcgggaauuucacuauauccaaucuaaacuuggcauugugucccugcuccuggggaccauccaugcccuuauuuucgcguggaacaaguggaucgacaucaaacaguuugucugguacacacccccuaccuucaugauugccguuuuucugcccaucguggugcucauuuucaagagcauccuguuccugccgugucuccgcaaaaagauucugaaaaucagacacggaugggaggaugucacgaagaucaauaagacagaaauuugcucucagcuuuga

SEQ ID NO: 76373 - RNA, 1473 nt, Artificial Sequence
  derived and/or modified sequence opt5 from STEAP2__Homo_sapiens__NP_001231873
auggagagcaucuccaugaugggcucucccaagagccuguccgaaaccuuccucccuaacgggauuaauggaaucaaagacgccagaaaggugacagucggcguuauugggucuggagauuuugcuaaaagccugacgauccggcuuauucgcugcggcuaccacguggugaucggguccagaaacccgaaguucgccucugaguuuuucccccaugucguggacguuacccaccaugaagaugcgcugacaaaaaccaauaucauuuuuguggcuauccaccgggagcauuauacaagccucugggaccugcgccaccuucuggucggaaagauucucaucgauguguccaacaauaugagaauuaaccaguacccugaaagcaaugccgaguaucuggccucucuguuccccgacucccucaucguuaagggcuuuaacguggucagcgcuugggcccugcaacuuggcccuaaagaugcuucucgccagguguacauuuguuccaauaacauccaggcccggcagcaagugaucgagcuggcgagacagcucaauuucauucccaucgaccuggggagccuuucuuccgcccgggaaauugagaaccugccucuccgccuguuuacccuguggagaggaccggucguuguggcuaucagccucgccacauucuuuuuccuguauuccuuugugcgggaugucauucaccccuacgcucgcaaucagcagucugacuucuauaagaucccuaucgaaauugugaacaaaacccuucccaucguugccauuacgcugcucagccugguguaccuugcgggccugcucgccgcugccuaccaacuguauuacgggaccaaguauagacgguucccucccuggcuggagacauggcuccagugccgcaaacagcugggacuucuguccuuuuucuuugcuaugguccauguggccuacagccucugucugccgaugagacggucugagagauaucuuuuccugaauauggccuaccagcaaguucacgcuaacaucgaaaacuccuggaaugaggaagagguguggcgcauugaaauguauaucagcuuuggcaucaugucucucgggcugcugagccuccuggcggucaccuccauuccuucugugagcaacgcccuuaauuggcgggaguucuccuuuauccagagcacacugggauacgucgcucuccugauuucuaccuuccaugugcugaucuacggcuggaagagagccuuugaggaagaguauuaccgcuucuauacgcccccuaacuuuguucuugcccucgugcugcccuccauugucauccugggcaagauuauccucuuccugcccugcaucagccggaaacuuaagagaauuaaaaaggggugggaaaaaucucaguuucuggaggaaggaaugggcgggacaaucccucacguguccccggagcgcguuaccgugauguga

SEQ ID NO: 76374 - RNA, 1467 nt, Artificial Sequence
  derived and/or modified sequence opt5 from STEAP3__Homo_sapiens__NP_001008410
augcccgaggaaauggacaagccucugaucagccuccaccugguggauuccgacucuagccuugccaaagucccggaugaggcucccaagguuggcauucugggguccggagacuucgccagaucucucgcgacccggcuggugggcagcggguuuaaaguggucgugggaucccgcaacccuaagagaacagcucggcuuuuccccucugccgcccagguuacguuucaagaagaggcugugagcuccccugaagucaucuucguggccguuuuucgcgagcauuacagcucucugugcucccucagcgaucagcuggcuggcaaaauucugguggacgucucuaaucccaccgagcaggaacaccuccagcauagagaguccaacgccgaauaucuggcgagccuuuucccuacauguaccguggugaaggccuuuaaugucaucucugcuuggacacugcaagccgggccgcgggauggaaaccgccagguucccauuugcggcgaccagccugaggcuaagagagccguguccgagauggcgcucgccaugggcuucaugcccguggauauggggagccuggcuuccgccugggaagucgaggcuaugccucuucggcugcuccccgccuggaaagugccgacccugcuggcccucggacuguuuguuuguuucuacgcuuauaauuuugugcgcgacguccuucagccuuacgugcaagaaucucagaacaaguucuuuaaacugcccguuagcguggucaauacaacccucccuugcguggcguauguccugcuuucccugguguaccuccccggcguucuggccgcugcccugcagcucagacgggggacgaaguaucagcgcuuccccgauuggcuggaccacuggcuucaacauagaaaacagaucggacugcucagcuucuuuugugccgcucugcacgcccuuuacucuuucugccugccucuccggcgcgcgcacagauacgaucuggugaaccuggcugucaaacaggugcucgccaauaagucccaucuguggguugaggaagagguguggcggauggagaucuaucuuagccugggcguccucgcccuggggacccugucucuucucgcugugacaagccugccguccauugccaacucucugaauuggagagaauuuagcuucgugcaauccagccucggauuuguugcucugguccuuucuacccugcacacacucaccuacggcuggacgcgcgccuucgaggaaucccgguauaaguuuuaccugcccccuacauucacccugacacuucucgugcccuguguggucauccuggcgaaggcccuguuucuccugccuugcauuagcagacgccuugcucggaucagacgcggcugggagcgggaaucuaccauuaaauucacccugcccacagaccaugcccucgcugagaagacgucccacguguga

SEQ ID NO: 76375 - RNA, 852 nt, Artificial Sequence
  derived and/or modified sequence opt5 from STEAP4__Homo_sapiens__NP_001192245
auggagaagaccugcaucgacgcccugccccucacaaugaacagcuccgaaaaacaggagacgguguguauuuucggcaccggggauuuuggaagaucucugggccuuaagaugcugcaaugcggguacagcgucguuuucggaucccggaauccucagaaaacaacccuccugccgucuggcgcugaagugcuuagcuauuccgaggccgcgaagaaaucugggaucauuaucauugcuauccaccgcgaacauuacgacuuucugacagagcucaccgaggugcugaacggaaagauccuggucgauauuagcaauaaccucaagaucaaucaguaucccgaauccaacgccgaguaccuggcccaccuugugccuggcgcucauguugugaaagccuucaauacaauuagcgcuugggcccugcagucuggcgcgcucgacgccuccagacaagcuauccugaagaaagaaaaccccuuuagcaccucuuccgccuggcuuagcgauucuuaugucgcucuggggauucucggauucuuucuguucgugcugcucggcaucacgucccugccuagcguuuccaaugccgugaacuggcgggaguuucgcuucguccagucuaaacuuggguaccugacccucauucuguguacagcgcacacccuuguguauggaggcaagagauuucugagccccuccaaucuccggugguaccugccugccgcuuacgugcuggggcucaucaucccgugcacaguccugguuauuaaguucgugcuuaucaugcccuguguggacaacacccugacgcgcauuagacagggaugggagcggaauagcaagcauuga

SEQ ID NO: 76376 - RNA, 387 nt, Artificial Sequence
  derived and/or modified sequence opt5 from STH__Homo_sapiens__NP_001007533
augagcgagggcgggggacagguguccugcaucuucgccgcucccaccagacugugucgguggccugcccucauugaaugcggcgucaaccugacacaaccgcuuugugaguggaugauccagguugcgcgcgacagaacgcugucucucgcuugggaaguggccagccugcuuacccuguccucuagcgagguggggcucgaaggagucggcacaauuuggcccuccucuuacagcuccgaggagagcucucggaauggggccgaacagggacgccagcuguccaucgagggcccuuuucaaggccagaacugccccagccacccugcugccgcucugccccucccuaugagaggggaaucucaggccaccuccugucagguguga

SEQ ID NO: 76377 - RNA, 3867 nt, Artificial Sequence
  derived and/or modified sequence opt5 from STIL__Homo_sapiens__XP_011540294
auggagcccaucuacccuuucgccagaccgcagaugaacacccgguuucccagcucccgcauggugccuuuccacuuucccccuucuaagugcgcucuguggaaucccacaccuacgggcgacuucauuuaucuccaucugagcuacuauagaaacccgaaacuugucguuaccgaaaagacaauccggcuggccuaccgccacgcgaaacaaaauaagaaaaacuccucuuguuuucuccuggggagccuuaccgcugaugaggacgaagagggagugacacugaccguggauagauucgaccccggccgggaagucccugagugccucgagauuacacccaccgccucccugccuggggauuuucugauccccuguaaggugcauacgcaggaacucugcucucgcgagaugauuguucacagcguggacgauuucuccagcgcccugaaggcucugcagugucauaucugcucuaaagacucccuggauuguggaaagcuccugagccuuagaguccacaucaccucucgggaaucccuggacagcguggaguuugaucuccacugggccgcuguuacacuggccaauaacuucaaaugcaccccggugaagccuauucccaucauuccuacagcgcuggcccgcaaucucucuuccaaccugaauaucagccagguccaaggcaccuauaaauacggguaucuuacgauggacgagacaagaaagcugcuccugcuucuggaauccgaucccaagguguacucucucccccuggugggaauuuggcugagcggcaucacccauauuuacuccccucaggucugggcuuguugccuccgguauaucuuuaacagcucuguucaggagcgcguguucuccgaaagcggcaauuuuaucauugugcuguacucuaugacacacaaagagccggaauuuuaugaguguuuccccugcgacgggaagaucccugacuuuagauuccagcuucugaccagcaaagagacccuccaucuguuuaagaacgucgaacccccugauaaaaaucccauucggugcgagcuuuccgccgaaucucaaaacgcugagacagaguucuuuagcaaggccuccaaaaauuucagcaucaagcgcuccucccagaagcugagcucuggaaaaaugccgauucacgaccacgauuccggcguggaagacgaggauuuuagcccuagacccaucccuucuccccauccuguuucucagaagaucagcaaaauucagcccuccgugccggaacucucucugguccuggacgggaacuucaucgagagcaacccucuccccacgccccuggaaauggugaauaacgagaauccuccgcuuauuaaccaccuggaacaucucaagccccugcaaccucagcuguacgaugagaaacacucccccgagguugaagcgggagagccuagccuucggggcauccccaaucagcucaaccaagacaagccugcccugcugagacauuguaaggugcgccagcccccggcuuauaaaaaggggaauccucacacccggaacucuauuaaacccuccagccacaauggaccuucucaugauaucuuugaaaagcuccagacagucuccgccggcaacgugcagaaugaggaguaccccaucagaccgagcacccugaacucucgccaaagcucccuugcuccucagagccagccccacgacuucgucuuuucuccucauaauuccggccggcccauggaacugcagauucccacaccuccgcuccccagcuauugcuccaccaacguguguagaugcugucaacaccacucucauauccaguacagcccucuuaauuccuggcagggggccaacacgguuggaucuauucaggaugugcaaagcgaggcccugcagaaacacucccuuuuccaucccucuggcugcccugcucucuacuguaacgcguuuugcagcuccagcucucccaucgcccugcgcccucagggggacaugggauccuguagcccgcacucuaauauugaacccuccccugucgcucggcccccuagccauauggaccugugcaacccccagccguguacagugugcaugcacaccccuaagaccgagucugauaauggcaugauggggcucucccccgacgccuauagauuccugacagaacaagaucgccagcuucggcugcuccaggcccaaauccagagacugcuggaggcucagagccuuaugcccugcuccccuaagaccacagccguugaggacacggugcaggcgggacgccaaauggaacucgucagcguggaggcucagucuagccccggccugcacaugcggaaaggcguguccauugccguuucuaccggggccagccuguucuggaacgcugccggagaagaucaggagccugacucccagaugaagcaagaugacacaaaaaucucuagcgaagauaugaauuuuuccgucgacaucaacaaugaggugaccucucucccgggcagcgcuuccagccugaaggccguggauauucccucuuucgaggaauccaacaucgcggucgaggaagaguuuaaucagccucuuagcgugucuaacuccagcucccugguugugagaaaagaacccgacgucccuguguucuuucccucugggcagcucgccgagagcguuuccaugugucugcagacaggaccgaccggcggggcuagcaauaacucugagacguccgaggaaccuaagauugaacaugugaugcaaccccugcuucaccagccuagcgauaaucagaagaucuaccaagaccuccugggccaggucaaccaucugcucaauucuagcuccaaagagaccgagcagcccucuacaaaggccgugauuaucagccacgaaugcacccggacacagaacguuuaucauaccaaaaagaaaacgcaccacucccgccugguggacaaggauuguguccuuaacgcuacacugaaacaacucagaucucugggagugaagaucgacagcccuaccaaggugaaaaagaaugcccauaacgucgaucacgcguccguucuggccugcauuagccccgaggcugugaucucuggccuuaauuguauguccuucgccaacguggggaugagcggacuguccccgaauggcgucgaccucucuauggaagcuaacgccauugcccugaaauaccucaaugagaaccagcugagccagcuuuccgugacacggucuaaucagaacaauugcgauccuuuuagccugcuccauaucaacaccgacagauccaccguugggcugagccugauuucucccaauaacauguccuucgcuacaaagaaauauaugaagcgcuacggacuucugcaaagcucugauaauuccgaagacgaggaggaacccccugauaacgcggacagcaagucugaguaucuccugaaccagaaucuccggagcaucccggaacagcugggcgggcagaaagagcccuccaagaacgaucacgaaaucauuaauuguucuaacugcgagagcgugggcacgaaugccgacaccccuguccuuagaaacaucacaaaugaggugcugcaaaccaaagcuaagcagcagcucacagaaaaacccgccuuucugguuaagaaccugaagccuucccccgccgugaaucuucgcaccggaaaagcugaguucacgcagcacccugaaaaggagaacgaaggcgauauuacaaucuuuccggagagccugcaacccuccgagacccucaaacagaugaacucuaugaauagcgucgggaccuuccuggacgugaagagacuccggcagcugccuaaacuuuucuga

SEQ ID NO: 76378 - RNA, 2058 nt, Artificial Sequence
  derived and/or modified sequence opt5 from STIM1__Homo_sapiens__NP_003147
auggacgugugcgucagacuggcccucuggcugcuuuggggccugcuccugcaccaggggcaaagccuuucccauucucacagcgagaaggcuaccggaacauccucuggcgccaacagcgaagaguccacggcggcugaguucugucggaucgauaaaccccugugccauucugaggacgaaaagcucagcuuugaggccguucgcaauauucacaaacugauggaugacgaugccaacggggacguggauguggaggaauccgacgaguuccugagagaagaucucaauuaccaugacccuaccgucaagcacagcacauuucacggagaggauaaacugaucucuguggaggaccuuuggaaggcuuggaaguccagcgaaguuuauaacuggaccguggaugaggucgugcaguggcugauuacauacguugaacucccgcaguaugaggaaaccuuccggaaacugcagcuuucuggccaugccaugccccgccuggcugugacaaauaccacgaugaccgggacaguccucaagaugaccgacagaucccaccggcaaaaacugcagcugaaggcccucgacacagugcuguuuggaccuccccuucugacccgccauaaccaccucaaagauuucaugcugguggucagcaucguuauuggcgugggcggguguugguuugcguacauccagaauagauauucuaaggagcacaugaagaaaaugaugaaggaccuugagggacugcaucgggccgaacagucccuccacgaucugcaagagcgccugcauaaagcucaggaagaacacagaacgguggaagucgagaaggugcaucucgagaaaaagcugcgggacgaaaucaaccuugccaaacaggaggcucagcgccugaaggaacucagagagggcacagaaaaugagcggagccgccaaaaguacgccgaggaagaacuggaacagguuagagaggcgcuucggaaagccgagaaggaacuggagucccacucuagcugguaugcuccugaagcccuccagaaauggcugcaacugacccacgagguggaaguccaguacuacaacauuaagaaacagaaugcugagaagcagcuccugguggccaaggagggggccgagaaaaucaagaaaaagagaaacacacuuuucggaaccuuucauguugcucacuccagcucucuggaugacguggaucauaaaauucucaccgcgaagcaagcccuguccgaggucacagcugcccugcgcgaacggcuucacagauggcagcagaucgagauucucugcggcuuccagaucgugaauaaccccgggauucacagccuggucgccgcucugaauaucgacccuucuuggaugggaagcacgcgcccgaaccccgcccauuuuaucaugaccgaugacguggaugacauggacgaagagauuguuuccccucucucuaugcaaagccccucccugcagagcucugugcggcagagacuuacagagccucagcacggccugggcucccaacgcgaucucacccauagcgacucugaauccagccugcacauguccgaucggcagagagucgcgcccaagccgccucagaugucucgcgcugccgacgaggcccugaacgcuaugacaagcaaugggucccaucggcuuaucgaaggagugcaccccggcucucucguugagaaacugccugauagccccgcccuggcuaagaaagcccuccuggcgcuuaaccacgggcuggacaaggcccauucccucauggaacugagccccucugcuccuccgggaggcagcccccaccuggauuccucuagaucccauagcccuucuagccccgacccugauacccccuccccggugggggacagccgcgcccuucaggcuucucggaauacgcggauuccucaccucgccggcaaaaaggcggucgccgaggaggauaacggauccaucggcgaagagacagacagcucccccgggagaaagaaauucccucugaagauuuuuaaaaagccccugaaaaaguga

SEQ ID NO: 76379 - RNA, 1800 nt, Artificial Sequence
  derived and/or modified sequence opt5 from STIM2__Homo_sapiens__NP_001162588
augcuggugcucggccugcuugucgccggggcugccgacggaugcgagcugguucccagacaccuccggggccgcagagcgaccgggagcgcugccacagccgcuuccucuccugccgcugccgcgggagauagcccggcccugaugacggaccccuguaugucccuuucuccucccugcuucaccgaagaggaucgguuuagccuggaagcucuccagacaauccauaagcaaauggacgaugacaaagauggcgggauugagguggaagaguccgacgaguucauccgcgaagauaugaaguacaaagacgccaccaacaagcacucucaucugcacagagaggauaaacauauuacaaucgaagaccuguggaagcgguggaagaccagcgaggugcacaauuggacacucgaggauacccugcaguggcuuauugaauuugucgagcugccucaguaugaaaagaacuuccgcgacaauaacgugaagggaacgacccuccccagaaucgcuguucacgagccuuccuuuaugaucagccagcugaaaauuucugaccggucccaucgccaaaaacuucagcugaaagcccucgaugugguccuguucggcccgcugacaagacccccucacaauuggaugaaggacuuuauccucaccgugagcauuguuaucggcgucgggggauguugguucgcguacacacagaacaagaccucuaaagaacauguggccaagaugaugaaagaucuggagucccuucagacggcugagcaaagccugauggaccuccaggaacggcuggagaaggcccaggaagagaaucgcaacguggcuguggaaaaacagaaucuugagagaaagaugauggaugagauuaacuaugccaaagaagaggccugccggcugcgcgaacucagagagggcgcugaaugugagcugucucggagacaauacgcggagcaggaacuggagcagguccgcauggcccucaagaaggcugaaaaagaguuugagcugcgguccagcugguccguucccgacgcccuucaaaaguggcugcagcucacacacgaaguggaggugcaguauuacaauaucaaaagacagaacgccgaaaugcaacuggcuauugccaaggaugaggcggagaaaaucaagaagaaacgcucuaccgucuucgggacacuucacguggcucauagcuccagccuggacgaaguugaucacaagauccucgaggccaaaaaggcccugucugaacugacaaccugccuccgggagagacuguuucgcuggcagcagauugagaaaaucuguggauuccagauugcucauaauuccggccuuccuagccugaccucuagccucuauuccgaccacucuuggguggucaugccccgggugagcaucccgccuuaccccauugccgggggaguugaugaccuggacgaagauacgccucccaucgugucccaauuucccggcaccauggcuaagccuccgggcagccuggccagaucuuccagccuuugccgcucucggagauccaucguccccagcuccccucagccccagcgcgcgcagcucgccccucaugcuccccacccgucucacccucggcauccccaccauccucaacacacaccccacagccugccuucccccgacccggauauucugucugugagcuccuguccugcccucuacagaaacgaagaggaggaagaggcuaucuauuucagcgccgaaaagcagugcauucaucuggggcuuggagcguguaaaucugaguga

SEQ ID NO: 76380 - RNA, 1632 nt, Artificial Sequence
  derived and/or modified sequence opt5 from STIP1__Homo_sapiens__NP_006810
auggaacaggugaacgaacugaaggagaaaggcaauaaggcccucagcgucgggaacaucgacgaugcucugcaaugcuacuccgaagccauuaaacuugacccccacaaucauguucuguauucuaacagaagcgcggcuuacgccaagaaaggagauuaucagaaggccuacgaggacggcuguaagaccguggaucucaaaccugacugggggaagggauauucccggaaagcugccgcucuggaguuccuuaaucgcuuugaggaggccaagagaacauacgaagagggccugaaacacgaagcgaacaauccgcagcucaaggaggggcugcagaacauggaggcccggcuggcugaacgcaaguucaugaaucccuuuaacaugccuaaucucuaucaaaaacuggagucugaucccagaacgcggacccuucugagcgacccuacauaccgcgaacucaucgagcagcugagaaacaagcccuccgaucuuggaaccaaacugcaggacccucggauuaugacaacccucucugugcugcugggcgucgaucucggcagcauggacgaagaggaggaaaucgccacaccgcccccucccccucccccgaagaaagagaccaagccugaacccauggaggaagaucugccugagaauaaaaagcaggcucuuaaggagaaagaacuggggaacgacgccuacaagaaaaaggacuucgauacggcgcucaaacauuaugacaaggccaaggagcuggaucccaccaauaugacauacauuaccaaccaagcugccguguauuuugaaaaaggagacuacaacaagugccgcgagcuuugugaaaaagcuaucgagguuggcagagagaaucgggaagauuaucgccagaucgccaaggccuacgcuagaauugggaacuccuauuucaaagaggaaaaguacaaggacgcgauccacuuuuacaauaaaagccuggccgagcaucggacacccgaugugcucaagaaaugccagcaggcugagaagauucugaaagaacaagagcgccuggccuauaucaacccugaccucgcccuggaagagaagaauaagggaaacgaauguuuccagaaaggcgauuacccgcaggcuaugaagcacuauaccgaggccauuaaaagaaaucccaaggacgcgaaacuuuacucuaaccgggcugccugcuauacgaagcugcucgaguuucaacuggcccuuaaagauugugaagagugcauccagcuggaaccuacauucauuaagggguacaccagaaaggcugccgcucucgaggccaugaaagacuauacaaaggcgauggacgucuaccagaaagcccuggaucuggacuccagcuguaaggaagcugccgauggauaccagcgcugcaugauggcucaauauaaucggcacgacucucccgaggaugugaaaagacgcgccauggcggacccugagguucagcagaucauguccgaucccgccaugcggcucauccuggaacagaugcaaaaggacccgcaggcucuuagcgagcaucugaagaacccugugauugcccagaaaauccagaagcucauggaugucggccugauugcuaucagauga

SEQ ID NO: 76381 - RNA, 2907 nt, Artificial Sequence
  derived and/or modified sequence opt5 from STK10__Homo_sapiens__NP_005981
auggccuucgcuaacuuuagacggauccugcgccucagcaccuucgagaagagaaaaucccgggaauacgagcacgugcgcagagaccuggaucccaaugaagucugggagauuguuggcgaacuuggggacggagccuuuggcaagguguauaaagcgaagaacaaagagacaggggcucuggccgccgcuaaggugaucgagacgaagucugaagaggaacucgaggauuacauugucgagaucgaaauucuggcuaccugcgaccauccuuauaucgugaaacuucugggagccuacuaucacgauggcaagcucuggaucaugauugaguucugucccgggggagccguugacgcgaucaugcuggaacuggaucggggccucacagagccccagauucaaguggucugccgccagaugcuggaagcccuuaauuuucugcauagcaaaagaaucauucaccgggaccucaaggcuggcaacgugcugaugacccuugagggggauauccgccuggccgacuucggaguuuccgcuaaaaaucucaagacacugcagaagagagauucuuuuauuggcaccccuuacuggauggcccccgagguggucaugugugaaacaaugaaagacaccccuuaugauuacaaggcggacaucuggagccuggggaucacgcucauugagauggcccagaucgaacccccucaucacgagcugaacccgaugcgggugcuucugaaaauugcuaaguccgacccgccuacccuccugacacccucuaaauggagcguggaguuccgcgauuuucuuaagaucgcccuggacaaaaauccugagaccagacccuccgcugcccaacuccuggagcacccguucgucagcucuauuacauccaacaaggcccugcgggaacucguugcugaggcgaaggccgaagugauggaggaaaucgaggauggacgcgacgagggcgaagaggaagaugcuguggacgccgccagcacccuggagaaucauacgcagaacucuuccgaggucagcccucccucucuuaaugcugauaaaccucuggaagagucccccagcacaccccucgccccuucccagucucaggacagcgugaacgaaccgugcucccaacccagcggggauagaucucugcagaccacauccccucccguuguggcgccuggaaaugagaacggccuugcuguccccgugccgcugagaaagagcagaccuguuucuauggacgcccgcauccagguggcccaggaaaaacaagucgcugagcagggcggggaucucagccccgccgcuaaucggucccagaaggccucucaaagcagaccuaacuccagcgcgcuggagacccugggaggcgaaaaacucgccaacgggucucuggagcccccugcucaggccgcucccggaccguccaagcgcgacagcgacuguucuucccuuugcaccagcgaauccauggauuacggcacaaaucugucuacggaccucagccugaacaaggagauggggucccugucuauuaaagauccuaaacuuuauaagaagacccucaaacggacaagaaaguuuguggucgacggaguggaaguuagcaucaccacauccaagauuaucagcgaggaugagaaaaaggacgaagagaugcgcuuccugcggagacaggaacugcgcgagcuccggcugcuucagaaagaagaacacagaaaucaaacccagcugucuaacaagcaugagcuccagcuggaacagaugcacaaacgcuuugagcaagaaauuaaugccaagaagaaauucuucgauacggagcuggagaaccuugaacggcagcagaagcagcaaguggagaaaauggaacaggaccacgcggucagacggcgcgaggaagccagacggaucagacucgagcaggaucgcgacuacacacgguuucaggagcaacugaagcugaugaaaaaggaagugaaaaaugagguugaaaagcuccccagacagcagcgcaaggaguccaugaaacaaaagauggaggaacauacccagaaaaagcagcugcuugauagagacuucguggcuaaacagaaggaggaucuggaacucgccaugaagcggcugaccacagacaaccgcagagagaucugugacaaagaacgggagugccugaugaagaaacaagaacuucuccgcgauagagaggcugcccugugggagauggaggaacaccagcugcaggaacggcaucagcucgucaagcaacagcugaaagaccaguauuuucuucagcgccacgagcugcucagaaagcaugagaaggaacgggagcaaaugcagcgcuacaaucagagaaugauugaacaacugaaagugcggcagcagcaggagaaggccagacugcccaaaauccaacgcagcgaaggcaagacccggauggcuauguauaaaaagucucuucacauuaacggcgggggauccgcggccgagcagagagagaagaucaaacaguucagccagcaagaagagaagcgccagaaaucugaacggcuccagcagcaacagaagcacgagaaucagaugagagauaugcuggcucagugugaaagcaacauguccgagcugcaacagcuccagaaugagaaaugccaucugcuuguggaacacgagacacaaaagcugaaagcccucgacgaaagccauaaccagaaucugaaggaguggcgcgauaagcugcggccucggaaaaaggcccuugaagaggaccugaaccagaaaaagcgcgagcaggaaauguuuuucaaacucucugaggaagcugaguguccgaaccccuccacgccuagcaaggccgcgaaguuuuuccccuacuccucugcugaugccagcuga

SEQ ID NO: 76382 - RNA, 1302 nt, Artificial Sequence
  derived and/or modified sequence opt5 from STK11__Homo_sapiens__NP_000446
auggagguggucgacccccagcaacugggcauguucaccgaaggggagcucaugagcguuggaauggauacauuuauccacagaauugacuccacggaagugaucuaccagccucggcgcaagagagccaaacugauuggcaaguaucuuaugggggaucugcucggagagggcucuuacgggaaagugaaggaaguccuggacagcgagacccuuugccggcgcgcugugaaaauccugaagaagaaaaagcucagacggauuccgaacggagaggccaauguuaaaaaggaaauccagcugcugcgcagacuccggcauaaaaacgugauccagcuggucgaugugcuuuauaaugaggaaaagcaaaagauguacaugguuauggaguauugugugugcggcaugcaggagaugcuggacuccguccccgaaaaacgcuucccugugugucaggcgcacggcuacuuuugccagcucauugaugggcuggaguaucuucauucucaaggaaucgugcacaaggacauuaaacccggcaaccugcuccugacaaccgggggaacacugaagaucagcgaucucggcgucgcugaagcccugcauccuuucgccgcugacgauaccuguagaacaucccaggggucucccgccuuucagccuccggagauugcuaauggacuugacaccuucagcggcuuuaaaguugauaucugguccgccggcgugacgcuguacaacauuaccacagggcucuaccccuucgaaggagacaauaucuauaagcuguuugagaacaucggcaaagggagcuacgcgauuccuggagacugcgggcccccucuuucugaucugcucaagggcaugcuggaguaugaacccgccaagcgguucuccauccgccagauuagacaacacagcugguuucggaaaaagcacccgccugcugaggcccccgugccuaucccucccucucccgacaccaaagaucgcuggagauccaugacagucgugccguaccuggaagaccuccauggagcugaugaggacgaagaucuguucgacauugaggaugacaucaucuauacccaggauuuuacgguucccggccaggugccugaggaagaggccagccacaauggccaacggagagggcuucccaaggcggucuguaugaacggaacagaagccgcucagcugucuaccaaaucccgcgccgagggccgggcuccuaaucccgccagaaaggccugcagcgcuuccucuaagauucgccggcucagcgcguguaaacagcaguga

SEQ ID NO: 76383 - RNA, 3267 nt, Artificial Sequence
  derived and/or modified sequence opt5 from STK11IP__Homo_sapiens__NP_443134
augaccacagcccagagagacagccugcucuggaagcuggcuggccuucugcgggaguccggggaugugguccucucuggaugcagcacgcugucccuucugacccccacacuccaacagcugaaccacguuuucgaacugcaucucggcccuugggggccgggacagaccggcuuuguggcccugcccucucacccugcggacagccccgugauccuucagcugcaauuccucuuugauguccugcagaaaacacuuucccugaagcucgugcauguugcugggccuggacccaccggcccuauuaaaaucuucccguuuaagucucugcgccaccuggagcucagaggcgugccccugcauugucuucacgggcugcggggaauuuacagccagcucgaaacacugaucugcucccgcagccuucaggcccuggaggaacuccugucugccuguggcggggacuucugcuccgcucugccuuggcucgcccugcuuagcgcuaauuuuucuuauaacgcccugaccgcgcucgauuccagccugagacuucugucugcccuccgguuccugaaucugucccacaaccaaguccaggacugucagggauuucucauggaucugugcgagcuucaucaccuggacauuagcuacaaucgccuccaucuggugcccagaaugggcccuuccggggcugcccugggaguucuuauccuccggggcaacgagcugcgcucucugcacggccucgaacagcugagaaaucuucggcaccuggaucucgcuuauaaccugcuggaggggcaucgcgaacuuagcccccucuggcugcuggccgagcucagaaaacuguaccuugagggaaauccgcugugguuccacccugaacaucgggcggccacggcucaauaucucuccccucgcgccagagacgcugccaccggcuuucugcuggaugggaaggugcuuagccucacagacuuccagacccacacaucucugggacugucccccaugggcccuccccuccccuggccggucgggagcacccccgagacgucuggaggcccugaucugagcgacucccuuucuagcggcgggguggugacacagccccugcuccauaaggucaaaucccggguuagagugcgccgggccagcaucucugaaccuuccgacaccgaucccgagccgagaacacugaacccuagccccgcuggaugguuugugcaacagcacccugaacuggagcuuaugucuuccuuccgcgagcgguucggcagaaauuggcuccaguaccgcagccaccuggaacccuccgggaacccucugcccgcgaccccgaccacaucugccccuagcgcuccucccgccuccucucagggacccgacacggccccgcggcccagcccuccccaagaggaagcuagaggcccucaggaguccccucagaagaugagcgaagagguccgcgccgagccccaggaagaggaagaggaaaaagaggggaaggaggaaaaagaggaaggcgagaugguggagcaaggagaagaggaagcgggcgaggaagaggaggaggaacaggaucagaaggaaguugaggcugaacucugucggccccugcuugugugcccgcuggaggggccugagggagucagaggccgcgaauguuuucuccgggugaccucugcccaucuguucgagguugaacugcaggccgcuagaacacuugagcggcuggaacuccaaucccuggaggccgcugagauugaacccgaggcccaggcgcagcgcagcccuagacccaccgggucugaccuccugccgggagccccuauccuuucccugcgguuuagcuauauuugccccgauagacagcuccgccgguaccuggugcuggaaccugacgcucacgccgcuguccaagagcuucuggccgugcucacacccgucaccaauguggcgagagagcagcugggcgaagcccgcgaucuccugcuugggagauuccagugucugcggugcggccaugaguuuaagcccgaggaaccucgcaugggacucgacucugaagagggcuggagaccgcuguuccagaaaacggagagccccgcuguuugcccuaacuguggguccgaucacgugguccugcuugccgugagccggggaacacccaaucgcgaaagaaagcaaggcgagcagucucuggcuccuucccccagcgccuccccuguuugccacccgcccgggcauggagaccaccucgaucgggccaaaaacucuccuccccaggcuccuagcacccgcgaccauggcuccuggucucugagcccgcccccugaaagaugugggcuccgguccguggaccaccgccugagacuuuuucuggaugucgagguguucucugacgcgcaagaagaguuucagugcugucugaaggugcccguugcccucgcuggccauaccggagaguucaugugccuggucguggugagcgaucggagacuuuaccugcucaaagucacaggcgaaaugcgcgagcccccugccuccuggcugcagcucacccuggccgugccccuucaggaccugagcgggaucgaacugggacucgcuggccaaucucugcggcuugagugggccgcgggggcuggaagauguguucugcucccucgcgaugcccggcacugcagagccuuucuggaggaacuccuggacgugcuucagucccugccgcccgcuuggcgcaacugugucagcgccacagaggaagaggugacgccucagcaccggcuguggccccuccuggaaaaggauucuucccuugaggcgagacaguucuuuuaucugcgcgcuuuccucguugagggcccuucuaccugccuggugagccuccugcuuacacccuccacccuguuccugcucgacgaagaugccgccgggagcccggcugagccuuccccucccgccgcuagcggcgaagccucugagaaagugcccccuagcggacccggcccggcgguccggguuagagaacaacagccucuguccucucuuagcuccgugcugcucuaccggucugcccccgaggaccugcgccugcucuuuuaugaugaggucagcagacuugaauccuucugggcucugcggguggugugucaggagcaacugacagcccuccuggcuuggauucgcgaacccugggaggaacuguuuucuaucgggcuuagaaccgucauucaggaggcccucgcccuggaccgguga

SEQ ID NO: 76384 - RNA, 1245 nt, Artificial Sequence
  derived and/or modified sequence opt5 from STK17A__Homo_sapiens__NP_004751
augaucccccuggagaagccuggcagcgggggauccucuccgggcgccaccagcggguccggcagagcuggacgggggcucucuggacccugccgcccucccccucccccucaggccagaggccugcuuacagaaauucgggcggugguccgcacggagccguuccaagacggcuacagccugugucccgggagagaacucggacggggcaaauuugcuguugugcgcaagugcaucaaaaaggauuccgggaaagaguucgccgccaaguuuaugagaaagcggcgcaaaggacaggacuguagaauggaaauuauccacgagauugcugugcuggagcuugcccaggauaacccuugggucaucaaucugcaugaaguguaugagaccgcuucugaaaugauccucguucuggaguacgccgcgggcggggagauuuucgaccagugcguggccgaucgggaagaggcuuuuaaggaaaaagacguccaacgccugaugagacagauccucgagggagugcacuuccugcauacacgggauguugugcaccuugaccugaagccccagaacauucuccugaccagcgaauccccucuuggcgauaucaaaauugucgacuuuggccugagccgcauccucaaaaauucugaggagcugagagaaauuauggggacacccgaguauguggccccggaaauccuguccuacgauccuaucagcauggcuaccgacauguggucuauuggagugcucacauaugucaugcugaccggcaucucccccuuccuugggaacgauaagcaggagacguuucugaauauuagccaaaugaaccucucuuacuccgaagaggaguucgacguucugagcgaauccgccguggacuuuauccggacccuucuggugaagaagccugaggauagagcgacagccgaagagugucucaaacaucccuggcugacccagucuagcauucaggaacccuccuuccgcauggagaaggcucuggaggaagccaaugcucuccaggagggacacagcgucccugaaaucaacucugacacagauaaauccgagaccaaggagagcaucgugacggaggaacugauuguugugacaucuuauacccuuggccaaugccggcagagcgaaaaagagaagauggaacagaaggccaucuccaaaagauuuaaguucgaggagccgcugcuccaagaaauucccggggaguucaucuacuga

SEQ ID NO: 76385 - RNA, 1119 nt, Artificial Sequence
  derived and/or modified sequence opt5 from STK17B__Homo_sapiens__NP_004217
augagcagacggcgcuucgacugcagauccaucucuggccugcucaccacaacgccccagauuccuaucaagauggagaacuuuaauaacuucuacauucugaccagcaaagaacuugggcggggaaaguuugccgugguccgccaauguaucuccaaaucuacaggccaggaguaugcugccaaguuccugaaaaagagacggcgcgggcaggauugcagagcggaaauucuccacgagaucgcuguucuggaacuugccaagagcuguccgcgggugaucaaucugcaugagguguacgagaacaccuccgaaauuauccucauucuggaguaugccgcuggaggcgaaaucuuuucucugugccuccccgagcuggccgagauggucagcgaaaaugacgugauucgccuuaucaaacagauucuggaggggguuuacuaucuccaccaaaacaauaucgugcaucuggaucuuaagccucagaacauccugcucuccagcauuuacccccugggagacaucaaaauugucgauuucggcaugucuagaaagaucggccacgcuugugaacugcgggagauuauggggacaccugaauaucucgcccccgagauccugaauuacgacccuaucaccacagcgaccgauauguggaacauuggaaucauugccuacaugcuucugacgcauaccuccccguuugugggcgaggacaaucaggaaacauaucucaacaucagccagguuaauguggauuacucugaggaaaccuucuccagcgucucucaacuggcuacagacuuuauucagucccuucuggugaaaaaccccgagaagcgcccuaccgccgaaaucugccucagccacuccuggcugcagcagugggauuucgagaaucuguuucaccccgaggaaacgucuagcuccagccaaacacaggaccauucugugagauccagcgaggauaagaccucuaaaagcuccuguaacgggacaugcggagaccgggaagacaaggagaacaucccugaagauucuagcauggucuccaaacgcuucagauuugacgauagccuccccaauccgcacgagcugguuucugaccuucuguguuga

SEQ ID NO: 76386 - RNA, 1095 nt, Artificial Sequence
  derived and/or modified sequence opt5 from STK19__Homo_sapiens__NP_004188
augcagaagugguucagcgccuuugacgaugcuaucauucaaagacaguggcgggccaaccccucccgcggcgggggaggcgugucuuucaccaaagaggucgacacaaauguugcgacgggggcuccuccgagacggcagcgcgugcccgggagagccugcccuuggcgggaacccauccgcggcagacggggagcccgcccuggaggcggcgaugcugggggaacccccggcgagacagugagacacuguagcgccccugaagacccgauuuuucgguucuccucucugcauagcuaccccuuuccugggaccaucaagucccgcgauaugucuuggaaaagacaccaucucauucccgagacauucggagucaagcggcgcagaaaacggggcccuguggaaagcgacccccugagaggggagccgggauccgcucgcgccgcgguuagcgagcuuaugcagcuguuuccucggggccucuucgaagaugcccugcccccuaucgugcuuagaucucaagucuauucccuggugcccgaccgcaccguugcugaucggcagcucaaggagcugcaggaacagggcgagaucagaauugugcaacugggguuugaccucgaugcccacggaaucauuuucacagaggacuaccgcacccggguccugaaggcuugcgauggcagacccuaugccggggcggugcagaaauuucuugccagcgugcugccugcuuguggagaccucucuuuccagcaggaccaaaugacgcagaccuuuggcuuccgcgauuccgaaaucacacaucuggucaacgccgggguucuuaccgugcgggacgcuggaagcugguggcuggccgugccgggcgccggcagauucauuaaguacuuugucaaagggcgccaggcugugcucucuaugguucggaaggcgaaauauagagagcugcugcucuccgaacugcuuggacggcgcgcccccguggucgugagacugggccucacauaccacguucacgaucugaucggggcucaacuuguggacugcauuagcaccacguccggaacacugcuccggcugccugagaccuga

SEQ ID NO: 76387 - RNA, 1296 nt, Artificial Sequence
  derived and/or modified sequence opt5 from STK24__Homo_sapiens__NP_001027467
auggcccacagccccgugcaguccggccugccugggaugcaaaaccucaaggcugacccggaggaacuguucaccaaacuugagaagaucggaaaaggcucuuuuggggaagucuucaagggaauugauaauagaacacagaaaguuguggccaucaagauuaucgaccuggaggaagcggaggaugagauugaagacauccagcaggagaucacggugcucagccaaugcgauucccccuacgucaccaaguauuacggcucuuaucugaaagacacaaagcuguggauuaucauggaauaccuugggggaggcagcgcucucgaucugcuggagccuggcccccucgacgagacccagauugccacaauccugcgggaaauucuuaaagggcuggauuaucuccauuccgagaagaaaauccaccgcgacauuaaggccgcuaacgugcugcuuucugaacauggagagguuaagcuggccgauuuuggcguggcugggcagcucaccgacacacagaucaaaagaaauaccuucgucggaacgccuuuuuggauggcccccgaagugaucaagcaaagcgcguacgauuccaaagccgacauuuggagccugggcaucaccgcuauugagcuggcccgcggggagccuccgcacucugaacuccaucccaugaagguucuguuccuuaucccuaaaaacaaucccccuacacuggagggaaacuauuccaagccccucaaagaauuuguggaggcuugucugaauaaggaaccgagcuuccggccuaccgccaaggagcuucugaaacacaaguuuauucucagaaacgcgaaaaagacaucuuaccugaccgagcugaucgaccgguacaaacgcuggaaggccgaacagucccacgaugacucuagcuccgaggauagcgacgcugaaacggauggccaggccuccggcgggucugacagcggagauuggaucuucacaauuagagagaaggaccccaaaaaucucgaaaacggcgcucugcagccuuccgaucuugaccggaauaagaugaaagauauccccaagcgccccuuuagccaaugccugucuaccauuaucuccccucucuucgccgagcugaaagaaaagagccaggccugugggggaaaccuuggcucuauugaggagcugagaggggcuaucuaucucgcggaagaggccugcccgggaaucagcgacacaauggucgcucagcuggugcaacggcugcagcgcuacucccucucuggcggcgggaccagcucccauuga

SEQ ID NO: 76388 - RNA, 1281 nt, Artificial Sequence
  derived and/or modified sequence opt5 from STK25__Homo_sapiens__NP_001258907
auggcccaccugagaggcuucgcuaaccagcauagccggguggaccccgaggaacucuuuaccaagcuggaucgcaucgggaaaggauccuucggcgaggucuacaaggggauugacaaucacacaaaagaaguuguggccaucaagauuaucgaucuugaggaagcggaggacgagauugaagauauccaacaggagaucacggugcugucucagugcgacagcccuuauauuaccagauacuuuggauccuaucucaaaucuacaaagcuguggaucauuauggaauaccuuggcgggggaagcgcucuggaucuccugaagccgggcccccuggaggagaccuauaucgccacaauucuccgggaaauccugaaaggccuugacuaccugcauuccgagcgcaagauucacagagauaucaaagccgcuaacguccuccugucugaacagggggacgugaagcucgccgauuucggaguugcuggccaacugaccgacacacagaucaaacggaauaccuuuguggggacgccuuucuggauggcccccgaggucauuaagcagagcgcguaugauuuuaaggccgacaucuggucccucggaauuaccgcuaucgaacuggccaaaggcgagccucccaacagcgaccugcauccuaugcgcgugcuuuuccugauuccgaaaaauucucccccuacacuugaggggcagcacuccaagcccuuuaaggaguucguugaggcuugucugaacaaagauccuagauuucggcccaccgccaaggaacuccugaaacacaaguucaucacacgcuacaccaagaaaacgagcuuucuuacagagcugaucgacagauacaagcgguggaaaucugaaggacauggcgaggaguccagcucugaagauuccgacauugauggcgaggcggaagacggggagcaaggaccgaucuggaccuucccucccacaauucgcccuagcccccacuccaagcuccauaaaggcaccgcccugcacucuagccagaagcccgcugaaccugugaagagacagccgcggucccagugccugagcacccucguccgccccguguucggggagcugaaagagaagcacaaacaaucuggaggcuccgugggggcccuugaagaacuggaaaaugcuuuuagccucgccgaggagucuuguccuggaaucagcgauaagcugaugguccaucuuguugaaagagugcagcgguucucccacaacagaaaucaucugacaucuacgcgcuga

SEQ ID NO: 76389 - RNA, 1065 nt, Artificial Sequence
  derived and/or modified sequence opt5 from STK26__Homo_sapiens__NP_001035917
auggcccacagccccguggcuguccagguuccuggcaugcaaaacaauaucgccgacccggaggaacuguucaccaagcucgagagaauugggaaaggauccuuuggcgaaguguucaaggggaucgauaaccggacacaacagguggucgcgauuaaaaucauugaccuggaggaagcugaggaugagaucgaagacauccagcaggagauuacggugcuuucucagugcgauagcuccuacguuaccaaguauuacggaucuuaucugaaaggcagcaagcucuggaucauuauggaauaccuugggggaggcuccgcccuggaccugcuccgcgccggccccuuugaugaguuccagaucgcuacaaugcugaaggagauucugaaagggcucgacuaucugcauucugaaaagaaaauccacagagauauuaaggccgcuaaugugcuucugagcgagcagggagacgucaaacucgccgauuuuggcguggcggggcaacugaccgacacacagaucaagcggaacaccuucguuggaacaccuuuuuggauggcccccgaagugauccagcaguccgcuuacgauagcaagcgcccuaccgccaaagagcuucugaagcauaaauucauugucaaaaauucuaaaaagacguccuaucucaccgaacugaucgacagauuuaaacgguggaaggcugagggccacagcgacgaugagucugacuccgaagggagcgauucugaguccacaagccgcgaaaacaauacccaucccgagugguccuucacaaccgugagaaagaaaccugacccgaagaaagugcaaaacggagccgaacaggaucugguccagacgcucucuugucugagcaugauuaucacacccgcguuugccgagcuuaagcaacaggacgagaauaacgcuucccggaaucaggccauugaggaacuggaaaagagcaucgcuguugccgaggccgcuugcccuggcaucaccgauaagauggugaagaaacucauugaaaaguuccagaaauguucugcggacgagucccccuga

SEQ ID NO: 76390 - RNA, 2991 nt, Artificial Sequence
  derived and/or modified sequence opt5 from STK31__Homo_sapiens__NP_001247433
auggacgaggauacccacuacgacaagguggaagaugucguuggcagccauaucgaggacgccgugacauucugggcucaguccauuaacagaaauaaagauaucaugaagauugggugcucucugagcgaaguguguccccaagccuccucuguccucggaaaccuggacccuaauaaaaucuauggcgggcuuuuuagcgaggaucagugcugguaccgguguaaggugcugaaaauuaucuccguugaaaagugccucgugcgcuauaucgacuacggaaacacggagauucugaauagaucugauaucgucgagauuccgcuugaacugcaguucagcuccguggcgaagaaauauaagcucuggggccugcacauccccagcgaccaggagguuacccaauuugaucaggggacaaccuuccugggaucucucauuuuugaaaaagagaucaagaugcggauuaaagcuacauccgaggacggcaccgugaucgcccaggccgaauacggcagcgucgauaucggggaggaagugcugaagaagggauucgcugagaaaugucgccuugccucuagaacagacauuugcgaagagaagaaacuggacccuggccagcucgugcugcggaaccuuaagucccccaucccucugugggggcaucgcagcaaucaaucuaccuuuuccagacccaaaggacaccucagcgagaagaugacgcuggaucugaaagacgaaaacgaugcuggcaaucucauuaccuucccuaaggagucccuggccgucggggacuuuaaccuuggaucuaauguuagccuggaaaagaucaaacaggaucagaagcucauugaggaaaacgagaaacugaagacagagaaagacgcgcuucuggaauccuauaaggcccucgagcugaagguggaacagaucgcucaagagcugcagcaggaaaaagccgcugccguggaucucaccaaucaucuggaguacacacuuaagaccuacaucgacacgcggaugaaaaaccuggcggccaagauggagauucucaaagaaaugcgccacgucgauaucagcgugagauucggcaaggaccugucugaugcuauucaaguucuugacgagggcuguuuuacaaccccggccucccugaaugggcucgaaaucauuugggcugaguauagccuggcccaggagaacaucaagacaugcgaauacgugucugagggaaacauccugauugcccagcggaaugaaaugcagcaaaaacucuauaugagcgucgaggacuucauccuggaaguggaugaguccucucuuaacaagcgccugaaaacccuccaggaccugagcguuucccuggaggcuguguacggccaggcgaaggaaggggccaauagcgaugagauucuuaaaaaguuuuaugacuggaagugugauaaaagagaagaguucaccucuguccgguccgaaacagacgcuagccuccaccgccugguggccugguuccagagaacgcugaaggucuuugaucucucuguggagggaucccugaucagcgaggacgccauggauaacauugacgaaauccuugagaaaaccgaauccucuguuugcaaggagcuggaaauugcucucguggaucaaggcgacgccgauaaagagaucaucagcaauacauacucccagguccugcagaagauucauucugaggaacggcugaucgcgaccgugcaggcuaaauauaaggacagcauugaguucaagaaacaacuuaucgaauaccucaacaagucccccagcguugaccaucugcugucuauuaaaaagacacucaaaucccugaaggcccuucugagauggaagcucguggagaaaagcaaucuggaggaaucugaugacccugaugggucccagaucgagaagaucaaagaagagauuacccagcugcgcaacaaugucuuucaggaaaucuaccacgagcgggaggaauaugagaugcuuacgagccucgcccaaaagugguuccccgaacugccucugcuccaccccgagauuggacugcuuaaauacaugaacucuggcggccugcucacaaugagccuggaaagagaccugcuugaugcugagccgaugaaggagcucuccagcaagcgcccucuggugcggucugaagugaaugggcagaucauucugcucaaaggauauuccguugacgucgauaccgaggccaaggugaucgaaagagcugccaccuaccaccgcgcguggcgggaggccgaaggcgacagcgggcugcuuccccugaucuuucucuuccuguguaaauccgauccuauggcuuaucugauggugcccuacuaucccagagccaaccuuaaugcuguccaggccaacaugccucucaauucugaggagacacugaaggugaugaaaggaguugcgcaaggccugcauacccuccacaaggccgacauuauccaugggagccugcaccagaacaacguguuugcucuuaaucgcgaacagggcauugucggagauuucgacuuuacaaaguccgugucucagcgggccagcguuaacaugauggugggcgaucugucccucaugucuccggagcugaaaauggggaagcccgcuagcccuggauccgaccuguacgccuacggcugccuucugcucuggcugagcguccaaaaucaggaguucgagaucaacaaagacgggauucccaagguggaucaguuucaucucgacgauaaaguuaagucucugcuuugcucccugaucuguuauagaagcucuaugacggccgaacaggugcucaaugcugaaugcuuccugaugccuaaagagcaauccguccccaacccggaaaaggacaccgaguacacacuguauaagaaagaagaggagaucaagaccgaaaaucuugauaaauguauggagaagacacgcaacggagaagcgaauuuugacugcuga

SEQ ID NO: 76391 - RNA, 1191 nt, Artificial Sequence
  derived and/or modified sequence opt5 from STK32A__Homo_sapiens__NP_001106195
augggcgccaacaccagcagaaagcccccuguguucgacgagaaugaagaugucaacuuugaccacuucgagauccugcgggcuauugggaaaggauccuuuggcaagguuugcaucgugcagaaaaaugauacaaagaaaauguacgccaugaaguauaugaacaagcaaaaauguguggaacgcaaugaggucagaaacguguucaaggaacuccagauuaugcaggggcuggagcauccguuucuuguuaaucugugguacucuuuccaggacgaggaagauauguuuaugguggucgaccuccugcuuggaggcgaucugcgguaucaccuccaacagaacgugcauuucaaagaggaaacgguuaagcuguuuaucugcgagcuggugauggcgcucgacuaccugcagaaucagcgcauuauccacagagauaugaaacccgacaacauccuucuggaugagcaugggcacguccacauuaccgacuucaauaucgcugccaugcucccucgggaaacacaaauuaccacaauggccggaaccaagcccuauauggcuccugagauguuuagcucccgcaagggcgccggcuacucuuucgcuguggauugguggagccugggggugacagccuaugaacuucugagaggacggcgccccuaccauaucagauccucuaccagcuccaaagagauuguccacacguuugaaaccacaguugugaccuacccuagcgcguggucucaggagauggugucccuccugaagaaacugcucgagccgaaccccgaccagcgguucagccagcugucugacguccaaaauuucccuuauaugaacgauaucaauugggacgccguguuucagaagcgccuuauucccggcuucaucccuaacaaagggagacugaacugugaucccacauuugaacucgaggaaaugauccuggaguccaagccgcuucauaaaaagaagaaacggcuggcuaagaaagaaaaggacaugcgcaaaugcgauagcucucagaccugucuccugcaagagcaccuggacuccguucagaaggaguucauuaucuuuaauagagaaaaggugaaccgggauuucaauaaaagacagccuaaccucgcccuggagcagacgaaggacccccaaggagaagauggccagaauaacaaucuuuga

SEQ ID NO: 76392 - RNA, 1245 nt, Artificial Sequence
  derived and/or modified sequence opt5 from STK32B__Homo_sapiens__NP_060871
augggcgggaaccacagccauaagcccccuguguucgacgagaaugaagaggucaacuuugaucacuuccagauccugagagccauuggaaaaggcuccuuugggaagguuugcaucgugcaaaaacgggacaccaagaaaauguacgcuaugaaguauaugaauaagcagaaauguauugaacgcgaugaggugagaaacgucuuccgggaacuccagaucaugcagggacuggagcauccguuucuugugaaucugugguacucuuuccaagacgaggaagauauguuuaugguuguggaccuccugcuuggcggggaucugcgcuaucaccuccagcagaacguccauuucacagagggaacggugaagcuguacauuugcgaacuggcccucgcgcuggaguaucuucagagauaccacaucauccaccgggacauuaaacccgauaauauccugcucgacgagcauggccacguucauauuaccgauuuuaacaucgcuacaguggucaagggcgccgaacgcgccagcuccauggcugggaccaaaccuuauauggcccccgagguguuccaaguguacauggacagaggaccuggcuacucuuaucccgucgauugguggagccuggggauuacagcuuacgaacuucugcggggauggcgcccuuaugagauccacuccguuaccccgauugacgaaauccucaauauguuuaagguggagagagugcacuacucuagcacaugguguaagggcauggucgcccugcugcggaaacuccugaccaaggaccccgagucccgcgugagcucucuucaugauauccaguccguuccuuaucuggcggacaugaacugggaugccguguucaaaaaggcucucaugcccggguuugucccuaauaaaggaagacugaacugcgaccccacguucgaacuugaggaaaugauucuggagagcaagccgcuccacaaaaagaagaaacggcuggccaagaaucgcucuagagauggcaccaaagacuccuguccucugaacggccaucuccagcacugccuggaaacagugcgggaggaguucaucauuuuuaauagagaaaaacuucgccggcagcaagggcagggaagccagcugcucgauaccgacucuagaggcgggggacaagcucaguccaagcugcaggauggcuguaacaacaaucuucugacacauaccugcacgcgcggguguagcuccuga

SEQ ID NO: 76393 - RNA, 1461 nt, Artificial Sequence
  derived and/or modified sequence opt5 from STK32C__Homo_sapiens__NP_775846
augagaagcggcgccgagcggcgcggguccucugcugccgcgagccccggauccccuccgcccggcagagcucggccugccgggucugacgcccccagcgcucugccucccccugccgcuggacagccgcgcgccagagauuccggcgacgugcggucucaaccccgcccucucuuccaguggagcaaguggaaaaagagaaugggguccagcaugucugcggccaccgcucggcgccccgucuuugaugacaaagaagauguuaacuucgaccacuuucagauccugagagccauuggaaagggcuccuucggcaaagugugcaucgugcagaagcgggauacagagaagauguacgcuaugaaauauaugaauaagcaacaguguauugaacgcgacgaggucagaaacguguuucgggaacuugagauccugcaggagauugaacauguuuuccucgugaaucugugguacagcuuucaggaugaggaagacauguucauggucguggaucuucugcucgggggagaccugcgcuaucaccuucaacagaacguucaguuuucugaggauacggugagacucuacaucugcgagauggcccuggcgcuugacuaucugcggggccagcauaucauucacagagacgucaaaccugauaauauccuccuggacgaacgcgggcaugcccaccuuaccgauuucaacauugcuacaaucauuaaggacggagagcgggccaccgcucuggccggcacaaaacccuacauggccccggaaaucuuucacuccuucgugaaugggggaaccggcuauagcuuugagguggauugguggucugucggcguuauggcuuacgaacuccugagaggguggcgcccuuacgacauucauuccagcaacgcgguggagucccuggugcaacucuucucuacagucagcgugcaguauguucccaccugguccaaggagaugguggcccugcuucggaagcugcucacggucaauccugaacacagacugagcucucuucaggaugugcaagcugcccccgcccuggcuggaguucucugggaccaucuguccgagaaacgcguggaacccggcuucgucccuaacaaggggcggcugcacugugauccgaccuuugagcucgaagagaugauccuggagagcagaccccuucacaaaaagaaaaagcgccuggccaaaaauaagucucgggacaacagcagagauuccucucagagcgaaaaugacuaccuccaggacugccuggaugcgauccagcaagacuucgugauuuuuaaccgcgagaagcugaaacggucccaggaucugccuagagaaccccucccugcucccgagagccgggacgccgccgaaccggucgaggaugaggcugaacgcucugcccugccuauguguggacccaucugcccuuccgcuggcagcggguga

SEQ ID NO: 76394 - RNA, 1545 nt, Artificial Sequence
  derived and/or modified sequence opt5 from STK33__Homo_sapiens__NP_001275990
auggccgacagcggccuggauaagaaguccaccaagugccccgacuguucuagcgcuucccagaaagaugugcucugcgucuguucuagcaagacaagaguuccuccggugcugguggucgagaugucccaaacgucuagcaucggguccgccgaaagccuuauuucucuggagcggaaaaaggaaaagaacaucaaucgcgacauuaccuccagaaaagaucuccccagccggacaucuaacguggagcgcaaggcgucccagcagcaguggggaagaggcaauuucaccgaagggaaaguuccucacauccggauugagaacggagcugccaucgaggaaaucuacacauuuggccgcauucuggggaagggcagcuucggcaucgugauugaggccaccgacaaagaaacagagaccaagugggcuaucaagaaagucaauaaggagaaagccggaucuuccgcugugaaacuucuggaaagagagguuaacauucucaagagcgugaagcaugaacacaucauucaucuggagcaagucuuugaaacgcccaaaaagauguaucuggugauggagcucugcgaggauggggaacugaaggagauccuugaccggaaaggacacuucuccgaaaaugagacccgcuggaucauucagucucuggccagcgcgaucgccuaccuccauaacaaugauauugugcacagagaccugaaacuugaaaacaucauggucaaguccagccugauugaugacaauaacgagaucaaucucaacaucaagguuacagauuuuggccuggcugugaaaaagcagucucgguccgaggccaugcugcaggcuaccugugggacaccuauuuauauggcccccgaagugaucagcgcgcacgacuacucucaacagugcgacauuuggagcaucggagucgugauguauaugcuccugcgcggcgagccuccguuccuugccuccucugaagagaagcuguuugaacucauuagaaaaggggagcugcauuucgagaaugcuguuuggaacagcaucuccgauugugccaagagcgugcuuaaacagcugaugaaggucgaccccgcucaccggaucaccgccaaagaacuccuggauaaccaguggcugacgggaaauaagcucucuuccgugcgcccuacaaacguucuggagaugaugaaggaauggaaaaauaaccccgagagcguggaggaaaauaccacagaggaaaagaacaaaccuucuaccgaggaaaaacuuaaguccuaccaacccuggggcaaugucccggacgccaacuauaccagcgaugaggaggaagagaagcaguccacagcuuacgaaaagcaguuuccugcgacgucuaaagacaauuucgauaugugcagcuccucuuuuaccagcuccaagcugcuccccgccgagauuaaaggcgaaauggagaagacaccugugacccccagccaagggacagcuaccaaauaccccgccaagucuggagcccuguccagaacgaaaaagaaacuuuga

SEQ ID NO: 76395 - RNA, 1605 nt, Artificial Sequence
  derived and/or modified sequence opt5 from STK35__Homo_sapiens__NP_543026
augggccaccaggagagcccccuggccagagcuccugccgggggagcggcuuacgugaagcggcucugcaaaggccuguccuggcgcgaacaugucgagucucacgggagccuuggagcccaagccuccccggcuucugccgcugccgcggaaggcagcgccaccagacgggcucgcgccgcuacauccagagccgcgcggucucgcagacagcccgggccuggagccgaccauccccaggcuggcgccccuggcgggaagcgggcugcccgcaaauggagaugugccggacagguuacgauccaaggccccgcuccuccgcggccccgcgcggggagacgggaugaggccggaggcgcucgcgccgccccucugcuccugcccccucccccggcugccauggaaaccgggaaggacggagcgagacggggcacacagagcccugagagaaaacgccggucccccgugccuagagcucccagcaccaaacuucgccccgccgccgcugcccgggcuauggauccuguggccgcggaggccccgggcgaggcuuuccuggccagacgccggcccgaagggggaggcgggucugcuagaccucgcuauucccuccuggccgaaauuggacggggcagcuacggggucguguaugaggcgguugccggaagaucuggcgcucgcguggccgucaagaaaauccggugcgacgcucccgagaacguggaacuggcccucgccgaguuuugggcucugacaucccuuaagagacggcaccagaauguugugcaguucgaagaguguguccugcaacgcaacggccucgcgcagagaaugagccaugggaauaaaucuucccagcuguaccuucggcugguggaaaccagccucaagggagagcgcauucugggcuaugccgaggaaccuugcuaccugugguuugugauggaguucugugaagggggagaucucaaccaguauguccuguccagacggcccgacccggcuacaaauaaaucuuuuaugcuucaacugaccagcgccaucgccuuccuccacaagaaccacauuguucauagagaucugaagccugacaauauccuuaucacggagcgcuccggcacccccauucugaaaguggcugauuuugggcucagcaaggugugcgccggccuggcgccuagaggaaaagaaggcaaccaggacaauaagaacgucaaugugaacaaauacuggcugucuuccgcuugugggagcgauuucuacauggcccccgagguuugggagggacacuauacagccaaggcugacaucuuugcccucggcauuaucauuugggcgaugaucgaacggauuaccuucaucgauucugagacaaagaaggaacugcuugggaccuacaucaagcagggaacggagauugugccugucggcgaagcucugcucgagaaucccaaaauggagcugcauaucccgcaaaagcgcagaacaagcauguccgaagggauuaaacagcuucugaaggacaugcucgccgccaacccucaggaccggcccgaugcuuuugagcuggaaacccgcauggaccaggugacaugcgccgcuuga

SEQ ID NO: 76396 - RNA, 1395 nt, Artificial Sequence
  derived and/or modified sequence opt5 from STK38L__Homo_sapiens__NP_055815
auggccaugaccgcuggcacaacgaccacauuccccaugagcaaccacaccagagagcgggugacagucgccaagcugacccucgaaaauuuuuacuccaaccugauccuucagcaugaggaacgcgagacaagacagaaaaagcuggaaguugcgauggaggaggaagggcucgcugacgaggagaaaaagcugcggcgcucucaacacgccagaaaagagaccgaguuccuucggcugaagcgcacgagacucggacuggaugacuuugaaagccugaaggugauuggccgcggggccuucggagaggugcggcucguccagaaaaaggauaccggccauaucuaugcuaugaaaauucugagaaaguccgacaugcuugaaaaagaacagguggcccacauccgggcugaacgcgauauucugguugaggccgacggggcguggguggucaagauguuuuacucuuuccaagauaagagaaaucucuaucugaucauggaguuucuuccuggaggcgacaugaugacacugcucaugaaaaaggauacccugacagaagaggaaacccaguucuacaucagcgagacggugcuggccauugacgcuauccaucagcucggcuuuauucaccgggauaucaaaccggacaaccugcuucuggaugccaaggggcacguuaaacucuccgacuucggacugugcacaggccuuaagaaagcucaucgcaccgaauuuuauagaaaucugacacacaacccuccuucugacuucagcuuucagaauaugaacuccaagcggaaggccgagaccuggaaaaagaauagacgccaacucgcguacagcaccguggggacacccgauuauauugccccugaggucuucaugcagacgggauacaacaaacugugugacugguggucucugggcgugaucauguacgaaaugcucauuggguaucccccuuucugcuccgagaccccgcaggaaacauaccggaaggugaugaauuggaaagagacccuggucuuucccccugaaguucccaucagcgagaaggcuaaggaucuuauccugagauucuguauugacucugagaaccgcaucggaaauuccggcguggaagagauuaaaggccaucccuuuuucgaagggguggauugggagcacauccgggagagacccgccgcuauuccgaucgaaaucaagagcauugacgauacaucuaacuuugacgauuucccugaguccgacauccuccagcccgucccuaauaccacggaacccgauuauaaaagcaaggacuggguguuucugaacuacacauauaaacgcuucgagggacuuacccaacggggcuccauucccaccuacaugaaggccgggaagcuguga

SEQ ID NO: 76397 - RNA, 1638 nt, Artificial Sequence
  derived and/or modified sequence opt5 from STK39__Homo_sapiens__NP_037365
auggccgagcccagcggcuccccugugcacguccagcugccgcaacaggcugcccccguuaccgcggcugccgccgcugccccugcugccgcgacagccgcucccgccccugcugcccccgcggccccugcuccggcccccgcuccugccgcccaggcugugggguggcccaucugcagagacgcguacgaacuccaggaggugauuggaucuggcgccacggcugucgugcaagccgcccuguguaagccucggcaggaacgcguugcuaucaaaagaauuaaccuugagaagugccagaccagcauggaugaacugcucaaagagauccaggccaugucccaauguucucaucccaauguggucacauauuacaccagcuucgugguuaaggacgagcuguggcuugugaugaaacugcucuccgggggaucuaugcuggauauuaucaaguauaucgucaaccggggcgaacacaagaauggggugcuggaggaagcgauuaucgcuacaauucucaaagaggugcuggagggacuugacuaccugcaucgcaacggccagauccacagagaucucaaggccggcaauauucugcuuggggaagacggaagcguccagaucgccgauuuuggcguuuccgcuuuccuggccaccgggggagacgugacacggaacaaagugcgcaagaccuuugucggcacgccgugcuggauggcuccugaggugauggaacagguuagaggguaugauuucaaagccgacauguggagcuuuggaauuaccgcgaucgagcucgccacaggcgcugcccccuaccauaaguauccucccaugaaggugcugaugcugacccuccaaaaugaucccccuacacuggaaaccggcgucgaggacaaagagaugaugaagaaauacgggaagucuuuccggaaacuucugucccucugucugcagaaggauccgagcaaacgccccacggcugccgaacuucugaagugcaaguuuuuccagaaagcgaagaacagagaguaccucaucgaaaaacugcugacacggaccccugacauugcccaacgcgcuaagaaagugagacggguucccggaucuuccggccaccuccacaagacagaggacggggauugggaauggagcgacgaugagauggacgagaagucugaagagggaaaagccgcuuuuucccaggaaaagagccgcagagugaaagaggaaaauccugagaucgccgucuccgccucuaccauucccgagcagauccagagccuguccgugcaugauagccaaggcccgccuaacgcuaaugaagacuaucgggaggcgucuuccugugccgucaaccuugugcugagacuccgcaauagccggaaggaacugaacgauauuagauucgaguuuacccccgggcgcgacacagcugauggaguuucucaggagcuuuucagcgccggccugguggacggccacgaugucgugaucguugccgcuaaucuccagaaaaucguggacgacccuaaggcccugaagacgcugaccuuuaaacucgcguccgggugcgauggaucugaaauucccgacgaggucaagcugaucggcuucgcucagcuuagcguguccuga

SEQ ID NO: 76398 - RNA, 1476 nt, Artificial Sequence
  derived and/or modified sequence opt5 from STK3__Homo_sapiens__NP_006272
auggagcagcccccugcccccaagagcaaacugaagaaacucuccgaagacucucugaccaagcaacccgaggaaguguucgauguccuugagaaacugggcgaagggagcuacggauccguuuuuaaggcuauccacaaggagucuggccaggugguggccauuaaacaggucccuguggagagcgaccuccaggaaaucauuaaggagaucuccauuaugcaacagugcgauucucccuauguugugaaauacuaugggagcuacuucaagaacacagaccuguggaucgucauggaauauuguggagcgggcuccgugagcgauaucauuagacuucggaauaaaacgcugaucgaggacgagauugcuaccauccucaagucuacacugaaggggcuggaauaccuccauuuuaugcgcaaaauucacagagauaucaaggccggaaacauucugcuuaauaccgagggccaugccaaacuggcugacuucggcguugccgggcagcucacagauaccauggcuaagcggaacacagugaucggaaccccuuuuuggauggcccccgaagucauccaggagauuggcuauaauugcguggcggacaucuggucccuggggauuacgagcaucgaaauggccgagggaaaaccuccguacgcugauauucaccccaugcgcgccaucuucaugaucccuaccaacccgccucccacauuuagaaagccggagcuuuggucugacgauuucaccgacuuugugaaaaagugucuggucaagaauccugaacaacgggcuacagccacccagcuccugcagcaucccuucauuaaaaacgcgaagccuguuuccauccugcgcgaccucauuacggaggccauggaaaucaaagcuaagagacacgaggaacagcaacgggagcuggaggaagaggaagagaauagcgaugaagacgagcuugauucucacacaauggugaaaaccuccguggagagcgucggcacaaugcgcgccaccuccaccaugucugaaggggcucagacaaugauugagcauaacagcacgaugcuggaauccgaccucggaaccauggugaucaauagcgaggaugaggaagaggaagacggcacaaugaagagaaacgccaccucuccccagguucaacggcccuccuuuauggauuacuucgacaagcaggauuuuaaaaauaagagccacgagaacugcaaucagaacaugcaugaaccuuucccgaugucuaaaaacguguuccccgacaauuggaaggucccucaggauggcgacuuugacuuccugaaaaaccuuagccuggaggagcuccaaaugcgccugaaggcccuggaucccaugauggaaagagagaucgaggaacuccggcagcgcuauacagcuaagagacagccuauucuggacgcgauggaugccaaaaagcggagacagcaaaauuuuuga

SEQ ID NO: 76399 - RNA, 1464 nt, Artificial Sequence
  derived and/or modified sequence opt5 from STK4__Homo_sapiens__NP_006273
auggagaccgugcagcugagaaaucccccucggcgccaacucaagaaacuggacgaagauagccuuacaaagcagccggaggaagucuucgacguucuggagaaacucggcgaaggguccuacggaucuguguauaaggccauccacaaagagacgggccagauuguggcuaucaagcagguccccguggagagcgaucugcaagaaauuaucaaggagauuuccaucaugcagcagugcgacucuccucauguugugaaauacuaugggagcuacuuuaagaacaccgaucuuuggaucgucauggaauauuguggagccggcuccgugucugacauuaucagacugcggaacaaaacacucaccgaggaugagauugcgacaauccugcagagcacccugaaggggcucgaauaccugcacuucaugcgcaaaauucauagagacaucaaggcuggaaauauucuucugaacacagagggccacgccaagcucgccgauuuuggcguugcugggcaacugaccgacacgauggccaaacggaauaccgugaucggaacacccuucuggauggcuccugaagucauccaggagauuggcuauaacugcguggccgauaucuggucccuugggauuaccgcgaucgaaauggccgagggaaagcccccuuacgcugacauucauccgaugcgcgccaucuuuaugauccccacaaauccucccccuaccuucagaaaacccgagcuguggagcgauaacuuuacggacuucgugaagcagugucucgucaaaucuccggaacagcgggcuacagccacccaacugcugcagcacccuuuuguucgcuccgcgaagggcgugagcauucucagagaccugaucaaugaggccauggaugugaaacuuaagcggcaggaaucucaacagcgcgaggucgaccaggaugacgaagagaacuccgaggaagaugagauggacagcgggacaauggugagagcuguuggagaugaaaugggcaccgugcgggucgccucuaccaugacagacggcgcuaauacgaugauugagcacgaugacacccugcccucccagcucgggacaauggugaucaacgccgaagaugaggaggaagagggaaccaugaagcgcagagacgaaacaaugcaaccugccaaacccagcuuccuggaguacuuugagcagaaggaaaaagagaaucagauuaacuccuucggcaagucuguucccgggccucuuaaaaauagcuccgacuggaagaucccgcaggauggagacuaugaauuucucaagagcuggaccguggaggaucugcaaaaacggcugcuggcucucgaccccaugauggaacaggagaucgaggaaauuagacagaaguaccagucuaaacgccaaccuauccuggaugcgauugaggccaagaaacggagacagcagaacuucuga

SEQ ID NO: 76400 - RNA, 564 nt, Artificial Sequence
  derived and/or modified sequence opt5 from STMN2__Homo_sapiens__NP_001186143
auggccaagaccgcuauggccuacaaagagaagaugaaagaacugagcaugcucucccugaucugcucuuguuucuaucccgagccuagaaacauuaauaucuacacauaugacgauauggaagugaagcagauuaacaaacgggcgagcggccaagccuuugagcuuauccugaagccgcccuccccuauuucugaagcuccccgcacgcucgccagcccuaagaaaaaggaccugucccuugaggagauccagaaaaagcuggaagcugccgaggaaagacggaaaucucaggaggcucagguccucaagcaacuggccgagaagcgcgaacacgagagagaaguucugcagaaagcgcucgaggaaaauaacaauuucagcaagauggccgaggagaaacugauccuuaagauggaacagauuaaagagaaccgggaagcuaaucuggccgcuaucauugagcgccuccaggaaaagcuggugaaauuuaucuccagcgagcuuaaggagucuauugaaucccaauuccuggagcuccagagagaaggggagaagcaguga

SEQ ID NO: 76401 - RNA, 510 nt, Artificial Sequence
  derived and/or modified sequence opt5 from STMN3__Homo_sapiens__NP_001263239
augaaggagcugagcgugcucucccugaucugcucuuguuucuacacccagccccacccuaacacagucuaucaauacggcgacauggaaguuaaacagcuugauaagagagccagcgggcaguccuuugaggugauucugaaaucuccgagcgaccucucccccgaaucuccuaugcugagcuccccucccaagaaaaaggauacgagccuugaggaacugcagaagcggcucgaggcugccgaggaacgcagaaaaacccaagaggcucaggugcugaagcagcuggcggaacggcgcgagcaugagagagaaguccuccacaaagcccuggaggaaaauaacaauuucucucggcaggccgaggaaaaacuuaacuauaagauggagcuguccaaggagauccgcgaagcucaucucgccgcucugagagagcggcuucgcgaaaaggagcugcacgccgcggaagugagacggaauaaagagcaacgcgaggaaaugagcggauga

SEQ ID NO: 76402 - RNA, 570 nt, Artificial Sequence
  derived and/or modified sequence opt5 from STMN4__Homo_sapiens__NP_001269983
augacccuggccgcuuacaaggagaaaaugaaggaacucccccuggugagccuuuucugcuccuguuuucuggccgacccucucaacaaaucuagcuauaaguacgaggcggauacagucgaccugaauuggugcguuaucuccgauauggaagugauugagcuuaacaaauguacgucuggccagagcuucgaagugauccugaagccgcccuccuuugacggggucccugaguucaaugcuucucuccccagacggcgcgauccuagccuggaggaaauucaaaagaaacuggaggccgccgaagagagacggaaguaucaggaggcugaacuccugaaacaccuugccgagaagcgcgaacaugagagagaagugauccagaaagcuauugaggagaacaauaacuuuaucaagauggccaaggaaaaacuggcgcagaagauggaguccaauaaagaaaaccgggaggcccaccucgcugccaugcuggaacgccuucaagagaaggacaaacaugcugaggaaguuagaaagaauaaagagcugaaggaagaggccagccgguga

SEQ ID NO: 76403 - RNA, 867 nt, Artificial Sequence
  derived and/or modified sequence opt5 from STOM__Homo_sapiens__NP_004090
auggccgagaagagacacacccgggacagcgaagcucagcgccugcccgauuccuucaaagacucuccuagcaagggccucgggccgugcggauggauccugguggccuuuuccuuccuuuuuacagucauuacguuccccaucucuauuuggauguguaucaaaauuaucaaggaguacgaaagagcgaucauuuuucggcugggccgcauccuccaagggggagcuaaaggcccugggcuguucuuuauucuucccugcaccgauagcuucaucaagguugacaugagaacaauuuccuuugauaucccuccccaggagauucugaccaaggacucugugacaaucagcguggauggagucguguauuaccggguucagaacgccacccucgccguggcuaauaucacaaacgccgacuccgcuacccgccugcuggcccagacgacccucagaaauguccugggcacaaagaaccuuagccaaauucugucugaucgggaagagaucgcgcauaauaugcaguccacccucgacgaugccacagacgcuuggggcauuaagguggagcgcguugaaaucaaagaugugaagcugccuguccagcuucagagagccauggcugccgaggcggaagccagccgggaggcucgcgccaaagugauugcugccgagggggaaaugaacgccucuagagcucugaaggaggcguccauggugaucaccgaaagcccggccgcucuccaacugcgguaucugcagacgcucacaaccaucgccgccgagaaaaauucuacaauugucuucccccugccuaucgacaugcuucagggaauuaucggcgcuaaacacucccaucugggguga

SEQ ID NO: 76404 - RNA, 1047 nt, Artificial Sequence
  derived and/or modified sequence opt5 from STOML1__Homo_sapiens__NP_001243602
augcugggcagaagcggguaccgggcccucccccugggagacuucgaucgcuuucagcaauccucuuucggcuuucuugggagccagaagggaugccuguccccugagagaggcggggugggaaccggcgcugacgucccgcagucuuggcccagcugucucugccacggccugaucuccuuccuuggguuucugcuccugcugguuacauucccuauuucuggaugguuugcccucaaacuggcgagcaaggauggcgcugugcuuuccgugggggccgacguccaguuccggaucugggaucccgugcugagcguuaugacggugaaagaccucaacaccgccacacgcaugaccgcucaaaaugccaugacaaaggcucugcuuaaaagaccucugcgggaaauucagauggagaagcucaagaucucugaucagcugcugcucgaaauuaacgacgucacccgcgccuggggacuggagguggauagaguugaacuugcgguggaggccguccugcagcccccucaagacuccccggcuggccccaaucucgauagcacacugcagcagcuugcccugcauuuucucgggggaucuaugaacuccauggcuggcggcgccccuagccccgggccugcggacaccguggagauggugucugaagucgagcccccggccccucagguuggagcucgguccagccccaaacaaccucuggccgaaggccugcucacggcucugcagcccuuccuuuccgaggcccuggugucucaggugggggccuguuaucaauuuaaugucgugcuccccagcggaacccaguccgcuuacuuccuggaucuuacaaccggccgcgggagaguuggacacggcgugccugacggcaucccggacgucgugguugagauggcggaagccgaucugcgggcucuccugugccgcgagcugagaccccucggggccuauaugagcggacggcugaaggugaaaggcgaccuugccauggcuaugaagcuggaagccguccuccgcgcgcugaaauga

SEQ ID NO: 76405 - RNA, 936 nt, Artificial Sequence
  derived and/or modified sequence opt5 from STOML2__Homo_sapiens__NP_001273960
augcuggccagagcugcccggggcaccggggcgcuccugcuucgcggaagccugcucgcuuccggcagagcuccccggcgcgccucuagcgggcugccuagaaacacagugguccuuuucguuccgcagcaagaggccugggugguggaacggaugggacgcuuucacagaauccuggagcccggccucaauauucugaucccuguccuggaccggauucgcuacgugcagucccucaaggaaaucguuauuaacgugcccgagcagucugccgucacgcuggauaaugugacccuucagaucgacgggguucuguaucucagaaucauggauccuuacaaagcuagcuauggaguggaagaccccgaguacgccgucacacaacuggcgcagaccacaaugcgguccgagcuuggcaagcugucucucgauaaaguguuccgcguggaagccgagagacggaagcgcgcuaccguccuggaaagcgagggcacaagagaguccgccauuaacguugcugaagggaaaaagcaggcccagauccuggcgagcgaggccgaaaaggcugagcaaauuaaucaggccgcuggagaagccucugccgugcucgcuaaagcgaaggccaaagcugaggccauccggauucuggccgcugcccuuacccagcauaacggcgacgcggcugccucccugacgguggccgagcaguaugucagcgcuuuuucuaagcucgccaaagauuccaauaccauccugcuuccuagcaacccgggggacgugacaucuaugguugcucaagccaugggaguguacggcgcgcugaccaaggcccccgucccugggacacccgauucccucagcuccggaucuagcagagacgugcagggcaccgaugcuucccuggacgaggaacuggaucgcguuaagaugagcuga

SEQ ID NO: 76406 - RNA, 849 nt, Artificial Sequence
  derived and/or modified sequence opt5 from STOML3__Homo_sapiens__NP_001137505
augaacagcagaggcgagcuggugggggucaauaacaagcggcucggaguuugcggcuggauccuguucucccuuucuuuucugcucgugauuaucaccuuccccauuagcaucuggaugugucugaaaauuaucaaggaauacgagcgcgccguggucuuuagacuugggcggauccaggcugacaaagccaagggaccuggccugauucucgugcugccgugcaucgauguuuucgugaaagucgaccugcgcacagugacguguaauauucccccucaagaaauccucaccagagauuccguuacaacccagguggacggggucguguauuaccggauuuauucugcggugagcgcugucgccaacguuaaugaugugcaccaggccacauuucugcuugcucagaccacacugcgcaacgugcucggaacccaaacgcugucccagauccuugccggcagagaggaaauugcucauucuauccagacccugcucgacgaugccacagagcuguggggcauccgggucgcgcgcguggagauuaaggacguuagaauccccgugcagcugcaacggagcauggccgcugaagccgaggcuacccgcgaagccagagcgaagguccucgccgcugagggggagaugaaugccuccaaaagccugaagucugcuuccauggugcuugccgaaagcccuauugcccugcagcuccgguaccugcagacacuuucuaccguugcuacggagaaaaacuccacaaucguguucccccugccuaugaauauucucgaaggaaucggcggggucagcuaugauaaccacaagaaacugccgaauaaggcguga

SEQ ID NO: 76407 - RNA, 3477 nt, Artificial Sequence
  derived and/or modified sequence opt5 from STON1-GTF2A1L__Homo_sapiens__NP_001185522
augugcagcaccaaccccggcaagugggugacauucgacgaugacccugccguccaguccucucagaaaagcaagaauuuuccgcuggagaaccaggggguuuguagacccaauggacucaaacugaaccuuccuggccugcgggaguuccccuccgggucuagcuccacgucuagcaccccucucuccagccccaucguggauuuuuacuucucuccuggaccgcccuccaauagcccucugucuacacccaccaaggacuuuccuggcuuccccgggauuccgaaagcuggaacacacgugcuuuauccuauccccgaguccagcucugauuccccucuggccauuagcggcggcgaauccucucuccugcccacccgccccacaugccugagccaugcgcuccugccuuccgaccacagcuguacccauccgacgcccaaggucgggcuuccugaugaggugaacccccagcaggcugaaucucugggauuucaauccgacgaucucccucaguuccaguacuuuagagaggacugcgccuucagcucucccuuuuggaaggaugagggcagcgacucccacuucacccuggauccgccugggucuaaaaagauguuuagcucccggaauaaagaaaugcccaucgaccaaaagagccuuaacaaauguucucugaauuauauuugcgagaagcucgaacaucugcaauccgccgagaaccaggacagccugcgcucucucuccaugcacugucugugcgcugaggaaaaugccagcuccuucguuccucacacacuuuucagaucucagcccaagagcggaugguccuuuaugcugcggaucccugagaaaaagaacaugaugucuagccgccaguggggccccaucuuccucaaagugcugccgggagggauucuucaaauguacuaugaacagggccuggagaagccuuuuaaagaaauccagcucgaucccuacuguagacuguccgagcccaaggucgagaauuucagcguggcuggcaaaauucauaccguuaagaucgaacacgugucuuauacagagaagcggaaauaccauuccaagaccgaagucgugcacgagccugacauugaacaaaugcugaaacucgggagcacgucuuaccacgauuuucuggacuuccuuacaaccguggaggaggaacugaugaagcucccggccgucuccaaacccaagaagaacuaugaggaacaggagaucagccuggaaauuguugauaauuuuuggggaaaagugacaaaggagggcaaauucguggagucugcggucaucacccagaucuacugccuuuguuuugugaacgggaaccuggaaugcuuccucacccugaaugaccuggagcucccuaagcgcgaugaaagcuauuacgagaaagacuccgagaagaagggaauugauauccuggacuaucauuuucacaaaugcguuaacgugcaggaguucgaacaaagcagaauuaucaaguuugucccccuugaugccugucgguucgaacugaugcgcuucaaaacacucuacaauggcgacaaccugccuuuuucucugaaguccgugguugugguccagggggcuuauguggagcuucaggccuucgucaauauggcuagccucgcccagagauccucuuacgcgggaagccugcgguccugcgacaacauucgcauccauuuucccgugccuucucaauggaucaaagcccuguggacgaugaaucuccagagacaaaagagccugaaggcuaaaaugaaccggagagccugucuuggcucccugcaggaacucgagucugagcccguuauucaggugaccgucggcagcgcuaaguacgaauccgccuaucaggccgugguuuggaaaaucgaucgccugccggacaagaauagcucucuggaucacccucauugccuuuccuacaaacucgagcuggggagcgaccaggaaauucccucugauugguauccuuucgcuacagugcaguuuuccguccccgacaccugugcgagccggacagaggugagaucucugggaguggaauccgauguucaaccgcagaagcacguccagcaacgcgccugcuacaacauccagccuaaacucuaucggagcgugauugaggacgugaucgagggcgucagaaaucuguucgcugaagaggggaucgaagaacaggugcuuaaggaucugaagcagcucugggaaaccaaaguucugcaauccaaggccacggaggacuuuuuccgcaacagcauucagucuccccuguuuacacuucagcucccucacagccugcaucagacccugcaauccucuaccgccagccucgugauccccgcuggacggacacugcccuccuucaccacagccgagcuuggcacgucuaauagcuccgcgaacuuuaccuucccuggguacccgauucacguccccgcuggcgugacacugcagaccguuucuggacaucucuauaaagugaaugucccuaucauggugacagaaaccagcggcagagccgggauucugcagcaccccauccagcaaguuuuucagcagcugggacaaccuuccgugauucagacgagcgucccccagcuuaacccuuggucucuccaggccaccacagagaagucccaacgcaucgaaaccgugcugcagcagccggcuauccugcccagcggcccuguggaucggaaacaccucgagaacgccacaucugacauucuggucucccccgggaaugagcauaagaucguuccugaagcccuucugugucaccaggagagcucccauuacauuucucuccccggagugguguucagcccgcaagucucccagaccaacagcaauguggaaucuguucuguccggcagcgcuucuauggcgcagaaccugcacgaugagagccuuuccacgucuccucauggggcccugcaccagcacgugacagacauccaacuccauauucugaagaauagaauguacggcugcgacagcgucaaacagccccgcaacaucgaggaacccuccaauaucccugugucugagaaggauagcaacucccagguugaccucagcauucgggugaccgaugacgauaucggagaaauuauccaggucgacggcucuggggauacauccagcaaugaggaaauuggauccaccagagacgcugaugagaacgaguuccugggcaauaucgacgggggagaucuuaaagugcccgaagaggaagccgacucuaucagcaacgaggauuccgcuaccaauucuagcgacaacgaagacccucaaguuaauauuguggaggaagauccgcugaacuccggcgacgaugucagcgagcaggacgugcccgaucucuuugacacagauaacgugaucgucugucaguaugacaagcaaggggauacgcggguucgccacggccagcaguga

SEQ ID NO: 76408 - RNA, 2208 nt, Artificial Sequence
  derived and/or modified sequence opt5 from STON1__Homo_sapiens__NP_001185524
augugcagcaccaaccccggcaagugggugacauucgacgaugacccugccguccaguccucucagaaaagcaagaauuuuccgcuggagaaccaggggguuuguagacccaauggacucaaacugaaccuuccuggccugcgggaguuccccuccgggucuagcuccacgucuagcaccccucucuccagccccaucguggauuuuuacuucucuccuggaccgcccuccaauagcccucugucuacacccaccaaggacuuuccuggcuuccccgggauuccgaaagcuggaacacacgugcuuuauccuauccccgaauccagcucugauuccccucuggccauuagcggcggcgaauccucucuccugcccacccgccccacaugccugagccaugcgcuccugccuuccgaccacagcuguacccauccgacgcccaaggucgggcuuccugaugaggugaacccccagcaggcugaaucucugggauuucaauccgacgaucucccucaguuccaguacuuuagagaggacugcgccuucagcucucccuuuuggaaggaugagggcagcgacucccacuucacccuggauccgccugggucuaaaaagauguuuagcucccggaauaaagaaaugcccaucgaccaaaagagccuuaacaaauguucucugaauuauauuugcgagaagcucgaacaucugcaauccgccgagaaccaggacagccugcgcucucucuccaugcacugucugugcgcugaggaaaaugccagcuccuucguuccucacacacuuuucagaucucagcccaagagcggaugguccuuuaugcugcggaucccugagaaaaagaacaugaugucuagccgccaguggggccccaucuuccucaaagugcugccgggagggauucuucaaauguacuaugaacagggccuggagaagccuuuuaaagaaauccagcucgaucccuacuguagacuguccgagcccaaggucgagaauuucagcguggcuggcaaaauucauaccguuaagaucgaacacgugucuuauacagagaagcggaaauaccauuccaagaccgaagucgugcacgagccugacauugaacaaaugcugaaacucgggagcacgucuuaccacgauuuucuggacuuccuuacaaccguggaggaggaacugaugaagcucccggccgucuccaaacccaagaagaacuaugaggaacaggagaucagccuggaaauuguugauaauuuuuggggaaaagugacaaaggagggcaaauucguggagucugcggucaucacccagaucuacugccuuuguuuugugaacgggaaccuggaaugcuuccucacccugaaugaccuggagcucccuaagcgcgaugaaagcuauuacgagaaagacuccgagaagaagggaauugauauccuggacuaucauuuucacaaaugcguuaacgugcaggaguucgaacaaagcagaauuaucaaguuugucccccuugaugccugucgguucgaacugaugcgcuucaaaacacucuacaauggcgacaaccugccuuuuucucugaaguccgugguugugguccagggggcuuauguggagcuucaggccuucgucaauauggcuagccucgcccagagauccucuuacgcgggaagccugcgguccugcgacaacauucgcauccauuuucccgugccuucucaauggaucaaagcccuguggacgaugaaucuccagagacaaaagagccugaaggcuaaaaugaaccggagagccugucuuggcucccugcaggaacucgagucugagcccguuauucaggugaccgucggcagcgcuaaguacgaauccgccuaucaggccgugguuuggaaaaucgaucgccugccggacaagaauagcucucuggaucacccucauugccuuuccuacaaacucgagcuggggagcgaccaggaaauucccucugauugguauccuuucgcuacagugcaguuuuccguccccgacaccugugcgagccggacagaggugagaucucugggaguggaauccgauguucaaccgcagaagcacguccagcaacgcgccugcuacaacauccagguggagauugagaaaaaguggaucaagaucgacggcgaagauccugacaaaauuggggauuguaucacccaguga

SEQ ID NO: 76409 - RNA, 684 nt, Artificial Sequence
  derived and/or modified sequence opt5 from STOX1__Homo_sapiens__NP_001123631
auggccagacccgugcagcuggcuccuggcagccucgcccugguccuuugccggcuggaggcgcaaaaggcugccggggccgcugaggaaccgggaggccgcgccguuuucagagcuuuucggcgcgccaacgcgagauguuucuggaaugcccggcucgcucgcgccgcuuccagacuggccuuucagggguggcuucggcgcggagugcugcucgugagagcgcccccugccugccugcagguccugcgggacgcuuggcgcagacgggcccucagacccccucgcggcuuccggaucagagcugugggggauguuuuucccgugcagaugaacccuauuacccaaucucaguucgucccgcugggagaagugcuuuguugcgccaucagcgacaugaauacagcccagauuguugugacgcaggagucccugcucgaacgccugaugaaacacuaccccggcaucgcuauuccuucugaggauauccuuuauaccacacugggcacccucaucaaggagcggaaaauuuaccauacaggggaaggauauuuuaucgucacaccccaaaccuacuucauuaccaacacgaccacacaggagaauaagagaaugcugccuagcgacgaaucccgccugaugcccgcgucuaugaccuaucucgauacagagagcggcaucuga

SEQ ID NO: 76410 - RNA, 246 nt, Artificial Sequence
  derived and/or modified sequence opt5 from STRA13__Homo_sapiens__NP_001257935
auggagggcgccggggcuggaagcggcuucagaaaggaacuggugucccggcuccugcaccuucauuuuaaagacgauaagaccaaagucucuggggacgcccugcagcucaugguugagcugcuuaagguguucguggucgaagcggcugugcgcggaguuagacaagcccaggccgaggaugcucugcggguggacgucgaucagcucgaaaaagugcugccccagcugcuccuggacuuuuga

SEQ ID NO: 76411 - RNA, 1977 nt, Artificial Sequence
  derived and/or modified sequence opt5 from STRA6__Homo_sapiens__NP_001136091
augagcucccagcccgccggcaaccaaaccucuccuggggcuacagaggacuacagcuauggauccugguacaucgaugaaccgcagggcggggaggaacugcagcccgagggagaagugccuucuugccacacgagcauucccccuggccucuaucaugccugucuggcgucccuuucuauccugguccuccugcuucuggcuaugcucguuagacggcgccagcuguggcccgacugcgugagagggcggccuggacugccgcgccccagagccgugccugccgcugucuucauggugcuccugagcucccuuugucugcuccugcccgaugaggacgcccuuccuuuucugacccucgcuagcgcccccucucaagauggcaagacagaggcgccgcggggcgccuggaaaauucuggggcuguucuacuaugcugcccucuacuauccucuggcugccugcgcgaccgccggacacacagcugcccaucuucugggcuccacccucagcugggcucaccuggggguucagguguggcagcgcgccgaauguccccaggucccuaagaucuacaaauacuauucucuucuggccucccucccccugcugcucggacugggcuuucuuagccugugguaccccgugcaacucguuagaucuuucucccggcgcacaggggcuggaagcaagggccugcaguccucuuauagcgaggaauaccuuagaaaucugcucugccggaaaaagcugggcuccagcuaucauaccucuaagcacggguuucuguccugggcgcgcgugugucucagacacugcauuuacacgccucagccgggauuccaucugccccuuaaacugguccucagcgccacccugacaggcaccgcuaucuaucagguggcccugcuucuccuggugggggucguuccuacaauccaaaaggugcgggccggagugaccacggacgucucuuaccugcucgcuggcuuugggauugugcugagcgaggauaaacaggagguuguggaacuugucaagcaccaucugugggcccucgagguguguuacaucuccgcgcugguucugucuugccuucucacauuccuggugcugaugcgcagccucgucacccacagaacaaaccugcgggcccuucacagaggagccgcccuggaccucagcccccugcaucgcuccccucaccccucucggcaggcuauuuucuguuggauguccuucagcgccuaucaaaccgcuuuuaucugccugggccuucucgugcagcagauuaucuucuuucugggcaccacagcccuggcguuccucguccugaugccggugcuucaugggagaaaucugcuccuguuccgcucucuggaauccagcuggccuuuuuggcuuacgcucgcccuggcuguuauucugcagaacauggccgcucacuggguguuccucgagacccaugauggacacccccaacugacaaaucggagaguccuuuacgccgcgaccuuucugcucuuuccucugaacgugcugguuggcgccaugguggcuacauggcgcguccuucuguccgcccucuauaaugcuauccaccuggggcagauggaccucucucugcuucccccucgggccgccacccuggaucccggauacuauacguacagaaacuuucucaaaaucgaagugagccagucccauccggcuaugacagcguucugcucucugcugcuucaggcccaaagccugcucccucgcaccauggcugcuccccaggacucccugcggcccggcgaggaggaugaagggaugcagcuccugcagaccaaggacagcauggccaagggcgcuagaccuggagccucucgcggccgggcgagaugggggcuugcuuauacacugcuccacaauccgacccugcaaguguuucggaaaacagcccugcuuggagccaacggcgcucagcccuga

SEQ ID NO: 76412 - RNA, 993 nt, Artificial Sequence
  derived and/or modified sequence opt5 from STRA8__Homo_sapiens__NP_872295
augggcaagaucgacguggauaaaauucuguucuuuaaccaggagaucagacucuggcaacugauuauggccacccccgaagagaauagcaacccucacgaccgggcuacaccgcagcuucccgcccagcugcaggaacucgagcaucgcgucgcgagacggcgccugucccaagcuagacaccgggccacgcuugccgcucuguucaauaaccuccgcaagaccguuuacucucagagcgaucugaucgccuccaaauggcaagugcugaauaaggcuaaaucucauauuccugaacucgagcagacacuggacaaccuucugaagcucaaggccagcuuuaaucuggaggaugggcacgcguccucucuugaagaggugaaaaaggaauaugccagcauguacuccggaaacgacagcuucccccagaaugggucuuccccuugguaucugaacuuuuacaaacagaccauggaucuccugacaggcagcggaaucaucacaccccaggaggcugcccugccuauugucucugcugccaucucccaucucuggcagaaucugagcgaggaaagaaaggcgucucuucggcaagccugggcucagaaacaccgcggcccggccacccuggcugaggccugcagagaacccgccugugcugagggguccgugaaggacagcggaguugauucccagggcgcgucuugcagccucguguccaccccugaagagauucuguucgaggacgccuuugaugucgcuagcuuccuugacaagucugaagugcccuccacgagcucuagcuccucuguucuggccagcuguaacccugagaaucccgaagagaaauuucaacucuauaugcagaucauuaacuucuuuaagggccuguccugcgccaauacccaggugaaacaggaagcuagcuucccggucgaugaggagaugaucaugcugcaauguacagaaaccuuugacgacgaggaucucuga

SEQ ID NO: 76413 - RNA, 1296 nt, Artificial Sequence
  derived and/or modified sequence opt5 from STRADA__Homo_sapiens__NP_001003787
augagcuuccugguguccaagcccgagagaauccggcgcugggucucugaaaaauuuauuguugagggccucagagaccuggaacuuuucggggagcagccuccgggagauacccggcgcaagacaaacgacgccagcuccgaaucuaucgcuagcuuuuccaaacaagaggugaugucuagcuuccugcccgagggcgggugcuacgaacuccugacggugauuggaaagggcuuugaggaucuuaugaccgucaaucuggccagauauaaaccuacaggggaauacgugaccguucggcgcaucaaccucgaggcguguuccaaugagauggugacauuccugcagggagaacugcacgucagcaagcucuuuaaccaucccaauauugugccuuauagagcuaccuucaucgccgacaacgagcuguggguugugacaucuuuuauggccuacggcuccgcuaaggaucuuaucugcacccacuucauggacggcaugaaugaacuggccauugcuuauauccuccaggggguccugaaagcccuugauuacauucaucacaugggauaugugcaucggagcgugaaggcgucucacauccugauuuccgucgacggcaaaguuuaccucagcgggcugcgcucuaaccuguccaugaucagccacggacagagacaacggguggugcaugauuuucccaaguacuccgucaaagugcucccuuggcugucuccggagguucuucagcagaaucugcagggcuaugacgccaagagcgauauuuacuccguggggaucacggcuugugaacucgccaacggacacguccccuucaaggacaugccugcuacccaaaugcugcuugagaaacugaauggcacagugcccugccuccuggauaccagcacaaucccugccgaggaacugaccaugucucccucccgcagcguugcgaacucuggccucagcgacucccugacgacaucuaccccgagaccuagcaauggggacucccccagccauccuuaucaccggacauuuucuccccacuuccaucacuucguggagcagugucuucagcgcaaccccgaugccagaccuuccgcuagcacccugcucaaucauuccuuuuucaagcagauuaaacggagagccucugaagcucugccggagcuucugcgccccgucaccccuaucacaaacuuugaaggaagccaaucccaggaccacucuggcauuuucgggcucgugacgaaccuggaggagcuggaagucgaugacugggaguuuuga

SEQ ID NO: 76414 - RNA, 1134 nt, Artificial Sequence
  derived and/or modified sequence opt5 from STRADB__Homo_sapiens__NP_001193793
augagccugcucgacugcuucuguaccuccagaacacagguggagucucugcggcccgaaaagcaaagcgagacguccauccaccaguaccuugucgaugaaccuacccugucuuggagccgcccguccacaagagccucugagguucucugcagcaccaacgugucccauuaugaacuucagguggagauuggccggggguuugacaaucugacaagcguccaccuggcucgccauacccccacaggaacccucgugacgaucaaaauuaccaaccuggagaauuguaacgaagagagacugaaggcccuccagaaagcgguuauccugucucacuucuuucggcauccuaauauuacaaccuacuggacaguguucaccgucggcuccuggcuuugggugaucagccccuuuauggcuuaugggucugccucccaacugcuccgcacguacuucccugaaggaaugagcgagacacugaucagaaacauucuuuuuggcgccguucgggggcugaauuaucuccaccagaacggaugcauccaccgcucuauuaaggcuucccauauccugauuagcggcgauggccuggugacccucuccgggcugucucaccuucauagccuggucaaacacggacagagacaccgggccguguacgacuucccccaguuuuccacaagcgugcaaccuuggcucucuccggagcugcuucgccaggaucugcauggcuauaaugucaaguccgacaucuacagcguugggauuaccgcuugugaacucgccucuggacaggugcccuuccaggauaugcacagaacccaaaugcugcugcagaagcucaaaggcccucccuacagcccucuggacaucuccaucuuuccccagucugagagccggaugaagaacucccaaagcgggguggauucuggaauuggcgaauccguccuugugagcucuggcacacauacgguuaauuccgaccgccugcacaccccgagcuccaaaacauucucuccugcguuuuucagccucgugcagcugugccuucagcaggaucccgagaagagaccuuccgccucuagccugcucucccaugucuucuuuaaacaacccuauuucgaauuucuguga

SEQ ID NO: 76415 - RNA, 1053 nt, Artificial Sequence
  derived and/or modified sequence opt5 from STRAP__Homo_sapiens__NP_009109
auggccaugagacagacaccccugaccugcagcggccacacgcggccuguggucgaccucgcuuucuccgggaucaccccguacggauauuuucugauuucugccuguaaggauggcaaacccaugcuucgccaaggggacacaggagauuggaucggcaccuuccuggggcauaagggagcgguuuggggcgcuacacucaacaaagacgccaccaaggccgcuacagccgcugccgauuuuaccgcgaaagugugggacgccgugagcggcgaugagcugaugacgcuugcucacaagcauauugucaagaccguggacuucacacaggauuccaauuaccugcucaccgggggacaggacaaacugcugagaaucuaugaucucaacaagccugaagccgagcccaaagaaauuucuggccacacaagcgggaucaagaaagcucuguggugcuccgaggacaagcagauccuuucugccgaugacaagaccguucggcugugggaccaugcgacgaugacagaagugaaaagccucaauuuuaacauguccgucagcucuauggaguacauuccugagggagaaauccuggugauuaccuauggccgcuccaucgccuuccacagcgcuguuucucuugaucccauuaaguccuuugaggccccugcuacaaucaauagcgccucucugcacccggaaaaagaguuccucguggccgggggagaggacuuuaagcuguacaaauaugauuacaacuccggcgaggaacuggaaagcuacaagggccauuucgggcccauucacugugucagauuuuccccugacggagagcucuaugcuucuggcagcgaagaugggacccugcggcuuuggcaaaccguggugggaaaaacauacggccuguggaagugcguccuccccgaggaggacuccggggaacuggcgaagccuaaaaucggauuccccgagacgaccgaagaggaacuugaggagaucgccagcgaaaauucugauuguauuuuuccguccgcuccugacguuaaggccuga

SEQ ID NO: 76416 - RNA, 5328 nt, Artificial Sequence
  derived and/or modified sequence opt5 from STRC__Homo_sapiens__NP_714544
auggcccugagccucuggccccugcuucugcuccugcuucugcuccugcugcucuccuucgcugugacccuggccccuaccggcccgcacucucuugaccccgggcuguccuuucucaagucccugcuuucuacgcuggaucaggccccucagggaagccucuccagaucucgguucuuuaccuuccuggcuaacaucagcuccagcuuugagcccggccgcaugggggaaggaccugucggcgagcccccuccgcugcagcccccugcccucagacugcaugacuuccuuguuacacugcgggggucucccgauugggaaccuaugcucggacugcuuggcgacaugcuggcccuccugggccaggagcagacaccccgcgauuuucuggugcaccaagcuggggugcucggaggccuggucgaagugcuucugggggcccucguuccgggaggcccucccacaccuaccagaccgcccugcacacgggacgggccuuccgauugugugcuggcugccgacuggcuuccgagccugcuccugcugcucgagggaacccgcuggcaggcccugguccaggugcagcccucuguugauccuacgaaugccaccggccuugacggcagagaggcugcgccccacuuccugcaagggcuccugggacugcuuacaccuaccggcgaacucggguccaaagaggcucuguggggaggccugcuccggacagugggggcgccccuguacgcggccuuucaggaaggacuucugcgcgucacccacagccuccaggaugagguguucucuauucugggccagccggagccugacacgaacggccaaugccaaggcgggaaucugcagcaacuucuccuguggggagugagacauaaccuguccugggauguccaggcucucggguuucugagcgggucucccccucccccucccgcccuucugcacugucucagcacaggcguuccgcugccucgggcuagccagcccuccgcccacaucagcccccgccagagacgggccauuaccguggaagcucugugcgagaaucaucuugggccugcgccgcccuauucuaucuccaacuucagcauucaccuccugugucaacauacaaagccugccaccccgcagccucaccccucuaccacagcuaucugccagacggccgugugguacgccgucagcugggcuccuggcgcccagggauggcugcaagcgugucacgaccaguuucccgacgaguuccucgaugcuaucugcuccaaucugucuuucagcgcccuuuccggcagcaaccgcagacuggugaaacggcucugugccgggcugcugccgccucccaccucuugcccugagggacuucccccgguuccucucacacccgacaucuuuuggggcuguuuccuggaaaaugagacccugugggcugagagacucugcggggaagccucccugcaggcugugccucccagcaaccaggccuggguccaacaugugugccagggacccacaccugauguuaccgcgucuccgcccugucacauuggcccuugcggggagcgcugucccgacggcggauccuuucuugugauggucugcgccaaugauacgauguaugaagugcuggucccuuucuggcccuggcucgcuggccagugucggauuagcagagggggaaacgacacaugcuuucuggagggccugcuugggccucugcucccgucccugcccccucucggacccucuccucugugucuuacccccggcccguuccugcucgggaugcugagccagcugccucgcugccaauccucugugcccgcccuugcucaucccacccggcugcacuaccuccugagacuccugacauuucuucugggcccuggagccggcggggcggaagcccagggaaugcucggccgcgcucugcugcuuagcucccugcccgauaauuguagcuucugggacgccuuucggccugaggggagacgcucuguucuccggaccaucggagaguaucuggaacaggaugaggaacaaccgacacccuccggcuucgagccuacggugaaccccagcucugggauuuccaagauggaacuccuggcuugcuuuagcccuguccuuugggaccugcugcagagagagaaaucugugugggcccuccagauccugguucaggccuaccuucauaugcccccggagaaucugcaacagcucgugcugagcgcugaacgcgaggcggcccagggcuuccucacccugaugcuucagggaaagcugcaaggcaagcugcaggucccucccuccgaagaacaggcucucgggcggcugacagcccuucugcuccagagauauccucggcugaccagccaacucuuuauugaucugucuccccuuaucccuuuccuggccguguccgaccugaugcgcuucccucccagccuccuggcuaacgacuccgugcuugccgcgaucagagauuacucucccggaaugcggcccgagcagaaagaagcucuggccaagagacuccuggcccccgagcucuuuggcgaaguuccugcuuggccgcaggagcugcuuugggccguccugccccugcucccucaucugccccuugaaaacuuccugcaacucagcccucaccagauucaggcgcuggaggacuccuggcccgcugccgggcugggaccuggccaugcccgccacgugcuccggucucuugugaaucagagcguccaagauggcgaggaacaggugagacgccuggggccgcuggcuuguuuucucucccccgaggaacugcagucucuuguuccucugagcgaccccacaggaccuguggagagaggccuccuggaaugcgccgcuaacgggacccugucccccgagggacgggucgccuacgagcuccuuggcgugcugcgcagcucugggggagcgguucuguccccgagagaacuccgggugugggccccucuguucagccagcuuggccugcgcuuucuccaagagcugucugaaccccagcugagagcuaugcuccccguccuucagggcacguccgugaccccugcccaggcuguucugcugcucgggcggcugcuuccccgccaugaucugagccucgaggaacugugcucucugcaccuccuucugccuggacuguccccgcaaacacuccaggccauccccagacgggugcuggucggcgccuguagcugccuugcuccugagcugucccgccucagcgcgugucagaccgccgcucugcugcagacauucagagugaaagacggggugaagaauaugggaaccacgggcgccgggcccgccgucugcauuccuggacaacccaucccgacaaccuggccugauugucuccuuccccugcugccucucaaacugcuucagcuggacucucucgcucugcuggccaaccggagacgcuauugggagcuccccuggagcgaacagcaagcgcaguuucuuuggaagaagaugcagguuccuacaaaucugacccugcggaaccuccaggcucugggcacccuugccggcgggauguccugcgaguuccugcaacagauuaauucuaugguggauuuucucgaagugguccacaugaucuaccagcugcccacaagagugcgcggaagccugcgggccuguaucugggcugagcuccagagacgcauggccaugccggagccugaauggacgaccguuggccccgagcuuaacgggcuggacuccaaacugcuccuggaucuucccauucaacugauggaccggcucucuaaugaaagcaucaugcugguggucgagcuggugcagagagcgccugaacagcuccuugcucugacaccgcugcaucaggccgcccucgcugagcgcgcccugcaaaaccuugcucccaaggagaccccuguuuccggagaagugcuggagacacucggcccccuggucggguuccugggaaccgaaucuacgcggcagauuccucuccagauccuucugagccaccugucccaacuccagggcuuuugccugggcgagacauucgccaccgaacuuggguggcugcuccugcaggagagcgugcugggaaaacccgagcucuggucucaggaugaaguugagcaagcgggcagacugguguuuacccuuuccacagaagccauuagccugaucccucgggaggcucucgggcccgaaacccuggagcgccuucuggagaagcagcagucuugggaacaguccagagucggacaacucugucgggagccgcagcuggccgcuaaaaaggccgcccugguggcuggcgugguccgcccugcggccgaagaccuccccgagccuguucccaauugcgcugacgugagagggacauucccggccgccuggagcgcuacgcagaucgccgagauggaacuguccgauuucgaggacugucuuacccuguuugcgggagauccuggccucggccccgaggaacugcgggcugccauggggaaagccaagcagcuuuggggacccccuagaggcuuccgccccgaacaaauucugcagcucgggcggcugcugaucggacucggcgacagagagcugcaggagcuuauucugguggauuggggaguccucucuacacugggacagaucgacggcuggagcaccacacaacuucgcauugugguuuccagcuuucugcggcagucuggcagacaugugucccaccucgauuucguccaucugaccgcucugggguauacgcucugcggacugcgcccugaggaacuucagcacaucagcucuugggaauuuagccaagccgcgcuguuccucggcacccugcaccuucagugcuccgaggaacagcuggaggugcucgcccaucugcugguucuccccgggggauuuggccccauuucuaacugggggccugagaucuucacagaaaucggaaccauugcugccggcauccccgaccuggcucuuagcgcccugcuccggggccagauucaaggggugacaccucuggcuaucuccgucauucccccuccgaaguuugccguggucuucucucccauccagcuuagcucccugaccagcgcgcaggccguggcuguuacaccugagcagauggccuuucucucucccgaacaaagacgcgcuguggccugggcccagcacgagggaaaagaauccccugagcagcagggcagaagcaccgcuugggggcugcaagauuggucccggcccucuuggagccugguccucacgaucuccuuccugggacaucuucuguga

SEQ ID NO: 76417 - RNA, 2394 nt, Artificial Sequence
  derived and/or modified sequence opt5 from STRN3__Homo_sapiens__NP_001077362
auggacgagcuggccggcgggggaggcgggggacccggcauggcugccccuccgagacagcaacaggggcccggaggcaaccucggccugagcccugggggaaauggcgcggcugggggaggcgggcccccugccuccgaaggagccggccccgcugccggcccugagcuuucucggccgcagcaguacaccauccccgggauucugcacuauauccaacaugaaugggcucgcuucgagauggaaagagcccacugggagguggagcgggcggaacuccaggcccgcauugcuuuucugcagggagagagaaagggccaggaaaaccuuaaaaaggaucugguccggcgcaucaaaaugcucgaguacgcccugaagcaagagagagcuaaauaucauaagcugaaguacgggacagaacucaaucagggagaccugaaaaugccuacguucgagagcgaagagaccaaggauacagaagcccccaccgcgccucagaacucccagcuuacauggaaacaaggccggcagcugcuccgccaguaucugcaagagguuggguacaccgacacaauucuugaugugagaucucagcgggugcgcagccugcucggacuguccaauucugagcccaacggcagcgucgaaaccaagaaucuggagcagauccucaacggcggggaauccccgaaacagaagggacaagagaucaagagaagcucuggcgacgugcuggaaacguuuaauuuccuugagaacgccgaugacuccgaugaggacgaagagaaugauaugauugaagggaucccugagggaaaagacaagcaccggaugaacaaacauaagauuggcaaugaagggcuggcugccgaucucaccgacgaccccgauacagaggaggcucugaaagaauuugacuuccuuguuaccgccgaggauggcgaaggagccggcgaggcucgcagcucuggggacggaacagagugggauaaggacgaucuguccccuaccgcggaagugugggacgucgaucagggccucaucagcaaacugaaggagcaguauaagaaagaaagaaaggggaaaaagggagugaaacgggccaacagaacgaagcuguacgacaugauugcugaucucggcgacgacgagcugccccacauccccucugggauuaucaaucagucccgcagcgccuccacacggaugaccgaucacgaaggcgccagagcugaggaggccgaaccuaucacauuuccgucuggaggcggaaagagcuucauuaugggguccgacgauguucuucugagcgugcucggccugggggaccuugcggaucugaccgucaccaacgacgcugauuacucuuaugaccuccccgccaacaaagaugccuuucgcaagacauggaauccuaaauacacgcugcggucccauuucgacggagugagagcucuggccuuucaccccguggagccuguccucguuaccgcuagcgaagaucauacacugaaacuuuggaaccugcaaaagaccgugcccgccaagaagucugcgagccucgacguggagccgaucuauacauuccgcgcccacauuggcccuguccugucccuggcuaucucuagcaauggggaacagugcuuuuccggcggaauugaugccaccauccagugguggaacaugcccagcccuucuguggaccccuacgacacguaugagccuaauguucuugcuggcacacucguggggcacaccgaugccgucuggggacuggcguacuccggcaucaaaaaccagcugcucagcuguucugccgacgggaccgugcggcuguggaauccccaagagaaacuuccgugcauuuguacauauaacggagauaagaagcauggcaucccuaccuccguugacuucauugggugcgaucccgcucacauggugacgagcuucaauacaggcuccgccgucaucuacgaccuggaaaccucucagagccucgugauucuguccucucaggucgauagcggacugcaguccaacaaucauaucaacagagugguuagccaccccacacuuccugugaccaucacagcucaugaggaccgccacauuaaauuuuucgauaauaagaccggcaagaugauccacucuauggucgcccaucucgacgccgugacgucccuggcuguugauccgaacgggauuuaccugaugagcggaucucacgacuguuccauccggcucuggaaucuggauagcaaaaccugcgugcaagaaauuacagcgcauagaaagaaacuugacgagucuaucuaugacgucgccuuucacagcuccaaggcuuacauugccagcgccggcgcugaugcccuggcgaaaguguucguguga

SEQ ID NO: 76418 - RNA, 2283 nt, Artificial Sequence
  derived and/or modified sequence opt5 from STRN4__Homo_sapiens__NP_001034966
augauggaggaaagagccgcugccgcgguggcugccgccgcuagcuccugccggccccugggcucuggggccggaccuggcccgaccggggcugcccccgucagcgcgccugcccccggaccuggccccgcugggaagggaggcggcgggggaggcuccccugggccgacagccggacccgagccucucucucugcccggcauccuucacuucauucagcaugaaugggcucgcuuugaggccgaaaaagcgagaugggaggccgagcgggcugaacugcaagcccagguugcuuuccuccagggggagcgcaagggacaggaaaaccugaaaacggaccuugugagacggaucaagaugcuggaguacgcccucaaacaagagcgcgccaaguaucacaagcugaaauuuggcaccgaucugaaucagggcgaaaagaaagcugacgugagcgagcaggucuccaacgggccuguggaaucuguuacacucgagaauagcccccugguguggaaggaaggaagacagcuucugcggcaauaccucgaggaggucggcuauaccgauacaauucuggacaugcgcuccaaaagagugcggagccuucuggggcgcucucucgaacugaacggagcgguugagccguccgaaggcgccccuagagcucccccugggcccgccggacugagcggcggcgagucucuccuggugaagcagaucgaggaacagauuaagcggaaugccgcugggaaagauggaaaggagcgccuuggcggguccguccugggacagauccccuuccuccaaaacugugaagacgaggauagcgacgaagaugacgagcuggauucugugcagcauaaaaagcagagagugaaacuuccuuccaaggcccuggucccggaaauggaggacgaggaugaagaggacgacagcgaagaugcgaucaaugaguuugacuuccucggcuccggggaggauggcgaaggagcucccgacccucggagaugcaccguugauggcucuccccacgagcuggaaagccgccgggugaaacugcaagggauucucgccgaccugagagauguggacggacuuccucccaaggucacaggcccgccucccgggaccccucagccccgcccucaugagggauccuuuggcuucagcucugauguguuuaucauggacacgauugggggcggagaaguuucccugggcgaucucgccgaccugaccgugacaaacgacaaugaucuuagcugugaccugucugauagcaaggacgcuuucaaaaagaccuggaaccccaaauuuacacuccggucccacuacgaugggaucagaucucuggccuuccaccauagccaguccgcucugcucaccgccagcgaggacggaacgcugaaacuuuggaaucugcagaaggcggucacagccaagaagaacgcugcccucgauguggagccgauucacgcuuuucgcgcccaucggggcccuguucuggcgguggccauggggucuaauuccgaauauugcuacagcggaggcgcugacgccuguauccacucuuggaaaauucccgaucuguccauggaccccuaugauggguacgacccuagcguccuuucccacgugcucgagggccauggagaugcugucuggggccuggccuucucuccgaccagccaaagacuggccuccugcucugcugacgggacagugcgcaucugggaccccagcuccagcucuccugcgugucucugcaccuuccccaccgccuccgaacacggaguuccuacaagcguggcuuuuacgucuaccgagcccgcccauaucgucgccuccuuccggagcggcgauacagugcuguacgacauggaaguugggucugcccuucugacccucgagagcagaggauccagcggcccuacacagauuaaccagguggucucucaccccaaucagccgcugaccaucacggcucaugaugaccgcgggauucgguuucuggauaacagaacaggcaagccugugcacuccaugguggcgcaccuugacgcuguuaccugucucgccgucgaucccaacggagccuuccugaugagcggcucccaugacugcucucugcggcucuggagccuggauaauaaaaccugugugcaagagaucacagcucaccgcaagaaacaugaagaggccauucacgcgguggcuugccacccuuccaaggcccuuaucgccucugcuggggccgacgcucuggccaaggucuuuguguga

SEQ ID NO: 76419 - RNA, 2343 nt, Artificial Sequence
  derived and/or modified sequence opt5 from STRN__Homo_sapiens__NP_003153
auggacgagcaggccggccccgggguguucuuuagcaacaaucacccuggagcuggcggggccaagggacugggcccgcucgcggaagcugccgccgcuggggauggagccgcugccgcgggcgccgcuagagcccaauacucccugcccggcauccuucauuuccugcagcacgagugggcucgguuugaagucgagcgcgcccagugggaaguugagagagcggagcuccaggcccaaauugcuuuccugcagggggaacggaaaggacaggagaaccuuaagaaagaccuggugcgcagaaucaagaugcucgaauaugcccugaaacaggagcgggcuaaguaccauaagcugaaauauggcaccgagcucaaucaaggggauaugaagccucccucuuacgacagcgaugaaggaaacgagacagaagugcagccucagcagaauagccaacugauguggaaacagggccgccagcuucugagacaauaucuccaggaggucggguacacggacaccauucuggaugugaagucuaaacggguucgcgcccuucugggauuuagcuccgacgugacagauagagaagacgauaagaaccaggacucugucgugaauggcaccgaggccgagguuaaggaaacagcuaugaucgcgaaaagcgagcucaccgauuccgccagcgugcuggacaacuucaaguuucuggaaucugcugccgccgacuucuccgaugaggacgaagaugacgaugucgacggccgggagaaaagcgugauugauacaucuaccaucgugcgcaagaaagcucuccccgacuccggggaggauagagacacgaaggaagcccugaaagaguuugauuuccuugucaccagcgaagagggagacaaugaaucucgguccgcgggcgacgggacagauugggagaaggaggaccagugccugaugccugaggcuuggaacguugaucaaggagugaucaccaagcucaaagaacaguauaagaaagaacgcaagggcaaaaagggggugaagagaccgaaucggagcaaacugcaggacaugcuugccaaccugagagaugucgacgagcuccccucccugcagccuucugugggaagccccucccgcccuuccucuucccggcugcccgagcacgaaauuaauagagccgaugagguugaagcucucacauuuccgccuagcucuggcaagagcuucaucaugggcgccgacgaggcucuggaauccgagcuugggcugggagagcucgccggccugaccguggcgaacgaagccgauucucuuacguacgacauugcuaauaacaaagaugcccugcgcaagacauggaaccccaaauuuacccuccggagccauuucgacgggaucagagcucuggccuuccacccuauugagcccguccugaucacagcguccgaagaucacacccucaagauguggaaucugcaaaagaccgcccccgcuaaaaagagcacaucucuugacguggagccuauuuacacguuucgcgcccauaaaggaccgguucuguguguggucauguccagcaacggcgaacagugcuauucugggggcaccgacggacucauccagggcuggaauacaaccaaccccaauaucgauccuuacgacuccuaugaucccagcgugcugcgggggccucugcuuggacacacagacgcugucuggggccucgccuacuccgccgcucaucagagacugcugucuuguagcgcggaugggacccuccgccuguggaacacgacagagguggcccccgcucuuuccguuuucaaugacaccaaggagcugggcauuccggccucuguggaucucgucagcuccgacccuagccacaugguggccucuuuuuccaaaggauauaccagcaucuucaacauggaaacacaacagcggauucugacccuggagucuaauguugauacaacggcuaacuccagcugccagaucaauagagugauuucucaccccacccuuccuaucagcaucacagcccaugaagaccgccacauuaaguuuuacgauaacaauaccgggaagcucauccauuccauggucgcgcaccuggaggcugugacaagccuggccguggaccccaacggccucuaucugaugucuggaucccaugauuguagcauucggcuuuggaaucuggaauccaaaaccugcauccaggaguucacggcccacagaaagaaauuugaggaaucuauucacgacguugcuuuccauccuagcaaguguuacaucgccuccgcgggcgcugacgcccucgccaaagucuuuguguga

SEQ ID NO: 76420 - RNA, 1752 nt, Artificial Sequence
  derived and/or modified sequence opt5 from STS__Homo_sapiens__NP_000342
augccccugagaaagaugaaaaucccuuuccuccugcuguuuuuccuuugggaggccgaaagccacgcugccucccggccgaacauuauccucgugauggcggacgaucugggcauuggggaccccggaugcuacggcaauaagaccauccgcacaccuaacauugauagacuugcuucugggggagucaaacugacgcagcaucucgccgccagcccccuguguaccccuucccgggcugccuuuaugacaggccgcuaucccguuagaucugggauggcuagcuggucccggaccggaguguuccuguuuacagccucuagcggcggccucccuaccgacgagaucacauucgcgaagcugcuuaaagaucaaggguacuccaccgcccugaucggaaaguggcaccucggcaugagcugccauucuaagacggacuuuugucaccauccgcugcaccacggguucaauuauuuuuacggaauuucccuuaccaaccugcgcgauugcaaacccggcgaagggagcguguucacaaccggauuuaagagacucgucuuccugccucugcagaucgugggcguuacacuccugacccuugcugcccugaauugucucggccugcuucaugugccccugggggucuuuuucucucuccuguuccuggcugcccucauucugacgcuuuuucugggauuccuccacuauuuucggccucugaacugcuucaugaugcgcaauuacgagaucauucagcagcccauguccuaugacaaccuuacacaaagacugaccguggaagcggcccaguuuauccagcggaauacagagaccccguuccuccugguucugagcuaccuccaugugcacaccgcucuguuuucuuccaaagauuucgccggcaagagccagcacggggucuacggagacgcuguggaggaaauggauugguccgugggccaaauucuuaaccugcucgacgagcugcgccuggccaaugauacacuuaucuauuuuacgucugaccagggggcccaugucgaagagguuagcuccaaaggagagauccacggcggcagcaacgggauuuacaagggaggcaaggcuaauaacugggaagggggaaucagagugccuggcauucuccgguggccccgcgugauccaggcggggcagaaaauugacgagccuaccucuaauauggauaucuuccccacagucgccaagcuggcuggcgcuccccugccugaagacagaaucauugauggacgggaccucaugccgcugcuugagggcaaaucccaaagaagcgaucaugaauuucuguuccacuauuguaacgccuaccucaacgccgugcgcuggcauccccaaaauucuaccagcaucuggaaggccuuuuucuucacaccuaacuuuaaucccguuggguccaacggaugcuucgcgacccacguguguuuuugcuucggcucuuaugucacgcaccaugacccuccccugcuguuugauauuagcaaagacccgcgggagagaaauccucuuacacccgcuuccgagccucgcuucuacgaaauccucaaggugaugcaggaggccgccgaucggcacacccagacccugcccgaaguuccugaccaguuuagcuggaacaauuuccuguggaaacccuggcuccagcuguguugcccgucuacagggcuuuccugccagugugauagagagaagcaagacaagcgccugagccgguga

SEQ ID NO: 76421 - RNA, 2118 nt, Artificial Sequence
  derived and/or modified sequence opt5 from STT3A__Homo_sapiens__NP_001265432
augaccaaguucggcuuucugagacucagcuacgagaaacaggacacacugcuuaagcugcucauccuguccauggccgcugugcuuucuuucagcacgcggcuguuugccguccuccgcuucgaauccguuauucacgaguuugaucccuauuucaacuacagaaccacacgguuucuggcggaagagggguucuauaaauuucauaauugguucgacgaucgcgcuugguacccucugggaagaaucauuggcgggaccaucuauccgggacucaugauuacaucugccgccaucuaccacgugcugcacuuuuuccauaucaccauugacauccggaacgugugcgucuuucuugcuccccuguucagcuccuucacaaccauugugacguaucaucucaccaaggaacugaaagaugccggcgcugggcuucuggccgcggccaugaucgcuguugugccuggauacauuucucgcagcgucgccggcuccuacgacaaugagggcaucgcuaucuuuuguaugcuccugacauauuacauguggauuaaggccgugaagaccgggagcaucugcugggcggccaaaugugcucuggccuauuucuacaugguuucuuccuggggaggcuauguguuucucauuaaccugaucccccuucacguccuggugcucaugcugacagggagauucagccaccggauuuacguggcuuauugcaccgucuacugucuuggaacgauccugucuaugcaaauuuccuuuguuggcuuccagccugugcucagcucugagcauauggccgccuuugggguguucggacugugccagauccacgcuuuugucgauuaccugcgcuccaagcucaauccccagcaauucgaagugcuguuuagaagcguuaucucccuugugggcuucguccugcucacagugggcgcgcugcuuaugcugaccgggaaaauuucuccuuggacaggacgguuuuauagccuccuggacccguccuacgccaagaacaauauccccauuaucgcuagcguuucugagcaucagccuaccaccugguccagcuauuacuucgaucugcagcuccugguguucauguuucccgucggccuuuauuacuguuucucuaaccugagcgacgcccgcauuuuuaucaucauguauggggugacauccauguacuucucugccgucauggugagacucaugcugguucuggcuccugugaugugcauucuuagcggaaucggcgucucccaggugcucagcacguacaugaaaaaucuggauauuucucggcccgacaagaaguccaaaaagcaacaggauagcaccuauccgaucaaaaacgaaguugccucugggaugauucuggugauggcguuuuuccucaucacauacaccuuucacuccacaugggucaccagcgaggcuuauuccucuccuagcauugugcuguccgcccgcggaggcgacggcucuagaaucaucuucgacgauuuucgggaggccuacuauuggcuuagacacaauacgcccgaagacgcuaaggugaugagcuggugggauuacggguaucagauuacagccauggcuaaccgcaccauccugguugacaauaacaccuggaauaacacacauauuucccgggucggacaggccauggcgagcaccgaggaaaaagccuacgagaucaugagagaacucgaugugucuuacgugcuggucauuuucggcgggcugacaggauauuccagcgacgauaucaacaaguuucuuuggauggugcgcaucggcgggucuacggacaccggcaaacacauuaaggagaaugauuacuauacaccuaccggagaguuccggguugacagagaaggcucccccgugcuccugaacugucugauguacaagaugugcuauuaccgcuuugggcaagucuauacagaggcuaaacggcccccuggauucgauagagugcgcaaugccgaaaucggcaacaaggacuucgagcucgacguucuggaagaggcuuacaccacggagcauuggcuugugcggauuuacaaagucaaggaucuggacaauagagggcucagccgcaccuga

SEQ ID NO: 76422 - RNA, 2481 nt, Artificial Sequence
  derived and/or modified sequence opt5 from STT3B__Homo_sapiens__NP_849193
auggccgagcccagcgcuccugaauccaagcacaaaucuagccugaacuccucuccguggagcggccucauggcccugggaaauuccagacaugggcaccauggccccggggcgcagugcgcucacaaggccgccggaggcgcugccccucccaaaccugcucccgccgggcuuucuggaggccugagccaaccugcgggcuggcagucccuccugagcuucaccauccuuuuucuggccuggcucgcuggguucucuucccggcuguuugccgugauucgcuucgagagcaucauucaugaauuugacccgugguucaacuacagaucuacacaccaccuggcuucccauggauuuuaugaguuccucaauugguuugaugaacgggccugguacccccugggccgcaucgucgggggaacgguuuauccuggccuuaugauuaccgcggggcugauccacuggauccucaacacacugaauauuaccgugcauaucagagacgugugugucuuccuugcccccacauuuagcggacugaccucuauuuccacauuccuccugacccgggagcuguggaaccagggcgcuggccuccuggccgcuugcuuuaucgccauugugccuggguacaucagccgcuccguugccggaucuuucgauaaugagggcauugcuaucuucgcgcuucaguuuacguauuaccugugggugaaaagcgucaaaaccggguccguguucuggacaauguguugcugucucagcuauuuuuacaugguuucugccuggggaggcuacguguucaucauuaaccugaucccccuucacgucuuugugcugcuccugaugcaaagauauuccaagcggguguacauugcuuauagcaccuucuacaucgucgggcugauucucucuaugcagaucccguuuguuggauuccagccuauccgcacaagcgaacacauggccgccgcuggcguguuugcccugcuucaggcguaugcuuuccugcaauaccucagagaccggcugaccaagcaggaguuucagacgcuuuucuuucugggcgugucccucgccgccggggcugucuuccugucugugauuuaucugacauacaccggauacaucgcccccuggagcggccgcuucuauucccucugggauacaggguacgcuaaaauucauaucccuauuaucgccagcguuucugaacaccagcccaccaccuggguguccuuuuucuuugaccugcauauccuugucugcacauuccccgcgggacugugguuuuguauuaagaauaucaacgaugagagaguguucguugcccucuaugcuauuagcgccguguacuuugcuggcgucauggugcggcugaugcugacgcuuaccccugucgugugcaugcucucugccaucgcguucuccaauguuuuugagcacuaucugggggacgauaugaaacgcgaaaacccgcccguggaggacagcuccgaugaagacgauaagagaaaucaaggcaaccuguacgacaaagccggaaagguccggaagcaugcuacagagcaggaaaagaccgaggagggccucgggccuaauauuaagucuaucgugacaaugcugaugcuuaugcugcucaugauguucgccguucacuguaccugggugacgagcaacgcuuauuccucucccagcgucgugcuggccuccuacaaccacgacggaacaagaaauauucuggaugacuuucgcgaagccuacuucuggcuucggcagaacaccgaugagcaugcuagagugaugagcuggugggacuauggcuaccaaaucgcggggauggccaaucgcaccacacucguugauaacaauaccuggaacaauucucacaucgcucuggucggaaaagccauguccagcaacgaaacagccgcuuauaagauuaugcggacgcuggacguggauuacgugcucgucaucuuuggcggggugauuggcuauucuggagacgauaucaauaaauuccuguggaugguuagaauugccgagggcgaacauccuaaggacauccgcgaguccgauuacuucacaccccagggggaguuucggguggacaaagcgggaagcccgacccuucugaacugccucauguauaagaugucuuacuacagauucggcgaaaugcagcuggacuuucgcaccccucccggguucgaucggacaagaaaugcugagaucggaaacaaggacauuaaauuuaagcaccuggaagaggccuucaccagcgaacacuggcuuguccgcaucuauaaagugaaggccccugauaaucgggagacgcucgaccauaaacccagaguuaccaacauuuuuccuaagcagaaguaccuguccaaaaagacaaccaaacggaagcgcggcuauaucaaaaauaagcugguguucaagaaagggaagaaaauuagcaagaaaacagucuga

SEQ ID NO: 76423 - RNA, 912 nt, Artificial Sequence
  derived and/or modified sequence opt5 from STUB1__Homo_sapiens__NP_005852
augaagggcaaagaggaaaaggaagggggagccagacugggcgcugggggaggcagccccgaaaaauccccuucugcccaggagcucaaggaacaagggaaccggcuguucgugggacgcaaauacccggaggcggcugccugcuauggcagagccaucacccggaauccccuugucgcuguuuacuauacaaaccgcgcccuguguuaccucaagaugcagcagcacgagcaggcucuggccgacugcagacgggcgcuugaacuggauggccaaagcgugaaggcccacuuuuuccucgggcagugucagcuggagauggaauccuaugacgaggcuauugccaaucugcagcgcgcuuacucucucgccaaagagcaaagacugaacuuuggagaugacaucccuagcgcgcuucggauugccaagaaaaagcgcuggaacuccaucgaagagagacggauucaccaggaaucugagcugcauagcuaucucucccgccugaucgcugccgaaagagagcgggagcuugaagagugccagcgcaaucacgaaggcgaugaggacgauagccaugugagagcucagcaagccuguaucgaagccaaacacgacaaguacauggcugauauggacgagcuguucucucaggucgaugagaagcggaaaaagagagacauucccgauuaccucugcgggaaaaucuccuuugaacugaugcgcgagccuuguauuacgcccagcggaaucaccuaugaccggaaggacauugaggagcaucugcagagagugggccauuucgauccuguuacacgcucuccgcucacccaagaacagcugauccccaaucuugcgaugaaagaggugauugacgccuuuaucuccgagaacgggugggucgaagauuacuga

SEQ ID NO: 76424 - RNA, 864 nt, Artificial Sequence
  derived and/or modified sequence opt5 from STX11__Homo_sapiens__NP_003755
augaaggacagacuggccgagcuccuggaucuuagcaaacaguacgaccaacaguuccccgauggcgacgaugaauuugacuccccucacgaggauaucguguucgaaaccgaccauauucuggagucucucuaucgggauauccgcgacauucaggaugaaaaccagcugcuugucgcugacguuaagagacuggggaaacaaaaugcccgguuucucacaagcaugcgcagacuguccucuaucaagcgggauacgaacagcauugcgaaagcuaucaaggcccgcggagaggugauccacugcaagcugagagccaugaaagagcucuccgaagcugccgaggcucagcauggcccgcacucugccguggcgcggauuagccgcgcccaguacaaugcucugacccuuacauuccagagagccaugcaugacuauaaccaagcugaaaugaagcagcgggacaauuguaaaauccgcauucagagacagcuggagaucauggggaaggaggucuccggagaucaaauugaagacauguuugagcagggcaaaugggauguguucagcgaaaaccuccuggccgacguuaagggggcgcgggccgcucuuaaugagaucgaaucucgccacagagagcugcuccggcuggagucccgcauuagagaugugcacgaacuguuucuccagauggccguccugguggagaagcaagcugacacccuuaacguuaucgaacugaaugugcagaaaacagucgauuacaccggacaggccaaggcccaggugcggaaagcugugcaauaugaggaaaagaaccccugcagaacacucuguugcuucuguugcccuugucugaaauga

SEQ ID NO: 76425 - RNA, 978 nt, Artificial Sequence
  derived and/or modified sequence opt5 from STX16__Homo_sapiens__NP_001001433
auggccaccagacggcugacagacgcuuuccuccugcuucgcaacaauagcauccagaacagacaacugcucgccgaacagguguccucucacauuacgagcagcccccugcauucucggagcaucgcggcugagcuugaugagcuggccgacgaucgcauggcccucgucuccggcauuucucuggacccugaagcugccaucgggguuaccaagagaccgcccccuaaauggguggauggaguggacgagauucaguacgaugucggccggaucaagcagaaaaugaaggaacuggcuagccuccacgacaaacaucugaaucgccccacacuugaugacuccagcgaggaggaacacgccaucgagauuaccacacaagaaaucacccagcuguuucauagaugccagcgggcggugcaggcccucccuucucgcgcuagagccuguuccgagcaagaggggcggcugcuuggaaacguuguggcuagccuggcccaggcgcuccaggaacugucuacauccuuccgccacgcccagagcggcuaucugaagagaaugaagaaucgggaggaacgcucucaacacuuuuucgauaccuccgucccccucauggacgauggggacgacaacacgcuguaccauagaggauuuaccgaggaucagcuugugcugguugaacagaauacacucaugguggaggagcgggaaagagagauucgccaaaucguccagagcauuuccgaccugaacgaaaucuuccgggaucuuggcgcuaugauuguggagcagggcaccgugcuggacagaaucgauuauaaugucgaacagucuugcaucaaaacagaggacgggcucaagcaacugcacaaagccgagcaguaccagaagaaaaaccgcaagaugcugguuauucucauccuguuugugauuaucauugugcuuaucgucgugcugguuggagugaagucccgguga

SEQ ID NO: 76426 - RNA, 909 nt, Artificial Sequence
  derived and/or modified sequence opt5 from STX17__Homo_sapiens__NP_060389
augagcgaggacgaagagaaggugaaacugagaagacucgaacccgccauccagaaguucauuaaaaucgucauuccuaccgaucuggagcgccuuagaaagcaccaaaucaacauugaaaaauaccagcggugccgcaucugggacaagcugcaugaggagcacaucaaugcuggcagaacaguucagcagcuccgguccaacauucgcgaaaucgagaagcugugucuuaaagugagaaaggaugaccuggugcuccugaaacggaugauugauccggucaaggaagaggccucugcggcuacggccgaguuucugcaacuccaucuggaaagcguggaggaacuuaaaaagcaguucaaugacgaggaaacccugcuccagcccccucugacacgcuccaugaccguugggggagccuuucacacaaccgaggcugaggccucuagccagucccuuacacaaaucuaugcucugcccgaaauuccucaggaucagaacgccgcggagucuugggaaacccucgaggccgaccugaucgaacugagccagcucgugacggauuucucccugcuugucaauagccaacaggagaagauugacucuaucgcugaucaugugaacuccgccgcuguuaauguggaggaaggcaccaaaaaccuggggaaggccgcgaaauacaagcucgccgcucugcccgucgccggagcucuuaucggcgggauggugggaggcccuauuggccugcucgccggguuuaaaguggccggaaucgcugcggcccugggcgggggaguccugggcuucacagggggaaagcucauucagcggaaaaagcaaaagaugauggagaaacugaccagcucuugcccggaccuucccucccagacagauaagaaauguagcuga

SEQ ID NO: 76427 - RNA, 1008 nt, Artificial Sequence
  derived and/or modified sequence opt5 from STX18__Homo_sapiens__NP_058626
auggccguggacaucacccuccuguucagagcuagcgucaagacaguuaaaacgcggaacaaggcccugggcguggcggucgggggaggcguggaugggucccgcgacgagcuuuuuagacggucuccccgcccuaaaggagauuucagcuccagagcucgggaagugauuucucacaucggcaagcugcgcgacuuucuccuggagcauagaaaagauuacauuaaugccuauagccacaccauguccgaauacgggcggaugacagacaccgagcgcgaucagaucgaccaagaugcccagauuuucaugagaacaugcucugaagcuauccagcagcuucggaccgaggcccauaaggagauccacagccaacagguuaaggaacaucgcacagcugugcuggacuuuauugaggauuaucucaaaagagucuguaagcuguacuccgaacagcgggccauccgcgugaaaagaguuguggacaagaaacggcugagcaagcucgagccggagcccaacaccaagacgagagaaucuaccuccagcgagaaagucucucaguccccuagcaaggauucugaagagaaucccgcgacagaggaacgcccugagaaaauucuggccgaaacccaacccgagcuuggaacauggggcgacggcaagggggaagacgagcuguccccugaagagauccagauguucgagcaggaaaaccagcggcucauuggagagaugaauagccuguuugaugaagugagacaaaucgagggccgcguggucgaaauuucccggcuucaggagaucuucaccgagaaaguucugcagcaagaagcugagaucgacucuauucaccagcucguggugggggccacggaaaacaucaaggagggaaaugaggauauuagagaagcuaucaaaaacaaugccggcuuucgcgucuggauucuguucuuucuggugaugugcagcuucucccuccuguuucuugacugguaugauagcuga

SEQ ID NO: 76428 - RNA, 756 nt, Artificial Sequence
  derived and/or modified sequence opt5 from STX1A__Homo_sapiens__NP_001159375
augaaggacagaacccaggagcugcggacagccaaagauagcgacgaugacgaugacguggcugucacgguugaucgcgacagauucauggaugaauuuuucgagcaaguggaagagauccggggcuuuauugacaagaucgccgaaaacguggaggaggucaaacgcaagcacuccgcgauucucgcuucucccaauccugaugagaaaaccaaggaagaacuggaggagcuuaugagcgacaucaagaaaacagccaacaaggugagauccaaacugaagucuauugaacagagcaucgagcaggaagaggggcucaaucgguccucugccgaucugcgcaucagaaaaacccagcauagcacacuuucccggaaguucguugaagugaugagcgaguacaacgcuacccaaucugacuaucgcgagagaugcaagggacggauucagcgccagcuggaaaucacaggcagaaccacgaccuccgaggaacucgaggacaugcuggaaagcgggaauccggccauuuuugcuucuggaaucauuauggauuccagcaucucuaaacaggcccuguccgagauugagacacggcacagcgaaaucaucaagcucgagaacuccauucgcgaacugcaugacauguucauggauauggcgaugcuugucgagucucaaaccauguggagaggccccugucugacaccucggagacccagcuccacccgcgcccggagagcugggcgcaaaagcuga

SEQ ID NO: 76429 - RNA, 867 nt, Artificial Sequence
  derived and/or modified sequence opt5 from STX1B__Homo_sapiens__NP_443106
augaaggacagaacccaggagcugcggagcgccaaagauuccgacgaugaagaggaagugguccacguugaccgcgaucauuucauggacgaguuuuucgaacaaguggaggagaucagaggcugcauugaaaagcucucugaggauguggaacaggucaaaaagcagcacagcgcuauccuggccgcgcccaacccugacgagaaaacaaagcaggagcuugaagaucugacggcugacauuaagaaaaccgccaauaaggugcgguccaaacucaaggccaucgagcaaucuauugaacaggaggaagggcugaaccgcagcuccgcugaucuuagaauccggaaaacacagcauucuacccugagccgcaaguuuguugaggugaugacagaguacaaugccacccaguccaaguauagagaccgguguaaagaucgcauccaaagacagcucgaaauuacaggacggaccacgaccaacgaggaacuggaggacaugcuggaaagcggcaagcucgcuaucuucacagacgauauuaaaauggacucucagaugaccaagcaggcccugaaugagaucgagacacgccacaacgaaauuaucaaacuugagaccuccauuagagaacugcaugauauguuugucgacauggcgaugcucguggagagccaaggggaaaugaucgaucggaucgaguacaauguugagcacucuguggacuaugucgaacgcgccguguccgauacgaagaaagcugugaaguaccagagcaaggccagacggaaaaagauuaugaucauuaucugcugugucguucugggaguggugcuugcuucuuccauuggcgggacacugggacucuga

SEQ ID NO: 76430 - RNA, 864 nt, Artificial Sequence
  derived and/or modified sequence opt5 from STX2__Homo_sapiens__NP_001971
augagagaccggcugcccgaucucaccgccugccgcaagaacgacgauggcgacacaguggucguuguggagaaagaucacuucauggacgacuuuuuccaucagguggaagagaucagaaauagcauugauaagaucacgcaauacgucgaagaggugaaaaagaaccacuccauuauccugucugcuccuaauccggaagggaaaauuaaggaggagcuugaagaucugaacaaggagaucaaaaagaccgccaauaaaauccgggcgaagcucaaagcuauugaacagagcuuugaccaggaugaguccggaaaccgcacaucuguugaccugagaauccggcgcacccagcauagcgugcuuuccagaaaguucgucgaggccauggccgaauauaaugaggcucaaacacuguuucgggaacgcucuaagggccggauucagagacagcucgagaucaccgggcgcacaaccacggaugacgaacuggaggagaugcuggaaagcggaaaacccuccauuuucaccagcgacaucauuucugauucccagaucacaagacaagcccucaacgagaucgaaagccggcacaaggacauuaugaaacuggagaccucuauccgcgaacuucaugagauguuuauggauauggcuauguucguggagacacagggcgaaaugauuaauaacaucgagagaaauguuaugaacgccaccgacuacguggaacacgcgaaggaggaaacgaaaaaggccauuaaauaucaguccaaggcucggagaaagcugauguuuaucaucauuugugucaucgugcuccuggugauucuugggaucauucuggccacaacccucagcuga

SEQ ID NO: 76431 - RNA, 834 nt, Artificial Sequence
  derived and/or modified sequence opt5 from STX3__Homo_sapiens__NP_001171511
augaaggacagacuggagcagcucaaagccaagcaacugacccaggaugacgauacagacgcuguggaaaucgccauugauaacacggcguucauggacgaguuuuucagcgaaaucgaggaaacccggcuuaauauugauaaaaucuccgagcacgucgaggaagcuaagaaacuguacucuauuauccucagcgcccccaucccugagccgaagacaaaggacgaucuggaacagcuuaccacagagauuaaaaagcgcgccaacaauguuagaaacaaacugaaguccauggagaaacauaucgaagaggacgaagugcggucuagcgcugaucuccgcauuagaaagucccagcacucugugcugagccggaaguuugucgaggugaugaccaaauauaaugaagcccaaguugacuuccgcgagagauccaagggccggauccagcgccagcuggagauuacagggaaaaagaccacggaugaggaacucgaagagaugcuggaaagcggaaaccccgcuaucuuuaccucuggcauuaucgacucccagaucagcaaacaagcccuuucugagauugaggggagacauaaggacaucgugcggcuggaauccagcauuaaagagcuccacgauauguucauggacaucgcgaugcuggucgaaaaucagggagagaugcuugauaacauugaacugaaugugaugcauacaguugaccacguggagaaggcccgcgaugagaccaagaaagcugucaaguaccagucucaggcccggaaaaagcucaucucccugcaaacaggcguggcuacccugguguuuagauga

SEQ ID NO: 76432 - RNA, 888 nt, Artificial Sequence
  derived and/or modified sequence opt5 from STX4__Homo_sapiens__NP_001259025
augggcaugaccgccagaacaaagcggacgcgcagcggguccagaugguggugcacccgggcucgccacggauggggcgccagaacacggucuagcuccaccucuccccuggggcauccuccccaggugcgcacaaucagacaaaccauugucaaacucggaaacaagguucaggagcuggaaaaacaacaggugacaauccuugcgaccccgcugccugaggaaagcaugaagcaggagcuccagaaucugcgggacgaaauuaaacagcuuggccgcgagaucagacugcagcucaaggcuauugagccccaaaaggaagaggccgaugaaaacuacaauuccgugaacacgcggaugcgcaaaacccagcacgggguccugucucagcaguucguggagcugaucaauaaguguaacagcaugcaauccgaguauagagagaaaaauguugagcggauccgcagacagcucaagauuacaaacgccggaauggugagcgacgaagaacuggaacagaugcuugauucuggccaauccgaggucuuugugagcaauauccugaaagacacccagguuacacggcaggcucucaacgagauuucugccagacauuccgaaauccagcaacuggagcgcagcauucgggaacuucacgauaucuucaccuuucuggcuacggagguggaaaugcagggcgagaugauuaauagaaucgagaagaacauccucucuuccgccgacuacgucgaacgcgggcaggagcaugugaagacagcgcuggaaaaucagaaaaaggcccggaaaaagaaagugcugauugcuaucugcgucagcauuaccguugugcuccuggccgugaucauuggagucacagugguuggcuga

SEQ ID NO: 76433 - RNA, 966 nt, Artificial Sequence
  derived and/or modified sequence opt5 from STX5__Homo_sapiens__NP_001231595
augauccccagaaagcgguacggcagcaaaaacaccgaccaggggguguaucugggacucuccaagacacaaguccugucuccugccacggcuggcagcuccucuagcgauauugccccgcuucccccucccguuacccuggugccucccccuccggacacaauguccugccgcgauagaacccaggaguuccucucugcguguaaaagccugcagacacggcagaaugggauccaaaccaacaagcccgcucugcgcgccgugagacagcgguccgaauuuacacugauggccaaacgcauuggaaaggaccucagcaauaccuucgcuaagcuggagaaacugacgauccucgccaagagaaaaucucuguuugaugacaaggcugucgaaauugaggaacuuaccuacaucaucaaacaggauauuaacucccugaauaagcagaucgcccaacuccaggacuucgugcgggcgaagggcagccagucugggcgccaucugcagacacacuccaacaccauuguugugagccuucaaucuaaacuggccuccaugagcaaugauuuuaaguccguccucgaggugagaacagagaaccugaaacagcagcggucucgcagagaacaauucagccgggcuccuguuuccgcccugccccucgcuccuaaucaccugggaggcggcgccgugguccuuggggcggagagccaugccucuaaggacguggcuaucgauaugauggacucccgcaccagccagcagcugcagcucauugaugaacaagacucuuauauccagagcagagccgacacgaugcagaacauugaguccacaaucguggagcugggaucuaucuuucagcaacuugcucacauggucaaagaacaggaggaaaccauucagagcguucuucucuucccccugcugccggcccucuccccuggcagcacacggaccugcuga

SEQ ID NO: 76434 - RNA, 465 nt, Artificial Sequence
  derived and/or modified sequence opt5 from STX6__Homo_sapiens__NP_001273139
augaaggaccagaugagcaccuccucugugcaagcccuggcugagcggaaaaacagacaggcccuccugggcgauagcgggucccagaauuggucuacaggaacgaccgacaaguacggccgccuugauagagaacugcagcgggcgaacagccacuucaucgaggaacaacaggcucagcagcaacucauugucgagcagcaggacgaacagcuggagcuuguuuccgggucuaucggagugcugaaaaauaugagccaacgcauuggcggggagcucgaggaacaggccgugaugcuggaagauuuuucccaugagcuggagagcacacagucuagacucgacaacgucaugaagaaacuggccaaggugucccacaugaccagcgaucggcgccaauggugcgcuaucgccauucuuuucgcuguucugcucgugguccugauccuuuuucuggugcucuga

SEQ ID NO: 76435 - RNA, 711 nt, Artificial Sequence
  derived and/or modified sequence opt5 from STX8__Homo_sapiens__NP_004844
auggcccccgacccuugguucagcaccuacgauuccacaugccagaucgcucaagagauugccgaaaagauccagcagagaaaccaguaugagcggaaaggcgaaaaggcgccgaaacugacggugaccauucgcgcucuccugcaaaaucuuaaggagaaaaucgcccugcucaaggaccugcuucugagagccgucucuacacaccagauuacccagcucgaaggggaucggcgccagaaccugcuggacgaucucguuacaagagagcggcugcuucuggcuagcuuuaagaaugagggagccgaacccgaccucauccgcuccucucugaugagcgaggaagcuaaaagaggcgccccuaaccccuggcuuuucgaggagccugaagagacccgggggcugggauuugaugaaauccgccaacagcagcagaagauuauccaagagcaggacgcgggccucgaugcccuguccucuauuaucagcagacagaaacaaauggggcaggaaauuggaaaugagcuggacgagcagaacgaaaucauugaugaccucgcuaaucugguggagaacacagaugaaaaacuucggaaugagacccgcagagugaacauggucgaccggaaguccgccagcuguggcaugaucauggugauccugcuccugcuuguugcuauuguggucguggccguuuggcccacgaauuga

SEQ ID NO: 76436 - RNA, 1785 nt, Artificial Sequence
  derived and/or modified sequence opt5 from STXBP1__Homo_sapiens__NP_001027392
auggcccccaucggccugaaggcuguggucggggagaaaauuaugcacgacguuaucaagaaagugaagaaaaagggagaauggaaggugcucgucguggaucagcugagcaugagaaugcuuuccucuugcuguaaaaugaccgacauuaugacagagggcaucacgauuguugaagauaucaacaagcggcgcgagccucugccgagccucgaagccguguaccugaucacccccuccgagaaaucuguccauagccuuauuuccgacuucaaggauccucccacagcgaaauauagagcugcccacguguuuuucaccgacucuugcccugaugcccuguuuaaugagcucguuaagagccgggcugccaaggugaucaaaacacugaccgaaauuaacaucgcuuuccugcccuacgagucccaagucuauagccucgacucugccgauuccuuucagagcuucuacucuccucauaaggcgcagaugaaaaauccgauucuggaacgccuugccgagcagaucgcuacacugugugccacccucaaggaguaucccgcugugagauaccgcggggaauauaaagacaacgcccugcuugcgcaacugauucaggauaagcucgacgccuacaaagcugaugacccuacgaugggagagggccccgacaaggcccgcucccagcugcugauccucgauagaggguuugacccuagcucucccgugcugcacgaacuuaccuuccaggcuauguccuacgaucugcucccgaucgagaaugacgucuauaaguacgaaacaagcggaauuggcgaggcccggguuaaagaggugcugcuugaugaagacgaugaccuguggaucgcccuccgccauaagcacauugcugaggugucccaagaagucaccagaucucugaaagauuuuagcuccagcaagcggaugaacacaggcgagaaaaccacgaugcgcgaccugucucagaugcucaagaagaugccucaguaucagaaagaacuguccaaguacagcacacaccuucaucuggcggaggauugcaugaaacacuaucaagggaccguggacaagcucuguagaguugagcaggaccuggccaugggaacagaugcugaaggcgagaaaaucaaggaccccaugcgggccauugugccuauccuucuggaugccaaugucucuaccuacgacaagauccgcauuauccuccuguauauuuuccugaaaaacgggaucaccgaagagaaucucaacaagcugauucagcaugcucaaaucccucccgaagauagcgagaucauuacaaauauggcccaccuuggagugcccaucguuacggacuccacccugagacggagaucuaaaccggagcgcaaggaacggauuagcgagcagacauaccagcucuccagauggacccccaucauuaaagauaucauggaagacacaauugaggauaagcuggacaccaagcacuacccuuauaucagcacgcggucuuccgcgagcuuuucuacaaccgcuguguccgcccgguacggccauuggcacaaaaacaaggcccccggggaguauagaagcggaccucgccugaucauuuucauccuuggcggcgucucccucaaugaaaugcggugcgcuuacgaggugacccaggccaacgggaaaugggaaguccugauuggaucuacacauauccugacaccccaaaagcuccuggauacccuuaaaaagcugaauaaaacggacgaggaaauuagcuccuga

SEQ ID NO: 76437 - RNA, 1773 nt, Artificial Sequence
  derived and/or modified sequence opt5 from STXBP2__Homo_sapiens__NP_001120868
auggcccccagcggccugaaggcuguggucggggagaaaauccucuccggaguuauuagaucugugaagaaagacggcgaauggaaggugcugaucauggaucacccuagcaugcggauucuuuccucuugcuguaaaaugagcgacauccuggccgaggggauuaccaucgucgaagauaucaacaagcgcagagagccgauucccucccucgaagcgaucuaccugcuuucuccuacagagaaggcucugauuaaagacuuccagggaacgcccaccuuuacauauaaggccgcccauaucuucuuuaccgauacaugcccugagccccucuucagcgaacugggccggucccgccuggcuaaagugguuaagacccucaaagagauucaccuggccuuucuuccuuacgaagcucaaguguucagccuggacgccccgcauucuacauauaaucucuacugucccuuuagagcggaggagcggacccgccagcuggaaguccuugcccagcagaucgcuacgcugugcgccacccuccaagaguauccugcuauuagauaccggaaggggcccgaagauacagcccagcuggcgcacgccgugcuggcuaagcucaacgccuucaaagcugacaccccuucccugggagagggccccgaaaagacacgcagccagcuucugaucauggauagagccgccgacccgguuucuccucuccugcaugagcuuaccuuucaggcuauggcguaugaucugcucgacaucgagcaagauacguaccgguacgaaacaaccggccuguccgaggcccgcgaaaaagcugugcugcucgacgaggacgaugaccugugggucgaacuuagacacaugcacauugccgaugugagcaagaaagugacagagcugcuccggaccuucugugagucuaagcgccugaccacagacaaagccaauaucaaggaucuuucccagauucugaagaaaaugccccaguaucagaaggaacucaacaaauacagcacgcaucugcaccuggcugacgauugcaugaagcauuuuaaaggguccgucgagaagcucuguucuguugaacaagaccuggccaugggaagcgaugcggagggcgaaaagaucaaagacuccaugaaacuuauugugccugugcugcucgaugcugccguccccgccuaugacaagaucagagugcugcugcuuuacauccuccugcggaaugggguuagcgaggagaaccuggcuaagcucauucagcacgccaaugugcaggcucacucuucccugaucagaaaccuugaacaacugggaggcaccgucacaaaucccgggggaagcggcaccucuagccgccucgagccucgggaaagaauggagccgacauaucagcugucccgcuggacccccgugauuaaagacguuauggaggaugccguggaagaccggcuggauagaaaccuuuggccuuucgucucugaccccgcgccuacggccagcucccaggcugccgugagcgcucgcuuuggccauuggcacaagaauaaggccgggaucgaggcgcgggccggacccagacucauugucuacgugaugggcgggguugcuaugucugaaaugcgcgccgcuuaugaggugacacgggccaccgaaggaaaaugggagguccugaucggcuccagccauauccugaccccgacaagauuccucgaugaccugaaggcccuugauaaaaagcuggaggacauugcucucccuuga

SEQ ID NO: 76438 - RNA, 1662 nt, Artificial Sequence
  derived and/or modified sequence opt5 from STXBP4__Homo_sapiens__NP_848604
augaacaagaauaccagcacaguggucucccccucucugcucgagaaagacccugccuuccagaugaucacgauugcuaaggaaaccggccuggggcuuaaaguucugggaggcaucaacagaaaugaggggccgcucguguacauucaagaaaucauucccggaggcgauugcuauaaggacgggcggcugaaaccuggagaucagcuugugagcgucaacaaggaguccaugaucggcgugucuuuugaagaggccaagagcaucauuacaggcgcgaaacugcgccucgaguccgcuugggaaaucgccuucauuagacagaagucugacaauauccagcccgagaaccugagcuguaccucccugauugaagccagcggggaguacggaccucaggcuucuacacucucccuguuuagcucucccccugagauccuuauuccgaaaaccuccagcacacccaagaccaauaacgauauccugucuuccugcgaaaucaaaacgggcuauaauaagaccguucaaauuccuaucacaagcgagaacuccaccguggggcucucuaauacagacgucgccagcgcuuggaccgaaaacuacggacugcaggagaagauuucccuuaaucccagcgugcgguucaaagccgaaaagcuggagauggcgcucaacuaucugggcauccagccuacgaaagagcaacaccaggcccugcgccagcagguucaagcugauucuaaggggacaguguccuuuggagacuucguccagguggccagaaaucucuuuugucugcagcuugaugaagugaacgucggcgcucaugagauuagcaacauccuggacucucaacuccugcccugcgauagcuccgaagccgacgagauggaacggcuuaaaugugagcgcgaugacgcgcugaaggagguuaauacccucaaagaaaagcugcuggagucugacaagcagagaaaacagcucacagaagaacugcagaacgugaagcaagaagccaaagcuguggucgaggagacccgggcccuucgcagcagaauccaccuggcugaagccgcccagcggcaggcucauggcauggagauggauuacgaagaggugauucgccuccuggaggcgaagaucaccgaacuuaaagcccagcuggcugacuauuccgaucaaaauaaggagagcguucaggaccucaagaaaagaauuauggugcuggauugccagcugcggaagucugaaauggcccgcaaaacauucgaggccuccacggaaaagcuccugcacuuugucgaggcuauccaggagguguucagcgacaacucuaccccgcuuuccaaucugagcgaaagacgggccguucucgcgucccaaacaucucugaccccucuggggagaaacggacgcagcauucccgcuacacuugcccucgaguccaaagaacuggugaagucuguccgggcccugcucgauauggacugucugccuuacggcugggaggaggcuuacaccgccgaugggaucaaguauuuuaucaaucaugugacgcagacaaccagcuggauucaccccgucauguccgugcuuaaccugagcagaucugaggagaaugaagaggacugcucccgcgaacuccccaaccagaaaagcuga

SEQ ID NO: 76439 - RNA, 3456 nt, Artificial Sequence
  derived and/or modified sequence opt5 from STXBP5__Homo_sapiens__NP_001121187
augagaaaguucaacauccggaaagugcuggacggccucaccgccgggagcuccucugcuagccagcaacagcagcagcaacaucccccuggaaaucgcgagccggaaauucaggagacacugcaguccgaacacuuucagcuuugcaagacggucagacacggcuuccccuaccaaccuucugcccuggcguuugaucccguucagaaaauccucgcuguggggacccagacaggagcccugcggcuuuucggccgcccugggguggaguguuauugccagcaugacagcggagccgcugucauucaacugcaguuucucaucaacgaaggcgcccugguguccgcucuggccgaugacacccuccaccuguggaaucuuagacagaagcggcccgcgauucugcauucucucaaauucugucgcgagagaguuacauuuugccaucugccuuuccaaagcaaguggcuuuacgugggcaccgagcgggggaacauccacaucgucaauguggaauccuuuacacugagcggauauguuauuauguggaacaaggccaucgagcucucuuccaaaagccacccgggccccgugguccacauuucugauaauccuauggacgaagggaagcugcugaucggauucgaguccggcaccguggugcucugggaucugaaaagcaagaaagcugacuaccgcuauacguacgaugaggccauucauucugucgcuuggcaccacgaagggaagcaguuuaucuguucccauagcgacggaacccuuacaauuuggaacguuagaucccccgccaagccugugcagaccaucacaccccacggcaaacagcugaaggauggcaaaaagccggagccuugcaaacccauccucaagguggaguucaaaaccacgcggucuggggaaccuuuuauuauccugagcggaggccuuuccuaugacacagucgggcgcagacccugucugaccgugaugcauggaaagagcacagcgguucucgaaauggauuacucuauuguggacuuccugacccugugcgagacccccuacccuaaugacuuccaagagccguaugccgucgugguucuccuggaaaaggaucuugugcugaucgaccucgcucagaacggcuaccccauuuuugagaauccuuauccccuguccauccacgaaagcccugucacauguugcgaguacuucgccgauugucccguggaccuuaucccggcucuguauucugucggggcccggcagaaacgccagggauacagcaagaaagaauggccuauuaacggcggcaauugggggcucggagcccaauccuaucccgagaucauuaucacgggccaugcugaugggucugugaaguuuugggacgcgagcgccauuacccugcagguucuguacaaacucaagacauccaagguguucgagaaaagcagaaacaaggaugaccggccuaauaccgauaucgucgacgaagaucccuacgcuauccagauuaucucuuggugcccugaguccagaaugcugugcauugccggagugagcgcccacguuaucauuuaucgcuuuucuaaacaggaagugaucacagaggucauucccaugcuugaagugcggcugcucuacgagaucaacgacguggagaccccggaaggcgagcaaccuccuccccugcccacgccgguugggggcuccaacccccagccuauucccccucagagccaccccuccacaucuagcuccucuagcgacggacugagagauaaugucccuugucuuaaggugaaaaacagcccccucaagcaguccccgggcuaucaaaccgaacuggugauccagcuggucugggugggaggggagccuccccagcaaaucaccucucucgcuguuaauuccagcuacggccugguggucuucgggaacugcaauggaauugccaugguggacuaucuucagaaggcgguucugcucaaccugggcacaaucgagcuguacgggucuaaugauccuuaucgccgggaacccagauccccgcgcaaaagccggcagccuucuggcgcuggacuuugugacauuagcgagggcaccgugguccccgaagauagaugcaaguccccuacaagcgggucuuccagcccccauaacuccgacgaugagcagaaaaugaauaacuuuaucgaaaaggugaaaacgaagucucgcaaguucagcaaaaugguugccaaugacaucgccaagaugucccggaaacucucucugcccaccgaucugaagccugaccucgaugugaaagacaacagcuuuuccagaucucgcagcuccagcgucacaucuauugauaaggagucccgggaggcuaucagcgcccugcacuucugugaaaccuuuacaagaaaaaccgacucuuccccgagccccugccuuugggugggaacgacccugggcacagugcucgucauugcucugaaucugccucccgggggagagcaacggcuucuccagccuguuaucgugucucccuccggcaccauucugcgccugaagggggccauccucagaauggcguuccuggacacaaccggcugucuuaucccuccggccuacgaacccuggcgggagcauaacgugccugaagagaaggaugagaaagaaaagcugaaaaagagacgccccgucagcguguccccuagcucuagccaggagauuuccgaaaaucaguacgcuguuaucugcucugagaaacaagccaaggugauuagccuccccacgcagaacugugcuuauaagcagaacaucacagaaaccuccuuuguccugcggggagacauuguggcccugucuaauagcaucugccuugcguguuucugcgccaacggccacaucaugacauucucccucccgucucugagaccucugcucgauguuuacuaucugccccuuaccaauaugcgcauugcuagaaccuuuugcuucacaaacaaugggcaggcccuguaccucgugagccccacggagauccaacggcugaccuauucccaggagacaugugaaaaccugcaggagaugcuuggagaacuguuuaccccugucgagacacccgaggcuccuaaucgcggcuucuuuaaaggacucuucgggggcggggcccaaagccuggacagagaggaacucuuuggcgaaucuuccagcggaaaggccucucggucccuggcucagcacauuccgggccccgggggaaucgagggcgugaaaggggcggccagcggaguugugggcgaacuugcucgcgccagacuggcccucgaugagcggggccagaagcugggggaccuggaggaacgcaccgcugccaugcuuuccucugcggagagcuucuccaaacaugcucacgaaauuaugcugaaguacaaggauaaaaagugguaucaguuuuga

SEQ ID NO: 76440 - RNA, 3561 nt, Artificial Sequence
  derived and/or modified sequence opt5 from STXBP5L__Homo_sapiens__NP_055795
augaagaaauucaacuuuagaaaggugcuggacggccucaccgccagcucccccgggucuggaagcuccucuggcagcaauuccgggggaggcgcugggucuggaagcguccacccugccggcacagcgggcguucugcgggaggaaauccaggagacgcuuaccuccgaauacuuccaaauuugcaaaacagugcgccauggguuuccgcaccagcccaccgcucuggccuucgauccugugcagaagauccucgccauuggaacaagaaccggcgcuauccggauucuggggcgccccggagucgacuguuauugccagcaugagagcggcgccgcugugcuucaacugcaguuucucaucaacgaaggggcccugguuucugcguccagcgaugacacacugcaccucuggaaucugagacagaaacggccugccauccuucauucucugaaguucaaccgcgagagaauuaccuacugucaccuccccuuucaguccaaguggcuguaugugggaacggagcggggcaauacccacaucgucaacauugaauccuucauccuuucuggcuacgugauuauguggaauaaagcuaucgagcuguccacaaagacccauccugggccgguugugcaccucagcgauagcccccgcgacgaaggaaaacugcugauuggcuaugagaacgggacagucguguuuugggaucucaagucuaaaagagccgagcugcggguguacuaugacgaagcuauccauagcaucgauuggcaccacgagggaaagcaauucaugugcucccauagcgacggcucucuuacccuguggaaucucaaguccccuagccgccccuuucagacgacaauuccucacgggaaaucucagagagaaggacgcaagagcgaguccuguaaacccauccugaaggucgaauacaaaaccugcaagaacucugagccguucauuaucuuuagcggcggccuuuccuacgauaaagccugucggagaccuagccugacaauuaugcaugggaaggcgaucaccguucucgagauggaccaccccaucguggaguuccugacccugugcgagacaccuuaucccaaugaguuccaggaacccuacgccguggucgugcuccuggaaaaggaucuuauuguuguggaccugacgcaaucuaacuuuccuaucuucgagaauccguaucccauggacauucaugaguccccugucaccuguacagcuuacuuugccgauugucccccugaccucauccuggugcuuuauagcauuggaguuaaacacaagaaacagggcuacucuaacaaggaauggcccaucuccgggggagcuuggaaucugggcgcccagaccuauccggagaucauuaucacagggcacgccgauggcagcauuaaauucugggacgcuuccgcgaucacccuccaaaugcuguacaagcugaagacgucuaaaguguuugaaaagcagaaagucggagagggcaagcagacaugcgaaauuguggaggaggauccuuucgccauccagaugauuuacuggugccccgaaagccggaucuuuugcgucuccggggugucugcuuauguuaucauuuacaaauucagcagacaugagaucaccaccgaaauugugucccucgagguccgccugcaauaugacguggaggauaucauuacaccugaacccgagaccagcccucccuuuccggaccuuucugcccagcugccuuccagccggucucucuccggaagcacaaacacgguugccucugaaggcgugaccaaggauagcauccccugucugaacgucaagacaagacccgugcgcaugccuccgggguaccaggcugagcuggugauccagcuuguuugggucgacggagaacccccucaacagauuaccucccucgccgugagcucugcguauggcaucguggcuuucgggaauugcaacggccuggccgucguggauuuuauucagaaaacaguucugcucuccaugggaaccaucgaccuguaccggagcuccgaccuuuaucagagacaaccccgcucuccucggaagaauaaacaguucauugccgauaacuuuuguaugagaggccugagcaauuucuaccccgaccucacgaagcgcauccggaccuccuaccagucucugacagagcugaacgauagcccugugccccuugagcucgaaagaugcaaauccccgaccucugaccacgucaaugggcauuguacaagcccuaccucccagagcuguucuuccggaaagcgccugagcucugcugauguguccaagguuaaccgguggggccccgggagaccucccuuccggaaagcccaaagcgcugccugcauggagaucucucugccggugacgacagaagagaaucgcgaaaacuccuauaauagaagccgguccagcucuauuagcuccaucgacaaggauucuaaagaggcgauuaccgcccucuacuuuauggacagcuucgcuagaaagaacgauuccacaaucucuccuugccuguuugucggaaccagccuuggcauggugcugauuaucucccucaaucugccccuggccgacgagcagcgcuucaccgaaccuguuauggugcuucccucugggacauuucucagccugaaaggcgcuguccugacguucuccuguauggaucggaugggaggccucaugcagcccccuuaugagguguggagagacccgaacaauaucgaugaaaacgaaaagagcuggcgcagaaaaguggucaugaacucuuccagcgccucucaagaaauuggggaccaccaguacaccaucauuugcuccgagaagcaggcgaagguuuuuagccugcccucccagacaugucuuuaugugcacaauaucaccgagacaucuuucauucugcaagccaacguggucgugaugugcagcuccgcuugccucgccuguuuuugcgcuaauggacauaucaugauuaugagccugccuucucugcggcccaugcuugacguuaacuaccucccucugaccgauaugcgcaucgccagaacguucuguuuuacaaaugaaggccaggcccuguaucucgugucccccaccgagauccagcggcugaccuacagccaggaaaugugcgacaaccuucaagauaugcugggggaccucuucacaccuauugagaccccggaggcucagaaucgcggauuucugaaaggccuguucgggggcucuggacagacauucgauagagaggaacuuuuuggcgaagcgagcgccgggaaggcuucccggucucuggcccagcacauccccggaccuggcagcauugaggggaugaaaggagccgcuggcggcgucaugggggaacucacgcgcgccagaaucgcgcuggacgagcggggacaacgccucggcgagcuggaagagaagaccgcugggaugaugacauccgccgaagccuucucuaaacaugcucacgagcuuaugcugaaguacaaggauaaaaagugguaucaguuuuga

SEQ ID NO: 76441 - RNA, 633 nt, Artificial Sequence
  derived and/or modified sequence opt5 from STXBP6__Homo_sapiens__NP_001291406
augagcgccaaguccgcuaucucuaaagagauuuucgcgccccuggacgaaagaaugcucggcgccgugcaggucaagcggcgcaccaaaaagaaaaucccuuuucuggcuacagggggacaaggcgaguaccuuacguauauuugccugagcguuaccaacaagaagccgacacaggccuccaucaccaaagugaagcaguucgaagggucuaccagcuuugugagacggucccaguggaugcucgagcaacugcgccaggucaauggaauugaucccaacggcgacucugccgaguucgaucuucuguuugaaaaugcuuucgaccaguggguggccagcacagcuuccgagaaauguacauuuuuccagauccuccaccauaccugccaaagauaccugacggaucggaagccugaauuuaucaacugucagagcaaaauuaugggaggcaauucuauccugcacuccgccgcggacagcguuaccucugccgugcagaaggcuucccaggcccucaacgagcgcggggaaagacugggccgggcugaggagaagacagaagaucuuaaaaauagcgcccaacaguucgcggagaccgcccauaagcuggcuaugaaacacaagugcuga

SEQ ID NO: 76442 - RNA, 1269 nt, Artificial Sequence
  derived and/or modified sequence opt5 from STYK1__Homo_sapiens__XP_005253474
augggcaugaccagaaugcugcucgagugcagccuguccgacaagcugugugugauccaggaaaaacaauacgaggucauuaucguucccacacugcucgugacgauuuuccugauccuucugggggugauucucuggcuguuuauccgggaacagcgcacccagcagcaaagaucuggaccucagggcaucgccccggugcccccuccccgggaucugagcugggaggcugggcacggaggcaacgucgcccucccucugaaggaaacauccguugagaauuuccuuggggcgaccacacccgcucuggccaaacuccaggugccucgcgagcagcugucugaaguccuugagcaaauuugcagcggauccuguggcccgaucuuuagagccaacaugaauaccggcgaccccucuaagccuaaaagcgugauucugaaggcucucaaggaacccgccgggcugcaugagguucaggauuuccugggacggauccaguuucaccaguaucucggcaaacauaagaaccuggugcaacuugaggggugcuguacagaaaaacugccucucuacaugguccuggaggacguggcucagggagaucuucuguccuuccucuggaccugccgcagagacgugaugacgauggauggccugcuguaugaccucaccgaaaagcaggucuaccacauugggaaacaaguucugcuugcccuggaguuucuccaggaaaagcaucuguuccacggagauguggcggcccggaauauccuuaugcagagcgaccugacagcuaagcucuguggccugggccuggccuaugagguguacacccgcggggcuauuucuuccacacagaccaucccccucaaauggcuggccccggagagacuucugcuccggccugcgagcauccgcgccgaugucuggucuuuuggcauucugcuguaugaaauggugacgcuuggagcucccccuuaccccgagguucccccuacauccauccucgaacaccuucaaagacggaagauuaugaaacgcccgagcucuugcacccauacaauguacuccaucaugaaaagcuguuggagauggcgggaggccgacagacccuccccucgcgaacugcggcucagacuggaggcugccauuaagaccgccgaugacgaggcugugcuucagguccccgaacuggugguuccugagcucuaugcggccguggcugggauccgcgucgaaucucuguucuacaacuauagcaugcuguga

SEQ ID NO: 76443 - RNA, 672 nt, Artificial Sequence
  derived and/or modified sequence opt5 from STYX__Homo_sapiens__NP_001124173
auggaggacgugaagcuggaguuccccagccucccucagugcaaagaagaugccgaagaguggaccuacccgaugagacgggaaaugcaagagauccugcccggccuuuuucuggggccuuauuccucugcuaugaaguccaaacuccccguccugcagaagcacggaauuacacauaucauuuguauccgccagaacauugaggccaauuucaucaaaccuaacuuucagcaacuuuucagauaccugguucucgacaucgcggauaaucccguggaaaacauuauccgguuuuucccuaugacgaaggaguuuauugacggcucccugcagaugggagggaaggugcugguccacggcaaugcugggaucucucgcagcgccgccuucgugauugcuuauaucauggaaaccuuuggaaugaaauacagagaugccuucgcuuauguucaggagcggcgcuuuugcauuaacccgaaugccggcuucgugcaucagcuccaagaguacgaagcgaucuaucuggccaaacuuacaauccagaugaugagcccccugcagauugagagaucucucagcguccacuccggcaccacagggagccugaagcggacccaugaagaggaagacgauuuuggaacaaugcaaguggcuaccgcccagaacggcuga

SEQ ID NO: 76444 - RNA, 384 nt, Artificial Sequence
  derived and/or modified sequence opt5 from SUB1__Homo_sapiens__NP_006704
augcccaagagcaaagagcugguguccucuagcuccucuggcagcgacuccgauucugaagucgacaagaaacucaagcggaaaaagcagguugccccugagaagccggugaaaaagcagaaaaccggggaaacaagcagagcucuguccagcucuaagcaauccucuagcucccgcgaugacaacauguuccagaucggaaaaaugagauacgugagcguccgggauuuuaagggcaaggugcuuauugacauccgcgaguauuggauggaucccgaaggggagaugaaaccuggaagaaagggcauuucucugaaucccgagcaguggucccaacucaaagaacagaucagcgacauugaugacgccguucggaagcuguga

SEQ ID NO: 76445 - RNA, 1392 nt, Artificial Sequence
  derived and/or modified sequence opt5 from SUCLA2__Homo_sapiens__NP_003841
auggccgcuagcauguucuacggcagacugguggccgucgcgacccuccggaaccaccgccccagaacagcucagcgggccgccgcucaaguucugggguccucuggacuuuuuaauaaccauggccuccaggugcagcagcaacagcagcgcaaucucagccugcacgaguauauguccauggaacuucugcaggaggccggggugucugucccuaagggauacguggcuaaaagcccggacgaagccuaugcgaucgccaagaaacucggcuccaaggauguugugauuaaagcucaaguccuggccgggggaagaggcaagggcacguucgagucugggcugaagggaggcgugaaaaucguuuuuagccccgaagaggcuaaggccguguccagccagaugauugggaaaaagcuguucaccaaacagacaggagagaagggccggaucugcaaccagguccuggugugugaacgcaaguacccuagacgggaguauuacuuugcgauuaccauggaacgcucuuuccaagggcccgugcuuaucggauccagccauggcggcgucaauaucgaggacguugccgcugagucuccugaagccauuaucaaagagcccauugauaucgaagaggggauuaagaaagaacaggcucugcagcucgcccaaaagaugggauuuccuccgaacaucguggaguccgccgcugagaauauggugaaacuguauagccuuuuccugaaguacgacgcgacaaugauugaaaucaaccccauggucgaggauucugacggcgccgugcucugcauggaugcuaaaaucaauuuugacuccaacagcgccuacagacagaagaagauuuucgaucugcaggacuggacccaggaagaugagcgggacaaagaugccgcuaaggccaaucugaacuauaucgggcucgacggaaauauuggcugucugguuaacggggcgggacuugcuauggccacaauggacaucauuaaacugcacggcggcaccccugccaauuuucucgaugucgggggaggcgcuacggugcaucaagugaccgaagccuucaagcugaucacauccgacaaaaagguucuugcuauccuggugaacauuuuugggggaaucaugcgcugcgaugucauugcccagggcaucgugauggcggucaaggaccucgagauuaaaauccccgugguugugagacugcaggggacccgggucgaugacgccaaggcucugaucgccgauucuggccucaaaauucuggcuugugacgaucuugacgaggccgcgcgcauggugguuaagcugagcgaaaucgugacacucgccaaacaggcucacgucgaugugaaguuccaacugccuauuuga

SEQ ID NO: 76446 - RNA, 1041 nt, Artificial Sequence
  derived and/or modified sequence opt5 from SUCLG1__Homo_sapiens__NP_003840
augaccgccacacuggcugccgcggcugacaucgccacgauggugagcggcuccucugggcucgccgcugccagacugcuuagccgguccuuccugcucccccagaacggcauucgccacugcucuuacaccgcuagcagacaacaucuguaugucgauaagaauacaaaaaucauuugucagggauuuaccgggaagcagggaacauuccacucccagcaagcccuugaguacggcaccaaacugguugggggaacaaccccuggcaagggcgggcagacgcaucucggacugccgguguuuaacaccgugaaagaagcgaaggagcagacaggcgccaccgcuucugucaucuaugugcccccucccuucgccgcugccgcgauuaaugaagccaucgaggcugaaaucccucugguugugugcauuacagaggggaucccccagcaagacaugguccgggugaagcacaaacuccugcgccaggagaagaccagacuuauuggaccuaacuguccgggcguuaucaaucccggggaaugcaaaauuggaaucaugccuggccauauucacaagaaaggccggaucgggaucgugagccgcuccggaacgcugacauacgaggccguccaccagaccacacaggugggccucgggcaaagccugugugugggaauuggcggggaucccuuuaacggaaccgacuucaucgauugccuugaaauuuuucugaaugacucugcuaccgagggcaucauucucaucggcgagaucgggggaaacgccgaagagaaugccgcugaauuucugaagcagcauaacuccggcccuaauagcaagcccgucguuucuuucauugcggggcugacagccccgccuggaagacggaugggccacgcuggggccaucauugccggcggaaaaggcggggcuaaggagaaaaucuccgcccuccagagcgcgggagugguggucucuaugucccccgcucaacugggcacgaccauuuauaaggaguucgaaaaacgcaagaugcuuuga

SEQ ID NO: 76447 - RNA, 1323 nt, Artificial Sequence
  derived and/or modified sequence opt5 from SUCLG2__Homo_sapiens__NP_001171070
auggccagccccguggcugcccaggcgggcaagcugcucagagcucuggcccuucggccucgcuuccuggccgcugggucccaagccguccagcucaccucuagacgguggcugaaccuucaggaguaccagagcaaaaagcugauguccgacaauggaguucgcgugcaaagauuuuucguggcugauacagccaacgaagcgcucgaggccgcuaaacggcugaaugccaaggaaaucguccugaaagcucagauucucgccggcgggcgcggaaagggcguguuuaacucugggcugaagggaggcguucaccuuacgaaagacccgaauguggucggccagcuggcgaagcagaugaucggguauaaccucgccaccaaacaaacacccaaggagggagugaaaguuaauaaggugauggucgcugaagcccuggauauuagcagagagaccuaccuugcuauccugauggaccgguccugcaacggcccugugcucguggggucuccccagggaggcgucgauauugaggaaguugccgccagcaauccugagcugaucuucaaggaacagaucgacauuuuugaggggaucaaagauucccaggcucaacgcauggcggagaaccugggauucgugggcccccucaagagccaggccgcugaccagauuacaaaacuguauaaucuuuuucugaagaucgaugccacccaaguggaagucaacccuuucggcgagacaccggaaggacaggugguuuguuuugacgccaaaauuaauuucgaugacaacgcugaguuuagacagaaggauaucuucgccauggacgacaaaucugaaaaugagcccauugagaacgaagcggcuaaguacgaucucaaguauaucgggcuggacggcaacaucgccugcuuugugaauggggccggacuugcuauggccaccugugauauuaucuuccugaacggcgggaaaccugcuaauuuccucgaccugggaggcggcgucaaggaggcccagguguaccaagcguuuaaacugcucacggccgaucccaagguugaagcuauucuggugaacaucuucgggggaauugucaauugcgccaucaucgcuaacggcauuaccaaagccugucgggagcuugaacugaaggugccucucgucgugcgccuggaggggacauuuauggagaagaaaggauccuauaugcauaucaagcaggaaaccggcaauagcaacgagaauauuacagggauccaggaaaacguugcgcaccagaaucuuucuaaaugcgccauuuccaucuuccuguguuga

SEQ ID NO: 76448 - RNA, 1005 nt, Artificial Sequence
  derived and/or modified sequence opt5 from SUCNR1__Homo_sapiens__NP_149039
augcugggcaucauggccuggaacgcuaccugcaagaauuggcucgccgcggaggcugcccuggaaaaauacuaucuuagcauuuucuacgggaucgaguuuguggucggaguucugggcaacacaauugugguguauggguacaucuucucccucaagaauuggaacucuagcaauauuuaucuguuuaaccuuuccgucucugaccuggccuuccucuguacgcugcccaugcugaucagaagcuacgcuaauggaaacuggaucuauggcgaugugcucugcauuuccaaucgguacguucugcacgccaaccuuuacaccucuauccuguuucucacauucauuagcaucgaccgcuaucugauuaucaaauacccuuuuagagaacaucuucugcagaagaaagaguucgcuauucucaucucccuggccaucugggugcuggucacccucgaacugcuuccgauucugccccucaucaauccugugauuacagauaacgggaccacauguaaugacuuugcgagcucuggagaucccaacuauaaucugaucuacuccaugugccuuacccugcucggcuuccugauuccucuguuuguuauguguuucuuuuauuacaagaucgcccucuuccugaagcaacggaaccgccagguggcuacggcccuuccccuggagaaaccucucaaccuggucaucauggcuguggugauuuucagcguccuuuuuaccccguaucacguuaugagaaaugugcggaucgccucucgccugggcuccuggaagcaguaccagugcacacaaguggucauuaacagcuucuacaucgugaccagaccccucgcguuucugaauagcguuauuaacccuguguucuauuuucugcucggggaccauuuccgggauaugcugaugaaucagcuucgccacaacuuuaaaucccugacaucuuucuccagaugggcccaugagcuccugcugucuuuucgggaaaaguga

SEQ ID NO: 76449 - RNA, 3765 nt, Artificial Sequence
  derived and/or modified sequence opt5 from SUCO__Homo_sapiens__NP_055098
augaagaaacacagacgggcccuggcucucgugagcugccuguuccuuuguucccuggucuggcuccccucuuggcgcguuugcuguaaggagagcuccucugccagcgcguccucuuacuauagccaggacgauaacugcgcucuggaaaaugaggacgugcaauuucagaaaaaggaugaaagagagggcccuaucaacgccgaaucccuugggaaaagcggaucuaaucugccgauuucccccaaggagcauaagcucaaagacgauagcaucguggacguccagaacaccgagucuaagaaacuguccccucccgugguugaaacacugccuacgguggaucuccacgaggaaagcucuaaugccgucguggacuccgagaccguugagaacauuagcuccucuagcacauccgaaaucacccccauuagcaagcuggaugagaucgaaaaaucuggcacaaucccuauugcuaagccguccgagaccgaacagagcgagacagacugugaugugggggaggcccuugacgcuucugcccccaucgaacaaccuagcuucgucucucccccugauucccuggugggacagcauauugagaaugugagcuccagccacggcaaggggaaaaucaccaagucugaauuugaguccaaagucagcgcgucugaacagggaggcggcgaccccaaguccgcccucaacgcuagcgacaaucugaaaaacgaguccucugauuacacgaagccgggggacauugauccuaccagcguugccucccccaaagacccugaggauauccccacauucgacgaauggaagaagaaagugauggagguggaaaaggagaaaucucagagcaugcaugcuuccagcaauggaggcucucacgccaccaagaaaguccaaaagaaccggaauaacuaugcguccguggaaugcggggccaagauucuugcugccaaucccgaggcuaaaagcacaucugccauccugaucgagaacauggaucucuacaugcugaacccuuguuccaccaagauuugguuuguuaucgaacugugcgagccgauucaggugaaacagcucgacaucgccaauuaugaacuguucagcucuacgcccaaggauuuucuugucagcauuuccgaccgcuacccuacaaacaaauggaucaagcugggaaccuuccacggcagagaugagcggaaugugcagagcuuuccccucgacgagcaaauguaugcuaaguacguuaaaauguucaucaaguacauuaaaguggaacugcuuucucauuuuggguccgagcacuucuguccucugagccucauccgcgucuuuggaacauccaugguggaagaguaugaagagauugcggacucucaguaccauagcgagagacaggaacuguucgaugaggacuaugauuacccccuggacuauaacaccggcgaagauaaguccucuaaaaaucuccugggcagcgccaccaacgcuauccuuaauauggucaacauugccgccaauauccugggggcuaagacagaggaccucacggaaggaaacaaguccaucucugagaaugccaccgcgacagcugccccgaaaaugccugagagcacccccguguccacaccuguucccagcccugaauacgugaccacggagguccacacacacgauauggaacccucuaccccggacaccccuaaggagucccccauugugcaacugguucaggaagaggaggaagaggccagccccucuacagugacccuucugggcuccggggaacaggaggaugagagcucuccuugguucgaauccgagacacagaucuuuugcagcgaacucacgaccauuuguugcaucuccagcuucucugaguauauuuacaaauggugcagcguccggguggcucuguaccgccaaagaucccggacagcccugucuaagggaaaagacuaucucgugcuggcucagccgccccuucugcucccugccgaaagcguugaugucuccgugcugcagccccugucuggcgagcuugagaacaccaauaucgaacgcgaggcggaaacagugguccucggggaccugagcuccucuaugcaucaggaugaccuggugaaccacaccguugacgccguggagcucgaaccuagccauucccaaacgcugagccagucucuucugcucgauauuacccccgagaucaauccucugcccaagaucgaggucuccgaaagcguggaguacgaagcuggacacauuccgucuccuguuaucccccaggaguccagcguggaaauugacaacgagacagagcagaaauccgaaucuuuuagcuccaucgagaagccuagcauuaccuaugaaacaaacaaggucaaugagcugauggauaacaucaucaaagaggacguuaauucuaugcaaauuuucaccaaacuuuccgaaacgaucgugcccccgauuaacacagccaccgugccugauaaugaggacggcgaagcuaaaaugaacaucgccgauacagcgaagcagacccucauuagcgucguggacucuagcucccugcccgaggugaaagaagaggagcagucuccugaagaugcccugcucagaggccugcagcggaccgcuacagacuuuuacgccgagcuucaaaauagcacggaucugggguaugcuaacggaaaucucguccauggcuccaaccagaaggaaucuguuuucaugcgccugaauaacagaaucaaggcccuggaggugaauaugagccuuuccgggcgguaccucgaggaacugagccagagauaucgcaaacaaauggaggaaaugcagaaggccuuuaacaaaaccaucgugaagcugcagaauacaucucggauugcugaggaacaggaccaaagacagaccgaggcgauccagcuccugcaggcccaacuuacaaacaugacccagcuggucuccaaccucagcgcuacgguggccgaacugaaacgcgagguuuccgaucggcagucuuaccuggugauuagccuuguccucugugugguucugggacugaugcucugcaugcagagaugucgcaauacaucccaauucgacggcgacuacaucucuaagcugcccaagagcaaccaguaucccuccccuaaacggugcuuuagcucuuacgaugacaugaaucuuaagagacgcaccuccuucccgcugaugcggagcaaaucucuccagcugaccgggaaggagguggaucccaacgaccuguauauugucgaaccucuuaaauuuucccccgagaagaagaaaaagagauguaaauacaagaucgaaaagaucgagacaauuaagccugaggaaccccugcacccuaucgccaauggcgauauuaaaggacgcaagccguucaccaaccaacgggacuuuagcaauaugggcgagguguaucacucuagcuacaaggggcccccuuccgaaggaucuagcgagacauccagccaguccgaagagucuuauuucugcggcaucagcgcuuguacgucccucugcaacgggcagucucagaaaaccaagacagagaaaagagcccugaagcggcgcagaagcaaaguucaagaucagggaaagcucauuaagacccugauccagacaaaauccggcucucuucccagccugcaugacauuaucaaggggaauaaagaaaucaccgugggcacguucggagucaccgcgguguccggccacauuuga

SEQ ID NO: 76450 - RNA, 987 nt, Artificial Sequence
  derived and/or modified sequence opt5 from SUDS3__Homo_sapiens__NP_071936
augagcgccgcuggccugcucgcccccgcgccugcucaggccggggccccgcccgcuccugaguacuaucccgaagaggacgaggaacuggaauccgccgaggaugacgagagaucuugccggggacgcgaaagcgaugaggacaccgaagaugcuuccgagacagaccuugccaagcacgaugaggaagacuacguggagaugaaagaacaaauguaucaggauaagcuggcgucucucaaaagacagcugcagcaacuucaggagggcacgcugcaggaauaccagaagcggaugaaaaagcucgaccaacaguauaaggagcgcaucagaaacgccgagcuguuccugcagcucgaaaccgagcaggucgaacggaauuacauuaaagagaagaaagcugccguuaaggaauuugaggauaaaaagguggagcugaaggaaaaccuuaucgcugagcuggaagagaaaaagaaaaugauugaaaaugagaagcucacaauggagcugaccggggacagcauggaagugaaaccuaucaugacacgcaaacuuagacggcgccccaacgauccugucccgauucccgacaagagacggaagccugcccccgcgcaacugaauuaucuccugaccgacgagcagaucauggaagaucugcgcacacucaacaagcugaaauccccuaagagacccgccucuccgagcuccccugagcaucuucccgcuaccccugccgagagccccgcucagcgguucgaagcccgcaucgaggacggaaaacuguacuacgauaagagaugguaucacaaaucucaagccauuuaccucgaauccaaggacaaucagaagcugagcugugugaucucuuccguuggcgcuaacgagauuugggugcggaaaacgagcgauucuaccaagaugagaaucuaucuugggcagcugcagcgcggacucuuugucauucggagacgcuccgcggccuga

SEQ ID NO: 76451 - RNA, 1302 nt, Artificial Sequence
  derived and/or modified sequence opt5 from SUFU__Homo_sapiens__NP_001171604
auggccgagcugagacccagcggcgcuccugggccgaccgcgcccccugcccccggaccuacagcucccccugccuucgccucccucuuuccgcccggccugcacgcuaucuacggggaaugccggcgccuuuauccugaccagcccaacccucugcaagugacggccauugucaaguacuggcucggaggccccgauccgcuggacuauguuucuauguacagaaauguggggagcccuuccgcuaacauccccgagcauuggcacuauauuucuuucggacuuagcgaucuguacggcgacaaucgggugcaugaauuuaccggcacagaugggccuuccggauucggcuuugagcucaccuuccgccugaaaagagaaacaggggagucugccccucccaccuggcccgcggagcugaugcagggacucgcccgguaugucuuucagagcgaaaacacauucuguuccggcgaccacgugagcuggcauucuccgcuggauaauuccgagagccgcauccagcacaugcuucugaccgaagacccccaaaugcagccuguucagacgcccuuugggguggucaccuuccuccagauugugggaguuugcacagaggagcugcacucugcucaacaguggaacggccagggcauccuugaacugcucagaaccgugccuaucgccgggggacccuggcugauuacagauaugcggcgcggcgagaccaucuuugaaauugacccgcaucugcaggagagagucgauaaggggaucgaaacggacggauccaaucucagcggcgugucugcuaaaugugccugggaugaccugucccggccucccgaggacgaugaggacagccgcuccauuugcaucgggacacaaccuagacggcuuucuggaaaggauaccgaacagauucgcgagacacugagacggggccucgaaaucaacagcaaacccgugcugccucccaucaauccgcagagacaaaacggccuugcgcacgaccgcgccccuucccggaaggauagccuggagucugacuccagcaccgcuauuaucccccaugaacucauuagaacccgccagcuggagucuguccaccugaaguucaaucaggagagcggggcccucaucccccugugucuucggggaagacugcuccacggccgccauuuuacauacaaauccauuacgggggauauggcuaucaccuucguuucuacaggaguggaaggcgccuucgccaccgaggaacacccuuacgcugcgcaugggccguggcugcagcuuuga

SEQ ID NO: 76452 - RNA, 1416 nt, Artificial Sequence
  derived and/or modified sequence opt5 from SUGCT__Homo_sapiens__NP_001180240
augcccagcgagacccacgccaugcuggcuacacucgccagaguggcggcucugcggcgcacgugccuuuucuccggcagagggggaggccgggggcuguggaccggacgcccucagucugacaugaacaauaucaagccgcucgaaggcgucaaaauucuggaucuuacaagaguucuggccgggcccuuugccaccaugaaccucggagaccugggcgcugaggugaucaagguggaacggccuggcgccggggaugacacacgcaccuggggacccccuuucgucggcacagagagcaccuacuaucuguccgugaauagaaacaaaaagucuauugcuguuaauaucaaagaucccaagggggugaagauuaucaaagaacucgccgcggucugugacguguuuguugagaacuacgugccuggaaagcugagcgccaugggccuuggguaugaggauaucgacgaaauugcuccgcauaucauuuacugcuccaucacgggauauggccaaaccggccccauuucucagcgggccggguacgaugcugucgccagcgcgguguccggacugaugcacaucacaggcccugagaauggggaccccgugcgcccuggagucgccaugaccgaucucgcuacaggccuguaugccuacggggcuauuauggccggacuuauccagaaauacaagaccggcaaaggccuguucaucgacuguaaccuccugagcucucagguugccugccugucccauauugcugcgaauuaucucaucgggcaaaaggaagccaagagauggggaacggcucacggcagcauugugcccuaccaggccuuuaaaacaaaggauggguauaucguggucggagccggcaacaaucagcaguucgcuaccguguguaaaauucuggaccuuccggagcugaucgacaacucuaaguacaaaacaaaucaucuccggguucacaaccgcaaggagcugaucaaaauucuuuccgaaagauuugaggaggaacugaccagcaaguggcucuaucuguucgaagggucuggcgugccuuacggacccaucaauaacaugaagaacgucuuugccgagccucaaaaugcgguguccggcuuccagagccugcuccacucccuggcucaugggcccuuucuucaucugcagggaucugcccggguucuccacaacggccuggugauggagauggaacaccccaccgucgggaaaauuagcgugccuggaccggccguccgcuauuccaaguucaaaaugagcgaggcuagacccccuccccuucugggccagcacacaacgcauauccucaaggaagugcugcgguacgaugacagagccauuggggagcugcucucugcuggcguuguggaucaacacgaaacccauuga

SEQ ID NO: 76453 - RNA, 1938 nt, Artificial Sequence
  derived and/or modified sequence opt5 from SUGP1__Homo_sapiens__NP_757386
augagccugaagauggacaacagagauguggccggcaaagcuaaucggugguucggggucgcgcccccuaaguccggaaaaaugaacaugaauauccuccaccaggaggaacugauugcccaaaagaaacgcgagaucgaagcuaagauggagcagaaggccaaacagaaccagguugccucuccgcaacccccucaucccggcgaaauuaccaaugcucacaacagcuccugcaucucuaauaaguuugccaacgacgggagcuuccuucagcaguuucugaaacuccagaaggcucaaacauccacggaugccccuaccucugcgcccagcgccccuccguccacacccaccccuagcgcuggaaaaagaucucugcuuauuucccggcgcacaggccuggggcucgccagccugcccggaccugugaagucuuacucccaugcuaagcagcugcccguggcccacagaccgagcgucuuccagucuccugacgaggaugaggaagaggacuaugaacaguggcucgagaucaaaguguccccucccgagggcgcggaaacccggaagguuaucgagaaacuggcccgcuuuguggcugaaggcgggcccgagcuugaaaaggucgccauggaggauuacaaagacaaucccgcuuucgccuuucugcaugauaagaacagcagagaguuccucuauuaccggaaaaagguggccgaaauucgcaaggaggcucaaaaaucccaggcggccucucagaagguuagcccuccggaagacgaggaagugaaaaaucuggcugagaaacuugccagauuuaucgccgauggaggccccgaggucgaaacaauugcucugcaaaacaaucgggagaaccaggccuucuccuuucucuaugaaccuaauagccagggguacaaauauuaccgccagaagcuggaggaguucagaaaggcgaaggcuucuuccaccggcagcuuuacggcccccgacccuggacugaagcggaaaucucccccggaagcccucagcgggucccugccucccgcuaccacauguccugccucuagcacccccgcuccuacaaucauucccgccccggcggccccuggaaagcccgcuuccgccgcuaccgugaaacgcaagagaaagagccgguggggccccgaggaagauaaaguggagcuuccuccggccgaacugguccaaagagacguugacgcgucucccuccccucucagcgugcaggaucugaagggccuuggguacgagaaaggaaagcccgugggccuggucggggugacggagcucucugacgcccagaaaaagcagcugaaggaacaacaggagaugcagcagauguaugauaugaucaugcaacacaaacgcgcuaugcaggacaugcagcugcucugggaaaaggccguucagcaacaccagcauggauacgauuccgacgaggaaguggauagcgagcugggcacaugggagcaccagcuucggagaauggaaauggacaaaacccgcgagugggcugaacaacugacaaagauggggcggggaaaacauuucauuggcgauuuccucccucccgacgagcuggaaaaguuuauggagaccuucaaagcccuuaaggagggcagagaaccugauuauuccgaguacaaggaauuuaaacugaccgucgagaacaucggguaucagaugcucaugaagaugggauggaaagaaggcgaggggcugggaucugagggccaggggaucaagaaccccgugaauaaaggcacaacgaccguugacggagccggcuucgggauugaccgcccggcugaacugagcaaggaggaugacgaauacgaggcguuucggaagagaaugaugcucgccuaucgcuuccggccuaacccccugaauaacccuagacgccccuacuacuga

SEQ ID NO: 76454 - RNA, 1098 nt, Artificial Sequence
  derived and/or modified sequence opt5 from SUGT1__Homo_sapiens__NP_001124384
auggccgcugccgcggcuggcaccgccacaagccagagauucuuucaauccuucucugacgcccugaucgaugaggacccccaggcugcccucgaggaacugacgaaggcucuugaacagaaaccugaugacgcccaguacuauugccaacgggcguacugucacauucugcucgggaacuauugcguggccgucgcugaugccaagaaaagccuggagcuuaauccgaacaauuccaccgcuaugcugcgcaagggaaucugugaauaccaugagaaaaacuaugccgcggcccucgagacauuuaccgaaggccagaagcuggacauugagacaggguuccacagaguuggacaggcuggccugcagcuccugaccucuagcgaucccccugcccuugacucccaaucugcugggaucacaggagccgaugccaauuuuagcguguggauuaagcggugccaggaagcucagaacggcuccgagagcgagguguggacccaucagucuaaaaucaaguacgacugguaucaaacggaaucccaggucgugaucacccugaugauuaaaaauguucagaagaacgaugugaaugucgaguucagcgaaaaagagcucucugcgcuggugaaacuucccuccggcgaagacuacaaccugaagcucgagcugcugcacccuaucauucccgagcaaagcacauuuaagguucucucuaccaagaucgaaauuaaacugaagaaaccugaggccgugcgcugggaaaaacuugaggggcagggagaugucccgacacccaagcaguucguggcugacgugaagaaucuguacccuuccagcucccccuauaccagaaacugggacaagcucgucggcgaaaucaaagaggaggaaaagaaugagaaacuggaaggggaugccgcccuuaaccggcuguuucagcaaauuuacucugacggaagcgaugagguuaagcgcgcuaugaauaaauccuucauggaaagcggcgggacggugcucucuacaaacugguccgacgugggaaagagaaaggucgagaucaacccucccgaugacauggaguggaaaaaguauuga

SEQ ID NO: 76455 - RNA, 2616 nt, Artificial Sequence
  derived and/or modified sequence opt5 from SULF1__Homo_sapiens__NP_055985
augaaguacagcugcugugcccuggugcucgcuguccugggcaccgagcuucuggggucccucugcucuacaguuagaagcccccgguuccgcggaagaauccagcaagaacggaaaaacauucgcccuaauaucauucuggugcuuacggacgaucaggacguggagcugggcucccuccaggucaugaacaagaccagaaaaaucauggaacacgggggagccacauuuauuaaugcguucgugaccacaccgauguguugccccucucggagcuccaugcugaccggcaaguauguucauaaccacaauguguacacaaacaaugagaacuguucuagcccuuccuggcaggcuaugcaugaaccccgcaccuuugccgucuaucugaauaacacgggguacagaaccgccuucuuuggaaaauaucucaaugaguacaacggcagcuauaucccucccggcuggcgggaguggcuggggcuuaucaaaaauucucgcuucuacaacuacacagugugcagaaauggaauuaaggaaaaacacggcuuugauuaugcuaaggacuacuucaccgaucugaucacaaacgaguccauuaacuauuuuaaaaugagcaagcggauguacccucaucgcccgguuaugauggugaucucucacgccgcuccccacgggccugaagacuccgcgccccaauucagcaaacucuauccuaaugccucucagcauauuacccccuccuacaacuaugccccgaauauggauaagcacuggaucaugcaguacacgggaccuaugcugcccauucauauggaguuuacaaacauccuucagagaaagcggcugcaaacccucaugagcgucgacgauuccguggagcgccuguacaauaugcugguggaaacaggcgagcucgaaaacaccuauaucauuuacaccgcugaccacggguaucacaucggacaguucggccuggucaaaggcaagucuaugccuuacgauuuugacauuagaguucccuucuucauccgggggcccagcguggagccuggauccauugugccgcagaucguccuuaauaucgaucuggcccccacaauucucgacaucgcuggccuggacacgccucccgauguggacgggaaaagcguucuuaagcugcucgauccugaaaaacccggaaacagauuucgcaccaauaagaaagccaagauuuggcgggacacauuccugguggagagaggcaaguuucugcgcaaaaaggaggaaucuuccaaaaacauccagcaaagcaaucaucucccgaaguaugagcgggucaaagaacugugucagcaggcgagauaccaaaccgccugcgagcagccugggcagaaguggcaguguauugaagauacaucuggaaaacuucgcauccacaaaugcaagggccccagcgaccugcucaccgugcggcaauccacgagaaaccuguaugcucgcggcuuccaugauaaagacaaggaguguucuugccgggagagcggguacagagccucccgcagccagcggaaaucucagagacaguuucuucggaaucaaggaacaccuaaguacaagccccgcuucguucacaccagacagacccggucccugagcguggaauuugagggcgaaaucuaugauauuaaccucgaggaagaggaggaacugcagguccugcagccuagaaauaucgcuaaacgccaugacgaggggcacaagggaccccgggaucuccaagccucuuccggcgggaacagaggccgcaugcuggccgacagcuccaacgcugugggaccgccuacaaccgucagagugacacacaaaugcuucauucuucccaaugacucuauccauugugaacgggagcuguaccagagcgcgcgcgccuggaaggaucacaaggcuuauauugacaaggagaucgaagcccuccaggauaagauuaaaaaccugagagagguucggggccaucugaagcgcagaaaacccgaagagugcuccuguucuaagcagagcuacuauaauaaagaaaagggggugaaaaagcaagagaaacuuaagucccaccuccacccuuuuaaggaggccgcucaggaagucgacagcaaacugcagcuguucaaggagaacaaucggcgcagaaagaaggaacggaaggagaaacgcagacaacggaagggagaagagugcucucucccgggccugacguguuuuacccaugauaacaaucacuggcagacagcccccuucuggaaccuuggguccuuuugcgcguguaccagcucuaauaacaauacauacuggugccugagaaccgugaacgagacgcauaauuuccucuucugugaauuugcuaccggauuccuggaguauuuugacaugaacacagauccuuaccagcugaccaauacaguucacaccguggaacgcggcauccuuaaccagcuccauguccaacugauggagcugcgguccugccagggguacaaacaguguaaccccagaccuaagaaucucgacgugggcaacaaagauggaggcagcuaugaccugcaccgcgggcagcuuugggauggaugggaaggcuga

SEQ ID NO: 76456 - RNA, 2613 nt, Artificial Sequence
  derived and/or modified sequence opt5 from SULF2__Homo_sapiens__NP_061325
auggggcccccuagccuggugcucugccugcuuuccgccaccgucuucucucugcucggcggaagcuccgcuuuucugucucaccauagacuuaagggccgguuccagcgcgacagacggaacauccgcccgaauauuauccugguucucacagaugaccaagauguggagcuggggagcaugcaagugaugaacaaaacgagacggauuauggaacagggaggcgcccacuuuaucaaugcguucgucaccacacccauguguugcccuucccgcucuagcauucugaccgggaaguacgugcauaaccacaauacauauaccaacaaugagaacuguuccagccccucuuggcaggcucagcaugaauccagaacauuugccguuuaccucaauagcaccggauaucggacggccuucuuuggcaaauaccugaacgaguauaauggcucuuacgugccucccggguggaaggaaugggucggacuucugaaaaacucccgcuucuauaauuacacccucugcagaaacggcgugaaggagaagcacgggagcgacuacucuaaagauuaucugacagaccuuaucaccaaugauuccguuagcuuuuuccggacauccaagaaaauguacccucaccgcccggugcugauggucaucucucaugcugccccucacggacccgaggacagcgcuccccaguauuccagacucuuuccuaacgccagccagcauauuacccccucuuacaacuaugcgccgaauccugauaagcacuggaucaugcgguacacgggccccaugaaaccuauucacauggaguucacaaacaugcugcagcgcaagagacugcaaacccucauguccguggacgauagcauggaaacaaucuauaauaugcugguggaaaccggggagcuugacaacaccuacauugucuacacagccgaucauggauaucacaucggccaguuuggccugguuaaggggaaaucuaugcccuacgaguucgacauucgggugcccuucuaugugagaggaccuaaugucgaagcuggcugucucaacccgcauaucgugcugaauaucgaccuugcccccacgauucuggauaucgcugggcucgacauuccugccgauauggacggaaagagcauccugaaacugcucgauaccgagcgccccguuaaccgguuucaccugaagaaaaagaugagaguguggcgcgacuccuuccuugucgaacggggcaaacugcuccauaagagagauaaugacaagguggaugcgcaggaggaaaacuuucugccuaaauaccagcgcguuaaggaccuuugccaacgggccgaguaucagacagcuugugagcagcuggggcaaaaauggcagugcguggaagaugccaccggaaagcucaaacugcacaaguguaagggccccaugagacugggcgggucucgcgcucucagcaaucuggucccgaaauacuauggacagggcuccgaggccugcacaugugacagcggggacuacaaacuuucucuggccggacggagaaagaaacucuucaaaaagaaguacaaggcuuccuaugugcgcagccggucuauuagauccgucgcgaucgaaguggauggccggguuuaccacguggggcugggcgacgccgcucagccucgcaaccugaccaagagacauuggcccggagccccugaggaucaagacgauaaagacggcggggauuuuagcggaacgggcgggcuucccgacuauuccgccgcuaauccuaucaaggucacacaccggugcuacauucucgaaaacgauaccgugcagugcgaccuggaucuguauaaaucucuccaggccuggaaggaccauaagcugcacaucgaucacgagauugagacccuucagaauaaaaucaagaaccugagagaaguucgcggacaucucaaaaagaaacggcccgaggaaugugacugccacaagauuagcuaccauacacaacacaaaggcagacugaagcaucgcggguccucucugcacccguucagaaagggccuucaggagaaagacaagguguggcuccugcgggaacagaaacgcaagaaaaagcugagaaagcuccugaaacggcuucagaacaaugauaccuguagcaugccuggacugacaugcuuuacgcacgacaaccaacauuggcagaccgcgcccuucuggacacucggccccuuuugugcuugcaccuccgccaauaacaauacauauugguguaugcgcaccaucaacgagacgcacaauuuccuguuuugcgaguucgccaccggguuucuggaauacuucgaucuuaacacagacccuuaccagcucaugaaugcugucaacacccuggauagagacgugcugaaucagcuccaugugcaacugauggagcuucggagcuguaagggauauaaacagugcaacccgcgcacaagaaauauggaucugggccucaaggacgggggaucuuacgaacaguaucggcaauuccagcgcagaaaauggcccgagaugaagcggccuuccagcaagucucugggccagcugugggaggggugggaaggcuga

SEQ ID NO: 76457 - RNA, 888 nt, Artificial Sequence
  derived and/or modified sequence opt5 from SULT1A1__Homo_sapiens__NP_803878
auggagcugauccaggacaccagcagacccccucucgaauacgugaagggcgucccgcugauuaaauauuucgccgaggcucuugggccccugcaauccuuucaggcccggccugaugaccuccugaucucuacauaccccaagagcggaacgaccuggguuucccagauucuugauaugaucuaucagggcggggaccuggaaaaaugccaccgcgcgccuauuuucaugagagugcccuuucucgaguucaaggcuccuggaaucccgucuggcauggaaacacugaaagauacccccgccccucggcugcucaagacacaucugccccuugcccugcucccucaaacccugcuugaccagaaggugaaagucguguacguugcucgcaacgccaaggauguggcugucagcuauuaccacuuuuaucauauggccaaagugcaccccgagccggggacaugggacuccuuccuggagaaguuuaugguuggagaagugucuuacggcagcugguaccagcauguccaggaguggugggaacucuccagaacccacccugugcuguaucuguucuacgaggauaugaaagagaaucccaagcgggaaauccaaaagauucucgaguuugugggccgcagccugccugaagagacggucgacuucguugugcagcacaccucuuuuaaagaaaugaagaaaaaccccaugacaaauuauaccacagugccccaggaguucauggaucauuccaucagcccuuuuaugagaaaggggauggcgggagacuggaaaaccacguucacagucgcccagaacgagcgguucgaugcugacuacgccgaaaagauggcuggcuguucucuuuccuuucgcagcgagcuguga

SEQ ID NO: 76458 - RNA, 888 nt, Artificial Sequence
  derived and/or modified sequence opt5 from SULT1A2__Homo_sapiens__NP_803564
auggagcugauccaggacauuagcagacccccucucgaauacgugaagggcgucccgcugaucaaauauuucgccgaggcucuugggccccugcaauccuuucaggcccggccugaugaccuccugauuucuaccuaccccaagagcggaacaacguggguuucccagauccuugauaugauuuaucagggcggggaccuggaaaaaugccaccgcgcgccuaucuucaugagagugcccuuucucgaguucaaggugccuggaaucccgucuggcauggaaacccugaaaaacacacccgcuccucggcugcucaagacccaucugccccuugcccugcucccucaaacacugcuugaucagaaggucaaagugguuuacguggcccgcaaugcuaaggacgucgccgugagcuauuaccacuuuuaucauauggcuaaaguuuacccccacccggggaccugggaguccuuccuggagaaguuuauggccggagaagugucuuacggcagcugguaucagcauguccaggaguggugggaacucuccagaacacacccugugcuguaccuguucuaugaggauaugaaagagaaccccaagcgggaaauucaaaagauccucgaguuugugggccgcagccugccugaagagaccgucgaccuuaugguugaacacacgucuuucaaagagaugaagaaaaaucccaugaccaacuacacaaccgugagacgggaguuuauggaucauuccauuagccccuucaugcgcaaggggauggcgggagacuggaaaacaaccuuuacgguggcccagaaugaaagauucgaugcugacuaugccgagaagauggcuggcuguucucuguccuuccggagcgaacucuga

SEQ ID NO: 76459 - RNA, 888 nt, Artificial Sequence
  derived and/or modified sequence opt5 from SULT1A4__Homo_sapiens__NP_001017390
auggagcugauccaggacaccagcagacccccucucgaauacgugaagggcgucccgcugauuaaauauuucgccgaggcucuugggccccugcaauccuuucaggcccggccugaugaccuccugaucaacacauaccccaagucuggaacgaccuggguuagccagauucuugauaugaucuaucagggcggggaccuggaaaaaugcaaucgcgcgccuauuuacgugagagugcccuuccucgaggucaacgauccuggagaaccguccggccuggagacacugaaggacacacccccuccccggcucaucaaaucucaucugccucuugcucugcucccccaaacccugcuugaucagaaggugaagguuguguaugucgcccgcaauccgaaagacguggccguuagcuacuaucacuuucacagaauggagaaggcucauccugaacccgggaccugggauuccuuccuggagaaauuuauggccggagaagugucuuacggcagcugguaccagcacguccaggaguggugggagcucucccggacacauccugugcuguaucuguucuacgaagacaugaaggagaaccccaaacgcgaaauccaaaagauucucgaguuugugggcagaagccugcccgaagagaccauggauuucaugguccagcacacgucuuuuaaggagaugaaaaagaauccuaugaccaacuauacaaccguuccgcaggaacuuauggaccacuccaucagccccuucaugcggaaagggauggcuggagauuggaagacaaccuuuacgguggcccagaaugagcgcuucgacgcggacuacgccgagaaaauggcuggcuguucucuguccuuuagaagcgaacucuga

SEQ ID NO: 76460 - RNA, 891 nt, Artificial Sequence
  derived and/or modified sequence opt5 from SULT1B1__Homo_sapiens__NP_055280
augcugagccccaaggacauccucagaaaagaucugaaacuugugcacggcuacccuaugaccugcgccuucgcuuccaacugggagaagauugaacaguuucauucucggccggacgauaucgucauugccacauaucccaagagcgggacgaccuggguuuccgagaucauugacaugauccugaaugauggagacaucgaaaaauguaagcgcggcuucauuacagagaaggugccuaugcucgaaaugacccugcccgggcuuagaacaucuggaaucgagcaacuggagaaaaacccuagcccccggauugugaagacccaccucccuacagaucugcugccgaaauccuuuugggaaaauaacugcaagaugaucuaccucgcgcgcaaugcuaaagacgucucugugagcuauuaccauuucgaucugaugaacaaucuucagcccuuuccuggcaccugggaggaauaucuggagaaguuccucacggggaagguugccuacggauccugguuuacccacgugaaaaacugguggaagaaaaaggaggaacaucccauucuguuccuuuauuacgaggacaugaaagaaaauccuaaggaggaaaucaaaaagauuaucagauuucuggagaagaaccucaaugaugagauccuggaccggauuauccaccacaccagcuucgaagucaugaaagauaacccccuggugaauuacacacaucucccgacaaccguuauggaccacucuaaguccccuuuuaugcgcaaaggcacggccggcgacuggaagaacuauuucacaguggcucagaaugagaaauuugaugccauuuacgaaaccgagaugagcaagacagcucugcaguucagaaccgaaaucuga

SEQ ID NO: 76461 - RNA, 891 nt, Artificial Sequence
  derived and/or modified sequence opt5 from SULT1C2__Homo_sapiens__NP_001047
auggcccugaccagcgaccucggcaagcagaucaaacugaaggagguggaagggacacuucugcaacccgcuacggucgauaacuggucccagauucagucuuucgaggccaaaccugacgaucuccugaucugcaccuacccgaaggcgggaacaaccuggauucaggaaaucguugacaugauugagcaaaauggcgauguggaaaaaugucagagagcuaucauccagcaccggcaucccuuuauugagugggcccgcccuccccagccuagcgggguggagaaggccaaggcuaugcccuccccuagaauccuuaaaacacaccugucuacccaacuccugccgcccagcuucugggaaaacaauugcaaguuucuguaugucgcccggaacgcuaaagacuguaugguguccuacuaucauuuccagcgcaugaaucacaugcucccugaucccggaacaugggaggaauacuuugagaccuucauuaacggcaagguugugugggggucuugguuugaccaugucaaaggauggugggagaugaaggauagacaccagauccuguuccuguuuuaugaagacauuaagcgggauccuaaacacgagauccgcaaggugaugcaguucaugggcaaaaagguugacgaaacggugcuugauaaaauuguccaagagaccagcuuugaaaagaugaaagagaaucccaugacaaacagauccaccgugagcaagucuauccucgaccaguccaucagcucuuucaugcggaagggcacagugggggacuggaaaaaucauuuuaccgucgcccagaacgagcgcuucgaugaaauuuacagacggaagauggagggaacguccaucaauuucugcauggaacuguga

SEQ ID NO: 76462 - RNA, 885 nt, Artificial Sequence
  derived and/or modified sequence opt5 from SULT1E1__Homo_sapiens__NP_005411
augaacagcgagcuggacuacuaugaaaaguucgaggaagugcacggcauccucauguacaaagauuuugucaaguauugggacaauguugaggccuuccaggcuagacccgaugaccuggugauugccaccuacccuaaauccgggacaacgugggugucugaaaucgucuauaugauuuacaaggagggagauguggagaaaugcaaggaagacguuaucuuuaaccggauuccguuccuugagugucgcaaggaaaaucugaugaacggcgugaaacaacucgaugagaugaauagccccagaaucgucaagacccaucugccucccgagcuucugccugcguccuuuugggaaaaagacugcaagaucauuuaucucugucggaacgcuaaagauguggccguuucuuucuacuacuuuuuccugaugguggccgggcaccccaauccuggcagcuuuccggaguucgucgaaaaguuuaugcagggacaggugcccuauggguccugguacaagcaugugaaaucuuggugggagaagggaaaaagcccucgcguccuguuccucuuuuaugaagaccugaaggaggauaucagaaaagagguuauuaaacuuauccacuuccuggaacggaagcccuccgaggaacucguggaccgcauuauccaucacaccagcuuccaggagaugaagaacaauccuucuacaaacuacacaacccugcccgaugaaauuaugaaucaaaaacuuuccccguuuaugagaaagggcaucacaggcgacuggaagaaccacuucaccguggcucugaaugagaaauuugacaagcauuaugagcagcagaugaaagaaagcacgcucaaguuccggaccgagaucuga

SEQ ID NO: 76463 - RNA, 858 nt, Artificial Sequence
  derived and/or modified sequence opt5 from SULT2A1__Homo_sapiens__NP_003158
augagcgacgauuuccugugguuugagggcaucgccuuccccaccaugggguuuagauccgaaacacuccggaaggugcgcgacgaguucgucauuagagaugaagacguuaucauucugacguacccuaaaucuggaaccaacuggcuugcugagauccugugccucaugcacagcaagggcgaugccaaauggauucaguccgugccgaucugggaacggucucccuggguggagagcgagaucggguauacagcgcuguccgaaaccgagucuccucgccuuuuuagcucccaucugcccauucaacucuucccuaagagcuuuuucucuuccaaagcuaaggucaucuaccugaugagaaauccccgggacgugcugguuagcggauacuuuuucuggaagaacaugaaauuuauuaagaaaccuaagucuugggaagaguauuucgagugguuuugucagggcacagugcucuauggguccugguucgaucacauccauggauggaugccgaugcgcgaagagaaaaauuuccugcuucugagcuacgaggaacucaagcaggacaccggcagaacaauugaaaagaucugccaguuucugggcaaaacccuugagcccgaggaacugaaccucauucugaaaaauucuuccuuccaaagcaugaaggagaacaagauguccaauuauucucugcucagcgucgauuacgugguugacaaagcccagcugcuucggaaggggguguccggagauuggaaaaaccacuuuacggucgcccaggcugaagacuucgauaagcuguuucaggagaagauggccgaccucccucgcgaacuguuccccugggaguga

SEQ ID NO: 76464 - RNA, 1053 nt, Artificial Sequence
  derived and/or modified sequence opt5 from SULT2B1__Homo_sapiens__NP_004596
auggccagcccucccccguuccacucccagaagcugcccggcgaguacuuuagauauaaaggggugccuuuccccgucggacucuacucucuggaaagcaucucccuugcugagaacacccaagacguucgggaugacgauauuuuuaucauuacauauccuaagucuggcacgaccuggaugaucgaaauuaucugccugauccucaaagagggggaccccagcuggauucgcuccgugccuaucugggaaagagccccguggugugagacaauugugggagcguucucucugcccgaucaguacagcccucggcuuauguccagccaucugcccauccagauuuuuaccaaggcuuucuuuucuuccaaagccaaggucaucuauaugggccgcaauccuagagacgugguugugagccucuaccacuauucuaagauugccgggcagcugaaagaucccggaacaccggaccaauuccugcgggauuuucucaagggcgagguccaguucggcuccugguuugaccauaucaaaggguggcugcgcaugaagggaaaagauaacuuccuuuuuaucaccuacgaggaacugcagcaggaccuccaaggcagcguggaaagaauuugcggguuccugggacggccucuuggcaaggaggcucuggggucuguuguggcccacuccacauucagcgcuaugaaggccaauaccauguccaacuacacgcuccugcccccuucucugcucgaucaucgcagaggagcguuucugcggaaaggcgucuguggcgacuggaagaaucacuucaccguggcccagagcgaggcuuuugaccgcgccuauagaaaacagaugcgggggaugcccacauuccccugggaugaagacccugaggaagauggauccccggaccccgagccuagccccgaaccugagcccaagccgucucuugagccuaacaccucccuggaacgcgagcccagaccuaauagcucucccagcccuucccccggccaggcuucugaaacaccgcacccucggcccagcuga

SEQ ID NO: 76465 - RNA, 855 nt, Artificial Sequence
  derived and/or modified sequence opt5 from SULT4A1__Homo_sapiens__NP_055166
auggccgagagcgaagcugagacccccuccacaccuggcgaguucgaaucuaaguacuuugaguuccacggggugagacugccgcccuuuugccggggaaaaauggaagagaucgccaacuucccuguccgccccagcgacguuuggauugugacguauccuaaguccggcaccucucuccugcaggaaguggucuaccuugugagccaaggggcggaucccgacgagaucggacugaugaauauugaugaacagcucccuguucuggaguauccgcagcccggccuugacaucauuaaagagcugacauccccuagacucaucaagucucaucugcccuaccgguuucugccuagcgaucuccacaacggggacuccaaagugaucuauauggcucgcaaucccaaggaucuggucgugagcuacuaucaguuccauagaucucuucggaccauguccuaccgcggaacauuucaagaguucuguagacgguuuaugaacgacaagcugggcuacggcagcugguucgaacacguucaggaauuuugggagcaucgcauggauucuaauguccucuuccugaaauaugaagacaugcacagagaucuugugaccaugguggagcagcuggcccgguuucucgggguguccugcgacaaggcccagcuggaggcucugacagaacacugucaucaacucgucgaucagugcuguaacgccgaggcucugccgguuggacgcggcagaguggggcuuuggaaagacauuuucaccgugagcaugaaugaaaaguucgaccuggucuacaaacagaagaugggaaagugcgaucucacguuugacuucuaucuguga

SEQ ID NO: 76466 - RNA, 1050 nt, Artificial Sequence
  derived and/or modified sequence opt5 from SUMF1__Homo_sapiens__NP_001158146
auggccgcucccgcccugggccucgugugcgggagauguccugagcugggacuuguccugcuccugcuucugcucagccugcugugcggcgcggcugggucccaggaagccggaaccggcgccggggcuggaucucucgccggcagcuguggcugcgggacaccgcaacggcccggagcucacggcuccucugccgcggcccaucgcuacagcagagaggcuaacgccccugggcccguuccuggagaacggcagcuggcucacuccaagauggugcccaucccugccggcguguucacgauggggaccgacgauccgcagauuaaacaggacggagaggcgcccgcccgcagagucacaaucgaugcuuuuuauauggacgccuacgaagugucuaauaccgaguucgagaaguuuguuaacagcacaggcuaucuuaccgaaguggcugccgccccuugguggcugcccgucaaaggcgcuaauuggcggcauccugaggggcccgauuccacaauucuccaccgcccggaccauccugugcugcacguuagcuggaacgaugcgguggccuacuguaccugggcuggaaagagacuucccacggaagccgagugggaguauucuugccggggcgggcugcacaaucgccucuucccuuggggaaacaaacugcaacccaagggccagcauuacgccaauaucuggcagggggaauuucccgucaccaacacaggagaggacggcuuccagggcaccgcuccuguggaugccuuuccgcccaauggguauggacuguacaacauugugggcaaugcgugggaauggacauccgacugguggaccguccaccauagcguugaggaaacgcucaacccuaaggggcccccuucuggaaaagauagagugaagaaaggcggguccuacaugugucaccggagcuauugcuaccgcuauagaugugcugcccggucucaaaauacacccgacuccagcgccuccaaccugggcuuccgcugcgcugccgauagacuuccgaccauggacuga

SEQ ID NO: 76467 - RNA, 918 nt, Artificial Sequence
  derived and/or modified sequence opt5 from SUMF2__Homo_sapiens__NP_001035934
augagagcccacgcucagcggggccgcgggugcaccagacggagcgccgcggugcugauggcucgccauggacucccccugcuuccucugcucucccugcuugucggcgccuggcugaagcucgggaacggacaagccacaucuaugguucagcugcagggcgggagauuccugaugggaacgaauagcccggacucccgggauggcgagggccccgugcgcgaagcuaccgugaaaccuuuugccaucgacauuuuccccgucacaaacaaggauuuuagagacuucgugcgggagaaaaaguaccgcaccgaagcugagauguuuggguggucuuucguuuuugaagauuucgugagcgacgagcucagaaauaaagccacacagccuaugaagcccgcgggaccuggcuccgggauccgggagcgccuggaacacccgguccuucaugugucuuggaacgaugccagagcuuauugugccuggcggggaaagcgccugcccaccgaggaagagugggaguuugcugccagaggcgggcucaaaggacaaguuuacccuuggggcaauugguuccagcccaaccggacaaaucuguggcagggcaaguuuccuaaaggggacaaggcggaagauggauuccacggcgugagccccgucaacgccuuuccggcucagaauaacuaugggcuuuacgaccugcucggaaaugugugggaguggaccgccuccccuuaucaagcugccgaacaggauaugagagugcugcgcggcgccagcuggauugacacggcugaugggucugcgaaccaucgggccagagucaccacacgcaugggaaauacccccgacuccgcuagcgacaaccugggcuuccggugcgccgccgaugcuggcagaccucccggggagcucuga

SEQ ID NO: 76468 - RNA, 306 nt, Artificial Sequence
  derived and/or modified sequence opt5 from SUMO1__Homo_sapiens__NP_001005781
augagcgaccaggaggccaagcccuccaccgaagaucugggcgacaaaaaggagggggaauacaucaaacucaaggugauuggacaagauucuagcgagauccacuucaaagucaagaugacaacgcaucugaagaaacuuaaggaauccuauugccagagacagggcguuccuaugaacucucugcgguuucucuucgaggggcagcgcauugcugacaaucacaccccgaaagagcugggaauggaagaggaagaugugaucgagguguaccaagagcagacaggcgggcauagcaccgucuga

SEQ ID NO: 76469 - RNA, 216 nt, Artificial Sequence
  derived and/or modified sequence opt5 from SUMO2__Homo_sapiens__NP_001005849
auggccgacgagaagcccaaagaaggcgugaagaccgagaacaaugaucacaucaaccugaaagucgcugggcaggacggaagcguugugcaauucaagauuaaaagacauacaccucucuccaagcugaugaaggccuacugcgaacggcagcuugagauggaagaugaggacacgaucgauguguuucagcagcaaaccggcggggucuauuga

SEQ ID NO: 76470 - RNA, 426 nt, Artificial Sequence
  derived and/or modified sequence opt5 from SUMO3__Homo_sapiens__NP_001273345
augagcgaggaaaagcccaaagagggcgugaagaccgaaaacgaccacaucaaucugaaagucgccgggcaggauggauccguugugcaauucaagauuaaaagacauacaccucucucuaagcugaugaaggcuuacugcgagcgccaggugcggcaccuugccccgccccagagccugccugucugugcgcucgugcugugcguucccggcaucccuagagcucgggccucccgcggguggacgcagaugcaacuucccgaaggacugucuaugagacagauucgguuucgcuucgacggccagccuaucaacgagaccgauacaccggcccagcucgagauggaagacgaggauaccauugacguguuucaacagcagacagggggaguccccgaaagcucccuggcuggccauucuuucuga

SEQ ID NO: 76471 - RNA, 288 nt, Artificial Sequence
  derived and/or modified sequence opt5 from SUMO4__Homo_sapiens__NP_001002255
auggccaacgagaagcccaccgaagaggugaaaacagaaaauaacaaucacaucaaccugaaggucgcuggccaggacgggagcguugugcaauucaaaauuaagagacagacgccucucuccaaacugaugaaggccuacugcgagccgcggggacuuucugugaagcagauccgcuuuagauucggcgggcagcccauuagcggaaccgauaaaccugcgcaacuggaaauggaggacgaggauacaaucgacgucuuucagcagcccaccggcgggguguauuga

SEQ ID NO: 76472 - RNA, 2358 nt, Artificial Sequence
  derived and/or modified sequence opt5 from SUN1__Homo_sapiens__NP_001124437
auggacuucagcagacugcacauguacucucccccucagugcgugccggagaacaccggcuauacauacgcccucuccagcuccuauucuagcgaugcucuggacuuugaaacggagcauaagcucgaucccgucuucgacuccccucggaugucucgcagaagccugcggcucgccaccacagcguguacccugggggauggagaagcuguuggcgccgacuccgggacaagcucugccgugucccuuaaaaaucgcgcugccagaaccacaaagcaacggcgcagcaccaacaaaucugcuuuuuccaucaaucacgugagcagacaggucacgucuuccggagugagccauggcgggaccguuucccugcaggaugccgugacacggagacccccuguccucgacgagucuuggauucgcgaacagaccacaguggaucacuucuggggacuggacgaugacggcgaucugaagggcgggaacaaagcggccauccaaggaaauggcgacguuggggcugccgcugccaccgcgcauaacggauuuagcugcuccaauuguagcaugcucucugagcggaaggacgugcugacggcccaccccgcugccccuggcccggucucccgcguguacagcagagaucggaaccagaagugcuauuuccuucugcagauucuccgcagaaucggggcugugggacaggccgucucucggacagccuggagcgcucuguggcuugcgguuguggcccccggcaaagcugccuccggcguguuuugguggcuggggauuggaugguaccaauucgucacccucaucucuuggcugaauguguuucugcucacaagaugucugcgcaacaucugcaaguuccuuguucugcucauuccucuguuucuucugcucgccggccugagccugcgggggcagggaaauuucuuuuccuuccuccccgugcugaacugggcuagcaugcacagaacccagcgcgucgacgauccucaggacguguucaaacccaccacaucucggcuuaagcaaccgcugcagggcgauuccgaggccuuuccuuggcauuggaugagcgggguugaacagcaaguggcgucucucuccggacagugucaccaucacggcgagaaucugagagaacuuacgacccugcuccagaaacugcaggcucgcgucgaccaaauggagggcggggccgccggacccagcgcuuccgugcgggaugccgucggccagccucccagagagacagacuucauggcuuuucaccaggaacaugaggugcgcaugucucaccuggaagauauccucgggaagcugcgggaaaagagcgaggccauucagaaagagcuugagcaaaccaagcagaaaacaaucuccgcgguuggagaacagcugcuccccaccguggagcaucugcagcuggaacuugaccaacucaagucugagcugagcuccuggagacacgucaaaacgggcugcgaaacaguggaugccguucaggagcgcguggacguccaggugcgggagauggugaagcugcuuuucagcgaagaccagcaagggggcucucuggagcagcuucugcagagauuuuccagccaauucguuucuaaaggagaucuccagaccaugcugcgggaccugcagcuucagauucuccgcaacgucacccaucacguguccgugacaaagcaacugccuaccagcgaagcugucgugucugccguuagcgaggcuggcgccuccgggaucacagaagcgcaggccagagcuauugugaauagcgcccugaagcucuauucucaggauaaaacgggaauggucgacuuugcucuggaguccggcgggggaagcauccuuuccacccgguguucugagacauacgaaaccaagacagcccugaugagccucuucggcaucccgcugugguacuuuucccagucucccagagugguuauucaaccugauaucuaucccgggaacugcugggccuucaaaggcagccagggauaccuggugguccgccuuuccaugaugauucacccugcugcguuuacccucgagcauauccccaagacgcugucuccgaccggcaacauuagcuccgccccuaaagacuucgcuguguaugggcuggaaaaugaguaccaggaggaaggacagcuccugggccaauuuacauaugaucaggacggggagagccuucagauguuccaagcccugaagcggcccgaugacaccgccuuccagaucguugaacucagaaucuuuucuaacuggggacacccugaguacacaugucuguaucgcuucagagugcauggcgaacccgucaaguga

SEQ ID NO: 76473 - RNA, 2217 nt, Artificial Sequence
  derived and/or modified sequence opt5 from SUN2__Homo_sapiens__NP_001186508
augagcagacggucccagcgccugaccagauacucucaaggcgacgaugacgggagcuccucuagcggaggcuccucuguggccgggagccaguccacacucuucaaggauagcccccugcggacgcuuaaacgcaagucuuccaacaugaaaagacugagcccugcuccgcagcucggacccucuuccgacgcccacaccagcuauuacucugagucccugguccaugaaagcugguuuccuccccgguccucucuugaggaacugcacggcgaugcgaauuggggagaggaccuccgcguuagacggcgcagaggaacaggcggcagcgaauccagccgggcuucugggcuggugggacgcaaggccaccgaggauuuccugggcuccagcucuggguauagcuccgaggacgauuacguggaagacucugagggaagaggcagcaaagucacagaaaccgagccuguguccagcuuucccgccggguauucugauguugaccagcaauccucuagcucccggcuccgcagcgcuguguccagagccggaucucugcuuuggauggucgcuacaagcccuggccggcuguucagacuccuguacuggugggccggcaccacgugguaucgccuuaccacagcggccucccugcucgauguguuuguucugacccggagauucucuagccugaagacauuucucugguuccugcuuccgcugcuccugcuuaccugccugacguacggggcuugguacuuuuaucccuacggacuccagacauuccauccugcccugguguccuggugggcugccaaggacagccgccggcccgacgagggcugggaagcgagagauucuuccccucacuuucaggccgagcagcgcgucaugagccgggugcauucucuggaaagacgccucgaggcucuggccgcugaguucuccagcaacuggcaaaaagaggccaugcggcuugagagacuggaacuccgccagggggcccccggacagggcgggggaggcggccugucucacgaggacacccuugcucugcucgaagggcuggugagccggagagaggcggcccugaaggaagauuuucggcgcgagacagcugccagaauccaggaggaacucuccgcccugcgggcugagcaccaacaggacagcgaagaucuuuucaaaaagauugucagagccucucaggaguccgaagcgcgcauccaacagcugaaaagcgaguggcaguccaugacccaggagucuuuccaagaaagcuccguuaaggagcuccggagacuggaagaccagcuggcuggacuucagcaggagcucgccgcccuggcucugaagcaaucuagcguggccgaggaagugggccuccugccgcagcagauucaggcuguccgcgaugacguggagucccaauuuccugccuggaucucucaguuccuugcgagagggggaggcgggcggguuggccugcuccagcgcgaagagaugcaggcccaacugagagaacuggagagcaaaauucuuacccauguggcugagaugcagggaaaguccgcccgggaagcugccgcgagccucucucugacacugcagaaagagggcgucaucggggugacggaagaacaaguucaccauaucgugaagcaggcccuccagcgcuauuccgaagauagaauuggacuggcugacuacgcccuugagagcggcggggcuucugucaucuccacccgguguagcgagacauaugaaaccaaaacagcccugcucucucuguuugggauuccccugugguaccacucccagagcccucgcgugauccuucaacccgauguccaccccggcaauugcugggccuuccaggggccucagggcuuugcugugguuagacucuccgcgcggauucgcccgaccgccgugacgcuggagcauguccccaaggcucugagcccuaacucuacaaucagcuccgcccccaaagacuucgccauuuuuggauucgacgaagaucuccagcaagagggcacccugcuugggaaguuuaccuaugaccaggauggagaaccuauccagacauuccacuuucaggcucccaccauggccacauaccaagugguugagcugagaauccucacgaauuggggccauccggaguacaccuguauuuaucgguucagagugcacggggaaccugcgcauuga

SEQ ID NO: 76474 - RNA, 1074 nt, Artificial Sequence
  derived and/or modified sequence opt5 from SUN3__Homo_sapiens__NP_001025190
augagcggcaagaccaaagccagacgggcugccauguucuuucgcagaugcuccgaggacgcgucugggagcgcuuccggaaacgcccugcucucugaagaugagaaucccgacgccaacggcgugacacggagcuggaagaucauucuguccacgaugcuuacccugacauuccuccuggucgggcuucugaaucaccaguggcucaaagaaaccgauguuccucaaaagucucgccagcuguacgcuaucauugccgaguauggaagcagacuguacaaauaucaggcucggcuccgcaugccgaaggaacagcuggagcuucugaagaaagagucccaaaaccucgaaaauaacuuuagacagauccuguuccuuauugagcagaucgacgugcugaaggcccuccugcgggauaugaaagacggcauggauaauaaccauaauuggaacacacacggggaccccguggaagauccugaccauaccgaggaggucagcaaucuggugaacuacguucucaagaaacugcgcgaagaucagguggagauggcggacuaugcccuuaagucugcuggagccuccaucauugaagcuggcacaagcgagucuuacaagaauaacaaagccaagcuguauuggcacggcaucggguuucucaaucaugaaaugcccccugauauuauccugcaacccgacgucuacccuggaaaauguugggcguucccgggcucccaggggcacacccuuauuaagcuggccacgaaaaucauucccaccgcugugacaauggagcacaucagcgagaagguuucuccuuccggaaacaucagcuccgcccccaaagaauuuucuguguacggcauuaccaagaagugcgagggggaagagaucuuccucggacaguuuauuuauaacaaaacaggcaccacgguccagacauucgaacugcaacaugcugugagcgaguaccugcucugugugaagcugaauaucuuuuccaacuggggccacccuaaauauaccugccuuuacagauuccggguccaugggacacccggaaagcacauuuga

SEQ ID NO: 76475 - RNA, 1638 nt, Artificial Sequence
  derived and/or modified sequence opt5 from SUOX__Homo_sapiens__NP_000447
augcugcuccugcacagagccgugguccuucggcugcagcaggcuugccgccucaagagcauccccuccagaauuuguauccaagccugcucuaccaacgacagcuuccagccucagcggccgucccugacauuuucuggcgauaauagcuccacgcaaggguggcgcguuaugggaacccuucugggccucggggcggugcuggcuuaccaggaccauagaugucgggccgcccaggagucuacacacauuuauaccaaagaagaggugagcucccauacaagccccgaaaccggaaucugggucacacugggcucugagguguucgauguuaccgaauuuguggaccuccacccugggggacccuccaagcugaugcuugcugccggcggcccucuggagcccuucugggcucucuacgccguccauaaccagagccacgugcgcgagcugcuugcgcaauauaaaauuggggaacugaauccugaggauaagguugccccgacgguggaaaccucugaccccuacgcugaugacccugucagacaccccgcccucaaagugaacucccagcggccuuuuaaugcugagcccccgccugagcugcugacagaaaacuauaucacccccaauccuaucuucuuuacacgcaaccaucuccccgugcccaaucuggauccugacaccuacagacuucacgucguuggagccccgggcgggcagagccugucucucucccuggaugaccuucauaacuucccccgguaugagauuacggugacacugcagugcgcgggaaaucgcagaagcgaaaugacccaagugaaggaggucaagggccucgaauggcggacaggggccaucuccaccgcucgcugggccggagcuagacugugugaugugcuggcccaggccggccaccagcucugcgagaccgaggcucacguuuguuuugaaggccuggacucugacccuacagggacggcguacggagccagcauuccccuugcucgggccauggauccugaggccgaagugcugcucgcuuacgagaugaacggccaaccccugccgagagaccauggguucccuguccgcgugguugugcccggagucgugggcgcccggcacgucaaauggcuugggagaguguccguucagccugaagagagcuauucucauuggcagcgccgggauuacaagggauuuucccccagcguggacugggagaccgucgauuucgacucugcgccuagcauccaggaacugcccgugcaauccgcuauuacagagccgagagauggcgaaaccguugagucuggcgaagugacaaucaaaggguaugccuggagcggaggcgggcgcgccgucauucggguggacgugucccucgauggaggccugaccuggcagguugcuaagcuggacggggaggagcagagaccucgcaaagccugggcuuggcggcucuggcagcugaaggcccccguccccgcgggccaaaaggaacuuaauaucgugugcaaagccguggaugacggauacaacguccagccugacacgguggcuccgaucuggaaucugagaggcguucucagcaacgccuggcaccgcgugcaugucuaugugucucccuga

SEQ ID NO: 76476 - RNA, 2340 nt, Artificial Sequence
  derived and/or modified sequence opt5 from SUPT20H__Homo_sapiens__NP_001014308
augcagcaagcccuggagcucgcucuggacagagccgaauacgugaucgagagcgcgcggcagcggcccccuaagagaaaauaucuuuccucuggccgcaagagcgucuuccagaaacuguacgaucucuauauugaagagugcgaaaaggagccggagguuaaaaagcugcgcagaaacgugaaucuucuggaaaagcucgugaugcaggagacccuguccugucuggucgugaaccucuaccccgggaaugaaggauauucucugaugcuucggggcaaaaacgggagcgacuccgagacaauccgccugccuuacgaggaaggagagcuccuggaauaucuugaugcugaggaacugcccccuauucucguugaccugcuggagaagucucaagugaauaucuuucacugcggcugugucauugccgagaucagagauuaccggcagagcuccaacaugaaaagccccggguaccagucucgccauauccuccugagaccuacgaugcagacccuuauuugcgacgugcacuccaucacaagcgauaaucauaaguggacccaagaagacaaacugcuccuggagucucagcuuauucuggccacagcugaaccgcucugucuggaucccuccaucgccguuaccugcacagcuaaccggcugcucuauaauaagcagaagaugaacacccgcccuaugaaaagauguuucaagcgguacagcagaucuucccugaaucgccagcaagaccuuagccacugucccccucccccgcagcugcggcuccuggauuuucuucagaaaagaaaggagcgcaaagccggacaacauuaugaccugaagauuuccaaagcgggcaacugcguggauauguggaagcggucuccuugcaaucucgccauccccagcgaagucgacguggagaaguacgcuaaaguggagaaguccauuaaaagcgacgauucucagccuacggucuggcccgcccacgacguuaaggaugacuauguguucgaaugugaggcuggcacccaguaccagaaaacaaagcugaccauccugcaaucccucggggauccccuguauuacggaaagauccagccuugcaaagccgacgaagagagcgauucucagaugagcccgucccacucuagcacagacgaucauuccaacugguuuauuaucggcagcaagaccgacgcggaaagaguggucaaucaguaccaagagcuugugcagaacgaggccaaaugccccguuaagaugucucacuccagcucuggguccgcuagccugucccaggugucuccuggaaaagaaacggaucagacagagaccgucagcgugcaauccucuguucucggcaagggggugaagcaucggcccccucccauuaaacugccgagcuccagcggaaacucuuccagcggcaauuauuucacaccucagcagaccucuuccuuucuuaagagccccaccccucccccuucuagcaaacccuccagcaucccgcgcaagucuuccgucgaccuuaaccaggugagcaugcucuccccugccgcucugucucccgccagcuccucucaaagaacaacggccacccaggucauggcuaauagcgcgggccugaacuucauuaaugugguuggguccguguguggagcccaggcucucaugucuggcagcaaccccaugcuggggugcaauacaggagccaucaccccugccggcaucaaccuuuccgggcugcucccgagcggaggccugcugcccaaugcucugccuucugccaugcaagcggcuucccaggccggcguccccuuugggcucaaaaacacaagcucucugcgcccucugaaucuccugcagcuucccggaggcucccugauuuucaacacccuccagcaacagcagcagcaacugagccaguuuacgccucagcagccccaacagccgacaaccuguucuccucagcaacccggggaacagggauccgagcagggcagcaccucccaggagcaagcccugagcgcucagcaggccgcugugaucaaucuuacagggguuggcucuuucaugcagagccaagccgcggugcucucccagcugggaucugccgaaaaccggccugagcagagccugccccagcaaagauuucagcucuccucugcuuuccagcagcaacagcagcaaauucagcagcugcgcuuccuucagcaccaaauggccauggcugccgcggccgcucagaccgcccagcugcaccaucaccggcauacaggcagccaguccaagucuaagaugaaaagagggacgccgaccacaccuaaguuuuga

SEQ ID NO: 76477 - RNA, 498 nt, Artificial Sequence
  derived and/or modified sequence opt5 from SUPT3H__Homo_sapiens__NP_001248752
auguucgaggacgaugaaaucgacgaggugaagcaggaaagaauggagcgggccgaacgccaaaccagaauuauggauagcgcucaguacgccgaguuuugcgagucccggcagcugucuuucagcaaaaaggcguccaaauuucgcgacuggcucgauuguucuagcauggaaaucaagcccaacgucguugcuauggagauucuggccuaucuugccuacgaaacaguggcucagcugguggaccucgcccugcuugucagacaagauauggugacgaaagcuggcgacccuuucucccacgccaucucugcgaccuuuauucaguaucauaauagcgccgaguccacagcugccugcgggguugaggcucacagcgaugccauccagccgugucauauccgggaagcgauucgcagauacucucaccggaucggaccccuguccccuuucaccaacgccuaucgcagaaauggcauggcuuuucucgccugcuga

SEQ ID NO: 76478 - RNA, 354 nt, Artificial Sequence
  derived and/or modified sequence opt5 from SUPT4H1__Homo_sapiens__NP_003159
auggcccuggagaccgugcccaaggaccucagacaccuucgggcuugccugcuguguagccucgucaaaacaaucgaucaguucgaauacgacggcugcgauaacugugacgccuaucugcaaaugaaggggaaucgcgagaugguuuacgauugcacguccucuagcuuugacggaauuaucgcgaugauguccccugaagauucuugggugagcaaauggcagagaguguccaacuucaagccgggcgucuaugcugugucuguuaccgggcggcuuccccagggaauugugcgcgagcugaaaagcagaggcgucgccuacaagucccgggacacagccaucaagaccuga

SEQ ID NO: 76479 - RNA, 1245 nt, Artificial Sequence
  derived and/or modified sequence opt5 from SUPT7L__Homo_sapiens__NP_001269658
augaaccugcagagauacuggggcgagauccccauuagcuccucucaaaccaaucggagcuccuucgaccuccugccucgcgaauuuagacuuguggagguccacgauccgccccugcaucagccuucugccaacaagcccaaaccucccacaaugcucgacaucccuagcgaaccgugcucccugacgauucacaccauccagcuuauucagcauaaucggcgccugagaaaccucaucgcuacagcccaagcgcagaaucagcagcaaaccgaggggguuaagacagaagagucugagccccugccuagcugucccggauccccuccccugccggaugaccuccugccucuugauugcaaaaaccccaaugcuccuuuccagauccggcacagcgaccccgaaucugauuuuuaucgcggcaagggggagcccgugaccgaacuguccuggcauagcuguagacagcuccuguaccaggccguggccacaauucuugcucacgccggauucgacugcgcuaacgagucuguccuggagacccucacggauguggcccacgaauauugucugaaauuuaccaagcugcuccgguucgcgguugaccgcgaggccagacugggccaaacaccuuuuccggaugugauggaacaggucuuccaugagguggggaucggauccguucuuagccugcagaaguuuuggcaacaccggauuaaagacuaccauucuuauaugcuccagaucuccaagcagcugagcgaagaguacgagcgcauugugaaucccgaaaaagcuaccgaggaugccaagccugucaaaaucaaggaagaacccguguccgacauuacauucccugugucugaggagcuugaggcugaccuggccagcggcgaucagucccuccccaugggcguccugggggcgcaaagcgaaagauuuccgucuaaccuggagguugaagccuccccucaggcuagcucugccgaggugaaugcuagcccccucuggaaccuggcccacgugaagauggaaccucaggaguccgaggaaggaaaugucucuggccacggggugcuuggaagcgacguuuucgaggaacccauguccggcaugagcgaggccgggaucccucagucucccgaugacuccgauagcucuuauggaucccauagcaccgacucccugaugggcucuagcccgguguuuaaccaacggugcaaaaagcgcaugagaaaaaucuga

SEQ ID NO: 76480 - RNA, 2361 nt, Artificial Sequence
  derived and/or modified sequence opt5 from SUPV3L1__Homo_sapiens__NP_003162
augagcuucuccagagcccugcucugggcucggcugcccgccggccgccaggcggggcacagagcugccaucugcucugcccuucggccucauuuuggaccguuccccggcgugcuggggcaagucagcguucucgcuaccgccuccucuagcgcuuccggaggcucuaagauuccuaacacaagccuguuugugccccuuacggugaaaccucaggggcccuccgccgacggagaugucggcgcggagcugacccgcccucucgacaagaaugaagugaaaaagguucuggauaaauucuacaagagaaaggagauccagaaacugggcgccgacuaugggcucgaugcucggcuguuucaccaggccuucauuagcuuucgcaacuacaucaugcaaucucauucccuugacguggauauucacaucguccugaaugacaucuguuucggagcugcccaugcggaugaccucuuuccguucuuucugagacacgccaagcagauuuuccccgugcuugauugcaaagacgaucugcggaagaucagcgaccuccgcauuccucccaacugguauccugacgcuagagccaugcagcggaaaaucauuuuucacucuggccccacaaauuccgggaagaccuaccaugcuauccagaaguauuucagcgccaaaucuggaguuuacuguggcccgcugaagcugcucgcccacgaaauuuucgagaaauccaacgcugcgggggugccuugcgaucuggucacaggagaggaacgcgugaccgugcaacccaauggcaagcaggccagccaugucuccuguacaguugagaugugcucugugaccacgccuuaugaaguggcugucaucgacgagauccagaugauuagagaucccgcccggggcugggccuggacccgcgcccuucuggggcucugugcugaagaggugcaccugugcggagagcccgcggcuaucgaccuuguuauggaacugauguacacaaccggcgaggaaguggaggucagagauuacaaacggcucacaccuauuagcgugcuggaccacgcccuggaaucccucgauaaccugagaccgggggacuguaucguuugcuuuagcaagaaugauauuuauucugugucccgccagaucgagauccggggacuugagagcgccgucauuuacggcucucugcccccugggaccaaacucgcucaagccaagaaguucaacgaccccaaugauccuuguaaaauccugguggcuacggacgccauuggaaugggccuuaaccugagcaucagacgcauuaucuuuuauucccucaucaagcccucuauuaaugaaaaaggcgagcgggaacuggagccgaucacaaccagccaggcgcugcagauugccgggagagcuggacgcuucuccagccgguuuaaggaaggcgaggucacaaccaugaaccaugaggaccucucucugcuuaaagaaauccugaagagaccuguggaucccauucgcgccgcugggcuccacccuaccgccgagcaaaucgaaauguucgcguaccaucugcccgacgccacacuguccaaucuuauugauaucuuuguugacuucagccagguggauggacaguauuuugucugcaacauggacgauuucaaguuuucugcugagcucauccagcacauuccucugucccugcgggugagauacguuuucugcacggcccccaucaacaaaaagcaaccguuuguguguagcucccuccugcaguucgcucgccaguauucucggaaugaaccucuuaccuucgccuggcugagacgguacauuaaauggccccuccugcccccuaagaacaucaaagaccugauggaucuugaggccguccaugacgugcucgaucuguaccuguggcucagcuaucgcuuuauggacauguucccggaugcuucccugauuagagaccuucagaaggagcuggacggcaucauccaagauggggugcacaauauuacaaagcucaucaaaaugucugaaacccacaagcugcugaaccuugagggcuuucccagcggaucccagagccggcucucuggcacacugaaaucccaggcgagacgcacccgggggacgaaggcccugggaagcaaagcuacagaaccucccucuccugacgccggcgagcucucccuggccagcagacuuguucagcaagggcugcucacccccgauaugcugaagcagcuggagaaggaauggaugacccagcagacagagcauaauaaagaaaagaccgagucuggaacacacccuaaaggcacgcgcagaaagaaaaaggaacccgacagcgauuga

SEQ ID NO: 76481 - RNA, 903 nt, Artificial Sequence
  derived and/or modified sequence opt5 from SURF1__Homo_sapiens__NP_003163
auggccgcuguggccgcgcugcagcucggccugagagcugccgggcuuggacgggcccccgcuagcgccgcuuggcgcuccguccugagaguuucuccucggccgggcguggccuggcgccccagcagaugcggguccucugcggccgaggcuagcgccaccaaggcugaagacgauuccuuccuccaaugggugcugcuucugaucccugucacagccuuuggacucggcacguggcaagugcagcggcgcaaauggaagcugaaccugauugcggagcucgaaucuagaguucuggccgagcccgugccucuucccgcugacccuauggaacugaaaaaucucgaguaccggccggucaaggugcgcggguguuucgaucacagcaaagagcuguauaugaugcccagaaccaugguugacccugugcgggaagcccgcgagggaggccuuaucuccagcucuacacaguccggcgcuuacgucgugacccccuuucauugcacagaucugggggugaccauucucgucaacagaggauucguuccucggaagaaggugaaucccgaaacacgccagaaaggccagaucgagggggagguggaccugauuggaauggucagacugaccgaaacgcggcagccguuugugccugagaacaaucccgaaagaaaccacuggcauuaucgcgaucucgaggccauggcccggaucaccggcgcugaaccuaucuucauugacgcgaauuuucagagcacaguucccgggggacccaucggcggccaaaccagagugacacugcgcaacgagcaccuucaguacauugucaccugguaugggcugucugccgcuacguccuaccucugguucaagaaauuucugcggggaacaccuggcguguga

SEQ ID NO: 76482 - RNA, 480 nt, Artificial Sequence
  derived and/or modified sequence opt5 from SURF4__Homo_sapiens__NP_001267718
augggccagaacgaccugauggggaccgccgaggauuucgcugaccaauuucucagagugacaaagcaguaccugccccacgucgcccggcuuugccugaucagcacguuccucgaagauggcauucgcaugugguuucagugguccgagcagagagacuauaucgauaccacauggaauuguggauaccugcuugcgucuagcuucguuuuucugaaccuccuggggcaacugaccggaugcgugcucgugcugucccggaauuucguccaguaugcuuguuuuggccuuuucgggauuaucgcccugcagacaauugccuacucuauccucugggaccugaaauuucuuaugcgcaaccuggcucucggaggcggccugcugcuccugcuugccgaaagcagauccgaggggaagucuauguucgcuggagugccuaccaugcgggaaagcuccccgaaacaguaucugcccggcuga

SEQ ID NO: 76483 - RNA, 2274 nt, Artificial Sequence
  derived and/or modified sequence opt5 from SUSD1__Homo_sapiens__NP_001269569
augggcagagggcccugggacgccggaccuagccggcgccugcucccgcugcuucugcuccugggccuugcuagaggggccgcgggagcucccggcccugaugggcuggacgugugcgccaccugucacgagcaugccacaugccagcaacgggaaggaaagaaaaucuguauuugcaacuacggcuucgucggcaaugggcgcacgcaguguguugauaagaacgagugccaguuuggagcuacccucguguguggcaaucacacauccugccauaacacccccgggggauucuauuguaucugccuggaaggcuacagagccacaaauaacaauaaaaccuuuauuccuaacgacgggacauucuguaccgauaucgacgagugcgaagugucuggacugugccggcacggcggccgcugugucaauacgcaugggagcuuugagugcuauuguauggauggauaccuccccagaaacggcccugagccguuccaccccaccacagacgcuaccuccugcacagaaauugauugugggaccccucccgaggugccugacggauauaucaucggcaauuacacgucuagccuggggucccagguucgguaugccugccgcgaaggauuuuucucugugcccgaggauacagucagcuccuguaccggccuuggcacaugggagagcccgaagcugcacugccaagaaauuaacugugggaauccucccgagaugagacaugcgauccucgugggaaaccacucuucccggcugggcgggguugcccgcuacgugugccaggaaggauuugagagcccuggcgggaaaauuaccucugucuguaccgaaaagggcacauggagagaguccacgcuuaccugcacagagauccugaccaagauuaaugacgugagccucuucaacgauacaugcgugcgguggcagaucaacucucgcagaauuaaucccaaaaucuccuacgucaucagcauuaagggacagcggcuggaccccauggaauccguuagagaggaaaccgugaaccugacgacagacucucgcaccccugaggugugucucgcucuguauccgggcaccaauuacacagucaacaucagcaccgcucccccucggagauccaugcccgccgugauuggguuucaaacagccgaaguugaucuucuggaggacgauggcagcuucaauaucucuauuuuuaacgagacgugccucaaacugaaucgccgguccagaaaggugggaagcgaacauauguaucaguucaccguccuugggcagcgcugguaccuggcgaacuucucucacgccaccagcuuuaauuucacaacacgggaacaggugccuguugugugucucgaccuguaucccaccacggauuacaccgucaacgugacacugcucagauccccgaaacgccacucuguccaaaucaccaucgcuacaccucccgccgugaagcagaccauuagcaauaucuccggauuuaacgagacgugccugcgguggagaagcauuaagacagcugacauggaggaaauguaucuuuuccauaucuggggccagcgcugguaccaaaaagaguuugcccaggagaugaccuucaauauuucuuccagcucucgggauccugaaguuugucuggaccucagacccgggacaaacuacaaugugucccugcgggcccuuagcuccgagcugccugucgugaucucucucaccacccagaucacagaacccccgcugccugagguugaguuuuucacggugcaccgcggcccccugcccagacuccggcugagaaaggcuaaagaaaagaacggaccuauuagcuccuaucagguccuugugcugccgcucgcgcugcaaucuaccuuuagcugcgauuccgagggcgccagcucuuucuuuuccaacgcuagcgacgccgauggguacguggccgcugaacugcuugccaaagacguucccgacgaugcgauggagaucccuauuggagaccgccucuauuacggcgaauauuacaaugcuccccugaagcgggggucugauuauuguaucauucugagaaucacauccgaguggaacaaaguccgcagacauagcugcgccgugugggcccaggugaaggagauuccuuguaauugcaacuuccuccggcugcacauccaucgcgcuaauucuggagacacccagaucagacacagcuguugcugccgguggcgcguccuugauugggugcccuggcugcucuga

SEQ ID NO: 76484 - RNA, 2469 nt, Artificial Sequence
  derived and/or modified sequence opt5 from SUSD2__Homo_sapiens__NP_062547
augaagcccgcccugcucccuugggcucugcuucugcucgccaccgcgcugggcccggggcccggaccuacagcugacgcccaggagagcugcuccaugagauguggcgcccuugaugggcccugcucuugucacccuacgugcagcggacugggcaccuguugccucgacuuccgggauuuuugucuggaaauccugcccuacuccgggucuaugaugggaggcaaagacuucgugguccgccauuuuaagaugagcuccccuacagaugcuucuguuauuugcagauucaaagacagcauccaaacccucggccacguggauuccagcggacaggugcauugugucucuccgcugcuuuaugaguccgggcggauucccuuuacagugagccuggacaacggccacucuuucccucgcgccgggaccuggcucgcuguucaucccaauaagguguccaugauggaaaagagcgagcuggucaacgaaacaagauggcaguacuauggaaccgccaauacgucuggcaaccuuucccugaccuggcacgugaaaagccucccuacacagaccaucacaauugagcuguggggguacgaggaaaccggaaugcccuauucccaagaguggacggcgaaguggucuuaccuguauccgcucgccacacacaucccuaauagcggcuccuuuaccuucacacccaaaccugcuccucccagcuaccagcgguggcgcguuggcgcccugagaaucauugauucuaagaacuacgcugggcagaaagacgugcaggcccuuuggaccaaugaucaugcgcuggccuggcaccucuccgacgauuuucgggaagaccccgucgcuugggcccgcacccaaugccaggcuugggaggagcuggaagaccagcuuccgaacuuccuggaggaacuccccgauuguccuugcacacugacgcaggccagagccgacagcggacgguuuuucaccgauuauggcugcgacauggagcaagggucuguguguacauaccaucccggagcugugcacugcguccgcagcguucaggcgucccugagauauggcucugggcagcaauguugcuacaccgccgauggaacacagcuccugaccgcugacagcuccggcggcagcacgccugaucgggggcacgacuggggagcucccccguuucgcacaccucccagagugccuucuaugucccauuggcuuuaugaugugcugagcuucuacuauuguugccucugggcccccgacuguccucgguacaugcagagacgccccucuaaugauugccggaacuacagaccgccucgccuggccuccgccuucggcgacccccacuuugucaccuucgacgggaccaauuuuacauucaacggacggggcgaauaugugcuucuggaggcggcucucaccgaucugagaguucaggcccgcgcccaacccgggacaaugagcaauggcacggagacccggggaacaggccugaccgcuguggccguccaggaagggaacuccgacgugguugaggugagacucgcuaaucgcacaggaggccuggaaguccuucugaaccaggaggugcucucuuuuaccgaacagagcuggauggaucugaaggggauguuccuguccgucgccgcgggagaccgggugucuaucaugcuugccagcggcgcugggcucgagguuuccgugcaaggcccuuuucugagcgucucugugcugcucccggagaaauuccugacgcauacccacggacuucugggcacacucaacaaugaucccaccgacgauuuuacacugcauuccgggagaguucugccucccggaaccagcccucaggaacuuuuccucuuuggcgccaacuggacggugcacaaugcuucuucccugcugacauacgacagcugguuccucguccacaacuuucuguaucagcccaagcaugauccuaccuucgagccccuuuucccgucugaaacaacccugaauccuagccucgcccaggaggcggccaagcuguguggggacgaucacuuuugcaacuucgacguggcugccaccggaucccugagcacaggcacggcuacccgcguggcccaucaacuucaccagcggagaaugcagucucuccagcccguugucuccuguggguggcuggccccucccccgaauggccaaaaagaaggaaaccgguaccuggcuggcagcacaauuuauuuucacugcgauaauggguacucccucgcgggagccgagaccucuacaugccaggcugacggcaccuggagcuccccuacgcccaagugucagccugggcgcucuuaugccgugcugcuuggaaucauuuucggcgggcuggccguggucgcugccguggcgcucguuuacgugcugcugagacggagaaaaggcaacacacaugucuggggagcucaacccuga

SEQ ID NO: 76485 - RNA, 873 nt, Artificial Sequence
  derived and/or modified sequence opt5 from SUSD4__Homo_sapiens__NP_001032252
auguaccacggcaugaaccccagcaauggggacggauuccuggagcagcaacagcagcagcaacagccucaguccccgcagagacuccuggccgugauccuuugguuucaacuggcucucugcuucggccccgcccagcugaccgggggauuugaugaccuucaggucugugcggauccuggcauucccgaaaacggguuccggacaccuucuggaggcguguuuuucgagggcagcguugcucgcuuucauugccaggacggguucaagcugaaaggagccacgaagagacucugucugaaacacuuuaauggcacccugggguggauccccuccgauaacucuauuugcgugcaagaagacugucggaucccucagauugaggaugccgaaauccauaauaagacauaucgccacggagagaaacucaucauuaccugccaugagggcuucaagaucagauacccggaccugcacaacauggucagccuuugucgggaugacgggacauggaauaaccugcccauuugccagggaugucuccgcccucuggcuuccucuaauggcuaugugaacaucagcgaacuucaaaccuccuuucccguuggcacagugauuagcuacagaugcuucccuggguuuaagcuggauggaucugccuaucucgagugucugcagaaucugaucugguccagcucucccccgcggugccucgcucuggaaggcgggcgcccugagcaccuuuuccccguccuguacuucccucauauuagacucgccgcggccgugcuguauuuuugccccguucuuaaauccagccccaccccugcuccgacguguucuuccaccagcacaaccacaucccuguucuga

SEQ ID NO: 76486 - RNA, 912 nt, Artificial Sequence
  derived and/or modified sequence opt5 from SUSD6__Homo_sapiens__NP_055549
augugccacggcagaaucgcccccaagagcaccuccguguucgcugucgccucuguugggcauggaguguuucugccucucgugauucuguguacacuucugggcgacgggcucgcgagcgucugcccgcugcccccugagcccgaaaacggaggcuacaucugucacccucggcccugccgcgauccucuuacggcuggguccgugauugaguaucugugugccgaaggauacaugcucaaaggcgacuauaaguaccugaccugcaaaaauggcgaguggaagccggccauggaaaucucuuguagacugaacgaggauaaagacacacauaccagccucgggguucccacacuguccauuguggcuucuaccgccagcuccgucgcucuuauccugcuccuggugguucuuuucgugcugcuccagccuaagcucaagagcuuucaccauucucggcgcgaucaaggagucuccggcgaccaggugagcaucaugguggaugggguccagguugcccugcccucuuaugaggaagcgguguacggauccagcggccacugcgugccucccgccgacccgagaguccagauugugcugucugagggguccggaccuagcggccgguccguuccccgcgaacaacagcugccugaucagggcgcuuguucuagcgccgggggagaggacgaggcucccggccaguccgggcuuugcgaagccuggggaagcagagcgucugagacagugaugguccaccaagccaccacguccagcuggguggcuggcucugggaaucggcagcuggcccauaaagaaaccgcugauagcgagaacuccgacauccagucucuccugagccuuacauccgaagaguauaccgaugacauuccccugcucaaggaggccuga

SEQ ID NO: 76487 - RNA, 1272 nt, Artificial Sequence
  derived and/or modified sequence opt5 from SUV39H1__Homo_sapiens__NP_001269095
auggugggcaugagcagacugcggaacgaccgccucgccgauccccugaccgggugcuccgucuguugcaagucuagcuggaaucagcuucaagaccuguguagacucgcuaaacuguccugcccugcccuuggaaucucuaagcggaaccuguacgauuucgagguugaauaucucugugacuacaaaaagauucgcgagcaggaauauuaccuggugaaauggagaggcuauccggauagcgaguccacaugggaaccccggcagaaucugaagugcgugcgcauccucaagcaguuucacaaagaccuggagagagagcuucugcggcgccaucacagaucuaagacgccucggcaucucgaucccagccuggcgaacuaccuuguccaaaaagcuaagcagcgcagagcccugcggcgcugggaacaggagcucaaugccaaaagaucccaccuggggcggauuaccguggaaaacgagguugaccuggauggaccucccagagcuuucguguauaucaaugaguaccgcgucggcgaagggauuacacucaaccagguggccguuggaugugagugccaagacugucugugggcuccuaccggcggcugcuguccgggggccagccuucauaaguuugcguacaaugaucagggacaggugcggcugagagccggccuccccaucuaugaaugcaacucucgcugccgguguggguacgacugcccuaauagagucgugcagaagggaauccgcuaugaucuguguauuuuccggacagacgacggcagaggguggggagugcgcacccuugagaaaauccggaagaacuccuuugucauggaauacguuggcgagauuaucacaagcgaggaagcugagagacgcggccaaauuuaugaucggcagggggccaccuaccuguucgaccucgauuauguggaagacguguacacggucgaugcugccuacuauggaaauaucucucacuuugugaaccacuccugcgaccccaaucugcagguuuacaacguguucauugauaaccuggacgagagacucccucggaucgcguuuuucgccacccgcacaaucagagcuggcgaggaacugaccuuugauuauaauaugcaagucgaccccguggauauggagagcacacggauggacucuaacuucgggcuugccggacugccgggcuccccuaaaaagagaguucgcauugaauguaaaugcgggaccgagagcugucggaaguaccucuuuuga

SEQ ID NO: 76488 - RNA, 1233 nt, Artificial Sequence
  derived and/or modified sequence opt5 from SUV39H2__Homo_sapiens__NP_001180353
auggccgcugugggcgccgaggcgagaggggcuuggugcguccccugucugguuagccucgacacccugcaggaacuuugccggaaggagaaacugacauguaaguccaucggaauuacgaaacgcaaccucaauaacuacgaaguggaguaucugugcgauuacaagguggucaaagacauggaauauuaccuugugaaguggaagggcuggccugauucuaccaauacaugggagccgcugcaaaaccucaaauguccccugcugcuccagcaguucagcaaugacaagcacaacuaucugucccagguuaaaaaggggaaagccaucaccccuaaggauaauaacaagacacuuaaacccgccauugcugaguacaucgugaagaaagccaagcaaagaauugcucugcagcgguggcaggacgaacucaaucgccggaaaaaccauaagggaaugaucuuugucgagaauaccguggaucuggaaggcccucccucugacuucuauuacaucaacgaguacaaaccugccccggggauuagccuuguuaaugaggcgacauuuggaugcuccuguaccgauugcuucuuucagaaguguugccccgccgaagcuggcgugcugcucgccuauaacaagaaucaacagaucaaaauuccucccggcacgccuaucuacgaguguaacucuagaugccagugcgggcccgacuguccgaaccgcauuguccagaagggaacccaauauagccugugcaucuucagaacauccaauggccggggguggggagugaaaacccuggugaagauuaaacgcaugagcuuugucauggaauacguuggcgaggugaucacaucugaagaggcugagagacgggggcaguucuaugauaacaagggaaucaccuaccucuuugaccuggauuaugaauccgacgaguucacgguggacgccgcgcgcuacggcaaugucagccacuuugugaaccauucuugugauccuaaucuucagguuuucaacguguuuauugacaaucuggauacaagacucccccggaucgcccuguucuccacccgcacaauuaacgcuggcgaggaacuuaccuucgacuaccaaaugaaggggagcggagauaucucuuccgacagcauugaucacuccccugccaaaaagagaguccggaccgugugcaaauguggcgcuguuacaugcagaggguaucugaauuga

SEQ ID NO: 76489 - RNA, 1389 nt, Artificial Sequence
  derived and/or modified sequence opt5 from SUV420H2__Homo_sapiens__NP_116090
augggccccgacagagugaccgcccgggagcugugcgaaaacgaugaccucgcuacaagccuggugcuugauccuuaccugggguuccgcacgcacaagaugaauguuuccccggugcccccucucagacggcagcaacaucugcgcucugcccuugagaccuuucugagacagcgggaccucgaagcggcuuaucgcgcccugacacugggaggcuggaccgccagauacuuccagagccgggggccccgccaggaggcugcccucaaaacacacguguauagauaccugcgggcuuuucuuccugaauccggauucaccauccugcccuguacacgcuauucuauggagaccaacggcgccaagauugucagcacgagagcguggaaaaagaaugagaaacucgaacugcuuguggggugcaucgccgagcugcgggaagcugaugagggacuccugcgcgccggcgagaacgacuuuuccauuauguacucuaccagaaagcggagcgcucaacuguggcucggcccugccgcguucaucaaucaugauuguaagccgaacugcaaauuuguucccgccgacgggaaugcugccugugugaagguccugagagauauugaaccuggagacgaggugacaugcuucuauggcgaaggguuuuucggagagaaaaacgaacacugugagugccauaccugugagcgcaagggcgaaggggcuuuucggacaagaccccgcgagccugcccuucccccgcggccucuggauaaauaccagcucagagaaaccaagcgccggcugcagcagggacuugacuccggcagcagacaaggccugcucgggccccgcgccugcguucacccuucuccccugcggagagaucccuucugugcugcgugccagccucugcgccucccggccugcuccgcucggcccgacacgagcccucuguggcuucaguggcugccccagccucaacccagagugcggccgcgcaagagacggagaccucgcccccggagagccccuguccucucuacacaccaugccgcucgcgugucccugcacagauggggaggcugugggccccauugccggcuucgcggagaggcccugguggcgcucggccagccuccccacgcuagaugggccccgcagcaagacuggcacugggcccggcgcuacgggcugccuuaugucguuagaguggaucugcggcgccucgcucccgcucccccugccaccccggcccccgcgggaacaccuggccccauccugaucccuaaacaggcccuugcuuuugcccccuucagcccucccaagagacugcggcucguggucucucauggcuccauugaccuggaugucgggggagaggaacuguga

SEQ ID NO: 76490 - RNA, 2220 nt, Artificial Sequence
  derived and/or modified sequence opt5 from SUZ12__Homo_sapiens__NP_056170
auggcuccccagaagcacggcgggggaggcgggggaggcagcgggccuuccgcuggaucuggcggcgggggauucggcgggagcgccgcgguggcugccgccaccgcuuccggaggcaaaucugggggaggcagcugcggcgggggaggcuccuacucugccagcuccucuucuuccgcugccgcggccgcuggggccgcuguccugccgguuaagaaacccaagauggagcaugugcaagccgaccacgaacucuuucugcaggcguucgagaaaccuacacagaucuauagauuucuucggacgcgcaaccugauugcccccaucuuccuccauagaacccugacauacaugagccaccggaauagccgcaccaacauuaagagaaagacauuuaaaguggaugacaugcuuuccaaggucgagaaaaugaagggagaacaggaaagccauucucuguccgcucaccuccaacugaccuucacaggcuuuuuccacaaaaaugauaagccuagccccaacuccgagaaugagcagaacucugugacccuggaaguucuccuggugaaggucugucauaaaaagcggaaagacgugagcugcccuauccgccagguuccgacggggaagaaacaggugccccuuaauccugaucugaaccaaaccaagcccggaaauuuuccuucccucgccgucagcucuaacgaguucgaacccuccaauagccacauggugaaaucuuauagccugcuuuuuagagugacacggccgggccgcagagaguucaacggcaugauuaauggggagaccaacgaaaauaucgacgucaacgaggaacugccugcucggcgcaagagaaaccgggaggauggagaaaagacauuuguugcccagaugaccguguucgacaaaaaucgcagacuccagcugcuggauggcgaguacgagguggccaugcaggaaauggaggaaugucccaucuccaagaaacgggcuacgugggagacaauucucgacgggaagagacugccucccuucgaaaccuuuucucaaggacccacacuucaguucacccugcgcuggaccggcgagacaaacgauaaaagcacggcgccuaucgccaagccgcucgcuaccagaaauuccgagagccugcaucaggaaaacaagcccgggucugucaaaccuacacaaaccauugccgugaaggagucccuuacaaccgaccugcagacgcggaaagaaaaggauacacccaaugagaaccgccagaaacuccggaucuuuuaucaguuccuguacaauaacaauaccagacaacagaccgaagcccgcgacgaccugcacugcccuugguguacacucaacugccggaagcuguauagccuucugaagcaccucaaacugugucauucuagauuuauuuucaauuacguuuaccaccccaagggcgcucgcaucgauguguccauuaacgagugcuaugacggaagcuacgccggcaauccgcaggauauccaucggcagccuggguuugcguucuccagaaacggacccgucaaacgcaccccuaucacacacauucuugugugucggcccaagagaacgaaagccucuaugagcgaguuucuggaauccgaggacggcgaaguugagcaacagcggaccuauucuagcgggcauaaucgccucuacuuccacuccgauacaugccugccucugagaccccaggagauggaaguggacagcgaggaugaaaaggacccggaguggcuccgggaaaagaccaucacacagauugaggaguuuucugaugucaacgaaggagagaaagaagugaugaagcuguggaaccuucacgucaugaaacauggcuucaucgccgacaaucaaaugaaccacgccuguaugcuguuuguggagaauuaugggcagaagauuaucaaaaagaaccucugcagaaauuucaugcugcaucugguuuccaugcacgauuucaaccuuaucagcauuaugucuaucgacaaagcugugaccaagcuccgcgaaaugcagcagaagcuggagaaaggcgaguccgccagcccugcuaaugaagagauuacggaggaacaaaacggaaccgccaauggcuuuucugaaaucaacagcaaggagaaagcgcuggagacagacuccgucagcggggugucuaagcaguccaaaaagcagaagcucuga

SEQ ID NO: 76491 - RNA, 2052 nt, Artificial Sequence
  derived and/or modified sequence opt5 from SV2B__Homo_sapiens__NP_055663
auggacgauuacaaguaucaggacaacuacggcggguaugcccccagcgauggauacuauagaggcaaugaguccaacccugaagaggacgcucaaucugaugugaccgaagggcacgacgaggaagaugagaucuacgagggagaauaucagggcauuccgcaucccgacgaugugaaagccaagcaggcgaaaauggcuccuagccggauggacucccugcgcgggcagacagaucucauggccgagagacuggaagacgaggagcaacuugcccaccaguacgaaacgaucauggaugagugcggacauggccgguuccaguggauucuguuuuucguucucggccuggcucuuauggccgacgggguggaaguguuugucgugucuuucgcucugcccagcgccgagaaggacaugugucucuccucuagcaaaaagggaaugcugggcaugaucguuuaccuggggaugauggcgggagccuuuauucucggcgggcuggcugauaaacuuggacgcaagagagugcuguccaugagccucgccgucaaugcuucuuucgccucccugagcucuuuugugcagggcuauggcgcguuccuuuucugccggcugaucuccgggaucggaauuggcggggcccucccuaucguuuucgcuuacuuuagcgaauuucugucucgcgagaagagaggagagcaccuguccuggcucggcaucuuuuggaugaccgggggacuguaugccagcgcuauggccugguccauuauuccccauuacggcuggggcuucucuauggggacaaacuaucacuuccacagcuggcggguguuugucaucgugugugcccuuccuugcaccguguccauggucgcucugaaauucaugccggaaagcccccgcuuucuccuggagaugggaaagcaugacgaagcguggaugauucuuaaacaaguucacgauacaaauaugagagccaagggcaccccugagaagguguucacagugucuaacaucaaaacccccaagcagauggacgaauuuaucgagauucaguccagcacggggaccugguaccagcgguggcugguccgcuucaaaacaaucuuuaagcaagugugggauaaugcucucuauuguguuaugggaccuuacagaaugaacacccugauucuggccguggucugguucgccauggcuuuuucuuacuauggccucacagugugguuccccgacaugauccgguacuuucaggaugaggaauauaaaagcaagaugaaaguuuucuuuggggagcauguguacggcgccaccauuaauuucacgauggaaaaccagauccaccaacacggaaagcuggucaaugacaaguucacacgcauguauuuuaaacaugugcuuuucgaggauaccuuuuucgacgaaugcuacuuugaggaugucacauccaccgacaccuauuucaagaacuguacaaucgagucuacgaucuuuuacaauaccgaccuguacgaacacaaauucauuaacugcagauuuauuaauagcacauuccucgagcagaaggaaggcugucauauggaucuggagcaggacaacgauuuucuuaucuaucugguguccuuccucgggagccugucuguucugccgggaaacauuaucuccgcgcuccugauggaccggaucggcagacuuaaaaugauugggggaagcaugcugaucucugcugugugcugcuuuuuccucuucuuuggcaauuccgagagcgccaugauuggguggcagugucuguucugcggcaccuccaucgccgcuuggaacgcccuggaugucauuacaguggaacuuuacccuaccaaucaacgcgcuacggccuuuggaauccucaacggccuguguaaguucggggcgauucugggaaauacaaucuuugccucuuucguuggcaucaccaaggugguccccauucuccuggcugccgcuagccuugucgggggaggccugaucgcccuccggcugccugagaccagagaacaggugcugauguga

SEQ ID NO: 76492 - RNA, 2031 nt, Artificial Sequence
  derived and/or modified sequence opt5 from SV2C__Homo_sapiens__NP_001284645
auggaggacagcuacaaggauagaaccucccugaugaaaggcgccaaggacaucgcucgggaagugaaaaagcagacagucaaaaagguuaaccaagccguggaucgcgcgcaggacgaguauacgcagagaucuuacagccgguuccaggaugaagaggacgaugacgauuauuaccccgcuggggaaaccuauaauggagaggccaacgacgaugagggcuccucugaagccacagaggggcacgacgaagaugacgagauuuacgagggagaauaucaaggcaucccuagcaugaaucaggcuaaggacuccauugugucugucgggcagccgaaaggagaugaguacaaggaccgcagagaacucgagagcgaacggcgcgccgaugaggaggaacuggcucagcaauacgagcuuaucauucaggaaugcggccauggcagauuucagugggcccuguucuuugugcucgggauggcgcugauggccgacggaguugagguguucgucgugggcuuuguucuucccuccgcugaaaccgaucuguguaucccuaacagcgggucuggauggcucggcuccaucguguaucuggggaugauggucggagccuucuuuuggggcggccuggcugacaaaguggggcggaagcagagccuccugauuugcaugucugugaauggauucuuugccuuccuuuccagcuuuguccaaggcuacggguucuuucuguucugucgccuccugucuggauucggcaucgggggagcgauucccacaguguuuuccuauuucgccgagguucuugcuagagagaaacggggcgaacaccugagcuggcucugcauguuuuggaugaucggcgggauuuacgccuccgcuauggccugggccaucauuccucauuauggauggucuuucagcaugggcuccgcuuaccaguuucacagcuggcgcguguucgucaucgugugugcgcugcccugcguuucuuccguggucgcccugaccuuuaugccugagagcccgagauuccuccuggaaguggggaagcaugaugaggcuuggaugauccuuaagcugauucacgacacaaacaugcgggcccgcggacagcccgaaaaaguuuuuaccgugaauaagaucaaaacgccuaagcaaauugaugagcucaucgagauugaaucugacaccggcacaugguauagacgguguuucgucagaauccgcaccgagcuguacgggaucuggcuuacauuuaugcggugcuucaacuaccccgugagagauaauaccauuaaacugacgaucgucugguuuacacucagcuucggcuauuacggacuguccgugugguucccugacguuauuaagccccugcagucugacgaauaugcccuccugacccgcaacguggagcgggauaaauacgcuaauuuuacaaucaacuucaccauggagaaucagauucacaccggcauggaauaugacaacgggagauuuaucggagucaaguucaagagcgugacauuuaaagauuccguuuucaagagcuguacguuugaggacgugaccucugucaauacauacuucaaaaacugcaccuuuaucgauacaguguucgacaacaccgauuuugaaccguauaaguucauugacuccgaguuuaaaaauuguagcuucuuccauaacaagacgggcugccagaucacauuugaugacgauuacucugccuacuggauuuauuucgugaauuuucuugggacccuggcgguucucccuggaaacaucgucuccgcucugcuuauggaccgcauuggccggcugaccaugcucgggggcagcauggugcuguccggaaucucuugcuucuuucugugguucggcacaagcgaauccaugaugauugggaugcucugucuguacaauggacuuaccaucucugccuggaacagccuggauguggucacaguggagcucuaucccacggacagacgccggagaguucugccuugcugucccggcuga

SEQ ID NO: 76493 - RNA, 10716 nt, Artificial Sequence
  derived and/or modified sequence opt5 from SVEP1__Homo_sapiens__NP_699197
auguggccccgccuggcuuucugcugcuggggccucgcucuggugagcgggugggccaccuuucagcaaauguccccuucucggaacuucagcuuucgccuuuuccccgaaacagcccccggagcuccuggcuccauucccgccccucccgccccuggggacgaagcugccggaucuagagucgaacggcugggccaggcuuuucgcagacggguucgccuccugagagaacuuagcgagcggcuggaacucguguuccugguggaugacuccucuagcgucggggaggugaauuuucgcuccgagcugauguucguuagaaagcuccugagcgauuuucccgugguccccacggccacccggguggcgauuguuaccuucucuuccaaaaacuacguggucccucgcguggacuauaucagcaccagacgggcccgccagcacaagugcgcccuucugcuccaggaaauucccgccaucucuuacagaggaggcggcacauauaccaaaggggcuuuucaacaggccgcccagauucugcuucacgcccgggaaaauuccacaaagguggucuuccugaucaccgauggauacagcaacggcggggacccuagacccaucgcugccucucuccgcgauuccggaguugaaauuuuuacguucggcaucuggcaggggaauauucgggagcugaacgacauggcuagcaccccgaaagaggaacacuguuaucugcuccauuccuucgaggaauuugaggcccuggccagacgcgcccuucacgaagaucugccuucuggauccuucauccaagacgauauggugcauugcuccuaccucugugacgagggcaaggauugcugugaccggaugggcagcugcaagugugggacacacaccggacacuuugagugcauuugugaaaaaggcuauuacgggaagggacugcaguacgagugcacagcgugccccucuggcaccuauaaaccugaagggucccccggaggcaucagcucuuguauucccugcccugacgagaaucauacgagcccgcccggcuccacaucuccugaagauugugugugcagagagggguaccgcgccagcggacagaccugugagcuuguccacugccccgcucugaagccucccgaaaacggcuauuucauccagaauacauguaacaaucauuuuaacgccgccugcggggugcggugucacccgggauucgaccucguuggcuccagcaucauucugugccugccuaaugggcucuggucuggcuccgagagcuacuguagagugagaaccugcccccaucugcggcaaccuaaacauggacacaucucuugcuccaccagagaaaugcuuuauaagacaacgugucuggucgcuugcgaugagggcuaccgccucgaagggagcgacaagcugaccugucagggaaacucccagugggauggccccgagccucggugcguggagagacauuguucuacauuucaaaugcccaaagacguuauuaucagcccgcacaauugcgggaagcagccugccaaauucggaaccauuuguuauguguccugccggcagggcuuuauccuuucuggggucaaggaaaugcugcgcuguacaaccagcggcaaauggaacgugggaguccaggcggcugugugcaaggauguugaggcgccccagaucaacugucccaaagacauugaagccaagacgcucgagcagcaggauuccgcuaaugugacauggcagaucccuaccgccaaggacaacagcggcgagaaagucucugugcauguucacccggcuuucacacccccuuaccuguuucccauuggggauguggccaucgucuacacagcgaccgaccuguccggaaaucaagccagcugcauuuuccacaucaaggugaucgacgcugaaccucccgugauugauuggugcagaucuccucccccgguucaggucuccgagaaagugcaugccgcuagcugggacgaaccucaguuuucugauaacagcggcgccgagcucgugaucacacggucccacacgcagggggaccuguucccccaaggagaaaccauuguccaguauacagcgaccgauccuagcggcaauaacagaacaugugacauccauauugugaucaaggggucucccugcgagauuccguucaccccuguuaauggcgauuuuaucuguacgcccgacaacaccggagugaauugcacacuuaccugucuggagggcuacgauuucacagaaggguccaccgacaaauauuacugcgccuaugaggauggagucuggaagccuacguacacaaccgaauggcccgacugugcuaagaaacgcuuugccaaccacggcuucaagagcuuugagauguucuauaaagcugcccggugcgaugacacagaccucaugaagaaauuuuccgaagccuucgagaccacccuggggaagauggugcccucuuuuuguagcgaugcugaggacaucgauugcagacuggaagagaaucuuacaaagaaauacugucucgaauacaacuaugacuacgagaauggauucgcgauuggcccugggggcuggggagccgcuaaccgccuggauuauuccuacgacgauuuucuggacacgguucaggaaaccgccacaucuaucggcaaugccaagagcuccagaauuaaacggucugcuccgcucagcgauuauaagaucaaacugauuuucaacaucaccgccuccgugccccuuccugacgagcgcaacgauacacuggagugggaaaaucagcaaagacuccugcagacccuggagacgaucacaaacaaacuuaagcggacccucaauaaagaccccauguacagcuuucagcuggcgucugaaauucugaucgcugauuccaacagccucgagaccaagaaagccucuccuuucugccgccccggguccguccugagaggacggaugugcgugaauuguccucuuggcacauauuacaaccuggagcacuuuaccugcgaaagcugucgcauugggucuuaccaagacgaggaaggacagcucgagugcaagcuguguccguccggcauguauacagaauacauccauagcagaaauauuuccgacugcaaagcccaguguaagcagggcacguauagcuacucugggcuggagaccugcgagagcuguccccuuggaacauaucaaccuaaauuuggcucccggucuugccucagcugucccgaaaacaccuccacaguuaagcgcggggcugugaauaucucugccugcggagucccuugccccgagggcaaguucagcagauccgggcugaugccgugucacccuugcccccgggauuacuaucagcccaacgcgggaaaggcuuucugucuggccugcccuuucuacggcaccacgcccuuugccggcucuagaagcaucaccgaauguuccagcuucucuuccacauuuagcgcugccgaggaaucuguggugccuccggcuucccucgggcauauuaagaaacgccacgagaucagcucccaggucuuccaugagugcuuuuucaaucccugucacaacucuggaaccugccagcaacugggccggggguacguuugucuuugcccucugggauauacaggccucaagugugaaaccgacauugaugagugcagcccccugccuugccugaauaacgggguguguaaagaccuugugggagaauuuaucugcgagugucccuccggcuacacaggccagagaugcgaagagaauauuaacgaguguuccucuuccccgugccucaacaaggggaucugugucgauggaguggccggcuaucgcugcaccuguguuaagggguucgugggacugcacugcgaaacggaggucaaugaaugucagagcaacccuugccugaauaacgcggugugugaggaccagguuggcggguuccucugcaaaugucccccuggauuucugggcacacgguguggcaagaauguggaugagugccuuucucaacccuguaaaaacggggcuaccugcaaggacggagcuaauagcuucagaugucugugcgccgcuggcuuuaccgggucccauugugaacucaacaucaaugagugccagucuaacccuugucgcaaucaggccacaugcgucgaugaacugaacagcuacuccuguaaaugccaacccggauucucuggcaagcggugcgagaccgaacagagcacgggguuuaaucuggacuucgagguguccggaauuuauggcuacguuaugcuugauggcaugcugccgagccuccacgcccugacauguaccuuuuggaugaagucuuccgacgacaugaacuaugggacaccuaucagcuacgcuguggauaauggauccgacaacacccuccugcuuacagauuacaacggcuggguccuguaugugaaugggagagagaaaauuaccaacugccccucugugaaugacggacgcuggcaucacaucgcgauuacguggaccagcgccaacggcaucuggaaggucuacauugaugggaaacucuccgacggaggcgcuggccugucuguugggcugcccaucccuggaggcggggcccuugugcugggacaggaacaggauaagaaaggcgagggguucagcccggccgaauccuuugugggaagcaucucucaacucaaucugugggacuauguccucagcccccaacaggugaagucccuggcuacaucuuguccugaggaacuuuccaagggcaacguucuggccuggcccgauuuccucagcggcauuguggggaaagucaagaucgacucuaaaagcaucuuuugcuccgauuguccucggcugggaggcucugugccccaucugagaaccgcgagcgaggaccuuaagccuggguccaaaguuaaucuguucugcgauccgggauuucagcucgugggcaaccccguccaauacugucugaaucaggggcaguggacacagccucucccccacugcgagcggaucagcuguggcgugccucccccgcuggaaaacggauuccacuccgcugacgacuucuaugccggcucuaccgucacguaccaaugcaauaacggguauuaccuucugggagauagccgcauguuuuguacagacaauggcuccuggaacggggugucuccuagcugccuggauguugacgagugcgccgugggauccgauuguucugaacaugcuagcugccucaaugucgacggcuccuacauuuguagcugcgugccgcccuauaccggggauggcaagaacugugccgagccuaucaaaugcaaggcgcccggaaauccugaaaacggccacucuuccggggagaucuacacaguuggagcugaggugaccuucagcugucaggaaggcuaucagcugaugggggucaccaagauuacaugccuugagucuggagaauggaaccaucugaucccguacuguaaagccguguccugcggcaagcccgccauuccugagaauggguguaucgaggaacucgcuuuuacguucggcagcaaagugaccuauagaugcaacaagggauacacacuggccggcgacaaagagucuuccugccucgcuaauagcuccuggagccacucucccccuguuugugaacccgucaagugcagcuccccggagaacauuaauaacgggaaguauauccugucuggacuuaccuaccugagcacagccuccuacucuugugauaccggcuauagccugcaggggccuuccaucauugaaugcacggcgucuggaaucugggaccgggcgcccccugcuugucaccucguguuuugcggcgagcccccugccauuaaagaugcugugaucacaggcaauaacuucaccuuucgcaauaccgucacauacaccuguaaggagggguauacacuggccggacuugacacgauugaaugccuggccgauggcaaauggagcagauccgaccaacagugucucgcugugagcugcgacgagcccccgaucguugaucaugcgucuccugaaaccgcccaccggcuguucggggacauugcuuuuuacuauuguuccgauggauacagccucgccgacaacucucagcugcuuugcaaugcccaaggcaagugggugccgcccgaggggcaggauaugccuagaugcaucgcucauuucugugaaaaaccgcccuccgucagcuauuccauccuggagucugugagcaaggccaaguuugcggcuggauccguugugagcuucaaaugcauggagggcuuuguccugaacacaucugccaagauugaauguaugcgcggcgggcaguggaauccuucccccaugagcauccagugcauuccugugcgguguggagagcccccuucuaucaugaacggcuacgccagcggguccaauuacucuuucggagcuaugguugccuauagcugcaacaaaggcuucuacauuaagggggagaagaaguccaccugugaggcgacaggacaauggucuagccccaucccgaccugccacccuguguccuguggcgaacccccuaaggucgagaacggcuuucucgagcauacgaccgggagaaucuucgaaagcgaggugcgcuaucagugcaaucccggauacaaaucugugggcuccccggucuuuguuugucaggccaaccggcacuggcacagcgaauccccucugaugugcgugccccuugacugcgggaagcccccucccauucagaauggauucaugaaaggcgagaacuuugagguggggucuaagguccaauucuuuuguaaugaaggauaugagcuggugggcgauagcuccuggacaugccagaaaucuggcaaguggaacaagaaaagcaauccuaaguguaugccggcuaaaugccccgaaccuccccuccuggagaaccagcucguucugaaggaacuuaccacagaggugggggucgugaccuucuccuguaaagagggacauguucugcagggcccuagcgugcugaagugccuccccucucaacaguggaaugacuccuuuccugucuguaaaaucgugcugugcacaccgcccccucuuauuagcuucgggguccccaucccuucuuccgcccugcacuuuggaagcacggugaaguacucuuguguuggcggguucuuucucagaggaaacuccaccacacugugccagcccgauggcaccuggagcucuccgcugccugaaugugugcccguggagugcccccaaccugaagagauucccaauggcaucaucgacguccaggggcucgcuuaucuuagcaccgcccuguacacaugcaagccuggauucgaacugguuggcaacacgaccacacucuguggggagaauggacauuggcugggcgggaaaccgaccugcaaggcuauugagugucuuaaacccaaggaaauccugaacggaaaauucuccuacacagaucuccacuauggccagaccgugacguacagcugcaaucgcggcuuucggcuggaggggccuuccgcccugacaugucucgaaaccggagacugggacguggaugcgcccucuugcaacgccauucacugugacagcccucagcccaucgagaacggcuucgucgaaggggcugauuauuccuacggagccauuaucauuuauucuugcuuuccgggcuuccaaguggcugggcaugccaugcagaccugugaggagagcggaugguccucuagcaucccuacaugcaugcccaucgacuguggccuuccuccccacauugauuuuggcgacugcaccaagcugaaggaugaccagggguacuucgaacaggaggaugacaugauggaaguuccguaugugacaccucauccgcccuaccaccugggagccgucgcuaaaaccugggagaauacgaaggaguccccugcgacacauagcucuaacuuucucuacggcaccaugguguccuauacaugcaaucccggguacgaacugcuuggaaacccuguccugaucugucaagaggauggcaccuggaaugggagcgccccgucuugcauuuccaucgaaugugaccuccccacggcuccugagaacggcuuccugagauuuaccgaaacaagcaugggaucugccgugcaguauuccugcaaacccggccacauucuggccgggagcgaucuccgccuuugucuggagaauagaaaguggucuggagcuuccccucggugcgaggccaucagcuguaaaaagcccaacccuguuaugaauggcagcaucaagggguccaacuacaccuaucugucuacacucuacuaugaaugcgacccgggauacgugcugaauggcaccgagcgcagaacaugucaggacgauaaaaacugggacgaagaugagcccauuugcaucccugucgacuguagcucucccccugugagcgcgaaugggcagguucggggcgaugaauacaccuuccaaaaggagauugaguauacgugcaacgaaggauuucuucuggagggcgcccgcagcagagugugccucgcuaauggguccuggucuggagccacacccgacugugucccggugcggugcgcuaccccuccccagcuggccaacggcgugaccgaagggcuggauuacggauucaugaaagagguuacauuucacugucaugaaggcuauauccuccacggggcgcccaaacuuaccugccagagcgacggcaacugggaugccgagauuccucuguguaaacccgucaauugcggaccuccggaggaccuggcucauggcuuccccaacggguucuccuuuauccacggaggccacauccaguaccaauguuucccuggguauaagcuccauggaaauagcucuagacgcugccuguccaacggcagcuggucuggguccagccccuccugucuuccuugccgguguucuacacccgugauugaauacggcacggugaauggaaccgauuuugacugcggcaaggccgcuagaauccagugcuucaaaggguuuaagcugcucggacugagcgagauuacaugugaagccgacggccagugguccucuggguucccgcacugcgagcauaccagcuguggaucccugccuaugauccccaacgcuuuuauuagcgagacaucuuccuggaaagaaaaugucaucaccuauagcugccgcucuggcuacguuauucaaggcagcuccgaucucaucuguacggagaaggggguguggucucagccuuaccccgugugcgaaccucuuagcuguggaagcccucccagcgucgccaacgcgguggccaccggcgaggcucacacauaugaaucugagguuaaacugcggugccuggagggguacaccauggacacagauaccgacacguucacaugucagaaggauggaagaugguuucccgaacggaucuccugcagccccaaaaaguguccccucccugagaauauuacccauauccuggugcacggcgacgauuucuccgucaaccgccaggugucuguuagcugcgccgaaggguauacauuugagggagugaauauuuccgucugccaacuugacggcaccugggaaccgcccuucucugaugagagcuguuccccugugucuugcggcaagcccgagagcccugaacacggguuuguggucggauccaaauacaccuucgagagcacaaucauuuaucagugugaacccggcuacgagcuggaagggaacagagagcggguuugccaggagaaucgccaguggucuggaggcguggcuaucuguaaggaaacgagaugcgagaccccucucgaguuccugaacgggaaagccgacaucgagaaucggacaaccggacccaacguggucuauuccuguaaccgcggcuacagccuggagggcccgucugaagcccauugcacagagaaugggaccuggucccacccugugccccucuguaagccuaaccccugcccgguuccuuuugugauucccgaaaaugcgcuucugagcgagaaagaguucuacgucgaucaaaacgugucuaucaaguguagagagggauuucugcuccagggccaugggauuaucacgugcaaucccgacgagacauggacccagaccagcgcuaagugcgagaaaauuuccuguggaccucccgcccacguugaaaacgcuaucgcccggggcgugcauuaucaguacggggauaugaucacauauagcugcuacuccggauauaugcuggaaggcuuccuucgcucugucugucuggagaauggcaccuggacaagcccuccgauuugcagagccgugugucgguuucccugccaaaacgggggaaucugucagagaccuaaugcuugcuccugucccgaaggcuggauggggcgccucugcgaggagccuauuuguauccugcccugccugaacggaggccgguguguugccccguaccagugcgacugcccucccggguggacgggaucuagaugucacaccgcggugugccaaagcccuugucucaauggcggcaagugcguccgccccaaccggugucacugccuuuccucuuggacagggcauaauuguagcagaaaacgccggaccggauucuga

SEQ ID NO: 76494 - RNA, 5367 nt, Artificial Sequence
  derived and/or modified sequence opt5 from SVIL__Homo_sapiens__NP_003165
augaagagaaaagaacggaucgcccgcagacuggaaggcauugaaaacgacacccagcccauccuccugcagagcugcacagggcuugugacgcaccggcugcucgaagaagauaccccucgcuauaugagagcuuccgacccggccucuccccauauuggacggagcaaugaagaggaggaaacauccgauucuagccuggagaagcagacccgcuccaaauauuguacagaaaccucuggcguccacggggacagcccuuacggauccggcacaauggauacccauagccuugagucuaaggcggagagaaucgcucgguauaaagccgaacgcagacggcagcuggccgagaaguacgggcucacgcuggaccccgaagcugauuccgaguaucugagccgcuacaccaagucuagaaaagaaccugacgccguugagaagcggggaggcaaauccgauaagcaggaggaaagcucucgcgacgcuuccagccucuaucccggcacagagaccauggggcugagaacaugcgccggagaauccaaagauuacgcgcuucacgugggcgacgggucuagcgauccugaggugcugcucaacauugaaaaucaacggagaggacaggagcuguccgccacccgccaggcucaugaccuuagcccggccgcugagucuuccagcacguucucuuuuagcggccgggacuccucuuucacagaaguccccagaagcccuaagcacgcccacuccagcucucugcagcaagcggccucccgcagccccucuuuuggggauccucagcucucccccgaggcucggccgagauguaccagccauuccgaaacaccuaccguggacgaugaggaaaagguugacgagcgcgccaaacugucuguggcugccaagcggcugcuguucagagagauggaaaagagcuuugaugagcagaacguccccaagcgccgguccagaaauaccgccguggagcagcgccugcggagacuucaagaccggucucugacacagccuaucacgaccgaggagguugugaucgcugcgacacuccaggccagcgcucaccaaaaagcccuggccaaggaucagaccaacgaaggaaaagagcuugcugaacagggcgagcccgacuccagcacacugucucucgccgaaaagcuggcgcuguucaauaagcucucccagcccgucagcaaagcuauuucuacccgcaacagaaucgauacgcggcaaagacgcaugaaugcccgguaccagacacagccugugacccugggcgagguggagcagguccaauccgggaaacuuauuccguuuagccccgccguuaacaccucugugagcacaguggcuuccaccgucgccccuauguaugcuggagaccugagaacaaaacccccucucgaucauaaugccagcgcgacggacuacaaguucucuuccagcaucgaaaacuccgacucucccgugcgcagcauucugaaaucccaggccuggcagccgcuuguugagggcucugaaaauaaggggaugcugagagaguauggagaaaccgagagcaagcgggcucucacaggccgcgauuccgggauggagaaauacggaucuuuugaagaggccgaagcuagcuauccuauccugaacagagcccgggagggcgacucccacaaggaaagcaaauacgcggugccccgcagaggcucucuggagcgggccaauccucccauuacccaccucggggaugagccuaaggaguucuccauggcuaaaaugaacgcccagggaaaccuggaccuucgcgauagacugcccuuugaggaaaaggucgagguggagaauguuaugaagcggaaauucagccuccgcgcugccgaauuuggcgagccgacaucugaacaaaccgggacggccgcuggaaagaccaucgcgcagacaaccgccccuguguccuggaaaccccaggacagcucugagcagccccaagaaaagcugugcaaaaacccuugugcuauguucgccgccggcgagaucaagacaccgaccggggagggccugcuugauucccccagcaagacgauguccauuaaagaaagacucgcucugcugaagaaaagcggagaggaagacuggcggaauagacucucucgccggcaggagggcgggaaggccccugcgagcucccugcauacacaggaagcuggaagaucucuuaucaaaaagcgcgucaccgagagccgggagucccaaaugacaauugaagagagaaaacagcugaucaccgugcgcgaagaggccuggaagacccggggcagaggggccgcuaacgauucuacacaguucacggucgccggacgcauggugaagaaaggccucgcgagccccaccgcuauuacaccuguugccucccccaucugcgggaagacccggggcacaaccccugugucuaaaccccuggaagacaucgaggccagaccggauaugcagcuggagagcgaccuuaagcucgaucggcuggaaacguuucugcgcagacucaauaacaaagucggaggcaugcacgagacagugcugaccguuaccgggaaguccgugaaggaagucaugaaaccugacgacgaugagacauucgcuaaguuuuaucggagcguggacuacaauaugccccgcucuccuguggagauggaugaagacuucgauguuauuuuugaccccuacgccccgaaacuuaccuccagcgucgcugagcauaagagagccgugcggccuaaaagacgcgugcaagcgucuaagaacccccugaagaugcucgccgcucgggaagaucugcugcaggaguauacagaacagagacuuaaugucgccuucauggaguccaaacgcaugaagguggagaaaaugagcuccaacucuaauuuuagcgaaguuacgcucgcuggacuggccuccaaggagaacuucagcaaugugucucugcgguccgucaaccucaccgaacagaauagcaacaacucugccgugccuuacaaaagacugaugcuucugcaaaucaagggccgccggcacguucagacaagacucguggagccccgcgcuagcgcgcucaauuccggggacuguuuucugcuucucucuccccauugcuguuuccugugggucggagaauuugccaacgugauugagaaggcuaaagccagcgagcuggccacccucauccagacaaagagagaacugggcugccgggcuaccuauauucagacgaucgaggaagggaucaauacccacacacacgccgcgaaagauuucuggaaacuucugggcggacaaaccuccuaccagucugcuggcgacccuaaagaggaugaacucuaugaggccgccauuaucgagacaaacuguauuuaccgccugauggacgauaagcugguuccggacgacgauuauugggggaaaauccccaagugcagccuucugcagccuaaggaagugcucgucuuugacuucggauccgagguguacguguggcauggcaaagaagucacccuggcucaaagaaagauugccuuccagcucgcgaaacaccuguggaaugggacauuugauuacgagaacugcgacaucaauccccuugauccuggagaguguaacccccugauuccucggaagggccaggggcgcccggacugggcuaucuucggcagacucaccgaacauaaugagacgauccuguuuaaagaaaaguuccuggauuggacagagcuuaagcggagcaacgagaagaaucccggagagcuggcccagcacaaggaggacccuagaaccgauguuaaagccuaugacgugacccgcauggugucuaugccccaaacaaccgcuggcacgauucucgauggggucaacgugggacggggcuacgggcugguugaaggacacgacagacgccaguuugagaucacauccgugagcgucgacguguggcauauucucgaguucgauuauucccggcugccuaagcagucuaucggccaguuucacgagggcgacgccuacguugugaaauggaaguucauggucagcaccgcugugggguccagacaaaagggagaacauucuguucgggccgcgggcaaagagaagugcguguacuuuuucuggcaggggcgccacagcacagucuccgagaaaggaaccagcgcccuuaugacaguggaacuggaugaggaaagaggcgcucaggugcagguccuccaagggaaggagcccccguguuuucugcagugcuuccagggaggcaugguugugcauucuggccggcgcgaagaggaggaagagaaugugcaguccgaauggagacuguacuguguccgcggggaagugccuguugagggaaaccuucuggaaguggccugccacuguagcucucuccgguccagaaccagcauggucgugcugaauguuaacaaagcucucauuuaucuguggcacggcugcaaggcccaagcccauacgaaggagguggggcggaccgcugcgaacaaaaucaaggaacaguguccccuugaggccggacugcacucuagcuccaaagucacaauccaugaaugcgacgagggcucugagccccugggguuuugggaugcucucggacgcagagaccggaaggccuacgauuguaugcugcaggacccuggcagcuucaauuucgcccccagacuuuuuauucuguccagcuccucuggcgauuucgcugccaccgaauuuguguacccugcgcgcgcuccgagcgucguguccucuaugcccuuccuccaagaggaccuguauagcgccccucagcccgcccucuuucugguugauaaccaccaugaaguguaccuuuggcaggggugguggccuaucgagaauaaaauuacaggauccgcucggaucagaugggccucugaccgcaagagcgcgauggaaaccguccugcaguauugcaagggcaaaaaccugaagaaacccgccccgaaguccuaccucauucacgcugggcuggagccucuuacguucacaaauauguuucccagcugggagcaccgggaagauaucgccgagaucaccgaaauggacacagaggugucuaaccaaauuacccugguugaagacgugcucgcuaaacugugcaagaccaucuauccucucgccgaucugcuugcuagaccccugccugagggagucgacccccugaaacucgagauuuaccugacagaugaagacuucgaguuugcccuugauaugacgcgcgacgaauauaaugcgcugccggccuggaagcaagugaaccucaagaaagcuaagggccuguucuga

SEQ ID NO: 76495 - RNA, 234 nt, Artificial Sequence
  derived and/or modified sequence opt5 from SVIP__Homo_sapiens__NP_683691
augggccugugcuuccccuguccuggggagagcgccccgcccaccccugaccucgaagagaagagagcuaaacuggccgaagcggcugagcggcgccagaaggaagccgccuccagaggaauccuugaugugcaaucuguccaggagaaacggaagaaaaaggagaagauugaaaaacagaucgcuacaagcgggcccccucccgagggcggacugcgcuggacgguuuccuga

SEQ ID NO: 76496 - RNA, 1647 nt, Artificial Sequence
  derived and/or modified sequence opt5 from SVOP__Homo_sapiens__NP_061181
auggaggaagaccuguuccagcucagacaacugcccguggucaaguuucggcgcaccggcgagagcgccagauccgaagaugacacagcuucuggggagcacgaaguucagaucgagggagugcaugugggccuugaggccgucgaacuggaugacggggcggcugugccuaaagaguucgccaacccgacggaugacaccuuuaugguugaagaugccguggaggcuauuggauucggcaaguuucaguggaaacucagcguccugacagggcuugccuggauggcugacgccauggagaugaugauccuguccauucucgcgccccagcugcacugcgaauggcggcugccuucuuggcaaguggcccuccugaccagcguuguguucgucggaaugauguccucuagcacacuuuggggcaauaucuccgaucaguacggccgcaagaccgggcugaaaauuagcgugcucuggacacuguauuacggaauccuuucugcuuuugcccccguguauuccuggauccugguccucagaggccugguuggguucggaauuggcggggugccucagagcgugacccuguacgcugaguuucuccccaugaaggcccgggcgaaguguauccugcuuauugaagucuucugggccaucggaacgguguuugagguugugcuggcugucuucgugaugccuucucucggcuggcgcuggcugcuuauucuguccgccguuccgcuccugcuguuugcugugcucugcuucuggcugcccgaaagcgccagauaugacguccuuucuggcaaccaggagaaagccaucgcuacccugaagcggauugcgacagagaauggggccccuaugccccucggaaaacugaucaucucccgccaagaagauagaggcaagaugcgggaccuuuucaccccucauuuucgcuggacaacccugcuccugugguucauuugguuuagcaacgcuuucuccuacuaugggcuggugcuccugacgacagagcuuuuucaggccggagaugucuguggcaucucuagccggaaaaaggccguggaagcuaagugcucccuggccugugaguaccucagcgaagaggacuacauggaccugcuguggaccacacuuucugaguuccccgggguucucgugacccuguggauuaucgauagacugggacgcaaaaagaccauggcgcucugcuuugucauuuucuccuuuuguagccugcuucuguucaucugcgugggcagaaauguucucacacugcugcuuuuuaucgcucgggccuucauuucuggcggguuucaggccgcuuauguguacacgccggaagucuauccuaccgccacaagagcucucggacugggcaccuguagcgggauggcccgcgugggagcgcugaucacacccuucauugcccaggugaugcucgaguccucuguuuaccugacccuugcugucuauagcggcugcugucugcucgccgcucuggccuccugcuuccugccuaucgaaacgaaagggcggggccuucaagagagcucucacagagaauggggacaggagauggugggccgcgggaugcauggagcgggcgugacacgguccaacagcgggucucaggaguga

SEQ ID NO: 76497 - RNA, 1758 nt, Artificial Sequence
  derived and/or modified sequence opt5 from SWAP70__Homo_sapiens__NP_055870
augggcagccugaaggaggaacuccugaaagccaucuggcacgcuuucaccgcccuugaccaggaucauuccgggaaggugucuaaaagccaacugaagguccucucccacaaccugugcacaguucuuaaagugccccaugacccuguggcgcuggaggaacacuuuagagaugacgaugagggaccggucucuaaucagggcuacaugcccuaucucaaccgguucauucuggaaaaggugcaggacaauuuugauaagaucgaguucaaccgcauguguuggacgcugugcguuaaaaagaaucucaccaaaaacccucugcuuauuacagaggaagacgcuuuuaagaucugggugauuuucaauuuucugagcgaggauaaauacccccucaucaucgucuccgaagagauugaguaucugcuuaagaagcugaccgaagccaugggagggggcuggcagcaagagcaguucgaacauuacaaaaucaacuuugacgauucuaagaaugggcucagcgccugggagcugauugaacugaucggaaacggccaguucuccaaaggcauggacagacagacagugagcauggcuauuaaugagguuuuuaacgagcucauccuggaugugcuuaagcaaggguauaugaugaaaaagggacaccggcgcaaaaauuggaccgaaagaugguucguccugaagccuaacauuaucucuuacuauguguccgaggaccucaaggacaaaaagggcgauauccugcuugacgaaaauuguugcguggagagccugcccgauaaagacgggaagaaaugucucuuucuggucaagugcuucgauaagacauucgaaauuucugccuccgacaaaaagaaaaagcaggaguggauccaggcuauucacagcaccauccaucugcucaaacugggaucuccuccgccccacaaggaggcccggcagcgcagaaaggaacuucggaaaaagcaacuggcggagcaggaagaacucgaacgccagaugaaagagcugcaagccgcuaacgaguccaagcagcaggaacuugaggccguucggaaaaagcuggaagaggcugccagcagagcggccgaggaagagaagaaacgccuccagacgcaaguggaacugcaggcuagauuuuccaccgagcuggaacgggagaagcucauucgccagcagauggaggaacaaguggcccagaaaucuagcgagcuggaacaguaccuucagagaguccgggagcuggaagauauguaccucaagcugcaagaggcucuggaggacgaaagacaggcccgccaggaugaggaaacagugcggaaacuucaggccagacuccuggaggaagaguccagcaagcgcgcugagcuggaaaaauggcaucucgagcaacagcaggcgauccaaaccacagaagccgagaagcaggagcuggaaaaccagcggguucuuaaggagcaggcucugcaagaagccauggagcagcucgaacagcuggagcuggagagaaaacaggcccuugaacaauaugaggaagugaagaaaaagcucgagauggcuaccaauaaaacgaagucuuggaaggacaaagucgcccaccacgaaggccugauccgccugauugagccuggguccaagaacccccaucucaucacaaauuggggaccugcggcuuucaccgaggccgaacuggaggaacgggagaaaaacuggaaggagaaaaagacaaccgaguga

SEQ ID NO: 76498 - RNA, 2703 nt, Artificial Sequence
  derived and/or modified sequence opt5 from SWT1__Homo_sapiens__NP_060143
augagcuccaaggagucuugcggcaaaaaggaaaccagccagagaaaagacacaacgaccuccucucccaacuucggggagaaggauaaaaaggaacggaagacacccgccagcuccaccucuagcuccagcauccgcucuguguccagcgagaaaagaaagcugaaaucugaccacacagauguccucuacuauaauauuaagcggcgccaaggacugaaaagacuuuccguugaaaucgacacccugcggcgcagaccgaagauuggcucuagcucccagcggcccaucaagcucaaagaggcuagcuacuccaacgauaaucagauuauccugcagucuccuagcuccaacgggacaaagaaagacauccacaaguguguggauuuuaaacccaaggacauuaaacuuaccaaugccggaagcaagcuggaucacggcaucaagucucucuccagcccuaaaauugcgucugacgugaagcccaaagcugaggggcaagccagcgaaaacaaguggucccaucugcugguccagcgcgagaaaaugaaggaacucaagaaaggaagaaauucuaaguuccgggauaacagcgagaaaugcgugcuggagaaguggaaacgcaaucaguuuucccaggacuauaacagcaauaagaucauuaaggaaccucuuggcucuagacggcagaaaaucuccuucaagauuccgaucaaaagccgcgauacgcugcaaaagcucguugaggaaaacguguuuaauaucgacucuaacaauuccaaaaccaagcaggaggaaagagaguaccuggagagcucccaggucucucuuaacgugacacggcaaaagaccgaacaucugcucagcgacuucacauauaaaagaaccguucacgaguggaagcgcaaacaccacuacgaucaucaggaauccaacgacucucacagccgggagaaucugacgcaguccuuugaagcccccuguugcagcgugucuuccgagagcauucaagaugcugaccaggagaugcagaucgucgaggaacugcaugccgcuagagugggcaagucuguggaucucccuggggaacugauguccauggagauugaccuugaagaugacguccacagcucuagcgccaacaauacauccgaucgcaaacugcucaucguuauugacaccaacauccugaugaaucaccuuaaguucgugcggauccugaaaacaaccgaggugcccggauuugauaagcucguccugauuaucccuugggugguuaugcaggagcuggacagaaugaaggaaggcaaacuccugaagcgcgcgcaacauaaagccauucccgcugugcacuucaucaacgacagccuuaagaaucaggaucggaaacugugggggcagucuauucagcucgccucccaaaagcauuauggacugagcgacgagaacaaugaugacagaguccuuaaguguugccugcagcaccaggaacucuuuccguguuccuucgugauccugugcaccgaugaccgcaaccugcggaauaaaggccucaucucugggguuaagagccuguccaaagaggagcuuucugcugaacugcuccaucugagccugaacacagaugugugucaccagccuugcauucccaagcaacagcuuaaagccgagacgaccccucucaaggaauccuacaaggaggaaucuacaaauagcggacuguccauccugcucgagagcauugucucugaccuggagaaaucccuuggcaccggccugagcucuauccucgaaacagagaugaagauugcguuugggaaccuguggauggaaauccuguaccuuaaaccucccuggacccuccugcaucugcuccaguguuucaagaaacacuggcuggccguguucggacuugucauggagaagaaucugcuccugacgauugaaucccuguauaagaaccuuagaaaagcuaacaaggccguggauuuuacaaccguuaaauuccuccugcaggacagccgcucucugcuccacgcuuuuuccacccggagcaauuacgauggcauccugccucaaacauucgcccaggugaacaaucuucugcagaccuuugccgaggucaagacaaaacucaagccgaacuccagcgagaauacggugaccaaaaagcaagaagggacaucucugaagaacagccauaaucaggagaucaccguuuucuccucuagccaucugccccagccuuccagacaccaggaaauuuggucuauccuugagagcguguggauuacaaucuaucaaaacuccaccgacgucuuucagcggcucggaucuaauagcgcucugacgaccuccaacauugcgagcuucgaagaggccuuuaucugccugcagaaacucauggcugccgugcgcgauauccuggagggcauucagagaauccuugcccccaauucuaacuaccaagacguggaaacacuguauaauuuccucauuaaguacgagguuaacaaaaaugucaaguuuaccgcucaggaaaucuaugacugcgugucccagacagaguaccgggagaaacugaccauuggguguagacagcugguggaaauggaguacacgaugcaacagugcaacgccagcgucuauauggaagcgaagaaccgcggauggugugaggauaugcuuaauuaccggaucuga

SEQ ID NO: 76499 - RNA, 1989 nt, Artificial Sequence
  derived and/or modified sequence opt5 from SYBU__Homo_sapiens__NP_001093213
augggcccccugagagagagcaaggaacaccgggugcagcaucacgacaaagagaucucccgcucucggauuccuagacucauccugcgcccgcauaugccccaacagcagcacaaggucagcccugccuccgaaucucccuucagcgaggaagaguccagagaguuuaacccuucuagcuccgggcggagcgcucgcaccguuucuuccaauagcuucugcucugaugacacaggaugucccuccagccagucuguguccccugugaaaacgccgagcgaugccggcaacucccccauuggguuuugcccuggaucugacgaaggcuucaccagaaagaaauguacaaucgggauggucggagagggcagcauucaauccagccgguacaagaaggaaucuaaauccggccuugugaagcccgggagcgaggcggauuuuucuagcuccucuagcaccggauccaucagcgcuccugagguucauaugucuacagccggcuccaaacgcagcagcuccagcagaaaucgggggccccacggacgcuccaacggcgccucuagccacaagccgggguccucuccuagcucccccagagaaaaagaccugcucagcaugcugugccggaaucagcuuucuccugugaacauccaucccuccuaugcucccagcucuccuuccagcucuaauagcggauccuacaagggcagcgauuguucuccgauuaugcgcagauccggccgguauaugagcugcggggagaaccacggagucagacccccuaaucccgaacaguaccugaccccucuccagcaaaaggaggugacaguucgccaucugaaaaccaagcugaaagaauccgagcggagacuccacgagcgcgaaucugagaucguggaacuuaagagccagcuugcccggaugagagaggacuggauugaagaggagugucaccgcgucgaagcucagcuggcccucaaagaggcgcggaaggaaaucaaacagcugaagcaagugauugagacgaugagauccucucuugccgauaaggacaaaggcauccagaaguauuucguggauauuaacauccagaauaaaaagcuggaaagccuccugcaauccauggagauggcucauucugggagccugcgcgacgagcucugccuggauuuucccugugacuccccggaaaaaucucuuacccugaacccuccccucgacacaauggccgauggacugucucuugaggaacaggucaccggcgagggggcugaccgggagcugcucguuggagauuccaucgccaauagcacagaccuguucgaugaaauugugaccgcgacgacaaccgagucuggcgaccuggaacucgugcacuccacaccuggcgccaacguccuggagcuucugcccaucgugauggggcaggaagagggaagcguuguggucgagagagcugugcagaccgauguugugccuuacucucccgccauuuccgaacucauccaaagcguccugcagaagcugcaggacccgugcccuuccagccuggcuucucccgaugagagcgaacccgacuccauggagucuuuuccugaaagccucuccgcccugguggucgaucugaccccgcgcaaucccaacucugccauucuccugagcccuguggagacacccuaugcuaacguugacgcggaggugcaugccaaucggcuuaugagagaacuggacuucgcugccugugucgaggaacggcucgauggcgugaucccucuggcccgcgggggaguugugagacaguacugguccucuagcuuucuggucgaccuucucgcuguggccgcgcccgugguuccuacgguccugugggcuuucuccacccaacggggcgggacagaucccguguacaacaucggcgcccugcucagaggaugcugcguggucgcccugcacagccuucgccggaccgcuuuuagaauuaagacauga

SEQ ID NO: 76500 - RNA, 957 nt, Artificial Sequence
  derived and/or modified sequence opt5 from SYCE1__Homo_sapiens__NP_001137235
auggccggcagaagccugaccuccaaggcugagcccacagccggggcgguggaccgggcugaaaaagccggaggccaggauacgucuagccaaaagaucgaggaccucauggaaaugguccagaaacugcagaagguugggucccuugagccucgcguggaagugcugauuaacagaaucaaugagguccagcaagccaaaaagaaggcuaacaaagaucucggagaggcccggaccauuugcgaagcucugcagaaggagcuugacucucugcacggcgaaaaagugcaucucaaggagauccugagcaaaaagcaggagacacugcgcauucucagacugcacugucaggaaaaggaguccgaagcccaucggaaacacaccaugcuucaagagugcaaggaacgcaucucugcgcugaaucuccagaucgaggaggagaaaaacaagcagagacagcugcggcuugccuucgaagaacaacuggaggaucucauggggcagcauaaagaccugugggauuuucacaugccggaacgccuggcuaaggagauuugugcccucgacagcuccaaagagcagcugcuuaaggaagagaagcugguuaaagcuacacucgaagaugugaagcaccaacugugcagccuuuguggagccgagggccccucuacccuggacgaaggccucuuccugagaucccaggaggcggccgcuacaguccagcuguuucaggaggaacaucggaaagccgaggaacuccuggcugccgccgcucaacgccaccagcagcuucagcaaaagugccagcagcagcaacagaaaagacagcggcugaaggaggagcucgaaaagcaugggaugcaagugccugcgcaggcccagagcacccaggaggaagaggcuggacccggcgauguugccccucgccccgggagaccugugacgugguggucuuga

SEQ ID NO: 76501 - RNA, 729 nt, Artificial Sequence
  derived and/or modified sequence opt5 from SYCE1L__Homo_sapiens__NP_001123451
auggccggcaagcugaaaccccucaacguggaggcuccugaagccaccgaggaagcggaggggcaggcuaagagccugaaaacagaagaccuucuggccauggucaucaagcuccaaaaagagggaucccuggagccgcagauugaagaucuuaucucuagaauuaaugaccugcagcaggccaagaagaaaagcuccgaggaacuccgggagacgcacucucugugggaggcucugcaucgcgaacucgauagccugaacggcgagaagguucaccuugaagaggugcuggggaaaaagcaagaagcccucagaauccugcagaugcauugccaggagaaagaguccgaagcucagcggcuugacgugcgcggacaacuggaggaucucaugggccagcacaaggaccugugggaguuccauaugcuggaacagagacucgcccgggaaauucgcgcgcuggagagaucuaaggagcagcuucugagcgaacggcgccucgucagagccaaacugcgggagguggaacgcagacuucacuccccucccgagguugaaggggcuauggccgugaaugauggacugaaggcugagcucgagaucuuuggcgaacaaguccggagcgcccccgaggugggcgcgggggaaggagaggccggcccugagcugccccgcgcuagagacgaagaggauccugaaccgcccguugccgcuccugacgcccuguga

SEQ ID NO: 76502 - RNA, 4593 nt, Artificial Sequence
  derived and/or modified sequence opt5 from SYCP2__Homo_sapiens__NP_055073
augcccaucagaccugaccugcagcaacucgagaagugcauugaugacgcccugcggaaaaacgauuucaagccgcuuaaaacccugcuccagaucgacauuugugaagaugugaagaucaaaugcagcaagcaguuuuuccacaaggucgacaaucugauuugucgcgagcuuaacaaagaagauauccauaauguuuccgcuauccuggugucugugggcagaugcgggaagaacauuagcguccucggacaggccggccugcugacaaugaucaaacaagggcucauucagaagaugguggcgugguuugagaaauccaaggacaucauucagucucagggaaauagcaaggaugaagcuguucugaacaugaucgaggaccuuguggaucugcuccuggucauucacgacguguccgaugagggcaaaaagcaaguuguggaaucuuucgucccccggaucuguagccuugugaucgacucccgcgugaauauuugcauccagcaggagauuaucaaaaagaugaacgccaugcuggacaaaaugccucaggaugccagaaagauucucagcaaucaagaaaugcugauccugaugucuuccaugggggagcggauccucgacgcuggagauuacgaccugcaggucggcauuguugaggcccuuugucgcaugacgaccgaaaaacagagacaagagcuggcucaucagugguuuagcauggauuucaucgccaaggcguuuaagcggauuaaagacucugaauuugagacagauugccgcaucuuccucaaccuggugaauggcaugcuuggggacaagagacggguguucaccuuucccugucuguccgccuuccucgauaaauaugaacugcagauuccuagcgacgagaagcuggaggaauuuuggaucgauuucaaccucggaucucagacacuguccuucuacaucgcuggcgacaaugacgaucaccaaugggaggccgucaccgugcccgaagagaaaguucagauuuauagcaucgaagugcgcgaguccaagaagcugcugacaauuauccucaaaaacaccgucaagauuucuaaaagagaggggaaggaacugcuucuguacuuugacgcuagccucgagaucacgaaugugacccagaaaauuuucggagccacaaagcaucgggaauccauccgcaagcagggcaucagcguugcgaaaaccucucugcacauucuguuugaugccuccgggagccaaauccucgugccugagucucagauuagcccggucggagaagaacuggugucccuuaaggagaaaucuaagagccccaaagaguucgcuaagccuuccaaguauaucaaaaacagcgacaagggcaacagaaauaacucucagcuggagaaaacaacccccuccaagcggaaaaugagcgaagccucuaugauugucuccggcgcugauagauacacgaugcgcagcccugugcucuuuuccaauacaucuauucccccgcggagacgccggaucaagccuccccugcagaugaccagcuccgccgagaaaccuucuguuagccaaacauccgagaacagaguggacaaugccgcuagccugaagucucgcuccagcgaagggcggcacagacgcgauaacaucgacaagcauaucaaaaccgcgaagugcgucgagaauaccgaaaacaaaaauguggaguuccccaaccagaauuuuucugaacuucaggauguuauucccgacucccaggccgcugagaagcgggaucacacaauccucccuggagugcuggacaacauuuguggcaauaaaauccauagcaagugggccugcuggacgccggucaccaacaucgagcugugcaauaaccaaagagccucuacaagcuccggggauacccucaaccaggacauugugaucaauaagaaacugacaaagcagaaauccucuuccagcauuuccgaccacaacucugaaggaaccggcaaggugaaauauaagaaggagcaaacggaucacaucaaaauugacaaggcugaaguugaggucuguaaaaagcauaaucagcagcagaaccaccccaaauacagcgggcaaaagaauacagaaaacgccaagcaguccgauuggccuguggagucugagaccaccuucaaaagcgugcuucugaauaagacaaucgaagagucccucaucuaccgcaaaaaguauauucugucuaaagacgucaacaccgcgacaugcgauaagaaucccagcgcuuccaaaaacgugcagagccaucggaaggccgaaaaggagcugacgucugaacuuaauuccugggacagcaaacagaagaaaaugagagagaagucuaaaggaaaggaguuuaccaacguugccgaaucccucaucagccaaauuaauaagcgguacaaaacaaaggaugacaucaaaucuacccgcaagcugaaagagucccugauuaacagcggcuucuccaauaagccugugguccagcucagcaaggaaaaagugcagaagaaaucuuauagaaagcugaaaacaaccuuuguuaacgugacgagcgagugucccgucaacgauguguacaauuucaaccuuaauggcgcugacgauccgaucauuaagcuggggauccaggaguuucaagccaccgcuaaggaagccugcgcggaccgguccaucagacucguuggaccucgcaaccacgaugagcugaaaucuagcgugaagacaaaagacaagaaaauuaucaccaaucaucagaagaagaaccuguucuccgacacagaaaccgaguaucggugugaugacucuaaaacggauauuagcuggcuuagagaacccaaguccaaaccucagcucaucgacuacucucgcaauaagaacgucaaaaaucacaagagcggcaaauccagaagcucucuggagaaggggcaacccuccagcaagaugacaccuucuaaaaacauuaccaagaaaauggauaagacaauccccgagggacggauccgccugccgagaaaagccaccaagaccaagaaaaauuauaaggaccucuccaacagcgaauccgagugcgaacaggaguucucucacagcuuuaaagaaaauauuccugugaaggaggagaacauccauucccggaugaaaacagugaagcugcccaagaaacagcagaaggucuucugugcugaaacggagaaagaacuuagcaagcaauggaaaaauucuucccugcucaaggaugccauucgcgacaacugccuggaucugagccccagaucucuuagcggcuccccuucuagcaucgagguuacccgguguauugaaaagaucacagagaaagacuuuacccaggauuacgacugcaucacaaaguccauuucuccguaccccaaaaccagcucccucgagagccugaacucuaauuccggggugggcggaacgaucaagagcccuaaaaacaaugaaaagaacuuccugugugcuuccgagucuugcagccccauuccucgcccccucuuucugccuagacacacacccaccaaauccaauaccaucgugaaccggaagaagauuucuagccuuguccugacacaggaaacccagaauagcaacagcuauucugacguguccagcuacucuuccgaggagcgcuucauggaaaucgagagcccgcauauuaaugaaaacuauauccaaucuaaaagagaggaaagccaccucgccuccucucugagcaaguccagcgagggccgggagaaaacaugguuugauaugccuugcgacgcgacgcacguuuccgggcccacccagcaucugucuagaaagcgcaucuacauugaagauaaucuuagcaacuccaaugagguggaaauggaggaaaaaggagagcggagagccaaccugcucccuaagaagcuguguaaaaucgaggacgcugaucaccauauucacaagaugucugaaagcgucuccucucucagcacaaaugacuucuccauccccugggagaccuggcagaacgaauuugccggcauugagaugacauaugaaaccuacgagcgccugaauagcgaguucaaacggagaaacaacauccgccauaagaugcuuucuuauuuuacgacccaguccuggaaaacagcucaacagcaccuucggaccaugaaucaccagagccaggauucuagaaucaagaagcucgacaaauuccaauuuauuaucauugaagaacuggaaaacuucgagaaggauucccagagccugaaagaccuugagaaggaguucguggauuuuugggagaaaaucuuccagaaguuuucugccuaccaaaaguccgaacagcagcgccugcaucuccugaaaacaagccucgccaaguccguuuucugcaauaccgacagcgaggaaacaguguuuaccucugagaugugucugaugaaagaggauaugaagguccuucaggaccggcugcucaaagacaugcuggaagaggaacugcuuaacgugagacgggagcugaugagcguuuucaugucccacgaacgcaaugcuaacguguga

SEQ ID NO: 76503 - RNA, 2439 nt, Artificial Sequence
  derived and/or modified sequence opt5 from SYCP2L__Homo_sapiens__NP_001035364
augcaggccaagaacaaagacgcucugcaacccaucaaggaggauagaaccggcaaagcccaggacgaugcguucuggcuccagagccugauuacagacgcuuuucacgauaagggguuccagaaaaucaaggaauacuuucaacagaaggagucccauuucccucagaaauauaaucggcuucugcucuaccgccuggacagaucuauuaacaaggaacuugauaaaaaugaguuucagagcgugucccugcuccugaagugcauccaacgguuccuggucgacggacucaaagaagaugagccgcugcuuauucgccagggccugauccccaagcucguuucuugguuugagagaacgaccgggauccugacaagcgaaggacuugccuccgacaccucucugauuugugugaucgaggauuucuuugacacagcccucauuaucagccgguccagcucugaaggcaagauucagaugcuggauuccuuccugcucagccugggguuucuugugaccgagaaaacagucaaccaccuucuccagcaagagggacugaagaccuucaauugcauccuucaugcugugccucgcgaagagagaaagaaguuuccccugucugaaggcaugugucaccucaugaaagaccuggcccggacgcugcucaccguuggcgacuaugaucaacagguggcuauuuccgaggcccugugccgccuuacaaucaagaaaagcagagacgaacugguccauaagugguucgaugacgaggugaucgcggaggccuucaaggaaauuaaagaucgggaguuugaaaccgacucucgcagauuccucaaccaccugaauaaccggcuuggggaucagcgcagaguuuacuccuuuccuuguaucgcugccuucgcugacgagcacgaaaugcggaagcccgccgaugagaaacuggagaaguuuuggauugacuucaaucucggaagccaguccgugacauuuuauaucgauaacgcggaaaauacccugugggacucugucacgcugccuaaagaggccgugaugaacuucagcauuacagaaaccgagaagaucaagaucuuuauuaucuaccucaaaaagccgaugauuaucuccuauaaagaagugaugaagauugagauccauuucgaccugcaguuuaauaucagccaggucucuauucaagcucuuggcgaggauaaacagaugcugcccgaccagacaaagaucuccagcgaacucuucucuaagagcgauaaagaggacagagaauccccuucugggcuggagcgcgagaccgaacaggccgaggaaagcaccaacaugguugaguuuauguccgcugaagaugaccggugccugauuacacuucaccucaaugaucaaagcgagcccccugugaucggagagcccgccucugacucccaucugcagccggugccucccuucggcgucccugauuucccccagcagcccaagagccacuacagaaaacaccuguuuucugaauccaaccaagacagcuccacgucugagcucagcuggaccuccaaccagaagaaaaagucucugaaaagcuacuccagccgcaaaaagacacggaccagaucuaaucuucgcauucugccuguguucccgcccuccagcgggucuggacaugaaaaagaucaggccaagcuccuguccccuagcgagaaagaaauccccgagcagaacaauacaaccucuccuaagacgagcgagcaaaaauuucaggacuccuucgcuuuucugacagcggaagauagcgcccagaagaccgagcuucaagacccccacucucucuccgaacugagcucccugaagcauucugaggacgaagagaaaccgaagauuguuaaccaggagagccucaccgaauccacaucucugaaacacaagcugcggaaucuggaggauaaagacaucccugaaggcagcuucgcuaagucccagcagucuagacucgaggaggaaguggcccccggcagcccuuuuuccaucaccgaggaacgcgagcugcccgaagggauuagcacaucuucccuggaggucgugccugagaaccuuaauggaagcgccauccuccccacguucgaaaacuuuaccaagaaacggaagagaaaauaugagcugcgcuaccggaagagaccguucaauucugaaaacgcuaaaaaggccccugauugucugauuaagcuccugaaucaaaugcagcuuuuucggcugaacaaacucgagcgcuuccagaaucugguucugcaggaacuuuccagccucaagcaagacauccaggcgcuggagcaucuggagaaagaagugcucgaguuuuggggcaagcagucugcugaucugcaguccuucugcgaccuucaaguccugagauucaacagcacacagaccuccuga

SEQ ID NO: 76504 - RNA, 711 nt, Artificial Sequence
  derived and/or modified sequence opt5 from SYCP3__Homo_sapiens__NP_001171420
auggugagcuccggcaagaaauacucuagaaagagcgggaaacccuccgucgaggaccaguucacccgggccuaugauuuugaaacagaggacaagaaagaucugucuggaagcgaagaggacguuaucgaaggcaagacggcugugauugagaagcgccggaaaaagagauccucugccgggguggucgaggauaugggaggcgaagugcaaaacaugcucgaggggguuggaguggacaucaauaaagcgcugcuugcuaagcgcaaaagacuggaaauguacaccaaggccagccucaagacauccaaccagaaaauugagcacgucuggaagacccagcaggaucaacggcagaaacugaaucaggaguauagccagcaauuccuuacacuguuucagcagugggaccucgauaugcagaaggccgaagaacaagaagagaaaauccugaacauguuccgccagcagcaaaagauucugcagcagucuagaaucgugcagucccaacggcucaaaaccaucaagcagcuguacgaacaguuuauuaagagcauggaggagcuugagaaaaaucaugacaaccugcucacaggcgcucagaaugaguucaagaaagaaauggccaugcugcaaaagaaaaucaugauggagacccagcagcaggaaauugcuucuguucgcaagucccuucaaagcaugcuguuuuga

SEQ ID NO: 76505 - RNA, 1908 nt, Artificial Sequence
  derived and/or modified sequence opt5 from SYK__Homo_sapiens__XP_011517248
auggccagcuccggcauggcugacucugccaaccaucugcccuucuuuuucgggaauaucaccagagaggaagcggaggauuaccucgugcagggaggcaugagcgacgggcuguaucuucugcggcaaucccgcaacuaccucggaggcuuugcucugucugucgcccacgggagaaaggcccaccauuauacaauugaacgggagcuuaauggaacguacgcuaucgccggcggccgcacccacgcuagcccugccgaucugugccauuaucacucccaggaaucugacgggcucguuugucugcugaaaaagccguucaacagaccccagggagugcagccuaaaacaggccccuuugaggaucucaaggagaaucugauucgggaauacgugaaacaaaccuggaaccuucaggggcaggcgcuggagcaggccaucauuagccaaaagccucagcucgaaaagcugaucgcuacaaccgcccacgagaaaaugcccugguuccauggaaagaucucccgcgaggaaagcgagcagauuguccuuaucggcucuaaaacaaaugggaaguuucugauuagagcucgggacaacaauggauccuaugcccucugccugcugcacgaaggcaaagugcuccauuaccgcaucgauaaggacaagaccggcaaacugagcauuccugaggggaagaaauucgauacgcuuuggcagcugguugaacacuacucuuauaaggcggacggacuccugagagugcuuaccgucccgugucagaaaaucggcacacaagggaacgugaauuuuggaggccggccccagcugccugggucccaccccgccaccuggagcgcuggaggcauuaucucucgcaucaaguccuacagcuucccuaaacccggccauagaaaguccucuccggcccaagggaaccggcaggagagcacaguuuccuuuaauccuuaugagcccgaacucgcuccuugggccgccgauaagggaccccagcgcgaggcucugcccauggacaccgaaguguacgagagcccuuaugcggauccggaagagauuagacccaaagaggucuaccuggaccggaagcuccugacgcuugaagacaaagagcugggcucugggaacuucggaacagugaagaaaggcuauuaccagaugaagaagguggucaaaaccguugccgugaagauccucaaaaaugaagcuaacgauccugcccugaaggacgagcuucuggccgaagcuaacgugaugcaacagcucgauaaucccuacauugucagaaugaucgggauuugcgaggccgaguccuggaugcuggugauggaaauggcggagcugggcccucucaacaaauaucugcagcagaaucgccacguuaaggacaagaacaucaucgaacuugugcaucaagucagcaugggaaugaaauaccuggaggagucuaauuuugugcaccgggaucucgcugccagaaacguucugcuggugacacagcauuaugccaagauuagcgacuucggccuuuccaaagcucuccgcgccgaugaaaauuacuauaaggcucagacccacgggaaauggcccgucaagugguacgccccggaguguaucaacuauuacaaguucucuagcaaauccgacguguggagcuuuggaguccugaugugggaagcguucucuuacggccagaagccuuaucgggggaugaaaggauccgaggugaccgccaugcuggaaaagggcgagagaauggggugccccgcuggcuguccucgcgagauguacgaucucaugaaucugugcuggacauaugacguugaaaaccggcccggauuugccgcuguggagcuuagacugcgcaauuacuauuacgaugucgugaacuga

SEQ ID NO: 76506 - RNA, 3825 nt, Artificial Sequence
  derived and/or modified sequence opt5 from SYMPK__Homo_sapiens__XP_011525656
auggccagcggcuccggggacucugugaccagacggagcgucgcuucccaguucuuuacacaagaggaaggacccggcaucgaugggaugacgaccucugagcgcguuguggaccugcucaaccaggccgcgcugauuacaaaugauagcaagaucaccgugcuuaaacagguccaggaacugauuaucaacaaggacccuacacuccuggauaauuuccuugacgagauuaucgcuuuucaagccgauaaauccaucgaagugagaaaguucguuauuggauuuaucgaggaggccugcaaacgggacauugaacugcuccugaagcugaucgcuaaccucaauaugcugcuucgcgaugagaacgugaaugucgugaagaaagccauucugaccaugacacagcucuacaagguugcucugcaguggauggugaaaucuagagucaucagcgaacuucaggaggccuguugggacaugguguccgcgauggccggcgauauuauccugcuccuggacagcgauaacgacgggauccggacccacgcuauuaaguucguggagggacugaucgucacgcucucuccgcgcauggccgacuccgaaauucccagacggcaagagcaugauaucagccuggaccgcauuccuagagaucaccccuauauccaguacaauguucuuugggaagagggcaaagcugcccuggaacagcuccugaaguuuauggugcauccugcgaucucuuccauuaaccuuaccacagcccugggcagccucgcuaauaucgcccggcagcgccccauguucaugucugaggugauucaggcuuaugagacccugcacgccaaccugccuccgacacucgccaagucccaagucagcuccgugagaaagaaucugaaacuucaucugcucucuguucugaaacaccccgcuagccuugaauuucaggcgcaaaucaccacgcugcucguggaccuggggacaccucaggccgagauugcucggaacaugcccuccagcaaggauacccgcaaaagaccucgggacgauucugacuccacacugaagaaaaugaagcucgaacccaaucugggagaggaugacgaagauaaggaccuugagccgggcccuagcgggaccucuaaagccagcgcccagaucuccggacagucugacaccgauaucacagcugaguuccugcaaccccuccugacgccugacaacgucgccaaccuggugcuuauuagcaugguuuaccuccccgaagcgaugcccgcuuccuuucaggccaucuauaccccuguggagagcgccggcacagaagcucagauuaagcaccuggccagacugauggcuacccagaugacagccgcggggcucggaccgggcgucgagcaaaccaaacagugcaaggaggaacccaaagaggaaaagguggucaagacggagucugugcugaucaaacgccggcuuuccgcccagggccaggcuauuagcguuguggggucucuguccagcauguccccucucgaagaggaggcgccccaagcuaagagacgcccugaacccaucauuccggucacacagccucggcuggccggagcgggcgggagaaagaagaucuuccgccugucugaugugcuuaaaccccucaccgacgcccagguugaggcuaugaagcugggagccgugaagcggauccugagagcugaaaaagccgucgccuguagcggcgcugcccaggugcgcauuaagauccucgccucccuggugacccaauuuaauucugggcuuaaagcugagguucugagcuucauucucgaagauguccgggccagacuggaccuggccuucgcuuggcuuuaccaggaguauaacgccuaccucgcggcuggagccuccggcagccuggauaaguacgaggacugccugauccgccuccugucuggccuucaggaaaaaccugaucaaaaggacgggauuuuuacaaagguggugcuggaggcuccccucaucaccgaauccgcucuggaggucgugcggaaauauugugaagaugagagcagaacauaccugggaaugucuacgcuucgggaccucaucuucaagcgcccuuccagacaguuucaguaucugcauguucugcucgaucugagcucucacgagaaagacaaggugcggagccaggcccuucuguucauuaaaagaauguacgaaaaggagcaacuccgcgaauaugucgagaaauuugcgcugaauuaccugcagcuucuggugcaucccaacccgccuuccguucucuucggcgcugacaaggauaccgaaguggccgcccccuggacagaggagaccgucaagcagugccuguaucucuaccuggcccuucugccccagaaucacaaacucauccacgaacuggccgcuguguacacagaggccauugcggacaucaagcggaccguucugagagugauugaacaaccuauccgcgggaugggaaugaacagcccggagcuucugcuccuggucgagaauugucccaaaggcgccgaaacgcucgugaccagaugccugcauucucuuacagauaaggugccucccuccccugagcuggucaaacggguucgcgaccucuaucacaagagacugcccgaugugcgguuucugaucccugugcuuaacgggcuggaaaagaaagaggucauucaggcucuccccaagcugaucaaacucaauccgauugugguuaaggaaguguucaaccgccugcuuggcacccagcauggagagggcaauagcgcccuguccccucugaaccccggggagcuccugaucgcccuucacaauauugacucugucaaaugugauaugaaaagcaucaucaaggccacaaaccugugcuuugccgaaagaaauguguacaccuccgagguucucgcuguggucaugcagcaacugauggaacagucuccucuccccaugcugcuuaugcggacggugauucagagccugacaauguauccgcgccugggaggcuucguuaugaacauccucuccagacugauuaugaaacaaguguggaaguacccuaaagucugggagggguuuaucaaguguugccagcggaccaaaccccagucuuuccaggugauucuucaacugccuccccagcagcucggagcgguguuugacaagugccccgaacugcgcgagccucuccuggcccauguccggagcuucacaccgcaccagcaagcucacauccccaacuccauuaugaccauccuugaggccagcggcaagcaggaaccugaggccaaagaagcucccgccgggccucuggaggaagaugaccuggagccccucacccuggcgccugcuccggcucccagaccuccccaggaucuuaucggccugagacucgcccaggagaaggcucugaaacgccaacucgaagaggaacagaagcugaaaccuggaggcguuggggcccccucuuccagcucuccguccccuagccccucugcgcggcccggaccucccccuuccgaggaggcuauggacuucagagaagagggcccggaaugugagacacccgggauuuuuaucagcauggaugacgacuccggacuuacggaagccgcccugcuggauagcucucucgagggcccucugcccaaggagaccgcugccgggggccuuacacugaaagaggaacgcagcccucagacccucgcucccgugggagaagacgccaugaagacaccguccccugcggccgaggaugcucgggaacccgaggccaagggcaauucuuga

SEQ ID NO: 76507 - RNA, 2118 nt, Artificial Sequence
  derived and/or modified sequence opt5 from SYN1__Homo_sapiens__NP_008881
augaacuaccugagacggcgccucagcgacuccaauuucauggccaaccugcccaauggcuauaugaccgaucuucagagaccucaaccgcccccucccccucccggggcucacucuccuggagccacaccgggccccgggacggcgaccgcugagcggagcuccggaguggccccugccgcuucucccgccgcuccuagccccggcuccucugggggaggcggcuuuuucagcucccugagcaacgccgucaagcagacaaccgcggccgcugccgcuacauuuucugaacagguugggggaggcuccgggggagccggccgcgggggagcggccagcagagugcuccuggugaucgacgagccgcauaccgauugggcuaaauacuucaagggcaaaaagauucacggcgaaaucgacauuaaagucgagcaggccgaauuuucugaucuuaaucugguggcucaugccaacgggggauucuccguugacauggaggugcuccggaauggcgucaaggugguucgcagccugaagccugauuuugugcugaucagacaacacgccuucucuauggcucggaacggggacuaucgcucccucgucauuggacugcaguacgcgggcauccccagcgucaauucccuucauucuguguauaacuuuugcgauaaaccuuggguguucgcccagaugguuagacugcacaagaaacucgggacagaggaauuuccccugaucgaccagaccuucuaccccaaucacaaggagaugcuuagcuccacgaccuauccugugguggucaaaaugggacaugcucacagcggcaugggcaaggugaagguugauaaccaacaugacuuucaggauauugccucuguggucgcccugacaaaaaccuacgcuacagccgaaccguucaucgacgcgaaguacgacgugcggguucagaaaauugggcagaauuauaaggcuuacaugcgcaccuccgugagcggaaacuggaaaacgaauacaggcucugccaugcucgagcaaaucgccaugagcgauagauauaagcugugggucgacaccuguuccgagauuuucgggggacuggauaucugcgcuguggaagcccuccacggcaaagacgggcgggaucacauuaucgaggucgugggcucuagcaugccccugaucggagaccaucaggaugaagacaagcagcuuauuguugagcugguggucaacaagauggcucaagcccucccucgccagagacagcgggaugcgucccccggcagagggagccacggacagacaccuucucccggcgcccugccgcuugggcgccaaaccucccagcagccugcuggacccccugcccagcaacggcccccuccccagggcgggccgccucagcccggccccggaccucagagacaaggcccgccccugcagcagcgcccucccccucaggggcaacagcaucucagcggacuggggcccccugcuggcucuccccugccgcagcggcucccuucccccaccagcgccccucaacagcccgcgucccaggccgcuccgccuacacagggacaaggcagacagucucgccccguggccgggggcccuggagcuccucccgccgcccggcccccggcuagccccuccccucagagacaggcggggcccccucaagccacgcgccagaccucuguuagcggccccgcuccuccgaaagccuccggagcucccccuggcgggcagcagcggcaaggacccccucagaagcccccgggcccugccgggcccacaagacaggccagccaagcgggccccgugccucgcaccggacccccuacaacccagcagccgcggcccucuggcccugggcccgcuggaagaccuaaaccccagcuggcccaaaagccgucccaggacgucccucccccugccacggcugccgcgggcgggcccccucacccccagcuuaacaaaagccagucucugacaaaugcuuuuaaccucccggaaccugccccuccccggcccucccugagccaagaugaggugaaggccgagaccauccgcucucuuagaaagagcuucgcuucccuguuuagcgacuga

SEQ ID NO: 76508 - RNA, 1437 nt, Artificial Sequence
  derived and/or modified sequence opt5 from SYN2__Homo_sapiens__NP_003169
augaugaacuuccugagacggcgccucagcgacuccucuuuuaucgccaaucugcccaacggcuacaugaccgaucuucagagaccugagccgcaacagcccccucccccucccccuccggggcccggagcugccagcgcguccgcugccccucccacagccucuccuggccccgaacggcgcccgccucccgcuagcgccccugcuccccagcccgccccuacgccguccguggggucuagcuucuuuuccagccugucucaggcggucaagcaaaccgccgcuuccgccggacucguugacgcucccgccccugcgcccgccgcugccagaaaagcuaaggugcugcuuguggucgaugagccucacgccgacugggccaaaugcuuccggggcaagaaagugcugggggauuaugacauuaagguugaacaggcugaguuuagcgaacucaaucugguggcgcaugccgauggaacauacgcugucgacaugcaagugcugcgcaacggcaccaagguugugagaucuuuccggcccgauuuuguccucauccgccagcacgccuucggcauggccgagaaugaggacuuuagacaucugauuaucgggaugcaguaugcuggacuuccguccauuaacagccuggaaucuaucuacaauuucugugauaaaccuuggguguuugcccagcucguggcgaucuauaagacacugggcggggagaaauucccccuuauugaacagaccuacuauccuaaccacaaggagaugcugacacuccccaccuuuccugucguugugaaaaucggacaugcucacuccggcauggggaaggugaaggucgagaaucacuacgacuuccaggauauugccagcgugguugcccugacgcaaaccuacgcuacagccgaacccuucaucgacuccaaauaugacauucgggugcagaagaucggaaacaauuacaaggcuuauaugcgcaccucuauuagcggcaacuggaaaacaaauaccggcuccgccaugcuggagcagaucgcgaugagcgauagauacaaacucugggucgacacgugcucugaaauguuugggggacuggauaucugugccgugaaggcuguucauggcaaagacgggaaggauuauauuuucgaggugauggacugcuccaugccgcuuaucggagaacaccaagucgaggaucggcagcugauuacagagcucgugaucagcaagaugaaccagcugcuuucucgcaccccugcccugagcccccagagaccccucacaacccaacagccucaguccggcacccugaaagacccggauucuagcaagacacccccucagcggcccccuccccaagggugucugcaguacauucucgacugcaauggaaucgcugucggcccuaaacaggugcaggccuccuga

SEQ ID NO: 76509 - RNA, 1335 nt, Artificial Sequence
  derived and/or modified sequence opt5 from SYN3__Homo_sapiens__NP_598344
augaacuuccugagacggcgccucagcgacuccucuuuuauggccaaucugcccaacggcuacaugaccgaucuucagagaccugacagcuccacaucuagcccggcuucccccgccauggagcggcgccacccucaaccccuggcggcuucuuucagcuccccugggagcucucucuuuuccagccugucuuccgccaugaagcaggcuccccaggccacgagcggacuuauggaaccuccgggccccucuaccccuaucgugcagagaccccggauucugcucgucaucgaugacgcccauacagauugguccaaauauuuccacgggaagaaaguuaauggagagauugaaauccgcguggagcaagcugaauuuagcgagcugaaccuggccgcguacgugaccggcgggugcauggucgacaugcaagugguuagaaauggaacaaagguggucucccggucuuucaaaccugauuuuauucucgugcgccagcaugccuauagcauggcucugggcgaggacuacagaucccuuguuaucggccugcaguaugggggacuccccgccgugaacagccuguacucugucuauaauuucuguuccaagccguggguguuuagccaacuuaucaagauuuuccacucucugggcccugaaaaauuuccccucguggagcagaccuucuuuccuaaccauaagcccauggucacagcuccccacuucccuguuguggugaaacuggggcacgcccaugcgggaaugggcaagaucaaagucgaaaaucagcuggauuuccaggacauuaccagcgugguugccauggcuaagacguacgccaccacagaggcuuuuaucgauuccaaguacgacauucggauccagaaaauugggucuaacuauaaggccuacaugcgcaccagcaucuccggaaauuggaaagccaacacaggcagcgcuaugcucgaacagguggcgaugaccgagagauaucggcugugggucgauucuugcuccgagauguucggcgggcuugacaucugugccgugaaggcuguucacagcaaagacggacgcgauuacauuaucgaagugauggacucuuccaugccgcugauuggcgagcaugucgaagaggauagacagcucauggccgaccugguggucagcaagaugucccaacuucccaugccugggggaacggcccccucuccucugcggcccugggcuccgcagaucaaaagcgccaaguccccuggccaggcgcagcucgggccccaacugggacagccucagcccagaccucccccgcaggcuaaucugucuccuuga

SEQ ID NO: 76510 - RNA, 1584 nt, Artificial Sequence
  derived and/or modified sequence opt5 from SYNCRIP__Homo_sapiens__NP_001153146
auggccaccgagcacgugaacggcaaugggacagaagaacccauggacacgaccagcgcugucauccauuccgaaaacuuccagacacugcucgaugccggacugccucaaaagguugcggagaaacuugacgaaauuuacguggcuggccugguggcccacucugaucucgacgagagagccaucgaggcucugaaggaauuuaaugaggauggggcccuugcuguccugcagcaguucaaagacagcgaucucucccaugugcagaacaagucugccuuucugugcggaguuaugaaaaccuaucggcaacgcgaaaagcagggcacaaagguggcggacagcuccaaagggccggaugaggccaagauuaaagcucugcucgagagaaccggauacacacuggacgucaccacgggccagcggaaguauggcgggcccccucccgauucuguguacagcggacagcaaccuuccguuggcaccgaaaucuucguggggaaaauuccccgcgaccuuuuugaggaugaacuggucccucucuucgagaaggccggaccgaucugggaccugagacuuaugauggacccccugacaggccucaaucggggguaugcuuuugugaccuucuguacaaaggaagccgcgcaggaggccgugaaacuguacaacaaucacgagauccgcagcggaaagcauauuggcgucugcaucucuguugcuaacaauagacuguuugugggcuccauuccuaaaagcaagaccaaagaacagauccucgaggaguucucuaaggugacggaggggcugacagaugucauucuuuaucaccagcccgacgauaaaaagaagaaccggggauuuuguuuccuggaauacgaggaccacaaaaccgccgcucaagugaagguucucuuugugcgcaaucuggccaacacagucaccgaggaaauccuugagaaagccuucucccaguucggcaagcuggaaagagugaaaaagcucaaggauuacgcuuuuauucauuucgacgagcgggauggggcgguuaaagccauggaagagaugaauggaaaggaccuggagggcgaaaacaucgagaucguguuugcuaaaccucccgaucagaagcgcaaagaaagaaaggcccaacggcaggccgcuaagaaucagauguaugacgauuacuauuacuaugggccgccucacaugcccccucccacccgcggaagaggccggggcgggagaggaggcuacggguaucccccugacuacuacggauaugaggacuacuaugauuacuauggcuacgacuaucauaacuaccgcgggggcuacgaggauccguauuacggauaugaagacuuccaggucggcgcccgggggagaggaggccgcggggcgcggggagcugcccccagcagaggccgcggggccgcuccuccccggggcagagccggauacucucaacgcggcgggccuggauccgcucggggcgugagaggggcccgcggaggcgcgcagcagcagcgggggagaggccaaggaaaaggcgucgaggccgggcccgaucugcuccaguga

SEQ ID NO: 76511 - RNA, 777 nt, Artificial Sequence
  derived and/or modified sequence opt5 from SYNDIG1__Homo_sapiens__NP_079169
auggacggcaucauugagcaaaagagcaugcuggugcacuccaaaaucucugaugccgggaagagaaacggacucauuaauacccggaaccugauggcugaaagccgcgacggccuugucuccguuuaccccgccccucaguaucagucucauagagugggggcgagcacagugccggcuucccuggauucuagccgguccgagcccaugcagcagcuccuggacccuaauacgcuucaacagagcgucgaaucucgcuacagacccaacaucauucuguauuccgagggagugcuccggagcuggggcgaugggguugccgccgacugcugugaaaccacauucaucgaggaucgcucuccuaccaaagacucccuggaguaccccgauggaaaguuuaucgaccugagcgcugaugacauuaaaauccacacacucucuuaugauguggaagaggaagaggaguuccaggaacuggaguccgacuacagcuccgacaccgaaucugaggauaauuuucuuaugaugccuccgagagaccaucugggccucagcgucuucuccaugcugugcuguuuuuggccccuuggcauugccgcuuucuaucugagccacgaaacaaacaaggccguggcgaagggggaucuccaucaggccucuaccuccagccggcgcgcucuguuucuggccguucucucuaucacgauuggaaccggcguguacgucgggguggcuguggcccugaucgcguaccuuagcaaaaauaaccaccuguga

SEQ ID NO: 76512 - RNA, 26250 nt, Artificial Sequence
  derived and/or modified sequence opt5 from SYNE1__Homo_sapiens__NP_149062
auggcuacaagcagaggcgcuucccggugccccagagacaucgccaacgugaugcagagacugcaagaugagcaggaaauugugcagaagcggaccuucacgaaauggaucaauucucaccucgccaagcgcaaaccuccgaugguuguggacgaucuguuugaggacaugaaggauggggugaaacuucuggcucuccuggaagugcuuagcggccagaagcugcccugugagcaaggcagacggaugaagcgcauucacgccguggccaacaucgggaccgcucucaaauuccuggaagggagaaaguccaugcaccggggcucuccuauuaaacugguuaauaucaacagcacagacaucgccgaugggcgccccuccauugugcucggacugauguggaccaucauucuuuacuuucagaucgaggagcugacaucuaaucucccucagcugcagagccuuuccagcucugcuuccagcgucgacucuauuguguccagcgaaacccccucuccuccguccaagagaaaaguuacaaccaagauccaaggcaacgccaagaaagcgcugcucaagugggugcaguauacggccggcaaacagaccgggauugaggucaaggauuucggaaaaagcuggcgguccggcguggcuuuucacucugugauccacgccauccgccccgaacuggucgaccuggagacaguuaaggggagaagcaaucgggagaaccucgaagaugcuuucaccauugccgagacagaacugggaaucccucgccuucuggaccccgaggauguggacguggacaaaccugaugaaaaguccauuaugaccuacgucgcgcaguuucucaagcacuaucccgacauccacaaugccagcacggauggccaagaggacgaugagauucugccgggguucccuucuuuugcuaacuccgugcagaauuucaaaagagaagaccggguuaucuuuaaggagaugaaaguguggaucgaacaguucgagagagaucuuacacgcgcccaaauggucgaaagcaaccugcaggacaaguaccagucuuuuaaacacuuccgggugcaguaugagaugaagagaaagcaaauugagcaccucauccagccccugcaccgcgauggaaaacugagccucgaccaggcucugguuaagcaguccugggaucgggugaccucuagacuuuucgacuggcauauucaacuggacaaaagccucccugcgccccugggcacaaucggcgccuggcuuuaccgcgcugaagucgcgcugcgggaggaaauuaccgugcagcagguccacgaggaaaccgccaauacaauccagagaaagcucgagcaacacaaagaucugcugcagaacacggacgcucauaagcgcgccuuucacgagaucuaucggaccagauccgugaaugggauucccguuccuccggaucagcucgaagacauggccgagcgcuuccauuuugugagcucuacauccgaacugcaccuuaugaagauggaguuccuggagcucaaauaccggcugcugagccuucucguccuggcugaaucuaagcugaaauccuggaucauuaaguacggaagacgggagagcguggaacagcuccugcaaaacuauguuuccuuuaucgagaacucuaaauucuuugaacaguacgaggugaccuaucagauucuuaagcaaacagccgagauguacgucaaggcggauggcagcguggaagaggcugaaaaugugaugaaauucaugaacgagaccacggcccaguggcgcaaucuguccguugaagucagaucugugcggagcaugcucgaggaggugaucuccaacugggacagauaugggaauacagucgccagccugcaggcuuggcuggaagaugccgagaagaugcuuaaccagucugaaaaugcuaaaaaggacuuuuuccgcaaccucccccauuggauucaacagcacaccgccaugaaugaugcgggaaacuuucugaucgagaccugcgacgaaauggugucccgggaucugaaacagcagcuccugcuucugaauggcagauggcgcgaacuguucauggagguuaagcaauacgcccaggcugacgaaauggauagaaugaaaaaggaguauacagacuguguggucacccugagcgccuuugcuacagaagcccacaagaaacugucugagccucuugagguguccuucaugaacguuaagcuccugauccaggaccuggaagauauugagcagcgggugcccgucauggacgcgcaauacaaaaucauuacgaagaccgcccaucucaucacaaaagaaagcccucaggaggaagggaaggagauguucgcuaccaugucuaagcugaaagagcagcuuacaaaggugaaagaaugcuacagcccccugcucuaugagucccaacagcugcugauuccgcuugaagaacuggaaaagcagaugaccagcuuuuacgauucucugggaaaaaucaaugagaucauuacgguucuggagcgcgaagcccaguccagcgcucucuucaagcaaaagcaccaggagcugcuugccugucaggaaaacugcaaaaagacccugacacucaucgagaaaggcucccagucugugcaaaaguuugucacccugagcaaugugcugaaacauuucgaccagacaagacuucagcggcagauugccgauauccacguggcuuuucaauccauggucaagaagaccggcgacuggaaaaagcacguugaaacgaacucucgccugaugaaaaaguucgaggagagcagagcggaacucgagaaagugcugcggauugcccaggaagggcucgaggagaagggagauccugaagaacugcuucgcagacauacagaauuuuucucccagcuggaccagcgggugcucaacgcuuuucugaaagccugugaugagcugaccgacauccuucccgaacaagagcagcagggccugcaagaggccguccgcaagcuccacaagcaguggaaagaucugcagggggaagcuccuuaucaucuccugcaccuuaagaucgacguggagaaaaauagauuccuggccucuguugaagagugccggacagaacucgauagagagaccaagcugaugccccaggagggaagcgagaagauuaucaaggagcaucgcguguuuuucuccgacaagggcccucaccaccugugugaaaaacggcuucaacugauugaggaacucugcgucaagcugcccgugagagacccgguucgcgauaccccugggacaugucaugugacgcucaaagagcugcgggcggcuaucgacagcaccuacagaaaacuuauggaggaucccgacaaauggaaggauuauacaucucgcuuuuccgaguucagcucuuggauuuccaccaacgagacacagcugaagggcaucaaaggagaagccaucgacaccgccaaucacggcgaggucaagcgggcuguggaggaaauuagaaacgggguuacgaaacgcggagagacacugagcuggcucaagucucggcugaaagugcuuaccgaagucuccagcgagaaugaagcccagaagcagggcgaugagcuggcgaagcucuccagcucuuucaaagcucuggugacccuccugagcgagguggaaaagaugcuuuccaacuuuggggacugcguccaauacaaagagaucguuaaaaauucucuggaagaacugauuagcggauccaaagaagugcaggagcaggccgagaagauccucgauacagaaaaccuguucgaggcccagcaacuucugcuccaucaccagcagaagaccaaaagaauuucugcuaagaaacgggacgugcaacagcagaucgcccaggcucaacagggcgaagggggccugcccgaucgcggacaugaggaacucagaaagcuggagagcacacuugacggccuggagcggucccgcgaaagacaggagcggcgcauucaagucacgcugagaaaaugggaacgguuugagaccaauaaggagacagugguuagauaucucuuccaaaccgggucuagccacgaacgcuuucuguccuucagcucucuugagucccugagcucugaacucgagcagacaaaagaauuuuccaagcggaccgagagcaucgccgugcaggcggagaaccuggucaaggaagccuccgagaucccucucggaccgcagaauaaacaacugcuucagcagcaggcuaagucuauuaaagaacaagugaagaaacuggaggacacgcuggaagaggauaucaagaccauggagaugguuaagacaaaaugggaccacuucggcagcaacuuugaaacccucuccguguggauuacagagaaggaaaaagagcugaaugcccuugaaaccuccucuagcgcuauggauaugcagaucagccagauuaaggucacaauccaagagaucgagucuaaacugagcuccauuguggggcucgaagaggaagcccagucuuucgcccaguuugucaccacgggagagagcgcuagaaucaaggcgaagcugacacagauucgccgguacggcgaggaacugagagagcaugcccaaugccucgaagggaccauccuuggccaccugucccagcagcagaaauucgaggaaaaccugcgcaagauucaacagucugugagcgaguucgaggacaaacucgcuguucccaucaagaucuguuccagcgccaccgaaacauacaaagugcugcaggagcauauggaucuuugccaggcccuggaaucucucuccagcgcuauuaccgccuuuuccgcgucugcuagaaaggucgugaaucgggacagcuguguucaagaggccgccgcucugcagcagcaauaugaagauauccugcgcagagccaaggagcggcagacggcgcucgagaaccuucuggcucacuggcagcgccuggaaaaagagcucuccucuuuccugacauggcuugaaagaggagaggccaaggccagcuccccugaaauggacauuagcgcugaucgggugaaagucgagggcgagcugcagcucauccaagcccugcagaacgaaguggugucucaggcuuccuuuuacagcaagcugcuccagcuuaaagagucucuguucuccguugccagcaaggacgaugucaaaaugaugaagcugcaccucgaacaacuggacgagagauggcgcgaucuuccccagauuaucaauaagcggauuaacuuucugcagucugugguggcggagcaucagcaauucgacgaacuccugcugagcuuuuccgucuggaucaaacucuuccuuucugagcugcagaccacaagcgaaaucuccauuauggaccaccagguggcccugaccagacauaaggaucacgcugccgagguugaaagcaaaaagggggagcuccaaucccugcagggacaucuugcuaaacugggcucucucgggcgcgccgaggaccugcaucugcuccagggaaaggccgaagauugcuuucagcuuuucgaggaagcuagccaaguggucgagcggagacagcuggcgcugucccaccucgccgaauuucugcagucucaugcuagccuuuccggcauccugcggcagcuccgccaaacaguggaggccaccaauucuaugaacaagaaugagagcgaccugauugaaaaagaucugaacgacgcccuccagaaugcuaaggcccuugaguccgcggcuguuagccuggaugggauccugucuaaagcccaguaucaccucaagauuggcuccagcgaacagagaacgucuugucgggccaccgcugaccaacugugcggagagguggaacgcauccagaaccuucugggcacaaaacaguccgaggccgaugcgcucgccguccugaagaaggcuuuccaggaccaaaaagaggaacugcucaagagcaucgaggauauugaagagagaaccgacaaagagcggcuuaaggaaccuacacgccaggcccugcagcaaagacugcggguguuuaaucagcucgaggaugaacugaacucucaugagcacgaacuuuguuggcugaaagacaaggcuaagcagaucgcccagaaagacguugcuuucgcccccgagguggaucgcgagauuaauagacucgaagucaccugggacgauacgaagcggcugauccacgagaaccaagggcagugcuguggacugauugaccucaugagagaauaccagaaucuuaaauccgcggugagcaaggugcuggagaacgccuccagcgucaucguuacacgcaccacaaucaaagaucaggaagaccugaagugggcuuucucuaaacaugagaccgccaagaauaagaugaacuauaaacaaaaggaucucgacaacuuuaccagcaaaggcaagcaucugcuuuccgagcugaaaaagauucauucuagcgauuucucccucgugaagacagacauggaaucuacgguggauaaauggcuggacgucagcgagaagcuggaagagaauauggaccggcucagagugucccuuucuaucugggaugacguucugagcacccgcgaugaaauugaggggugguccaacaauugcgugccucagauggcugagaacaucagcaaucuggacaaccaccuccgggccgaagaacugcuuaaagaauuugagucugaggucaagaauaaagcccugagacucgaagaacugcauuccaaggugaacgaucugaaggaacucaccaagaaucuggagacaccucccgaccuucaguucauugaagcugaucugaugcagaagcucgagcacgcgaaagagaucacagaaguugccaagggaacccugaaagacuuuacggcucaaagcacacagguggagaaguucauuaacgauaucaccaccugguuuacaaaggucgaagagucucuuaugaauugugcccagaacgaaaccugcgaggcccugaaaaaggugaaagacauccaaaaggagcuccagucccagcagagcaauauuuccucuacacaagaaaaccugaauagccugugccgcaaauaccacuccgcugagcucgaaagccugggccgggccaugacgggccuuaucaagaagcaugaggcggucucucagcuguguuccaaaacccaggccagccuccaggaaucucuggagaagcacuucagcgaguccaugcaagaauuucaggagugguuccuuggggcuaaagccgcugccaaggaaucuagcgauagaacaggagacuccaaagugcuggaggcgaagcuccaugaucugcagaacauucuggacucuguuagcgacggccaguccaaacucgaugccgugacccaagaggggcagacacuguaugcucaccuuagcaagcagaucgugucuuccauucaggaacaaaucaccaaggccaaugaggaauuucaggcuuuccugaaacagugccucaaggacaaacaagcccugcaggauugugcuagcgagcuuggauccuuugaagaccagcaccgcaagcugaaccucuggauccaugagauggaggaacgguucaacacggagaaucugggcgaaucuaaacagcacauucccgagaagaagaacgaaguccauaaaguugagauguuccugggggagcuccuggccgcgagagaaagccuugauaagcugucccaacgcggacagcuccugucugaggaaggccacggcgccgggcaggagggacggcuuugcagccagcugcucaccucccaucaaaaucugcugagaaugacaaaagaaaagcuccgcagcugucagguggcucugcaggagcacgaggcccuugaagaggcucugcagucuaugugguuuugggugaaagccauccaagacagacucgccugcgcggaauccacccugggcagcaaggauacacuugagaagcggcugucucagauucaggacauccuccugaugaaaggggagggagaagucaagcugaacauggcuauuggcaaaggggagcaagcccuccgcuccagcaauaaggaaggacagagagugauccagacccagcuggagacacuuaaagaaguuugggcugauaucaugucuuccagcgugcacgcccaaucuacgcuggagagcgucauuucccaguggaacgacuacguggagcggaagaaucagcucgaacaguggauggagagcgucgaucaaaagaucgaacauccccugcagccucagcccggccuuaaagagaaguucgugcugcucgaccaucugcaguccauucugucugaagccgaggaccauaccagagcucuccaccggcugaucgccaaaagccgcgagcuuuacgaaaagacagaggaugaauccuuuaaagacaccgcgcaagaggaacugaagacccaguucaacgauauuaugacaguugccaaagagaagaugagaaagguggaggaaaucgucaaagaccaucucauguaucuggaugcugugcacgaguuuacggacuggcuucacucugccaaggaagaacugcaucgguggagcgauauguccggcgacucuagcgcuacccagaaaaagcucuccaaaauuaaggagcugaucgauagccgcgaaaucggggccucuagacugucccggguugagagccuugcgccggaagugaagcaaaauacaaccgccucuggaugugagcugaugcacacagaaaugcaggcucuccgcgccgacuggaaacagugggaggauuccgucuuccagacccaaagcugccuggagaaccucgugucucagauggcucuguccgaacaggaguuuagcggccagguggcccaacuugaacaggcucuggagcaguucucugcccugcucaagacgugggcgcagcaacugacacuucuggaagggaaaaauaccgacgaggagauuguugaauguuggcauaagggacaggagauccucgaugcccugcagaaagcugaaccuagaaccgaggaccucaagucccagcugaacgaacugugccgguuuagccgcgaccuuagcacauacuccggcaaggucucugggcugauuaaagaguauaauugucucugccugcaagccagcaagggaugccagaacaaagagcagauccuucaacagagauuccggaaggcuuuucgcgauuuccagcaguggcuggugaaugccaaaauuaccacagccaaguguuuugacaucccccaaaacaucuccgaagugucuaccagccuccagaagauucaggaguuccuguccgaaucugagaacggccagcacaaacucaauaugaugcugagcaagggcgagcugcuuuccacgcugcucacaaaagaaaaggcgaaagggauccaagcuaaggucaccgccgccaaagaggauuggaagaacuuccacagcaaucugcaucagaaggaaucugcucuugagaaccugaaaauucagaugaaggacuuugaaguuuccgccgagccuauccaggauuggcucagcaaaacagagaagauggugcacgaaucuuccaauagacuguacgaccugcccgcuaaacggcgcgagcaacagaagcuccagagcgugcuggaagagauucauugcuaugaaccccaacuuaacagacugaaggagaaagcccagcagcucugggagggacaggcggccuccaagucuuuccggcacagagucagccaacuguccucucaguaccuugcucugagcaaucucaccaaagaaaaggugucccgccuggaucggaucguugccgagcauaaccaguuuagccugggcaucaaagaacuccaggacuggaugacggaugcuauucacaugcuggacucuuauugucacccuaccuccgauaagagcgugcuugacucuagaacacugaagcucgaggcccugcuuagcgucaaacaagaaaaggagauccagaugaaaaugauugugacccgcggggaguccguucugcagaauacaucuccggaaggaauccccaccauucagcaacagcuccagagcgugaaggauaugugggcgucccugcugagcgccggcauccggugcaaaucucagcucgagggggcucuguccaaguggacaagcuaccaagacggagucagacaguucuccggcuggauggacucuauggaagccaaccuuaaugagagcgagcgccagcaugcugaacugcgggauaagaccacgaugcucggcaaagccaagcugcuuaacgaggaagugcuguccuacucuagccuccuggagacaauugaagugaaaggggcuggaaugaccgagcacuaugucacccaacuggagcuccaggaccugcaggaaagauaccgcgccauccaggagcgggcgaaggaagccguuacaaaauccgagaaacuugugagacugcaucaagaauaucagcgcgaucucaaggcuuuugagguguggcugggccaggagcaggaaaaacuugaccaauacucuguccuggagggggaugcccacacccacgaaacaacgcuccgggaccugcaggagcuccaggugcauugugccgaaggacaggcucuccugaauagcguucuucacaccagagaggaugugaucccuuccggcauuccccaagccgaggaccgggcgcuggaaagccucagacaggauuggcaggcuuaucaacaucgccugucugagacacggacccaguucaacaaugucgugaacaaacuuagacugauggaacagaaauuucagcaaguugacgaguggcucaagacagccgaggagaagaaguggcacgaggaagugaccgccuaccgcgaugaggucgaagaggugggggcuagagcccaggagauccuggacgaaucccauguuaacagccggaugggaugccaggcuacgcagcugaccucucgcuaucaagcccuccugcuucaggugcuggagcagauuaaauuccucgaagaggaaauccagucccuggaggagagcgaaucuagccuguccagcuacuccgacugguacggcucuacacacaagaauuuuaagaacgucgcgaccaaaauugauaagguggacacagucaugaugggcaaaaagcucaaaacccuugaggugcugcugaaggauauggaaaaggggcacagccuccugaaauccgccagagagaagggagaacgggcuguuaaauaucuugaggagggcgaagccgagcgccugagaaaggaaauccaugaccacauggagcaacucaaagagcugacgucuacagugcggaaggaacauaugacccuggagaaggggcuucaccucgcuaaagaguucagcgauaaguguaaagcccugacacaguggaucgcggaguaccaggaaauucugcaugucccugaggagcccaagauggaacucuaugagaaaaaggcccagcuguccaaguacaaaucucuucaacagaccgugcugagccacgaaccuuccgucaagagcguucgcgagaaaggagaagcucuccuggagcuggugcaggacgucacccuuaaggauaaaaucgaccaacuccagucugauuaucaggaccugugcuccauuggcaaggccaugauggaggaaaucgcuggguuugaggauagacugaauaaccuccagaugaaaggagacacacugauuggccaaugugccgaucaccuucaggccaagcugaagcagaaugugcaugcucaccuccagggcacgaaagacagcuacucugcgaucugcuccaccgcccaacggauguaucagagccuggaacaugagcugcagaagcacguuucucgccaggacacacuucaacagugucaggcuuggcucuccgccgugcaaccggaucuggaacccagcccucagcccccucugucuagagccgaggcuaucaaacaggucaagcacuuccgggcccuccaggagcaagcgcgcaccuaccuggaccuucugugcuccaugugcgaucucagcaacgcuuccgugaaaacaaccgccaaggacauucagcagacggaacagacaaucgagcaaaagcugguccaggcccagaaucugacccaggggugggaagagauuaaacaucuuaagagcgagcucuggaucuaccugcaagaugcugaccagcagcugcaaaacaugaaaagacggcacucugaacucgagcugaauauugcccagaacauggugagccagguuaaggauuuugugaagaaacuucaguccaagcaggcuucugucaauaccaucaucgaaaaagugaacaagcugaccaagaaggaggaaagccccgagcauaaagagauuaaucaccucaacgaccaguggcuggaucuguguagacaguccaauaaccuuugccuccagcgcgaagaggaccugcaacggaccagagauuaucaugacuguaugaacguuguggaagucuuccuggagaaguucacaacggaaugggauaaucucgcccgcucugacgcggagagcaccgccgugcaccuggaggcucuuaagaaacuggcccucgcucugcaggaacggaaguacgccaucgaggaccugaaagaucagaagcagaaaaugauugaacaccuuaaccucgacgauaaggagcuggugaaagaacaaacaucccaucuggagcagagaugguuucagcucgaggaccugaucaagcgcaagauucagguuagcgucaccaaucuugaagaacugaacguggugcaaucucgguuccaggaacucauggagugggcggaggaacagcaaccgaauaucgccgaggcucugaaacaguccccuccgcccgauauggcccagaaccugcuuauggaccaccucgcuauuugcagcgaacuggaggccaagcagaugcugcucaaaucucugaucaaggaugccgacagagucauggcugaucuuggacugaaugaacgccaagugauccagaaagcgcucuccgacgcccagagccauguuaacugucugucugaucuggugggccagcggagaaaguaucuuaauaaggcucucuccgagaaaacacaauuucugauggccgucuuccaggccaccagccagauucagcaacacgagcggaagaucauguuucgcgaacacauuugccugcucccugacgacguguccaaacagguuaagacguguaaaucugcucaggccagccugaagaccuaccaaaacgaggugacagggcuuugggcgcagggaagagaacugaugaaggaggucaccgaacaggagaaauccgaggugcucggcaagcugcaggaacugcaaagcguuuaugauucugugcuucagaaaugcucccaucggcuccaggagcuggaaaagaaucuggucagccgcaaacacuucaaggaggacuuugauaaggcuugucauuggcucaaacaggccgacaucgugacauuccccgagauuaaccugaugaaugaaucuagcgagcuucacacccaacuggccaaguaccagaacauccucgaacaguccccugaguaugaaaaucugcugcuuacacuccagagaaccgggcaaacgauccugccgucucugaacgagguggaucauagcuaccucuccgagaaacugaacgcccuuccccggcaguuuaaugucauuguugcccuggcuaaggacaaauucuacaaggugcaggaagccauccucgcgagaaaggaguaugccagccugauugaacugacaacccagucucuuuccgagcucgaagcucaauuucugcgcaugagcaaagugccuaccgaucuggccgucgaggaggcucucucucugcaggacggcugccgggccauccuugaugaaguggcgggacugggcgaggccguugacgaacucaaccagaagaaagagggguucagauccacaggacaacccuggcagccugauaagaugcugcaccuggugacgcuuuaccaccgccugaaacggcagaccgaacagagagucagccuccuggaggacacaaccuccgcuuaucaagagcaugaaaagaugugucagcagcucgagcgccagcugaaaucugugaaggaagaacaaagcaagguuaaugaggaaacacuucccgccgaggaaaaacugaagauguaccacucccucgcuggcucucugcaggauagcgggauugugcugaaaagagucaccauccaucuugaggaccuggccccgcaccucgacccucuggccuaugaaaaggcucggcaccagauccaguccuggcaaggagagcucaaacugcuuacaagcgcgauuggcgagaccgugacggaaugcgagucucgcaugguccaguccaucgauuuucagaccgaaaugagcagaucucuggacuggcuccggcgcgugaaggccgagcuguccgggcccguuuaccuggaucuuaaccugcaagacauucaggaagagaucagaaagauucagauccaucaggaggaagugcaaagcucucuccggauuaugaaugcucugucccacaaagagaaggaaaaauucacaaaggccaaagagcucaucagcgccgaucuggaacauagccuugcugagcuguccgagcuggacggcgauauccaggaagcccuccgcaccagacaggcgacacugaccgagauuuauucucagugccaacgguacuaccaggucuuccaggcugccaacgacuggcuugaagaugcccaggagcugcuccaacuggcuggaaauggccucgacguggagagcgccgaagagaaccugaagucccacauggaauuuuucucuacggaggaucaguuucauagcaaucuugaagaacugcacucccugguugcuacacucgacccucugaucaagcccaccgggaaagaggaucuugaacagaagguggccucucuggagcucagaagccaacgcaugucccgggacucuggagcgcaggucgaccugcuccagagauguacagcccaguggcacgauuaucaaaaagcucgcgaagaggugauugaacugaugaacgacaccgagaagaaacuuagcgaguucucccugcugaagacgagcucuagccaugaagccgaggaaaagcucagcgagcacaaagcucuggugucuguugucaauuccuuucaugaaaagaucguggcccuugaggagaaagcgagccagcuggaaaagaccggcaacgaugccucuaaagcuacacucucccggagcaugaccacaguguggcagagauggacccgccugcgggccgucgcucaggaccaagagaagauucuggaagaugccguggacgaguggacaggguucaauaacaaaguuaagaaggcgaccgagaugaucgaucagcuccaggacaaacuuccuggauccagcgccgaaaaggcuucuaaagccgagcugcugacgcuccuggaauaccacgauacauuugugcuugagcuggaacagcaacagagcgcucucggcaugcugagacagcagacccuguccaugcuccaagacggggccgcccccaccccgggcgaggagccuccccuuaugcaggaaaucacagcuaugcaggaucggugccugaauaugcaagagaaggucaaaaccaacggaaagcuggugaagcaggaacucaaagaccgcgagaugguugaaacacagauuaacucugugaaguguuggguccaggagacgaaagaguaucugggcaaucccaccaucgaaauugacgcccaacuugaggaacugcagauccuccugacagaggcgaccaaccauagacagaauauugaaaagauggcugaggagcagaaagaaaaguaccuggggcucuauacaauccuuccuagcgagcugucccugcaacucgccgaaguggcccuggaucuuaagauccgggaccagauucaggauaaaaucaaggagguggagcagucuaaagcuaccagccaagaacugucccgccagauucagaagcucgccaaagaccugacgaccauccugacaaagcucaaggcgaaaaccgauaacguuguccaagcuaagacagaccagaaagugcugggagaggaacuugauggcugcaauucuaagcugauggagcucgacgccgccgugcagaaauuccuggaacagaacgggcaacuuggaaagccgcuggcuaaaaagauuggcaagcucaccgagcugcaccagcagacgaucagacaggccgagaaucggcugagcaaacucaaccaagcugccucccaccuggaagaguacaaugaaaugcuugagcugauucucaaguggaucgaaaaagcgaagguccuggcccauggcacaaucgcuuggaacagcgccucucagcuucgcgagcaguauauucugcaccagacccuccuggaggaauccaaagagaucgauagcgaacuggaggcuaugacagaaaagcuccaauaccugaccucuguuuacuguaccgagaagaugucccaacagguggccgagcuugggagagaaacagaggaacugcggcagaugauuaaaaucagacuccagaaucugcaggacgcggccaaggauaugaaaaaguuugaggcugagcuuaaaaagcugcaggccgcucucgaacaagcccaggccacgcugaccagccccgaggugggacgccugucccucaaggaacagcugucucaucggcagcaccuucugagcgagauggaaucccucaaaccuaagguccaagcugugcagcugugccagagcgcccuucgcauucccgaggacguuguggcgucucugccucucugucacgcugcccugcgccugcaggaggaagccucccggcuccaacauacagcuauccagcagugcaacaucaugcaggccgcggucgugcaauaugagcaguacgaacaggagaugaaacaucugcaacagcuuauugaaggcgcucauagagagaucgaggauaagcccguugccaccagcaauauucaggaacugcaggcccaaaucucucgccacgaggaacucgcucagaaaauuaagggguaucaggagcagaucgccucccugaacagcaaguguaaaaugcuuacaaugaaggcuaaacaugccaccaugcugcucacggugacagaagucgagggacuggcggagggcaccgaagaccuggacggggagcuccugccuaccccgucugcccaccccagcguggugaugaugacagcuggacggugccacacccuucuguccccugucacagaagagucuggcgaggaaggcacgaauagcgagaucuccucucccccugccuguagaucccccuccccgguugcuaacaccgaugccagcgugaaccaagacauugcguacuaucaggcccucuccgcugaacgccugcagacagaugccgcuaagauccauccuucuaccagcgccucccaggaguucuacgaacccgggcuugagcccucugccacagcuaaacugggagaccuccaacggagcugggagacccugaagaaugugauuuccgaaaagcagagaacgcuguaugaggcccucgaacgccagcagaaauaccaagauagccugcagucuaucuccaccaagauggaggcgauugaacuuaaacugagcgagucuccugagcccggcagauccccugaaagccagauggcugagcaccaagcccucauggacgaaauccugaugcuucaggaugagauuaacgaacugcagucuucccucgccgaggagcuggucagcgaaucuugcgaggcugacccggccgaacagcuggcgcuccaaagcacacugaccguucuugcugagcggauguccacaauccgcaugaaggccagcgggaaaagacagcugcucgaggaaaagcugaaugaucagcuggaggaacagcggcaagagcaggcccuucagagauaccgcugcgaagcugacgagcucgauuccuggcugcugucuaccaaagccacacucgacaccgcucugucucccccuaaggagcccauggauauggaagcccagcuuauggacugucaaaacaugcugguggagaucgaacagaagguggucgcgcucuccgagcuguccgugcauaaugaaaaccugcuucucgagggaaaagcccacacgaaggacgaggcugaacagcuggccggcaaacugcggagacucaaggggagccugcuugagcugcaacgggcucuccacgauaaacagcugaauaugcagggaacagcccaggaaaaggaggaauccgacguugaucugaccgcgacccaaucuccuggcgugcaggaguggcuugcccaggcucgcacaacguggacccagcaaagacagagcucccuccagcagcaaaaggagcuggaacaggagcuggccgaacagaaaagccuccugcggucugucgcuucccgcggcgaggagauucuuauccaacauagcgccgccgaaacaucuggggacgcuggagagaagcccgaugugcugucccaggaacucggcauggagggggaaaagagcucugccgaggaccagaugagaaugaagugggagucccugcaccaggaguuuagcaccaaacaaaagcugcuucagaacguucucgagcaggaacaggagcaagugcuguauucccggccgaaucgccugcucagcggagucccucuguacaagggcgaugugcccacacaggacaaaucugcggucaccucccuucuggaugggcucaaccaggcuuucgaagaggugagcucucagagcggaggcgccaagagacaauccauucaucuggagcagaaacuguaugacggcguuucugccacaagcaccuggcuugaugacguggaagaacggcucuuugucgcuacggcccugcugccugaagagaccgaaacaugccucuucaaucaggagauccuggcgaaggacauuaaagagauguccgaagagauggauaagaacaagaaucuuuucucucaggcuuuucccgaaaacggggacaaucgcgaugugaucgaggacacccugggaugucuccugggcagacugagccuucucgauuccgugguuaaccaacggugccaccagaugaaagagcgccugcagcaaauccugaacuuccagaaugaccucaagguccuguuuacaagccuugccgauaacaaauacauuauccugcagaagcucgccaauguguucgaacagccuguggcugagcaaauugaagccauccagcaggcugaggacgggcugaaagaauuugaugccggaauuaucgagcugaagagacggggcgacaaacuucagguugagcaacccucuaugcaggaacucuccaagcugcaggauauguaugacgagcugaugaugaucauugggagcagacgcucuggacucaaccagaaucugacccuuaagucccaauacgaacgggcgcugcaggaucucgccgaccugcuggagacgggccaggagaagauggcuggcgaccaaaagaucauugucagcuccaaagaggagauccagcagcuucuggauaagcauaaagaauauuuccaggggcucgagucucacaugauucugacagaaacccucuuuagaaagaucauuagcuucgccgugcaaaaggagacacaguuucacaccgaacugauggcucaggccuccgcggugcuuaaacgcgcccauaagcggggagucgagcuggaguacauccucgaaaccuggagccaccuggacgaggaucagcaagaacugucuagacagcuugaggugguugaguccagcaucccgucugugggccuggucgaagagaacgaagaccgccucauugaucggaucacacuguaccagcaucucaaauccagccugaaugaguaucagccuaaacuuuaccaagugcuggacgaugggaaaagacuccugauuucuaucagcuguuccgaccuggaaucucagcuuaaccagcugggagagugcuggcucagcaauacgaacaagauguccaaggagcugcaccgccucgaaaccauucugaaacauuggacacgguaucagagcgagucugcugaucuuauccacuggcugcaauccgccaaggacagacuggaguucuggacccagcagagcguuacagugccccaagagcucgaaaugguccgcgaucaccugaaugcuuuucuugaguucuccaaagagguggacgcccagucuagccugaaguccucugugcucagcaccggcaaccagcugcuccggcugaaaaagguugacacggccacacuuagauccgaacugagccgcaucgauucucaguggaccgaccugcucaccaauauucccgcuguccaagagaagcugcaucagcuucagauggauaaacugccuucccggcacgccaucagcgaagugaugucuuggauuucccucauggagaacgugauccagaaggacgaagauaauauuaaaaacagcaucggguacaaggcgauccaugaguaucugcaaaaauacaagggauucaaaauugacaucaauuguaagcagcucacagucgauuuugugaaccagucuguucugcagauuuccagccaagacguggagucuaagagaagcgauaaaaccgacuucgcugaacagcuuggcgccaugaacaaguccuggcagauccugcaaggccuggucacagagaaaauucagcuccuggaagggcuucuggagagcugguccgaguaugaaaauaacgugcagugccucaagacgugguuugagacccaggagaagagacugaagcaacagcaccggaucggagaucaggccucuguucagaaugcucugaaggacugucaagaucucgaggaccuuaucaaagccaaggaaaaagagguggagaagauugaacagaacggccuggcgcugauccagaauaaaaaggaggacgucagcuccauugugaugucuacacuccgcgaacuggggcagaccugggcuaaccuugaucacaugguuggacaacugaagauccuccugaaaagcgugcuggaccagugguccucucauaaggucgccuucgauaaaauuaauagcuaccucauggaggccagauacucccuuagccgguuucgccugcugacaggcucucucgaagcuguccaggugcaagucgacaaccugcagaaucuucaggaugaccuggagaagcaggagagaucccuccaaaaauucgggagcaucaccaaccagcugcugaaggaaugccacccgcccguuacggagacccucacaaauacccuuaaggaagugaacaugcgguggaauaaccugcuggaggaaauugccgagcagcuccagucuuccaaagcucugcuucaacuguggcagcgcuauaaggauuacagcaaacagugugccucuacagugcagcaacaggaggacagaaccaaugaacuccugaaggcggccacaaacaaagauaucgcugacgaugaggucgccacguggauccaggacugcaacgaucugcucaagggacuuggcaccgugaaagacucccuguuuuuccugcaugaacucggcgagcagcugaagcaacagguugacgcuagcgccgcguccgccauucagucugaucaacuuagccugucccagcaccucugugcucuggagcaggcccugugcaagcagcaaacaagccuccaggcuggggugcuugacuaugaaaccuuugccaaaucucuggaggcccuggaggcuuggaucgucgaggccgaagagauucuccagggacaggauccuagccauuccucugaccugagcaccauccaagagcggauggaagaacuuaagggccagaugcugaaauucuccucuauggcgcccgaucucgaccgccugaaugaacugggguacagacucccucuuaacgauaaggagauuaaacggaugcagaaucugaaccgccacuggagccugaucuccagccagacaacggaaagauuuucuaagcuccaauccuuccugcuucagcaccagaccuuucuggagaagugcgagacauggauggaguuccucgugcaaaccgagcagaaacuggcuguugaaaucagcggaaauuaucagcaucugcucgagcagcaacgggcccacgaacuuuuccaggccgagauguuuucucgccagcagauucugcauuccaucauuaucgacggccaaagacugcucgagcagggacagguggaugaccgggaugaguucaaccugaaacuuacacugcucagcaaucaguggcaaggcgucauuagacgcgcucagcagcggagaggaaucaucgacucccagauucgccaauggcagcgguacagagagauggccgaaaaacugcgcaaguggcugguggaggucucuuaucuccccaugagcggccuuggguccgugccuaucccccugcagcaagcgcggacccuguuugacgagguucaguucaaagaaaagguguuucucagacagcagggaucuuacauucugacggucgaggccggcaagcaacuucugcucagcgcugauuccggggccgaagcugcccugcaggcugagcuggccgaaauccaggagaaauggaaaagcgcgucuaugcgccucgaggaacagaaaaagaaacuggccuuccuucugaaggacugggagaagugugaaaaaggaauugcugauucccucgagaagcugcggacauuuaaaaagaaacuuagccaaucucugccggaccaccacgaggaacuccaugccgagcagaugagaugcaaggaacuggagaacgcugugggcagcuggaccgaugaccugacccagcucucccugcuuaaggauacacugucugccuacaucagcgcggacgauauuuccauccucaaugaacgcguugagcugcuucagcggcaaugggaggaacugugucaccagcucagccugagacggcagcaaaucggggagcgccugaacgaaugggccguguucucugagaaaaauaaggaacucugcgaguggcugacccagauggaguccaaagucagccagaacggcgacauucuuaucgaagagaugauugaaaagcugaaaaaggauuaucaggaggaaaucgcuauugcccaagagaauaaaauccagcuccagcagaugggagagagacuggcuaaggccucccaugaaucuaaggccagcgagaucgaauacaaacuuggcaaggugaacgaccgguggcaacaucugcucgaucugauugcugcgagagugaaaaagcugaaagagacacucguugccguccagcagcuggacaagaauauguccucucuucgcacguggcuggcucauaucgaaagcgagcucgccaagccuauuguguaugacuccuguaacagcgaggaaauccagcggaaacugaacgagcaacaggaacuucagagagauauugagaagcacucuaccgggguggccuccguccugaaucucugcgaagugcugcugcacgacugugaugcuugcgccacagacgcggagugugauagcauccaacaggccacccgcaaccucgacagacgguggcgcaauaucugcgcuaugucuauggagagacggcugaaaauugaagagacauggcgccuuuggcagaaguuucuggaugacuacuccagauucgaagauuggcucaaaagcucugagcggaccgccgcuuuucccuccagcucuggaguuaucuauacgguggccaaggaggaacugaagaaauucgaggcuuuucagcgccaaguccaugaaugucuuacccagcuggagcucauuaacaagcaguacagacggcuggcccgcgaaaauagaacagacuccgcgugcagccugaaacagauggugcacgagggcaaccaacggugggauaaucuccagaagagaguuaccagcauccugcgccggcuuaaacauuucauugggcagagagaggaguucgagacagcccgcgacuccauccugguguggcucaccgaaauggaucugcagcuuacaaacauugagcacuuuucugaaugcgacguccaagcuaagaucaagcagcugaaagccuuccagcaggagaucagccucaaucauaacaagauugagcaaaucauugcucagggagaacagcugaucgagaaauccgaaccucuggacgccgcgauuaucgaggaggaacucgaugagcugcggagauacugucaagaaguguuuggccgcguugagcgguaucacaagaaacuuaucagacugccccucccggacgaugaacacgaccugucugaucgcgagcuugagcuggaagacagcgccgcucucuccgaucugcauuggcacgaccggucugccgauagccugcucuccccucagcccagcucuaaucugucccuuagccuggcucagccccucagaucugagcgguccgggcgcgacaccccugccagcguggauucuauuccccuggaaugggaccaugacuacgaucuguccagagaccuugagagcgccaugucccgggcucucccuucugaagaugaggagggccaggacgauaaggacuucuaucugcgcggagcggucggccugagcgaugugaugaucccggaaucccccgaggccuacgugaaacucacggaaaacgccauuaagaauacaagcggggaccacucugcucuggagucccaaaucagacagcuuggaaaggcccuggaugacagccgguuucagauucagcaaaccgaaaacaucaucagaucuaaaaccccuacaggccccgagcucgauaccagcuauaagggguacaugaaacugcugggagagugcuccucuagcauugacuccgucaagcgccuugaacacaaacucaaggaggaagaggaaagccugccuggcuucguuaaucugcauucuacagagacgcagaccgcuggggugaucgaucggugggagcuccugcaggcccaggcgcuuuccaaggaacugagaaugaaacaaaaccuccagaaguggcagcaauuuaacagcgaccucaauucuauuugggccuggcugggcgacacagaggaggaacuugagcagcugcagcgccucgaacuguccaccgauauccagacaauugagcuccaaaucaaaaagcugaaagaacuucagaaggcuguggaccaccggaaggccauuauccugagcaucaaccucuguucccccgaguucacccaggcugauucuaaagaaagcagagaccugcaggaucgccugucccaaaugaauggacggugggacagagucugcucucuucuggaggaguggcgcggccuccugcaggaugcccucaugcagugucagggguuucaugaaaugagccacggacugcuucugaugcucgagaacauugacagacggaagaaugaaaucgugccuauugauuccaaccuggacgcggagauccugcaagaucaucacaaacagcuuaugcagauuaagcacgaacugcucgagagccagcugcgcguugccucucuccaagacauguccugccagcugcuugugaaugcugagggcacggauugucuggaagccaaagagaagguccaugugaucgggaacagacugaagcuccugcuuaaagaaguuagccggcacaucaaggagcuggaaaaacuccuggacgugucuuccagccagcaagaccucucuagcugguccagcgcugaugagcuggacaccucuggauccgucagcccgacauccggccgcucuacccccaauagacagaagacaccucggggcaaaugcagccuuucccagcccgggccuucugugagcagcccccacucucgcagcaccaagggaggcuccgauagcucucuguccgagccggggccuggaagaagcggccggggguuccuguuuagagugcuccgcgccgcucugccccuucagcugcuccugcuucugcucauuggacuggccugucugguccccaugucugaagaggacuauuccugcgcgcucagcaacaauuucgcccggucuuuucacccuaugcugagauacacgaacggacccccuccgcuuuga

SEQ ID NO: 76513 - RNA, 20658 nt, Artificial Sequence
  derived and/or modified sequence opt5 from SYNE2__Homo_sapiens__NP_055995
auggcuagcucccccgagcugccuaccgaagacgagcagggaucuugggggaucgaugaccuccacauuagccugcaggcugaacaggaggauacccagaagaaagccuucacgugcuggaucaacucccagcuugcgagacauaccucuccgagcgugauuuccgaccuguuuaccgauaucaagaaagggcacguccuccuggaccuucuggaaguucucucuggccagcagcugccccgggauaaggggagcaauaccuuccagugucgcauuaacaucgagcaugcucugacauuucucagaaaucgguccaucaaacugauuaacauccacgugaccgacauuaucgauggaaauccuagcauuauccuuggccugauuuggacaaucauccuccauuuccacauugagaagcuggcccagacccuuucuugcaacuacaaucagcccucccuggacgaugugagcgucguggacucuuccccugccagcucucccccugcuaagaaauguuccaagguucaggcccgcuggcagaugagcgcuagaaaagcccuccugcugugggcgcaggaacaaugcgccacguaugaguccgugaacgucaccgauuuuaagucuagcuggcggaaugggauggcuuuccucgccaucauucacgcucugcgcccggaccuuaucgacaugaaauccgugaagcauagaagcaacaaggauaaucugcgggaagccuuucgcauugcggagcaggagcucaaaauccccagacugcuugaaccugaggacguugauguggucgaccccgaugaaaagucuaucaugacauacguggcccaguuccugcaauauuccaaagacgcuccuggaaccggcgaggaagcccagggcaaggugaaagaugcuaugggguggcucacacugcagaaggagaaacugcagaagcuccugaaggacagcgagaacgauaccuacuuuaaaaaguauaauucucuucugagcuucauggaauccuuuaacgaggagaagaaaucuuuccucgacguccugagcauuaaacgggaucuugacgagcuggacaaggaucaccuccaacugcgcgaagccugggacggacuggaucaucagaucaaugccuggaagauuaaacucaacuacgcucugcccccgccucuucaccagacggaggcguggcugcaggagguugaagaacugauggacgaagaucuguccgccagccaagaccacucucaggcugugacacugauccaggagaagaugacccuuuuuaaaucccucauggauagauucgaacaucacagcaacauucugcugacauucgagaauaaggacgagaaccaucucccccuggugccucccaauaaacuugaagagaugaagcggcgcaucaacaauauccuggaaaagaaauuuauucuccugcuggaguuccacuauuacaagugucuuguccucggccugguggaugagguuaaaucuaagcuggacaucuggaacauuaaauacggguccagagaaagcguggagcuccugcuugaagauuggcauaaguuuaucgaggaaaaggaguuccuggcccggcucgacaccuccuuucagaaaugcggagagauuuauaagaaucuggccggcgaaugucaaaacaucaauaaacaguacaugauggucaagucugaugugugcauguaucgcaagaacauuuacaauguuaagagcacccugcagaaagugcuugcuuguugggccacauaugucgagaaccuccgccugcugcgggcgugcuucgaagagacgaagaaggaagagaucaaagaggugcccuuugaaacccucgcucaguggaaucuggagcacgccacacuuaacgaagccgggaauuuccuggucgagguguccaacgacguugugggaucuagcaucuccaaggaacucagacgccugaacaaacgguggagaaagcuggucagcaaaacccaacuugagaugaaucucccucugaugauuaagaagcaggaccagccgacauuugauaacucuggcaauauccuguccaaagaggaaaaggcuaccguggaguucagcacggacaugucuguugaacuccccgagaacuacaaucaaaacauuaaagccggcgagaagcacgaaaaagagaaugaagaguuuacagggcagcugaagguggcuaaggaugucgaaaaacuuaucggacagguggagauuugggaggccgaagcgaaguccgugcuggaccaggaugacguugauaccagcauggaggaaucucucaaacaucugaucgccaagggcagcauguucgacgagcugauggcucgcuccgaagauaugcuucaaauggacauccagaacauuagcucucaggaguccuuucagcacguccugaccacagggcuccaagccaaaauccaggaggcuaaggaaaaggugcagauuaauguggucaaacugaucgccgcgcucaagaaccugaccgaugugagcccugaccuugauauucggcugaaaauggaggaaucccagaaggagcucgaaucuuauaugaugagagcccaacagcugcugggacagcgcgagagccccggcgagcuuaucuccaaacauaaggaagcucugaucauuucuaauacaaaaagccucgccaaguaccugaaggcuguugaggaacucaaaaacaaugugacggaggacaucaagaugucccuggaggaaaaaucucgggacgucugugccaagugggagagccuucaccacgaacugucccucuacgugcaacagcugaaaauugauaucgagaaggggaagcugagcgacaacauucuuaaacuggaaaagcagaucaauaaagagaagaaacucaucagacgcggacggaccaagggccugauuaaggagcaugaagccugcuucucugaggaaggcugccucuaucagcugaaccaccauauggagguucuuagagaacugugugaggagcugccuucccagaagucccagcaggaagugaagcggcuccugaaagauuacgagcagaagaucgaacgccuucugaaaugcgcuucugagauucacaugacacuccaacccaccgccgggggcacauccaagaacgaaggcaccaucacgaccagcgagaauagagggggagacccgcauucugaggcgccuuucgcuaaguccgauaaccagcccagcacagaaaaagccauggagccuaccaugaaguuuucccuggccagcguccuccggccccugcaggaagagucuauuauggagaaagacuauagcgcuuccaucaauucucuucuggaaagauacgauacauaucgcgacauucuggagcaccaccuccagaacaauaaguuccggaucaccagcgauuuuuccucugaagaggacagaagcuccucuugucugcaagccaaacuuacggaucuccaagucaucaagaacgaaacagacgcgcgcuggaaggaguucgagauuaucagccucaaacuggaaaaucauguuaacgacauuaagaaaccuuuugugaucaaggagagagauacccucaaagaacgggagcgcgaacugcagaugacacuuaauaccagaauggagucccuggagaccgcucugcggcucguccugcccguggaaaaggccagccuucugcucugcggcucugaccugccgcuccacaaaauggccauucagggguuccaucugaucgaugcugaccgcaucuaccaacaccuuagaaacauucaggauuccaucgccaagcagauugagaucuguaaucggcuggaagaaccuggcaacuuugugcugaaggaacuccaucccuucgaccugcacgcgaugcaaaauauuauccuuaaauauaagacacaguuugagggaaugaaccaccgcguccagagaagcgaggauacgcugaaagcucucgaagacuuccuggccucucugcggaccgccaagcucuccgcugagcccguuacagaucuuagcgccuccgacacccagguggcucaagaaaauacacugaccgugaaaaacaaggagggcgagauccaucugaugaaggauaaagccaagcaccucgacaaaugccugaagaugcuugauaugucuuuuaaagacgcggaacgcggggacgauacgagcugugagaaccugcucgacgccuucuccauuaagcugagcgaaacacauggauacggcguccaggaggaauuuaccgaggagaauaagcugcucgaggcuugcaucuucaaaaacaaugagcuucugaagaacauucaggaugugcagucucaaaucuccaaaauugggcugaaggacccuaccguuccggccgugaaacaccggaaaaagagccucaucagacuggauaaaguccuugacgaauacgaggaagagaagagacaucugcaagagauggcuaauucucucccccacuucaaagauggacgcgaaaagacagugaaccagcagugucaaaauaccguugugcugugggagaacacaaaagcccuggucacggaaugccucgagcaguguggccgggugcuugaacugcugaagcaguaucaaaauuuuaaaagcauucucaccacacugauccagaaggaggaguccguuaucucucuucaggccagcuacauggggaaggaaaaccugaaaaagagaauugcugagaucgaaauugugaaagaggaguucaaugaacaccucgaggucguggacaagaucaaccaggugugcaaaaaucugcaauuuuaucugaacaagaugaagaccuucgaagaaccucccuuugaaaaagaggcgaauauuaucgucgaucgcuggcucgacaucaacgagaagacagaagauuacuaugagaaucuuggccgggcccuggcucugugggacaaacucuucaaccugaagaacguuauugaugaauggaccgagaaagcccuucagaagauggaacugcaucagcucacggaggaggacagagaacgccugaaggaggaacugcaagugcacgagcagaagaccuccgaauuuucucggagaguggccgagauccaguuccuccuucagagcuccgagauuccucuggaacugcaggucauggagagcucuauccucaauaagauggaacaugugcaaaaaugccugacaggagaguccaacugucacgcucuuagcggcuccaccgccgagcugcgcgaagaccucgaucaggcgaagacacagauugggaugaccgagucucugcugaaagcucucagccccuccgacucucuugaaaucuuuacaaagcuggaggaaauccagcaacagauucugcagcaaaagcacagcaugauccuccuggagaaucagauuggaugccuuaccccugagcuguccgaacucaaaaagcaguacgagagcguuucugaucuguucaacacgaaaaaguccgugcugcaggaccauuuuagcaaacuccuuaaugaucaauguaagaacuucaaugacugguucucuaacaucaaagucaaucugaaggaaugcuuugaguccagcgaaacaaagaaaucuguggagcagaagcugcagaaacucagcgauuuccugacccuugagggccggaacuccaagauuaaacagguugacucugugcugaagcacgucaagaaacaucuccccaaggcccacgugaaagaacugaucagcuggcuggucgggcaagaguuugaacucgagaagauggaauccauuugucaggccagagcuaaagagcuugaggauagccugcagcagcugcuccggcugcaagacgaucaccgcaaucuuagaaaguggcugaccaaccaggaagagaaguggaaaggaauggaagaacccggcgagaagacagaacucuucugccaggcccuggcgcggaaacgcgagcaauuugaauccguggcucagcugaauaacucucucaaggaguauggguucaccgaagaggaggaaaucaucauggaggccacgugucuuauggacagauaccagacacugcugcggcagcucagcgaaauugaggaagaggacaaacugcuuccuaccgaggaucaauccuuuaaugaccuggcccaugauguuauccacuggauuaaggaaaucaaggagucucucauggugcugaacagcuccgaaggcaaaaugccccuggaggaacggauucaaaagaucaaagagaucauucuccugaagccugagggagacgcucgcaucgaaacaauuaugaaacaggccgagucuagcgaagcuccccuuguccagaagacccugacagauaucuccaaccaaugggacaauacccuccaucuggccagcacguaccuuucucaccaggagaagcugcuccuggagggcgaaaaauaucugcaguccaaggaggaucuccggcugaugcuuauugaacugaaaaagaaacaggaggcgggguucgcccuccaacauggacugcaggaaaagaaagcucagcuuaagaucuacaagaaauuucugaagaaagcccaagaccucaccagccugcugaaggagcucaaaucucagggcaacuaucugcuugagugcacaaagaauccguccuucagcgaagaaccuuggcuggaaaucaagcaccuccacgagucucugcuucagcagcugcaagauuccgugcagaaccucgacgggcauguuagagaacacgauagcuaccaggugugugucaccgaccugaauacaacccuggauaacuuuuccaaagaguucgugagcuuuucugacaagcccguggaccagauugcuguugaggaaaaacuccaaaagcugcaggagcuugaaaaucgccugagccuccaggauggaacgcugaaaaagauccuugcccuggccaaguccgucaaacagaacacaucuagcgugggccaaaagauuaucaaagacgauauuaagucccuccagugcaaacagaaggaccuggagaaucggcuggcuucugcgaagcaggaaauggaguguugccucaacagcauccugaaauccaagagaucuaccgagaaaaaggggaaauucacacuuccuggccgcgaaaagcaagccaccagcgaugugcaggaguccacccaggaaagcgcugccgucgagaaacuggaggaagacugggagauuaauaaggauucugccguggaaauggcuauguccaagcaacucagccugaacgcccaggagucuaugaaaaauacagaagacgagcggaagguuaacgagcuucagaaucagccccuggaacucgauacgaugcugagaaacgagcaacuggaagagaucgaaaaacucuauacccagcuggaggcgaagaaagcugccaucaagccccuugagcagacagaaugccugaacaagaccgagacaggagcccucgugcugcauaauauuggcuacuccgcucagcaccuugacaaccugcuccaagcccugaucacccugaaaaagaauaaagaaagccaguauuguguccuccgcgauuuccaggaguaccuggcggccguggaauccucuaugaaggcccuucugacggacaaagagagccucaagguugggccucuggacuccgugacauaccuugauaagauuaaaaaguuuaucgccagcauugagaaagaaaaggacucucugggaaaccucaaaaucaagugggagaaucuguccaaccacgucaccgauauggacaagaaacugcuugaaagccagaucaagcaacuggagcauggcugggaacagguggaacagcaaauucagaaaaaguauucucagcagguuguggaguacgaugaguucaccacacucaugaauaaaguccaagacaccgagaucagccugcagcagcagcaacagcaccuccagcugagacuuaaguccccggaagaacgggcugggaaccagucuaugauugcccugacaacggaucugcaagcuaccaaacauggauuuagcgugcucaagggccaggccgagcugcagaugaagcgcaucuggggcgaaaaagagaagaaaaaucuugaagacgggauuaacaaucugaagaaacagugggagacacucgaaccccugcaccucgaggcggagaaccaaaucaagaagugcgauaucagaaauaaaaugaaggaaaccauucugugggccaaaaaccugcuuggagagcugaauccuuccaucccccuccugccugacgauauucuuucucagauccggaaguguaaagugacacaugacggcauucuggcucgccagcaaagcgucgaaucccucgccgaggaaguuaaggauaaggugcccagccugaccacguaugaggggucugaccucaacaacacccuggaggaccugagaaaucaguaccagaugcuugugcugaaauccacacagcggagccaacagcucgaguucaagcuggaggaaagauccaacuuuuucgcuaucauucgcaaauuucagcuuaugguccaggagucugagacccugaucaucccucggguggaaacagccgccaccgaggcugaacucaagcaccaccauguuacacuggaggcgagccaaaaagaacugcaggagauugauuccggaaucucuacgcaccuccaggagcugaccaauauuuaugaagaacuuaacguguucgaaagacuguuucucgaggaccagcugaagaaucuuaagauccgcacaaaccggauucaaagauucauccagaauaccugcaacgaagucgagcauaaaaucaaguuuugucggcaguuccacgagaaaaccagcgcccugcaagaagaggcugauuccauucagcgcaaugaacuccugcugaaccaggaggugaauaagggcguuaaagaagagaucuacaaccucaaggacagacugacagccauuaagugcuguauccuucaggugcugaaacucaagaaagucuuugauuauauugggcugaauugggacuucagccaacuugaucagcugcagacccagguguucgagaaggaaaaagagcucgaagagaagaucaaacaacuggacacguuugaggaggaacacggaaaguaccaggcccugcucucuaagaugcgggcuaucgaucugcagauuaaaaagaugacagaagucgugcuuaaagccccggacuccagccccgagucucgcagacugaacgcgcagauccucucccaacggauugaaaaggccaaaugccugugugaugagaucauuaagaaacuuaaugagaacaaaaccuucgacgauagcuuuaaggaaaaagagauccugcagaucaagcucaacgcugaagagaaugacaaacuguacaagguucugcagaacauggugcucgaacugucuccuaaggagcuugacgagaaaaauugccaagauaagcuggaaacaucccuccacgugcugaaccagauuaaaagccagcuucagcaaccccugcucaucaaucuggagauuaagcacauccagaacgaaaaagacaauugugaggccuuccaggaacaggucugggcugagaugugcucuauuaaggccguuaccgcgaucgagaagcaacgcgaagagaacagcuccgaagccagcgauguggagacgaaacugagagaguuugaagaccuccagaugcagcugaauacauccauugaucuucggaccaacgugcugaaugacgcuuaugagaaccucacccgcuacaaggaagccgucacaagagcuguggagucuaucaccagccuggaagccaucauuaucccuuaucggguugaugugggcaaucccgaggagucccuugaaaugccgcugagaaaacaggaggaacucgagucuacagucgcucauauucaagaccugaccgaaaagcugggcaugaucagcuccccugaggccaaacuccagcugcaguacacgcuucaggagcuggugucuaagaacagcgcgaugaaagaagccuucaaggcucaagagacagaagccgagcgcuaucucgaaaauuacaagugcuaucggaaaauggaggaggauauuuacaccaaccuguccaagauggaaacaguccuggggcagagcaugucuucccucccccuuagcuacagagaggcucuggaacgccuggagcagucuaaagcccucguguccaaccugaucagcaccaaggaggaacuuaugaaacugcggcaaauccucagacugcugcgccuucgguguacggagaaugacggaauuugccuccugaagaucguuucugcccugugggaaaaguggcucucccugcuugaggcggcuaaagaaugggagauguggugugaggaacugaagcaggaguggaaauuugugagcgaagagauugaaagagaggccaucauucucgauaaccugcaggaggaacugcccgagaucucuaagaccaaagaagcugccacaaccgaggaacuuuccgagcuccuggacugccugugucaguauggcgagaaugucgaaaagcaacagcuccugcuuacacugcuccugcagcgcauccggagcauucagaacgugccugagagcuccggggccguugaaaccgugcccgcuuuccaagagaucacaucuaugaaggagagaugcaauaaacugcuucagaagguccagaaaaacaaggaacucgugcagaccgagauucaagaacgccacagcuuuacgaaagagaucauugcccugaagaauuucuuucagcagacaaccaccuccuuccaaaacauggcguuucaggaccauccugaaaagucugagcaguucgaggaacugcagagcauccucaaaaagggaaaacugacauucgagaauauuauggaaaaacuucggaucaaauacuccgagauguauaccaucgugccggccgaaauugagucucaaguugaggaauguagaaaggcucuggaggauaucgacgagaaaauuagcaacgagguccucaaguccagccccucuuacgccaugcgcagaaagaucgaagagauuaauaacggccugcacaauguggagaaaaugcugcagcagaaguccaaaaacaucgaaaaggcucaggagauccagaaaaagaugugggaugaacuugaccucuggcacagcaagcugaaugagcuggauucugaggugcaggacauugucgaacaggauccugggcaggcccaagaguggauggacaaccucaugauccccuuucagcaguaucagcaaguuucccagcgggcggaaugccgcacaagccagcugaacaaagccacggugaagauggaggaauacuccgaucuucugaaaucuaccgaggcuuggauugagaauacaagccaucuccuggccaacccugcugacuaugauucccugagaacccuuucucaccaugccagcacagugcaaauggcucucgaagacuccgagcagaagcacaaucugcugcauagcaucuucauggaucucgaagaccugucuauuaucuuugagaccgacgaacuuacgcaguccauccaggagcugagcaaccaagucaccgcccuccagcagaaaauuauggagucucugccccagauccaacggauggcggaugacgugguugccauugaaagcgaggugaaguccauggaaaagagagucucuaaaaucaagacaauucugcuuagcaaagagaucuucgauuuuuccccggaggaacaccucaagcacggagaggugauucuggaaaauauccggccuaugaaaaagaccaucgcugagauuguuagcuaccagguggaacugcgccucccccagacaggcaugaagccucugcccgucuuccagagaaccaaccaacuucugcaggacaucaaacuccuggagaaugugacgcaggagcaaaacgaacugcuuaagguggucauuaaacagacaaaugagugggaugaagagaucgaaaaccucaagcagauucugaauaacuacucugcccaguuuucccuggagcauaugagcccugaccaagcugauaaacucccccagcugcagggcgagaucgaacggauggagaagcagauccuuucccugaaucaacgcaaggaagaccuccugguugaucugaaagccaccgugcuuaaccuccaccagcaucugaagcaggagcaggaagggguggagagagaccggcugccggccgucacaucugaggaaggaggcguggcggagcgcgaugcuagcgaaagaaaacucaaucggcgcggguccaugucuuaucuggccgccguugaggaggaaguggaggaaagcuccgucaagucugacaacggagaugagaaagcugaaccuagcccccaauccuggagcucucuuuggaagcacgacaaagacauggaggaggauagagccuccuccucuagcggcaccauugugcaggaggcuuacgggaagaucagcaccucugacaacagcauggcccagauucugacacccgauucccucaauacggagcagggaccugaauguagccugcggccgaaccaaaccgaggaaggcacaacacccccuaucgaggcggacacacuggauuccucugacgcccagggcgggcuugagccccgcguugaaaagaccagaccugagcccacggaagugcuccacgcuugcaaaacacaggucgccgagcuggaacuguggcuccaacaggcuaauguggccguugagccugagacccugaacgcggauaugcaacaggugcuugaacaacagcuggucggaugucaggccaugcucaccgagauugaacauaagguggcuuuccugcuggagacaugcaaagaccagggccuuggggauaauggagccacccaacacgaggcugaagcccucagccugaagcugaaaacagucaagugcaaccucgagaaggugcagaugaugcugcaggaaaaacauuccgaggaccagcacccgacgauccuuaagaaaucuagcgaacccgagcaucaagaggcucugcagccuguuaaucucuccgaacuggagucuaucgugaccgaacggccccaguuuagccgccaaaaggauuuccagcagcagcaaguccuggagcuuaaaccuauggaacagaaggacuuuauuaaguucaucgaguuuaacgccaaaaagauguggccccaguauugucagcacgacaaugauacaacccaagaguccagcgcgucuaaccaggccuccagcccggaaaaugacgugccugauucuauucucagcccccagggccagaacggggacaaauggcaauaccugcaccaugagcugagcucuaagaucaaacucccccugccucagcuuguggaaccccagguuuccacaaauaugggcauucugccuagcgugaccauguauaacuucagauacccgacgaccgaggaacucaagacauauaccacacaacuggaggaucugcggcaggaggcuucuaaucuucagacccaggaaaacaugacagaggaagccuacaucaaucuggacaagaaacucuucgagcuguuucucacccugucccaaugccuuagcuccgucgaggaaaugcuggagaugcccagacucuaccgcgaagauggcagcggccaacaggugcacuaugagacgcuggcccuggaacuuaagaaacuguaccucgcucugucugacaagaaaggggaucuccugaaggccaugacauggccuggagagaacaccaaccuucugcucgaguguuucgacaaucugcagguuugccuggaacauacccaagcggcugccgugugucggagcaaaucccuuaaggccggccuggauuauaacagaucuuaccagaaugagauuaagcgccucuaucaccagcugaucaaaagcaagacaucccuccagcaaucucugaacgaaaucagcgggcaguccgucgcugagcagcuucagaaagccgacgcuuacacgguggaacuggagaaugccgagagccgggucgcgaagcugagagaugaaggagagcgccuccaucugcccuaugcccuucugcaagaaguguacaaacucgaggacguucuggacucuauguggggcaugcuccgggcuagauacaccgaacuguccagcccuuuugugacagagucucagcaggaugcccuucugcaagggauggucgagcuggugaagauuggaaaggaaaaacucgcucacggccaccugaagcagaccaaauccaagguugcccuucaggcgcagaucgagaaccauaaaguguucuuucaaaagcuggucgccgacaugcuccugauucaggcuuauagcgccaagauccuccccucucugcuucagaaucgcgaaacauucugggcugaacaggugaccgaggugaaaauucuggaagagaagucccggcaaugcggcaugaaacugcagagccuccugcagaagugggaagaguuugaugaaaacuacgccucccuugagaaagaccuggagauccucaucucuacacugccgagcguuucccuggucgaagagaccgaagagagacucguggaacgcauuagcuucuaucagcaaaucaagcggaauauugggggaaagcacgccagacuuuaccagacgcugaacgagggcaaacagcugguggcuucugucuccuguccugagcucgaagggcaaaucgcgaagcuggaggaacaguggcuuagccugaauaaaaagauugaucaugagcuccaccggcugcaggcccugcucaaacaccuucugucuuauaacagagacagcgaucagcugaccaaguggcucgaauccucucaacauacacugaauuacuggaaagagcagagccuuaacgugucccaggaccuggauaccauccgcagcaauaucaacaacuuuuucgaguuuucuaaggaaguugacgagaaguccagccucaaaacagcugugauuucuaucggaaaucagcugcugcaccucaaggaaaccgauacggccacacuucgggccucccuggcucaauucgagcagaaauggaccaugcugauuacacagcuccccgacauccaggagaagcugcaucaacuucagauggaaaaacugccuagcagaaaggccauuaccgagaugaucuccuggaugaacaaugucgaacaccagacgucugaugaggacagcgugcauucccccucuagcgcgucccagguuaagcaccuccugcaaaaacacaaggaauuucgcauggagauggacuauaaacaguggauuguggauuucgucaaccagagccugcuccaacugucuaccugcgacguggaguccaagagauacgaacggacagaguucgcugaacaucuuggcgagaugaaucgccaguggcacagaguucaugggaugcugaaccggaaaauccagcaccucgaacagcugcuugagagcaucaccgagucugaaaauaagauucaaauccugaacaauuggcucgaggcccaggaagaaagacugaagacacugcagaaaccugaauccgugauuagcguccagaagcuccugcuugauugucaagacaucgagaaccagcuggccauuaaaucuaaggcucucgaugagcugaaacaguccuaccuuacccuggaaagcggagccgugccccuccuggaggacacagcuagcagaaucgaugaacuguuucagaagcgguccucugugcucacccaagucaaucagcugaagacgagcaugcaguccguucuucaagaguggaaaaucuaugaccagcuguacgaugaggugaacaugaugacaauucgcuucugguauugcauggaacacucuaagccggugguccucagccuggagacccuuagaugucagguggaaaaucugcagucccuccaagacgaggccgaaucuagcgagggcuccugggagaaacugcaggaaguuaucggcaagcugaaagggcucugcccuucuguggcggagauuaucgaagagaagugccagaacacccauaagcgguggacacaggucaaucaagccauugcugaucagcugcagaaagcccagagccuucugcaacucuggaaggcuuacuccaacgcccacggagaagcggccgcucgccugaaacagcaggaggccaaguuucaacagcuugcuaacaucagcaugucuggcaauaaccuggccgagauccugccgcccgcccugcaggacauuaaagaacugcagcaugacgugcaaaagaccaaagaggcuuuccuccaaaauuccagcguucuggauagacuuccucagccggcggaaucuuccacacacaugcugcuccccgggccucugcauagccuucagcgggccgcuuaucuggagaagaugcuccuggugaaggccaacgaauuugaguucguccugucucaauuuaaagacuucggagugcgccucgagucccugaagggccuuaucaugcacgaagaggaaaaucuggauagacuccaccagcaggagaaagagaaccccgacagcuuucugaaucauguccuugcccugacggcucaguccccugauauugaacaccucaacgaggugagccugaagcugccccucucugacguugccgugaaaacccugcaaaauaugaaccggcaguggaucagagcgacagcuaccgcccuugaacgcuguagcgagcugcaggggauuggccucaaugaaaaguuccuguacugcugugagaaguggauccagcuucuggagaaaaucgaagaggcccucaaggucgauguggcuaacucccugccugaacugcucgagcaacagaaaacauauaagaugcuggaagccgagguuucuauuaaucagaccaucgcugacagcuacgugacgcaaucccuucagcugcucgauaccacagagauugaaaaccggcccgaguuuaucaccgaguucucuaaacugacagacagauggcagaaugccguccagggagugcgccaacggaagggcgauguggacgggcugguuagacaguggcaggauuuuaccacgagcgucgagaaccuuuuccgcuuccucacagacaccucccaucugcugucugcggugaagggacaggaacgguuuagccucuaccaaacaagaucccugauucacgagcuuaaaaacaaggagauccacuuccagcgccggagaacaaccugcgcccugacacucgaagcuggcgagaaacugcugcuuacgaccgaccucaagacaaaagaaagcguggggcggcgcauuucucagcugcaggauuccuggaaggacauggagccgcaacuggccgagaugaucaagcaguuucagagcaccgucgaaacaugggaucaaugugagaaaaagaucaaagaacucaagucuagacuccaggugcuuaaagcucaguccgaggacccucugcccgaacuccaugaggaucugcacaaugagaaggaacugauuaaagagcuugaacagagccucgccuccuggacccaaaaccugaaggagcugcagacgaugaaggcggaccucacacggcauguucugguggaagaugucauggugcuuaaagagcagaucgagcaucugcaucgccagugggaagaccucugccugagaguugccauucggaagcaagagaucgaagauagacugaauaccuggguggucuucaacgagaaaaauaaggaacuuugugcuuggcucgugcagauggagaacaaagugcugcagaccgccgacauuucuaucgaggaaaugaucgagaagcugcagaaggauugcauggaagagauuaaucucuuuagcgagaacaaacugcaacuuaagcagaugggagaccagcugaucaaggcuuccaauaagagccgcgccgccgaaauugaugacaaacucaacaagaucaaugaccgguggcagcaccuguucgauguuauuggcucuagagucaagaaacugaaggagacauuugcuuucauccaacagcuugacaaaaacauguccaaucuccgcaccuggcuggcgcggaucgaaagcgagcugucuaagccugugguguaugaugucugugacgaucaggaaauucagaaaagacucgccgagcagcaggaccugcagcgcgauaucgagcaacacuccgcugggguugaaagcguguuuaacauuugcgacgugcuucugcaugauucugacgccugugccaaugagacagaaugcgauagcauccagcagacgaccagaucccucgaccggcgcuggagaaacauuugugcuaugucuauggagcggcgcaugaagaucgaagagacauggagacuguggcagaaguuccuggacgauuacagccgguuugaggacuggcuuaaauccgccgaacgcaccgcggcuugccccaacagcucugagguccucuauacauccgccaaggaggagcugaaaagauucgaagccuuccaacggcagauucacgagagacugacccagcucgagcugaucaauaagcaguaccgccggcuugcuagagaaaaccgcacggauaccgccagccggcugaaacaaauggugcaugagggcaaucagagaugggacaaccuccagcgccggguuacagcugugcugagacggcugcgccacuuuaccaaucaaagagaagaguucgagggaacacgggaauccauccuugucuggcucaccgagauggaucugcagcugacaaacguggaacauuuuucugagagcgacgccgaugacaagaugcgccagcucaauggcuuccagcaagaaauuacccugaacacgaauaaaaucgaucagcuuauuguuuuuggggagcagcugauccagaaguccgagccgcucgacgcggugcugauugaagaugagcuggaggagcuucacagauauugccaagaagucuucggacgggugucucgcuuucacagacggcugacaagcuguaccccuggccucgaggacgagaaggaagccuccgagaacgaaaccgauauggaggaccccagagaaauccagacagacagcuggcgcaaaagaggggagucugaggaacccuccagcccucagucucugugccaucucguggcucccggacacgagagauccggcugugaaacgccugucagcguugauucuaucccgcuggagugggaccauaccggggaugugggcggauccagcucucacgaggaagacgaggaaggccccuacuauagcgcccuuuccggaaagagcauuuccgauggacacucuuggcaugugccugacagccccuccugcccugagcaccauuacaaacagauggaaggcgaucgcaaugugcccccuguuccgcccgcuucuagcacaccuuacaagcccccuuaugggaaacugcuccugcccccgggaaccgacggcggcaaggaggggccucgggugcugaacggaaauccccaacaggaggauggcgggcuugccggaaucacagaacagcaguccggcgcguucgacagaugggagaugauucaagcccaggaacugcacaacaagcucaaaaucaagcagaaucugcaacagcucaacucugauauuagcgcuaucaccacauggcugaaaaagaccgaggccgaacuugagaugcugaaaauggcuaagcccccuuccgacauccaggagauugaacuccgcgugaagcggcugcaggagauccugaaagccuuugacacguacaaggcgcuugucgugagcguuaacgugucuuccaaagaguuccugcaaaccgagagccccgaaucuacagagcuccaguccagacugcgccagcucagccugcuuugggaggccgcucagggggccgucgauucuuggcggggaggccugagacaaucccugaugcagugucaggacuuucaucagcucagccaaaaucugcuucuguggcucgcuuccgccaagaaccgcagacagaaagcccacgugaccgauccuaaggcugacccgcgggcccugcucgaaugccgcagagagcugaugcagcuugaaaaggagcugguugagcggcaaccccagguggauaugcugcaggaaauuagcaauucucuccugaucaaaggccacggggaggacuguauugaagcggaggaaaagguccaugugaucgagaagaaacuuaaacagcugagagagcaagucucccaggaucucauggcucugcagggaacacagaacccugccagcccccucccuucuuucgacgaaguggauagcggcgaccaacccccggccaccuccguuccugcuccccgcgccaaacaguuucgggcggugagaacgacagagggggaagaggaaaccgagucucgggucccuggaagcacacgcccccagagauccuuccugucucggguggugcgcgcugcccuuccgcugcagcugcuccugcuucugcuccugcugcucgccugccuucugccuagcuccgaggaagauuauagcuguacccaagcuaauaacuucgccagaucuuuuuaccccaugcugcgguauaccaauggacccccucccacauga

SEQ ID NO: 76514 - RNA, 1215 nt, Artificial Sequence
  derived and/or modified sequence opt5 from SYNE4__Homo_sapiens__NP_001034965
auggcccugagccucccccugggccccagacuuggguccgagccgcugaaccaucccccuggagcuccccgggaagccgacaucgugggcugcaccgucuguccugcgucuggggaggaaagcacaucccccgagcaggcucaaacgcucggacaggauucucugggcccuccggaacacuuccaagggggaccccgcggcaaugagccugccgcccaucccccuagauggagcacccccuccucuuacgaggacccggcuggcgggaagcacugcgaacacccuauuagcggacuugagguucuggaagccgagcagaacucccuccaucugugucugcucggccuggggcggcgccuucaggaucuggagcagggacucggccacugggcucuggcccagagcgggauggugcagcuucaagcgcuccagguggaccugagaggagccgcugaacgggucgaggcccugcuggcuuuuggcgaaggccucgcccagcgcucugagcccagagcgugggccgcucuggaacagauccuucgggcccugggggcuuaucgcgauuccauuuucagacggcucuggcaacugcaggcccagcuugugagcuacucucugguuuuugaggaggccaauacacucgaccaagaucuggaaguggagggagacuccgauuggccuggccccgggggagucuggggccccugggcuccuagcucucugccgaccuccacagaacucgagugggaccccgcgggggauaucggaggccugggcccucuugggcagaaaaccgcccgcacacugggagugcccugcgaacucuguggccagagagggccucagggacggggccaagggcuggaggaggcugacaccagccacucccgccaggauaugcuugaaucuggccugggacaucagaagagacucgcccggcaccagagacauagccugcugcgcaaaccccaagacaagaaacggcaggccuccccgcaccuccaggacguuagacuggagggcaacccuggggcucccgauccugccagccgccagccccuuacguuccugcucauucuguuucugcuuuuccuccugcuggugggagcgauguuucuccugccugcuucuggcgggcccugcuguucccacgcccggaucccgagaaccccuuaucuuguccugagcuacgugaauggacucccucccguguga

SEQ ID NO: 76515 - RNA, 4032 nt, Artificial Sequence
  derived and/or modified sequence opt5 from SYNGAP1__Homo_sapiens__NP_006763
augagcagaucccgggccucuauccaccgcggcagcauucccgcuauguccuacgccccuuucagagacgugcgggggccgucuaugcaucgcacccaguauguccacagccccuacgauagaccuggauggaacccccgguuuugcaucauuuccggcaaucaacugcucaugcuggacgaggaugaaauccauccucuucugauucgcgacagacggucugagagcucccgcaacaagcuccugagacggacaguuagcgugcccguggaagggcgcccucacggagagcaugaauaucaccuuggcagaucucggcgcaaauccguccccgggggaaagcaguacagcauggagggcgcgcccgcugccccuuucagacccucucagggcuuucugucccggagacucaaaagcucuaucaagcgcacgaaaucccagccuaagcuggaucggaccagcuccuucagacaaauccugccccgcuuucggucugccgaccacgauagagcucgccucaugcagagcuucaaggagucccauagccacgaaucucugcuuuccccgagcucugccgcugaggcccuggaacucaaucuggacgaggauagcauuaucaaaccugugcauuccucuauucuugggcaggaguuuuguuucgaaguuacaaccagcuccggaacaaagugcuuugcgugucggagcgccgcugagagagacaaauggaucgaaaaccugcagcgcgccgugaagcccaauaaagauaacucucggagagucgacaaugugcucaagcuguggauuaucgaggcucgcgaacugccucccaagaaacgguauuacugcgagcucugucuggaugacaugcuuuaugccagaaccacauccaagccccggagcgcgucuggcgacaccguuuucuggggagagcacuuugaguucaacaaucugccugccgugcgcgcucucagacugcaccuuuaccgggauuccgacaaaaagagaaagaaggauaaagccggguacgucggccuggugacggugccggucgcuacccucgccgggcgccauuuuacagaacaaugguaucccguuacccugccuacaggaagcggcggcuccgggggaaugggcucugggggaggcgggggaagcggcggcggguccggaggcaaggggaagggaggcugccccgccgugcggcugaaagcuagauaccagaccaugucuauucucccuauggaacuguauaaggaguucgcggaauacgugacgaaccacuaucgcaugcuuugugccguccuggagcccgcucucaaugugaaagggaaggaggaaguugccagcgcccuggugcauauccuucaguccacaggcaaagcuaaggacuuccugagcgauauggccaugucugaggucgacagauuuauggaacgggagcaccucaucuuccgcgaaaacacccuggcgacaaaggcuauugaggaguacaugagacugaucggacagaaauaucucaaggaugccauuggcgaauuuauccgggcccuguacgaguccgaagagaauugcgagguggacccgauuaaauguaccgcuagcucucuugccgaacaucaagcuaaccugcgcaugugcugugagcucgcccugugcaagguugucaauucccacugcguguucccuagagaacugaaagagguguuugcgagcuggcggcuucgcugugccgaaagagggcgggaggauaucgcugaccgccucaucucugccagccuguuccugagauuucucugccccgcuauuauguccccuagccuguucggacuuaugcaggaguaccccgaugaacagaccucucggacacugacgcucaucgccaaggucauucaaaaccuggcgaacuuuuccaaguucaccagcaaagaggacuuucugggcuucaugaaugaauuucuugagcucgaauggggguccaugcagcaguuccuguaugagaucucuaaccuggacacacucaccaauagcuccucuuucgagggauacauugaucugggcagagaacuuagcacacugcacgcccuccugugggaggugcugccucagcuuuccaaggaagcucuccugaaacuggggccccucccgcgccugcuuaacgacaucucuaccgcccugcggaauccuaacauccaaagacagcccagccgccaguccgagcggcccagaccucagccgguugugcuccgcggccccagcgcugaaaugcaaggauauaugaugcgggaucuuaauucuuccauugaccugcagagcuuuauggccagaggccugaacucuuccauggauauggcccgccucccuagccccacgaaggagaaaccucccccucccccgccugggggaggcaaggaccuguucuacgucucucggcccccucuggcuagauccagccccgcguauuguacauccagcucugauaucaccgagccggaacagaagaugcucagcgugaauaaauccguuucuaugcuggaccuucagggggauggaccuggcgggcggcugaacagcuccucugugagcaaucucgccgcugucggcgaccugcugcauuccucucaagccagccuuaccgccgcucugggacuccgccccgccccugcgggcagacugucccaggggagcggaucuuccauuacagcugccggcaugcggcucagccagaugggggugaccacagauggagugcccgcccagcaacugcgcaucccccuuucuuuucagaacccucuguuccacauggcugccgacggcccggggcccccuggcggacauggcgggggaggcgggcacggacccccuuccagccaccaucaccaucaccaucaccaccaucacagaggcggcgagcccccuggggauacguuugcgccguuccauggauacuccaagucugaagaccucagcuccggcguucccaaaccucccgcugccagcauucugcacucucauuccuauagcgacgaguuugggccuucuggaaccgauuucacacggagacagcugagccuucaagacaaucugcagcacaugcucuccccgccgcagaucaccauuggcccucagcgccccgcccccucugggccuggaggcggcagcgggggaggcuccgggggaggcgggggaggccaacccccuccgcugcagcggggcaagucucagcagcucacagucagcgcugcccaaaaacccagaccuuccagcgggaaccugcuucagucucccgagccuuccuacggacccgcucgcccgcggcagcagagccuguccaaggaaggcucuaucgggggaagcggcggguccggaggcggcgggggaggcgggcucaaaccuucuaucaccaagcaacacagccagacgcccuccacccugaauccuacaaugcccgccagcgagagaaccguggcgugggugucuaacaugccucaucuguccgccgauauugaaagcgcucacaucgagcgcgaagaguacaaacuuaaagaguauucuaaguccauggacgaaagccggcuggauagagucaaagaguacgaagaggaaauucauucucucaaggagcgccugcacaugagcaacagaaaacucgaggaauaugagcggcgccugcuuucccaggaggaacaaacaucuaagauccugaugcaguaccaggccagacuggaacagagcgagaagcggcuccgccaacagcaggcugagaaagacucccagauuaagagcaucaucggaagacugaugcuuguggaagaggaacugcggagagaucaccccgccauggccgagccgcucccugagcccaaaaagcgccugcucgacgcucaagaacggcagcugcccccucuuggcccgaccaaucccagaguuacgcuggcgccucccuggaacgggcuggccccucccgcuccuccgcccccuccccgccuccagauuacagagaauggagaauuucggaacaccgccgaucauuga

SEQ ID NO: 76516 - RNA, 702 nt, Artificial Sequence
  derived and/or modified sequence opt5 from SYNGR1__Homo_sapiens__NP_004702
auggagggcggggccuacggagcuggcaaggccgggggagcguucgaccccuauacccuggugagacagccucacacaauccuccgggucguuagcuggcuguuuuccauugugguguucggcucuaucgucaacgaaggguaccuuaauagcgcuuccgagggagaagaguuuugcauuuauaaccgcaauccgaacgccuguucuuacggcguggccguuggcgugcuggcuuuccucacgugccugcuuuaucuggcccucgaugucuacuuuccccaaaucagcuccgugaaagacagaaagaaagcuguucugucugauauuggggugagcgccuucugggcguuucugugguucgucggauuuuguuaucucgccaaucaguggcaaguguccaagccuaaagacaacccccugaaugaaggcaccgaugcugcccgggcugccaucgcguucagcuuuuucucuaucuuuacaugggccgggcaggcugugcuugccuuccagcgcuaccagauuggagcugacuccgcccuguucagccaggauuacauggacccuucucaggauuccagcaugcccuaugccccuuacgucgagccgaccggccccgacccugcugggaugggaggcacauaucaacagcccgcgaacaccuuugauacagagccucagggcuaccagucucaaggguauuga

SEQ ID NO: 76517 - RNA, 675 nt, Artificial Sequence
  derived and/or modified sequence opt5 from SYNGR2__Homo_sapiens__NP_004701
auggagagcggcgccuacggggcugccaaggcgggaggcuccuucgaccugagacgguuucucacccagccccaaguggucgcucgcgccguuugccugguguucgcccuuaucguguuuucuuguauuuauggggaaggauacagcaacgcucacgaguccaaacagauguauugcgucuucaauagaaacgaagaugccugucgguacggcucugcuaucggggugcuggccuuucucgcgagcgccuucuuucugguuguggacgcuuauuucccucagauuuccaaugccacagaucgcaaguaccuugucaucggagaccugcucuuuucugcucuguggacguuccugugguuugugggcuucugcuuucucaccaaccagugggccguuacaaauccgaaagaugugcuggucggcgcggacagcgugagagccgcuauuaccuucuccuucuuuagcaucuucucuuggggagugcuugccucccuggcuuaucaacgguacaaggccggggucgaugacuuuauccagaacuacguugaucccacaccugaccccaauaccgccuaugcuagcuacccuggcgcgucuguggauaacuaucagcagcccccuuucacacaaaaugccgagaccacggaaggguaccagccgcccccuguguauuga

SEQ ID NO: 76518 - RNA, 3888 nt, Artificial Sequence
  derived and/or modified sequence opt5 from SYNJ1__Homo_sapiens__NP_001153774
auggccuucagcaagggcuuuagaaucuaccacaaacuggaucccccuccguucucccucauuguggagacccggcauaaggaagagugccugauguuugaaucuggggcugucgccguucuuagcuccgcggagaaagaagcuaucaagggaacauauucuaaagugcuggacgccuacggccuccugggggugcuucgccugaaccucggagacacgaugcugcacuaucugguccucgugaccggcuguaugagcguugggaagauucaggaguccgagguguucagagucacaucuaccgaauuuaucagccugcggauugauuccagcgacgaggaucgcaucucugaagugagaaagguucuuaauuccggaaacuucuacuuugccuggagcgcuucuggcaucucccuggaccucagccugaaugcccaucggucuaugcaagagcagacaaccgauaaccgcuucuuuuggaaucagucccuucaucugcaccucaaacacuauggcgugaacugcgacgauuggcugcugagacucaugugugggggagucgagauucggacaaucuacgcugcccacaagcaggcgaaagccugccugauuagccgccuuuccugugaaagagcuggcacccgguucaaugugcgcgggacgaacgacgauggacauguggccaauuuugucgagaccgaacaaguuguguaucuggacgauucugugagcuccuucauccagauuagaggcagcgucccccucuuuugggagcagccugggcuucaggugggaucucaccggguucgcauguccagaggcuucgaagcuaacgcccccgcguucgaccggcauuuuagaacacugaagaaucuguacggcaaacaaaucauugugaaccuccuggggagcaaggagggagagcacaugcugucuaaggccuuccagagccaccucaaggcuuccgaacaugccgcugacauccagauggucaauuuugauuaccaccagauggugaaaggcgggaaagccgagaagcugcauucuguucuuaaaccucaagugcagaaguuccuggacuauggauuuuucuacuuuaacggcagcgaaguccagcgcugccaauccgggaccgugcggacaaauugucucgauugccuggacagaaccaacagcguccaggccuuccuuggacuggagaugcucgcuaaacagcuggaagcgcugggccucgccgagaagccccagcuggugacgcgcuuucaagagguuuuccggucuaugugguccgugaacggcgauagcaucucuaagauuuaugcugggacaggagcccuugaaggcaaagccaagcugaaagacggggcuagauccgucacccgcacaauccagaauaacuuuuucgauagcuccaagcaggaggccauugacgugcuccugcugggaaauacccuuaacucugaucucgcggacaaagcucgggcccugcugaccacaggcagccucagaguuuccgaacagacgcugcaaucugccagcuccaaggugcuuaagagcaugugugagaauuuuuacaaauauucuaagccuaaaaagauccgcgucugcguggggaccuggaacgugaauggcggaaaacaguuccgguccauugcuuucaagaaccagacacugaccgauuggcuccuggacgccccgaagcuggcuggcauccaggaauuucaagacaaaagaagcaagcccacagauaucuucgccauuggguuugaggagaugguugaacuuaaugcgggaaacaucgucucugccuccaccacgaaucagaaacucugggcuguggagcugcagaagacaauuagccgcgacaacaaauacgugcugcucgccucugaacagcuggucggcgugugucuuuucguuuuuauccggccucaacacgcucccuucauuagagauguggccgucgacaccgugaagaccgggaugggaggcgcgacagggaauaagggcgccguugcuauccggaugcuguuucauaccacaagccucugcuucgugugcucccacuuugccgcuggacagagccaggucaaagagcgcaacgaggauuucaucgaaauugccagaaagcugucuuuuccuaugggccggaugcuguucucccacgacuauguguuuugguguggggauuucaauuacagaaucgaccuucccaacgaggaaguuaaagagcucauucgccaacagaacugggauagccugaucgccggagaccagcugauuaaucagaagaacgcuggccaaguguuccggggguuucucgaaggaaaagucacguucgcgccgaccuacaaguaugaucuguuuuccgacgauuacgacacaucugagaaaugcagaaccccugccuggacagaccgcgugcuuuggagacggcgcaaguggcccuucgauagaagcgcugaggaccuggaucuccugaaugccuccuuucaggacgaaucuaagauccuguauaccuggacgccuggcacccuucuccauuacgggcgggccgagcugaaaacaagcgaucaccgccccguggucgcucugauugacaucgauaucuucgaaguugaggccgaagagagacagaacauuuauaaggaggugaucgcggugcagggacccccugacggcaccguccucguguccauuaaaucuagccugccggaaaauaacuuuuucgaugacgcucuuaucgaugagcugcuccaacaguuugccuccuucggcgaaguuauucugauccgguuuguggaggacaagaugugggucacauuccuggaagggagcucugcccuuaaugugcugucccucaacggaaaagagcugcucaaucgcaccaucacgauugcucuuaagagccccgauuggaucaagaaccuggaggaagagaugucucuggagaaaauuuccaucgcccucccuagcucuacauccagcacccugcugggcgaagacgcggagguugcugccgacuucgauauggaaggggacguggaugacuacuccgccgaggucgaggaacuucugccccagcaucuccagccuagcucuagcuccggacugggcacaucucccagcuccucuccgagaaccagcccuugucaaucccccaccauuucugaagggccugugcccagccucccuauccggcccucccgcgcuccgagcagaacaccuggcccucccucugcccaguccagccccaucgaugcucagccggccacgccccugccucaaaaggaccccgcgcagccucuugagcccaaacggccucccccgccuagacccguugccccucccacccgcccggcuccuccccagcggccucccccucccucuggagccagauccccggcucccacacgcaaggaguuuggcgccccuaaaagccccgggaccacacggaaggauaauauuggaagaucccagccuucuccccaagccggccuggcugggccuggaccggcgggcuauagcaccgcccgccccacgaucccuccccgggcuggcgugauuuccgccccucagagccacgccagagcuucugccgggcgccucacacccgaaucccagagcaagaccucugagaccagcaaaggauccacauuccugccggaaccucugaagccccaggcggcuuuucccccucaaucuagccuucccccuccggcccagcggcugcaggagccccucgucccuguggccgcucccaugccucaguccggcccccaaccgaaccuggaaaccccuccccagccucccccuagaucucggagcucccacagccuccccucugaggccuccagccagccgcagcaagagcagccuuccggguga

SEQ ID NO: 76519 - RNA, 438 nt, Artificial Sequence
  derived and/or modified sequence opt5 from SYNJ2BP__Homo_sapiens__NP_060843
augaacggcagaguggacuaccuggucaccgaggaagagaucaaucucacacgggggcccagcggacugggcuucaacauuguugggggaacggaucagcaauauguguccaaugacucuggcaucuacgugagccgcauuaaggaaaacggggccgcugcccuugauggaagacugcaggagggcgacaaaauccucuccgucaauggccaggaucugaagaaccuucugcaccaggacgcgguggaucucuuucggaaugcuggguaugccguuucucugcgcgugcaacauagacugcagguccagaacggaccuauuggccaccgcggggaaggagacccgagcggcauccccaucuucauggugcucguuccuguguuugcccugaccauggucgcugccugggcuuucaugcgguacagacagcaacuuuga

SEQ ID NO: 76520 - RNA, 3780 nt, Artificial Sequence
  derived and/or modified sequence opt5 from SYNJ2__Homo_sapiens__NP_001171559
augaucuacauggacgauggcgugagcuccuucguccagauuagagggucuguuccccuguuuugggagcaaccuggacuccaggugggcagccaccaucugcggcuucaccgcgggcuggaagccaacgcuccggccuucgacagacauauggugcuccugaaggagcaguauggacagcaagucgugguuaaucuucugggcucccgggggggagaagaggugcucaaccgcgcguuuaaaaagcugcugugggcuucuugccacgccggcgauacccccaugaucaauuucgacuuucaucaguucgccaaaggcgggaagcucgaaaaacuggagacacuucugagaccucagcucaagcugcacugggaggauuuugacgucuucacgaagggagaaaacgugagcccccgguuucagaaaggcacccuucgcaugaauugucuggauugccucgacagaacaaacaccguucaauccuucauugcucuggaggugcugcaccuccagcugaagacacuugggcugucuagcaaaccuaucgucgaucgguuuguggaauccuucaaggccauguggagccucaauggacauucucuguccaaaguguuuaccggcagccgcgcucuugaggggaaggccaaggucggaaaacugaaggacggcgcgagaucuaugucccggacaauucagagcaacuucuucgauggcguuaaacaggaggccaucaagcuccugcuggugggggacguguacggagaagaggucgcugauaaaggcgggaugcuccuggacucuaccgcccuucuggugacgccccgcauccucaaggcuaugaccgaaagacaauccgaguuuacaaauuucaaacggauucgcaucgccaugggaaccuggaacguuaauggcgggaagcaguuuagaagcaacgugcugcggacagcggaacuuaccgacuggcugcucgauuccccucagcugucuggagccacggacagccaagaugacuccagcccggcugauauuuucgccgucggcuuugaggagaugguggaacugucugcuggcaauaucguuaacgccuccacaaccaauaagaaaauguggggggagcagcuccagaaggccauuagcagaucucaccgcuauauccugcuuacaagcgcucagcuggugggagucugucucuacauuuucgugcggcccuaucaugucccuuuuaucagagacguggcgaucgauaccguuaaaaccggcauggggggaaaggccggcaacaaaggggcugugggcauucgcuuccaauuucacuccacaucuuucugcuuuaucuguagccaccugacggccggacagucccaggucaaggaacggaacgaggacuacaaggaaauuacccagaaacugugcuuccccaugggcagaaauguguuuagccaugauuauguuuucugguguggggacuucaacuaccgcaucgaucuuacauacgaggagguguuuuauuucgucaagcggcaagacuggaaaaagcuccuggaauuugaccagcugcagcuccagaaaucuuccggaaagauuuucaaggauuuucacgagggcgccaucaauuucgggccuaccuacaaauaugacgugggaagcgcugccuacgauacaucugacaagugcagaacccccgcguggacggaucgcgugcugugguggcggaaaaagcauccguuugacaaaacagcuggcgaacuuaaccugcucgauuccgaccuggauguugacaccaaggucagacacaccuggagcccuggggcccugcaauauuacggccgcgccgagcuucaggcuuccgaucaucggcccgugcucgccaucguggaagucgaggugcaggagguugacgugggagcuagagaacgggucuuccaggaggugucuagcuuucaaggcccucuggaugccacaguuguggucaaucugcagucccccacccucgaagagaagaacgaguuccccgaagaccugcgcacagagcuuaugcagacgcuggggucuuauggaaccauugugcucguuagaaucaaucaaggccagaugcuggugacauuugcggacagccacuccgcccugagcguccuugauguggacgggaugaaagugaagggacgggcugucaaaauuagaccuaagaccaaagauuggcucaagggccugcgcgaagagaucauucggaaaagagacucuauggccccgguuucccccacagcuaacagcugucugcucgaagagaauuucgauuuuaccucucuggacuacgaguccgaaggggauauccuugaggacgaugaagacuaccugguggaugaguucaaccagccuggcgugagcgacucugaacucggaggcgaugaccugagcgacguccccgggccuacggcccuggcgcccccguccaagagcccugcccuuaccaagaaaaagcagcaccccacauauaaagaugacgcugaucucguggagcugaagcgcgagcuggaagccguuggagaguucagacaucggucuccuucccgcagccucuccgugcccaauagaccucggcccccgcaaccuccccagcgccccccuccgcccaccggccugauggucaaaaagucugcuagcgacgccuccaucucuagcgggacacacggacaguacuccauucuucagaccgccagacugcucccuggcgcuccccaacagccucccaaggcgcggacggggaucucuaaaccuuauaacgugaagcagauuaaaacaaccaaugcccaggaagcugaggccgccauccgcugccugcuggaagcuagaggcggagccagcgaggaggcgcuuuccgcuguugccccccgggaucuggaagccagcucugagccggaaccuacacccggcgcugccaagccugagaccccccaagcgccgccucuccugccccgcagaccucccccccgggugccugcuauuaaaaagccgacccucagacgcacagggaagccccuguccccugaggaacaguuugagcagcaaacgguccauuucaccaucggacccccugaaacaagcguggaggcccccccuguugugaccgccccgcggguccccccugugcccaaaccuagaacauuucagcccggcaaggcugccgaacgcccgucucaccggaaaccugcuuccgacgaggccccccccggggcgggagccagcgugccucccccucuugaggcuccgccccuggucccuaagguucccccuagacgcaaaaagucugcccccgcugccuuccaccuccaggugcugcaguccaacagccaacugcuucagggccugaccuacaauuccagcgauucuccgagcggccauccucccgccgcugggacgguguuuccucagggagacuuccucuccacaucuagcgcgaccucccccgauucugacggcaccaaggccaugaaaccugaagcugccccccugcucggggauuaucaggacccguuuuggaaccugcuucaccauccuaagcugcucaacaauacauggcugagcaaauccucugacccccuggauagcggaacccggucccccaagagagacccuauugauccggucagcgccggcgcuucugccgcgaaagcugagcuucccccugaccacgaacauaagacacuggggcacugggugacgaucuccgaucaagagaaacgcaccgcccuccagguuuucgacccccuggccaagacauga

SEQ ID NO: 76521 - RNA, 3762 nt, Artificial Sequence
  derived and/or modified sequence opt5 from SYNM__Homo_sapiens__NP_056101
augcugagcuggagacuccagaccggccccgagaaggccgaacugcaagagcuuaacgcucggcuguacgacuaugugugccgcgucagagaacucgagcgggaaaaucugcuucuggaggaggaacuccgcgggagacggggacgcgagggccugugggccgaagggcaggcgagaugugcugaggaggcccggucccugcgccagcagcucgaugaacugucuugggccacagcucuugccgagggagaaagagacgcucugcggcgcgagcucagagaacugcaacggcuugaugccgaggagcgcgcggccagaggccggcuggacgcugaacucggggcccagcagagagagcugcaggaagcucugggagcccgcgcggcccucgaggcucugcuuggccggcugcaagccgaaagacgcggccucgaugcugcccacgagcgggacguuagagagcugcgcgcccgggcugcgagccuuacgaugcauuucagagcccgcgcuaccgggccugccgccccgcccccucggcugagagaagugcacgauuccuacgcucuccugguggccgagucuuggcgcgaaacaguccagcuguaugaggacgaagugcgggagcucgaggaagcgcugagacggggacaggagagccgccuucaggcugaagaggagaccagacugugcgcccaagaagccgaggcucuccggagagaagcccugggccuugagcagcugcgcgcucggcucgaagaugcccugcugagaaugcgcgaggaguacgggauccaggcggaagagagacaacggguuauugacugucucgaagaugagaaagccacacugacccuugcuauggccgacuggcugcgcgauuaucaggaccuccuucaggugaagacaggacugucccuggaagucgcuaccuacagagcccuccuggagggcgagucuaaccccgaaaucgugauuugggcggagcauguugaaaauaugccuagcgaguuucggaacaaauccuaucacuacacggacagccugcuccagcgcgaaaaugagagaaaccuguucucucggcaaaaggccccgcuugcuuccuuuaaucauagcucugcccuguacuccaaccucagcgggcaccgcggaucucagaccggcacauccaucggcggggaugcuagacggggauuccugggcagcggguauuccucuagcgccaccacacagcaggaaaauuccuacggaaaagccgugagcucucaaaccaacguccgcacguuuuccccuacauauggccugcuuagaaauaccgaagcucaggugaagacauucccggaccggcccaaggcgggggauaccagagaggugccugucuacauuggagaagacagcaccaucgcccgcgagucuuaucgggauagacgcgacaaaguugcugccggcgccagcgaguccacacggucuaacgaaagaacggugauccucggcaagaaaaccgaggugaaggcuacacgcgaacaggagcggaauagacccgaaaccauucgcacaaaaccugaggagaagauguuugauagcaaggaaaaagccuccgaggaacggaaccugagaugggaggaacugaccaagcucgacaaagaggcgcggcagcgcgagagccaacagaugaaggaaaaagcuaaggagaaagauucucccaaggaaaaguccgucagagagcgggaagugccgaucagccuggagguuucucaggaccgcagagccgagguguccccuaaagggcuucagacgcccgucaaggaugccggaggcgggacaggacgggaagcugaggccagagaacugcgcuuccggcucggcaccagcgacgcgaccgggucccugcaaggcgacucuaugacagagaccguggcugagaauauuguuacaagcauccugaaacaguuuacgcaguccccugaaaccgaggccucugccgauagcuuccccgacacaaaggugaccuacgucgauagaaaagaacuucccggagagcgcaagacaaagaccgaaauuguggucgaguccaaacucacggaggacguggauguuagcgacgaagcuggccuggauuaucugcucucuaaggacaucaaagagguggggcugaagggaaaauccgccgaacaaaugauuggcgauaucaucaaccuugggcugaagggacgggagggcagagcuaaggucgugaacguugaaauuguggaggagccugucagcuacgugucuggggaaaaaccggaggaauuuuccgugcccuucaagguugaggaagucgaggacgugagcccuggccccuggggacucgugaaagaggaagagggcuacggggaaucugaugucaccuuuagcgugaaucagcaccgccggacaaagcagccucaggagaacaccacacauguugaggaagugaccgaggccggagacuccgaaggcgagcaaagcuauuucgucucuacgcccgaugaacaccccgggggacaugacagagacgauggcuccguguacgggcagauccacauugaggaggaaagcacaauccgcuauuccuggcaggacgagauuguucagggcaccagacggcgcacacaaaaagauggagcggugggcgaaaaggucgugaagccucuggacguucccgccccuucucuggagggggaucuuggaagcacccacuggaaagaacaggcuagauccggcgaguuccaugccgagcccaccgugaucgaaaaggagaucaaaauuccucacgaauuucauacaucuaugaaggggaucagcuccaaagagccccggcagcagcucgucgaagugauuggacaacuggaggagacgcugccggaacgcaugagagaggaacucucugcucugacccgggagggccaagggggcccuggaagcguguccgucgacguuaagaaagugcagggcgccgggggaagcucugugacacuugucgccgaggugaauguuucccagaccguggaugcugacagacuggaucucgaggagcugagcaaggacgaagcgucugagauggaaaaggccgucgaguccgugguucgcgagagccugucucggcagagaucccccgcucccggcagcccugaugaagaagggggagccgaggccccggcugccggcauccgcuuccggagaugggcgacacgggagcuuuacauucccuccggcgaaagcgagguggcugggggagccucucacagcuccggccagcgcaccccucaggggcccgucucugccacgguggagguuagcuccccuacaggauuugcucaaucucaggugcuggaagacgucagccaggccgcgagacauaucaaacucggccccuccgagguguggcggaccgaacgcaugucuuaugaggggccuaccgcugaaguggucgagauggauguuagcaacguggaggccaucagaucccggacacaggaagccggagcucugggcgugagcgaccgcggcucuuggagagacgccgauucccggaaugaccaagcugucggggugagcuucaaggccucugcgggagagggcgaucaggcccaccgcgaacaggggaaagagcaggcuauguuugacaagaaaguucaacuccagagaaugguggaucagcgguccgucauuagcgacgagaagaagguggcccugcuuuaccuggauaacgaagaggaagagaaugacggacacugguucuga

SEQ ID NO: 76522 - RNA, 3282 nt, Artificial Sequence
  derived and/or modified sequence opt5 from SYNPO2__Homo_sapiens__NP_001122405
augggcaccggggacuucaucugcauuagcaugacaggaggcgcccccuggggguuuagacuccagggaggcaaggagcaaaaacagccucuccagguggcuaagauccggaaccaguccaaagccucugggagcggacugugugaaggcgaugaggucguuuccauuaauggcaacccgugcgcggaccuuacguaccccgaagugaucaagcugauggagucuauuaccgauagccuccaaaugcugaucaaacgcccuuccucugggaucagcgaagcucuuauuuccgagaaugagaacaagaaucuggaacaccucacacauggaggcuauguggagagcaccacacugcagaucagacccgccaccaagacacaguguaccgaguucuuucuggccccugucaaaacggaagugccccucgcugagaaccagcggucugggccugacugcgccggaucccugaaggaagagaccggcccgagcuaccaacgcgcuccccagaugccugauucucagagagggcggguugccgaggaacuuauucugcgcgaaaaaguggaggcgguccagcccggaccugugguugagcuccaacugucccuuagccaggaaagacacaagggcgccucuggcccccugguggcucucccgggggccgagaaauccaagagcccugaccccgauccuaaucugucccaugaccggaucguccacauuaacucuauccccacaaaugaaaaggcugaucccuuccugcgcagcuccaaaauuauccagaucagcucuggaagagagcuccgggugauucaagaauccgaggccggcgacgcggggcugccucgcguggaggucauccuugauuguagcgacagacagaagaccgaaggaugccggcugcaggccggcaaagaguguguugauucuccgguggaagggggacagagcgaggcucccccuucccucgugucuuuugccgucagcuccgaaggcacagagcaaggcgaggacccccgcagcgaaaaggaccauucuagaccucacaaacaccgggcuagacaugcccgccugcggagauccgagagccuuucugaaaaacaggugaaggaggccaaguccaagugcaaaagcauugcucugcuccugaccgaugcgcccaaccccaauuccaaggggguucugauguucaaaaagcgccggagacgcgcccggaaauauacgcucgugucuuacggaacaggcgagcuggaaagagaggcugacgaagaggaagagggggauaaggaggacaccugugaagucgccuuucuuggagccagcgaguccgaaguggaugaggaacugcucucugacguugaugacaacacacagguggucaauuucgauugggacagcggccugguggauaucgagaagaaacuuaaccgcggggacaagauggagaugcugccugacaccaccggcaaaggagcucucauguuugccaagcggagagaacgcauggaucagauuacagcgcaaaaagaggaagacaaggucggcgggacgcccucccgggagcaggaugcugcccagaccgacggacugagaacaaccacaagcuaucagcggaaggaagaggagucugugcgcacccaauccagcguuucuaaauccuacaucgaagugagccacggccuggggcaugucccucagcagaauggauucucuggcacgagcgagacagccaacauccagagaauggugcccaugaaccggaccgcuaagccuuuucccggguccguuaaucaaccggccaccccuuucagccccacaagaaacaugaccucucccauugcugauuuuccugccccgcccccuuauuccgcggugacacccccucccgacgccuucagccgcggcgucuccucuccuaucgcuggacccgcccagccgccucccuggccucagcccgcuccguggagccaaccugccuucuacgauuccucugaacggauugcgagcagagacgagcgcaucuccgugcccgccaaaagaacgggcauucuccaggaggcuaagcggcgcucuaccacaaaaccuauguuuaccuucaaggaacccaaggugagccccaauccugagcugcuuucccugcuccagaacagcgaagggaaaagaggaacaggcgccgggggagauucuggcccggaggaagacuaccugucccugggggcugaggccugcaauuuuaugcaguccucuuccgccaagcagaaaaccccgccucccguugcuccuaagcccgcggucaaaucuagcuccagccagccugugacgccggugucccccgucuggagcccuggcguggcccccacccagccucccgcuuucccgacaucuaacccuagcaagggaaccguuguguccucuaucaaaaucgcccagcccagcuaucccccugcccggcccgcuuccacacuuaaugucgccggcccuuuuaaggggccgcaagcggcuguggccucucagaacuacacccccaagccuacgguuagcacacccaccgugaaugccguccagccuggagcugugggccccuccaacgagcucccggggaugucuggacgcggcgcccagcuguucgcgaaaagacaaagccggauggaaaaguauguuguggauuccgacacaguccaggcucacgccgcccgcgcucagagcccuacccccucucugccugccuccuggaaauacagcucuaaugugagagcucccccucccguggccuauaacccgauucacuccccuagcuacccccucgcggcccugaagucccaacccucugcugcccagccuagcaaaauggggaagaagaaaggcaagaaaccgcuuaaugcucuggaugucaugaagcaucagcccuaucagcucaacgccucccuguuuaccuuccaaccucccgacgccaaagacggacugccucaaaagagcucuguuaaggugaauagcgcucuugcgaugaaacaggcccugcccccucggccggugaacgcugccagccccacaaacguccaggccucuagcguguacuccguuccugcuuacacgucucccccuagcuuuuucgccgaggcguccucucccgugagcgcuuccccggucccugugggcauccccaccagccccaagcaagaaucugccuccagcuccuauuuuguugccccucgccccaaauucucugcuaagaaaagcggggugacaauucaggucuggaagccuuccgugguugaggaauga

SEQ ID NO: 76523 - RNA, 2058 nt, Artificial Sequence
  derived and/or modified sequence opt5 from SYNPO__Homo_sapiens__NP_001103444
auggagggcuacagcgaagaggccucccugcucagacaccuggaaaagguggcuucugaggaagaggaggucccccuuguuguguaucugaaagaaaacgccgcgcuccugaccgcuaaugggcuucaucugagccagaaccgggaggcccaacaguccucuccugccccgcccccugcugaagugcacagccccgccgcugacgucaaucagaaccucgccuccccuucugcgacacugacgacccccacaagcaauuccagccauaacccuccggccaccgaugugaaucagaaucccccugcuacaguugugccccaaucucugccucucuccagcauccagcagaacucuuccgaggcccagcugcccagcaacggaaccggcccggcuucuaagccuuccacacuuugcgccgacgggcaaccccaggcgccugccgaggaaguccgcuguagcacccugcucauugauaaaguguccacgcccgcuaccacaaccucuacauucagcagagaggccacccugauccccuccagccggccuccggcuucugacuuuauguccagcucucuucugauugauauccagcccaauacgcucguugugagcgccgaccaggaaauguccggacgcgccgcugcgacaaccccuacaaaggucuacucugaggugcacuucacccuggccaaacccccuagcguggucaacagaaccgcucggcccuuuggcauucaagcccccgggggaacaucccagauggaacgcagcccuaugcuggagagacggcauuucggcgagaaggcccccgcuccucagcccccuucucuccccgaucgcuccccgagaccucaacggcacaucaugagccgcucucccaugguugaaagacggaugaugggccagcgcucccccgccagcgagagacggccucuggggaauuuuacggcgccgcccaccuauacagaaacccuuuccacagcuccucuggccucuugggugagaagcccgccuuccuacucugugcucuaucccagcuccgacccuaagagcucucaccugaaaggacaggccguccccgcuuccaagaccggcauccuugaggaaagcauggcccgccgggggucuagaaaauccauguucacguuuguggagaagccgaaaguuacaccuaaccccgaucugcucgaccuggugcagaccgcugaugagaagcgccggcaaagagaccagggagaagucggcguggaggaggaaccuuucgcccugggggcggaagccagcaauuuucagcaggagcccgcuccgcgcgaucgggccucuccugcugccgcggaggaaguugugcccgagugggccagcugccucaaguccccucgcauucaagcuaaacccaagcccaaaccuaaccagaaccugagcgaagccucuggaaagggcgcugagcuuuacgcccgccggcaguccagaauggagaaauaugucaucgaaagcuccucucauaccccggagcuggcccgcugucccagcccuacaaugucccuccccucuagcuggaaguacccuaccaaugcucccggcgcguuccggguggccuccagaucuccugcucggacaccgcccgccagccuguaccacggguaucuuccugaaaacggaguccugcgccccgagccuacgaaacagcccccguaccaacucagaccuucccuguuugugcugagccccauuaaggaacccgccaagguuucuccucgggcugccucccccgcgaaaccuagcucucucgaccuggugccgaaucuucccaagggcgcucugccucccuccccugcccuccccagaccgagcagaucuuccccugggcuguauaccagccccggacaggacucccugcagccuacagccgucucucccccuuacggcggggauaucagccccgugagcccgucccgggcuuggucuccuagagccaaacaggcgccccgccccagcuucuccaccagaaacgcuggaauugaggcccaaguuuggaagccuucuuuuugcuucaaauga

SEQ ID NO: 76524 - RNA, 858 nt, Artificial Sequence
  derived and/or modified sequence opt5 from SYNPR__Homo_sapiens__NP_001123475
auggaccccgugagccagcuggccuccgcuggcaccuucagaguccucaaggagccucuggccuuucuucgggcgcuggaacuccuguucgcuaucuuugccuucgccacaugcgggggauacucuggcgggcuucgccugagcguugauugugugaacaaaacggaguccaaucucucuauugacaucgcuuuugccuauccguucagacugcaccaagugaccuuugaaguccccacaugcgagggaaaggaacggcagaaacuggcucucauuggcgauagcuccucuagcgccgaguucuuugugaccguugcgguguucgccuuucuguacucccuugcugccacagucguguauaucuucuuucagaacaaguaccgcgagaauaacagagggccucugauugacuucaucguuaccguggucuucagcuuucucuggcuggugggaucuuccgcuugggccaaaggccuuagcgaugugaaggucgcgacagaccccaaggaaguucugcuccugaugucugccuguaaacagccuuccaauaagugcauggcuauccauagccccgugaugucuucccugaacaccagcguggucuucggcuuucucaauuucauucugugggccgggaacaucugguuuguguucaaagagacgggauggcacuccucuggccaacgguaucuuagcgauccuauggaaaagcauuccagcucuuacaaucaagggggauauaaccaggacuccuacggcagcucuagcggguacucccagcaggcuucucugggaccgaccagcgaugaguuuggccagcagcccacaggcccuaccuccuucacaaaucagauuuga

SEQ ID NO: 76525 - RNA, 942 nt, Artificial Sequence
  derived and/or modified sequence opt5 from SYP__Homo_sapiens__NP_003170
augcugcuccuggccgacauggauguggucaaccagcuuguugcuggcgggcaauucagaguggugaaggagccccugggauuugucaaagugcuccaguggguuuucgccaucuuugcguucgcuaccugcggcagcuacuccggggaacugcagcuuucuguggacugugccaauaagacagagagcgaucuguccauugaagucgaguuugaauauccuuuccggcuccaccagguguacuuugacgccccgacgugccgcggaggcaccacaaaaguuuuccuggugggggauuauucuagcuccgcugaguuuuucgucaccguggccguguuugcuuuccuguacucuaugggagcccucgcgacauauaucuuucugcaaaacaaguacagagagaauaacaaaggccccaugcuugacuuccuggccaccgcugucuucgccuuuauguggcucguuagcuccagcgcuugggccaagggccugucugaugugaagauggcgacagacccugaaaauauuaucaaagagaugcccgugugucggcagaccgggaacacgugcaaggaacuucgcgauccugucaccuccggacugaauacaagcgugguuuucggcuuucucaaccuggugcugugggucgggaaucucugguucguguuuaaagagaccggaugggccgcucccuuccugagagccccuccgggcgcucccgagaagcagccugcccccggggacgccuauggagaugcuggcuacggccaggggccuggaggcuacgggccccaagacucuuauggaccgcagggcggguaccagccugauuauggacagcccgcgggcuccggcgggagcggauacggcccucaaggggacuauggacagcagggcuacgggccccaaggcgcccccacaucuuuuuccaaccagauguga

SEQ ID NO: 76526 - RNA, 780 nt, Artificial Sequence
  derived and/or modified sequence opt5 from SYPL1__Homo_sapiens__NP_006745
auggcccccaacaucuaccuggugagacagcggauuagccgccucggccaaagaauguccggguuccagaucaaucugaacccucuuaaggagccgcugggauuuauuaaaguccucgaauggaucgcuucuauuuucgccuuugcgaccugcggcggguucaagggacagacagagauccagguuaauugucccccugcugugacggaaaacaaaaccgugacagccaccuuuggcuaucccuuccggcugaaugaggccagcuuucaaccucccccuggggucaacaucugcgacgugaauuggaaggauuacguucuuauuggagacuauuccucuagcgcucaguucuacgugacauuugccgucuucguguuucuguauuguaucgcugcccuccugcuguacguuggcuauaccucccucuaccuggauucucgcaaacuuccgaugauugacuucguggucacacugguggcgaccuuucucuggcuggugagcacguccgccugggcuaaggcccuuaccgauaucaagauugcuacaggccacaacaucauugacgaacugcccccuugcaaaaagaaagccguccucuguuacuucgggagcguuaccucuaugggaucccugaaugugagcgugaucuucggcuuucugaacaugauccucuggggagggaaugcgugguucgucuauaaggagacaucucugcauucccccagcaacaccucugccccucacucccagggcgggauucccccgccuacgggaaucuga

SEQ ID NO: 76527 - RNA, 831 nt, Artificial Sequence
  derived and/or modified sequence opt5 from SYPL2__Homo_sapiens__XP_011539585
augagcuccaccgagucugccggcagaacagcugacaagagcccccggcagcaaguggaucgccugcucgucgggcugagauggcggcgccuugaggaaccucugggauucaucaaaguucuccaguggcuguuugccauuuucgcguuuggcuccugcgggucuuacagcggagaaacgggcgcuauggugagauguaacaaugaggccaaggacguguccucuaucauugucgccuucggguauccguuucggcuucaccgcauccaguacgaaaugccccugugcgaugaggagagcuccagcaaaaccaugcaucucaugggagacuucucugcuccugccgaauuuuucgugacacugggcaucuuuuccuucuuuuauaccauggcugcccugguuauuuaccucagauuccacaaccuguauacagagaauaagcgguuuccccuuguggauuucugugucaccgugagcuucacauuuuucuggcugguugcggccgcugccuggggcaaagggcucaccgacgugaagggagcuacgcgcccuucuucccugaccgccgcgaugagcgucugccauggcgaagaggccguguguucugcuggggccacacccuccaugggacuugcuaacaucagcgugcuguuuggcuucauuaacuuuuuccucugggccgggaauugcugguuugucuucaaggagaccccuuggcacggacagggccaaggccaggaucaggaccaggaucaagaccaggggcagggaccgucccaggaaucugccgcugagcaaggcgcgguugaaaaacagauccaucacguguga

SEQ ID NO: 76528 - RNA, 1296 nt, Artificial Sequence
  derived and/or modified sequence opt5 from SYT11__Homo_sapiens__NP_689493
auggccgagaucaccaacauuagacccagcuucgacguguccccugucguugcuggccugaucggggccucugugcucguggucugcgugagcguuacaguguuugucugguccuguugccaccagcaagcggaaaagaaacagaagaauccgcccuacaaauucauucauaugcugaagggaaucucuauuuauccugagacgcuuagcaacaaaaagaagaucaucaaagugcggcgcgauaaggacggccccgggagagaaggaggccggcgcaaucugcucguugaugcugccgaggccgggcugcuuuccagagacaaagauccucggggacccucuagcggcuccuguauugaccagcugccuaucaagauggauuacggcgaggaacuccgcagcccgauuaccucucugacacccggggaguccaaaaccacaagcccuucuucccccgaagaggacgugaugcugggaagccucaccuuuucugucgauuauaacuucccuaagaaggcucugguggugacaauccaggaagcccacggccuucccgucauggacgaucaaacccagggguccgacccguacauuaaaaugacgauccugccugauaagagacaucggguuaaaacccgcgugcucagaaagacacuggaccccguguuugacgagaccuucacauuuuauggcauuccuuacagccagcuucaggaucugguccuccacuuccuggugcuguccuuugaccgguucucucgcgaugacguuaucggagaggugauggucccccucgcugggguggaucccagcaccggaaaaguucaacugacgagagacaucauuaagcggaauauccagaaaugcauuucccgcggcgaacuucaggugagccugucuuaucagccugucgcccaaagaaugacaguggucgugcucaaggcgcggcaucugccgaagauggauaucaccggccuuuccgggaaccccuacguuaaagugaaugucuacuauggaagaaagcgcauugccaaaaagaaaacacacgugaagaaguguacccugaacccuaucuuuaaugagagcuucaucuacgacauucccaccgaucuccugccugacaucucuauugaauuucugguuaucgauuucgaccggacaacgaaaaacgagguggucggcagacucauucugggggcucacagcgugaccgccuccggagcugaacauuggcgcgaggugugcgagucuccccggaagccgguugccaaauggcacagccuuuccgaauauuga

SEQ ID NO: 76529 - RNA, 1266 nt, Artificial Sequence
  derived and/or modified sequence opt5 from SYT12__Homo_sapiens__NP_001171351
auggccguggacgucgcugaguaccaccugagcguuaucaagucucccccuggcugggaaguggggguguaugccgcgggagcucucgcccugcuuggcauugccgcugucucccuguggaaacucuggaccagcggguccuucccgucucccagcccuuuucccaacuacgauuauagauaccugcagcaaaaguauggagaguccugcgccgaagcucgggagaaacgcgugccugccuggaaugcgcagagagccucuacacgggggcccccuagccgcaagggcucccuuagcaucgaagacacguucgagucuauuuccgagcugggaccgcucgaacugaugggcagagagcuggaucucgcucccuacggcacccugcggaaaagccagucugccgacucccuuaacagcaucucuuccguuagcaauacauuugggcaggauuucacccugggacaaguggaagucuccauggaguaugacacagcuucucauacccucaacguggccguuaugcagggcaaggaucugcuugagcgcgaagaggcgagcuuugaauccuguuucaugagagugagccugcucccugacgagcagauugucgggaucucucggauccagcgcaaugccuacuccaucuuuuucgaugaaaaguuuagcauuccccuggacccuacagcucuggaggagaaaucucucagauucagcguguuuggaauugaugaagacgagcggaacguguccaccggcgucguugaacugaaacuuucugugcuggaucucccccugcaaccguucagcggguggcuuuaccugcaggaccagaauaaggccgcugacgccgugggagagauccuccugucccugagcuaucucccuacggccgaacgccugaccgucgugguugugaaggcuaaaaaccuuauuuggacaaaugauaagaccacagcggaccccuuugucaagguguaccugcuccaggauggcagaaaaaugucuaagaaaaagaccgccguuaaacgggacgauccuaaccccguguucaaugaggcuaugaucuucuccguccccgccauugugcugcaagaccuuagccugcgcgucacgguggccgagucuuccagcgauggcagaggggacaacguuggacacgugaucaucggcccuuccgcuucugggaugggaacaacccauuggaaucagaugcucgccacacugcggagaccggucagcauguggcacgcggugcgccggaacuga

SEQ ID NO: 76530 - RNA, 1281 nt, Artificial Sequence
  derived and/or modified sequence opt5 from SYT13__Homo_sapiens__NP_065877
auggugcugagcguccccguuaucgcccucggcgcuacccuggggacagccacguccauucuugcgcugugcggagugaccugucucugcagacacaugcauccuaagaaaggccugcuuccgcgggaccaggaucccgaccuggagaaggcuaaaccuucucuccuggggagcgcccaacaguucaacgugaagaaauccacagaacccguccagccucgcgcccugcucaaguuucccgauaucuacggaccuagaccggcugugaccgcccccgagguuauuaauuaugcugacuacucucugcggagcacagaagaaccuaccgcccccgcguccccucagcccccgaacgauucucgccuuaagagacaagugacagaggagcuguucauccucccucagaauggcgucguggaggacguuugugugauggaaaccuggaaccccgagaaagccgcuagcuggaaucaggccccuaagcugcacuauugccuugauuacgacugucagaaagcugaacuguuugucacgcggcucgaggccgugaccuccaaccaugaugggggaugcgacuguuaugugcaaggcagcgucgcgaaucgcacaggcucuguugaggcccagaccgcucugaagaaaagacagcugcacacaaccugggaagaggggcucgugcugccccuugccgaagaggaacugcccacggcuacacucacccugacacuucggaccugcgaucgcuucuccagacauagcguggccggagagcugcggcucggccuggacgggaccucugucccucugggagccgcucaguggggcgagcucaagacauccgcgaaggaaccgagcgccggggcuggagaggugcugcuuucuauuuccuaccugcccgccgccaaccgccuccugguugugcuuaucaaagcuaagaaucugcacagcaaccaauccaaagaacuccugggcaaggaugucucugugaaaguuacgcugaagcaccaggccagaaaacucaagaagaaacagaccaagcgggcgaaacauaagaucaauccuguguggaacgagaugauuauguuugaacugcccgacgaccuucugcaagcuagcuccgucgagcucgaggugcugggccaggaugacagcgggcagucuugugcccugggacacugcucccuuggccuccauacaagcgggucugaacgcagccacugggaggaaaugcugaaaaauccuagacggcagaucgccauguggcaccaacugcaucucuga

SEQ ID NO: 76531 - RNA, 1860 nt, Artificial Sequence
  derived and/or modified sequence opt5 from SYT14__Homo_sapiens__NP_001139733
auggccagcgcuuccuggagacugaagguggagcgggaacccgucgaguacaugaaccucucuguucuggaaaagaucggcuauuucagcguggcccgccuugaguacuccgggaccauucuggcgcacugcaauuuuagacuccugggaucuaacgacagcuccgcuucugccagccaggugacaggcacgaccgucuccccugaagccgugggguuccuuagcgcuguuggaguguuuaucauucugaugcuccugcuguuccucuauaucaauaagaaauuuuguuucgagaacgucggcggguuuccggaucugggaucugaguacuccacacggaagaauagccaagacaaaauuuauaacucuuacauggauaaggacgaacauggcuccagcucugaguccgaagaugaggcccuuggcaaguaucacgaggcucugagccgcacccauaauuccagacucccccuggccgacucucggcagcgcaacuacgcgugggaaacaagacagaaauacagcccucuuuccgccgaguaugauggguacagcucugaggcuuccaucgacgaaggaaauugcauccagcggaugcgcagaacacccccucuggaugaacuccaacccccuccguaucaggacgauagcggcucuccccaccugagcuguaccccuuccgagauuggggacucuaagugcgaguucagccauuguuccaacagcccccggugcucuuacaauaaauguccuuccgaaggaagcaccggccacgagaucgaaucuuuucacaacaagggguaugaggaagaugugcccuccgacagcacggccguucuguccccggaggacaugucugcucagggaagcuccucucagcucccuaaacccuucgauccugagcccgaagccaaguacggcacccuggacgugacauuugauuaugacagccaagagcagaaacuucuggucaccgugacagcggugaccgauauucccacguacaaucgcacaggcgggaacuccuggcagguccaucucguucugcuuccuaucaaaaagcagagagccaaaaccagcauucaacggggaccgugccccguguucacagaaaccuuuaaguucaaucacguggagucugaaaugaucggcaacuacgcuguccgcuucagacuguauggggugcaucggaugaaaaaggagaaaauuguuggagagaagaucuuuuaccucaccaagcugaaccugcagggcaaaaugucccucccugugauccuggaacccagcuauaaucacucugggugugacucccagaugagcgucucugagaugagcugcuccgaaagcacaucuuccugucaaagccuugagcacggauccgugccugagauucugaucggccuccuguacaacgccacgaccggcagacuuucugcugaaguuauuaaggggagccauuucaaaaaucuggccgccaaccggcccccgaauggacucuuuugcugccugaagcaccugaucggcggacagguguauauuauccgcgauacauacgucaaacucacccugcuuaacuccauggggcaggagaugucuaaguguaagacaagcaucagacgcggccagccuaaucccguguauaaagaaaccuucgucuuucaaguggcucuguuccagcucuccgacguuacgcugauucugucuguguacaacaagcggagcaugaaaagaaaggagaugaucggguggauuucccuuggccucaauagcucuggagaagaggagcugaaccauuggacagaaaugaaagaguccaagggccagcaggucugccgcuggcacgcgcugcucgaaagcuga

SEQ ID NO: 76532 - RNA, 1260 nt, Artificial Sequence
  derived and/or modified sequence opt5 from SYT1__Homo_sapiens__NP_001278830
auggugagcgagucccaccaugaagcccuggcugcgcccccugucaccacaguugccacggugcucccgucuaacgcuaccgagcccgccagcccuggcgaagggaaggaggacgccuucuccaaacugaaggaaaaauuuaugaaugagcuucacaagaucccccugccucccugggcucucauugccaucgcuauuguggccguccugcuugugcugacaugcuguuucugcaucuguaaaaagugccucuuuaagaaaaagaacaaaaagaaaggaaaggagaagggcgggaaaaaugcgauuaacaugaaggauguuaaagaccugggaaagaccaugaaagaucaggacgaugacgccgaaacaggccugaccgauggggaggaaaaggaggagccuaaagaagaggaaaagcucggaaagcugcaauacucucuugacuaugauuuccagaauaaccagcugcucgugggcaucauccaggcugccgagcugccggcucuugacaugggcgggacaagcgaucccuacgucaaaguguuucugcucccugacaagaaaaagaaauucgaaaccaagguucauagaaagacgcugaaucccguguuuaacgagcaauucaccuuuaaagucccuuauuccgagcugggaggcaagacacucgugauggccguguacgauuucgaccgguuuucuaaacacgacauuaucggggaguucaagguccccaugaauaccguugauuuuggacaugugacagaggaauggcgcgaccugcagagcgcggagaaagaagaacaggagaaacuuggcgauauuuguuucucccugagauaugugccgaccgccgggaagcucacggucgugauccuggaagcuaagaaccuuaagaaaauggacguuggaggccugagcgauccuuacgugaagauucaccucaugcagaauggcaaacggcugaagaagaaaaagacaaccaucaaaaagaacacacugaaucccuauuacaacgagucuuucuccuuugaagucccuuucgagcaaauucagaaagugcagguuguggucaccgugcucgacuacgauaagaucgggaaaaaugacgccaucggaaaggucuuugugggcuauaacagcaccggggcugaacugcgccacuggucugauaugcuugccaaccccagacggcccauugcccaguggcauacacugcaaguugaggaggaaguggacgcuaugcucgcggucaagaaauga

SEQ ID NO: 76533 - RNA, 1278 nt, Artificial Sequence
  derived and/or modified sequence opt5 from SYT4__Homo_sapiens__NP_065834
auggcccccaucaccacaagcagagaggaguucgacgaaauuccuacgguggucggcaucuuuuccgcuuucgggcugguuuuuaccgugucucucuucgccuggauuugcugucagcggaaguccuccaaaucuaacaagacaccgcccuacaaauuugugcacguccugaagggaguggauaucuauccugaaaaucuuaacagcaaaaagaaguucggcgcggacgauaaaaaugagguuaagaacaaacccgcugugccuaagaauagccugcaucucgaccuggaaaaacgcgaucuuaacgggaauuuucccaagaccaaccugaagccuggaucuccgagcgaccucgagaaugccacacccaaacuguuccuggagggcgaaaaggaguccgucagcccugaaucucucaaauccagcaccucucugacauccgaggagaagcaagaaaaacuugggacccuguuuuucagccucgaguacaacuuugaaagaaaggccuucgugguuaauauuaaagaggcucggggacugcccgccauggaugaacagucuaugacguccgacccuuauaucaagaugaccauccuucccgagaagaaacacaaggugaaaacacgcguccugagaaagacccucgauccggcuuuugacgagacauucaccuucuacggcauuccuuauacgcagauccaggaacuggcccugcauuuuacaauucucagcuucgaucgguuuucccgcgacgauaucauuggcgaggugcugaucccccuuucugggauugaacugagcgagggaaaaaugcucaugaacagagaaaucaucaagcggaaugugcgcaaguccagcggcagaggggagcugcuuauuucucugugcuaccaauccaccacaaacacccucaccgucguugugcugaaagcgcggcaucugccuaagagcgacgugucuggacucagcgaccccuaugucaaagugaaucuguaccacgccaagaaacgcaucuccaagaagaaaacacacguuaagaaauguacgcccaacgcuguguucaacgagcuuuuugucuucgauauuccuugcgaaggccuggaggacaucucuguggaauuucucguucuggauagcgagagagggucccggaaugaagugauuggacagcuuguccugggcgccgcugccgagggcaccgggggagagcacuggaaggaaaucugugacuacccgcgcagacagaucgcgaaauggcaugugcucugcgauggcuga

SEQ ID NO: 76534 - RNA, 900 nt, Artificial Sequence
  derived and/or modified sequence opt5 from SYT6__Homo_sapiens__XP_011539054
augcccuggagaaacaaggaggccagcuccccuucuagcgcuaauccgccccuggaagcccuccaguccccuucuuuccggggcaacauggcggacaaacugaaggaucccagcacccuuggguuucuggaggcugccgugaaaaucucccacacaucuccugacauucccgccgaaguccaaaugagcguuaaggagcauaucaugcgccacacgagacuccagcggcagaccacagaaccugcuuccagcacccgccauacaucuuucaaaagacaccuuccgcggcagaugcauguguccagcguggauuacggaaaugagcuucccccugccgcugagcaacccaccucuauuggccgcaucaagccugaacuguauaagcagaaauccgucgacggggaggaugccaagagcgaagcgacaaaaucuugcggaaagauuaacuuuucccucagauacgacuaugagaccgagacgcugaucgugcggauccugaaagccuucgaucuccccgcuaaggacuuuuguggcagcuccgauccguacguuaagauuuaucugcuuccugaccgcaaaugcaagcugcagaccagagugcaccggaaaacacucaaucccaccuucgaugaaaacuuucacuucccuguccccuacgaggaacuggccgaccgcaagcugcaucugucuguguuugauuucgacagauuuagccggcacgacaugaucggggagguuauucucgauaaucuguucgaggcuuccgaccugagccgcgaaacaucuaucuggaaagauauucaguaugccaccucccucgacuggggacuguguagcacgcuucugcccggcgauccuucucaacagagacuccaucuggacacaggcccgcacagcuga

SEQ ID NO: 76535 - RNA, 1476 nt, Artificial Sequence
  derived and/or modified sequence opt5 from SYT9__Homo_sapiens__NP_783860
augcccggcgccagagacgcucugugccaccaggcccuccaacugcuugcggagcugugugcucgcggggcccucgaacaugauagcugccaggacuucaucuaccaccuucgggauagagcccggccucgccuuagagacccggauauuuccgugucucugcucacccuggucguuacagcuuguggacuggcccucuuuggcgugagccuguucguguccuggaagcugugcuggguccccuggcgggagcgcgggcugccuucuggaagcaaagacaacaaucaggaaccccucaacuauauggauacggagaccaaugaacaggagaacuccgaggacuuucuggauccucccacaccuuguccggacucuagcaugaagaucucccauaccagccccgauauuccucuuucuacacaaaccggcauccaggaaaauugcgcucacggggugagaguucagcgccaggugacagagcccaccuccagcgcccggcauaacucuauuagacggcaacugaaucucuccaacccugacuucaauauccagcagcugcagaaacaagaacagcugacgggaaucggccgcauuaagcccgagcucuacaaacagagaagccuggauaacgacgacggccggcgcucuaauuccaaggcgugugggaaacuuaacuuuauccugaaguaugauugcgaccucgagcaacugauugucaagauccacaaagccgugaaucuuccggcuaaggauuucagcggaaccuccgacccuuacguuaaaauuuaucugcuccccgauagaaagacaaagcaccagaccaaagugcaucggaagacacugaacccugucuuugacgaaguguuccuguuucccgugcccuacaaugaucucgaggccagaaaacugcacuucucugucuaugacuuugaucgcuucagccggcaugaccuuaucggccagguugugguggaucacuuucuggaccucgcugacuucccuagagaauguauucuguggaaggauaucgaguacgucaccaacgacaacguggaucuuggggaacugauguucucccucugcuaccugccgacggccggacgccugacaaucaccauuaucaaagcgcggaaucucaaggccauggacauuacaggcgcuagcgaucccuauguuaaagugucucugaugugugacgggagacgccuuaagaagcggaaaaccuccaccaagagaaacacacugaauccugucuacaacgaggccaucguguuugauguucccccugagaauauugaccagauccaccucagcaucgcugugauggauuaugaccgcgucggacauaacgaaauuaucggcgugugccaagucggcaaugaggccgaacggcuggggagagaucacuggucugagaugcugagcuacccccgcaaaccgauugcccauuggcacucccuuguggaaaagcgguga

SEQ ID NO: 76536 - RNA, 954 nt, Artificial Sequence
  derived and/or modified sequence opt5 from SYTL1__Homo_sapiens__XP_011540618
augagaccccugcggcgcggcagcgggagacuccggcugcagauccuucgcagacggccucgcccgagaaagauucuggccaaagagaccaaccgguccgugccccgcagacucacacggucuuggagcccucgcagaggagaaucccggucucgcggccccagcaagccuuccuacgucaaaucuuaucugcuucccgacaagcaaagcaaaagaaagacggcuguuaagaaacggaaucugaacccuguguucaaugagacccucagauacuccgugccgcaggccgaacugcaggggcgcguccugagccucucuguguggcaccgggagucccugggaagaaacaucuuucuuggcgaaguugaggugccccuggauacaugggacugggggagcgagccuaccuggcucccccugcagccucgcgugcccccgucuccugaugaccuucccucccggggacugcucgcgcugagccugaaguaugucccugcuggcucugaaggcgccgggcucccucccuccggagagcugcauuucuggguuaaagaagccagagaucuucugccccuccgcgcuggcagccuggacacauacgugcaaugcuuuguccuuccggaugacucccaggccucucggcagagaacccgcguggugcggagaagccugucccccgucuucaaucacacaaugguuuaugauggguuuggaccugcugaccuccgccaggccugugcggagcugagccugugggaucauggcgcccucgcuaaccggcaacuugggggaaccagacugucucugggcacgggcuccagcuacgggcuccaggugcccuggauggacucuaccccugaggaaaagcagcuguggcaggcccuucuggagcaacccugcgaauggguggauggacuccugccgcugcggacaaaucucgcuccucgcaccuga

SEQ ID NO: 76537 - RNA, 2805 nt, Artificial Sequence
  derived and/or modified sequence opt5 from SYTL2__Homo_sapiens__NP_001156423
augaucgaccugagcuuccucaccgaggaagaacaggaagccauuaugaaggugcugcaaagagaugcugcccuuaaacgggcggaggaagaacgcgugagacaucugcccgagaagaucaaagacgaucagcagcucaagaacauguccggccagugguuuuacgaagcuaaagccaagcggcaccgcgacaagauucacggggccgauaucauuagagcuucuaugcggaaaaagcgcccucaaaucgccgcugagcagagcaaagacagagaaaauggagccaaggaguccuggguuaacaaugugaacaaagaugcguuccugccgcccgagcuugccggcguggucgaggagccugaagaggacgcugcccccgcuucuccuagcuccucugugguuaaucccgccagcuccgugaucgauaugagccaggaaaacacacggaagccuaaugucucuccggagaagcgcaaaaaccccuuuaauuccagcaagcugccugaggggcauucuucccagcaaacgaaaaacgaacagagcaagaauggaagaaccggccucuuccagacaucuaaagaggacgaacuguccgagagcaaggaaaaauccaccguggcggauacaucuauucagaagcuggaaaagagcaaacaaacccuccccgggcuguccaacggaagccagaucaaggccccuauucccaaagcucggaagaugaucuauaaaucuacagaccuuaauaaggaugacaaccaguccuuuccgcgccaaagaaccgacagccugaaggcccggggcgcuccucgcggcauucucaaaagaaauucuagcuccucuagcacggauuccgagacccugcgguacaaccacaacuucgaacccaagagcaaaaucguuucuccugggcuuacaauucaugagagaaucuccgaaaaggagcacagccuggaagacaauucuucccccaacagccucgagccccugaaacacgugcgcuuuuccgccgucaaggaugagcugccucagucuccgggacucauccauggccgggaagugggggaguucagcgugcuggaauccgacagacuuaagaauggaauggaggaugccggcgacaccgaggaauuucagucugaucccaaaccuagccaguaucgcaagcccucccuguuccaccaaagcacaucuuccccuuacgucagcaaaucugagacccaucagcccaugacguccgggagcuuuccgauuaacggacuccacucucacagcgaaguucugacagcucggccucaguccauggagaauagccccaccaucaacgaaccuaaggacaaaucuuccgagcuuacaagacuggagagcgugcucccccgcuccccugcggaugaacugucucauugcguggagcccgaaccgagccaggucccuggcggcuccucucgggacagacaacaggggagcgaggaggagcccucccccgugcugaagacccucgagcgcucugccgcucggaagaugccuagcaaaucccuggaagauauuagcucugacuccagcaaucaggccaagguugacaaccagccggaggaacuugugagaucugccgaggaugucuccaccgugcccacacaaccugacaaucccuucagccacccugauaaacugaagcgcaugucuaaauccguucccgcuuuucuccaggacgaaagcgaugaccgggagacggauaccgccuccgagagcucuuaucagcugagcagacauaagaaauccccuucuagccuuacaaaccuguccucuagcuccggaaugaccucucucagcuccgugagcggcucugucauguccguguacagcggggacuucggaaaucuggaagucaagggcaacauccaguucgcgauugaguauguggaaucucugaaggagcuccacguuuuuguggcucaauguaaagaucuggccgccgcugacgucaagaaacagcgguccgaucccuacgugaaggccuaccuucugccggacaaagggaagaugggaaagaaaaagacacucguugugaaaaagacccugaauccugucuauaacgagauccugcgcuacaaaaucgaaaagcagauucuuaagacgcaaaaacucaaucugagcaucuggcauagagauacauucaagcggaacuccuuucugggcgagguggaacucgaccuggagaccugggacugggauaacaaacagaauaagcagcuuagaugguauccccugaaacgcaagaccgcuccuguggcccucgaagcggagaaccggggcgagaugaagcuggcccugcaguacguucccgaaccggucccugggaaaaagcuccccacaaccggagaggugcacauuugggugaaagaaugccuugaccugccucugcucagaggcucucaccugaauagcuucgucaaguguacaauccuucccgauacgucccgcaaaagcagacaaaagacccgggcuguggggaaaacaaccaaccccauuuuuaaucauacaaugguuuaugacggauuccgcccugaggaucugauggaagccugcguggagcucaccgucugggaccacuacaagcugacgaaccaguuucugggcgggcuuagaaucggcuucggaaccggcaagucuuaugggacagagguggauuggauggacuccaccagcgaagagguugcucucugggagaaaauggucaauucuccgaacacauggaucgaggccacccugccccugcggaugcuccugauugcgaagaucagcaaauga

SEQ ID NO: 76538 - RNA, 2259 nt, Artificial Sequence
  derived and/or modified sequence opt5 from SYTL5__Homo_sapiens__NP_001156806
augagcaagaacuccgaguucaucaaucugucuuuucuccuggaccacgaaaaagagaugauucuuggcgugcugaagagagaugaauaccucaaaaaggucgaggacaaacggauccgcaagcugaagaacgaacuucuggaggccaaaagacggagcgggaagacccagcaagaggcuucccgcguuugcgugcauugucacagaaaucucggacugauuuucgaucggggcgaccccugccaggccuguucucugcgcgugugcagagaaugucgggucgcggggccuaacggaagcuggaaaugcacagugugugauaagaucgcucagcuccgcauuaucacgggcgagugguuuuucgaagagaaagccaagagauuuaagcagguuaaugugcuggggaccgacgucgugcggcaauccauccuucgcagaucuccgggagccgaggaaguucagagccaggagcagacacggcaagaugcugaaaaauccgacaccagccccguggccggcaagaaggcuucucaugauggcccuaaacgcaaaggguuccugcucuccaaguuuagaagcgccacacggggagagauuaucacccccaaaacagacaccggcagaucuuauucccuggaucuugacgggcagcacuuccgcagccugaagucuccucccggauccgaucggggcagcacgggguccucugaccucaacgaccaggaaccuggaccgagaacccccaagagcucccgcagcaauggcgucacaccuggcacccagucuucccccgcgccuagcacacggaccgugacgucugugauuagcagagaguacggguuugagaacuccauggaucuggccgcuaucgaaggaacaucucaagagcugaccaaaagccaucgccggaauacauccggcacccccagcauugccgucucugggaccucccucagcucugaccaguccagaagcgaacuggaucuuuccgagucuuucacagaagacagcgaggauacgguuuccauccgcucuaagagcgugccgggagcucuggacaaagauucccucgaggaaaccgaggaaagcauugacgcccuggugucuucccagcuuagcacaaacacccaccggcuggcgucuggccucuccacaagcucucaagccgggagcgauagaaaguggaccuaucugaaugucccugacgcugauuccgacacgacaagccugaacucuaugauguccguguacagcgagaccggagacuauggcaauguuaaaguguccggcgaaauccuccugcacaucucuuacugcuauaagaccgggggacuuuacauuuuugucaagaacugucgcaaucuggccaucggcgaugagaaaaagcagcggacagacgcuuacgugaaaagcuaucuccugcccgauaaguccagaaacaacaaacggaagaccaagauucgcacagggacgaauccugaguucaacgaaacccuuaaauacacaaucucucauacccagcuggagacaagaacccuccagcugagcguuuggcacuaugaccgguuuggaagaaauuccuuccugggcgaaguggagauucccuucgauucuuggaacuuugagaaucccacggacgaaugguucguccuccaaccuaagguggaguuugccccggauaucgggcugcaguacaaaggcgaacuuaccgucgugcugcgcuauauucccccugaggaaaaccucaugcugcccccugagcagcugcagggaaauaagacauucaaaaagggcaagaaaaaggagagccccguuaucuccgggggaauccuugaaguguuuauuaaagaggccaagaaccucaccgcugucaaaagcggcgggacaucugacuccuucgugaagggauaccugcugccggaugacagcaaagcgaccaagcauaagacgcucguuaucaaaaagucugugaauccucaauggaaccacacauuuauguucuccggcauucacccccaggauaucaaaaaugucugccuggaacuuaccaucugggacaaggaggccuuuagcucuaacauuuuccugggcggggugcggcucaauuccggaagcggcgugucccaugggaaaaacguugauuggauggacagccagggagaggaacagagacuguggcaaaagauggcuaauaacccuggcacacccuuugaggggguccugaugcuucgcucuagcaugggaaaguguagacucuga

SEQ ID NO: 76539 - RNA, 1851 nt, Artificial Sequence
  derived and/or modified sequence opt5 from SYVN1__Homo_sapiens__NP_115807
auguucagaaccgccgugaugauggcugccagccuggcgcucacaggcgcugucguugcccacgccuacuaucugaagcaucaguuuuaccccacggugguguaucuuaccaaauccucuccuagcauggcuguccuguacauccaagccuucgugcucguuuuucugcuugggaaggugaugggaaaagucuucuuuggccagcugcgggcugccgagauggaacaccuccuggagcgcuccugguaugcggugacagaaaccugccuggccuucacaguuuuuagagacgauuucucuccgcgguuuguggcucucuucacccugcuucuguuucucaaguguuuccauuggcuggccgaggaccgcgucgauuuuauggaaagaagccccaacauuuccuggcuuuuccacugccggaucgugucucugauguuccuccuggggauucuggacuuucucuucgugagccaugcuuaccacuccauccugacacgcggagccagcguccagcuuguuuuuggcuucgaguaugcgauucugaugaccauggugcucacgaucuuuaucaaauacgugcugcacucugucgaucuucaguccgagaauccuugggacaacaaggccguguacaugcuguauaccgaacucuucacaggguuuauuaagguucugcuguacauggcuuucaugaccaucaugauuaaagugcauacauuuccccucuucgccaucagaccuauguaucuggcuaugcggcaauuuaagaaagccgucaccgaugccauuaugagccgcagagcuauccggaauaugaacacgcuuuaccccgacgcgacaccugaggaacugcaggccauggauaauguguguauuaucugccgcgaggagaugguuaccggagcuaagagacucccguguaaccacaucuuccauacaucuugccugcgguccugguuucagcgccagcaaaccuguccuaccugcagaauggacgugcuucgggccagccugcccgcccagucucccccucccccggaaccugcugaucaggggcccccucccgcgccccacccuccgccccuccugccucagcccccuaauuucccccaaggccugcucccgccuuuucccccuggcauguucccccuguggccucccaugggaccguucccucccgugcccccuccgcccuccagcggcgaggccgucgcuccucccuccacaucugccgcccuuagcagaccuuccggggcugccacgaccacagcugccggaaccagcgcgacagccgcuucugccaccgcuuccggccccgggagcggaucugccccugaagcgggccccgccccgggcuuuccuuuucccccucccuggauggggaugccgcugccucccccuuucgcuuucccucccaugcccgucccgcccgccggauuugcuggccucacgccugaggaacugcgcgcccuggaggggcacgagcggcagcaucuugaagccagacuccagagccugcgcaacauucacacacugcucgacgcugcgaugcugcaaaucaaucaguaucuuaccgugcuggccucccucggacccccucggcccgcuaccucuguuaacagcacagaggaaaccgccacaacgguggucgccgcugccuccagcaccucuauuccuuccagcgaggcgacaaccccgacacccggcgcuucuccucccgccccugaaauggagagacccccggccccugaguccguggggaccgaagagaugcccgaagauggagagcccgacgcugccgaacugcgccggagacgccugcagaaacuugagagcccuguugcgcauuga

SEQ ID NO: 76540 - RNA, 1020 nt, Artificial Sequence
  derived and/or modified sequence opt5 from TAAR1__Homo_sapiens__NP_612200
augaugcccuucugccacaacaucauuaauaucagcugugugaagaacaauugguccaacgacgucagagccucucuguacagccucaugguucugauuauccuuaccacacuggugggcaaucucauugugaucgucuccaucucucauuuuaaacagcugcacacgccuaccaacuggcuuauucauagcauggcuacaguggauuuccugcucgggugccugguuaugccguauuccauggugcggucugccgagcacuguugguacuuuggagaagucuucugcaagauccauaccagcacagacauuaugcuguccagcgcgucuaucuuucaccucuccuucauuagcaucgaucgcuauuacgcugugugugacccccugagauauaaagccaagaugaauauucuuguuaucugcgugaugaucuuuauuucuugguccgucccugccguguucgcuuuuggcaugaucuuccuggagcucaacuuuaaaggggccgaagagauuuacuauaagcacgugcauugucggggaggcugcagcgucuucuuuucuaagaucuccgggguucugaccuucaugaccagcuucuacauucccggauccaucaugcuuuguguguacuaucgcaucuaccugauugcuaaagaacaagccagacucaucucugaugcgaaucagaagcugcagauuggccuggagaugaaaaacggcaucagccaguccaaggagcggaaagccgugaagacacucgggauugucaugggaguguuucugaucugcugguguccuuucuuuaucugcacgguuauggaccccuuccuucacuauauuaucccuccgacccugaaugaugugcucauuugguuuggcuaccugaacagcacauucaaucccauggucuaugcuuucuucuacccuugguuucgcaaggcccuuaaaaugaugcuguucgggaagaucuuucaaaaagacucuuccagaugcaagcucuuucuggaacugagcucuuga

SEQ ID NO: 76541 - RNA, 1056 nt, Artificial Sequence
  derived and/or modified sequence opt5 from TAAR2__Homo_sapiens__NP_001028252
auggccgugagcuccgagcagcacgaacugucucauuucaagagaacccaaacgaaaaaggagaaauuuaacugcagcgaauacggcaaucgguccugucccgagaacgaacgcucucucggggucagaguugcuauguauagcuucauggccggauccaucuuuauuacaaucuucggcaaucuggcgaugauuaucucuauuagcuacuuuaagcagcuucacaccccuacaaacuuccugauccucuccauggcuaucaccgacuuucugcuuggguucacaauuaugccguauagcaugauccggucuguggagaauugcugguacuuuggacugaccuucuguaaaauuuauuacuccuuugaucucaugcugagcaucacaucuauuuuccaucugugcuccguggccaucgaccgcuuuuaugccauuuguuacccccuccuguacagcaccaagaucacgaucccugucauuaagagacuucugcuccugugcuggucugugcccggcgcuuucgccuucgggguuguguuuuccgaggcuuaugccgauggaaucgaaggcuacgacauucuugucgcguguagcuccucuugcccugugauguucaacaaacuguggggcaccacacucuuuauggccggguucuuuacccccggaagcaugaugguuggcaucuaugggaagauuuucgcugugucccggaaacacgcccaugcuaucaauaaccugcgcgagaaucagaacaaucaggucaagaaagauaagaaggccgcgaaaacacugggaaucgugauuggcguguuucuccuguguugguucccuugcuuuuucaccauccuucuggacccguuucucaacuucagcacgcccgucguucuguuugaugcccuuacaugguucggguacuucaauucuaccuguaacccucugauuuauggauuuuucuaccccugguuuagacgggcucucaaguauauccugcugggcaaaauuuucuccagcugcuuucacaauacaauccucugcaugcaaaaggaaucugaguga

SEQ ID NO: 76542 - RNA, 1014 nt, Artificial Sequence
  derived and/or modified sequence opt5 from TAAR5__Homo_sapiens__NP_003958
augagagccguguucauccagggcgcugaggaacaccccgccgcguuuugcuaccaagucaacggguccuguccucggaccguucauacacugggcauucagcucgugaucuaucuggcuugcgccgccggaaugcuuauuaucgugcuggggaaugucuucguggcuuuugccguuuccuacuucaaggcucuccacacgccgaccaacuuucugcuucugucucucgcccuggcggacauguuccugggacuccuggugcuuccccugagcacaauucgcuccgucgagucuuguugguuuuucggcgauuuucucugcagacugcauaccuaucuugacacacuguucugucucaccagcaucuuucaccugugcuucaucuccauugaucggcauugugccaucugcgacccucugcucuaccccucuaaauuuacagugcgcguugcucugagauauauucuugccggguggggagugccugcugccuacaccagccuguuccucuauacggaugucguggaaacccggcugucccaguggcuugaggaaaugcccugugugggcagcugccagcugcuccugaauaaguucuggggcuggcugaacuuuccucucuucuuugucccgugucugaucaugauuucucuuuacguuaaaaucuucgugguggcgacacgccaagcccagcagauuaccacacuguccaagagccucgcuggggccgcuaaacacgagagaaaggccgccaagacccugggaaucgcugucggcaucuaccuucugugcuggcuccccuuuacgauugacacaaugguggauucucugcugcacuucaucaccccuccccucguuuuugacauuuucaucugguuugcguauuucaauuccgccugcaacccuauuaucuacguguuuagcuaucagugguuccggaaagcucugaaacuuacacugucucaaaaggucuuuagcccccagacccgcaccguggaucucuaccaggaguga

SEQ ID NO: 76543 - RNA, 1038 nt, Artificial Sequence
  derived and/or modified sequence opt5 from TAAR6__Homo_sapiens__NP_778237
augagcuccaacucuagccugcucguggccguccagcugugcuacgcuaauguuaacggcuccugugugaagauccccuucucuccugggagcagagugauucuuuauaucgucuuuggauucggcgccgugcuggcgguuuuugggaaucuccuggugaugauuuccauccuucacuucaaacaacugcauucuccgaccaacuuucucgucgcuagccuggccugcgccgacuuccuggugggaguuacagugaugcccuuuuccaugguccggacgguggagagcuguugguacuucggccgcucuuuuugcaccuuccacacauguugcgauguggcuuuuuguuauuccagccucuuccaucugugcuuuauuucuaucgacagauacaucgccgucaccgauccucuuguuuaucccacaaaguucaccguguccgugagcgggauuuguaucucugucuccuggauucugccucucauguacagcggagcuguguucuauacaggcguuuacgacgauggccuggaggaacuuuccgacgcccugaauugcaucgggggaugucagaccguggucaaccagaauugggugcucacggauuuucugucuuucuuuauucccaccuucaucaugauuauccuguacggcaacaucuuucucguugcgcggcgccaggccaaaaagauugaaaauacagggagcaaaaccgaguccagcucugaauccuauaaggcuagaguggcccggcgcgagagaaaggcugccaaaacacugggagucaccguggucgcguucaugaucagcuggcuuccuuacucuauugacagccugaucgaugccuuuaugggcuucauuacgccggcuugcaucuaugagaucugcuguuggugcgccuacuauaacuccgcuaugaauccccucauuuacgcccuguuuuauccuugguuccggaaggccaucaaagugauuguuacagggcaagugcuuaagaacucuagcgcuaccaugaaucuguuuuccgaacacaucuga

SEQ ID NO: 76544 - RNA, 1515 nt, Artificial Sequence
  derived and/or modified sequence opt5 from TAB1__Homo_sapiens__NP_006107
auggccgcucagagacggagccugcuccaauccgagcagcagcccucuuggaccgacgaucugccucuuugccaccugagcggcgugggguccgccucuaaccgcagcuacuccgcggacggaaagggcacagaaucucauccgcccgaggauagcuggcucaaauucagauccgaaaauaacuguuuucuguauggggucuucaauggauacgacggcaaccggguuacgaauuuuguggcucagcgccuuagcgccgagcugcuccuggggcaacugaacgccgaacacgcugaggccgaugugagacggguccuccugcaggcuuucgacgugguugagcgcucuuuucuugaauccaucgaugacgcccuggcggagaaggccagccuccagucucagcugccugaaggagugccccaacaucagcuuccuccccaguaucagaaaauucuggagagacucaagacccuggagcgggaaaucuccggcggcgcuauggccgucguggcuguucugcucaauaacaaacuguacguggccaaugucgggacaaaccgcgcgcuucugugcaagagcaccguggauggacuccaagugacacagcugaaugucgaccacaccacagagaacgaagaugagcuuuucagacugucucagcucggccuggacgccgggaagauuaaacaaguuggaaucauuuguggccaggaauccacccggcgcaucggggauuauaaggugaaauacggauauacggacaucgaccugcucagcgcugccaaguccaaaccuauuaucgcugagccggagauucauggcgcccagccccuggauggcgugaccggguuucuuguccugaugucugaaggacucuacaaggcccuggaggcugcgcacggcccugggcaggccaaucaagaaaucgcugccaugauugacacagaguucgccaagcagaccagccuugaugcuguggcccaggcgguuguggacagagucaaacggauccacuccgauacauuugcuagcggaggcgaacgcgccagauucugcccccggcaugaggacaugacccugcucgugagaaacuuuggguacccucugggagagaugucucagcccacgccguccccugcccccgcugccggcggccgcguuuauccugugagcguccccuacucuagcgcucaauccacaucuaagaccagcgugacacugucccucgucaugcccagccaggggcagauggugaauggagcccacucugcguccacccuggaugaagccaccccuacacuuacgaaccagagcccgacccugacacuccaaucuaccaacacacauacccaguccagcuccucuagcuccgacggcgggcuguuccggucuagacccgcucacagccugccucccggagaggauggccgcguugaaccuuauguggacuuugccgaguucuaccggcuuugguccgucgaucacggggaacagagcgugguuacggcucccuga

SEQ ID NO: 76545 - RNA, 1986 nt, Artificial Sequence
  derived and/or modified sequence opt5 from TAB2__Homo_sapiens__NP_001278964
augcagaacaauaacaaucuggacgccugcugugcugugcucagccaagaguccaccagauaccuguauggcgaaggggaucuuaacuucucugacgauagcggaaucuccggccugcggaaucacaugacaucucucaaccuggaccuucagagccagaauauuuaccaucacgggcgcgagggauccagaaugaacggcucucggacgcugacccauagcaucuccgaugggcagcuccaaggaggccagagcaauucugaacuguuucagcaggagccccaaacagccccugcgcaggucccgcagggcuucaacguuuuugggauguccucuagcuccggagcuagcaauucugcuccccaccugggcuuccaucucggguccaagggaaccagcucccugucucagcaaacaccucgcuuuaaccccauuauggugacccuugccccuaauauccagacaggcagaaacacccccacgagccugcacauucacggggugccuccgcccguccucaauuccccucagggaaacagcaucuauauccggcccuacauuaccacaccuggcggcaccacacgccaaacccagcagcauucugggugggugucccaguucaaccccaugaauccgcaacagguuuaucagccuagccagcccggaccuuggacgacaugccccgcuucuaacccccugagccacaccuccucucaacagccuaaucagcagggccaucaaacaagccacguguacaugccgaucuccagccccaccaccucucagccucccacaauucacuccagcgggucuucccagagcuccgcccauucucaguauaacauccaaaauauuagcacgggaccuagaaagaaccagaucgaaauuaaacuugagcccccgcagcggaauaacuccucuaaacugcgcagcuccggcccuagaaccagcucuacauccagcucugucaauucccaaacccucaaccggaaucagcccacaguguacaucgcugccagcccucccaacaccgacgagcugaugucucgcagccagccuaagguuuacaucuccgcgaaugccgcuacgggggaugaacaggugaugagaaaccaacccacacuguuuauuagcaccaauucuggagccuccgcugccagccggaacauguccggccaggucucuaugggcccggcguucauccaccaucacccucccaaaagccgcgccauugggaacaauuccgcuaccucucccagagugguggucacacagccuaacaccaaguauacauuuaagaucacgguuagcccgaauaaacccccugccgugucccccggaguggucucuccuaccuucgagcucacaaaccugcuuaaucaucccgaccacuacguggaaaccgagaacauucagcaccugacagauccuacccucgcucauguugaccggaucagcgagacgagaaagcuguccaugggcagcgaugacgccgccuauacccaagcccuucuggugcaccagaaagcgcgcauggaacggcuccagagagagcuggaaauccagaagaaaaagcuggauaagcucaaaucugaggucaaugaaauggagaacaaucugacacgccggagacuuaagcgcuccaacagcauuucucaaauccccucccuggaggaaaugcagcagcuccggagcuguaauagacaacugcagauugacaucgacugccuuaccaaagagauugaucuguuucaggcccgcgggccgcauuucaacccuucugcuauccacaauuuuuacgacaacaucggauucgugggccccguuccucccaagccgaaagaucagcgguccauuaucaagacaccuaaaacccaagacacggaagaugacgagggggcccaguggaauuguacagccugcaccuuccucaaccaccccgcucugauuagaugugaacagugcgagaugccucgccauuuuuga

SEQ ID NO: 76546 - RNA, 2139 nt, Artificial Sequence
  derived and/or modified sequence opt5 from TAB3__Homo_sapiens__XP_005274539
auggcccagagcagcccccaacuggacauccaggugcuccacgaucugagacagcgguucccugagauuccggaaggcgucguuucucagugcaugcuucaaaacaauaacaaucuggaggcuuguugccgcgcccucagccaggaauccucuaaguaccuguauauggaguaccauagccccgacgauaacagaaugaaucggaaccgccuucugcacaucaaucucgggauucauuccccuucuagcuaucaccccggagacggcgcgcagcugaacgggggaagaacccuggugcauuccagcucugauggccacaucgacccucagcacgcugccgggaaacaacucauuugucuggugcaggaaccccauuccgccccugcugucguggccgcuacaccgaauuacaaccccuuuuucaugaaugagcagaaccggagcgccgcgacgccucccucucagccuccccaacagccguccagcaugcagaccggaaugaauccuucugccaugcaaggccccuccccucccccucccccgcccagcuauaugcacaucccucgcuacuccacaaaccccaucaccguuacagugucucagaaucuuccuagcggccagaccguccccagagcucugcagauucucccgcaaaucccuuccaaccuguaugggagccccggaucuauuuacauccggcagacaucccagagcucuagcggccgccagaccccucaauccacgcccuggcagucuagcccucaggggcccgugccgcauuacucccagagaccucuucccguuuauccccaccaacagaacuaccagccuagccaguauucuccgaagcaacagcagauuccccaauccgccuaccacagcccucccccuucucagugccccuccccuuuuagcagcccccagcaucaggugcaaccgucucagcugggacacaucuucaugccucccagcccuuccaccacacccccgcauccuuaucagcagggacccccuucuuaccaaaaacaggggagccacuccgucgcuuaucuccccuacaccgccagcucucuguccaagggaagcaugaaaaagauugagaucacaguggaacccucucagcggccuggcaccgcgaucaaucgcuccccgagccccauuucuaaccagccuagccccagaaaucaacauucccuguacacggccacaaccccucccuccucuuccccuagccggggcaucuccucucagccgaagcccccuuuuagcgugaaccccgucuauauuacauacacccagccuaccgggcccuccuguacaccgucuccuagcccccgcguuauccccaauccuacgaccguguucaaaauuacagugggcagagcuaccacagagaaccuccugaaucuugucgaucaagaggaacgguccgccgcucccgagccuauccagccgaucucugugauucccggcagcgggggagaaaagggcucccacaaauaucagagauccucuuccagcgggucugacgauuacgccuauacccaggcccugcuccugcaccaacgcgcucggauggagagacuugcgaagcagcugaaacucgaaaaggaggaacuggagcgccugaaguccgagguuaacggaauggaacaugaccucaugcagcggagacugcgccgggugagcugcacgacagccaucccuacccccgaggaaaugaccagacuucgcucuaugaaucggcagcugcaaauuaacgucgauuguacacucaaagagguggaccugcuucaguccagaggcaauuuugauccuaaggcuaugaacaauuucuacgacaacaucgaacccggcccgguugugccucccaaaccuagcaagaaagacuccagcgaucccugcaccauugagcgcaaggcccggagaaucucugucacaagcaaagugcaggccgacauccacgauacgcaggcugccgcggcugacgagcaucggaccggguccacacaaucuccucgcacccagcccagagaugaagacuaugagggagccccguggaauugugauagcugcacauuucugaaccacccugcccucaaccggugugaacagugcgagaugcccagauacaccuga

SEQ ID NO: 76547 - RNA, 390 nt, Artificial Sequence
  derived and/or modified sequence opt5 from TAC1__Homo_sapiens__NP_003173
augaagauccugguggcccucgcugucuucuuucugguuagcacccagcuuuucgccgaggaaauuggcgcgaacgacgaucugaauuacugguccgacugguaugauucugaccaaaucaaagaggaacuccccgagccuuuugaacaucugcuucagagaauugcucggcgcccgaagccccagcaguucuuugggcugaugggaaaaagagaugccgacagcuccaucgagaagcaaguggcccuccugaaagcucuguacggccacgggcagauuucucacaagcggcauaagacagauagcuucgugggacucaugggcaaacgcgcccugaacuccgucgcuuaugagagaucugccaugcagaauuacgaacggcgcagauga

SEQ ID NO: 76548 - RNA, 312 nt, Artificial Sequence
  derived and/or modified sequence opt5 from TAC3__Homo_sapiens__NP_001171525
augagaaucaugcuccuguucaccgccauucuggcuuuuagccuugcccaguccuucggcgcggugugcaaggagccccaagaagaggucguuccugggggaggccggucuaaacgcgacccggaucuguaccagcuccugcagagacuuuuuaagagccacuccucucuggaagggcuccugaaagcucugagccaggccuccacagaccccaaggagucuacgagcccugaaaaacauucccccaccgaugugaaccaagagaaugugccuagcuucggaauccucaaguaucccccucgggccgaguga

SEQ ID NO: 76549 - RNA, 291 nt, Artificial Sequence
  derived and/or modified sequence opt5 from TAC4__Homo_sapiens__NP_001070971
augcugcccugccucgcccugcuucugcucauggagcugagcguguguaccgucgcuggcgacgggggagaggaacagacacuuuccacggaagccgagaccugggaaggcgcggggccuucuauccaacugcagcuccaggagguuaagacaggaaaagcuagccaguucuuuggccugauggggaagagagugggagccuaccaacuggagcacaccuuccagggccuccugggcaaacggucccuuuuuacagaagggcgcgaggaugaagcccagggaucugaguga

SEQ ID NO: 76550 - RNA, 1188 nt, Artificial Sequence
  derived and/or modified sequence opt5 from TACC1__Homo_sapiens__NP_001116296
auggccuucagccccuggcagauccuguccccugugcaaugggcuaaguggaccuggucugccgucagaggcggggcggcuggagaggacgaagccggcgggccggagggagaucccgaagaggaagacagccaggccgagacaaaaucccucucuuuucggagcggcugcaagguuaaaaagcacgagacgcagucccuggcucuugaugccuguucucgcgacgaaggggcugugauuagccagaucuccgauauuagcaacagagacggacaugccaccgaugaggaaaaacuggcgucuacauccugcggccaaaagagcgccggcgcugaggugaagggggagccugaagaggaccucgaauacuucgaguguucuaauguccccguguccaccaucaaccacgccuuuagcagcuccgaagcuggaauugagaaagagacaugccagaagauggaagaggauggcagcaccguucuggggcuucuggaauccucugccgagaaagcgccugugagcgucuccuguggaggcgaaagcccccucgacgggaucugccugucugaguccgauaagacagccgugcugacccucauccgggaggaaauuaucacgaaagagauugaagcuaaugaguggaagaagaaauaugaagagacccgccaggagguucuggaaaugagaaagaucguggccgaguacgagaaaacaauugcucagaugaucgaggacgagcaacggaccagcaugacaucucagaagucuuuccagcagcuuaccauggaaaaagagcaagcccuggccgaucucaacuccgucgaacgcucucugagcgaccuuuuuagacgguaugagaaucugaagggagugcucgaaggcuucaaaaagaacgaggaggcucugaagaaaugugcgcaggacuaccuggcccgcgugaagcaggaagaacaaagauaucaggcucucaaaauucaugccgaagagaagcuggauaaagccaaugaagagaucgcucagguccggacgaaggccaaggcggaguccgcugcccuucacgccggccugcgcaaagaacagaugaagguugagagccucgaaagagcucugcaacagaaaaaccaggagaucgaggaacuuacaaagauuugcgacgagcugaucgccaaacucgggaagaccgauuga

SEQ ID NO: 76551 - RNA, 8481 nt, Artificial Sequence
  derived and/or modified sequence opt5 from TACC2__Homo_sapiens__NP_001278805
augggcaacgaaaauagcaccuccgacaaccagagaacccugucugcccaaacgccccggagcgcucagccuccggggaauagccagaacaucaagcgcaaacagcaagauacccccggaucuccugaccacagagaugccagcuccauuggcucuguggggcugggaggcuucugcacagcgagcgaauccagcgcuucucuggaccccugucuugucuccccugagguuaccgaaccccggaaggauccucagggggcccgcggacccgaaggcagccugcuccccucuccucccccuucccaggaaagagagcaucccuccucuagcaugccguuugccgagugcccucccgaaggcugucuggcuagcccugccgcugcccccgaggacgggccccagacacaauccccucggcgcgaaccggcgcccaaugccccuggagauaucgcugccgcuuuccccgccgagagagacucuagcaccccuuaccaggagauugcggccgugcccuccgcuggccgggaacgccagccgaaagaggaagggcaaaagagcucuuuuuccuucagcucuggaaucgaucaaagcccuggcaugucccccgugccucuuagagagcccaugaaagccccucugugcggggaaggagaccagcccggcggcuuugagucucaggagaaggaagcugccgggggauucccgccugccgagagccggcaaggcgucgcuuccgugcagguuacacccgaagcgcccgccgcugcccagcaggggaccgagagcucugccgugcucgaaaaguccccucugaaaccgauggcucccauuccucaagaucccgccccucgcgcgagcgacagagagcggggacagggcgaggcucccccucaguaucugacggaugaccucgaauuucugcgcgccugucaccuucccagaucuaacuccggggccgcuccggaggccgaagucaaugcugccagccaggaguccugccaacagccugugggagcguaccugccccaugccgaacucccuuggggccugcccucuccggcucuuguuccugaggccggcgggagcggaaaggaggcucuggacaccaucgaugugcagggccacccccagacagggaugcggggaaccaaaccuaaccaagucguguguguggccgcgggcgggcagcccgaaggcggacuccccgucuccccugagccgucucugcugacacccaccgaagaggcccauccugcuagcucccucgccagcuuccccgcugcccagaucccuauugccguugaggaacccggaucuuccagcagagagucuguguccaaggcugggaugccugugagcgcggacgccgcuaaagaagucguggaugccggacugguuggccuugagcgccaggugucugaccuggggagcaagggagaacacccggagggcgaucccggggaggucccugcccccuccccucaagaacggggcgagcaccucaauacggaacagagccaugaggugcagcccggaguuccgccuccgccccucccuaaggaacaaucucacgaggugcagcccggcgcuccuccgcccccucuucccaaagccccuuccgagagcgcgagagggcccccgggaccuacagacggcgcuaagguccaugaagauuccaccucucccgccguggccaaagaggggagccgcuccccuggagacucucccggcgggaaggaagaggcuccugaacccccggauggcggagacccuggcaaccugcagggggaggauagccaggccuuuuccucuaaacgggaccccgaggucggaaaggacgaacucagcaaacccuccagcgaugcggagucuagagaccacccuuccagccacucugcucaaccgccccgcaagggcggggccggacauacagauggcccucacucccagaccgccgaagcugacgccagcgggcugccccauaagcugggcgaggaggauccugugcugcccccuguuccggacggagcuggcgaacccaccgugccugagggggccaucugggaaggaucuggccugcagcccaaaugcccugauacacuucagucccgggaggggcugggaagaauggagagcuuccucacgcuggaguccgaaaagagcgacuuucccccgaccccugucgcggaaguggcccccaaagcucaagagggcgaaucuacacuugagauucgcaagaugggcagcugugauggggaaggacugcucaccucccccgaccagccucggggccccgccugcgaugcuucuagacaggaguuccacgccgggguuccucauccgccccagggagagaaucuggccgcugaccugggccucacagcgcugauccuugaucaagaccagcaggggauuccuagcugucccggagaaggcuggauccgcggcgccgcuuccgaguggccucugcucucuagcgaaaaacaucugcagcccucccaggcccagccggagaccucuauuuuugacgugcugaaggaacaggcccaaccucccgagaacgggaaggagacgagcccuucccaccccggauucaaagaucagggcgcugacagcucucagauccacgucccuguggaaccccaggaggauaauaaccuuccgacacacgggggacaagaacaggcccucggcuccgagcugcagagccagcugccuaaggggacccucucugacacccccacauccagccccaccgauauggugugggaguccucucugacagaagagagcgaacuuuccgcgccuacgcggcaaaaacugccggcucucggagagaagagacccgaaggcgccugcggcgacgggcagagcucucggguuuccccucccgccgcugauguccugaaagacuucagccuggccggaaauuuuucucgcaaggagaccugcuguacaggccaggggccuaacaagagccagcaagcgcuugcugaugcccucgaggaaggaucccagcaugaggaagccugccagagacaccccggcgcuucugaggccgcugacggguguagcccucuguggggacuguccaaacgggaaauggccucuggcaacaccggcgaggcgcccccgugccaaccugauagcguggcccuccuggacgcugugcccugucuuccugcccuggcucccgccuccccgggggucacaccuacccaggaugcccccgagacggaggcuugcgacgagacccaggaaggaagacagcaacccgugccugcgccccagcagaagauggagugucgcgccacaagcgacgcugaaucuccuaaacuccuggccuccuucccgagcgccggcgagcaagggggcgaggcuggcgccgcggaaaccgggggauccgcuggcgccggcgaucccgggaagcagcaggccccugagaaacccggagaagcuacacugucuugcggccuucuccagaccgagcacugucugacgagcggggaggaagccuccacaucugcgcugcgggagagcugccaggccgaacauccuauggcuuccugucaagacgcccuccugcccgcuagagagcuuggaggcaucccucgcagcaccauggauuuuucuacacaccaggccguuccggaccccaaggaacugcuccuguccgggccucccgagguggcugccccugauacccccuaucugcaugucgacagcgcggcccagagaggagcugaggauucuggcgugaaggccguuuccagcgcugacccgcgggccccuggcgaaucucccugccccgugggggagccuccccuugcccucgaaaaugcugcgagccugaaacuguucgccggaucccucgcuccucugcuucaaccgggcgccgccgggggagagauucccgcuguccaggccucuagcggcuccccuaaggcgcgcaccacagaagggcccguggauagcaugccuugccuggacagaaugccccuccuggccaaaggaaagcaggcuacgggcgaggagaaagccgcuaccgccccgggcgcgggggccaaggcuuccggagaaggcauggccggggaugcugccggagagacagaaggcucuauggagcggaugggggaaccuagccaggaccccaaacaaggcaccuccggaggcguugacacaucuagcgagcagaucgcuacccugacgggguuuccugauuuccgcgagcacauugccaagaucuuugaaaagcccgugcuuggagcgcuggccacaccgggcgagaaagcuggggccggaagauccgcugucggcaaggaccucacccggccucuggggcccgaaaaacuccuggauggacccccuggaguggacgugacccuucugcccgccccuccggcccgccuccaggucgagaagaaacagcaacuggcgggcgaggcugaaauuucucaucuggcccuucaggaucccgcuagcgacaagcugcucgggccugccggacugacaugggagagaaaccuccccggcgccgggguuggaaaggaaauggcuggcgugccucccacccugcgggaggaugaacgcccugaggggccgggcgccgcguggcccggacuugagggccaggccuacucccagcuggaaagaagccggcaagagcucgcuucugggcugccuucccccgccgcuacacaggaacugccuguggagagagccgcggccuuccaggucgcuccccacagccacggagaagaggccguggcucaggaccgcaucccgucuggcaaacaacaucaggagacguccgccugugauagcccucacggggaagacggacccggcgauuuugcucauaccggcguucccgggcacgugccucggucuacaugcgcccccuccccucagagagagguccuuaccgugccggaagcgaauagcgagcccuggacacuggacacccucggaggcgaacgccggccugggguuacggccggaauccuggagaugagaaacgcucucggcaaucaauccacccccgccccucccacaggggagguggcugauaccccgcuggaaccuggaaaggucgccggcgccgcgggcgaggcugaaggggacauuacacuuagcaccgccgagacacaggccugugcuucuggagaccugcccgaggccggcaccacgcgcacauucagcgugguugcuggggaucuggugcucccuggauccugccaggaccccgccuguucugauaaagcgccuggcauggaagggaccgccgcucugcauggagacagccccgcccggccgcagcaagcuaaggagcagcccggcccugaaagacccaucccugccggcgaugggaaagucugcguguccucuccgcccgagccugacgaaacccacgaucccaaacuucagcaccuggcgccugaggagcuccauacagaccgcgaaagcccccggccuggacccuccaugcugccgucugugccuaagaaagaugcccccagagucauggacaagguuaccagcgaugagacgcggggcgcugaagggacagaguccagcccuguggccgacgauauuauccagcccgcugccccggcugaccucgaaucuccuacccuggccgcguccagcuaucacggagacguggucggccaagugucuacagaucuuauugcccagcgcuccagcgacuccgaggaggcuuuugaaacccccgagucuacaacccccguuaaagccccucccgccccuccgcccccucccccugaagugauccccgagccggaagucagcacgcagccucccccugaggagcccggguguggauccgaaaccgugccuguucccgauggcccgagaagcgacucuguggagggcucccccuuccggccucccagccauucuuuuagcgcugucuucgaugaagacaagccuaucgccuccucugggacauacaaccuggauuucgacaauauugagcugguggauaccuuucagacacucgagccccgcgcgagcgacgcuaaaaaccaagaaggaaaggucaauaccagacggaaguccacggauucugugccuaucagcaaauccacacugagcagaucucuuucccugcaggccagcgacuucgacggcgccuccucuagcgggaacccggaggcuguugcccucgcucccgaugccuauuccaccggaucuagcuccgcgagcucuacacugaagcgcaccaaaaagccucggcccccuucccucaaaaagaaacagaccacaaagaagcccacggaaaccccgccugugaaagagacacaacaggaacccgacgaggagagccuggucccuucuggcgaaaaucuugccuccgagaccaagacagaaagcgcuaaaaccgaggggcccucuccggcccugcuggaagagacgccucucgagcccgcugugggacccaaggccgcgugcccucuggauuccgaaagcgccgagggcguugugcccccugcuucuggcgggggaagaguccagaacagcccgcccgugggccgcaaaacacuuccucugaccaccgcccccgaagcuggggaggugacaccuuccgacagcggaggccaggaagauucccccgccaaggggcucucuguucggcuggaguuugacuacagcgaggauaaguccucuugggacaaucaacaggaaaacccuccgcccaccaaaaagauuggcaagaagccugucgccaaaaugccccucagacgcccuaagaugaagaaaacacccgagaagcuggauaauacgccggcuucucccccucggucccccgcggaaccuaacgacauccccauugccaaaggcaccuacacauucgauaucgacaagugggaugacccuaacuuuaauccguucuccagcaccuccaaaaugcaggagagccccaaacuuccucagcaaucuuauaacuuugaccccgauacaugugacgaguccguggauccuuucaagaccagcucuaaaacgcccuccagcccgucuaaguccccugcuagcuuugaaauucccgccucugccauggaggcuaauggcguggacggggauggacugaacaaaccugccaagaaaaagaagacaccccugaaaacagacaccuucagagucaagaaauccccuaagcgcagcccccucagcgauccgcccucccaggacccuacacccgcggcuaccccugaaacacccccggugaucucugccguugugcacgccacggaugaggaaaaacuggcugucaccaaucagaaguggacaugcaugaccguggaccuugaggccgauaaacaggacuacccucaacccagcgaccuguccaccuuuguuaacgagacaaaguucucuagcccuacggaagaacuggauuauagaaauuccuacgaaaucgaguauauggaaaagauuggcucuagccugccccaggacgaugacgcuccuaaaaagcaggcccuguaccucauguuugauaccucccaagagagccccgugaaaucuuccccgguccggaugagcgagucuccuacacccuguuccgggagcuccuucgaagagaccgaagcgcuugugaacacagccgcuaagaaucagcacccuguuccccgcggacuggccccgaaccaggagucucaucuccaggugcccgaaaagagcucccaaaaggagcucgaggcuaugggccuggggaccccuucugaggccaucgagauuagagaagcggcccaccccacggacgucagcaucuccaagacagcucuuuauagccggauuggaaccgccgagguggagaaaccugcuggccuccuguuccagcagcccgaucuggacucugcccugcagaucgcccgcgcugaaaucauuaccaaggagagagaaguguccgaguggaaagauaaguacgaagagagccggagagaggucauggaaaugcgcaaaaucguugcggaguacgaaaagacaauugcccaaaugaucgaggacgaacagcgggagaagucugugagccaucagaccgugcagcaacucguccuugagaaagaacaggcucuggccgaucucaauuccguggagaagucucucgccgaccuguuuagacgcuaugagaaaaugaaggagguucuugaaggcuuccggaaaaacgaggaggugcugaagagaugcgcucaggaauaccucagccgggucaagaaagaggaacagcgcuaucaagcccugaaggugcacgcggaggagaaacuggauagagcuaaugccgaaauugcccagguucgggggaaggcucagcaagagcaggccgcucaucaggccucccuccgcaaagaacagcuuagaguggacgcgcuggagcggacacuggaacaaaagaacaaagagaucgaggaacucaccaagaucugcgacgagcugauugccaagaugggaaaaagcuga

SEQ ID NO: 76552 - RNA, 2517 nt, Artificial Sequence
  derived and/or modified sequence opt5 from TACC3__Homo_sapiens__NP_006333
augagccuucaggugcucaacgacaagaaugucuccaacgagaaaaauaccgaaaacugcgauuuccuguuuucucccccugagguuacaggcagaagcuccgugcuucgggugucucaaaaggaaaaugucccgcccaaaaaccuggccaaggcuaugaaagugacguuccagaccccucuccgcgacccccagacacacagaauccugagcccuuccauggccucuaagcuggaggcgcccuuuacccaggaugacacacuggggcucgaaaauagccauccuguuuggacccaaaaggagaaccagcagcugauuaaagagguggaugcuaagacaacccacggaauccugcagaaaccggucgaagccgacacggaucuccugggcgacgccucccccgcuuucgggagcggaucuuccagcgagucuggcccuggggcccuugcugaucuggacuguuccagcagcucccaaagccccggauccucugaaaaucagauggugagcccuggcaagguuuccggcagccccgagcaggccguggaggaaaaccucucuuccuacagccuggaucggcgcgucaccccggcgucugagacacuugaagacccuugcagaaccgagagccagcauaaagccgaaacaccccacggggcugaggaggaauguaaggccgagaccccucauggagcugaagaggaaugccggcacggcggggugugugcccccgcggccguggcuacguccccucccggagccauuccgaaggaggcuugcggcggggcuccccugcaaggacucccuggcgaggcccugggcugucccgccggggucggaacaccuguucccgcggauggcacccagacacugaccugcgcccacaccucugcuccggaaagcacagccccuacgaaucaucucguggccgggcgcgcuaugacccugagcccccaggaggaaguggccgcgggacaaauggcuucuucuuccagaagcggcccugucaaacuugaguuugacgugucugacggggccacauccaagcgggcucccccuccccgcagacugggagaacggagcggccucaaaccgccucugcgcaaggccgccguuagacagcagaaagcuccccaggagguggaggaagaugacggccgguccggggccggagaggaucccccuaugccggcgucucgcggcagcuaucaccuugacugggauaagauggacgaucccaacuucaucccuuuugggggagacaccaaauccggcuguucugaagcccaacccccugagagccccgagacaagacuggggcagccugcugccgaacagcuccaugcuggccccgccaccgaggaaccgggaccuugccugucccagcaacugcacagcgcgucugccgaggauacgcccgucgugcagcucgcugccgaaacaccuaccgcugaguccaaggagcgggcccugaauagcgccucuaccucccuucccacaagcuguccgggcucugaaccuguucccacccaccagcaggggcaaccugcucuggagcucaaggaagagagcuucagagaccccgcggaagugcugggaacaggcgccgaggucgauuaccuugagcaguuugggacguccagcuucaaagaaucugcucugcgcaagcagucccucuaucugaaauuugacccccugcuccgggacagcccuggaagaccggugcccgucgccaccgagacauccucuaugcauggcgccaacgaaaccccuagcgggcgcccccgggaggcuaagcugguggaguucgauuuucuuggcgcccuggacauuccuguucccggaccuccgcccggcgugccugcgcccgggggaccuccccucuccacaggcccgaucgucgaucugcugcaguacucucaaaaagaccuugaugcugugguuaaggccacccaggaagagaauagagaacuccgcagccggugcgaggaacugcacgggaagaaccuggagcucggaaaaaucauggacagauucgaggaaguggucuaucaggccauggaggaagugcaaaagcagaaagagcuguccaaggcugaaauucagaaagugcuuaaggagaaggaucagcugacgaccgaccucaacucuauggagaaauccuucuccgaucuguuuaagcgcuucgaaaaacaaaaggagguuaucgaaggcuaccggaaaaaugaggaaagccugaagaagugcgucgaggacuaucuugccagaauuacacaggaggggcagcgcuaccaggcgcucaaagcucaugccgaagagaagcugcaacuggccaacgaagagaucgcucaggugcggucuaaagcccaggcugaagcccucgcgcugcaggccucccuuagaaaggagcaaaugcggauucagagccuggagaaaaccguggaacagaagacaaaagagaaugaggaacucacccgcaucugugaugaccugauuucuaagauggagaagaucuga

SEQ ID NO: 76553 - RNA, 894 nt, Artificial Sequence
  derived and/or modified sequence opt5 from TACO1__Homo_sapiens__NP_057444
augagcgccugggcugccgcgucccugucuagagcugccgcccggugccuccuggcucgcggccccggggugagagccgcuccuccgcgggacccccgcccuagccaccccgagccuagaggauguggcgccgcgcccgggcggacccuucauuucacagccgcugucccugccggacacaacaagugguccaaaguucgccauaucaagggcccgaaagauguggaaagaucucggauuuuuagcaagcugugccucaauauccgccuggcugugaaagaagggggacccaacccugagcacaauuccaaccuugccaauauucuggaggucuguagaucuaagcauaugcccaagagcacgaucgaaaccgcgcucaaaauggagaaguccaaagacacauaccugcuguaugagggccggggcccugggggaagcucucuccugauugaagcccuuuccaacagcucucacaagugccaggcugauauccgccacauccugaauaaaaacggcggggugauggccguuggagcuagacauuccuucgacaagaagggcgugauugucguggagguugaagaucgggagaaaaaggccgugaaucucgagcgcgcccuggaaauggcuaucgaggcgggggccgaagacgucaaagagaccgaagaugaggaggaaagaaacguguuuaaguucauuugugacgcuagcucucuucaccaagugcggaaaaagcuggauucccucggacugugcagcgucuccugugcccuggaguuuauccccaauucuaaaguucagcucgccgaaccggaccuggagcaggcugcccaucuuauucaggcgcugagcaaccacgaagaugugauccacguguacgacaauauugaguga

SEQ ID NO: 76554 - RNA, 1224 nt, Artificial Sequence
  derived and/or modified sequence opt5 from TACR1__Homo_sapiens__NP_001049
auggacaacgugcugcccgucgauagcgaccucuccccuaauaucucuaccaacacaagcgagccgaaucaguucguucaacccgccuggcagauugugcugugggcugccgcguacacggugaucgucgugaccuccguugugggcaacgucgugguuauguggauuauccuugcucacaagagaaugcggacagugaccaauuauuuucuggucaaccucgccuucgccgaggcuucuauggccgcuuuuaauacaguggugaacuucaccuacgccguccauaaugagugguauuacgggcuguuuuauugcaaauuccacaacuuuuucccuauugcggccguuuuugcuagcaucuacuccaugacagccguggcuuucgaucgcuauauggccaucauucauccccuucagccuagacugucugcgaccgccacgaagguggucaucugugugauuuggguucucgcucugcugcucgccuuuccccagggauacuacagcaccacagaaaccaugccuucccggguggucugcaugaucgaguggccggaacaccccaauaaaauuuaugagaagguguaccauaucuguguuacagugcugauuuauuuccuuccucugcucgucaucggcuacgcuuauaccguggucgggaucacgcugugggccagcgagauucccggagacucuuccgaucgcuaccacgaacaagugagcgccaaaagaaagguugugaagaugaugaucgucgugguuugcacauuugcuauuuguuggcuuccuuuccacaucuucuuucugcuccccuauauuaacccggaccuguaccugaaaaaguucauccaacagguguaccucgcgaucauguggcuggccaugucuuccaccauguauaauccuauuaucuacugcugucuuaacgaucgguuucgccugggcuucaaacaugcuuuuagaugcugucccuucauuagcgccggggacuaugagggacucgaaaugaagucuacacgguaccugcagacccagggcuccgucuauaaagugagccgccuugagaccacaaucuccacggugguuggcgcccacgaggaagaaccugaagaugggcccaaggcuacccccucuagccuggaccucacauccaauugcagcucuagauccgauagcaagaccaugacagagucuuuuagcuucuccucuaacguccugagcuga

SEQ ID NO: 76555 - RNA, 1197 nt, Artificial Sequence
  derived and/or modified sequence opt5 from TACR2__Homo_sapiens__NP_001048
augggaaccugcgacaucgugacagaggccaacauuagcuccgggcccgaaucuaauacgaccggaaucacagcuuucagcaugccuuccuggcagcuggcccucugggcgaccgcuuaccuggcccuuguccugguugccgugacaggcaacgcuauugugaucuggauuauccucgcccacagacggaugcgcaccgucacaaauuauuuuaucgugaaccuggcucuugccgaucuguguauggcggccuucaaugcugccuuuaacuucguuuacgcuucucauaauauuugguauuuugggagagccuucugcuacuuucaaaaccucuucccgaucaccgcgauguuugugagcauuuauuccaugacggccaucgcugccgaccgguacauggcuauuguccaccccuuccagccucgccugucugcccccagcaccaaggccgugaucgcuggaauuuggcugguugcgcucgcccuggcuuccccucaguguuuuuauagcacagugaccauggaucagggcgccacaaaaugcgucguggccuggcccgaggacucugggggaaagacccuucugcucuaccaucugguggucaucgcucuuaucuacuuccugccucucgccguuauguuuguggcguauuccgugauuggccugacgcuguggagacgggcugucccgggccaccaagcccauggggccaaucuccgccaucugcaggcuaugaaaaaguucgugaaaacaaugguucuugugguccugaccuucgccaucuguuggcuccccuaccaccuguauuuuauucuuggcagcuuccaggaagauaucuacugccacaaguuuauucagcaaguguaucuggcucucuucuggcuggccaugucuuccacaauguacaacccuaucaucuauuguugccugaaucacagauuucggagcggcuuccgccucgcguuuagauguugccccuggguuaccccuaccaaggaggacaaacuggaacuuacacccacgaccucucuguccacacgggugaaccgcugucauaccaaggagacacucuucauggccggggauaccgcuccgagcgaggccacguccggagaagcuggcagaccucaggacgggucuggacugugguuuggcuacggccuucuggcccccacaaaaacccacgucgagauuuga

SEQ ID NO: 76556 - RNA, 1398 nt, Artificial Sequence
  derived and/or modified sequence opt5 from TACR3__Homo_sapiens__NP_001050
auggccacccugcccgcugccgagacauggaucgacggcgggggaggcgugggggcggaugcugucaaccucacggccagccuggccgcuggagccgcuaccggcgccguugaaacaggguggcuucagcugcucgaccaagcgggaaaucuguccucuagcccuuccgcccuuggccugccgguggcuucucccgccccuagccagcccugggcuaaccucaccaaucaguucgugcagccuuccuggagaauugcccuguggucucuggcguacggcgucgugguugccguggcuguccucgggaaccugaucgugauuuggaucauucuugcccacaagcggaugcgcacaguuaccaauuauuuucuggugaaccucgcuuucagcgaugccuccauggccgcuuuuaauacacuggucaacuucaucuacgcgcuucauagcgagugguauuuuggagccaauuacugcagauuccaaaacuuuuuccccaucaccgcuguguuugccucuauuuauuccaugacggccaucgcuguggaccgguacauggccauuaucgauccucugaaaccgcgccucagcgcgaccgcuacaaagauugucaucggcucuauuuggauccuggccuuccugcucgccuuuccccagugucuguauuccaaaaccaagguuaugccugggagaacacuuugcuucgugcaguggcccgaaggaccuaaacagcacuuuaccuaccauaucauugugaucauucuggucuacuguuucccccuccugaucaugggcauuacguauacaaucguggggaucacccuuuggggaggcgagauuccgggcgacacaugcgauaaguaccacgaacaacugaaggcuaaacggaagguugugaaaaugaugaucauugucgugaugaccuucgccaucuguuggcucccuuaucauauuuacuuuauccugaccgcuaucuaucagcagcugaaucgcuggaaguacauucagcaaguuuaucucgccagcuucuggcuggcgaugucuuccacaauguacaaccccaucauuuacugcugucuuaauaaaagauuucgggccggguucaagcgcgcuuuuagauggugcccuuucaucaaggugagcuccuaugacgagcuggagcucaaaacgacccgguuucaccccaaccgccagucuagcauguacacagucaccagaauggaauccaugacaguggucuucgaucccaaugacgccgauaccacgcggagcucucgcaagaaaagagcuacaccucgggacccguccuuuaacggauguagcagacgcaacucuaagagcgccuccgcgaccucuagcuucauuuccagccccuauaccucuguggaugaguacuccuga

SEQ ID NO: 76557 - RNA, 1008 nt, Artificial Sequence
  derived and/or modified sequence opt5 from TADA1__Homo_sapiens__NP_444281
auggccaccuucgugagcgagcuggaagcugccaagaaaaaccucuccgaggcgcugggcgacaaugucaagcaguacugggcuaaccuuaaacugugguuuaagcagaaaaucucuaaggaagaguucgaucucgaagcccacagacugcuuacacaagacaauguucauagccacaacgauuuucugcucgccauucugacgcggugccagauccugguguccacccccgacggggcuggaucucucccuuggccgggcgggagcgccgcuaagcccggaaaaccuaagggcaaaaagaaacuguccucugugcgccagaaguucgaucauagauuucaaccccagaauccucuuagcggggcccagcaguucgucgcgaaggacccccaagaugacgaugaccugaaacucuguucccacacaaugaugcugccuacccggggacagcuugagggccgcaugauugugacagccuaugagcauggccuggauaacguuaccgaagaggcugugagcgccgucguguacgcuguugaaaaucaccucaaggacauccugacaucuguggucuccagacggaaagccuaucgccugagagaugggcacuuuaaguacgcguucggaagcaacgugaccccgcagcccuaucucaaaaauucuguggucgccuacaacaaucugauugaguccccucccgcuuuuacggccccuugcgcuggccagaaccccgccagccauccgccucccgacgacgccgagcaacaggcugcgcuucugcucgccuguucuggggauacccugccugcuucccuuccucccguuaauauguaugaccuguucgaagcccuccaggugcaccgggaggugauccccacacauaccgucuacgcccugaacaucgaacgcauuaucacaaagcuguggcacccgaaucacgaggaacuccaacaggauaaagugcauagacagcggcuggcugccaaggagggacuucugcucugcuga

SEQ ID NO: 76558 - RNA, 1332 nt, Artificial Sequence
  derived and/or modified sequence opt5 from TADA2A__Homo_sapiens__NP_001159577
auggacagacugggcagcuucuccaacgaucccucugacaagccuccgugccggggguguagcuccuaccucauggagcccuauaucaaaugcgccgaauguggaccucccccuuucuuccugugccuucaguguuuuacccgcggcuucgaguacaagaaacaccaaucugaucauacauaugaaauuaugacgagcgacuuucccgugcuggauccuuccuggaccgcucaggaggaaauggcccuccuggaggcggucauggacugcggguucggaaauuggcaggauguugcuaaccagauguguacaaagaccaaagaggaaugcgagaagcacuacaugaagcauuuuaucaauaacccgcuuuucgccucuacacugcucaaucugaaacaagccgaagaggcuaagaccgccgacacagcuauucccuuucacagcaccgaugacccucccagaccuacguucgauucccugcucagccgggacauggccggcuauaugcccgcgcgcgccgauuuuaucgaggaauuugacaacuacgcugagugggaccugagagauauugacuuuguggaagaugacucugauauccuucaugcccugaaaauggcuguggucgacaucuaucacucccggcucaaggagcgccagagacggaaaaagauuauccgcgaucacgggcugauuaaucuuagaaaguuccagcugauggaacggcgcuacccgaaagaggugcaggaccucuacgagaccaugagacgguucgcccgcaucguuggaccuguggaacaugauaaguuuauugagagccacgcgcuggaguucgagcugagacgggaaaucaaaagacuccaagaguaucgcacagccggcauuaccaacuuuuguucugcucggacauacgaccaucugaagaaaaccagagaggaagaacgccuuaagcggacgaugcuguccgaaguccuccaguauauccaggauagcucugccugccagcaauggcugagacgccaggcugacaucgacuccggccuuagccccuccauuccuauggccucuaauagcgggcggagauccgccccuccccugaaccucacaggacugcccggcaccgagaaacugaaugaaaaggagaaggagcucugucagauggugcgccugguuccgggggcuuaccuugaauauaaaagcgcgcugcucaacgagugcaauaagcaaggaggccugcggcuugcccaggcuagagcccugaucaaaauugaugugaacaagacacgcaaaaucuacgacuuccucauucgggaaggguauaucaccaagggauga

SEQ ID NO: 76559 - RNA, 1299 nt, Artificial Sequence
  derived and/or modified sequence opt5 from TADA3__Homo_sapiens__NP_006345
augagcgagcugaaggacugcccccuccaauuccacgauuuuaaguccguggaccaucugaaggucuguccuagauacaccgccguucuugcucggucugaagaugacggcaucgggauugaggaacuggauacacuccaacuggagcuugaaacgcugcucagcuccgccucucgcagacugcgggugcuggaggcggagacccagauccucacagacuggcaggauaaaaagggagaccgcagauuccugaaacuuggccgggaucacgaacugggggcuccgcccaagcauggaaagccuaaaaagcagaaacucgagggcaaggccgggcacggacccggcccuggccccgggcgcccuaaaagcaagaaccugcaaccgaagauucaggaauaugaguuuaccgacgaucccaucgacgugccuagaauccccaaaaaugaugccccuaaccgguucugggcuuccgucgagcccuacugcgccgacaucacaucugaagaggugcgcacccuugaggaacugcucaagccgccugaagacgaggcugagcauuauaaaauucccccucugggaaagcacuacagccagagaugggcccaggaagaucugcucgaggaacaaaaagacggcgcgcgggccgcugccguugcugauaagaaaaaggggcugaugggaccccuuacagagcuggacaccaaggauguggacgcccuccugaaaaaguccgaagcgcagcacgagcagcccgaggauggcuguccuuuuggggcccuuacgcagcgccugcuccaagcucuggucgaagagaauauuaucagcccgauggaagacucucccauuccugauauguccggaaaagagagcggcgccgacggcgcuucuaccucccccagaaaccagaauaagccuuucagcgugccccauacaaaaucucuggaaucccggaucaaggaggagcucauugcccaggggcugcuugaaagcgaggaucgcccggccgaagacuccgaggacgagguucuggcugaacucagaaagcggcaagcggagcugaaagcccuuucugcucacaacagaaccaagaaacaugaucugcuccgccuggccaaggaagaggugagccggcaggaacugagacagcgcguccggauggccgacaaugaggugauggaugcuuuuagaaaaaucauggccgcgcgccagaagaagcggacaccuaccaaaaaggagaaagaccaggcuuggaagacgcucaaagaaagagaguccauucugaaacuucuggauggauga

SEQ ID NO: 76560 - RNA, 1779 nt, Artificial Sequence
  derived and/or modified sequence opt5 from TAF15__Homo_sapiens__NP_631961
augagcgacuccggcucuuacgggcagagcggaggcgagcaacaguccuauucuaccuacgggaaccccggaagccagggcuaugggcaggccucccaaucuuacagcggauauggccagacaacggauuccagcuacggccagaauuauucuggguacuccagcuacggacagucucaauccggcuauagccagucuuacgggggauaugaaaaccagaagcaguccagcuacucccaacagccuuauaauaaccagggccaacagcagaauauggagucuagcgggucccagggaggcagagcuccgagcuacgaccaacccgauuauggccagcaggacucuuacgaucagcaauccggguacgaccagcaccagggaagcuaugaugaacagucuaacuacgaccaacagcaugauagcuauucccagaaucagcaaucuuaccacagccagcgggagaacuauucccaucacacccaggacgaucgcagagacgugagccgguacggcgaagauaaucgcggguauggaggcucucaagggggaggcagaggccgcgggggauacgacaaagacggccgcgggccuaugacaggauccagcggcggggauagaggcggauucaagaacuuuggcgggcaucgggacuacggaccccgcaccgaugccgacucugaguccgauaauagcgacaacaauacaaucuucguccagggccugggggagggaguuuccaccgaucaggugggcgaauuuuucaaacagauugggaucauuaagacaaacaaaaagaccggcaagccuaugaucaaucucuauacggacaaagauaccggaaagcccaaaggcgaggcgacagugucuuuugacgauccuccgagcgcuaaggccgccauugacugguucgacgggaaagaauuucacggaaacaucaucaaggucuccuucgcuaccagacggcccgaguuuaugcgcggcgggggaucuggcgggggcagacggggacgcggcggguacagaggacggggcggguuccaaggaagaggcggggauccuaagagcggcgacugggugugccccaacccuuccuguggaaauaugaacuuugcccgccggaauagcugcaaccaguguaaugagcccagaccggaagauucucgcccuuccggcggggacuuccggggaagaggcuaugggggagagcgcggcuaccggggcagagggggacgcggcggggaucggggaggcuaugggggagacagaagcggcggcggguacggaggcgaucggucuuccgggggaggcuauagcggggaccggucuggaggcggcuacgggggagauagaagcggcgggggauacggcggggaccggggaggcggcuaugggggagaucgcggcgggggauacggcggggacagaggaggcggcuaugggggagaucggggcggguacggaggcgacagagggggaggcuauggcggggaccgcggaggcuacgggggagaucggggcggguauggaggcgacagaggcggguacggaggcgaucgcgggggauacggcggggacagaucccggggcggauauggcggggaucgcggaggcgggagcggauacggcggggacagaucuggcggauauggcggggaucgguccggaggcggguacggaggcgaccgcgggggcggauauggcggggauagaggaggcuacgggggaaaaaugggcggccggaacgacuaucgcaaugaucagagaaaccggcccuacuga

SEQ ID NO: 76561 - RNA, 1767 nt, Artificial Sequence
  derived and/or modified sequence opt5 from TAF1B__Homo_sapiens__NP_005671
auggaccuggaggaagccgaggaauuuaaggagagaugcacccagugugcugccgugagcuggggccucacagaugaagggaaauacuauugcacguccugucacaacgucaccgagcgguaccaagagguuacaaauaccgaccugauccccaacacacagauuaaggcgcuuaaucgcggacugaaaaagaaaaacaauaccgaaaagggcugggauugguaugugugcgagggguuucaguacauccucuaucagcaagcugaagcccugaagaaccuuggagugggcccugagcugaaaaaugacguccuccauaacuucuggaagagauaccugcagaaaucuaagcaggccuauuguaaaaauccgguguacacaaccgggcggaagcccacgguucuggaggauaaccucagccacuccgacugggcuucugaaccugagcugcuuagcgauguguccugucccccuuuucuggaaucuggagccgagagccaguccgacauucauacccgcaagcccuucccugucagcaaggcuucucaauccgaaacaagcgugugcucuggcucccucgauggcguugaguacagccagagaaaagagaaagggaucgugaagaugaccaugccgcagacacuggccuuuugcuaucuuucucugcucuggcagcgggaagcgauuacccuguccgaccugcuccgcuucgucgaggaagaucacauccccuacaucaaugccuuucaacauuucccugagcagaugaaacuguauggaagagaccggggcauuuuugggaucgaaagcuggcccgauuacgaggacauuuauaagaaaacgaucgaggugggaacauuccuugaccugccucgcuuucccgauauuaccgaagacuguuaccuccacccgaacauccugugcaugaaguaucuuauggaggugaaucugccugaugaaaugcacucccucacaugucaugucguuaagaugaccggcaugggggagguggacuuccugaccuuugaucccauugcuaaaauggccaagacagugaaauacgacguccaggcuguggccaucaucguugugguccugaagcuccuguuccuucuggaugacucuuucgaauggagccucuccaaccuggcggagaaacacaaugagaagaacaagaaagauaagccuugguuugacuucagaaaaugguaccaaauuaugaagaaagccuuugaugaaaagaagcagaaaugggaggaagcucgggccaaguaucuuuggaaaagcgagaagccccuguacuauucuuucguggacaaacccguugcuuacaagaagcgcgagaugguggucaaccuccagaaacaguuuuccacgcugguggaaagcaccgccacagccggaaagaaaucuccuagcuccuuccaauuuaauuggaccgaggaagacacagauagaaccugcuuccauggccacucucugcagggcguccucaaggagaaagggcagagccugcuuacgaagaacucccuguauuggcucagcacacagaaauuuugccgguguuacugcacccacgugaccacauaugaagagucuaauuacucccugagcuaccaauucauccugaaccuuuucucuuuccuccugcgcauuaagaccucccugcuccaugaggaaguuagccugguggagaagaaacuuuuugaaaagaaauauuccgucaagcggaaaaagucuagaagcaagaaagugagacgccacuga

SEQ ID NO: 76562 - RNA, 1179 nt, Artificial Sequence
  derived and/or modified sequence opt5 from TAF1C__Homo_sapiens__NP_001230089
augcugaaguggaaccacggccuccccagcccucugcuucuggccagacuccugccgcccccucggcccuccugcgugcagccucuucugcucgggggacaaggcgggcagcugcagcugcuccaucuggcugagggagccucugucccccgccuugcgggcccuccgcagagccugcccuccagaaucgacucucucccugcuuucccccugcuugaaccuaaaauucaauggcggcugcaggagcgccucaaggcccccaccaucgggcuggccgcuguugugccgccucugcccagcgccccuacacccggacucgugcuguuucagcuuuccgcugccggcgaugucuucuaccagcaacugagaccccagguggacucuagccuccggcgcgaugcgggcccuccgggggacacgcagcccgauugucacgccccuaccgcuuccuggacaagccaggacaccgccggaugcucucaauggcugaaagcccuucugaagguuccccucgcuccucccguguggacagcgccgaccuuuacacauagacagaugcugggcuccaccgaacugcggcgcgaggaagaggaggggcagagacucggaguccugcggaaagccauggcucgcggccaacuucugcuccagagagaucuggggagccuuccugccgcugaacccccucccgccccugagucuggacuggaagacaagcucuccgagcggcugggcgaggccugggcuggccgcggggcggccuggugggaaagacagcagggacggacgagcgagcccggcagacaaacccgccggccgaagagacgcacacagcugucuuccagcuucucccucucugggcacguggauccuagcgaagacaccuccagcccccauucucccgaguggccuccggcugaugcccugccccuuccucccacaaccccucccucccaggaacugacgccugacgccugugcucagggaguucccagcgagcaacggcagaugcucagagauuauauggccaaacugccgccucagcgcgacacacccggcugcgcgaccacaccuccccacucucaggcuagcuccgugcgggccaccagaucucaacagcacaccccgguccugagcuccagccagccucuucgcaagaaaccccggaugggguuuuga

SEQ ID NO: 76563 - RNA, 837 nt, Artificial Sequence
  derived and/or modified sequence opt5 from TAF1D__Homo_sapiens__NP_077021
auggacaagagcggcaucgauucccuggaccacgugaccucugaugccgucgagcucgcuaacagaagcgacaauuccucugauagcucccuguucaaaacacagugcauucccuacucuccuaagggggaaaaacggaacccgauccgcaaguuuguuagaacgcccgagagcgugcaugccuccgacucuagcuccgauagcucuuucgaaccuauuccccuuaccaucaaagcgauuuuugagcgguucaagaaucgcaagaaaagauauaagaaaaagaaaaagcggcgcuaccaaccuacaggaagaccccggggccgcccugaagggagacggaacccgaucuauucccugaucgacaagaaaaagcaguuucgcagcagaggaucuggcuuccccuuucucgaguccgagaaugagaaaaacgcuccuuggcggaagauucugaccuucgaacaggccguggcccgcggguuuuucaauuacaucgaaaaacuuaaguaugagcaccaucugaaagagagccucaagcagaugaacgucggagaagaucuggagaaugaagacuuugauuccagacgguacaaguuccuggacgaugacggcucuauuagccccaucgaggaauccacagcugaggacgaggaugccacccaccucgaagacaacgagugugauauuaaacuggcuggcgacagcuuuaucgugucuuccgaguucccuguuagacuuagcguguaucuggaagaagaggauauuacagaggaagccgcgcucucuaagaaacgcgccaccaaggcuaaaaauacggggcaacggggacugaagauguga

SEQ ID NO: 76564 - RNA, 5688 nt, Artificial Sequence
  derived and/or modified sequence opt5 from TAF1__Homo_sapiens__NP_001273003
augggccccgggugcgaccugcugcugagaaccgccgcuacaaucacggccgcggcuauuaugagcgauaccgacuccgaugaggacucugccggaggcgggccuuucagccuugccggauuucuguucggcaacaucaauggggcuggacagcucgaaggcgaguccgugcuggaugacgaauguaagaaacaccuugccggccugggggcucucggacugggcucucugauuacagagcucaccgccaacgaagaacugacagggaccgauggagcccuugucaaugacgagggcuggguucggagcacagaagaugccguggacuacuccgauaucaacgagguggcugaagacgagucuagaagauaucaacagaccauggggagccugcagccgcucugccauuccgauuacgacgaggacgauuaugacgccgauugugaagacauugauugcaagcugaugcccccucccccucccccuccgggacccaugaaaaaggacaaagaucaggacagcaucacgggcgucucugagaauggcgaagggaucauucuuccuuccaucauugcucccagcucucuggccuccgagaagguggauuuuuccucuagcagcgacuccgaaucugagaugggaccucaagaggcgacccaggccgaaagcgaggauggcaagcucacacugccccuggcugggaucaugcagcacgacgccaccaaacuccugccguccguuacagaacuuuucccugaguuucggcccggaaaggugcugcgcuuccucagacuguuuggcccugggaaaaacguccccagcguguggcggucugcucgcagaaagcggaaaaagaagcaucgcgaacuuauucaggaggagcaaauccaggaaguugaguguuccguggaaagcgaggucucucagaaaagccuguggaauuacgacuaugcgcccccuccgcccccugaacagugccucuccgaugacgagauuaccaugauggcccccguggagucuaaguucagccaauccacgggagauaucgacaaagugacagauaccaagccuagagucgcugaauggcgguacggccccgcgcgccugugguaugacaugcugggcguuccggaggaugggagcggauuugacuacggcuucaaacucagaaagacagaacacgagccugugaucaaaucucggaugauugaggaauuucgcaagcuggaggaaaacaaugggaccgaucuucuggccgacgagaacuuccucauggugacccagcugcauugggaagaugacaucauuugggauggagaggacgucaagcacaaaggcacaaagccccagagagcuucccuugccggguggcugccuagcucuaugacgcggaaugccauggcuuacaacgugcaacagggcuuugccgcgacccucgacgaugacaaacccugguauuccaucuucccuauugauaaugaggaccugguuuacggaagaugggaagauaacaucaucugggacgcucaggccaugccccgccugcucgagccgccugugcugacacuugaucccaaugacgaaaaccugauucucgagauccccgaugaaaaggaggaggccaccagcaacuccccuucuaaagaaagcaagaaggaguccucucugaaaaagagccggauucugcuuggcaaaacaggggucaucaaggaagaaccgcagcaaaauaugucccagcccgaagugaaagacccuuggaaccucagcaaugaugaguauuacuaucccaagcagcagggacugagaggcaccuucgggggaaacauuauccaacacucuaucccugcuguugagcugcgccagcccuuuuucccuacgcauaugggccccauuaagcuccggcaguuucacagaccgccucugaaaaaguacuccuucggggcccuuagccagcccggcccucauucugugcaaccccugcucaaacacaucaagaaaaaggcuaagaugcgcgaacaggagcggcaggccuccggaggcggggaaauguuuuucaugagaacaccgcaggaccugaccggaaaagauggcgaccugauucuugcggaguauagcgaggaaaaugggccucucaugaugcaagucggaauggccaccaagaucaaaaacuacuacaagcgcaaacccggcaaggacccuggggcucccgauuguaaauauggcgagacaguguacugccacaccucucccuuucugggaagccugcauccuggccagcuccugcaggccuucgaaaauaaccuuuuucgggcuccgauuuaucugcacaagaugcccgagacagacuuccucaucauuagaacgcgccaaggguacuauauccgggaacuggucgauaucuuugugguuggacagcaguguccucuguucgaggugcccggcccuaauuccaagagagccaacacccauauucgggacuuucuucaggucuucaucuaccgccucuucuggaaaagcaaggauagaccccggcgcauuagaauggaggacaucaaaaaggcguuuccuucucacuccgaaagcuccauucggaaaagacugaagcugugcgccgauuucaagcgcacagggauggacucuaauuggugggugcucaaaagcgauuuuagacugccgaccgaggaagagauccgggcuaugguuucccccgaacaauguugcgccuauuacucuaugaucgcugccgagcagcgccuuaaggacgccggauacggcgagaaauccuucuuugcuccugaagaggaaaacgaggaagauuuccagaugaagauugacgacgaggugagaacagcgcccuggaauaccacgcgggccuuuaucgcugccaugaaagggaagugccugcucgaggucaccggcguggccgauccuacaggauguggcgaaggguucagcuaugugaagauucccaacaaaccgacccagcaaaaggacgauaaagagccucagcccguuaagaaaacagucaccggaacggacgcugaucugcgcagacugucucuuaagaaugccaagcagcuccugcggaaauuuggcgugcccgaagaggagaucaagaaacugagccgcugggaagugauugacgucgugagaacaauguccaccgagcaggcgcggagcggggaaggaccuaugucuaaguucgcucgcggcuccagauuuagcguugccgagcaucaagaacgguacaaagaggagugccagagaaucuucgaucuccagaacaaggugcugucuuccacagaaguccuuagcaccgacaccgauucuuccagcgccgaggacuccgauuuugaagagaugggcaaaaacaucgaaaauaugcugcaaaacaagaagacaagcucucagcucagccgcgagcgggaggaacaggagagaaaagaacugcagcgcaugcugcuugcugccggguccgcggcuucuggaaauaaccaccgggacgaugacacggccagcgugaccucccucaauucuagcgccacaggcagaugucucaagauuuaucgcaccuuccgggacgaggaagggaaagaguacguuagaugcgagacagugcgcaagcccgcugucaucgaugccuaugugcggauuagaaccacgaaagacgaagaguucauccggaaguuugcucuguucgaugaacaacaccgcgaggagaugagaaaggaacggcgccgcauucaggagcagcuccggagacugaaacgcaaccaggaaaaggagaaacuuaagggaccuccggagaagaaacccaagaaaaugaaggagcggccugaccugaaacucaaguguggcgccugcggggcgaucggacauaugagaacaaauaaauuuuguccccuguacuaucaaaccaacgccccucccuccaauccgguugcuaugaccgaggaacaggaggaggaacuggaaaagacagugauccacaacgauaaugaggagcuuauuaaggucgaaggcaccaaaaucgugcugggcaagcagcucauugagucugccgacgaagugcgccggaaaagccugguccucaaguucccuaaacagcaacugcccccuaagaagaaaagacgcguugggacaacggugcauugcgauuaccuuaaccggccccacaaguccauccacagacgcagaaccgacccuauggugacacugagcucuauucucgaguccaucauuaaugauaugcgggaccugcccaacaccuacccguuucauacaccugucaaugcuaaagugguuaaggauuauuacaaaaucaucacccgccccauggaccugcagacgcuuagagaaaacgugcggaagcgccuguaucccagcagagaggaguuccgggaacaccucgagcugauugucaaaaacucugccaccuacaauggaccuaagcauucccucacacagaucagccaguccaugcuggaucuuugugacgaaaagcugaaagagaaggaggacaaacuggccagacucgaaaaggcuauuaacccgcugcuugaugacgaugaccaaguggcguuuucuuucauccuggauaauauuguuacccagaaaaugauggccgugcccgacagcuggccuuuucaccaucccgucaacaagaaguucgugccugauuauuacaaaguuaucgugaaucccauggaccucgagacaauccgcaagaacauuuccaaacacaaguaucagagccgggaaucuuuucuggaugacgucaaucucauccuggcuaacuccgugaaauacaauggcccugagagccaauacaccaagacagcccaggaaauugugaacgucugcuaucagacccuuacggaguacgaugagcaccugacacagcuggaaaaggacaucuguaccgccaaagaggcugcccucgaagaggcggaacuggagucucuugacccgaugacccccgggccuuauacaccccaagcuaagccucccgaucuguacgacaccaauacgagccucuccaugucuagagaugccagcguuuuccaggacgaguccaacaugucugugcuggauauuccgagcgccacaccugaaaaacaggugacccaggagggagaagacggcgauggggaccucgcugaugaggaagagggaacaguccaacagccccaggccuccgugcuguaugaggaccuucugaugagcgaaggcgaggaugacgaagaggaugcgggcucugacgaggaaggggacaaucccuucuccgcuauccagcugagcgaguccggaucugauagcgacguuggcuccgggggaauccgcccuaagcaaccccggaugcuccaggaaaacaccagaauggauauggagaaugaagagucuaugaugagcuacgagggcgacgggggagaagccucccauggccuggaggauagcaacauuucuuauggcuccuacgaggagccugacccgaaaagcaacacacaggauaccucuuuuuccagcaucgggggauacgaagugucugaggaggaagaggacgaagaggaagaggagcaacggagcggccccuccguccuuucucaggugcaccugagcgaagaugaggaagacuccgaggauuuccauagcauugccggggacuccgaccucgauucugacgaguga

SEQ ID NO: 76565 - RNA, 3600 nt, Artificial Sequence
  derived and/or modified sequence opt5 from TAF2__Homo_sapiens__NP_003175
augccccugaccggcguggagccugccagaaugaaccggaagaaaggggacaagggauucgaaagcccgcgccccuacaaacucacacaccaggucguuugcaucaauaacauuaauuuucaaagaaaguccguggugggcuucgucgagcugacgaucuuuccuaccguggcuaaccuuaaucggauuaaacugaacucuaagcagugucgcaucuauagaguucggauuaaugaucucgaagccgcguucaucuacaacgaccccacacuggaggugugccauagcgaauccaagcagcgcaaucuuaacuauuuuucuaaugcuuacgccgccgcugucagcgccguggauccugacgcugggaacggagagcuguguaucaaaguucccuccgagcucuggaagcacguggaugaacugaaaguccugaagauucauaucaauuucucucucgaccagccuaaaggcgggcugcacuuuguggugccgagcgucgagggauccauggccgaaagaggcgcgcauguuuucagcugcggcuaucaaaacucuacccgguuuugguuccccuguguggauuccuacagcgagcuuugcacauggaagcuggaguuuaccguggacgccgcuauggucgccgugucuaauggggaucucguugaaacaguguauacccacgacaugcgcaagaaaacguuccacuacaugcugaccauuccuacagcugccuccaacaucagccuugcgauuggacccuuugagauccuggucgauccuuacaugcaugaagugacccacuucugucucccccagcugcugccgcuccugaagcauacaaccucuuaucuucacgagguuuucgaauuuuacgaggagauucugacgugcagauauccuuacuccuguuucaaaacaguguuuaucgacgaagccuaugucgagguggcugccuacgcuagcauguccaucuucucuaccaaccuccugcacagcgccaugauuaucgaugaaacaccccuuacccggcgcugccuggcccagucccucgcucagcaauuuuucggcuguuuuauuagcagaaugucuugguccgacgaguggguccugaaggggaucagcggauauauuuacggccuguggaugaaaaagaccuucggggugaaugaauaccggcauuggaucaaagaggagcucgacaagaucguugcguaugaacugaagacaggaggcgugcuucugcacccuauuuuuggcgggggaaaagagaaggauaaccccgccucucaucuccacuucagcaucaaacauccccacacgcuguccugggaauacuauaccauguuucagugcaaggcucaccuugucaugcgccugauugagaauagaaucucuauggaguucaugcuccagguguuuaacaaacugcugagccucgccuccacagccagcucucagaaguuccaaucccauauguggagccagaugcugguuucuaccuccggcuuccuuaagagcauuuccaaugugucugggaaagacauccagccucugaucaagcaaugggucgaucagagcggaguggugaaauuuuacggcuccuucgcuuuuaaccggaagagaaauguucucgaacuggagauuaaacaggacuauacaucuccggggacccagaaguacgucggaccccugaaggugacggugcaagaacuugauggcagcuucaaccacacacuccagaucgaggaaaauucccugaaacaugacauuccuugccacagcaagucucgccggaacaaaaagaaaaagaucccccugaugaauggcgaggaggucgauauggaccucuccgccauggaugcggacagcccucugcuuuggauuagaaucgaucccgacaugucugugcugcgcaagguugaauuugagcaggcugacuucauguggcaguaucaacuccgguacgaaagagauguggucgcccagcaggaguccauucuggcccuggaaaaauuuccgaccccugcuagccgccuugcccucaccgacauccuggagcaggagcaauguuucuaccgggugagaaugucugcuugcuuuugucuggccaagaucgcgaacagcaugguuuccacauggaccgggcccccugccaugaaaagccucuucacacgcauguuuugcuguaagucuugccccaauauugugaaaacgaacaauuucauguccuuucagagcuauuuccugcagaagaccaugccugucgcuauggcccuucugcgggaugugcacaaccucugucccaaagaaguucugacauucauccuggaccuuauuaaguacaacgauaauagaaagaacaaauuuuccgacaauuauuaccgcgcugagaugaucgaugcccucgcgaacucugugaccccggccgucagcgugaauaacgaagugcggacacuggacaaucugaacccugaugucagacucauucuggaggaaaucacccgguuccuuaauauggagaagcugcuccccuccuaucgccauacgaucaccguuucuugccugagagcuauucgggugcugcagaaaaacggacacgugcccagcgacccugcccuuuuuaaguccuacgcugaguauggccauuucgucgauaucagaauugccgcccucgaagcugugguugacuacacaaaaguggaucgcucuuacgaggaacugcaauggcugcucaauaugauccagaacgacccgguccccuaugugcggcacaagauucugaauaugcuuaccaagaacccucccuuuaccaaaaauauggagagcccucuguguaacgaagcgcucguugaccagcuguggaagcugaugaacuccgggacaagccaugauuggagacuucgcugcggagccguggaccuguacuucacgcucuuuggccugucuagacccuccugucucccucugcccgagcuugggcugguccucaaucugaaagagaagaaagcugugcugaacccgacaaucaucccugaaagcguugccggcaaucaagaggccgcuaacaaucccucuucccacccucagcuugugggauuccagaaccccuuuucuagcucccaggaugaagaggagauugacauggauaccguccacgacagccaagccuucaucucccaucaccugaauaugcucgaacggccgagcacaccuggccugucuaaguaucgccccgcgagcuccagaucugcucucauuccucagcauagcgccgggugcgauuccacccccaccacaaagccccaguggucucuggagcuugcccggaaaggaacgggcaaggaacaggcuccucuggagaugagcaugcacccggccgcguccgcuccccucucuguguuuaccaaagaaagcacagccuccaagcauagcgaccaccaccaucaccaucaccacgagcauaaaaagaagaaaaagaaacacaagcauaaacacaagcauaaacacaagcacgauucuaaggagaaagacaaggaaccuuucaccuucuccagccccgccucugggcgcuccaucagaagcccuucccugucugauuga

SEQ ID NO: 76566 - RNA, 2790 nt, Artificial Sequence
  derived and/or modified sequence opt5 from TAF3__Homo_sapiens__NP_114129
augugcgagagcuacuccagaucucugcuccgggugagcgucgcccagaucugucaagcucugggcugggacuccguucagcuuucugccugccaccuucucaccgaugugcugcagcgcuaucuucagcaacuggggagaggaugucaucgguacagcgaacucuauggccgcacagaccccauucuggaugacgugggggaggcguuccagcugaugggagucucccuccacgaacuggaggauuacauccauaacauugaaccugugacguuuccgcaccagauccccucuuucccuguuagcaagaauaacgugcuucaguuuccccaaccuggcuccaaagacgcugaggagagaaaggaauauauucccgauuaccugccuccgaucgucagcucucaggaggaagaggaggaagaacaggugcccaccgacgggggaacauccgccgaggccaugcagguuccucucgaggaagaugacgagcuggaggaagaggaaaucauuaaugaugagaacuuccuuggcaaacggccccuggacagcccugaagcugaggagcuccccgccaugaagcgcccgagacugcugucuaccaaaggcgauacacucgacgugguccugcuugaagcucgggagccucuguccagcaucaauacccaaaagauucccccuaugcucucucccgugcaugugcaggacuccacagaucuggcgcccccuagcccggaacccccuaugcuugcccccgucgccaagucccagaugccuaccgcuaaaccccuggagacgaagucuuuuaccccgaaaacaaagaccaaaacaagcuccccugggcaaaagaccaagagccccaaaacggcccagucuccugcuaugguuggaucccccauccgcagcccuaagacagugucuaaagaaaagaaaagccccggcagauccaagucuccgaaaagcccuaagucccccaaggugaccacacacauuccccagaccccuguccggccggagacccccaaccgcacaccuagcgccacgcucucugagaaaaucuccaaggaaaccauucaggugaaacaaauccagacacccccugacgcggggaagcugaauagcgagaaccagcccaaaaaggccguuguggcugauaagaccaucgaagccucuauugacgcugucaucgccagagccugcgcugagcgggagccugaucccuucgaauuuuccagcggauccgagucugaaggcgacauuuucacaagcccgaaacgcaucuccgggccugaguguaccacgcccaaggcgucuacaagcgccaauaacuuuaccaaauccggaagcaccccucugccccucucuggcggcacauccagcucugauaauuccuggaccauggacgcuagcauugaugaagugguuagaaaggccaaacuggggacaccgucuaacaugccucccaauuucccuuauaucagcucccccagcgugucucccccuacgccggagccccuucacaaggucuacgaggaaaagaccaaacugccuuccagcguggaggucaagaaaaagcucaaaaaggaacugaagacaaaaaugaagaaaaaggagaaacagcgggacagagaacgcgagaaggauaaaaacaaggacaaguccaaagagaaggacaaagugaaggaaaaagagaaggauaaggaaaccggacgggagacaaaauaccccuggaaggaauuucuuaaagaggaggaagccgacccuuauaaguucaaaaucaaggaguuugaagauguugaccccaaggugaaacugaaggauggccucgucagaaaagagaaggagaaacauaaggacaagaaaaaggaucgcgaaaaagggaagaaagacaaggauaaacgggagaaggaaaaggugaaagacaagggaagagaggauaaaaugaaggcuccugccccgccccugguucugccucccaaagaacucgcgcugccucuuuucucucccgcuaccgccagccgcgugccggccaugcugccuucccuccugcccguccugcccgagaagcuguucgaggaaaaggagaaagugaaggaaaaagagaagaaaaaggacaagaaagaaaagaaaaagaaaaaggagaaggagaaagaaaagaaagagaaggaacgggagaaagaaaagagagagcgcgagaagcgggaaaaagagaaggaaaaacacaagcaugagaaaauuaagguggagccuguugcucucgcccccucuccugucaucccgagacugacgcugcgcgugggcgcugggcaagauaaaauugugaucagcaaggucgugcccgccccugaagcgaagcccgccccuucccagaaucggcccaaaaccccgccucccgcuccugcccccgcuccuggacccaugcucguuucuccggccccugugccccugccccuucuggcgcaggccgcugccggcccugcucuccugccgagccccggcccugccgccuccggggcuagcgcgaaggcccccgucagaucugugguuacagagaccguguccacauacgucauucgggacgaauggggaaaccagaucuggaucugcccuggcuguaacaaacccgacgaugggagcccuaugauuggaugcgacgauugugacgauugguaucacuggccgugcgugggcaucaugaccgcucccccugaggaaaugcaaugguuuugucccaagugcgccaauaaaaagaaggacaaaaagcacaaaaagcgcaaacauagagcccacuga

SEQ ID NO: 76567 - RNA, 2604 nt, Artificial Sequence
  derived and/or modified sequence opt5 from TAF4B__Homo_sapiens__NP_001280654
augcccgccggccugaccgagccugcuggggccgcgccgcccgcugccgugagcgccuccggaacagucacgauggcuccugccggcgcucuccccguuagaguggaaucuaccccuguggcccugggggcggucacaaaggcccccgugagcguuugcguggagccuaccgcuucccagccgcuucggucucccgucggaacacuggugaccaaaguugccccugugagcgcucccccuaaggucuccucuggcccccgccucccggccccucaaaucguggcggugaaagcccccaacacaaccacgauucaguucccugcuaaucugcagcuuccucccgggaccguccugaucaagagcaacuccggaccccucaugcugguuagcccgcagcaaacagugaccagagccgaaacaaccucuaauauuacgucccggcccgcugugccugccaacccccagacagucaaaaucuguaccgugccuaauagcagcucccagcugauuaagaagguugccgugacacccgucaaaaagcucgcucagaucggcaccaccgugguuacaacggugccgaaaccuagcucuguccaauccguggcgguccccaccagcgugguuacagugaccccuggcaagccccugaacacagucaccacgcuuaaaccuuccucucugggggccagcuccacacccagcaaugagccgaaccucaaggcugaaaauucugccgccgugcagaucaaccuguccccuaccaugcuugagaauguuaagaaaugcaagaacuuucuggcuaugcucauuaaacuggccuguagcggaucucagagccccgagaugggccagaaugugaagaaacuggucgaacaacuccuggacgcgaagaucgaggcugaagaguucacccgcaaacuuuacguggagcugaaguccucuccccagccucaccucgugccguuucugaagaaaagcguugucgcccuuagacagcugcuccccaacucccaaucuuucauucagcagugcgugcagcaaacaucuuccgauauggugaucgccaccuguacaacgaccgucacaaccagcccugugguuacaaccacggugucuuccagccaguccgaaaagucuauuaucgucagcggggcuaccgcuccccggacaguguccguucagacccugaauccucuggccggacccgugggcgccaaagcgggggucgugacacuccauucuguuggaccuaccgccgcuacgggcggcacaaccgccgggacaggacugcuucagaccagcaagccccuggugaccuccgucgcuaacacagugacgaccgugagccuccaaccggagaaaccugucguuucuggcacagccgugacccugucccuucccgcggugacauuuggggaaaccagcggagccgcuauuugccugccuucugucaagcccgugguuuccagcgccggcacgacaucugacaagccggugaucgggaccccuguccagaucaaacucgcucagcccggaccugugcugagccagcccgccggcauuccccaagccguucaggugaagcagcuguucucccucuuucaggucgugcaacagccuagcggcgggaacgagaaacagguuaccacaaucucucacuccagcacccugacaauucaaaaguguggacagaaaacgaugccggugaauaccaucauucccacaucccaguucccucccgcuucuauccuuaagcagaucacccugccuggcaacaagauucucagccugcaagcgucccccacacagaaaaaucgcaucaaggaaaacgucaccucuugcuuuagagaugaggacgauauuaaugacgugacgagcauggccggggugaaccugaaugaggaaaacgcuuguauccuugccaccaauuccgagcucgucggaacacugauucagucuugcaaagaugaaccuuuccuguuuaucggcgcccuccagaagcggauccuggacauugggaaaaagcaugauaucaccgagcuuaacagcgacgcuguuaaucugauuucccaagccacacaggaacgccucagaggccugcuggagaaacuuaccgcgaucgcucagcaccggaugacaaccuauaaagccagcgagaacuacauucucuguucugauacgcgcucccagcugaaguuccuggaaaaacucgaccaacuggagaagcagagaaaagaucuugaggaacgggaaaugcugcucaaggccgcuaaaagccgcucuaauaaggaggacccggagcagcugagacugaagcaaaaagccaaggaacuucagcagcucgagcuggcgcagauccaacaucgggacgcuaaccugacagcccucgccgcuauuggacccagaaagaagcgcccucuggaauccggcaucgaggggcuuaaagauaaucugcucgccagcggaaccucuucccugaccgcuacaaagcagcugcaccggcccagaaucacccgcauuugccuucgggaccucaucuuuugcauggagcaggaaagagagaugaaguauagccgcgcccuguaccuggcgcuccugaaauga

SEQ ID NO: 76568 - RNA, 3258 nt, Artificial Sequence
  derived and/or modified sequence opt5 from TAF4__Homo_sapiens__NP_003176
auggccgcuggcagcgaccugcucgaugagguguucuuuaacuccgaagucgacgagaagguugugucugaucugguggggagccuugaaucccagcuggccgcgucugcugcccaccaucaccaucucgcccccagaaccccugagguccgggcugccgcugccggagcgcugggcaaucacgugguuagcggguccccggccggagcugccggcgcugggcccgccgcgccugccgaaggagcucccggcgccgcuccugagcccccuccggccggccgcgccagacccgggggaggcgggccucaacggcccggaccucccucuccgcgcagaccucuugugcccgcuggcccugcgccucccgccgcuaaacugcggcccccgcccgaggggagcgccggauccugcgccccuguccccgcugccgcggcuguggccgccggcccugaacccgcuccggccggcccugcuaagcccgccgggccugcggcccucgcugcccgcgcuggacccggcccugggcccggaccgggcccugggcccggacccggcccuggcaaaccggccgggcccggagcggcccagacacugaacggcagcgcugcccugcucaauucucaucacgcugccgccccugcuguuucccuggugaacaaugggcccgcggcccuucugccucuccccaagccugcugcccccggaacggucauccagaccccgccuuucgugggcgccgcugcgcccccugcccccgcugccccgagcccucccgccgcuccugcccccgcggcucccgccgccgcuccuccgcccccucccccugcccccgcuacacuggccagaccuccggggcaccccgcgggcccucccaccgccgcuccugccgugcccccgccugcugccgcccagaacggaggcucugcuggggcggcccccgcucccgccccugccgcuggaggccccgccggggucuccggacaaccuggcccgggggcggcugccgccgcucccgccccuggcguuaaagcggagagccccaagcggguggugcaggcugccccucccgccgcucagacacuugccgcuucuggaccggccuccaccgcggccagcauggucauuggcccuacaaugcagggggcucugcccuccccugccgcugugcccccucccgccccgggaaccccuacgggccuccccaagggggccgcuggagcgguuacccaaucucugagccgcacacccaccgccacaaccuccggcaucagagcuacgcugacaccuaccgugcucgccccgcggcugccccagccuccccagaauccuacaaacauucagaauuuucaacuucccccugggaugguccuggugcgcagcgaaaacggccagcuccugaugaucccgcagcaagcccuugcucagaugcaggcccaggcgcaugcucaaccccagaccaccauggccccuagacccgccacaccuacgucugcucccccgguucagauuuccaccgugcaggccccuggaacacccaucaucgcgcggcaagucacccccacaaccauuaucaaacaggugagccaggcccagacgacaguccaaccuucugcuacccugcagcgcagccccggcgugcagccucagcucguucugggaggagccgcucaaaccgccucccugggcacagcuaccgccgugcagacagggacgccgcagagaaccguccccggagcgacaaccacaucuagcgccgcuaccgagacgauggagaaugugaagaaauguaagaacuuccucuccacccugauuaaacuugccagcucuggcaagcaauccacagaaaccgcugccaauguuaaggagcuggugcagaaccuccuggacgggaaaaucgaagccgaggauuuuacaagccggcuuuacagagaacucaauucuuccccucagcccuaucuggucccuuuccugaagcgcagccugcccgcucuccggcagcugaccccggacuccgcggccuuuauucaacagucucagcagcaaccucccccucccacgagccaggcuacaaccgcccuuacagccguggugcuguccucuagcguucagagaaccgcuggcaaaaccgccgcgacagucacguccgcccuccagccucccgugcugagccugacccaaccgacacaggugggagucggcaagcaggggcaaccuacaccccuugugauccagcagcccccuaaaccgggagcucucauuagacccccucagguuacccugacccaaacgcccaugguggcccugcggcagccucacaacagaaucaugcucacaacaccccagcagauccaacugaacccucuucagcccgucccggugguuaagccugcugugcugcccggcaccaaagcccucucugcggucuccgcccaggcugccgcugcccagaagaauaagcugaaagagccugggggaggcagcuuccgcgaugacgaugacauuaacgauguggcuucuauggccggcguuaaucuguccgaggaaagcgcgcggauccuugccaccaacucugagcucguggggacccugacaagaagcugcaaggacgaaacguuucugcuccaagcuccccugcagcgccggauucuugagaucgggaaaaagcauggcauuaccgaacugcacccggaugucguguccuacgugagccacgccacacagcagagacuccaaaaucuggucgagaaaaucucugagaccgcucagcagaagaacuucuccuauaaggacgacgaucgcuacgaacaagccagcgacguucgggcccagcugaaauuuuucgagcagcuugaucagaucgaaaagcaaagaaaagacgagcaggaacgggagauucucaugcgcgcggcuaaguccagaucucggcaggaggauccugaacagcugagacugaaacaaaaggccaaggagaugcagcagcaggaacucgcucaaaugcgccagcgggacgccaaucugacagcccuugcugccaucgggccccgcaaaaagcgcaaaguggauugucccggaccuggcagcggggcggagggauccggccccggcucuguggucccugggagcuccggagugggcaccccgagacaguuuacgcggcaacgcauuaccagaguuaaccugcgggaccucaucuucugccuggagaaugaacgcgagacaucucauagccugcuucucuauaaggccuuccugaaauga

SEQ ID NO: 76569 - RNA, 978 nt, Artificial Sequence
  derived and/or modified sequence opt5 from TAF5L__Homo_sapiens__NP_001020418
augaagagagugagaaccgagcagauccaaauggccgucagcugcuaccugaaacgcagacaguauguugacuccgauggcccccucaagcaggggcugcggcuuucucagacagcugaagagauggccgcgaaccugacggugcaaagcgaauccggaugugcuaauauugugucugccgccccuugccaggcugagccgcagcaguacgaaguccaauucggccgccucagaaacuuucugaccgacagcgauucccagcacucucaugaggugaugccccuucuguauccucucuucguuuaccugcaccugaaucucgugcagaacagccccaaauccacagucgagagcuuuuauucucgguuccaugggauguuucugcagaaugccucccaaaaggacgugaucgaacagcuucagaccacacaaaccauucaggauauccugagcaacuucaaacuccgcgcuuuucuggacaauaaguacguugugagacuucaggaggauucuuauaacuaccugauucgguaccuccaguccgacaauaacacagcccuguguaagguccugacccuccacauccaucuggaugugcaaccugcgaaacgcacggacuaucagcuuuacgccagcggaucuuccagcagauccgaaaauaacggccuggagcccccugauaugccgucucccauccuccagaaugaggcugcccuggaagugcuucaggagagcauuaagcgggucaaagacgggccucccucccugaccacaaucugcuucuaugcuuuuuacaacaccgaacaacuccugaauacagccgagauuagcccugauucuaagcugcucgcggccggauucgacaacuccuguaucaaacuguggagccuucgcucuaagaagcugaaaagcgaaccccaccagguugacgugucccggauucaccucgcuugcgauauccuggaggaggaaguguga

SEQ ID NO: 76570 - RNA, 2145 nt, Artificial Sequence
  derived and/or modified sequence opt5 from TAF6__Homo_sapiens__NP_001177344
augaccaagagacggcugcagacaaucacggccugccuccaacugcgcgagggcagccccucccuucacagagggcugcauccuucucgggaagagaaacgcgacagcagaauggcugaagagaagaaacucaagcuguccaacaccgugcuuccgucugaaagcaugaaagucguugccgaguccaugggaauugcgcagauccaggaggaaacaugucagcugcucaccgaugaggugucuuaccggauuaaggaaaucgcucaagacgcccugaaguucaugcacaugggcaaacgccagaagcugacaaccagcgauauugacuaugcccucaaacugaagaauguggagccccuuuacggguuucaugcucaggaguucaucccuuuuagauucgccuccggaggcgggcgggaacuguauuuuuacgaggaaaaagaggucgaucucagcgacaucauuaacacaccccugccucgcgugccccuugauguuugccugaaggcucacuggcucucuaucgaaggaugucagccugccauuccggagaaucccccucccgcgccuaaggagcaacagaaagccgaagcuaccgagccccugaaguccgccaaaccgggccaggaagaggacggcccucugaaggggaaaggacagggcgcuacgaccgccgaugggaagggaaaagaaaagaaggcgcccccucuccuggagggcgcuccccuuagacugaaaccccggagcauccaugagcucucuguggaacaacagcuguauuacaaggagauuacagaagccugcgucggguccugugaggccaaacgcgcugaagcccuucagagcaucgccaccgacccuggacuguaucaaaugcucccgagauucucuacauuuauuuccgagggcgugcggguuaacgugguccagaauaaccuggcucugcucaucuaccugaugcgcauggugaaggcgcuuauggauaaucccacccuguaccucgagaaauaugugcacgaacugaucccugccgucaugacgugcauuguuagcagacagcuuugucugcggcccgacguggauaaccacugggcucucagagacuucgccgcccgccugguggcucagaucugcaagcauuuuuccacaaccacaaauaacauucaaucucggaucaccaagaccuucacaaaaagcugggucgacgagaagacgccuuggaccacaagauacggcuccauugccgggcuggcggaacucggacacgaugugaucaaaacccugauccuuccccgccugcagcaggagggcgagcggauuagaagcguucucgacgggccggugcugucuaauaucgaucgcauuggagcugaccauguccagucccugcuucucaagcacugugccccugugcuggccaaacugcggcccccucccgauaaccaagacgcuuauagagccgaauuuggcagccucgggccucugcuuugcucucagguugugaaggcucgcgcccaggcggcccugcaggcucaacaggucaaucggacaacccucacgaucacacagcccagaccgacccugacccugagccaggccccucaacccggaccccgcacaccuggccuucucaaggugccgggcuccauugcucugcccguccagacccuggugucugcccgggcggccgcuccuccccagccuucucccccucccacaaaauucaucguuauguccagcagcuccagcgccccgucuacgcaacaggugcucucccugagcaccuccgcuccugggucuggaagcacaaccacaucccccgucaccacgaccgugccuucuguucagcccaucgugaaacuugucagcacagccaccacagccccgccuuccaccgcucccagcggcccugggucugugcagaaguacauugugguuucccugccucccacgggagagggcaaagggggccccacaagccacccgucucccgucccucccccugcguccagccccucuccucucagcggauccgcccuguguggcgggaagcaagaagcuggagauagcccgcccccugcccccggcaccccuaaggccaacgggucucagcccaauuccggaagcccgcagccugcucccuga

SEQ ID NO: 76571 - RNA, 1050 nt, Artificial Sequence
  derived and/or modified sequence opt5 from TAF7__Homo_sapiens__NP_005633
augagcaaguccaaagacgaugcuccccacgagcuggaaucucaguucauccucagacugccuccggaguacgccagcaccgugcggcgcgccguccaauccggccauguuaaccuuaaggacagacugacaauugaacuccaccccgaugggcggcauggaaucgugcgcguggacagagucccucuggcgucuaaacuuguggaucugcccugcguuauggagagccucaagacgauugacaaaaagaccuuuuauaagacagcugauaucugucagaugcugguguccaccgucgacggcgaucuguacccucccguggaagaaccuguugccucuacagacccgaaagccagcaagaaaaaggauaaagacaaggagaagaaauucauuuggaaucacgggaucacccucccccugaagaacgugcggaaacgcagauuucggaagacagcuaaaaagaaauauaucgaauccccugaugucgagaaggaagugaagcgccuucugagcaccgacgccgaggcugugucuacgagaugggagauuaucgccgaagacgagaccaaagaagcggagaaucagggacucgauauuuccagccccggcaugucugggcaucggcagggacacgacucccuggaacacgaugagcuucgcgagaucuucaacgaccugucuagcuccagcgaagaugaggacgaaacacaacaucaggaugaggaagacauuaauaucauugauaccgaggaggaccucgaaagacagcugcaggauaagcugaacgaguccgacgaacaacaccaggagaaugaaggcacaaaccagcucgucaugggcauccagaaacaaaucgacaauaugaaggggaaacugcaggagacccaggaucgggccaagcgccaagaggaccuuauuaugaagguugaaaaccuggcucucaaaaauagauuucaggccgugcuggaugagcuuaagcagaaagaagaccgggagaaggagcagcugucuagccuccaagaggagcuggaaucccugcucgagaaauga

SEQ ID NO: 76572 - RNA, 1131 nt, Artificial Sequence
  derived and/or modified sequence opt5 from TAF7L__Homo_sapiens__NP_001161946
augagcgagucccaggacgaagugcccgaugaggucgaaaaccaauucauccugagacucccucuggagcacgccugcaccguucggaaucuugcucgcucucagagcgugaagaugaaagacaagcugaaaauugaucuccugccggacggcagacaugccguggucgaaguggaggauguuccccuugcggcuaagcugguggaccucccuugugucaucgagucccugcggacacuggauaaaaagacguuuuacaagaccgccgacauuucucagaugcucgugugcacagccgauggggacauccaccugagccccgaagaaccugcugccuccaccgaucccaacauuguucgcaaaaaggaaagaggacgggaggagaaauguguguggaagcauggcaucacaccuccgcuuaaaaauguccgcaagaagagauuccggaaaacccagaagaaagugcccgacgugaaggaaauggagaaaucuagcuuuacagaauauaucgaguccccugaugucgaaaacgagguuaagcgccugcucagaagcgacgcugaggccgugucuacccggugggaagugauugcggaggacgggacgaaagaaaucgagucccaaggaagcauucccggcuuccugaucucuuccgggaugagcucucacaagcagggacauaccuccagcgaauacgauaugcuucgcgagauguuuuccgacucuagaagcaauaacgaugacgaugaggacgaagaugacgaggaugaagacgaggaugaagacgaggacgaggaugaagacaaggaggaagaggaggaagauugcuccgaggaauaucuggagcggcagcuccaggccgaguucauugagagcggccaauaccgcgcuaaugagggcacaucuuccaucgucauggaaauucagaaacagaucgagaagaaagaaaagaaacugcacaagauccagaacaaggcccaaagacagaaagaccugauuaugaagguggagaaucucacccugaaaaaccacuuucagagcguucuugaacaacuggagcuccaggagaagcagaaaaaugaaaagcugaucucucuucaggagcaacugcagcgguuccucaagaaauga

SEQ ID NO: 76573 - RNA, 933 nt, Artificial Sequence
  derived and/or modified sequence opt5 from TAF8__Homo_sapiens__NP_612639
auggccgacgcugccgcgaccgcuggcgccgggggaagcggcacaagauccgggucuaagcagagcacgaaccccgccgauaauuaccaccuggcucggcgcagaacccuccaaguggucguuuccucucugcuuacagaggccggauucgaaagcgcugagaaggccuccguggaaacccugacagagaugcuccagucuuauaucagcgaaauuggccgguccgccaagagcuacugcgagcauaccgcgcgcacacagccuacccugucugacaucguggucacgcuuguggagaugggguuuaacguugauacccugccggcuuaugccaaaagaucccagcggauggugauuacagcucccccugucaccaaucaacccgugacaccuaaggcccucaccgcgggacagaaccgcccccacccuccgcauauccccagccacuucccugaauuucccgacccucauacguacauuaaaacacccaccuauagagagccgguuucugauuaccaggugcugcgggaaaaggccgcuucccagcgcagagacgucgagcgggcccugacacgcuucauggcuaagaccggcgagacccaaagccucuuuaaagaugacgugucuacauucccucugaucgccgccagacccuuuacgaucccuuaucuuaccgcucugcuccccuccgaacuggagaugcagcagauggaagagacagauagcuccgaacaggacgagcaaaccgauacagagaaucuugcgcugcacauuucuauggaagacagcggcgccgagaaggaaaacaccuccgugcuccagcagaaucccagccugucugggucccggaacggagaggaaaauaucauugauaacccuuaccugcgcccggucaaaaagcccaaaaucagacggaaaaagagccucucuuga

SEQ ID NO: 76574 - RNA, 795 nt, Artificial Sequence
  derived and/or modified sequence opt5 from TAF9__Homo_sapiens__NP_003178
auggagagcggcaagaccgccucccccaaaucuaugccuaaggacgcucagaugauggcccaaauccugaaagauauggggauuacagaauacgagccgagagugaucaaccagaugcucgaauucgcguuucgguaugucacgaccauucuggacgaugcuaagaucuacagcucccacgccaaaaaggccacaguugacgcugaugacgugcgccuugccauucagugcagagcugaucagucuuucaccagccccccuccccgggacuuucugcucgauaucgcccgccaaagaaaucagacaccucugccccuuaucaagccuuauuccggaccgcggcugcccccugaccgcuacugucucaccgcgcccaacuauagacugaaaucucugcagaagaaagccagcacauccgcuggccggauuaccgugccucgccucagcgucgggucugugacguccagacccagcaccccgacacugggaaccccuacaccccagaccaugucuguuuccacgaaggugggcacaccuaugagccuuaccgggcaacgguucacaguccagaugcccaccucucagucccccgccgugaaagcuagcaucccugccaccuccgcgguucagaaugugcugauuaacccgucucucaucggaagcaagaauauucugaucacaacgaacaugauguccagccaaaauaccgccaacgagucuuccaaugcucuuaagcgcaaaagagaagaugacgaugacgacgaugacgaugacgaugacuacgauaaccuguga

SEQ ID NO: 76575 - RNA, 2007 nt, Artificial Sequence
  derived and/or modified sequence opt5 from TAGAP__Homo_sapiens__NP_001265662
augagacggcugagccccgccuccgacuucucuggcgcucucgagaccgaucugaaggccagccuuuuugaccagccucuguccaucauuugcggggauucugacacacucccgcgccccauccaagauauucugacgauccuuugucugaaaggaccuagcaccgaaggcauuuucagacgggcggcuaacgagaaggcccgcaaagaacucaaggaggaacugaauagcggggacgccguggaucuggagagacuccccguccaucugcuugcuguuguguuuaaagacuuccugcggucuaucccucgcaagcuccugagcuccgaucuuuuugaggaauggaugggagcccuggagaugcaggacgaagaggauagaaucgaggcucucaaacagguggccgacaagcugccccggccuaaccugcuccugcuuaagcaccuggucuacgugcuccaccugauuagcaaaaauucugaaguuaaccgcauggauuccagcaaucuugcgaucugcauuggcccgaacaugcugacacucgagaaugaccagucucuguccuucgaagcccaaaaggaccugaacaauaaagugaagacccucgucgaguuucugaucgauaacuguuucgaaauuuuuggggagaauauccccgugcauagcucuauuacauccgacgauagccuugagcacaccgacuccucugauguuagcacacugcagaacgacuccgcuuaugauagcaaugacccugauguggaaucuaacuccagcucuggaaucagcucccccucuagacagccucagguccccauggccaccgcugccggccucgacagcgcgggcccgcaagaugcccgggagguguccccugaacccaucgugagcacggucgcucgccugaagucuucccuugcccagccugacagacgguacagcgagcccucuaugcccuccagccaggaaugccuggagucccgcguuaccaaucagacacucaccaaaucugagggggacuucccugugccgagagugggaagccggcuggaauccgaggaagcugaggaucccuuuccugaagaggucuuccccgccgugcaaggcaagacaaaaagaccuguugaccugaagauuaaaaaccucgcccccgggucugugcugccgcgcgcucuuguccugaaggcguuuagcuccagcucucucgaugccuccagcgacucuuccccuguggcuagccccucuagcccuaaacggaacuucuucuccagacaucagagcuuuaccacgaagacagagaagggaaaacccucucgcgaaaucaagaaacacuccaugagcuucaccuuugccccucacaagaaaguucugacaaagaaucuguccgccggcucugggaagucccaggauuucacccgggaccaugugcccagaggaguccgcaaagagucccaacuugcuggccggauugugcaggaaaacggcugugagacccacaaucagacagccagaggguuuugccuccgcccgcaugcgcugucugucgaugacguguuccagggagcugauugggagcggccuggcagcccucccuccuaugaagaggccaugcaagggcccgccgcuagacugguugccucugaaagccagacggugggauccaugaccgucggcagcaugcgcgcucggaugcucgaggcccacugucugcuuccgccccugccucccgcgcaccauguggaagacucuagacaccggggguccaaggagccucuccccggacauggccugagcccucugcccgagcgcuggaaacagucuagaacaguucacgccuccggcgauagccuugggcaugugucuggaccgggccggccugaacuccugccccugagaaccgucuccgagagcgugcagcgcaacaagcgggacugccucgugagacgcuguucccaaccuguuuuugaagcugaucaguuccaguacgccaaagagagcuauaucuga

SEQ ID NO: 76576 - RNA, 663 nt, Artificial Sequence
  derived and/or modified sequence opt5 from TAGLN2__Homo_sapiens__NP_001264153
augagcgccuucucccuggcucucgcccuggugucuagcccccagccuccgcccccuaucggcauggcgaacagagggcccgcuuacggacuuucccgggagguccaacagaagauugaaaaacaguaugacgccgaucuggagcagauccucauucaauggaucaccacacagugccgcaaggacguuggcagaccucagcccgggcgggaaaauuuucagaacuggcugaaagauggaacggugcuuugugagcugauuaaugcccucuacccugaaggccaagcuccggugaagaaaauccaggccucuaccauggcuuucaagcagauggagcagaucagccaauuucugcaggccgcggagcgcuaugggauuaacacaaccgacaucuuccagacagucgaucugugggaaggaaagaauauggccugcgugcaaagaacccucaugaaccugggcggccuugcuguugcccgggacgaugggcuguuuuccggagaccccaauugguucccuaaaaagucuaaagagaacccccgcaauuuuagcgauaaccagcuccaggaaggcaagaaugugauugggcugcagaugggaacaaacagaggcgcuucccaagccgggaugaccggauacggcaugccucggcagauccuuuga

SEQ ID NO: 76577 - RNA, 606 nt, Artificial Sequence
  derived and/or modified sequence opt5 from TAGLN__Homo_sapiens__NP_001001522
auggccaacaagggccccagcuacgggauguccagagaggugcagucuaaaaucgaaaagaaauaugacgaggaacuggaggaacggcucgucgaguggauuaucguucaaugcggaccugaugugggccgcccggacagagggcggcugggauuccagguguggcuuaagaauggcgucauucugagcaaacucgugaacucccuguaccccgaugggucuaagccuguuaaggugcccgagaauccucccagcauggucuuuaaacagauggaacagguggcucaauuccuuaaggccgcggaggacuauggaguuaucaaaaccgauauguuucagacaguggaccuguucgaaggcaaggauauggcugccguccagcgcacgcucauggcccugggcucccuggcugugaccaaaaacgacgggcacuacagaggagauccuaauugguuuaugaagaaggcccaggagcauaaacgggaguucacagaaucucaacuccaggagggcaagcacgugauugggcugcagaugggaagcaaccgcggcgcuucccaggccgggaugaccggauauggcagaccgcggcaaaucaucagcuga

SEQ ID NO: 76578 - RNA, 996 nt, Artificial Sequence
  derived and/or modified sequence opt5 from TAL1__Homo_sapiens__NP_001277334
augaccgagagacccccuagcgaagccgcucgguccgacccgcagcuggagggccgcgaugccgcggaagccucuauggcucccccucaccucgugcugcuuaacggggucgccaaggagacaagcagagcugccgcugccgaacccccuguuaucgagcugggagcgcggggcgggcccggaggcgggccugccggaggcggcggggcugcccgcgaccucaaaggaagagaugcugccacggcggaggcccggcaucgcgugccgaccacagaacugugcagacccccuggccccgcuccugcccccgcuccggccuccgugaccgccgagcuuccuggggacggacggaugguccaacugucucccccugcucucgcggcccccgcugcccccggccgcgcccugcuguacagccucucccagccucuggcuucucuugggagcggauucuuuggcgaaccggaugccuuccccauguuuacaaccaauaacagagugaagcggcgcccuucccccuaugagauggagauuacagacggcccucacaccaaaguugugagacggaucuucacgaauagccgcgaaagauggcggcagcagaacgucaauggggcguuugcugagcugagaaagcucauucccacccauccgccugauaaaaagcugucuaagaacgaaauccuucgccuggccaugaaauacauuaauuuccucgccaagcugcugaacgaccaagaggaagagggaacacagcgggcuaaaaccggcaaggaucccgugguuggggccggaggcgggggaggcggcgggggaggcggggcuccucccgacgaucuccugcaggacgugcuuuccccuaauagcucuuguggauccagccuggauggcgccgcgucucccgacuccuauacagaggaaccggccccuaaacacaccgcuagaagccuccaucccgccaugcugcccgcugccgacggggcgggcccucgcuga

SEQ ID NO: 76579 - RNA, 327 nt, Artificial Sequence
  derived and/or modified sequence opt5 from TAL2__Homo_sapiens__NP_005412
augaccagaaagaucuucacaaacacgcgggagcgcuggagacagcaaaaugugaacagcgccuuugcuaaacugcggaagcucauucccacccacccuccggacaaaaagcuguccaaaaaugaaacacuucgccuggccaugagauacaucaacuuccucgucaagguucugggcgagcagucucuucagcagaccgggguggcggcucaaggaaauauucugggccucuuuccccaggggccucaucugcccggacuggaagaucggacacuccuggagaacuaucaggugccuagccccggcccuucccaccauaucccguga

SEQ ID NO: 76580 - RNA, 1014 nt, Artificial Sequence
  derived and/or modified sequence opt5 from TALDO1__Homo_sapiens__NP_006746
augagcuccucucccgugaagagacagcggauggagagcgcccuggaccaacucaaacaguucaccacagucguugcugauacgggcgacuuucacgccaucgaugaauacaagccucaggacgcgaccacaaacccgucccugauucuugcugccgcccagaugcccgcuuaucaagagcugguggaagaggccaucgcuuacgggcgcaaacucggaggcucucaggaagaucagauuaagaaugccaucgacaaacuguucgugcuuuuuggggcggagauucugaagaagaucccuggaagagucagcaccgagguggaugcccggcucuccuucgacaaagaugcuaugguugcccgcgcuagacggcugaucgaacuguauaaggaggccggcauuucuaaagaccgcauccucauuaagcugagcuccacaugggaagggauccaggcgggaaaagagcuugaggaacaacauggcauucacugcaacaugacccugcucuuuagcuucgcccaggcuguggccugugcugaggccggcgucacacugaucucucccuuuguggggcggauucuugauuggcauguugccaauaccgacaagaaguccuacgaaccucuggaggaucccggagugaaaagcgucacgaagaucuauaacuacuauaaaaaguucucuuacaaaaccaucgugaugggcgcuuccuuuagaaauacaggggaaauuaaggcgcucgccggaugcgacuuccugaccaucagcccuaaacugcucggcgagcugcuucaggacaacgcuaagcuggugccgguccucucugccaaggccgcucaggccuccgaucuggagaaaauucaccuugacgaaaagagcuuucgcuggcugcauaaugaggaucaaauggcgguugaaaaacucuccgacgggaucagaaaguucgcugccgaugccgugaaacuggagcggaugcugacagaacgcauguuuaacgcugagaauggaaaguga

SEQ ID NO: 76581 - RNA, 951 nt, Artificial Sequence
  derived and/or modified sequence opt5 from TAMM41__Homo_sapiens__NP_620162
auggcccugcagacccuccaaagcuccugggugacauucagaaagauccugucucacuuucccgaggaacuuagccuggcuuucgucuacggcuccgggguuuaucggcaggccggaccuucuagcgaccagaaaaacgcgaugcucgauuuuguguucacgguggacgauccggucgcuuggcauuccaagaaucugaaaaagaacuggucucacuacagcuuucuuaaagugcugggccccaagauuaucaccuccauucagaauaacuauggggccggaguuuacuauaauagccucaucaugugcaacggccgccugauuaaguacggggugaucucuacaaauguccugaucgaggaccuccugaacuggaauaaccuuuauauugccggaagacugcaaaaaccugugaagaucauuuccguuaaugaagaugugacccuccggagcgcucuggaccgcaaccuuaaaucugccgucacagcugccuuccugaugcuccccgaguccuuuagcgaagaggaucuguucaucgagauugcgggccugucuuacuccggcgacuuuagaaugguggugggggaagauaagaccaaaguccucaauaucguuaagccuaacauugcccauuuccgggagcuguacggaagcauccuucaggaaaauccccaggugguguauaagucccagcaaggcuggcuggagaucgacaaaucuccugaggggcaguuuacacagcucaugacccugccgaagacgcuucagcaacagauuaaccacaucauggaucccccuggcaaaaaccgcgacgucgaagagacccuguuccagguggcucaugaucccgacuguggagacguugugagacucgggcugaagaaaagcgucauuuacuccagccugaagcuccacaaaauguggaagggauggcugcggaagacaucuuga

SEQ ID NO: 76582 - RNA, 5586 nt, Artificial Sequence
  derived and/or modified sequence opt5 from TANC1__Homo_sapiens__NP_203752
augcugaaggccgugcucaaaaagagcagagagggcgggaagggaggcaagaaagaagcuggguccgacuucggacccgagaccucuccuguccugcaccuugaucauagcgccgacuccccgguuucuagccugcccaccgcggaagauacguaccgggugucccucgcuaagggcgugucuaugagccugccuuccagcccccuucugccucgccagucucaccucguccaauccagagugaacaagaaaagccccgggccuguucggaagccgaaauauguggagucuccccgcgucccuggagacgccgugaucaugcccuuuagagaaguugccaagccuaccgagcccgaugagcaugaagcuaaagccgacaaugagccguccugcagcccugcugcccaggaacugcugacacggcucggcuuccugcuuggcgaggggauucccucugcgacccacaucacaauugaggauaagaacgaaaccauguguacagcccugucccagggaaucagcccuugcuccacccucacgucuagcaccgcuucccccagcacagacucucccuguuccacccugaauagcugcgugucuaagacagccgcuaacaaaagcccuugugagaccauuuccucuccgagcuccacgcuugaaagcaaggauucuggcaucaucgccacaauuaccuccagcucugagaaugacgaucgcuccgggagcucccuggaauggaacaaagacggaaaucucagacugggcguccagaagggggugcugcaugaucggcgcgcggacaacugcucucccguggccgaggaggaaacaaccggaagcgcugaguccacccucccuaaagccgaaucuagcgcuggcgacggccccgucccuuacucccaaggguccucuagccugaucaugcccagaccgaauagcguugccgccacaucuuccacgaaacuugaggaucugagcuaucucgacggacagcggaacgcuccucugcgcaccucuauuagacuucccuggcacaauacagcgggcgggcgggcccaggaagugaaagcucgcuuugccccuuacaagccccaggauauccugcucaagccucugcuguucgaggugcccagcauuaccacagacuccgucuuugugggaagagauuggcuguuccaccaaaucgaggaaaaccugcggaauaccgagcuugccgaaaacagaggcgcuguuguggucgggaaugugggauuuggcaaaacggccauuaucagcaagcugguugcgcucucuugucauggcucccgcaugcggcagaucgcuagcaacuccccggggucuagcccuaaaacauccgaccccacccaggaucugcacuucacaccccuucugucuccuagcuccucuacaagcgccuccagcaccgccaagacaccgcucggaucuauuuccgcugagaaccagagaccccgcgaagacgccgugaaauaucuggcuagcaaggucguggccuaccauuauugccaagcggauaauacguacaccugucuggucccugaguuugugcacucuaucgccgcucuccugugccggucccaccagcuugccgcuuacagagaccugcucauuaaggagccccagcugcaaagcaugcugucucuucgcuccuguguucaggauccuguggccgcguucaaacggggcguccucgaaccccugacaaaccugagaaaugagcagaagaucccugaagaggaguauauuauccucaucgacgggcugaacgaagccgaguuucauaaacccgacuacggagauacccuuagcuccuucauuacaaagaucauuagcaaauuuccggcuuggcugaagcucaucgugaccguucgcgccaauuuccaggaaauuaucucugcucugccuuucgugaagcugagccuugacgauuuucccgacaacaaagauauccacuccgaccuccaugccuauguccaacaccgggugcauucuagccaggauauucuguccaauaucucucugaacggcaaggccgacgcuacgcucauugggaaagugagcucccaccugguucuuagaucucugggcagcuaccucuaucugaagcugacccuugaucucuuccagcgcggacaccuggucaucaaauccgcgagcuacaagguggugccugucucucuguccgagcucuaucugcuucagugcaauaugaaguuuaugacacaaagcgccuucgaacgggcucugcccauucucaacguggcccuggccucucugcauccgaugaccgacgagcagaucuuucaggcuauuaaugccggccacauccagggggagcaaggaugggaagauuuccagcagagaauggacgcgcuuuccugcuuucucaucaaacggcgcgauaagacaagaauguucugucauccuagcuuucgggaguggcugguuuggagagcugacggcgaaaacaccgccuuccugugcgagccccgcaaugggcacgcccuccuggcuuuuauguucucccggcaggaaggaaaacuuaacagacaacagacgauggagcugggccaccauauucucaaggcccacaucuuuaaagggcugucuaagaaaacaggcauuagcuccagccaucugcaggcgcuuuggaucggauacucuaccgagggccuguccgcugcccucgccagccugcgcaaucucuacacaccuaacgugaaggucucuagacugcuuauucucggcggggcuaacgugaauuaucggaccgaaguucucaacaaugcccccauccugugugugcaaagccaccuggggcaugaggaagucgugacccuucugcucgaguucggggcuugccuggacggaacauccgaaaacggcaugacggcccucuguuacgcggccgcugccgggcacaugaagcugguuugccuucugaccaaaaagggcgugcgcgucgaucaccucgacaaaaagggacagugugcucuggugcauucugcccugagaggccacggggauauccuucaguaucugcucacaugcgaguggagccccggaccuccgcagcccggcacccugcggaaaucccaugcccuccaacaggcucugacagcggccgcuucuauggggcacagcuccgugguccagugucuucugggaauggagaaggaacaugagguugaagugaauggcaccgacacgcuguggggagagacagcccucaccgccgcugccggccgcggaaagcuggaggugugcgaacuucugcucggccacggggcggcugucagcagaaccaaccggcgcggagugccuccccuguucugugccgccagacagggccacuggcaaauuguucggcuccugcuugagcgcgggugcgaugugaaucugucugacaaacagggaagaacaccucugauggucgcugccugcgaaggccaucucuccaccguggaguuucugcuuagcaagggcgcggcucuguccucucucgauaaagaagggcugagcgcccucuccugggccugucugaagggacaccgggcuguugugcaguaccuugucgaggagggcgccgcuaucgaccagacagauaaaaacgggagaacgccccuggaccuggccgcguucuauggagaugccgaaaccgugcucuaccugguugagaagggcgcugugauugaacaugucgaccacucugggaugcgcccucuugaucgggccaucggaugcagaaauacaagcgugguggucgcucugcuccgcaagggcgccaaacugggcaacgccgcuugggcgauggccaccuccaagccggacauucucaucauccugcuucaaaaacugauggaggaagggaauguuauguauaagaaaggaaagaugaaggaggcugcccagcgguaccaguacgcccugagaaaauuuccccgcgagggcuucggggaagacaugcggccuuuuaacgagcucagagugagccuguaucuuaaucugucucgcugucggagaaagacaaacgauuucggaauggcugaagaguuugccuccaaagcgcucgaacugaagcccaaaagcuacgaggcuuucuaugcccgggcccgcgcuaagagaaauucucggcaauuuguggccgcgcuggccgaccuccaggaggcugucaaacuuugcccuaccaaccaggaagugaagcgccugcuggccagaguugaggaagaguguaagcagcuccaacggucccagcagcagaaacaacagggcccccugccggcuccucuuaacgauagcgagaaugaagaggacacgcccacccccgggcugucugaucacuuccauagcgaagagacagaagaggaggaaaccuccccucaggaggaaucugugagccccacaccuagaucccagccgagcuccucuguccccagcuccuacauucgcaaccuccaagagggacugcagucuaagggccggccugugagcccccaguccagagccggcaucgggaaaucucugcgcgaaccuguugcucagcccggacuccuucugcaaccgagcaagcaggcccagauugugaaaaccucccaacaccugggcagcgggcagucugcgguccggaauggauccaugaaggugcagaucagcucucagaacccucccccuucccccaugccuggcagaauugccgcuacacccgccgggagccgcacccaacaucucgagggaacgggcacauuuaccacccgggcuggcugcgggcacuucggagacagacugggcccgucucagaauguccgccuucaguguggggagaacggaccugcccauccccugcccuccaagacaaaaaccacggaaagacuccugagccacuccagcguggccguugaugcugcgccuccgaaucagggcgggcuggccacaugcucugacgugcggcaccccgcuagccucaccuccucuggaagcuccggcucuccuagcuccucuaucaagaugagcuccagcacaucuucccuuaccuccucuagcagcuuuuccgauggcuucaaaguccaagggcccgacacacgcaucaaggauaaagugguuacccaugugcagucuggaacggccgagcacagaccucggaacacccccuucaugggcauuauggacaagacagcccgcuuucagcagcaaagcaauccuccguccagaagcuggcauugucccgcuccugaagggcugcugaccaacacaucuuccgccgcgggacuccagagcgccaauaccgagaagcccucucugaugcaggucggcggguauaacaaucaagcuaaaacgugcagcguguccacacuuucugccagcgugcacaacggagcucagguuaaggaacuggaggaguccaaaugucagaucccuguccacucucaggaaaaucggauuaccaagacagugagccaucucuaccaagaguccaucagcaaacagcagccccacauuucuaacgaagcccauagaucccaccugaccgcggccaagccgaagcgcagcuucaucgaguccaacguguga

SEQ ID NO: 76583 - RNA, 5973 nt, Artificial Sequence
  derived and/or modified sequence opt5 from TANC2__Homo_sapiens__XP_005257260
auguucagaaacagccugaagaugcuccugaccggcgggaaauccucucggaagaaucgcagcuccgacggaggcucugaggaacccccugauagacggcagagcuccguggacucucgccaaagcagauccgggcagggaggcaucagcacagagucugauugcgccuuugaaccggacuacgcuguccccccucuucccguuuccgagggggaugccgaacaggagcugggaccucccccuagcguggacgaggcggcuaacacgcucaugacccggcugggcuuccuucugggcgaaaaagugacagagguccagccgggggaucaauauucuauggaagugcaggacgagaaucagaccuccgccauuacacagcgcaucagccccuguucuacccucacauccagcaccgccuccccucccgcuucuagcccuugcuccacgcugcccccgauuagcaccaacgccacagcuaaggauuguucuuacggagccguuaccuccccuacaagcacccuggagucuagagacagcggcaucauugcgacgcucacauccuauucugaaaauguggagcggaccaaauacgccggggaaagcuccaaggagcugggaagcggcgggaacaucaagcccuggcaaucucagaaauccagcauggauucuugccuuuaucgcgucgacgaaaauaugacagcuuccaccuacagccugaacaagaucccugagagaaaucucgagaccgugcugucccagucuguucagagcauuccccuuuaucugaugccccggccuaacuccguggccgcuacaucuagcgcccaccucgaagaucuggcguaccuggacgagcaacgccauacgccgcucagaaccucccugcggaugccccgccagagcaugggaggcgccagaacacagcaagaccuucgggucagauuugcuccuuaccgccccccugauaucucucugaaaccccuccuguucgaagugccguccauuaccacagagagcguguuugucggccgggacuggguuuuccacgaaaucgaugcccagcuucagucuuccaaugcuagcgugaaccaggggguggucauugugggaaauaucggcuuugggaagaccgccauuaucucuagacugguugcccucagcugucauggaacgcgcaugcggcaaaucgcuuccgacagcccucacgcgucucccaaacauguggaugccaacagagagcugccucugacacagcccccuuccgcucacagcuccauuaccucuggcagcugccccgggaccccggagaugcgccggagacaggaagaggccaugcgccggcucgccucccaggucguggcuuaucacuacugucaagccgacaaugcguauacaugccugguuccugaauucgugcauaacgucgcugcccuucuguguagaucuccccagcucaccgccuaccgcgagcagcugcuucgggaaccccaccugcagagcaugcucucccugagaucuugcgugcaagauccuauggcuagcuuucggcgcggaguccuggagccgcucgagaaccugcauaaggaaagaaagauccccgacgaggauuucauuauccuuauugacggccugaaugaagccgaguuucacaaaccugauuauggcgacacaaucguguccuuccucagcaagaugaucgggaaauuucccucuuggcugaagcugauuguuacggugcggaccucccuucaggagaucacaaaacuccugccuuuccacagaauuuuccuggaccgccucgaagagaacgaagcuaucgaucaggaccugcaggccuacauucuucaucggauccacagcucuuccgagauccaaaauaacauuagccugaauggaaagauggauaacaccacauuuggcaaacucucuucccaucugaagacccugagccagggguccuaucuuuaccucaagcugacguucgaccugaucgaaaaaggauaccucguccugaagagcucuagcuauaaagugguucccgugucccuuucugaggucuaccugcuccaguguaauaugaaguuuccuacccaaagcuccuucgauagagugaugccccugcugaacguggcgguugccucucuucacccgcucacagacgagcauauuuuucaggcuaucaaugccggcagcauugaagggacccuggagugggaagauuuccagcagcgcauggagaaccuguccauguuucucaucaaaagacgggacaugacacgcauguucguccacccuucuuuuagagaauggcugauuuggcgggaggagggcgaaaagaccaaguuccuuugcgauccccgcagcggacacacgcugcucgcuuuuugguucuccagacaagagggcaaacugaaucggcagcagacaaucgaacuggggcaucacauccuuaaggcccauauuuuuaaaggacucagcaagaaagugggcgugucuuccagcauccugcaggggcuguggauuucuuauuccaccgagggacucagcauggcgcuggccucccuucgcaaccuguacacaccuaauaucaaggucucuagacuccugauucugggcggggcuaacaucaauuaucggaccgaagugcuuaacaacgcccccauccugugcguucaaagccaccucggcuacaccgagaugguggcucugcuccuggaguucggagccaaugucgacgccuccagcgaaucuggccuuacaccgcugggguaugcugcggccgcuggauaccucuccauugugguucugcuguguaagaaacgcgccaagguggaucaccuugacaaaaacggccagugcgcccugguccaugcugcccucagagggcaccuggaggugguuaaguuccucauccagugugauuggacgauggcgggacagcaacagggcguguuuaaaaagagccaugcuauucagcaagcccugaucgccgcugccucuaugggguacaccgaaauugucagcuaucuucuggaccucccugagaaggacgaggaagagguggaacgggcgcagaucaauuccuucgauucucuguggggcgagacagcucugaccgccgccgcuggaagaggcaaacuugaagugugccgccugcuccuggagcagggggccgcugucgcccagcccaaccggagaggagcgguuccucucuuuagcacagugcgccaaggccacuggcagaucguggaccugcuucugacccauggggccgaugucaauauggcugacaagcagggacggacgccccugaugauggccgcuuccgagggccaccucgggacaguggauuuccugcuugcccagggcgccucuauugcucugauggacaaagaaggacucaccgcgcugagcugggccugucucaagggccaccuguccguugugagaagccuugucgauaacggggcugccaccgaccaugccgauaaaaauggacgcacaccccuggaccuggcugccuuuuacggcgaugcggaggugguucaauuccucguggaccacggggcuaugaucgaacaugucgauuauucuggaaugcggccucuggacagagccgugggcugccgcaacaccuccguuguggucacacuucugaagaaaggcgccaagauugggccggcuacgugggccauggcgaccagcaagcccgacaucaugauuauccuccuguccaaacucauggaggaaggagauauguuuuacaagaaaggcaaggugaaagaggcugcccagcgguaucaguacgcccugaagaaguucccuagagagggguuuggagaagaccuuaaaacauuccgggagcugaaggugucucugcuccugaaucuuagccgcuguagacggaaaaugaacgauuuuggcauggcugaagaguucgccaccaaggcucuggaacucaaacccaaguccuaugaggccuacuacgcgcgcgccagagcuaagcggucuagcagacaguuugccgcugcccuggaggaccucaaugaagccaucaaacugugcccuaacaaucgcgagauucaacggcuucugcugagagucgaagaggagugucgccagaugcagcagccccaacagccuccgcccccuccccagccucaacagcagcuccccgaagaggcugaaccggagccucagcacgaagauaucuauuccguucaagacauuuucgaggaggaauaccuggagcaggauguggaaaacgugagcaucgggcuucagacagaggcgcggcccucucagggacugcccgucauucaauccccucccagcucuccuccgcauagagacuccgccuauaucagcucuagcccccucggcucccaccagguguucgauuuucgcucuagcuccagcguuggcuccccuacccggcagacguaccagucuaccagccccgcucuguccccuacacaccaaaauucucauuauagacccagcccgccucacaccucccccgcccaucaggggggaucuuaccgcuucagcccucccccugugggcgggcagggaaaggaauaucccuccccgccucccagcccccugagacggggcccucaauaccgcgccucuccgcccgcugaguccaugagcgucuacagaucucaguccgggagcccugugcgguaucagcaggagacaucuguuucccaacuccccggacgcccuaaaagcccccuuuccaagauggcccagagaccuuaccagaugccgcagcugcccguggcggucccucaacagggccugcggcuccagcccgcuaaagcccagauugugagaagcaaccaaccuucucccgccguccacagcuccaccgugaucccgacaggcgcuuaugggcagguugcccacucuauggcgagcaaguaccaguccucucagggagacaucggcgugagccaaucccgccuggucuaucaggggucuauuggaggcaucgugggggauggacggccuguucagcaugugcaagccagccuuuccgcuggcgccauuugccagcacggcgggcugaccaaggaagaccucccccagagacccagcucugcuuaccgcggaggcguccgguauucccagacgccucaaaucgggagaagccagucugccuccuacuaccccgugugucauagcaaacuggaccuggagcgguccucuagccagcucggauccccugaugugagccaccuuauucgcagaccgaucucuguuaaccccaaugaaaucaagccucaucccccuacaccccggccgcugcugcacucccagagcgucggccuccgcuuuucuccuagcuccaacucuauuagcuccaccucuaaucugacccccacauucagaccuagcuccagcauccaacagauggagauuccccuuaaaccugcuuaugaacggucuugcgacgagcugucccccgugagcccgacccaggggggauacccuuccgagcccacgcgcucuagaacaacccccuuuaugggcaucauugauaagacagcccggacccagcaauauccucaccuccaucagcagaaccgcacaugggcggugagcuccgucgacaccgugcugucuccgacgagccccggcaaucugccucaacccgaauccuucagcccucccucuuccaucagcaacaucgccuuuuacaauaaaaccaacaaugcucagaacgggcaccuccuugaggaugacuauuacucuccucauggaaugcuggccaauggcuccagaggggaucugcucgaacggguuagccaggcuucuuccuaucccgacgugaaggucgccagaacacugccgguggcccaggcuuaccaagauaaccuuuaccgccagcugagccgggacucuagacagggacagaccagcccuauuaaacccaagcgcccuuucguugaguccaauguguga

SEQ ID NO: 76584 - RNA, 831 nt, Artificial Sequence
  derived and/or modified sequence opt5 from TANGO2__Homo_sapiens__NP_001270045
augugcaucauuuucuuuaaguucgaccccagaccugugagcaaaaacgccuaccggcugauccucgcugccaaucgcgaugaauuuuauuccagaccgucuaagcuggcggacuucuggggcaacaauaacgaaauucuuagcgggcuggauauggaggaaggaaaagagggcgggaccuggcucggaaucuccacacggggcaagcuggcugcccuuacgaauuaccugcagccccagcucgacuggcaggcccgcgggagaggagaacuggucacccacuuucugacaaccgauguugacucucucagcuaucugaaaaagguguccauggagggccaucuuuacaacggcuucaaucugauugcugccgaucucucuacagcuaagggggacgugaucuguuauuacggaaaccggggcgagccugaucccaucguccugaccccugggacauauggacuuagcaaugcccugcucgaaacccccuggcgcaaacugugcuuuggcaagcagcuguuccucgaggcgguggaaagaucccaggcccugccuaaagacguucuuauugcuagccugcucgaugugcugaacaaugaggaggcccaacuuccggaccccgcuaucgaagaucaagggggagaguacguccagccuaugcugucuaaguacgccgcgguguguguucggugccccggcuauggcacgcgcaccaacacaauuauccucguggacgccgacgggcacgucaccuuuacagaaagauccaugauggauaaagaccugagccauugggagacccggacguacgaguucacacugcagucuuga

SEQ ID NO: 76585 - RNA, 1278 nt, Artificial Sequence
  derived and/or modified sequence opt5 from TANK__Homo_sapiens__NP_004171
auggacaagaacaucggcgagcagcugaauaaagccuacgaggcuuucagacaagccugcauggaucgggacagcgcggugaaggaacugcagcagaaaaccgaaaacuaugagcagcgcauuagagaacaacaggagcagcugucccuucagcaaacaaucauugauaagcugaaaucucagcuccugcuugucaauagcacgcaggacaacaauuacggguguguuccccugcucgaggauuccgaaacccggaagaacaaucugacacuggaccagccucaagauaaggugaucucuggaauugcucgcgagaaacucccgaaggugagacggcaggaagucagcucuccccgcaaagagaccuccgccagaagccugggcuccccucuucugcacgagcgggggaacaucgaaaagacauuuugggaccucaaagaggaguuccauaagaucugcaugcuggccaaggcucagaaagaucaccuuagcaagcugaauauucccgacaccgccacagaaacccaauguucugugccuauccagugcacggauaaaaccgacaagcaggaagcucucuuuaaaccccaggccaaggaugacauuaaccgcggagcgccuuccaucacaagcguuaccccgagaggccugugucgggacgaggaggauacaucuuucgaaucccugagcaaauuuaaugugaaguuucccccuauggacaacgauucuaccuuccuccauuccacgcccgagcgcccugggauucugagccccgccacauccgaagcugucugccaagagaaguucaauauggaauuuagagacaacccgggaaauuucgugaaaaccgaggagacacuuuuugaaauccagggcauugauccuaucgccucugcuauccagaaccugaagaccaccgacaaaacaaagcccagcaaccucguuaauacguguauucggaccacacuggaucgcgccgcgugccuuccucccggcgaccacaacgcccuguaugucaauuccuucccccuccuggauccuagcgacgcuccguuucccucucuggauuccccugggaaagccaucagaggaccccagcaaccuauuuggaagcccuucccgaaccaggacagcgacucuguggugcucagcggcaccgauuccgagcugcauaucccucgggugugugaguucugccaggcugucuuucccccuucuauuacaagcagaggggacuuccuucgccaccucaauucccacuuuaacggagaaaccuga

SEQ ID NO: 76586 - RNA, 2562 nt, Artificial Sequence
  derived and/or modified sequence opt5 from TAOK1__Homo_sapiens__NP_079418
augcccagcaccaacagagccggcucccugaaggacccugagaucgcugaacucuucuuuaaagaggauccggaaaagcuguucacagaccuucgggagauugggcacggaucuuuuggcgccguguacuucgcgcgcgaugucagaacgaaugaaguuguggcuaucaaaaagaugagcuauuccgggaaacagucuaccgagaaguggcaagacauuaucaaggaggugaaauuucugcagcggauuaagcaucccaacagcaucgaauacaaaggaugcuaucuccgcgagcacacagccuggcuggucauggaauacugucuuggcuccgccucugaucugcucgaggugcauaagaaaccucugcaggagguugaaaucgcugccauuacccacggggcucugcagggacucgccuaucugcauagccacacaaugauccacagagacauuaaggcgggcaauauccuucugaccgagcccggccaagugaagcucgccgauuucggguccgcuagcauggccucuccugcuaacuccuuugucggaacacccuacuggauggccccugaagugauucuggcgauggacgagggccaguaugaugggaaaguugacguguggagccuuggaauuaccugcaucgaacuggccgagcggaagccgccccucuucaauaugaacgcuaugucugcccuguaccauaucgcucagaaugaguccccuacgcugcagagcaacgaauggucugauuacuuucgcaauuucgucgacuccugucuccagaaaaucccccaggauagaccuaccagcgaggaacugcuuaagcacauuuuugugcugcgggagcgccccgaaacagugcucaucgaccugauucagagaaccaaagacgccguccgggagcuugauaaccugcaguaucgcaagaugaaaaagcuccuguuccaagaggcccauaauggcccggcuguugaagcgcaggaggaagaggaggaacaggaccacggggugggaagaacaggcaccgugaacuccgucggcucuaaucaaagcaucccuuccaugagcauuucugccuccagccagucuagcuccgugaacucucugcccgauguuagcgacgauaaguccgagcucgacaugauggaaggggaucacacggugaugagcaauucuuccgucauccaucugaaaccugaggaagagaacuaccgggaggaaggagacccccgcacaagagcuagcgauccccagucuccuccccaggugucccggcacaagagccauuauagaaaccgcgagcacuuugccaccauccggacagccucccuuguuaccagacaaaugcaggaacaugagcaggacucugaacugcgcgagcagaugagcggcuacaaacggaugagacgccaacaccagaagcagcucaugacccuggagaauaaacuuaaggcugaaauggaugagcaccggcugagacucgacaaggaccuggaaacacagcgcaacaauuucgccgcggagauggaaaaacugauuaagaaacaucaagcugccauggagaaggaggccaaagugauguccaacgaagagaagaaguuccagcagcacauccaggcucaacagaaaaaggaacucaauucuuuucuggagagccagaaacgggaauauaaacuuagaaaggagcaacugaaggaguccaaggaacuccagauuaaaaagcaguuccaggauacgugcaaaauccaaacccgccaguacaaggcccugcggaaccaucugcuugagacaaccccgaaaagcgaacacaaggcuguccucaaaagacugaaggaggagcagacacggaagcuggccauucucgcggaacaguaugaccacucuaucaaugagaugcuguccacccaagcccuucgccuggaugaagcucaggaggccgaaugucaggugcucaaaaugcagcugcaacaggagcuggagcuucucaacgcuuaccagagcaagaucaaaaugcaagccgaagcgcagcaugacagagagcugcgggaacuggagcagagagucucucuccgccgggcccugcuugaacagaagauugaggaggaaaugcuggcucuccaaaaugagagaacggaacgcaucagaucccugcuggagcggcaggcccgcgaaauugaggcuuuugauagcgagucuaugagacuuggguucagcaacauggugcucuccaaucugagcccugaagccuuuucucacuccuaccccggagccagcggcuggucccauaacccuacagggggacccggcccgcacuggggccauccuaugggagggcccccucaggcuuggggccaccccaugcaagggggaccucaacccuggggccacccgucugggccuaugcagggcguuccccggggaagcuccaugggcgugcgcaauucuccccaggcgcugagacggaccgccagcgggggacgcaccgagcagggcauguccagaucuacaagcgucaccucccaaaucagcaacgggucucauauguccuauacauga

SEQ ID NO: 76587 - RNA, 3369 nt, Artificial Sequence
  derived and/or modified sequence opt5 from TAOK2__Homo_sapiens__NP_001238972
augcccgccggcgggagagcuggaagccugaaggacccugauguggccgaacucuucuuuaaagacgauccggaaaagcuguucuccgaccuucgggagaucggccacgggucuuuuggagcggucuacuucgcucgcgauguuagaaacagcgaagugguggccauuaaaaagauguccuauucuggcaaacagagcaaugagaaguggcaagacaucauuaaggaaguccgguuucugcagaaacuccgccaccccaacaccauccaguacagagggugcuaucugcgggagcacacagccuggcuugugauggaguacugucugggauccgcuucugaucuccuggaaguucauaagaaaccucugcaggagguggaaauugccgcugucacgcacggcgcccuccaaggccuggcguaucuucauagccacaauaugauccaccgcgacgugaaggccgggaacauccugcucuccgagcccggacugguuaaacuuggcgauuucgggagcgcuucuauuauggccccugcuaauuccuuugugggaacccccuacuggauggccccugaggucauccuggcgauggacgaaggccaguaugaugggaagguggacguguggagccucggaauuacaugcaucgagcuggccgaaagaaagccgccccuguucaacaugaaugcuaugucugcccucuaccauauugcucagaacgaguccccuguccugcagagcggccacuggucugaauacuuucggaauuucguugauuccugucuucagaaaaucccccaagaccgcccuaccagcgaggugcugcucaagcauagauuugugcugcgggagagacccccgacagucauuauggaccuuauccagcgcaccaaagaugccgugcgggaacuggacaaccuccaguaucgcaagaugaaaaagauccuguuccaagaggccccuaauggccccggggcugaagcgccugaggaagaggaggaagccgagcccuacaugcacagagcuggaacacugaccucccucgaaucuagccacuccguucccagcaugucuauuuccgccagcucucagagcuccucugugaacagccuggccgaugcuuccgacaaugaggaagaggaggaagaggaagaggaggaagaggaagaggaagagggcccugaggcccgggaaauggcgaugaugcaggagggggaacauacggucaccagccacucuuccaucauucauagacuuccgggaagcgauaaccuguaugacgaucccuaccaaccugagaucacacccucuccucuccagcccccggcugccccugcccccaccuccacaaccagcuccgcucgccggagagccuauugccgcaaucgggaccacuuugcuacgauuagaacagccucucuggugagccgccagauccaggaacaugagcaagauuccgcgcuucgggagcagcugucuggcuacaaaagaaugcgccggcagcaccagaagcaacuccuggcccuggaaagcagacuccgcggggagcgggaggagcacuccgcuagacugcagcgggaacuugaggcccagcgcgcuggauucggcgccgaggcggaaaagcuggccagacggcaucaggcuaucggcgagaaagaagccagagcugcccaagccgaggagcgcaaguuccagcagcacauucucgggcagcagaaaaaggaacuggcugcgcugcuugaggcccaaaaacggaccuauaagcucagaaaggaacagcugaaagaggaacugcaagagaacccuagcacacccaagcgcgagaaagcugaauggcuccugagacagaaggagcagcuucagcaaugucaggccgaagaggaagccggacugcuccggcgccagagacaguacuuugagcugcaaugccggcaguacaaacgcaagaugcugcuugcuagacauucucucgaccaggaucugcugcgggaggaccucaacaagaaacagacccaaaaggaccuggaaugugcccuucugcuccgccagcacgaggcgaccagagaacuggagcugcggcagcuucaagcuguucagcgcacaagagccgaacucacgcggcugcagcaccagaccgagcugggcaaucaacucgaguauaacaaaagacgcgaacaggagcugcggcagaagcaugccgcucaggugagacaacagccuaaaucccuuaaggaacgcagcaucgucgggcaggaggaggccggaacauggucucuguggggcaaggaagaugagucccuccuggacgaagaguucgaacuggggugggugcagggccccgcgcuuaccccggucccugaggaggaagaggaagaggaagagggagcucccauuggcacaccccgggauccuggggacggaugcccgagccccgauaucccucccgagccucccccuacccaccucagacccuguccggccucucaacugccuggccugcucagccaugggcugcuugccggacuguccuuugcugugggcucuagcuccgggcuccugccccugcuucugcuccugcuccugccucuucuggccgcucagggcggaggcgggcuccaggccgcgcugcuggcccuugaaguuggacuggugggccucggggcuagcuaccugcuccugugcacggcccuucaucugcccuccucucucuuccugcugcuugcucagggaacagcccugggcgccguccucgggcugagcuggcgccggggccucaugggagugccgcugggccuuggggcugcguggcugcuggccuggccuggacucgcucugccccuuguugccauggccgcuggcgggagaugggugcgccaacagggaccucgggucagacggggcauuucccgccuguggcucagagugcugcuccggcugucucccauggccuuucgcgcgcuucagggguguggcgcugugggagacagaggccuguucgcccuguaucccaaaaccaauaaggauggguuucggagcagacucccuguuccgggaccccgccggagaaacccucgcaccacacaacacccccuggcccuucuggcucgggucugggugcucugcaaaggcuggaauuggagacuggcccgcgcgucccaggggcucgcuucucaucugccucccugggccauccacacccuugccagcuggggacugcugcggggcgagagaccuacacgcaucccgagacuccugccccggucccagcgccagcuuggcccucccgcuagcagacaaccucugcccgggacgcucgccggacggcgcucuagaacccggcaguccagagcucugccgccuuggcgcuga

SEQ ID NO: 76588 - RNA, 2697 nt, Artificial Sequence
  derived and/or modified sequence opt5 from TAOK3__Homo_sapiens__NP_057365
augagaaagggcgugcugaaagaccccgagaucgccgaucucuucuacaaggacgauccugaagaacuguuuauugggcuucacgaaaucggacauggcagcuucggggcugucuauuuugccaccaacgcgcacacauccgagguuguggcuauuaaaaagaugucuuacagcggaaaacagacgcaugaaaaguggcaagacauccugaaggaggugaaauuccuccggcagcugaagcacccgaauaccauugaguauaaaggcugcuaccuuaaggaacauacagccuggcuggucauggaguauugucucggguccgccucugaucugcuggaagugcacaaaaagccccuccaggagguugagaucgcugccaucacccacggagcucugcauggccuugccuaccugcacagccaugcgcucauucaccgcgacaucaaggccggcaacauucugcuuacagaaccuggacaggugaaacuggcugauuuuggguccgccucuauggcuagccccgccaauuccuucgucggcaccccuuauuggauggcgcccgaggugauccucgccauggacgaagggcaauacgauggaaagguugacauuuggagccugggcaucacaugcauugagcuggcugaaagaaaaccuccgcucuuuaacaugaaugccaugucugcucuguaccacaucgcccagaacgauucccccacccuucagagcaaugaguggacggacucuuuccggcgcuuuguggauuauugucugcagaagaucccucaagagagacccaccuccgccgaacuccugcggcaugacuucguccgcagagaccggccucuucgcgugcugauugaucucauccagagaacaaaagacgcugugcgggagcuggauaaccugcaguaccgcaagaugaaaaagauucucuuucaggaaaccagaaaugggccccugaacgagagccaagaagacgaggaggauucugaacacggaacaucccuuaaucgggagauggacagccugggcuccaaccauucuaucccgagcauguccgucagcaccggcucucaguccagcucuguuaauagcaugcaggaagugauggaugaguccucuagcgaacucgugaugaugcacgacgaugaguccacgauuaacucuagcuccagcgucgugcauaagaaagaccacguuuucauccgcgaugaggcggggcacggagacccuagacccgaaccucggcccacacaaucugugcagucccaggcccugcauuauagaaaucgcgagcgguuugcuaccaucaagagcgccucccuugucacaagacagauucacgaacaugagcaagagaacgaacugcgcgagcagaugucuggcuacaaacggaugagacgccagcaccagaagcaacucaucgcccuggaaaacaaacugaaggcugagauggacgaacaccggcucaagcugcagaaagagguggagacccaugccaauaacagcuccauugaacuugagaagcuggcgaaaaagcagguugcuaucauugaaaaagaggccaagguggccgcugccgaugaaaagaaauuccagcaacagauccucgcucagcagaagaaagaccugaccacauuccuggagucucaaaagaaacaguauaagaucugcaaggagaaaauuaaggaagagaugaaugaagaucacagcacgcccaaaaaggagaaacaggaaagaaucuccaagcauaaagagaaccuucaacacacccaggccgaggaagaggcgcaucuccugacacagcagcgccuguacuaugacaagaauugucgguuuuucaagagaaaaauuaugaucaagcgccacgaagucgagcaacagaacauucgggaggaacucaauaaaaagagaacccagaaagagauggaacacgccaugcugauccggcaugaugagagcacacgcgaacuugaguacagacagcugcacacccuccaaaagcugcggauggaccugauuagacuucagcaucagacggagcucgaaaaccagcuggaguacaauaagcgccgggaaagagagcugcaccgcaaacaugugauggaacucagacaacagccuaagaaccugaaagcuauggagaugcagaucaagaaacaauuucaggauacaugcaagguccagaccaagcaguauaaagcccuuaagaaucaccaacuggaggugaccccgaaaaacgaacacaagacaauccucaaaacccugaaggacgagcagacacggaagcuggcuauucuugccgaacaguacgagcagucuaucaaugaaaugauggcgucccaagcccuccgccuggaugaggcucaggaggccgaaugucaggcucugagacuccagcugcaacaggagauggaacuucugaacgccuaucagagcaaaauuaagaugcagacggaggcccaacaugagcgggaacuccagaaacuggagcagcgcguuucucugagacgggcucaccuugaacaaaagaucgaggaggagcucgcggcccugcagaaagagcgcuccgaaagaauuaagaaucugcucgagcggcaggaacgcgagaucgaaaccuucgacauggagagccugagaaugggguuuggaaaccuugugacacuggauuuccccaaagaggacuaccgguga

SEQ ID NO: 76589 - RNA, 2427 nt, Artificial Sequence
  derived and/or modified sequence opt5 from TAP1__Homo_sapiens__NP_000584
auggccgagcugcucgcuagcgccggcuccgcgugcucuugggacuuccccagagcuccuccgagcuuucccccucccgccgccuccagagggggacugggcgggacccgcucuuucagaccucaccggggagcugaaagcccccgcccuggcagagaucgggacggggugcgcgucccgauggccuccucuagaugucccgcuccucggggaugccgcugucuucccggcgccagccuggcguggcucggcacaguucugcuucugcucgccgauugggugcugcugagaacggcucucccucggaucuuuucccugcuugugcccaccgcccugccgcuccugcgcgucugggcuguggggcuuagcagaugggccguucuguggcucggagcgugcggcgugcugcgggccacagucgggucuaaguccgagaacgcuggagcccagggcuggcuggcugcccucaaaccucuggccgcugcgcuugggcuggcccuccccggacuggcucuuuuccgcgaacugauuagcuggggcgccccuggcucugccgacuccaccagacuccugcauugggggagccaccccacagcuuuugugguuucuuacgccgcggcucugcccgccgccgcucucuggcauaagcugggaucccuuugggugccuggcgggcaaggaggcagcgggaauccgguccggagacugcucggaugucugggcuccgagacccgccggcuuucucuguuccucgugcuggugguccugagcucccucggcgaaauggccauccccuuuuucacagggagacugaccgauuggauucuucaggacggaagcgcugauacguuuacccgcaaccugacacucaugucuauccugaccauugccuccgcgguucuggaguucgugggcgacgggaucuauaauaacacaaugggacacgugcauagccaccuucagggcgaggucuuuggggccgugcuccggcaggaaaccgaguucuuucaacagaaucagacgggcaacaucaugucuagaguuacagaagauaccagcacacuguccgacucucugagcgagaaucucucccuguuccuuugguaccuggugcgcggacucugccugcugggcauuaugcuuugggggagcgucucucucaccauggugacccugaucacacugccucuccuguuccuucugcccaaaaagguuggaaaaugguaucagcuccuggaggugcaaguccgggaaucccuggcuaagagcucucagguggccauugaggcucuuuccgccaugccuacgguccggagcuuugcgaacgaagagggcgaagcccagaaguuccgcgagaaacuccaggagaucaagacccugaaucaaaaagaagcuguggccuacgcuguuaacuccuggacaaccucuauuagcgggaugcugcucaaggugggaauccuguauauuggcgggcagcuugucacauccggcgccgugucuagcggaaaucugguuaccuuugugcucuaccagaugcaauucacgcaggccgucgaggugcugcuguccaucuauccccgggugcagaaagcuguuggcagcucugaaaagaucuuugaguaccuugauagaacaccgcgcuguccucccuccgggcuccugaccccucugcaccucgaaggacugguccaguuccaagacgugagcuuugcguaccccaaccggccugaugugcuuguccugcagggccucaccuucacacugagacccggggaggugaccgcccugguuggaccgaauggcucugggaaguccacaguggcugcccuucugcagaaccucuaucagccuacgggcggacaacugcuccuggacggcaaaccccuuccccaguacgagcaucgguaucugcaccgccaggucgccgcuguggggcaggaaccucaaguuuuuggaagaagccuccaggagaauauugccuacggccugacccagaagccgacaauggaagagaucaccgcggcugccgugaaaucuggggcccauagcuucauuuccggacugccccagggcuaugacacagaagucgaugaggcugggagccaacuuucuggcggacagcggcaggccguggcgcuggcuagagcccucauccgcaagccuugcguucugauucucgacgaugccaccuccgcucuggacgccaacagccaacuucagguggagcagcugcucuacgaaucccccgagcgguauucuagaagcguccugcugaucacgcagcaccuuucccugguggaacaagcugaucacauccucuuucuggagggcggggccauucgcgagggaggcacccaucagcagcucauggagaaaaagggguguuacugggcgauggugcaggccccugcugacgcccccgaauga

SEQ ID NO: 76590 - RNA, 2112 nt, Artificial Sequence
  derived and/or modified sequence opt5 from TAP2__Homo_sapiens__NP_000535
augagacugcccgaccuccggccuuggaccagccugcuucugguggaugccgcucuccuguggcuucugcagggcccgcucgggacacugcugccccaaggacucccuggccuguggcuugaggggacgcugcgccucggaggccugugggggcuucugaagcucagaggacugcugggcuucgucggcacccuccugcuuccccugugccucgccacaccucugaccguuucccuucgggcgcugguggcuggggccucucgcgcucccccugcuagaguggccagcgcuccgugguccuggcuccuggucggauacggcgccgcggggcugucuuggagccucugggccgugcugucucccccuggagcucaggaaaaagagcaggaccagguuaauaauaaggugcuuauguggcggcugcucaaacugucccgccccgaucuuccucugcucgucgccgccuuuuucuuucuggugcuggccguucucggcgaaacacugaucccccacuauagcgggagagugauugacauccuuggaggcgauuucgacccgcaugcguuugccuccgcuauuuucuuuaugugucuguucagcuuugggucuucccucagcgccgggugccggggaggcuguuucaccuacacaaugucucgcaucaaccugcgcauucgggagcaacuguuuuccagccuucuccgccaggaucugggguucuuucaggaaaccaagacgggagagcucaauucuagacuguccagcgacaccacacugauguccaacuggcuuccucugaaugcuaacguccuccugcggucucuggugaaaguggucggccuuuauggguucaugcucagcaucucccccagacugacccugcucagccugcuucacaugccuuucacaaucgccgccgagaagguuuacaauaccagacaucaggaagugcugcgggagauucaagaugcuguggcgagagccggacaggucgugcgcgaagcuguuggcggccuccagacggugcggucuuuuggggccgaggagcacgaagucugcagauauaaggaggcccuggaacagugucgccaacuguacuggcggagagaccuugagcgcgcucucuaucugcuggugcggagaguucuccaucugggagugcagaugcuuaugcuguccugcggccuccagcaaaugcaggauggggaacugacacagggaagccugcuuucuuucaugaucuaccaggagagcgucggcuccuacgugcaaacccucgucuauauuuacggggacaugcugucuaacgugggcgccgcggagaaaguuuuuagcuauauggaucgccagcccaaucugcccuccccuggaacacucgcuccgaccacccugcagggcguggucaaguuccaggacgugagcuuugccuaccccaaccggccugacagacccguucuuaaagggcugacauucacgcuccgcccuggagaagugaccgcccuggucggccccaaugggucuggaaaguccacaguggcugcccugcuucaaaaccuguaucagccgaccggcggccaggugcuccuggaugagaaaccuaucagccaguacgaacacuguuaucuccacucucaaguugucuccgugggccaggagcccgugcuguuuagcggauccguccggaauaacauugcuuacggccuucagucuugcgaagacgauaaggugauggccgcggcccaggcugcccaugcugacgauuucauccaagagauggagcacgggauuuacacagacguuggagaaaagggcagccagcuggccgcggggcagaaacaaagacucgccaucgcucgggcccuggugcgcgauccuagaguccugauccuugacgaggcuaccuccgcccuggaugugcagugugaacaggcccuccaggacuggaacucucggggagauagaacgguucuggugauugcucaucgccuccaagcgguccagcgggcccaccagauccuggugcuucaggagggcaagcugcaaaaacucgcucagcugcaggaagggcaggaccuguauagcagacuuguucaacagcgccugauggacuga

SEQ ID NO: 76591 - RNA, 1347 nt, Artificial Sequence
  derived and/or modified sequence opt5 from TAPBP__Homo_sapiens__NP_003181
augaaaagccugucccuccugcuugccguggcucugggccucgccaccgcggucucugcugggcccgccguuaucgagugcugguucguggaagacgccagcggaaagggccuggcuaagagaccuggggcccuucugcuccggcagggaccgggcgagcccccuccccgcccugaucuggaccccgaacuguaccucuccgugcacgauccugcuggggcccugcaagcggccuuuagacgguauccgcgcggagcucccgccccucauugugagaugucuagauucgucccccuuccugcuagcgccaaaugggcguccggccugacacccgcccagaacugcccgcgggcucucgacggcgccuggcugauggugucuauuagcuccccuguucuuagccugucuucccuccugcgcccccagccugaaccccagcaagagcccgugcugaucacgauggcuaccgucgugcucacaguucugacccacaccccugccccgagagugcggcuugggcaggaugcccugcucgaccugagcuuugcuuacaugcccccuacaucugaggcggccuccagccuugcucccggaccucccccguucggccuggaauggcgcagacagcaucucgggaagggacaucugcugcucgccgccacaccuggccugaaugggcagaugcccgcugcccaagagggagcggucgcuuuugccgccugggaugacgaugaaccuuggggccccuggaccggcaacgggacguucuggcuuccuaccgugcagcccuuucaggagggaacauaucuggcuaccauucaccucccguaccugcagggccaagugacacuugagcuggccgucuauaaaccucccaagguuucucucaugcccgcuacccuggcccgggcggccccuggggaagcuccgcccgagcugcucugucuggugucccacuucuacccuagcggaggccuugaaguggagugggaacugcgcgggggacccggcggcagaucccagaaggccgaggggcagcgguggcucucugcucugcgccaccauagcgacggauccgucagccugucuggccaccuucaaccucccccugugacgacagagcagcauggggccagauaugcgugccggauccaccaccccucccucccggccagcggaagaucugcugaaguuacccuggagguggccggccugagcgggccuucccucgaagauucugucggccuguuucuuagcgcuuuccugcuccugggacuguuuaaagcccuuggcugggccgcuguguaccucuccacauguaaggacagcaaaaagaaagcggaguga

SEQ ID NO: 76592 - RNA, 1407 nt, Artificial Sequence
  derived and/or modified sequence opt5 from TAPBPL__Homo_sapiens__NP_060479
augggcacccaggagggguggugccugcuccugugucuugcccugagcggagcugccgaaacaaagccccacccugcggagggccaauggagagcuguggacgucguucucgauugcuuccuggccaaagacggggcccaucggggagcucuugccuccucugaagaucgcgcuagagccagccuggugcucaaacaggugccgguccuggacgauggcucccuggaggacuuuacggauuuccaagggggaacccucgcgcaggacgaucccccuaucauuuuugaagccucuguggaccugguucagaucccccaggcugaggcccuucugcacgcugauuguagcggcaaggaggugacaugcgaaauuucccgguacuuccuccagaugaccgagacaaccgucaagacagccgcgugguuuauggccaacaugcaagugucuggcgggggaccuagcaucucccugguuaugaaaacgccccgcgugaccaagaaugaagcucuuuggcauccuacccugaaccucccgcugagcccccagggcacagucagaaccgccguggaguuccaggugaugacacagacccagucucuguccuuucuccuggggagcucugcuucccuugacuguggauucagcauggccccuggccuggaucucauuucugucgaguggcggcugcaacacaaggggcgcggacagcuuguuuauuccuggacggccggccagggccaagcugugagaaaaggggcgacacuggaacccgcccagcucggaauggcucgggacgccagccugacccugccuggccucacaauccaggacgaggggaccuacaucugccagauuaccacaucccuguaucgcgcccaacagaucauucagcuuaauauccaggcuucucccaaggugagacugagccucgccaacgaagcgcugcuuccgacgcugauuugugauaucgcuggauacuauccucucgacgucgugguuaccuggacacgggaggaacugggcgggucccccgcccaagugagcggagccucuuuuuccagccugcgccagucugucgcuggcaccuacagcauuuccucuagccucacagccgagccuggcuccgcuggggccaccuauacgugccaggugacacauaucagccuggaggaaccccuuggagcgucuacccagguugugcccccugagagacggaccgcccugggcgucaucuucgcuuccagccucuuucugcuggcccuuauguuccucgggcugcaacgcagacaggcuccgacaggacugggccuccugcaggccgaacggugggagaccacaucuugugcggauacgcaguccagccaccuucacgaagacagaaccgcccgcgugucccaacccucuuga

SEQ ID NO: 76593 - RNA, 4866 nt, Artificial Sequence
  derived and/or modified sequence opt5 from TARBP1__Homo_sapiens__NP_005637
auggagugggugcuggccgaagcucuccugagccaguccagagacccccgggcccuucugggcgcgcucugccaaggggaggcuucugccgaacgcgucgagacccugagauuccuucugcagcggcucgaagaugaggaggcccgcggaagcggcggggcuggagcccugccugaagcugccagagagguugcggccggcuaccuggugccgcuccugcggucccuucgcgggagacccgcuggaggcccugaccccucucugcagccucggcaccgcagacgggugcuccgcgccgcuggcgccgcgcugagaagcuguguccggcuugccgggcgcccccagcuggcugccgcucucgccgaagaggcccugagagaucugcucgcuggauggcgggcgccuggcgccgaggcugccguggaaguucuggccgcuguggggccgugccuuagaccccgcgaggacggaccucugcucgaacgggucgccggcacagcgguggcucuggcccuugggggaggcggcgauggggacgaggccggacccgcugaagaugccgcugcccugguugcgggcagacuccugccugugcugguccaaugugggggagccgcucuccgcgccguguggggcgggcuggcugcccccggagcgucccuuggcucuggccggguggaggagaagcugcucguccugagcgcccuugcugaaaaacugcucccggagccugggggagacagagcccgcggcgcucgggaagccgggcccgaugccagacgcugcuggcgguuuuggagaacgguucaggcuggacugggccaggcggacgcccugacccgcaagcgggcuagauaucuccugcagcgggccguggagguguccgccgaacuuggggcugauuguacaugcggcccucaagagggaaacggccccagccuguucugguggucugagcgcaaaaaggacgaacuccugaaauuuugggagaauuacauccugauuauggaaacccuugaggggaaccagauccaugucauuaagcccgugcucccuaagcugaauaaccuguucgaauaugccguuuccgaggagaauggauguuggcucuuucacccgagcuggcauaugugcaucuacaaaagaauguucgaaucugagaacaagauucuguccaaagaaggcgugauccacuuucuugagcuguaugagacaaagauccuccccuucagcccugaauuuucugaguucauuaucgggccccugauggaugcgcuguccgaaagcucccuuuacucucggagcccuggacagcccauuggcuccuguagcccgcucgggcugaaacugcagaaguuucucgucaccuauaucucucugcuuccugaggaaauuaaguccagcuuccugcucaaauuuaucagaaagaugacaucucgccauuggugcgcugugcccauucuguuccugagcaaagcccuugccaauguuccucggcacaaggcucucggcaucgacggacugcuggcccucagagacgugauccacuguaccaugauuacgcaucaaauccugcuucgcggcgcggcucagugcuaccugcuccagaccgccaugaaccugcuggaugucgagaaagugucccuuucugacgucagcacauuccucaugucccugagacaagaggaaagccuggggcggggaaccucucucuggacagagcugugcgauuggcuucgcgugaaugaauccuacuuuaagcccagcccuaccuguucuuccauuggccugcacaaaacgagccucaacgccuauguuaaguccaucgugcaggaguacgucaagucuagcgcuugggaaacaggggagaauugcuucaugcccgacugguuugaggccaaacuggugucccugaugguucuucuggcuguggaugucgaaggaaugaagacccaguauucuggcaaacagagaacagagaacgugcuccggauuuuccuggacccgcuccuggaugugcuuaugaaguuuagcaccaaugccuacaugccucugcucaaaaccgaccgcugucugcaacugcuucugaagcuccugaacacaugcagacucaagggguccagcgcgcaggaugacgaaguuucuacgguccugcagaauuucuuuauguccaccacagagagcaucucugaguucauccuucggcgccugaccaugaacgagcucaacuccgugagcgaucuggacagaugucaucuguaucuuauggugcugacagagcucauuaaucugcaccucaaagucggcuggaagcggggaaaccccaucuggcgcgugauuucucugcuuaaaaaugccagcauccagcaucugcaagaaauggacuccggccaggagcccaccguugggagccagauucagagaguggucucuauggcugcccuggcuauggugugcgaagccaucgaucaaaagccugagcuccagcuggacucccuucacgccggaccgcuggagagcuuucucuccucucugcagcucaaccagacgcugcaaaaaccccacgcugaagaacagagcuccuacgcgcauccucuugaauguucuagcguucuggaggaauccucuagcucccagggcugggggaagaucguggcccaauauauucacgaucagugggucugccugagcuuccuccugaagaaauaccauacacuuauccccaccaccggaucugagauucuggagccuuuucuccccgcugugcagaugccuauccggacacugcaguccgcccucgaagcccugaccguucuuagcucugaccaagugcugcccgucuuccacugucugaaggugcucgugccgaaacugcuuacauccagcgagucucugugcauugaauccuuugauauggcuuggaagaucauuagcucccucagcaauacgcagcugaucuucugggccaaccucaaagcguucguccaguuuguuuucgacaauaaggugcugaccaucgcugccaagauuaaaggccaggccuacuuuaagaucaaagagauuauguauaagaucauugaaaugucugcuaucaaaacagggguguucaacacccuuaucagcuacuguugccaauccuggauugucucugccagcaaugugucccagggcucucugagcuccgcgaagaacuauucugagcugauccucgaggcuugcauuuuuggaacaguuuucagacgcgaucagcggcuggugcaggacguccaaaccuuuaucgaaaaucuuggccacgauugugccgccaacauugugauggagaauacgaaaagagaagaccauuacguucgcaucugcgcugugaaguuccugugucuccuggaugggagcaacaugucccacaagcuguuuaucgaggaccucgccauuaaacuucuggauaaggacgaacuggucagcaaaucuaagaaacgguauuacgugaauagccuccagcauagaguuaagaaccgcguguggcagacccugcuuguccuguucccucggcucgaccaaaacuuucugaauggaaucauugauagaaucuuccaggcuggcuuuacaaacaaucaggccagcauuaaguauuucaucgaguggaucauuauccugauucuccacaaauucccccaguuucuuccuaaguucugggacugcuuuucuuacggggaggaaaaccugaaaaccuccaucuguacauuccuggcggugcucagccaccuggauauuaucacccaaaauauucccgagaagaaacuuauccugaagcaggcccucaucgugguccugcaguggugcuuuaaccauaauuucuccguucgccuguacgcucucguggcccuuaagaaacuguggacgguguguaagguccugucuguggaagaguuugacgcucucacaccgguuauugagagcucccugcaccagguggaaagcaugcauggagccggcaacgccaaaaagaauuggcaacggauccaggagcacuucuuuuucgcuaccuuucauccucuuaaagauuauugccuggaaacaauuuucuacauccuccccagacugucuggccugauugaggacgaauggaucaccaucgauaaguucacccgguuuacagacgucccucucgcggccggguuccagugguaucuuucccagacgcaacugagcaagcugaaacccggagauuggucucagcaggacauuggcaccaaccucguggaggcugauaaucaggccgaguggacagacguucaaaagaaaaucauucccuggaacagccgcguguccgaucuggaccuugaacugcucuuucaggacagagccgcucggcuggggaagucuaucagccgccugauugucguggccucccucaucgauaaaccuaccaaucuuggaggccuguguagaacaugcgaggucuucggggcgucugugcugguugugggaagccuccaguguaucuccgacaagcaauuucagcaccugagcgucucugcugaacaguggcuuccgcugguggagguuaaacccccucagcucauugauuaccugcaacagaagaagaccgaaggcuauacgaucauuggcguggagcagacagccaaaucccuggaccucacccaguacugcuuccccgagaagucccuucugcugcucgggaacgaacgggagggaaucccugccaaucugauucaacagcuugaugucugcguggaaaucccccagcagggcauuaucagaucccugaacgugcacguuucuggggcucuccugaucugggaguauacccgccaacagcugcucagccauggagacacaaaaccuuga

SEQ ID NO: 76594 - RNA, 1101 nt, Artificial Sequence
  derived and/or modified sequence opt5 from TARBP2__Homo_sapiens__NP_599150
augagcgaggaagaacagggcuccgggaccacaacgggaugcggccugcccucuaucgaacaaaugcucgccgcuaacccugggaagaccccgauuagccugcuucaggaguacggaacaagaaucggcaaaacccccguguaugaccugcucaaggccgaagggcaggcgcaccagccuaauuucacauuucgggucaccguuggagauacauccuguaccggccaaggccccucuaaaaaggcugccaaacauaaggccgcugagguggcccugaagcaccuuaaagggggaagcaugcuggagccugcucucgaagacuccucuagcuucuccccucuggauagcucucugcccgaggacauuccgguguuuacggccgcggccgcugccacccccgucccuuccgugguucucacacgcucucccccuauggaacugcagcccccggugagcccucagcaguccgagugcaaccccgucggcgcccuucaagagcuggugguucagaagggguggagacucccugaauacaccgugacacaggagagcggacccgcucaucggaaagaguucaccaugacgugucgcgucgagagauuuaucgaaauuggcucugggacauccaagaaacuggcgaagcggaaugccgcugccaagaugcuucugcgcgugcacaccgugccccucgaugcuagagacggaaacgaggucgagccugaugacgaucauuucagcaucggcguuggcucccggcuggacgggcugcgcaauagaggaccgggcugcacaugggauucucuccggaacagcgugggggagaaaauccugucccuucgcagcuguucucugggaucccucggcgcccuggggcccgccugcuguagagugcuuagcgagcugucugaagaacaggcuuuucacgucagcuaucucgacauugaggaacugucccugucuggacucugccaaugucugguggagcuuagcacccagccugcgaccguuugccacggcuccgccacaacgcgggaagcugcccgcggcgaggccgcuagacgggcccugcaguaccucaagaucauggcggggagcaaauga

SEQ ID NO: 76595 - RNA, 924 nt, Artificial Sequence
  derived and/or modified sequence opt5 from TARP__Homo_sapiens__XP_011513708
auguucaucggcaacagcccccugcuccugaccguggggcuuggacuguccaaggucgagcaguuucaacucucuauuagcacagaaguuaaaaaguccaucgacauuccuugcaaaaucucuagcacgagauucgagaccgaugugauucacugguaccggcagaagccgaaucaggcccuggaacaucuuaucuauaucguguccacaaaaucugcugcccgcagaagcaugggcaagaccuccaacaaggucgaggcgcggaaaaauagccagacacugaccucuauucucacaaucaaguccguggaaaaagaggacauggcuguuuacuauugugccgccugggauuuugggcacuacaagaaacuguucggaagcggcaccacgcugguggucaccgacaagcaacucgaugcugacgugucucccaagccuacaauuuuucugcccuccaucgccgagaccaaacuucagaaggcugggacauaucugugccuccuggaaaaauucuuuccugauguuauuaagauccauuggcaggagaaaaagagcaacaccauucuuggaucucaggaaggcaauacgaugaaaacaaacgacaccuacaugaaguucuccuggcugacagugcccgaaaagagccucgauaaagagcaccgcuguaucgucagacaugagaauaacaagaauggcguggaccaagagaucauuuuuccuccgaucaaaaccgaugugauuaccauggaccccaaggauaacugcuccaaagacgccaaugacacacugcugcuccagcugacgaacaccucugcguauuacauguaccuucugcuccugcuuaagagcgucguuuauuucgccaucauuacauguugccugcuccggcgcaccgcuuuuuguugcaauggggaaaaguccuga

SEQ ID NO: 76596 - RNA, 2172 nt, Artificial Sequence
  derived and/or modified sequence opt5 from TARS__Homo_sapiens__NP_001245366
auguucgaggaaaaggccagcucccccucuggcaaaaugggaggggaggaaaagccuaucggcgcuggggaggaaaaacagaaggagggaggcaaaaagaagaacaaagaggggagcggagacggcggcagagccgaacugaauccguggcccgaguacauuuauacccggcucgaaauguacaacauccugaaggcggagcacgauuccauucuugcugagaaagccgaaaaggacucuaaaccuaucaaggugacacugcccgaugggaagcaagucgacgccgagagcuggaaaacgaccccuuaucagauugcuugcggaaucucccagggccucgccgauaauacaguuaucgcuaaggugaacaauguggucugggaccuggaucgcccccuugaagaggacuguacccuggaacuccugaaauuugaggaugaggaagcccaggcgguguacuggcauucuagcgcccacauuaugggggaggcuauggaaagaguuuauggaggcugccuguguuacgggccuccgaucgagaacggauucuauuacgacauguaccucgaagagggcggcguguccagcaaugauuuuucuucccuggaggcccuuugcaagaaaauuaucaaggaaaaacaggcuuucgagcggcuggaagucaagaaggagacacuccuggccauguuuaaauauaacaaguucaaaugucgcauucuuaaugaaaaggugaacacccccacaaccacgguuuacagaugcgggccucugaucgaccucugucggggaccccaugugcgccacaccggcaaaauuaaggcgcugaagauccauaaaaauagcucuacauauugggaggggaaggccgauauggagacccugcaaagaaucuacggaauuuccuuuccugaccccaaaaugcucaaggaaugggagaaauuccaggaagaggcuaagaaccgggaccaccgcaagaucggcagagaucaggagcuguauuucuuccacgaacuuagcccggggucuugcuuuuuccugccuaaaggagccuacauuuauaaugcucucaucgaguuuauucgguccgaauaccgcaagagaggcuuccaagaggucgugacacccaacaucuucaauagccggcuguggaugaccuccggccauuggcagcacuacucugaaaacauguuuagcuucgagguggagaaagaacuuuuugcccugaagccuaugaacugucccgggcauugccucauguucgaccaccgccccagauccuggcgggagcugccucugagacucgccgauuuuggaguccugcaccgcaaugaacuuagcggcgcucugacggggcucacacggguuagacgcuuccagcaggacgaugcgcauaucuuuugugccauggagcaaauugaagacgagaucaaaggaugccuggauuuccuucggaccguguauucuguguuuggcuucuccuuuaagcugaaccucagcacaagaccggagaaguuccugggggacauugaagucugggaucaggcugagaaacagcuggaaaauucucucaacgaguuuggcgaaaagugggagcugaauagcggagacggcgccuucuacgggcccaaaaucgauauucaaaucaaggacgccaucggacgcuaucaccagugcgcuaccauucagcuugacuuccagcugccuauccgguuuaaccucaccuacgugucccaugauggcgacgauaaaaagagacccguuauugugcaccgcgccauccuggggucugucgagcggaugauugcgauccugacagaaaauuauggaggcaaauggccuuucuggcuuagccccagacaagugaugguugugccggucgggccuacgugugacgaguacgcucagaaggugcgccagcaguuucaugaugccaaguucauggccgacauugaucucgaccccggcugcacccugaacaaaaagauccggaaugcucaacuggcccaguauaacuuuauccucgucgugggagaaaaagagaagauuuccggcacaguuaauaucagaacccgggauaacaaagugcacggggagcgcacaauuagcgaaaccaucgagagacugcagcagcuuaaggaauuucggucuaagcaagcugaggaagaguuuuga

SEQ ID NO: 76597 - RNA, 2409 nt, Artificial Sequence
  derived and/or modified sequence opt5 from TARSL2__Homo_sapiens__NP_689547
auggccgcugaggcccuggcggcugaagccguggccagcagacucgagcggcaggaagaggacauccgcuggcugugguccgaagucgagagacuucgggaugagcaacugaacgcucccuacucuugccaggccgaaggcccuugucucacccgcgagguugcucagcugagagccgaaaauugcgaccuucggcaccgccuguguagccucagacugugccuggcggaggagcggucccgccaggccacacucgaaucugcugagcuggaagccgcucaagaggccggggcgcagccgcccccuagccagucccaggauaaggacaugaaaaagaaaaagaugaaagaaucugaggccgauagcgaggugaagcaucaacccauuuucaucaaggaaagacuuaaacuguuugagauucucaagaaagaccaccagcugcuucuggcuaucuauggaaagaaaggcgauacguccaacauuaucaccgugcgggucgccgacgggcagacagugcagggagaaguuuggaagaccacaccuuaccaaguggcugccgagaucagccaggaacucgccgagucuaccgucauugcuaaggugaauggcgagcugugggaucuggaccgcccccucgaaggggauuccagccuggagcuucugacauucgacaacgaagaggcgcaggccguuuauuggcauucuuccgcucacauccucggagaagccauggagcuguacuauggcggccaucuuuguuacgggccuccgauugagaauggauuuuauuacgauauguucaucgaagacagagccgugagcucuaccgagcuguccgcucucgaaaacauuugcaaagccaucauuaaggagaaacaacccuuugagcggcuggaagucagcaaggagauccugcucgaaauguucaaauacaauaaguuuaaaugucgcauccugaacgagaaggugaauacggcgaccacaaccguguauagaugcggcccucuuauugaccuguguaaggggccccacguccggcacacaggaaaaaucaagaccauuaaaaucuucaagaacuccucuacguacugggaaggcaauccugagauggagacacuccagagaauuuaugggaucagcuuucccgauaacaaaaugaugcgcgacugggaaaaguuccaggaggaagcuaagaaucgggaucauagaaaaaucggaaaggagcaggaacuguuuuucuuucacgaccuuuccccgggcagcugcuucuuccugccucgcggcgccuuuauuuacaacacccucacagauuucauccgggaggaguaucauaaaagagacuuuaccgaaguucugucucccaauauguacaacuccaagcugugggaggccagcgggcacuggcaacacuauucugaaaacauguucaccuuugagauugaaaaagauacauucgcucucaagccuaugaauugucccggacauugccugauguuugcccaccgcccccggagcuggagagagaugccuauccgcuucgcugacuuuggcgugcuucaucggaacgagcuguccgggacgcucucuggacugaccagagugcgccgguuccagcaggaugacgcccacaucuuuugcacagucgaacagauugaggaagagaucaagggcugucugcaauuccuucagagcguguacuccaccuuuggguucagcuuccagcucaaucugucuacaagaccggagaacuuucugggagaaauugagauguggaaugaagcggagaaacagcuccaaaacucccugauggauuucggcgaacccuggaagaugaauccuggcgacggggccuuuuacggacccaaaaucgacauuaagaucaaagaugcuauuggccgguaucaucagugcgccaccauccagcuugacuuccagcugccuauucgcuuuaaccucacguacguuagcaaggauggggacgauaagaaaagacccgugaucauccaccgggcuauucugggaucugucgagagaaugaucgccauucuguccgagaauuauggcgggaaguggccguucuggcuuagcccucgccaagugaugguuauccccgugggcccuacaugugaaaaauacgcgcuccaggucuccucugaguuuuucgaagagggauuuauggccgacguggaucuggaccacagcugcacccugaacaagaaaauucggaaugcucagcucgcccaauauaacuucauccuggucgugggcgaaaaggagaaaaucgauaaugcuguuaacgugagaacccgcgacaauaagauucauggggagauccuugucacauccgccauugauaagcugaaaaaccucagaaagacccggacacugaacgccgaagaggcuuuuuga

SEQ ID NO: 76598 - RNA, 924 nt, Artificial Sequence
  derived and/or modified sequence opt5 from TAS2R10__Homo_sapiens__NP_076410
augcugagaguggucgagggcaucuucauuuuuguuguggugagcgaauccgucuucggggugcucggaaacggcuuuaucgggcugguuaauugcauugacugugccaagaacaaacuuucuaccaucggauucauucugacaggccucgcuaucagccggaucuuucugauuuggaucauuaucacggauggguucauucagaucuuuucccccaauauuuacgccucuggaaaccuuaucgaguauaucagcuacuucugggugauuggcaaucaauccucuaugugguuugcgaccagccuguccaucuucuauuuucucaagauugcuaacuucagcaauuacaucuuucuguggcugaaaucucgcacaaacaugguccucccuuucaugauuguguuccugcuuaucuccagccugcucaauuuugccuauaucgccaagauucugaacgacuacaaaaccaagaaugauacaguuugggaccuuaacauguauaagucugaauacuucaucaaacagauucugcucaaucugggcgugaucuuuuucuuuacccugucccucauuacaugcaucuuccugaucauuagccuuuggagacacaaccggcagaugcagucuaaugucaccgggcugcgcgauuccaacacggaggcucaugugaaggccaugaaagugcucaucagcuuuauuauccuguucauucuuuacuuuaucggaauggcuauugaaaucuccuguuucaccgucagagagaacaagcugcuccugauguuuggcaugacaaccacagccaucuauccgugggggcacucuuucauucugauccucggaaauagcaaacugaagcaagcgucccuucggguucugcagcagcucaagugcugugagaaacgcaagaaccugagagugaccuga

SEQ ID NO: 76599 - RNA, 912 nt, Artificial Sequence
  derived and/or modified sequence opt5 from TAS2R13__Homo_sapiens__NP_076409
auggagagcgcccugcccuccaucuucacccucgugauuaucgcugaauuuauuaucggcaaccugucuaauggguucauuguccuuaucaacugcaucgacuggguuagcaagagagagcuguccucuguggauaaacuccugauuauccuugccauuagccggaucggacugauuugggaaauccucguguccugguuucuggcgcugcacuaccucgcuauuuucgucucuggcacagggcugcgcaucaugaucuuuagcuggauuguguccaaucauuucaaccuuuggcuggccacgaucuuuagcauuuucuaucuccugaagaucgccucuuuuuccagcccugcuuuccuuuaccugaaauggagaguuaauaaggugauucucaugauccugcugggaacccucgucuuucuguuccuuaaccugauccagauuaauaugcacaucaaagacuggcucgaucgguaugagcgcaacacaaccuggaauuuuucuauguccgacuucgaaacauucagcgugucuguuaaguuuaccaugacaauguucucccugaccccguuuacgguggccuucauuagcuuucuucugcucaucuucucccugcaaaagcaucugcagaaaaugcagcucaacuacaagggccacagagauccccggaccaaaguccauacaaaugcucugaagauugugaucucuuuucuucuguucuaugccagcuuuuuccucugugugcugaucuccuggauuagcgagcuuuaccagaacaccgucaucuauaugcugugcgagacaauugggguguuuucuccuuccagccacucuuuccuccugauccugggaaaugcgaaacuccgccaagccuuucugcuuguugcugccaaggugugggcuaagagauga

SEQ ID NO: 76600 - RNA, 954 nt, Artificial Sequence
  derived and/or modified sequence opt5 from TAS2R14__Homo_sapiens__NP_076411
augggcggggugaucaagagcauuuucaccuuuguccugaucguugaguucauuaucggaaaccucggcaauuccuuuauugcccuggugaacugcaucgacugggugaaagggagaaagaucucuagcgucgaucggauucuuacagcucuggccaucucccgcauuucucucguguggcugaucuucggaagcugguguguuuccguguuuuuccccgcgcuuuuugcuacggagaaaauguucagaaugcugaccaauauuuggacagucaucaaccacuuuucuguguggcucgccaccggccuggggacauucuacuuucugaagauugccaauuucagcaacuccaucuuucucuaucugaaauggcggguuaagaaggugguccuugugcugcuccuggugaccagcgucuuccuuuuccugaauaucgcucucauuaacauccauauuaaugccucuaucaacggauaccgcagaaauaaaacaugcuccagcgacucuuccaacuuuacccgguucagcucucugauuguucugacguccaccguguuuaucuucaucccuuuuacacucagccuggcuauguuccuucugcucaucuuuuccauguggaagcaccgcaaaaagaugcagcauaccgugaaaauuucuggcgaugccagcacaaaggcgcacagaggcgucaaguccgugauuaccuucuuucugcuuuaugccaucuucagccuguccuuuuucauuucuguuuggacgagcgaacggcucgaagagaaucugaucauccugucucaagugauggggauggcuuacccgagcugucauuccugcguccucauucugggaaacaaaaagcugcgccaggccucucuuagcgugcuccuguggcuuagauauauguuuaaagacggcgaacccuccgggcacaaggaguuccgggagagcucuuga

SEQ ID NO: 76601 - RNA, 876 nt, Artificial Sequence
  derived and/or modified sequence opt5 from TAS2R16__Homo_sapiens__NP_058641
augauccccauucagcugaccguguucuuuaugaucauuuacguccucgagagccugacaaucauuguucaauccucucuuaucguggccgugcugggcagagaauggcuccagguccggcgccugaugccuguggacaugauccuuauuagccuggggaucuccagauucugccuccagugggcuucuaugcugaacaauuuuuguagcuauuucaaccugaauuacguucucugcaaccugacgauuaccugggaguuuuucaauauccuuacauuuuggcugaacucccuccugaccguguucuauuguauuaaggucucuagcuuuacacaccauaucuuccuuuggcugcgguggcgcauucucagacuguuuccguggauccugcucggaucccugaugauuaccugcgugacaaucauccccagcgccauuggcaauuacauccagauucaacuucugaccauggaacaccucccucggaacucuacgguuaccgauaaacuggagaauuuccaucaguaucaguuucaggcgcacacaguggcucuugucauccccuucauccuguuccucgccuccaccauuuuucugauggccagccugacaaagcaaauccagcaucacucuaccgggcacuguaacccuuccaugaaagcucgcuucacggcccucagaagccuggcugugcuuuuuauuguguucacaucuuacuuucugaccauccucauuacaaucaucggaacccuguucgacaagcggugcuggcuuugggucugggaagccuuuguuuaugcguucauucugaugcauuccaccagccucaugcuguccucucccacacugaaacgcauccucaagggcaaguguuga

SEQ ID NO: 76602 - RNA, 900 nt, Artificial Sequence
  derived and/or modified sequence opt5 from TAS2R1__Homo_sapiens__NP_062545
augcuggaaagccaccucaucauuuacuuccugcuugccgugauccaguuucugcucggcauuuucaccaacgggaucauugucguugugaauggaaucgaccugaucaagcauagaaaaauggcuccccuugaucugcuccuguccugccuggccgugucucggauuuuucuccaacuguucaucuuuuaugucaacgugauuguuaucuucuuuauugaauuuaucauguguagcgcgaauugcgcuauucuucuguuuaucaacgagcucgaacuguggcuugccacauggcugggcguguucuacugugccaaggucgcuuccgugcgccacccucucuuuaucuggcugaaaaugagaauuucuaagcugguuccguggaugauccucgggagccugcuuuauguguccaugauuugcgucuuccauucuaaauacgccggauuuauggugcccuauuuccugcggaaguucuuuagccagaaugcuacgauccagaaggaggacacccucgccauucagaucuucuccuuuguggcggaguucagcgucccucugcuuaucuuucuguucgccguucuccugcugauuuucucucucggccgccacacaagacaaaugcggaacaccguggcugggucccgcgugcccggaagaggcgccccuaucagcgcucugcuuucuauucuguccuuccucauccuguacuuuagccauuguaugauuaaagucuuccuuucuucccugaaguuucacauccggcgcuucaucuuucucuucuucauucuggugaucggcauuuaucccagcgggcacucccugauccucauucugggaaauccuaaacuuaagcagaacgccaaaaaguuucugcuccauucuaagugcugucaguga

SEQ ID NO: 76603 - RNA, 1002 nt, Artificial Sequence
  derived and/or modified sequence opt5 from TAS2R38__Homo_sapiens__NP_789787
augcugacccucacaagaauccggacggugagcuacgagguccgcuccaccuuccuguuuauuucuguucuugaguucgccgugggcuuucugacaaacgcuuucguguuucucgucaauuucugggacgugguuaagagacaggcccugagcaacuccgauugcgugcuucugugucucucuaucagccggcuguuucugcacgggcuccuguuccuuuccgcgauucaacugacccauuuucagaaacucucugaaccccugaaucacagcuaucaggcuaucauuaugcuuuggaugaucgccaaccaggccaaucuguggcucgcugccugccugucccugcucuacuguagcaagcugauccgcuucucucauacauuucuuauuugccuggcuuccugggucagcagaaaaaucucucaaaugcuccugggaauuauccuuuguuccugcauuuguaccgugcugugcguuugguguuucuuuagccggccucacuucacagugaccacgguccucuucaugaacaauaacacccgccugaauuggcagaucaaggaccugaaccucuuuuauucuuuccuguuuugcuaccuuugguccgugccgcccuuccugcucuuucuggugagcuccggcaugcuuacagucucucuggggagacauaugcggaccaugaaaguuuauacacgcaauagcagagauccuucccucgaagcccacauuaaggcgcucaagagccuggugucuuucuuuuguuucuuugugaucuccagcugcgucgccuucaucucugugccccugcugauucuuuggcgggacaaaaucggaguuauggugugcgucggcauuauggcugccuguccuagcgggcacgcugccauccugauuuccggaaacgcgaagcuccgcagagccgugaugaccauccugcugugggcucagucuagccuuaaaguucgggccgaucauaaggcugacucccgcacgcucugcuga

SEQ ID NO: 76604 - RNA, 900 nt, Artificial Sequence
  derived and/or modified sequence opt5 from TAS2R50__Homo_sapiens__NP_795371
augaucaccuuccuguacaucuuuuucagcauucucauuauggugcuguuuguccuuggcaacuucgccaauggguuuaucgcucugguuaacuucauugacugggugaagagaaagaagaucuccucugccgaucagauccucacagcgcuggcugugagccggauuggacuucugugggcccuccugcugaauugguaucucacgguccugaaccccgccuuuuacuccguggagcuucgcaucaccucuuauaaugcuuggguugugacaaaccacuucagcauguggcuggccgcuaaucucuccaucuuuuaccugcuuaaaauugccaacuucucuaaucugcucuuucugcaucugaagagacggguccgcagcgugauucucguuauccugcuuggcacccugauuuuccucgugugccaucugcuugucgcgaacauggacgaauccaugugggccgaggaauaugaggggaauaugacaggaaaaaugaagcugagaaacaccgugcaccucagcuaccugacagugaccacgcuguggucuuuuaucccuuucacccucucccugaucagcuuccuuaugcugauuuguucucucugcaagcaccugaaaaagaugcaacuucauggcgaagggucccaggaucugagcacaaaaguccacaucaaggcucuccagacccugauuucuuuucugcuccugugugccaucuucuuucuuuuccugauuguuuccguguggagcccgcggcgccucagaaaugaccccguggucaugguguccaaagcuguuggaaacaucuaucuggccuuugauucuuucauccugauuuggcggacaaagaaacuuaaacacaccuuucuccugauccugugccagauucgcuguuga

SEQ ID NO: 76605 - RNA, 957 nt, Artificial Sequence
  derived and/or modified sequence opt5 from TAS2R60__Homo_sapiens__NP_803186
augaacggcgaccacauggugcuggggagcuccgucaccgauaagaaagccaucauucucguuacaauccugcuucugcucagacugguggcuauugccggaaauggcuucaucacggcggcucuugggguggaguggguccugcggcgcaugcuccugcccugcgacaagcugcucgugucucugggagccagcagauuuugucuucaguccguugugaugggcaaaaccauuuacgucuuccugcauccuauggccuuuccguauaaccccgugcuccaauuccuggcuuuucagugggauuuccuuaaugccgcuacacuguggucuagcaccuggcucuccguguuuuacugcguuaagaucgccacauucacccacccugucuuuuucuggcugaaacauaagcugucuggguggcuccccuggaugcuguuuagcuccgugggacuuagcucuuucacaaccauccuguuuuucauuggcaaccaccggauguaucagaauuaccuccgcaaccaucugcagccuuggaaugugacgggcgacuccaucagaagcuauugugaaaaguucuaccuuuuuccccugaaaaugauuaccuggacaaugccuaccgcggucuucuuuaucugcaugauucuccugaucacaucucuggggcggcaccgcaagaaagcccuccugaccacguccggauucagagagccgagcguucaagcucacauuaaggcccuucuggcucuccugucuuuugccaugcuuuucaucuccuauuuucugagccucguguucuccgcggccggcaucuuucccccucuggauuucaaauuuugggugugggaaucugucauuuaccugugugcugccgugcaucccaucauucuccuguucagcaacugccggcuucgcgcuguucugaaguccagacggagcucucgcugugggacaccuuga

SEQ ID NO: 76606 - RNA, 939 nt, Artificial Sequence
  derived and/or modified sequence opt5 from TAS2R9__Homo_sapiens__NP_076406
augcccagcgccaucgaggcuauuuacaucauucugaucgccggcgaacucaccauugggaucuggggaaacggcuucaucgugcuggucaauugcauugacuggcuuaagagacgggauaucucccugauugacaucauucucaucucucuggcgauuagccgcaucugucuucugugcguuaucucccucgauggguuuuucaugcugcuguuuccuggaacauauggcaacucugugcucgugagcauugucaaugugguuuggacguucgcuaacaauuccucucugugguuuaccagcugucuuuccaucuucuaccugcucaaaauugccaacaucagccacccguuuuucuuuuggcugaaacuuaagauuaauaaggugaugcuggccauccuccuggggucuuuccugaucucccucauuaucagcguccccaaaaacgacgauaugugguaucaucuguuuaaggugucucacgaggaaaauauuacauggaaguucaaaguuuccaagaucccuggaaccuuuaaacagcuuacacugaaccucggcgugaugguccccuucauucugugccuuaucagcuucuuucugcuccuguucucucuggugagacauaccaagcaaauccggcuccacgcuacaggcuuucgcgacccuuccaccgaggcccauaugagagcuauuaaagccgugaucauuuuccugcuucugcucaucgucuacuaucccguuuuucuggugaugacgagcuccgcgcuuauuccucaggggaagcuggugcucaugaucggagauauugucaccgugaucuucccgucuagccacuccuuuauccugauuaugggcaauagcaagcugcgggaagccuuccucaaaaugcugcgcuuuguuaaguguuuccuuagacggcgcaaacccuuugugccuuga

SEQ ID NO: 76607 - RNA, 1263 nt, Artificial Sequence
  derived and/or modified sequence opt5 from TASP1__Homo_sapiens__NP_060184
augaccauggagaagggcaugagcuccggggaaggacugcccucuagaagcucccaggugucugccggcaaaaucacagcuaaggagcucgaaacgaaacaaagcuacaaggagaaacgcgggggauucguccugguucacgccggcgcgggguaucauuccgaaucuaaggcuaaggaguacaaacacgugugcaagcgggccugucagaaagccauugagaaacuucaggcuggagcccuggcuaccgacgccgugacagcggcccucgucgaacuggaggauagcccuuuuaccaacgcuggcaugggcuccaaucuuaaccugcucggggaaaucgagugcgacgccagcauuauggauggaaagucucugaauuucggcgcugugggggcccuguccggaaucaagaacccgguuagcguggcgaauagacuccugugugagggccagaaggggaaacuuucugccggacggauucccccuugcuuucuggucggcgaaggcgcuuaucgcugggccguggaccaugggauccccuccuguccucccaacaucaugacaaccagauucagccucgcugccuuuaagcggaauaaacgcaagcuggagcuugccgaaagaguugauacagacuucaugcaacugaaaaagcggcgccagucuuccgagaaagaaaacgauagcggaacccucgacacggugggcgcugucgugguggaucacgaggggaaugucgcggccgcuguuuccucuggaggccuggcccugaagcauccugggagagugggacaggccgcucucuacggcugcggcuguugggccgagaacaccggggcgcacaauccguauagcacagcuguguccaccagcggaugcggcgaacaccugguccggacaauucuugcccgcgaguguucucaugcccugcaggcugaagacgcccaccaagcucuccuggagaccaugcagaacaaguuuaucuccagccccuuccuugccucugaagauggggugcugggaggcguuauugugcucagaagcugccgguguuccgcggagccugacucuagccagaauaaacagacgcugcuggucgaguuucucuggucccauacaaccgaaagcaugugcgugggguacaugucugcccaagauggcaaggcuaaaacacacaucucccgccugcccccuggagccguugcuggccagagcguggccauugaagggggagucugcagacuugagucucccgugaacuga

SEQ ID NO: 76608 - RNA, 753 nt, Artificial Sequence
  derived and/or modified sequence opt5 from TATDN1__Homo_sapiens__NP_001139632
augaucaccggcgggaaccugcaggacagcaaggaugcccuccaccuggcucaaacaaauggaauguucuuuuccacggugggcugccaucccaccagauguggggaguucgagaaaaacaauccugaccuuuaccugaaggaacuccugaaccuugccgaaaauaacaaaggaaaggucguugcgauuggcgagugcgggcuggauuuugaccggcuccaguucuguccgaaagauacacagcugaaguauuuugaaaagcaguucgagcugucugagcaaaccaaacuccccauguuucugcacugccgcaauagccaugcugaguuccuugacaucaugaagagaaaccgggaucgcugugugggaggcgugguccacuccuuugacggcacaaaagaagccgccgcugcccugauugaucucgaccuguacaucggguucaauggaugcucucuuaagaccgaagcuaaccuggaggugcucaaaagcauuccuuccgagaagcugaugaucgaaacagaugcccccugguguggcguuaagucuacccaugcggggagcaaauauaucagaacggccuuuccuaccaagaaaaagugggaguccggacacugccugaaagaccggaaugaacccugucacauuauccagauucucgagaucaugagcgcugugcgcgaugaagacccucuggagcuugccaacacacuguacaauaacaccauuaaggucuucuuuccgggcaucuga

SEQ ID NO: 76609 - RNA, 1365 nt, Artificial Sequence
  derived and/or modified sequence opt5 from TAT__Homo_sapiens__NP_000344
auggaccccuacaugauccagaugagcuccaagggcaaccugccuucuauucucgaugugcacgucaauguugggggaagaagcuccgugccgggcaaaaugaaggggcggaaagcccgcuggucugugagacccagcgacauggcuaagaaaaccuucaacccuauccgggccauugucgauaauaugaaggugaagcccaacccuaauaaaacaaugaucucccugucuauuggagaccccacgguuuuuggcaaccuuccuaccgauccggaggugacacaagcgaugaaggacgcucuggauagcgggaaauauaauggauacgcccccuccaucggcuuccucagcucucgcgaagagaucgccuccuauuaccauugcccugaagcuccccuggaggccaaggacgucauucuuaccagcggcuguucucaggcuaucgaucugugccucgccgugcuggcgaacccugggcagaauauucugguucccagaccgggauuuucccucuauaaaacacuggccgaaagcaugggcaucgaggugaagcuguacaaccugcucccugagaagucuugggaaauugaccugaaacagcuugaguaucugaucgaugaaaagaccgcuugucucauugucaauaaccccuccaauccuugcgggagcguguucuccaaacggcaucugcaaaagauccuggccguggcugcccgccaguguguccccauccucgcggacgagauuuacggagauaugguuuucucugacugcaaauacgagccccuggccacacuuagcaccgacgugccuauccuguccuguggcgggcucgcuaagagauggcuggugccgggauggcggcuuggcuggauucugauccacgaucgcagagacauuuucggcaacgaaauccgggaugggcucgucaaacugagccagcgcauccugggacccugcacgauugugcagggcgcccucaagucuauccuguguagaaccccuggggaguuuuaucacaauacacuuuccuuccuuaagagcaacgcugaccucugcuacggagcccuggccgcuauucccggccuucggccuguucgccccucuggggcgauguaucugauggugggaaucgaaauggagcauuuuccggaauuugagaacgaugucgaguuuaccgaaagacucguggccgagcaaagcguucacugucugccugcuacaugcuucgaauaccccaauuuuauucggguggucaucaccgugccugaggucaugaugcuggaagccugcuccagaauccaggaguucugugagcagcacuaucauugcgccgaaggcucucaggaggaaugugacaaauga

SEQ ID NO: 76610 - RNA, 2244 nt, Artificial Sequence
  derived and/or modified sequence opt5 from TAX1BP1__Homo_sapiens__NP_001073333
augaccagcuuccaggaggugccccugcaaacauccaacuuugcccacgucaucuuccagaauguugcuaagucuuaccucccuaacgcccaucuggaaugccacuauacgcuuaccccguacauucauccccacccuaaagacugggugggcaucuuuaaggugggguggagcacagcgagagauuauuacaccuuccuguggucccccaugccugagcauuaugucgaaggaucuacagugaauuguguucucgcuuuucagggcuacuaucugcccaacgacgauggggaguucuaccaguuuugcuacgugacccacaaaggagaaauucggggcgccagcacaccuuuccaauuucgcgccuccucuccggucgaggagcuucugaccauggaagacgaggggaauagcgauaugcucgugguuacgaccaaggcuggacugcuggaacucaaaaucgagaagacaaugaaggagaaagaagaacugcuuaagcugauugccgugcucgaaaaagagaccgcucagcugagagaacaggucggccggauggagcgcgagcuuaaccacgaaaaggagagaugugaccagcugcaagccgaacagaaaggccucacagaggugacccagucccugaagauggaaaaugaggaguucaagaaacgguuuagcgaugcgacgucuaaggcccaucagcuggaagaggacaucguguccgucacacacaaagcuaucgaaaaggagaccgaacucgauagccugaaagacaaacuuaagaaggcccaacaugagcgcgagcagcuggaaugccagcucaagacagagaaagaugaaaaggagcuguauaaaguucaccuuaagaacaccgagauugaaaauaccaaacugaugucugaggugcaaacacucaagaaccuggacgggaauaaggaauccgugaucacgcacuucaaagaggaaauuggaagacugcagcucugucuggcugagaaggagaaccuucagcggaccuuucugcucacaaccagcucuaaagaagauacaugcuuccugaaggagcagcuucgcaaagccgaggagcaaguccaggcgaccagacaggaagugguuuuccuggccaaggagcucuccgacgcugugaauguccgggaccgcacgauggccgaucugcauacagcuagacuggagaacgaaaaggugaaaaagcagcucgccgacgccguugcugagcugaaacuuaaugcgaugaagaaagaucaagacaagaccgauacccuggaacacgagcuccggcgcgaaguggaggaccugaagcugagacuucagauggccgcugaucauuacaaagagaaguuuaaagaaugucagcggcuccagaagcaaaucaacaaacugagcgaccaguccgccaacaauaacaaugucuucacaaagaaaaccggcaaccagcagaaggugaaugaugccucugucaacacagaccccgcuacgagcgccuccaccguggauguuaagccuagccccucugcggcugaggccgacuuugacauugugacaaaagggcaagucugcgaaaugaccaaggagaucgccgauaaaacagagaaguauaauaaauguaagcagcugcuccaggacgaaaaggcuaaaugcaacaaguacgccgaugagcuggcuaaaauggaacuuaaguggaaagagcaagugaagauugccgaaaauguuaagcuggagcucgcggaggugcaggacaacuauaaagaacugaagagaucccuggagaauccugccgaacgcaaaauggaggauggagcugacggcgccuucuaccccgaugaaauccagcggccgccugucagagugcccagcugggggcuugaggacaacgugguuuguucucagccugcucgcaauuuuagccggcccgauggacucgaggacuccgaagauucuaaggaggacgaaaacguccccaccgccccugauccgcccagccaacaccugagaggccauggcacgggguucugcuuugacuccagcuucgacgugcacaaaaagugcccucugugugagcucauguuucccccuaauuaugaucagucuaaguucgaggaacacguggagucccauuggaaagucugccccauguguagcgaacaguuuccgccugacuacgaucagcaaguguucgagcgccacguucagacccauuuugaccagaacgugcugaacuucgauuga

SEQ ID NO: 76611 - RNA, 375 nt, Artificial Sequence
  derived and/or modified sequence opt5 from TAX1BP3__Homo_sapiens__NP_055419
augagcuacauccccggccagccugugaccgccgucguucaaagaguggagauucacaagcugcggcagggggaaaaccucauccugggauucuccauuggcgggggaaucgaccaggauccgucucagaaucccuuuagcgaggacaaaacagauaagggcauuuaugugacgcgcgucuccgaagggggaccugcugagaucgccggccuucaaaucggcgacaaaauuaugcaagugaacgggugggauaugaccaugguuacacaugaccaggcgagaaagcggcugaccaaacgcucugaagagguggucagacuccuggugacacggcagagccuucagaaggcuguucagcaguccaugcugucuuga

SEQ ID NO: 76612 - RNA, 879 nt, Artificial Sequence
  derived and/or modified sequence opt5 from TAZ__Homo_sapiens__NP_000107
augccccugcacgugaaguggccuuucccggccguucccccucucaccuggacacuggcuagcuccgucgugaugggccuuguggggacguacucuugcuuuuggaccaaauauaugaaccaucugacaguccacaauagagaggugcucuacgaacugaucgagaagcggggacccgccaccccucuuauuacaguuagcaaccaucaguccuguauggacgauccccaccuguggggcauccucaaacugcgccauauuuggaaucugaagcucaugagauggaccccugcggcugccgacaucugcuucacaaaagaacugcacucucacuuuuucagccuugggaagugugugccggucugccggggagccgaguuuuuccaagcugaaaacgagggcaagggggugcuggauaccggacgccauaugcccggcgccggcaaaagacgggagaagggggacggaguuuaucagaaaggcauggauuuuauucucgaaaagcugaaucacggggacugggugcauaucuucccugagggaaaagucaacauguccucugaauuucuucgcuucaaguggggcaucgggagacugauugcugagugucaccucaaucccaucauucugccucuguggcacgugggaaugaacgaugugcuccccaauagcccgccuuacuuuccccgguucggccagaagaucacgguccugauuggcaaaccuuuuuccgcccuucccguucuggagcgccucagagcggaaaacaagagcgccguggagaugcggaaagcucugaccgacuucauccaggaagaguuccaacaucuuaagacacaggccgaacagcugcacaaucaucuccagcccgggcgcuga

SEQ ID NO: 76613 - RNA, 1482 nt, Artificial Sequence
  derived and/or modified sequence opt5 from TBATA__Homo_sapiens__XP_011537769
auggccaccgacgugcagcuggcugauuacccccucaugagcccuagaucccugcggggcgaguggcgcauggaacaagagacacaggggccgucucaguggagcccccagagaguccggggacgccacgcccuucuguccacgucuagaguucaucucuauagcaagcggaccccuuucucccaaggccaccgcgaaaaagggaugcagacagcgaucucucccaaggcugagcugaaacuugaaaagaaaagcggaagaaagccucggucccccagagacagcggcccucagaaggagcuggugauuccggggaucguggauuuugagcgcauucggcgcgcccucagaacccccaaaccucagacacccggaaccuacugcuucggccggcugucucaucacuccuuuuucagccgccaucacccucacccccaacaugucacacacauccaggaccugaccggcaagccgguguguguugugagagauuuuccugcuccccucccugaaucuacggucuucuccgggugccagaugggcauucccaccaucagcgugcccaucggagacccucagucuaaccggaauccgcaacuguccagcgccuggaaaaaggagcuuaaagaacuggccuccagaguugcuuuucucacaaaggaggaugagcugaagaaaaaggaagacaccacaucucuuaacuggaauuguaaaagccgccggccccaggccccugggcuguccggaaccgaucucggcgcggccgagcuggggauuaagaaagaacagaaggaggaaccccugagagagcaaggagcuaaauauagcgccgagacgggccgccucaucccugcuucuacacgggccgugggcagacgccggucccaucaggggcagcagagccaaucuagcuccagacacgaaggaguccaggcguuccugcuucaggaccaggagcugcucgugcuggaacuucugugccgcauucucgagaccgaucugcugucugccauccaauuuuggcuccuguacgcucccccgaaggaaaaggaccuugcccugggccuccugcagacagcuguggcccagcuucugccucagccccucgucagcauuccuaccgagaaacugcugucccaacuccccgagguucacgaaccuccccaggagaagcaggaaccgccuugucggugggcuccccaucccgcccugccuuucugcagccuucugucuucccagagcaucccggaggaaaacgaggauauuaccuuuuauaaaaagagaaaaacacgcgugcacuggcggucuuccagcccucccgacgcguucaagcccgagcauagagaagaggacaucgaagccgaggggcgggagcuccgcggaccuaauacguguaccugccuggcucaagaacagccccagggcuuuagagggguguccgucucuacaaccuucacagccgugccugauagccugcccuga

SEQ ID NO: 76614 - RNA, 2025 nt, Artificial Sequence
  derived and/or modified sequence opt5 from TBC1D15__Homo_sapiens__NP_001139685
auggccgcugccggcguggucagcgggaagaucauuuacgagcaggaaggaguuuauauccacuccucuugcggcaaaaccaacgaccaagaugggcugauuagcggaauccucagagugcuggagaaggacgcggaagugauugucgauuggcggccccuugacgaugcucuggacuccucuagcauccucuacgcccgcaaagauuccucuagcgugguugaguggacacaggccccuaaggaaagaggccaucggggguccgagcaccugaauagcuaugaggcugaaugggacauggugaacacggucucuuucaaacgcaagccgcauaccaauggagaugcccccucccacagaaacggcaagagcaaauggucuuuucuuuucucccugacagaccucaagagcaucaaacagaauaaggagggcaugggguggucuuaccugguguuuugucugaaagaugacguugugcucccugcucugcauuuccaccagggagauuccaagcugcugauugaaagccucgagaaguaugucgugcugugcgagagcccccaagacaaacggacccuucuggugaacugucagaauaagucucucagccaguccuuugaaaaccugcuggacgagccugccuacggccucauccagaaaauuaagaaagaucccuauacagcgaccaugaucggguucagcaaggucacaaauuacauuuuugacucucugcgcggauccgauccuagcacccaccaaagaccgcccucugaaauggccgacuuccuuagcgaugcuaucccuggccugaaaauuaaccagcaggaggaacccggguuugagguuaucacgcggaucgaccucggagagcgcccuguggugcagagacgggaacccgucucccuggaggaauggaccaagaauauugauucugagggccgcauccuuaacguggacaauaugaagcaaaugauuuucagaggcgggcugagccaugcccuccggaaacaggcuuggaaguuucugcugggauacuucccgugggauuccacaaaagaagaacgcacccagcuccaaaagcagaaaacagacgaguauuuuagaaugaagcugcaguggaaguccaucucucaggaacaagagaaacggaacuccagacuucgcgauuaccggagccugauugaaaaggacguuaauagaaccgaccgcacgaacaaauucuaugagggccaggauaacccugggcucauccugcuucacgacauccugaugacauacugcauguaugauuucgaccucggauacgugcagggcaugucugaucugcugagcccccuccuguaugucauggaaaaugagguggacgccuuuugguguuucgcguccuacauggaucagaugcaucaaaacuuugaggaacagaugcaggggaugaagacccagcuuauucaacuguccacacuccugcggcugcuugacucuggauucugcagcuaccucgagucccaggauucuggcuaucuguacuuuuguuucagauggcugcucauccgcuuuaaacgggaguucagcuuucuggacauucuuagacugugggagguuauguggaccgagcucccuugcaccaauuuccaccuucugcuuuguugcgccauccucgaauccgagaagcagcagauuauggaaaagcacuauggcuuuaacgagauccugaaacauaucaaugaacugagcaugaagauugauguggaggacauccucuguaaagcugaggccauuucucugcaaauggucaagugcaaagaacuuccccaggcugugugcgagauccuggggcuccagggauccgaagucacaacgcccgauagcgacgugggcgaggacgaaaacguugugaugaccccuuguccgacaucugccuuccaauccaaugcccugcccacccugagcgcuucuggggcgcgcaacgauagcccuacacagauucccgucuccagcgacgugugccggcuuaccccugccuga

SEQ ID NO: 76615 - RNA, 1218 nt, Artificial Sequence
  derived and/or modified sequence opt5 from TBC1D16__Homo_sapiens__NP_001258774
augaagguggcccccgacaaaaccugcaugcaguucagcaucagacggccuaagcugccguccucugagacccaccccgaagagagcauguacaaacgccucggcgucuccgcuuggcugaaccaucuuaaugaacuggggcaaguugaggaagaguauaagcucagaaaagccauuuucuucggaggcaucgaugugucuauucgcggggagguguggccuuuucugcuucgguacuauagccacgaauccacgucugaggaaagagaggcgcugcggcuccagaagcgcaaggaguacagcgaaauccagcagaaaagacuguccaugacccccgaggaacaucgggcuuucuggcgcaacguccaauuuacaguggacaaggauguugugagaaccgaccggaauaaccaguucuuucgcggagaggauaauccuaacgucgaaagcaugagacggauucugcucaauuaugccguguacaaccccgccguuggcuauucucaggggauguccgaccugguggcuccuauccuugccgagguccuggaugagagcgacacauucugguguuuugugggacucaugcagaauaccaucuucgugucuuccccgcgcgaugaagacauggagaaacaacugcuuuaccugagagaacuccugcggcugacacacgucagauuuuaccagcaucucguuagccugggcgaggauggccuucagaugcuguucugccaccgcuggcuccugcuuuguuuuaagcgggaauuucccgaggcugaggcccugagaauuugggaagcgugcugggcccacuaucagaccgacuacuuccaucucuuuaucuguguggcuauuguggccaucuauggggaugacgucauugagcaacagcuggcuacggaccagaugcugcuccacuucggaaaccuggccaugcauaugaauggcgaacuugugcugcgcaaagcgcggucucuccuguaccaauuuagacuucugccucgcauccccugcucccuccacgaucuguguaagcugugcgggagcggaaugugggacuccggcucuaugccugccguugaguguaccgggcaccaucccggaagcgaauccugcccguauggcggcacaguggagaugccuagccccaagucucuccgggaggggaaaaagggaccuaaaacaccccaggauggcuucggguuuagacgcuga

SEQ ID NO: 76616 - RNA, 3480 nt, Artificial Sequence
  derived and/or modified sequence opt5 from TBC1D1__Homo_sapiens__NP_001240841
auggagcccaucaccuucacagccagaaagcaccuucucagcaacgaaguguccgucgacuuuggccugcagcuuguugggucucugccugugcauagccucacgaccaugccgaugcugcccuggguggucgcugaggugcggcgccuuuccagacaaucuacacggaaagaaccuguuaccaaacaggugcgccugugcgucagccccuccggacucagaugugagccugaacccggccggucucagcagugggauccucugauuuacagcuccaucuucgagugcaagccgcaacgcgugcacaagcugauucauaauagccacgaccccucuuauuuugccugucucaucaaagaggaugcgguucauagacaguccauuugcuacguguucaaggcugacgaucagacaaaggucccugaaaucaucagcucuauucggcaggccgggaaaaucgcccgccaagaggaacugcacugucccuccgaguuugacgauaccuucagcaagaaauuugaggugcuuuucugcggaagagugacagucgcucacaagaaagccccucccgcucugauugacgaauguaucgagaaguuuaaccauguuucuggcucccgggggagcgaauccccgcgcccuaaucccccucacgccgcgcccaccggaucucaggagcccgugagacggccuaugcgcaagagcuucucccagccgggccucagaagccuggccuuucggaaagaacuucaggauggcgggcugagaucuuccggauucuuuagcucuuucgaggagagcgacauugaaaaccaucucaucuccggccacaauauugugcaacccacggauaucgaggaaaaccgcaccaugcuguucacaaucgggcagucugaggucuaucugauuagcccugacaccaagaaaaucgcucucgaaaagaauuuuaaagagauuuccuucugcagccagggaauccggcacguggaucauuuuggcuucauuuguagagagucuuccgggggaggcggcuuucacuucguuugcuacguguuucaauguacaaacgaagcccuggucgacgagaucaugaugacccuuaagcaggcuuucacgguggccgcgguucagcagacagccaaagcucccgcccaacugugcgaagggugcccucuccagagccugcauaagcugugugagcgcaucgaaggaaugaacucuuccaagaccaaacuggagcuccagaagcaccugacaacccugaccaaucaggagcaagcuacaauuuuugaagaggugcagaaacuccggcccagaaaugaacagcgcgagaacgagcugaucauuagcuuccuucggugccuguaugaagagaagcagaaagaacauauccacauuggcgagaugaagcaaacgucccagauggccgccgaaaauaucgggucugagcucccgccuagcgcuaccagauuucgccuggacaugcuuaagaacaaagcgaagcggucccugacagagucucucgaaagcauccuguccagaggaaauaaagcccgcggccugcaggagcacagcauuucugucgaucucgacuccagccugucuuccacccuuagcaacacaucuaaggaacccagcgugugugagaaagaagcucugccuaucuccgagagcucuuucaagcuccugggguccagcgaggaucuguccucugacagcgaaucccaucuucccgaggaaccugcuccccucucuccgcagcaagccuuucggagacgggcuaacacccugagccacuucccuauugagugccaggaaccuccccagcccgcccgcggauccccgggcgucucucaaagaaagcugaugcgguaccauagcguguccacggagacaccccacgagagaaauguugauccuagccccgugggcgaaucuaaacaccgcccugggcaguccagcgcgcccgcuccucccccgcggcucaacccuucugccuccagccccaauuucuuuaaguaucugaaacauaacucuuccggagagcagagcggcaaugccgucccuaaguccaucagcuacagaaacgcucugcgcaaaaagcugcacucuagcuccucugugcccaauuuccucaaguuucuggccccgguugacgaaaacaauaccagcgauuucaugaacaccaaaagagacuuugaguccaaggcuaaucaucugggggauucuggaggcacaccugugaaaacccggcgccacagcuggagacagcaaauuuuccuucgggucgccacaccccagaaggcgugugacuccucuagccgcuacgaggauuauuccgaacucggggagcugccucccagaagcccccuggaaccugugugcgaggacggcccguuuggacccccucccgaagagaaaaagcggacgucucgcgagcucagagaacuguggcagaaagccauccuucagcaaauucugcuccugcggauggagaaggaaaaccagaagcugcaggcuuccgagaaugaccuucucaacaaacgccugaagcuggauuacgaagagaucaccccuugucucaaagaggugacaaccguuugggaaaagaugcugagcacacccggcagaucuaaaaucaaguucgacauggagaagaugcauuccgccgucgggcagggagugccucggcaccacagaggcgaaauuuggaaauuucuugcugagcaauuccaucugaagcaccaguuuccgagcaaacagcaacccaaggaugugccuuauaaagaacuccugaagcagcugaccucccagcagcaugccauccuuauugaccucgggcgcacguuccccacccacccuuacuuuucugcgcaacugggagccggccagcugagccucuauaauauccugaaggcuuacucccuucuggaucaggaggucggguauugccagggccucagcuucguggccggcauucugcugcuucauaugucugaggaagaggcuuucaaaaugcugaaguuucucauguucgacaugggacugcggaaacaauacagacccgauaugaucauccuccagauggaaaagacaauuaaccagguuuuugagauggacaucgccaaacagcugcaagccuacgagguggaauaucacguccuucaggaggaacugauugauuccagcccgcucucugacaaccagcgcauggauaagcuggagaagaccaauagcucccugcggaaacagaaccuugaccugcucgaacaacuucagguggcuaaugggagaauccagucucucgaggcgacaauugagaagcugcuuagcuccgaaucuaaacugaagcaagccaugcucacccuggagcuggaacgcagcgcccuucugcagacgguugaggaacuccggagacgcuccgccgagccuagcgaucgggagcccgaauguacacagcccgagccuaccggagacuga

SEQ ID NO: 76617 - RNA, 1212 nt, Artificial Sequence
  derived and/or modified sequence opt5 from TBC1D20__Homo_sapiens__NP_653229
auggcccugagaagcgcucagggcgacgggcccaccuccggacacugggauggcggggccgagaaggcggacuucaacgcuaaacggaagaaaaagguggccgaaauccaucaagcccucaauucugauccuacagacgucgcugcccugcgcagaauggcuauuagcgagggaggccuucugacggaugaaauccggcgcaaaguuuggccgaagcuccugaacgugaaugccaacgaucccccucccauuuccgggaagaaucuuagacagaugucuaaagacuaccaacaggugcugcucgacguccggcgcagccugagacgguuuccucccggaaugccugaggaacagcgcgagggccugcaggaggaacucaucgauauuauccugcuuauccuggagagaaacccgcagcuccacuauuaccagggcuaucaugacauugugguuaccuuccugcuuguggucggggaacggcuggcgacaucccucguggagaagcugucuacccaccaucugcgcgauuuuauggaccccacaauggauaauaccaaacacauccucaacuaccugaugccuauuaucgaccaaguuaaucccgagcuucacgacuucaugcagagcgccgaagugggaacaauuuuugcucuguccuggcucaucaccugguucggccauguccugagcgauuuuagacacguggugcggcuuuaugacuucuuucuggccugccauccucucaugcccauuuacuucgcugccgucaucguucuguaucgcgagcaggaagugcuggauugugacugcgauauggcgucugugcaccaccuccugucccagaucccgcaagaccuuccuuacgagacgcugauuagcagagccggggaucucuuuguccaguuucccccuucugaacuggcucgggaggccgcugcccagcaacaggccgagagaaccgcugcguccacauucaaggacuucgaacuugccagcgcucagcagcgccccgauauggugcugcggcaaagauuccgcggacuccugcggcccgaggacagaaccaaagauguucugacaaagccucgcaccaaccgguuugugaagcucgccgucaugggccugacgguggcccuuggggcugccgcgcuggcuguugugaaaucugcccucgaaugggccccgaaguuccagcugcagcuguuucccuga

SEQ ID NO: 76618 - RNA, 1320 nt, Artificial Sequence
  derived and/or modified sequence opt5 from TBC1D22A__Homo_sapiens__NP_001271232
auggccagcgacggcgcuagaaagcaguucuggaaacgguccaacucuaagcugcccgggagccuccugcgcuccaccgccaaaaugccuacaacgccggugaaggcgaaaagagucucuaccuuucaagaguucgaaagcaauacauccgaugcuugggacgccggagaggaugacgaugaacuucuggccauggcugccgagucucucaacagcgaaguugugauggagaccgcuaaucgggugcugcgcaaccacucccagagacagggccggcccacacuucaggaggggccuggacugcaacagaagccccgcccugaagccgagcccccuagcccgcccucuggcgaccucagacuggucaaguccgugagcgaaucucauaccuccugcccugcggaggagcugcggcgccucagcuggucugggauccccaaaccuguuagacccaugacauggaagcugcuuuccggauaccugccggccaauguggaucggcgcccugcuacccuccagagaaaacagaaggaauauuuugccuucauugagcacuacuaugacagccggaacgaugaaguccaucaagacacguaccgccagauccacauugauauccccagaauguccccugaggcucugauucuucagcccaaagugaccgaaaucuuugagcggauccuguucauuugggccaucagacaucccgcgucuggcuauguucagggcauuaaugaccucgugacaccguuuuucgucguguuuaucugugaguacauugaagccgaggaaguggauaccgucgacguuagcggggugccugcugaggugcugugcaacaucgaagccgacacauauugguguauguccaagcugcucgauggcauucaagacaauuacaccuucgcucagcccggaauccagaugaaggucaaaaugcuggaggagcuugugagccgcaucgaugaacaaguucaccggcaccuggaccagcaugaggugagauaccuccaguuugccuuccgcuggaugaacaaucugcuuaugcgggaagucccucugagaugcacgauucgccucugggauacauaucagucugagcccgacggguuuucccacuuccaucuguacgugugugccgcuuuccugguucgguggagaaaggaaauccucgaggagaaagauuuucaagaacugcuucuguuccuccagaaccugccuaccgcgcacugggacgaugaggacauuagccuucugcucgccgaagccuaucgccugaaguuugcuuucgccgaugcucccaaucacuacaaaaaguga

SEQ ID NO: 76619 - RNA, 1518 nt, Artificial Sequence
  derived and/or modified sequence opt5 from TBC1D22B__Homo_sapiens__NP_060242
auggccgcugagaacagcaagcaguucuggaaaagauccgccaagcugcccggcucuauccaaccuguguacggggcgcagcacccgccccucgacccucggcugaccaaaaauuuuauuaaggaacgcagcaaagucaacacaguuccccuuaagaauaagaaggcuuccucuuuccaugaguuugccagaaacacgagcgaugccugggacaucggagaugacgaagaggaagauuucuccucuccuagcuuucagacccucaauuccaaaguggcucuggccacagcugcccaggugcuggagaaccacagcaaacuucgggucaagcccgagcgcucucaauccaccacaagcgacgugccugcgaauuauaaaguuauuaagucuuccagcgaugcccagcugucuagaaacuccagcgauaccugccuccggaauccgcugcauaagcagcagucccugccccuccgcccuaucauuccccugguggcuagaaucucugaccaaaacgccagcggcgcuccucccaugacaguccgggagaaaacccgccuugaaaaguucagacagcugcucuccagccagaauacggaccuggaugaacuucggaaauguucuuggccgggggugccucgcgagguuagacccaucaccuggcggcugcucuccggauaccugccugccaacacagagcgcagaaagcugacccuccagcggaaaagagaagaguauuuuggcuucauugaacaauacuaugacagccgcaaugaggaacaccaucaggauacauaccggcagauccacauugacauccccagaaccaacccccugauuccucuuuuucaacagccgcuggugcaggagaucuucgagcgcauucucuuuaucugggcgauccggcaccccgccucuggguauguccagggaauuaaugaccuggugacgccuuucuuuguggucuuccuuagcgaauacguugaggaagauguggagaacuucgacgugacaaaccugucccaagauaugcucagaucuaucgaagcugacagcuuuuggugcauguccaagcugcuggauggcauucaggacaauuacaccuucgcccagcccggcauccagaaaaaggucaaggcucucgaggagcuggugagccgcauugaugaacaaguucauaaccacuuucggagauaugagguggaauaccuucaguucgccuuucgcuggaugaauaaccugcucaugcgggagcugccucuuagauguacaauccgccugugggacaccuaucagucugaacccgagggguucucccauuuucaccucuacgucugcgccgcuuuccugaucaaauggcggaaggagauucuggaugaagaggacuuucagggacuccugaugcuucugcaaaaucucccgaccauccacuggggcaacgaagagauugggcugcugcuugcggaggccuauagacucaaauacauguucgcugaugccccuaaucauuaucggcgcuga

SEQ ID NO: 76620 - RNA, 1680 nt, Artificial Sequence
  derived and/or modified sequence opt5 from TBC1D24__Homo_sapiens__NP_001186036
auggacagccccggcuacaacugcuucguggauaaggacaaaauggaugccgcuauccaggaccuggggccuaaggagcucuccuguaccgaacugcaagagcuuaaacagcuggccagacagggauauugggcgcagucucacgcucuccggggcaaggucuaccaacgccugauuagagauaucccgugccggacaguuacgcccgacgccagcguguauuccgauauuguggggaaaaucgucggaaagcauucuagcuccugucuuccucugcccgaauuuguggacaauacccagguuccuucuuacugccucaacgcccgcggcgagggggcugugagaaagauucugcugugucucgccaaucaguuccccgauaucagcuuuugcccugcucugccggccgucguggcgcuucugcuccacuauuccaucgacgaagccgaguguuucgagaaggcuugccggauucuggccuguaacgaucccggacgcagacuuaucgaccagagcuuucuggcuuucgaaucuuccugcaugacauuuggcgaucucguuaauaaauacugucaagccgcgcauaaacugaugguggccgucagcgaggacgugcuccagguguaugcugacuggcagcgguggcuguucggcgaacugccucuuugcuacuuugcccgcgucuucgauguuuuucugguggagggguacaaggugcucuauagagucgcucuggccauucuuaaauucuuucacaaggugcgggccggacagccccuggagucugacuccguuaagcaagauauccgcaccuucgugagagacauugcuaaaacagucagcccugaaaagcuccuggagaaagcguucgccauccggcuguuuucucgcaaggaaauucagcuccugcagauggcuaacgagaaagcccuuaagcaaaaaggcaucaccgugaagcagaaguccguuagccuguccaaaagacaguucgugcaucucgccguccacgcugaaaauuuucggucugagaucgugagcgucagagagaugcgcgauauuugguccugggugcccgaacgguucgcccugugccagccgcuucugcucuuuagcucucugcaacacggguacucccuggcgagauucuauuuucagugugagggacaugaaccuacacuccugcuuaucaagaccacgcagaaagagguuugcggcgcuuaccugagcaccgacuggucugaacgcaacaaguucgggggaaaacucggcuuuuucggcacaggggaguguuuuguguuccggcugcagcccgagguccaaagauaugaaugggugguuauuaagcacccugagcugaccaagcccccuccccuuauggccgccgaaccgacagcuccccucagccauuccgccucuagcgauccugcugaccgccugucccccuuucuggccgcgcggcacuucaaucucccuagcaaaaccgagucuauguucauggccggaggcuccgauugccugaucgucgggggaggcgggggacaggcucuuuacauugacggcgaucugaacagaggccgcacgagccacugugacacauuuaauaaccagccccucugcucugaaaauuuccugaucgccgcuguggaggccuggggguuucaggacccggauacccaauga

SEQ ID NO: 76621 - RNA, 2067 nt, Artificial Sequence
  derived and/or modified sequence opt5 from TBC1D25__Homo_sapiens__NP_002527
auggccaccgcuagcggcgccuccgaccugucugggagcggagcgcccccuccgggcgugggggcucaggccgccgcugccgcugaggaagaggaaagagaggucguucgggugcgcgugaagaaaugcgaauccuuccugcccccugaguuuagaucuuucgccgucgauccccaaaucacaagccucgacgugcuucagcacauucugauccgggcguuugaucucuccggaaagaaaaacuucggcauuucuuaccuggggcgcgacagacuuggacaggagguuuaucugagccuccuguccgauugggaccugagcacggccuuugcuaccgccucuaagccuuaccuccagcugcggguggauauccgccccuccgaagacagcccucuucuggaggauugggacauuaucucuccgaaagaugucaucggcuccgacgugcuccuggcugaaaagagaagcucucuuacaaccgccgcgcugcccuucacacaauccauucucacccagguuggccggacacugagcaaggugcagcagguccuguccuggucuuauggggaggaugugaaaccuuuuaagcccccucucagcgacgccgaguuccauaccuaccugaaucacgaaggacaacuuucccgccccgaggaacugagacuccggaucuaucauggcgggguggagccgagccugcgcaaagucguuuggagauaccuucugaacguguauccugacggacucacgggccgggaacgcauggauuacaugaagagaaaaucucgggaguacgagcagcugaaguccgaaugggcucagagagccaaucccgaggaccuggaauuuauucgcagcaccgugcucaaggauguccugcggacagacagagcucacccuuauuacgccgggcccgaggauggaccccaucuucgcgcccugcacgaccuccugaccacauaugcugugacccacccucagguuucuuacugucaaggcaugagcgaucuugcguccccgauccuggccgugauggaccaugaaggccacgcuuucgucugcuuuugugggauuaugaaacggcucgccgccaacuuccaucccgauggcagagcuauggccacgaaguuugcgcaccugaaacugcuccugcgccacgcugacccugauuucuaucaguaccuucaggaggccggagccgacgaccuguucuuuugcuaucgguggcuccugcuggagcuuaagagagaguucgcuuuugaugacgcccuccgcaugcuggaagugacauggucuagccugcccccugaucccccggaacaugagguugaacucguggggccucccucccaagucgcugacgccggauucggcgggcaccggggauggccugugagacagcgccauaugcugcggcccgcgggcggcgggggaagcaccuuugaggaugccgucgaccaccuugcuacagccucucagggcccugggggaggcgggagacugcuccggcaggcuucccuggauggccugcaacagcuucgcgacaauaugggaagcagacgggauccccucgugcagcugccgcauccugccgcgcugaucucuuccaaaagccucuccgagccccugcuuaacucucccgacccucugcucagcuccuucucucacccggauagccccuccuccucuuccccucccagcacccaggaagccucuccuaccggcgacauggcuguugggagcccccugaugcaagaggugggaagcccuaaggaucccggcaaaucucugccgccugugcccccuauggggcuucccccgccucaggaauuuggaagaggcaaucccuucaugcucuuucugugucuggccauucuccuggagcaccgcgaccauaucaugcggaacgggcuugacuacaaugagcuggcuaugcacuucgauagacucguccgcaagcaucaccugggcagaguucugcggcgcgccagagcccuuuuugcugacuaccuccagagcgaagugugggauuccgaggaaggagcggaggccacagcugccagcuga

SEQ ID NO: 76622 - RNA, 2787 nt, Artificial Sequence
  derived and/or modified sequence opt5 from TBC1D2__Homo_sapiens__NP_001254500
auggaaggcgccggggaaaacgcucccgagagcuccucuagcgccccuggauccgaagagucugcgagagacccccaggugcccccucccgaagaggagagcggcgauugcgcucggucccuggaagccgucccuaagaaacucuguggguaccugucuaaguucggaggcaaagggcccauccgcggauggaaaagcagaugguuuuucuaugacgagcggaagugccaacuuuacuauucccgcaccgcccaggaugcuaauccucuggacagcauugaucucucuuccgccguuuuugacuguaaggcugaugccgaagagggcaucuucgagauuaagacaccgagcagagugaucacgcugaaagcggccaccaagcaggcuaugcuuuacuggcugcagcaacuccagaugaaacggugggaauuucacaacucucccccugcucccccugcuacacccgacgccgcgcuggccggcaaugggccggugcugcaucucgagcugggacaggaagaggcugaacuugaggaguuccugugcccugucaagaccccgccuggccucguggggguugccgcugcccugcagcccuuucccgcccuucaaaacauuucccugaaacaccucggaacagaaauccagaauaccaugcauaacauccgcggcaauaagcaggcucaggggacaggacacgagccuccgggcgaagauagcccccaaucuggcgagccucagagagaggaacagccccuggcguccgacgccagcaccccugggcgggagcccgaagauuccccgaagccugcucccaaaccuucucugacgauuagcuucgcccaaaaggccaaacgccagaacaauaccuuucccuucuuuuccgagggaaucacaagaaaccggaccgcucaggaaaagguggccgcgcucgagcagcaaguccugaugcuuacaaaagaacuuaagagccagaaagagcucgugaagauucugcauaaggcucuugaggccgcccagcaggaaaaacgcgcuucuuccgccuaucuggcugccgcggaggacaaggauagacucgaacugguucggcacaaagugcgccaaaucgccgagcugggcagacgggucgaggcucucgaacaggagagagaaagccuggcccacaccgcuucucuucgcgagcaacaggugcaggaacugcagcagcaugugcagcuccugauggacaagaaucacgccaaacaacaggucauuuguaagcugagcgagaagguuacgcaggacuucacacauccucccgaucaauccccgcugcggccugacgcggccaacagagauuuucucucucagcaggggaaaaucgagcaccugaaggacgauauggaagccuaccgcacccagaauugcuuccugaacagcgagauucaccaagugacaaaaaucuggcggaagguggccgaaaaagagaaggcucuccugaccaagugugccuaucuucaggccagaaauugccaggucgaauccaaauaccuggcuggacuccgccggcugcaggaggcgcugggcgacgaggccagcgaauguucugagcuucucagacaacuggugcaggaagcucugcagugggaggccggggaagccuccagcgauucuaucgagcucucccccauuagcaaguacgacgaguauggauuccugaccguucccgauuacgaaguggaggaccuuaaacugcucgcuaagauccaggcccuggaaucccgcucucaucaucugcuuggccucgaggcggucgaucggccucugagagagcgcugggcugcccugggcgaccucgugccgagcgccgaacugaaacaacuucugcgggcugggguucccagagagcaccggccucgcguguggagauggcucguccaccuucgggugcagcaucugcacacacccggaugcuaucaggaacugcucuccagaggccaagcccgcgagcacccugcggcucggcagauugaacuggaccugaacagaacguuucccaacaauaagcauuucaccuguccuacaucuagcuuucccgauaagcuccgcagaguccugcuugccuucuccuggcagaacccgaccaucggguacugccagggacugaaucggcucgccgcuauugcccugcuggugcuugaggaggaagagagcgcuuuuuggugccucguugccaucguggaaacaaucaugccugcggacuauuacuguaacacccugacggccucucaagucgaucagcgcgugcugcaggaccuccuguccgagaaacuucccagacugauggcucaccucggccagcaucacguugaucugagccuggugacauucaauugguuucuugucguguucgccgacucucugauuuccaacauccuccugcgggugugggaugcuuuucucuaugaagggaccaagguugucuuccgcuacgcccuggccauuuuuaaauacaaugagaaggagauccuuagacugcaaaacggccucgaaauuuaucaguaccugcgguucuuuaccaaaacaaucagcaauucucgcaagcugaugaacaucgcuuucaaugacaugaacccuuucagaaugaaacagcuucggcagcugcgcauggugcacagagagcggcucgaagcggagcugagagaacucgagcaacugaaggccgaguaucuugaacgccgggcuagcagacgccgggccguguccgagggaugcgccagcgaagaugaggucgagggcgaggcuuga

SEQ ID NO: 76623 - RNA, 3774 nt, Artificial Sequence
  derived and/or modified sequence opt5 from TBC1D32__Homo_sapiens__NP_689943
auggcccacuucagcuccgaggaccaggcuaugcugcaagccaugcucagacggcuguuucagucugugaaggagaaaaucaccggcgcgcccagccuugaaugcgcugaagagauucugcuccaucuggaagagacagaugagaacuuccacaauuacgaauuugucaaguaucuucgccagcauaucgggaacacgcugggauccaugauugaggaagagauggagaaauguaccucugacagaaaucagggcgaagagugcggguacgauacaguugugcaacaggugaccaagcggacacaggaaagcaaagaguauaaggaaaugaugcacuaccucaagaacaucaugauugccgucguggaguccaugaucaauaaauucgaggaagacgagacccgcaaccaggaaagacaaaagaaaauccagaaggagaaaucucauagcuaucggacagauaauuguuccgacagcgauucuucccugaaccagagcuacaaguuuugccagggaaagcugcaacucauucuggaccagcuugauccuggccagccgaaagaaguucgcuaugaggcccugcaaacccucuguucugcucccccuuccgacgugcugaauugcgagaacuggacgacccuuugugaaaagcugacagucagccucucugaucccgacccuguguucuccgauagaauccugaaauuuugcgcccagaccuuccugcucagcccccugcacaugacaaaggagauuuacaccucccuugcuaaauaccuggaaucuuauuuucucagccgggagaaucacaucccuacgcuguccgccgggguugacauuacaaacccgaauaugacccgccuucugaagaaagugagacuccugaacgaauaccagaaggaggcgcccagcuucuggauccggcauccugagaaguauauggaagagauugucgaaucuacacugucccuccugaccgugaaacacaaucagagccauguggucucucaaaagauccuugaccccaucuacuuuuucgcccugguugauaccaaagcugugugguuuaagaaauggaugcacgcccacuauagccgcacaacggugcucagacugcuugagaccaaguacaagucccuggucacaaccgcuauucagcagugugugcaguauuucgagaugugcaaaacacggaaggccgacgaaacccucggacauucuaaacacugucgcaacaagcagaaaacguucuacuaccugggccaagagcugcaguauaucuacuuuauucauagccucugccugcuuggcagacugcucaucuauaagcaggggcggaagcuguucccuauuaaacugaagaacaaaaagggacuuguuucccucaucgaucugcuggugcucuuuacacaacugaucuacuauagccccucuugcccgaaaaugaccuccgcggcccacagcgaaaauuacucuccugcuuccauggucaccgaggugcuuuggauucugagcgaccagaaggaaugugccguugagugccucuauaacaauaucgugauugagacacugcugcagcccauccauaaccuuaugaagggcaaugaagcuagcccuaacuguucugagaccgcccucauucacaucgccgggauccuggcuagaauugcgagcgucgaagagggacugauccuccugcuuuacggcgccaauaugaacuccucugaagagagccccacaggggcucacauuaucgcccaguucuccaaaaagcugcucgaugaggacauuagcaucuuuucuggauccgaaaugcugcccguggucaaaggcgccuucauuagcgugugccgccauaucuacucuacgugugagggccugcaaguucuuaucaccuauaaucuccacgaauccauugcuaaggccuggaaaaagacaagccugcugucugagcggaucccuaccccgguggaagggagcgauuccgucagcucugugucccaggagagccagaacauuauggcgugggaggacaaucuccuggaugaccuucugcauuuugcugccacacccaaaggacuccugcugcuucaaagaaccggcgccaucaacgaaugcguuacguucauuuuuaaucgcuacgcuaagaagcuccaggugucccggcacaaaaaguucggguauggaguccuggugaccagaguggccucuacagcugccggcgggaucgcgcugaaaaagagcggauuuaucaacgagcucauuaccgaacugugguccaaucuugaguacggccgcgaugacguucgggucacacacccuagaaccacgcccguggacccuaucgaucgcucuugucagaaauccuuccuggcccucgugaaccugcuguccuaucccgcuauuuacgagcuuguccggaaccaggaccugccgaauaagacagaauauucucucagagaggugccuaccugcguuaucgauauuaucgaccgccugaucauucucaacagcgaagccaagauccggucccuguuuaauuacgagcaaagccauauuuucggccuuagagauuucaucauugacgggcugucuguggaacggaaccacguccucgugcgcaucaaucugguuggaggcccccuggagagaauccuuccuccccggcugcucgagaaauccgauaacccuuaccccuggccgauguuuagcucuuauccucugcccaauuguuaccucuccgacauuacaagaaacgcugggaucaagcaggauaaugaccuggauaaacuucugcucugccugaagauuagcgacaaacagaccgaauggaucgagaacugucagcgccaauucugcaagaugaugaaggccaaacccgauauuaucucuggagaagcgcugauugagcuucuggaaaaguuugugcuccaucugaccgaguccccuagcgagugcuauuucccguccgucgaauacacagccacggacgcuaaugugaaaaacgagagccucucuagcguucagcagcugggcaucaagaugaccgugcgguaugggaaauuucuuucccugcugaaggacggcgccgaaaaugaucucacauggguccugaagcacugugagagauuccuuaaacagcaacagaccucuaucaagagcucccugcucugccugcagggaaacuacgcuggccaugacugguuugugucuagccucuucaugauuaugcugggggauaaagaaaagacauuucaauuccuucaccaguuuucccgccugcugaccucugccuuccucuggcugcccagacuucacaucagcuccuaucugccuaaugacacgguggagagcggcauucaucccgucuacuuuuguucuacacacuacaucgagaugcuccugaaagccgaacucccucugguuuucuccgcuuuccauaugagcggauuugcgcccucucagauuugccuucaguggaucacccaauguuucuggaacuaucuggauuggaucgagauuugccacuacaucgccaccuguguguuucuggggccugacuaucagguguacauuugcaucgcugucuucaagcaucuccagcaggauauucugcaacacacacagacccaggaccuucagguguuucugaaagaagaggcccuccacggauuccggguuuccgauuauuuugaguacauggaaauccuggagcaaaacuaucgcacagugcuccugagagacaugcggaauauccgccuucagagcacguga

SEQ ID NO: 76624 - RNA, 1584 nt, Artificial Sequence
  derived and/or modified sequence opt5 from TBC1D3C__Homo_sapiens__XP_006721970
auggacguggucgagguugccggcagcuggugggcucaggaaagagaggauaucauuaugaaguacgaaaaagggcaccgggccggacugcccgaggacaagggcccuaaaccguuccgcuccuauaacaauaacguggaucaucucgggaucgugcacgaaaccgagcugcccccucuuacagcgagagaggcuaagcaaauucggcgcgaaaucucuagaaaaagcaagugggucgacaugcugggagauugggagaaguacaaauccucucggaagcucauugaccgcgccuauaaaggcaugcccaugaauaucagagggccuauguggagcgugcugcuuaacacggaagagaugaagcugaaaaaucccggacgguaccagaucaugaaggagaagggcaaacgcuccucugaacauauucagagaaucgaucgggacguuagcggcacccuccgcaagcacaucuuuuucagagaucgguaugggacaaaacagcgcgagcugcugcauauucuccuggccuacgaagaguauaacccugaagugggauacugcagagaccuuucccacauugcugcccuguuucuccuguaccuuccggaggaggaugcuuucugggcccugguccaacuccuggcgagcgaacggcacucucugcagggcuuucauucccccaaugggggaaccgugcagggccuccaggaccaacaggagcacguuguggccacaagccagccuaagaccauggggcaucagaucucucugggacuuacacugagacucugggaugucuaucugguggaaggcgagcaagcucuuaugcccauuacccgcaucgccuucaaagugcagcagaagcggcugacgaaaaccuccagauguggcccuugggcucgcuuuugcaaccgguucgucgacacaugggccagagacgaagauaccguucucaagcaccuccgcgcgagcaugaagaaacugacacggaagaaaggggaccugcccccgccugccaagcccgagcaaggaucuuccgcuagcagaccugugcccgccucccgcggcgggaaaacccuguguaagggagaucggcaggcucccccuggcccgcccgccagauuuccucgccccaucuggucugccagcccuccccgggcuccgagauccagcacgccuugccccgggggagcggugcgggaggacacauacccugucggcacccagggcgugcccucuccugcccuugcucaagggggaccccagggcuccuggcgcuuccugcaguggaauagcaugccgagacucccuacagaucuggacguugaagggcccugguuucggcacuaugauuucagacagucuuguugggugcgcgccauuagccaggaggaccaacuugcccccugcuggcaggcugaacauccugccgagcgggucagauccgcguuugcugccccgucuaccgauagcgaccagggaacccccuuccgcgccagagaugaacagcaaugugcuccuacauccggccccugccugugugggcuccaccuggagagcucucaguucccucccggcuuuuga

SEQ ID NO: 76625 - RNA, 1650 nt, Artificial Sequence
  derived and/or modified sequence opt5 from TBC1D3F__Homo_sapiens__NP_115634
auggacguggucgagguugccggcagcuggugggcucaggaaagagaggauaucauuaugaaguacgaaaaagggcaccgggccggacugcccgaggacaagggcccuaaaccguuccgcuccuauaauaauaacguggaucaucucgggaucgugcacgaaaccgagcugcccccucuuacagcgagagaggcuaagcaaauucggcgcgaaaucucuagaaaaagcaagugggucgacaugcugggagauugggagaaguacaaauccucucggaagcucauugaccgcgccuauaaaggcaugcccaugaauaucagagggccuauguggagcgugcugcuuaacaucgaagagaugaagcugaaaaaucccggacgguaccagauuaugaaggagaagggcaaacgcuccucugaacauauccagagaauugaucgggacguuagcggcacgcuccgcaagcacaucuuuuucagagaucgguaugggaccaaacagcgcgagcugcugcauauucuccuggccuacgaagaguauaacccugaagugggauacugcagagaccuuucccacaucgcugcccuguuucuccuguaccuuccggaggaggaugcuuucugggcccugguccaacuccuggcgagcgaacggcacucucugcagggcuuucauucccccaaugggggaacagugcagggccuccaggaccaacaggagcacguuguggccaccagccagccuaagacaauggggcaucaggauaaaaaggaccuguguggacaaugcucuccccuuggcugucugauuagaauccucaucgacggcauuucccuggggcuuacccugcgccucugggaugucuaucugguggaaggagagcaggcucugaugccuaucacacggauugccuucaaagugcagcaaaagagacucaccaagacgagccgcugcggccccugggcucgguuuuguaacagauucgucgacaccugggcccgcgaugaagacacaguucugaaacaccuucgggcgucuaugaagaaacugaccagaaagaaaggggaugugccgccucccgccaagccugagcagggauccagcgcuucccgccccgugcccgccucucggggcgggaagacacucugcaaaggagacagacaggcuccuccggggcccccugcccgcuuuccccggccuaucuggagcgccuccccgcccagagcuccucggagcucuacccccuguccuggcggcgcgguccgcgaggauacguaccccgugggaacacagggcguuccuucccccgcccuggcucaagggggaccgcagggcagcuggagauuccuucaguggaacucuaugccucggcugcccaccgaccucgauguggaagggcccugguuuagacacuaugacuuccgccagagcugcuggguccgggccauuucccaagaggaucagcuggccccuuguuggcaggcugaacauccggccgagagagugcgcucugcguuugcugcccccagcacagacuccgaccagggcaccccuuucagagcccgggaugaacaacagugcgcucccaccagcggaccuugucugugcggccuccaccuggagucuucccaguuucccccuggguucuga

SEQ ID NO: 76626 - RNA, 3873 nt, Artificial Sequence
  derived and/or modified sequence opt5 from TBC1D4__Homo_sapiens__NP_001273587
auggagcccccuagcugcauccaggacgaaccguucccccacccucuggagcccgaaccuggcguguccgcccaacccgggccuggaaagccgucugauaaaagauuucggcucugguacgucggcgggagcugucuggaccaucgcaccacacuucccaugcugccuuggcucauggcugagauuagacggcgcucccagaagcccgaagccggaggcugcggggcgccugcugccagagagguuauccuggugcuuucugcccccuuccugcggugugugccggcuccuggagccggcgcuagcggcgggacgucccccucugccacccagccuaaccccgcggucuuuauuuucgagcacaaagcccagcauaucagccgcuuuauucacaauucccaugaucucacauauuucgcuuaccugaucaaggcccaacccgacgauccugaaagccagauggcuugccacguguuuagagccaccgacccgucucagguucccgaugugaucuccagcauucggcagcugucuaaagcggccaugaaggaggacgcuaagccuuccaaagauaacgaagacgccuucuauaauagccaaaaguuugagguccucuacuguggaaaagugacaguuacccacaagaaagcucccucuucccugaucgaugacugcauggagaaguucagccuucaugaacagcagcgccugaagauucagggcgagcaaagagggccugaucccggagaagaccucgccgaccuggagguggucgugccgggcuccccuggggauugucuucccgaagaggccgacggaacagauacccaccugggccucccugcuggcgcgucucagcccgcccugacgagcucccgggugugcuuuccugagcgcauccuggaagacagcggguucgaugagcagcaagaauuuagaucucgguguuccagcgucaccggaguucagcgcagagugcaugagggcucucagaaaagccagccccggagacgccacgcuuccgccccgucucacgugcaaccuagcgacuccgaaaagaaccggacaaugcuguuccaggucgggagauucgagauuaaucucaucagccccgauaccaaaucugugguucuugagaagaacuuuaaagacauuuccagcugcucucagggaaucaagcauguggaucacuucggcuuuaucugucgcgaaucccccgagccugggcugagccaguauauuugcuacgucuuccaaugcgccuccgaaucucucguggacgagguuaugcugacacuuaaacaggcuuuuagcaccgccgcggcucugcaguccgccaagacgcagaucaagcucugugaagccugcccgaugcauucucugcacaaacugugugagcggauugagggacucuaucccccuagagcuaagcuggugauccaacgccaucuuagcucccugacagauaaugaacaggccgacauuuucgagcggguccagaaaaugaagcccgugagcgaccaggaagagaacgagcucgucauccugcaccuuagacaacugugcgaagcuaaacagaagacccacgugcauaucggcgagggcccuucuacaauuuccaauagcaccauccccgaaaacgccaccucuuccgggcgcuuuaagcucgauauucugaaaaauaaggcgaaacggagccugacaucuagccucgagaacaucuucuccagaggagccaaucgcaugcggggcagacuggggagcguugacucuuuugaacgguccaacagccuugcuuccgagaaggauuacucuccuggagacagcccgcccggcacgccucccgccuccccucccucuagcgcuuggcagaccuucccggaggaagauuccgacucuccucaauuucgcagacgggcccacacauucagccaucccccuuccagcaccaaaagaaagcugaaucuccaggaugggcgcgcgcagggcgugcggucuccccugcugagacaguccagcucugagcaauguuccaaccuuagcucuguccgcagaauguacaaggaauccaacagcuccagcucucuccccagccugcacacauccuuuucugccccuagcuucaccgcuccguccuuccugaaaucuuuuuaucagaauagcggacggcucucuccccaguacgagaacgaaauuuccgacggcgaggggcgcaagagaacgagcuccacaugcagcaaugagucucuguccgugggaggcaccagcguuaccccucggcgcaucucuuggagacagcggaucuuccuucgcguggccucccccaugaacaaaagcccuuccgcuaugcaacagcaggaugggcuggacagaaaugaacuccugccccugucuccucuuagcccgacaauggaggaagaaccccucgucguguuucuguccggagaagaugacccugagaagauugaggaacggaaaaagagcaaggagcugcgcucucucuggagaaaagccauccaccagcaaauucugcuucugcggauggaaaaggagaaccagaaacucgaggccuccagagaugaacugcagagccgcaaggugaaacuggacuaugaggaaguuggcgcuugucaaaaggagguccuuaucaccugggacaaaaagcuccugaauugccgggcgaagauuagaugugauauggaagacauccauacacugcucaaagagggggugcccaagucucgccggggcgagauuuggcaguuccuggcccuucaguacagacugcgccaccggcucccuaacaaacagcaacccccggauaucagcuauaaggaacugcugaaacagcuuacggcucagcagcaugccauccucguggaccugggaagaaccuuuccuacacaccccuacuucuccguccaacugggccccgggcagcucucucuguuuaaucuucugaaggccuauagccuccuggauaaggaggugggauacugccagggcauuuccuucguugcuggggugcugcuucugcauaugucugaggagcaggccuuugaaaugcucaaauuccugauguacgaccucggauuucgcaagcaauaucggccugauaugaugagccugcagauccagauguaccagcuuuccagacugcuccacgacuaucaccgggaucuguacaaccaucuggaggagaaugaaauuagccccucucuuuaugcggcuccuugguuccugacccucuuugccucccaauucagccugggcuucgucgcccgcguguuugacaucauuuuccuccaggggacagagguuaucuuuaaaguggcucugucccuucugucuagccaggaaacccucaucauggagugugaauccuucgagaacauugucgaguuucugaagaauacgcugccggauaugaacaccucugaaauggagaaaaucauuacacaaguguucgaaauggacaucagcaagcagcuucacgccuacgagguugaguaucaugugcugcaggaugaacuccaggaguccagcuacucuugcgaagacuccgagacccuggaaaagcucgagagagcgaauagccaacugaaacggcagaacauggaccuucuggagaagcugcaggucgcucacacaaaaauucaggcccucgaaucuaaccuggagaaucuucugacccgcgaaacgaagaugaaaucccucaucagaacacuggagcaagaaaagauggccuaccagaagaccguggagcagcuccggaaacugcuucccgcugaugcccuggugaacugcgaccugcuccugagagaucuuaauuguaacccuaauaacaaggcuaaaaucggcaauaagcccuga

SEQ ID NO: 76627 - RNA, 2454 nt, Artificial Sequence
  derived and/or modified sequence opt5 from TBC1D5__Homo_sapiens__NP_001127853
auguaccacagccuguccgagaccagacauccccuccagccugaagaacaagaagugggcaucgacccgcugucuagcuauuccaacaagucugggggagauagcaauaaaaacggccggcgcacauccucuacgcuugacagcgaggggaccuucaauuccuacagaaaggaaugggaggagcuguuugucaacaauaacuaucucgccacaauucggcagaaaggaaucaauggccagcugcgcagcucuagauuccgguccauuugcuggaagcuguuucuguguguucucccccaggauaaaagccaauggaucucucgcauugaggagcugagagcuugguacuccaacaucaaggaaauccacauuaccaauccucggaaggugguggggcagcaggaccugaugaucaacaauccccucagccaggaugagggaucucuguggaacaaauucuuucaagacaaggagcuucgcuccaugauugaacaggaugucaaaagaacauucccugagaugcaguuuuuccagcaagaaaaugugcggaagauccugaccgacguucucuuuugcuaugcccgcgagaacgaacagcugcuuuacaaacagggcaugcaugagcugcucgcgcccauuguguucguccugcacugugaucaucaggcuuuucugcacgccagcgaguccgcccaaccuucugaagagaugaagacagugcucaauccggaauaucuggagcacgacgcuuacgccguuuucagccagcuuauggaaaccgcugagcccugguuuuccacguucgagcaugauggccagaaggggaaagaaacccugaugacaccuauccccuucgccagaccucaagaccucggacccaccauugcgaucgugacaaaggucaaccagauccaggaucaccuucuuaaaaagcaugacauugagcuguacaugcaccucaaccggcuggaaaucgccccgcagauuuauggccugcgcugggugagacuccuguuugggcgggaguucccucuucaagaccugcucguggucugggaugcucuguuugccgacggacuuagccugggccucguugauuacaucuucguggcuaugcugcuguauauuagagacgcccucaucucuuccaauuaccagaccugccuggggcuucugaugcacuaucccuuuaucggagaugugcauagccucauucugaaagcgcuguuccuucgcgacccuaagcggaaccccagacccgucacguaccaguuucacccuaaucucgauuauuacaaagcccgcggcgcugaccugaugaacaagucucggacaaaugccaagggcgcuccgcugaacaucaauaaagugagcaacucccucauuaauuucgggagaaagcugaucucucccgccauggccccuggaagcgcuggcgggcccguuccuggaggcaacuccucuagcuccagcucuguggucauucccacccgcacauccgcggaagccccgagccaucaccuucagcaacagcagcagcaacagcggcugaugaaauccgagucuaugccugugcagcucaauaagggggauguugugaccggaagcgacgcucaagucuccgugcccguccagacccugacagaucugcagggccuuucuagcaaaaacaucuccagcucuccuuccguggagagccuccccggcgggagagaauuuacgggaucuccucccuccagcgccaccaagaaggacucuuucuuuagcaauaucucccgcagccggucucauuccaaaacaaugggcagaaaggagagcgaagaggagcuggaagcccagauuuccuuccugcaagggcagcucaacgaccuggaugcuauguguaaauacugcgccaagguuauggacacccaccuugugaauauccaggaugucauucugcaggagaaccucgaaaaagaggaccaaauccuggugucucuggcgggacuuaagcagauuaaggauauccucaaaggcagccugcgcuuuaaccagucccagcuggaagcugaggagaaugaacaaauuacaaucgccgacaaccacuauuguucuagcgggcagggccagggacggggccaagggcaguccguucagaugucuggagccaucaagcaggcuagcuccgagaccccgggcugcacggauagagggaauagcgacgauuucauucucaucucuaaagacgaugacggauccagcgcccggggcucuuucuccgggcaagcucagccucugcgcacacuuagaagcaccucuggcaagucccaggcccccguguguagcccccuggucuuuuccgauccucucaugggaccggcgagcgccucuagcuccaaccccucuagcuccccugacgacgauucuagcaaagacuccggcuucaccauugugucuccccuggauaucuga

SEQ ID NO: 76628 - RNA, 801 nt, Artificial Sequence
  derived and/or modified sequence opt5 from TBC1D7__Homo_sapiens__NP_001137438
augaccgaggacagccagagaaacuuccgguccguguacuaugaaaaggucggcuuucgcgggguugaggagaaaaagucucuggaaauccuccugaaagaugacagacuuggcauucugcccccucaccaugaaagccacgccaaggugaugauguaccggaaagagcaauaucucgaugugcugcaugcucuuaaggucgugcgcuucguuuccgacgccacaccgcaggcggagguguaccugagaauguaucagcucgaaucuggaaagcugccccggagcccuuccuuuccccuggagccugaugacgaagucuuccucgcuaucgccaaagccauggaggagaugguggaagauucuguugacugcuacuggauuacgcgcagauuugugaaucagcugaacaccaaguaucgggauagccuuccccaacugccuaaggcuuucgagcaguaccucaaucuggaagacgggcgccuucugacacaccucagaauguguuccgccgcuccgaaacugcccuacgaucugugguuuaaacggugcuucgccggaugucucccugagagcucucugcagcgcgucugggacaaggugguguccggcagcugcaagauccuugucuuuguugcgguggaaauucugcucaccuucaaaaucaaggugauggcccugaacucugcugagaaaaucacaaaguuucuugagaauauuccccaggauuccagcgacgccaucgucucuaaagcuauugaccuguggcauaagcacugugggaccccugugcacuccagcuga

SEQ ID NO: 76629 - RNA, 3423 nt, Artificial Sequence
  derived and/or modified sequence opt5 from TBC1D8__Homo_sapiens__NP_001095896
auguggcugaagcccgaggaagugcuccugaaaaacgcccuuaagcugugggucacccagaaaagcuccugcuacuucauccuccaaagacggcgcggccacggggagggaggcgggagacugacaggacggcuuguuggcgcucuggacgccgugcucgauucuaaugcgcgcguggcuccuuuucggauucugcugcaggucccggggagccagguguauucccccaucgccuguggagccacgcucgaagagauuaaccagcauugggacuggcuggaacaaaaucuucugcacacccucucuguuuucgauaacaaggacgauaucgcuagcuuugugaaaggcaaggucaaggcccugauugcugaggagacauccucucggcuugccgaacaggaggaagaaccugagaaauuccgcgaagcgcuggugaaguuugaggccagauucaauuuucccgaagcugagaaacucguuaccuacuauagcugcuguugcuggaagggccgggugccucgccagggguggcuguaccuguccaucaaccaucucuguuucuauagcuuuuuccugggaaaagaacuuaagcuggucgugcccuggguggacauccagaagcucgagagaacaucuaaugucuuucugaccgauacaauucggaucaccacgcaaaacaaagagcgcgacuucuccauguuucuuaaucuggaugaaguuuucaaggugauggagcagcucgccgacgugacccugagacggcugcucgauaacgaagucuucgaccuggauccugaccuucaggagccgagccagauuacaaaacgcgaccuggaagcuagagcccaaaaugaguuuuuccgggcguuuuucagacucccccgcaaggagaaacugcacgccgugguugauugcucucuuuggaccccuuuuucccggugucauacaaccggcagaauguucgcuagcgacucuuacaucugcuuugccucccgcgaagauggguguugcaagauuauccugccccuccgggagguggucagcauugagaaaauggaggacacgucccugcugccucaccccaucaucgugucuauuagaagcaagguugcuuuccaguuuaucgaacuccgcgaucgggacucccugguggaggcccuucuggccagacucaagcagguccacgcuaaccauccggugcacuaugauacaagcgcggacgaugacauggccucucuggucuuccauuccaccagcauguguucugaucaccgcuuuggagaccuggagaugaugagcucccaaaauucugaagagagcgaaaaagagaaguccccucuuaugcaccccgacgcucucgugacagccuuccagcagagcggcucucaguccccugauagccggaugucuagagagcaaauuaaaaucucccuguggaacgaccauuuuguugaauacgggcgcaccgugugcauguuccggaccgagaagauuagaaaacuggucgccaugggaauccccgaaagccuccggggccgccuguggcuucuguucuccgaugcugugacagaccucgccucucaccccggcuacuaugggaaucugguugaggaaagccugggaaagugcugucuugugacggaggagaucgaaagagaucuccaucggucccugccugagcacccggcguuucagaacgaaaccggcauugcugcccugagacgcguccucacagccuacgcucaucggaaccccaagaucggguauugccagucuaugaauauucugaccagcgugcuucugcucuacacaaaagaggaagaggccuucuggcugcugguggcuguuugugagagaaugcuuccugacuauuuuaaccaccgcgucaucggagcccagguggaucaauccguguucgaggaacucauuaagggccaucugcccgaacuggcggagcacaugaaugaccucagcgcccuggcuucugucucccuuagcugguuucugacccucuuccugucuaucaugccucuggaauccgccgugaacguuguggauugcuuuuucuacgacgggaucaaagcuauuuuucagcuuggacucgccguccuggaggcgaaugccgaggaucuguguagcucuaaggacgauggccaggcucucaugauccugagcagauuccuugaccacauuaaaaacgaagacucccccggcccgccuguggggagccaucacgccuuuuucucugaugaccaggagcccuauccuguuacggauaucuccgaccugauucgggauagcuacgaaaaguuuggagaccaauccguggagcagaucgagcaccuccgcuacaagcauagaauuagaguccugcagggccacgaagauacaaccaaacagaaugugcugcgcguugugauccccgaggucucuauccuuccugaagaccuggaggaacucuaugaucuguucaagagagagcauaugaugagcugcuacugggagcaaccccggccgauggcuucccgccacgacccuucuagacccuaugccgaacaguaccggauugaugcccgccaguucgcucaucucuuucaacuggugagccccuggaccuguggggcgcacacagagauccuugccgaaagaaccuuccggcugcucgacgauaacauggaccagcugauugaguuuaaggcuuucguguccugccuggacaucauguauaauggagaaaugaacgagaaaauuaaacuucuguacagacuccacaucccuccggcccugacagagaaugaucgcgacucucagagcccccuccggaacccucugcuuuccacgagcagaccccuggucuuuggcaagccuaauggggaugccguugacuaucagaagcaacucaaacagaugaucaaggaucuggcuaaagaaaaggacaaaaccgagaaggaacugcccaaaaugucucagcgcgaguucauucaguuuuguaagacacuuuacuccauguuccaugaagauccugaggagaacgaccuguaccaagccaucgcgaccgugacaacccuccugcuccagauuggcgaagugggacagcggggcucuagcuccgggagcugcucucaggaguguggagaggaacugagagcuuccgcccccagcccggaggauuccgucuuugccgacacgggcaagaccccucaagauagccaggcuuuccccgaagccgcggagcgcgacuggacagugucucuugaacacauccuggcuagccugcucaccgagcagucccugguuaacuuuuucgaaaaaccucuugacaugaagucuaaacuggagaaugccaagauuaaccaauauaaucucaaaacauucgagaugagccaucagucccagucugaacugaagcucagcaaccuguga

SEQ ID NO: 76630 - RNA, 3801 nt, Artificial Sequence
  derived and/or modified sequence opt5 from TBC1D9__Homo_sapiens__NP_055945
augugggugaaccccgaggaaguccugcucgccaaugcucuguggaucaccgagagagccaacccuuacuucauucuucagcggcgcaagggccacgcgggggacggaggcgggggaggcgggcuggcuggacuccugguuggcacacuugauguggugcuggacagcuccgccagagucgccccguaucggauccucuaccaaacgcccgauucucugguguauuggaccauugcuugcggcgggagccgcaaagaaaucacagagcauugggaauggcuggagcagaaucuccugcagacccuuuccauuuuugagaacgaaaaugacaucacaaccuucguuagaggaaagauccagggcauuaucgccgaguacaacaaaauuaaugaugugaaggaagacgaugacacagagaaauuuaaggaggcuaucgucaaguuccaccggcuguuugggaugccugaagaggaaaaacucgugaacuauuacucuuguagcuauuggaagggaaaaguuccccgccaaggcuggauguaccuguccauuaaucaucuuugcuucuacucuuuucugauggggagagaggccaagcucgugauccggugggucgauauuacccagcuggaaaagaacgcgacgcugcuccugccugacgugaucaaggugagcacccgcuccagcgagcacuucuuuucugucuuccuuaauaucaacgagacauuuaagcugauggaacagcucgccaauauugcuaugagacagcugcuugauaacgagggauucgaacaagaccggucccugcccaaacucaagcgcaaaagcccuaagaaaguuucugcccugaagagagaucuggacgcucgggccaaauccgagcgcuauagagcgcucuuucggcugccgaaggacgaaaaacuugauggccauaccgacuguacacuguggacccccuucaauaaaaugcacauccucggccagauguucgugagcacgaacuacauuugcuuuacaucuaaggaggagaaccuguguucccuuaucauuccucugagagaagugaccaucgucgagaaagccgauagcuccucugugcuccccagcccucuguccaucagcacacgcaaucggaugaccuuccuguuugcuaaccucaaggacagagauuuccugguucagcgcauuucugacuuucuucagcaaaccacauccaaaaucuauagcgauaaggaguucgccgggucuuacaauagcuccgacgaugaaguguauucucggcccagcucccuggucuccucuuccccgcagagaagcacgucuuccgacgcugauggagaacgccaguuuaaccucaauggcaacagcgugccuaccgccacacaaacccugaugacaauguaccggagacgcucccccgaggaguucaauccuaagcuggccaaagaauuucuuaaggagcaggcuuggaaaauucacuucgcggaauaugggcagggaaucugcauguaccggaccgagaagacgagagagcucguucugaaaggcauucccgaaucuaugcgcggggagcuguggcuccugcuuagcggagccaucaacgaaaaggcuacacaucccggcuacuaugaggaccugguggaaaaguccaugggcaaauacaaucucgccaccgaggagaucgaacgggaccugcacagaucucugccugagcauccggccuuucagaacgaaauggggauugcugcccuucggcgcguccucaccgcguaugcuuucagaaaucccaacaucggauacugucaagccaugaauauugugacaagcguccugcugcucuaugccaaggaggaagaggcuuuuuggcugcuuguggcccugugcgagcggaugcucccugauuacuauaacaccagaguugugggcgcucuggucgaccaggggguguucgaggaacuggcccgcgauuacguuccccagcuuuacgacuguaugcaggaucucggagugaucuccacaauuagccugucuugguuccugacgcucuuucuguccgucaugccuuucgaaagcgcgguggugguugucgacugcuuuuucuaugagggcaucaaagugauuuuucaacuugcccuggcugugcucgaugccaaugucgacaagcugcugaacuguaaagaugacggggaagcuaugaccgugcuuggccgguaccucgauucuguuacaaacaaggacuccacccugcccccgaucccucaucugcacagccuccugucugaugacguggagcccuauccugaggucgacaucuucagacuuauucgcacaagcuacgaaaaguuuggaaccaucagagccgaucugauugagcagaugcgguucaaacagcgccucaaggugauccagacgcuggaagacaccacaaaaagaaauguugugcggaccauugucacagagaccuccuuuacgaucgaugagcuggaggaacuuuaugcgcuguucaaggccgaacaccucacaagcugcuacuggggcgggucuuccaacgcucuggaccgccacgaucccagccucccuuaucuggagcaauacagaaucgacuuugaacaguucaaaggaauguuugcccuucuguuccccugggcuugcggcacccauuccgaugugcucgccucucggcuguuccagcugcuugacgagaauggggauagccugauuaacuuucgcgaguucguuuccggacucucugccgcuugucacggcgaccugacagaaaagcucaaacugcuuuacaagaugcaugugcugccggagccuagcuccgaucaggacgaacccgauucugcguuugaggccacccaauauuucuuugaagacaucacccccgagugcacacacgucguggggcucgacagcagauccaagcagggcgcugaugacggauucgugacggucagccugaaaccugauaagggcaaacgggccaauucucaggagaaccgcaauuaccugagacuuuggaccccggaaaacaaguccaaaagcaagaaugccaaggaccugcccaaacucaaccaagggcaguuuauugagcuguguaagacaauguauaauauguucucugaagauccuaacgagcaggaacucuaccacgcuaccgccgcgguuacaucccugcuucuggagaucggagaggugggcaaacuguuuguggcucagcccgccaaggaagggggaagcggcgggucuggcccuuccugccaucaaggcauucccggaguccucuucccuaaaaaggggcccggacagccguaugugguugagagcguggaaccucugcccgccucccuugcuccugacagcgaggagcacucucugggcgggcagauggaagauaucaagcucgaggacagcagcccccgggauaauggagccuguucuagcaugcugaucuccgacgaugacaccaaagacgauucuagcauguccucuuacagcguccucuccgcgggcagccaugaagaggacaagcugcacugcgaagauauuggggaggacacggugcuuguuagaucuggccagggaacagcugcccugccgcgcuccaccagccuggaucgggacugggccaucaccuuugagcaauuccucgcuucucugcuuacagaaccugcccuggugaaauauuucgauaagcccgucuguaugauggcuagaauuaccuccgccaaaaacauccgcaugaugggcaagccucucacaagcgcguccgacuacgagauuucugccaugagcggguga

SEQ ID NO: 76631 - RNA, 390 nt, Artificial Sequence
  derived and/or modified sequence opt5 from TBCA__Homo_sapiens__NP_001284667
auggccgaccccagagugcggcagaucaagauuaaaaccggcgucguuaagcgccuggugaaagagaaggugauguacgaaaaagaggcuaagcaacaggaagagaagaucgagaaaaugagagccgaagauggggagaacuaugacauuaagaaacaggcggaaauccuccaggagagccggaugaugauuccugauugccaacgcagacuggaagcugccuaccuugaccugcagcggauccucgucuccaaggauuucugugugauguuuaaauucuuuuucucuauccaguauauggagagccagaaguuuaaguaccugacacuucgcacguccuggcaauauuuccuguuuaccugcccgcucuacagauauauucugaaauga

SEQ ID NO: 76632 - RNA, 1041 nt, Artificial Sequence
  derived and/or modified sequence opt5 from TBCC__Homo_sapiens__NP_003183
auggagagcguguccugcucugccgcugccgucagaaccggcgacauggaaagccagcgggaucugucccucguucccgagcgccugcaaagacgggaacaggagcgccagcuugaaguggagagacggaagcagaaacgccaaaaccaggagguggaaaaggaaaauucucacuucuuugucgcgacauucgcuagagaacgggccgccguggaggagcugcucgaacgcgcugagagcguugaaagacuggaggaagccgcuucccggcuucaggggcugcagaaacucaucaacgacucuguguuuuuccuggccgcguacgaucugcgccaaggacaggaggcccucgcuagacugcaggccgcucuugccgagcggcgcagaggccugcagccuaagaaacgguuugcguucaagacgagagggaaggacgccgcuagcuccaccaaagucgaugccgcuccgggcauucccccugccguggaaagcauccaagacucuccccucccuaagaaagccgagggagaucuggggcccuccuggguuuguggauuuagcaaucuugaaucucaggugcuggagaagcgcgcuuccgaacuccaucagcgggacguccugcugacagagcucagcaacugcaccgugagacuguauggcaauccuaacacacuucgccugaccaaagcgcacucuuguaagcuccugugcggcccgguguccacaagcgucuuccuugaggauuguuccgacugcguucuggccguggcuugucaacagcuccggauucauucuaccaaggauacgagaaucuuucuccaggugaccagccgcgccauugucgaagacugcuccgggauccaguucgcccccuacacauggagcuauccugagaucgauaaagacuuugaaucuuccggacuggaccggagcaagaauaacuggaaugauguggacgauuucaacuggcuggcuagagacauggccucucccaauuggagcauucugccugaggaggagcgcaacauccaaugggauuga

SEQ ID NO: 76633 - RNA, 3579 nt, Artificial Sequence
  derived and/or modified sequence opt5 from TBCD__Homo_sapiens__NP_005984
auggcccugagcgacgagcccgcugccggcgggccugaagaggaagcggaggaugaaacccucgcuuucggagccgcccuggaggcuuuuggcgaguccgccgaaacaagagcccuucuggggcggcuccgcgaggugcacggaggcggggcugaaagagaggucgcgcuggagcgguuccgcguuaucauggacaaguaccaggaacaaccgcaucuucuggauccccaccucgaguggaugaugaaccugcugcucgacauugugcaggaucagacgucuccugccagccuggugcaucuugcuuuuaaauuccuguauaucauuaccaaggucagaggauacaaaacauuucuccggcuguucccccacgaaguggccgacguugagccugugcuugaucuggucaccauccagaaucccaaggaccaugaggcuugggaaacacgcuauaugcuccugcuguggcucuccgugaccugccugauuccuuuugauuucucuagacuugacggcaaccugcucacacaaccgggccaggcccggaugagcaucauggaucgcauccugcagauugcggaguccuaccuuaucguuucugacaaagccagagaugcugccgcugugcuggucagccgguuuauuacccgccccgacgugaagcaguccaagauggccgaguuccucgacuggagccuguguaaucuggccagaucuuccuuucaaacgaugcagggggugaucaccauggauggaacacuccaggcucuggcgcagauuuucaaacacggcaagcgggaagacugccuuccuuaugccgcuaccguccugcgcugucucgaugggugcagacugcccgaaagcaaccaaacacuucugcggaaacucggaguuaagcuggugcagagacugggccucaccuuucugaaaccuaagguggccgccuggcgcuaccagcggggguguagaucucuugcugccaaucugcaacuccugacgcagggacaguccgagcagaagccccugauccuuacagaagacgaugacgaggaugacgaugucccggagggcguggaacgcguuauugagcaacuccuggugggccugaaagacaaggauaccgucgugcgguggagcgcggcuaaagggaucggaagaauggccggccgccucccucgggcccuggcugacgacguuguggggucuguccuugauugcuucuccuuccaggaaacagacaaggccuggcacggaggcugucuggcucucgccgagcuggggagacgcggacugcuucuccccagccggcugguggaugucguggcgguuauccugaaagcccucaccuaugacgaaaagagaggcgcuugcuccgugggcaccaacguccgcgaugccgcuuguuacgugugcugggccuuugcgcgggccuacgagccucaggagcugaaacccuucguuacagcuauuucuagcgcccuugugaucgcugccgucuuugacagagauauuaauugucggcgcgccgcuuccgcggccuuccaggaaaacguggggagacaaggaacguuuccccauggcaucgacauucugaccacagcugauuauuucgccguggggaaucggagcaacugcuuucucguuaucucugucuucaucgccggauuuccugaguacacccagccgaugauugaccaccuggugacaaugaagaucucccauugggauggcgugauuagagaacuggcugcccgcgcgcuucacaaucucgcucagcaggcccccgaguucagcgccacccaagucuuuccucggcugcugucuaugacgcucagccccgaccugcacaugagacauggguccauccuugcuugcgccgagguggcguaugcucuguacaagcucgccgcccaggaaaaccgcccuguuacagaucaccuggacgagcaggcugugcagggccugaaacaaauucaucagcagcuuuaugacagacaacucuaccggggacugggcgggcagcugaugcgccaggccgucugugugcucaucgaaaagcugucucuuagcaaaaugcccuucagaggagauaccguuaucgacggcuggcaguggcugauuaaugauacccuccggcaucugcaccugaucuccagccacucucgccaacagaugaaggacgcugccguguccgcgcuugccgcucugugcagcgaguauuacaugaaagaaccgggggaggccgauccugcuauucaggaggaacucaucacacaguaccuggccgagcucagaaaccccgaagagaugacccgguguggauuuucucuggcccuuggcgcucugccuggguuccuccugaagggccgccugcaacagguccuuacaggacugagagcggugacgcacaccucccccgaagacguuagcuucgccgagucccggcgcgauggccucaaggcuauugccagaaucugccagacagugggggucaaagccggagcuccugacgaggccguguguggcgaaaaugugucucagauuuauugcgcgcugcucggguguauggaugacuacaccacagauagccggggagacgucggcaccuggguuagaaaggcugccaugacgucccugauggaucuuacccugcuccuggcccgcucucaacccgagcugaucgaagcucauacaugcgagcggaucauguguugcguggcccagcaggcgagcgaaaagauugacagauuucgcgcucacgccgccuccguguuccuuacccugcuccauuuugacagcccgccuaucccccacgucccccaccggggagagcuggagaaacucuucccuagaucugauguggcuuccguuaacuggagcgccccgucucaggcuuuuccccgcauuacacaacugcuuggccugccuaccuaucgguaccaugugcugcucggacuggucgugucccuuggcgggcugacggaaagcacaaucagacacucuacccagagccucuucgaguauaugaaagggauucaguccgacccccaagcccugggcagcuuuucugggacacuccugcagaucuucgaagauaaccuucugaaugagcgcguuuccgugccucugcucaagacccuggaccauguccuuacccacggauguuuugauaucuucacaacggaggaagaccaucccuuugcggugaagcugcucgcccugugcaaaaaggagauuaaaaacagcaaggauauccagaaacuccuguccggcauugcuguuuucugcgaaauggugcaguuuccuggggacguccggagacaagcccuucugcagcugugucuccugcuuugccaccgguucccccugauccgcaagaccacagcuucucagguguacgagacccuccugacauauagcgauguggucggcgccgacguucucgaugaaguggugaccguccuguccgacacggccugggacgcugagcuugcggugguuagagagcagcggaaucgccugugugaucugcucggagugccgagaccucaacuggucccccagccuggcgccugcuga

SEQ ID NO: 76634 - RNA, 1584 nt, Artificial Sequence
  derived and/or modified sequence opt5 from TBCE__Homo_sapiens__NP_001072983
augagcgacacccugacagccgaugugaucggcagacgggucgagguuaacggggaacacgcuacggugcgcuucgccggaguggugcccccugucgcgggcccguggcucgggguugagugggacaaucccgaaagaggaaagcaugauggcucccacgaggggaccguguacuuuaaaugccggcauccuacaggaggcucuuucauucgccccaacaaggucaauuuuggcaccgacuuccugacagcuaucaaaaacagauaugugcuugaagaugggccugaggaggaccggaaggaacagauuguuaccaucggaaauaaacccguggagacaauuggcuuugauagcaucaugaagcaacagucccagcugucuaagcuccaggaagucagccugcgcaacugugccguguccugcgccggggagaaaggaggcguggcugaggccuguccuaauaucagaaaggucgaccuuucuaaaaaccugcucagcuccugggaugaaguuauucacaucgcugaccaacugcggcaucuggaggugcucaaugugagcgaaaacaagcugaaauucccgucuggguccguccuuaccggaacgcugagcgugcucaagguucuggugcuuaaucagaccggcauuacaugggccgagguccugcgcugcguggcgggcugucccgggcucgaagaacuguaccuggagucuaacaauaucuuuauuuccgaaagaccuaccgauguucuccagacagugaagcugcuugaccugagcucuaaccagcucaucgaugagaaucaacuguaucuuauugcccaucugccccggcucgaacagcugauccuguccgacaccggaaucagcucccuccacuucccugacgcuggcauugggugcaaaacgucuauguuucccagccugaaguaccuugucgugaacgauaaccagaucucccaguggagcuucuuuaaugagcuggaaaaacucccgucucugcgcgcccuuuccugucugagaaacccucucacaaaggaggacaaagaggcugaaaccgcccggcugcugauuaucgcgagcauuggacaacucaagacacugaauaaaugcgagauccuucccgaggagcgcagacgggccgaacuggauuauagaaaggcuuucggcaacgaguggaagcaggccgggggacacaaagacccugagaagaaucgccucucugaagaguuucugaccgcucacccccgguaccaguuccugugucuuaaauauggcgcccccgaagauugggagcucaagacccaacagccucugaugcugaaaaaccagcuccugacacuuaagaucaaguacccgcaucagcuggaccaaaaaguccucgagaagcagcugcccggcagcaugacgauucagaaagugaaggggcugcuuuccagacuccugaaaguuccugugucugaucugcuccugagcuacgaaucccccaagaagccuggacgcgagaucgaacuugagaaugaccugaaaagccuccaguucuauucugucgaaaacggcgauugccugcuggugcggugguga

SEQ ID NO: 76635 - RNA, 1275 nt, Artificial Sequence
  derived and/or modified sequence opt5 from TBCEL__Homo_sapiens__NP_001123519
auggaccagcccagcggcagauccuucaugcaagugcugugcgagaaguacucuccugaaaacuuuccguaucggcgcgggcccggaaugggcguccacguuccugccaccccucaggggagccccaugaaagauagacucaaucugcccuccgugcuugugcugaacucuuguggaaucacaugcgcuggcgacgagaaggaaauugccgcguucugugcucaugucagcgagcucgaucuguccgacaauaaacuugaagauuggcacgaggugucuaagaucguuagcaacgugccucagcuggaguuucucaaucuguccagcaacccgcugaaucucucuguccuggaacggacgugcgccggguccuucagcggagugcgcaaacuuguucugaacaauucuaaggccuccugggagaccgugcauaugauucuccaggaacugcccgaccuugaggagcuguuucucugucugaacgauuacgaaacagucagcugcccuucuaucuguugccacucccugaagcuccugcauauuaccgacaauaaccuucaagauuggacagagaucagaaaacugggcgugauguuccccagccucgacacccuggugcuugcuaauaaccaccugaaugccaucgaagaaccugaugacucccucgcucggcuguuucccaaccugcgcucuauuagccuccacaaguccggccugcagagcugggaagauaucgacaaacuuaacucuuucccgaagcuggaggaggucagacuccuggggauuccucuucugcagcccuauacaaccgaggagcggcgcaaacucguuaucgccagacugccuuccgugagcaagcugaauggaucuguggucacggacggcgaacgggaggauagcgaacgcuuuuucauuagauacuauguggacguuccccaggaggaggugcccuuucgguaccaugaacucaucaccaaguaugggaaacuggagccucuugcggaagucgaucugcgcccgcaauccucugccaagguggagguucacuucaacgaccagguggaagagaugagcauuagacucgaucagacagucgcugagcugaaaaagcagcugaaaacccuugugcaacuccccacauccaauaugcugcuguacuacuuugaccaugaagccccuuucggacccgaggaaaugaaguauagcucucgggcucuccacuccuucggcaucagagauggggacaaaaucuacgucgagagcaagaccaaguga

SEQ ID NO: 76636 - RNA, 2190 nt, Artificial Sequence
  derived and/or modified sequence opt5 from TBK1__Homo_sapiens__XP_005268867
augcagagcaccuccaaccaccuguggcuccugucugacauccuuggccaaggggccacagcuaauguguucagaggacggcauaagaaaacgggcgaucuguuugccauuaaggucuucaacaauaucagcuuucuccgccccguugacgugcagaugagagaguucgaagugcugaaaaagcugaaccacaaaaauauugucaagcuguuugcgaucgaggaagagaccacaacccggcauaaggugcucauuauggaguucugcccuugugggucccuguacacaguucuggaggagccgucuaacgcuuauggacuccccgaaagcgaguuucugaucgugcuucgcgaugucgugggcgggaugaaucaccugagagaaaacggaaucguucaucgggacauuaaaccuggcaauaucaugcgcgugauuggcgaggaugggcaguccgucuacaagcucaccgacuucggagccgccagagagcuggaagaugacgagcaguuugugucucuuuauggcacagaagaguaccugcaccccgauauguaugaacgggcugugcuccgcaaagaccaccaaaagaaauacggggccaccgucgaucuguggagcaucggaguuacguucuaucaugcugccaccggcucccugccuuuuagacccuucgaggggccucggcgcaacaaggaggugauguacaagauuaucacaggaaaaccgagcggcgcgauuucuggcgugcagaaggccgaaaaugggcccaucgacugguccggagauaugccugucagcugcucucucuccagaggccuucaggugcuucugacccccguucucgcuaacauccuggaggccgaccaggaaaaauguuggggguuugaccaauucuucgcugagacaagcgauauucuucaccggauggugauccaugucuuuucucugcagcagaugaccgcccacaagauuuacauccacuccuauaauacggcgacaauuuuccaugaacucguguacaaacagaccaagaucaucagcuccaaccaagagcugauuuaugagggacgcagacugguucucgaaccuggccggcuggcccagcacuuucccaaaacaaccgaggaaaauccgaucuucguggucucuagagagccucuuaacaccauugggcugaucuacgaaaagauuagccuccccaaggugcauccucgcuaugaccuggauggagacgcuuccauggccaaagcuaucacaggcgucgugugcuacgccugucggaucgccagcacgcuucugcucuaucaggagcugaugagaaagggcauucgcuggcugaucgagcucauuaaagaugacuacaacgaaaccguucacaagaaaacagagguggucaucacccuggauuuuugcauucggaauaucgaaaagacagugaagguuuacgagaaacuuaugaagauuaaccuggaggcugcggaacucggggagaucucugacauccauaccaaacugcugagacuuuccagcucucaaggaacgauugaaacaagccuccaggauaucgacucccgccugucucccggcgggagccuggccgaugcuugggcccaccaggagggaacccaccccaaggaccggaauguggaaaaacuccagguccugcuuaacuguaugaccgagauuuauuaccaauucaagaaggacaaagccgagagacgccuggcuuauaaugaagaacagauccauaaguuugauaaacagaagcucuacuaucacgccacaaaagcgaugacccauuucacagacgaaugcgugaagaaguacgaggcuuuucugaacaaauccgaagaguggauucggaagaugcugcaccuuagaaaacagcuccugagccugacgaaucaauguuucgauaucgaggaagaggugucuaaguaucaggaauacaccaacgagcuccaggaaacacugccucagaaaauguuuaccgccuccagcggcaucaagcacacaaugaccccgauuuaccccucuuccaauacgcuuguugagaugacccuggggaugaaaaagcucaaggaggaaauggagggcgucgugaaagaacuggccgagaacaaucauauccuggagcgcuucggaagccuuacaauggacggcgggcuccggaacguggauugccuguga

SEQ ID NO: 76637 - RNA, 1848 nt, Artificial Sequence
  derived and/or modified sequence opt5 from TBKBP1__Homo_sapiens__NP_055541
auggagagcauguucgaagacgauaucuccauucugacccaggaggcccucggccccucugaaguguggcuggacagcccuggggauccgucccuuggaggcgacaugugcucugcuagccacuuugcccugaucacagcguacggggauauuaaggagagacucggaggccuggaacgggagaacgcuacgcuucgcagacggcugaaagucuaugagaucaaguacccccucauuuccgacuucggggaggaacauggauuuucucuguaugaaaucaaagauggcagccugcucgagguugagaaggugucccugcaacagcgccuuaaucaguuccagcacgaacugcagaaaaacaaggagcaagaggaacagcucggcgaaaugauccaggccuacgagaagcuguguguggagaaaagcgaccuugaaaccgagcugagagaaaugcgggcccucgucgagacacaucugcgccaaauuugcgggcuggaacagcagcucagacagcaacagggacugcaggaugcugccuuuucuaaucuuuccccucccccugcucccgccccuccguguaccgaccuggaucuccacuaucuggcgcuucggggcgggagcggacugucucaugccggcuggcccggguccacaccuagcgugucugaccucgagcgcagacggcuggaggaagcucuggaggccgcucaaggagaagcccgcggcgcgcagcucagagaggaacagcugcaggccgagugcgagcggcuucaaggcgaacugaagcagcuccaggagacccgcgcucaggaucuggccuccaaccaaagcgaaagagacauggcuuggguuaaacgggugggggacgaucaggucaaucuugcccuggccuacacagagcucaccgaggaacugggaagacugcgcgagcucuccucucugcagggccggauccuuagaacgcugcuccaggaacaagcucgcagcgggggacagcggcacagcccccugucccagagacacucuccugcgccccaguguccguccccuagcccucccgcccgcgcugccccucccugucccccgugccaaucucccgugccucagcggagaagccccguuccucccugcccguccccucagcaacgccggucucccgccagcccuuccugucccagcccugugccccagagacgcucuccggucccucccuccugccagagccccucuccucagcggagauccccggugcccccuagcugucccgcuccucaaccccggccucccccgccucccccucccggcgagcgcacccuggccgaaagagcguaugcuaagccgccuucccaucacgugaaagccggguuccagggacggagaucuuacagcgagcuugccgagggcgcugccuacgcuggcgccucucccccuuggcuccaggcggaagccgcuacacugcccaagccccgcgccuauggguccgagcuguacggaccuggccggccgcucagccccagacgcgcuuuugaagggauuagacugcgguucgagaagcagccuuccgaagaggacgagugggccguccccaccagcccucccucuccugaaguuggaacaauccgcugcgcguccuuuugcgccggcuucccgauucccgagagcccugcugccaccgcuuaugcccaugccgaacacgcucaaucuuggcccuccaucaaccuucugauggagacgguggggagcgauauuagaucuuguccucucugccagcugggcuuucccgugggauacccggacgaugcgcugaucaaacacaucgacagccaucuugaaaauuccaagauuuga

SEQ ID NO: 76638 - RNA, 1734 nt, Artificial Sequence
  derived and/or modified sequence opt5 from TBL1X__Homo_sapiens__NP_001132938
augaccgagcuggccggcgcuagcuccucuugcugucacagacccgccgggcggggagcgaugcagagcgugcuccaucacuuccaacgccugagaggccgggaagggggaucccauuuuaucaacacaucuagcccucgcggcgaggcuaagauguccauuacgucugacgaagucaauuuccuuguuuacagauaucugcaggagagcggguuuucccacagcgccuucaccuuuggaaucgaaucucauauuucccagagcaacaucaauggcacacucgugccgcccgccgcucugauuucuauccuucagaaaggccugcaauacguggaggccgagaucuccauuaacgaagaugggaccgucuucgacggacggccuaucgagagccucucucugauugaugcugugaugcccgacguugugcagacacgccagcaggccuuuagagaaaagcuggcgcaacagcaggccuccgcugccgcugccgcggccgcugccaccgcugccgccacagcugcgaccacgaccagcgccggcgucucccaccagaauccuucuaaaaaccgggaggcuacagugaauggggaggaaaaccgcgcccacagcguuaauaaccaugccaagcccauggagaucgauggagaaguggagauuccuuccagcaaagcuaccguccucagaggccacgaaucugagguguucaucugcgccuggaauccgguguccgaccugcuugcgagcgggucuggagauagcacagcucggauuuggaaccugaaugagaacuccaauggcggcucuacccaacucguccugcgccauuguaucagagaagggggacacgacguucccagcaacaaggaugugacgucccuugacuggaacacaaauggcacccugcucgccacagggagcuaugauggauuugcccggaucuggaccgaggacggcaaccuggcuucuacccuggggcagcacaagggaccuauuuucgcccucaaauggaaucgcaagggcaacuacauccuguccgcuggcguggauaaaacaacgauuaucugggacgcccauaccggggaagcgaagcagcaauuucccuuccacagcgccccugcucuugacgucgauuggcagaauaacacaaccuuugccucuugcuccacagacauguguauucaugugugcagacugggaugugaucggcccguuaaaaccuuccagggccacacgaaugaggugaacgcuaucaagugggacccgagcgggaugcuccuggccuccugcucugaugacaugacacuuaagaucuggagcaugaaacaggaagucuguauucaugaucugcaagcgcacaauaaggagaucuauaccauuaaaugguccccuaccggacccgccacaucuaacccuaauagcaacaucaugcucgcuuccgccagcuucgacucuaccgugagacugugggauauugagcgcggcguuugcacacacacgcugaccaagcaucaggaacccguguacuccgucgcuuuuagccccgacgggaaauaucucgccucuggcuccuucgauaagugugugcacaucuggaauacacagagcggaaaccugguccauucuuaccggggcaccgggggaaucuuugaggugugcuggaaugccagaggcgacaaaguuggggcuagcgcguccgacggaagcgugugcguccuugaucugcgcaaguga

SEQ ID NO: 76639 - RNA, 1575 nt, Artificial Sequence
  derived and/or modified sequence opt5 from TBL1XR1__Homo_sapiens__XP_005247828
augggcgugaagcaccagcaacagcagcuggucaucgggggagacagaauuuucagcugcaccucuccccaucaguguacagccaacggcuuuucccacagcgcuuucacguuugggaucgagucccauauuucucaaagcaauaucaacggagcccucguuccuccggcggcucugauuuccaucauccagaaaggccuucaguacguggaagccgaggugucuauuaaugaagaugggacccuguucgacggacggcccaucgagagccucucccugauugaugccgucaugccugacgugguucagacacgccaacaggcuuauagagauaaacuugcccagcagcaagcugccgcggccgcugccgcugccgcggccgcuagccagcagggcucugccaagaacggcgaaaauaccgcuaacggggaggagaauggagcccacacaaucgccaacaaucauaccgacaugauggaaguggauggcgacgucgagauucccccuaacaaggcugugguucugcgggggcacgaauccgagguguuuaucugcgcguggaaucccgucagcgaucuccuggccucuggauccggcgacagcacagcucgcauuuggaaccugucugaaaauuccaccagcggguccacgcaacucgugcugagacacuguauccgggagggaggccaggaugugccuucuaacaaagacgucaccagccuugauuggaacuccgagggcacacugcucgccaccgggagcuacgacggauucgcccgcaucuggacaaaggacggcaaucuggcuucuacccuugggcagcauaagggaccgauuuuugcccugaaauggaacaagaaaggcaauuucauccucuccgcggggguugauaagacgacaauuaucugggacgcucacaccggagaagccaaacagcaauuucccuuccauagcgccccugcucuggauguggacuggcagucuaacaauacauuugccagcugcuccaccgauauguguauucacgugugcaagcugggccaggacagacccaucaagaccuuccagggccacacaaacgaggucaaugcuaucaaaugggauccuacggggaaccuccuggccucuuguagcgacgauaugacccuuaagauuugguccaugaaacaagacaauugcgugcaugaucugcaggcgcacaacaaggaaaucuauacaauuaaauggagccccaccggaccgggcacaaauaacccuaaugccaaccucaugcuggcuucugccuccuuugacagcaccguucggcuuugggacguggaucgcgggaucuguauucauacgcugacaaagcaccaggagcccgucuacucuguggcuuucuccccugacggaagauaucucgccagcggcuccuucgauaaaugcguucauaucuggaauacccagaccggggcgcuggugcacucuuaccggggcacaggaggcaucuuugaggucuguuggaacgccgcuggggacaaggugggagccagcgcuuccgauggcucugucugcgugcuggaccuccgcaaguga

SEQ ID NO: 76640 - RNA, 1569 nt, Artificial Sequence
  derived and/or modified sequence opt5 from TBL1Y__Homo_sapiens__NP_599021
augagcaucaccuccgacgaggugaacuuccuggucuacagauaucuccaggaaucuggcuuuagccacuccgccuucacauuugggauugagucucauaucagccaauccaauauuaacggaacgcugguucccccuucugcucuuaucagcauucugcagaagggccuccaguacguggaagccgagaucuccaucaauaaagaugggaccguguucgacagccggccgauugaaucucugucccuuaucgucgcggugauucccgauguugugcagaugcgccaacaggcuuuuggagagaagcugacacagcagcaagccagcgccgcugccaccgaggcuucugccauggcgaaagccgcuacaaugaccccugccgcuaucucccagcagaaucccccuaagaacagagaagccacagucaacggcgaggaaaauggggcgcacgagauuaacaaucauagcaaacccauggagaucgacggagauguggaaauuccuccgaacaaggccaccguucuccggggccacgagucugaaguguucaucugcgcuuggaaucccgucuccgaccugcuggccagcggcuccggggauucuacggcucgcaucuggaaccucaaugagaacagcaauggaggcuccacccagcuggugcuuagacauuguauucgggaagggggacacgacgugccuagcaacaaggaugucacaucucuggacuggaacuccgauggcacccuccuggccauggggagcuaugacggauuugcccgcaucuggacagagaauggcaaccuugcuucuacccugggccaacacaaagggcccauuuucgcgcucaaguggaauaaaaagggaaacuacguucugagcgccggcguggauaaaacgacaaucauuugggacgcucauaccggggaggccaagcagcaguuuccuuuccacuccgcccccgcucuggacguggauuggcaaaauaacaugacauuugccucuugcagcaccgacauguguauccaugucugcagacucggaugugaucacccggugaagaccuuccagggccacacaaaugaaguuaacgcgaucaaaugggacccuuccgggaugcugcuugcuagcugcucugaugacaugacgcugaagauuugguccaugaaacaggaugccugugugcaugaccuccaggcccacagcaaggagaucuauaccauuaaauggucucccacaggaccugcuaccuccaaucccaacagcuccaucaugcuggccucugcuagcuuugauuccacaguccggcuuugggacguggaacaaggcguuugcacccauacgcugaugaagcaccaggagcccguguacucugucgccuucagcccugauggcaaauaucucgcguccgggagcuucgacaaguacgugcauauuuggaauacacagucuggaucccugguccacagcuaccagggcaccgggggaaucuuugaaguguguuggaacgcccgcggcgacaagguuggggcuucugccuccgauggcagcgugugcguccuggaccucuga

SEQ ID NO: 76641 - RNA, 1344 nt, Artificial Sequence
  derived and/or modified sequence opt5 from TBL2__Homo_sapiens__NP_036585
auggagcugagccagauguccgaacucaugggccugucugugcuucuggggcuccuggcccuuauggcuaccgccgcggucgcuagaggauggcugcgggccggcgaggaacgcagcgggagacccgccugccaaaaggcuaacggauucccuccggacaaauccucuggcagcaagaaacagaagcaguaccagcggauccgcaaagagaagccccaacagcacaauuuuacacauagacuccuggccgcugcccugaagucccacucugggaacauuagcuguauggauuucuccagcaauggaaaauaucucgcgacgugcgccgacgaucggaccauccgcauuuggucuacaaaggacuuucugcagagagaacaucgguccaugcgcgcuaacguugagcuugaucacgccacccuggugagauucagcccugacugucgggcuuuuaucguguggcucgccaauggcgauacacugcgcgucuucaaaaugaccaagagagaggacggcggguacacauuuaccgcgacgcccgaagauuucccuaaaaagcauaaggcccccgugauugacaucggaaucgcuaacaccggcaaauuuauuaugacagccucuuccgauaccacaguucuuaucuggagccugaagggacaggugcucucuaccauuaauacgaaccaaaugaauaacacacacgcugccgucuccccuugcgggcgguucguggccagcuguggcuuuaccccggacguuaaagugugggaggucugcuucgggaagaaaggagaauuucaggagguggugcgcgcuuucgagcugaagggccacuccgcggccguccauucuuucgcuuuuagcaaugauuccagacggauggccagcguuucuaaagacggcacauggaagcugugggacaccgauguggaauauaagaaaaagcaggaccccuaccuccugaaaaccgggagauucgaggaagccgcuggagccgcgccuugucgccuugcucugucccccaacgcccaggugcucgcccuggcuagcggcucuagcauccaccuuuauaauacacggagaggggagaaggaagagugcuuugagcgcguccauggagaauguauugccaaccuguccuucgauaucacgggccgguuucucgcuucuugcggggacagagccgugcgccuguuccacaauaccccuggacaccgggcgaugguugaggaaaugcaaggccaucugaaaagagccagcaacgaguccacacgccagcggcuccagcaacagcugacccaggcucaggaaacacuuaagagccugggcgcccucaagaaauga

SEQ ID NO: 76642 - RNA, 2427 nt, Artificial Sequence
  derived and/or modified sequence opt5 from TBL3__Homo_sapiens__NP_006444
auggccgagaccgcugccggcguggggagauucaagacaaacuacgcggucgaacggaaaaucgagcccuuuuauaagggaggcaaagcucagcuggaccaaacggggcagcaccucuucugcguuuguggaacccgcgugaauauucuggaaguggccagcggcgccguccuuagaucccuggagcaggaagaucaggaggacaucacagcuuuugaucucucuccugacaacgaggugcugguuaccgccagccgggcccuucugcucgcucaaugggcguggcaggaaggguccgugacacgccuguggaaggccauucauaccgcuccggucgccacaauggcuuucgaucccaccucuacgcugcucgccaccggaggcugcgacggcgcggugagaguuugggauaucgugcggcacuacgggacacaucacuuucgcggaagcccuggcgucgugcaucugguggccuuccaccccgacccuaccagacuucugcucuuuuccucugcuacagaugccgcuauucgggucuggagccugcaggaccgcuccugucuugccguucugaccgcccacuauagcgcugugacgucucucgcguucuccgccgaugggcauacaaugcugagcucuggaagagacaaaaucugcaucauuugggaucugcaguccugucaagcuacccggacagugcccgucuuugagagcguggaagccgccguucuccugccugaggagccggugucucagcuuggcgucaagucccccgggcuguacuuccucaccgcuggagaccagggcacccugcgcgugugggaagccgcgagcggccagugcguuuauacacaagcucagccucccgggccuggacaggagcuuacgcacuguacccuggcccauacagccggcgugguccucaccgcuacagccgaccacaaucugcugcucuacgaagcuagaucccugcggcuucaaaagcaguuugccggguauucugaggaagugcuggauguccgcuuccucggacccgaggacagccacgugguuguggcguccaacagcccgugccugaaagucuuugagcuucagaccucugccugucagauccugcauggccacacggauauugugcucgcucuggacguuuucagaaagggguggcuguucgccuccugcgcuaaagaucaaagcgugcggaucuggagaaugaauaaggccggacaggucauguguguggcgcagggcucuggccauacacacagcguggggaccguuugcugcucccgccucaaagaaucuuuucuggucaccggaagccaggacuguacagugaaacuuuggccucugcccaaggcccuccuguccaaaaacaccgcuccugauaauggccccauucugcuucaagcccagacaacgcagcggugccaugacaaggauaucaacagcguggcuauugcccccaaugacaaacuccuggccaccgggucucaggauagaacagcuaagcugugggcgcucccucaaugucagcugcuuggagucuucuccggccaccgccgggggcuguggugcgugcaguuuagcccgauggaccagguucucgccaccgcuucugccgacggcacaaucaaacugugggcccugcaagauuucuccugucuuaagaccuuugagggacacgacgcuagcgugcucaaagucgccuucguguccagaggcacgcagcugcugucuagcggguccgauggacucguuaagcuguggaccaucaagaacaaugaaugcgugcgcacacuugacgcgcaugaggauaaagucuggggccugcacuguucucggcucgacgaucaugcucugaccggggccagcgacuccagagugauucuguggaaggauguuacagaagccgagcaggcugaggaacaagcccgccaggaggaacaggugguccggcagcaagagcuugacaaccuccugcacgaaaagagauaccugcgcgcgcucggacuggcuaucagccuugaucggccccacaccgugcugacggugauucaggccaucagacgggacccugaggccugcgagaagcucgaagcuacaaugcugcgccugagacgggaucagaaagaggcccuucucagauuuugugucaccuggaauacaaacucucgccauugccacgaagcucaggccguucugggcgugcugcuccggagagaggcgcccgaggaacugcuugccuacgagggggugcgcgcugcccuggaagcucuccugccuuauaccgagagacauuuccaacggcugucccgcacccuucaggccgccgcuuuucuggacuuccucuggcacaauaugaagcugcccgucccggcggccgcuccuacacccugggaaacgcauaagggcgcccucccuuga

SEQ ID NO: 76643 - RNA, 960 nt, Artificial Sequence
  derived and/or modified sequence opt5 from TBP__Homo_sapiens__NP_001165556
augacccccggcaucccuauuuucagcccgaugaugcccuacgggacaggacugacgccucagcccauccaaaacaccaauucccucucuauucuggaggaacagcagagacagcaacagcagcagcaacagcagcagcaacagcagcaacagcagcagcaacagcagcagcaacagcagcagcaacagcagcagcaacagcagcaacagcagcagcaacagcaggccguggcugccgcggcuguccagcaaagcacaucccagcaggccacccagggcacaucugggcaagccccucagcuuuuucacagccagacccugacaaccgcuccccucccuggaacgaccccgcuguaucccuccccuaugacacccaugaccccuaucacacccgccaccccggcuucugagagcuccggcauuguuccucaacuucagaacaucgugagcacggugaaucuggggugcaagcucgaccugaaaacaaucgcccugcgggcgcgcaacgccgaauacaaucccaagagauucgcugccgucauuaugcggauccgcgagccuagaaccacagcucucaucuuuucuuccggaaaaaugguguguaccggcgccaagagcgaggaacagucucggcuggcggcccgcaaauaugcuagaguugugcagaaacuuggcuuccccgccaaguuucuggauuucaagauucaaaacauggucggguccugcgacgugaaguuucccauucggcucgagggacugguucuuacccaucagcaguucagcucuuacgaaccugagcuguuuccgggccucaucuaucgcaugauuaaacccagaaucgugcugcugaucuucgucuccgggaagguggugcucacaggagcuaaaguccgggccgaaauuuacgaggccuuugagaauaucuauccuauucugaagggcuuccgcaagacgaccuga

SEQ ID NO: 76644 - RNA, 561 nt, Artificial Sequence
  derived and/or modified sequence opt5 from TBPL1__Homo_sapiens__NP_004856
auggacgccgauagcgacguggcucuggauauccucauuaccaacgucguuugcguguucagaacacggugucaccugaaucuucgcaagaucgcccuggagggcgcgaacgugauuuacaaaagagacgucgggaaggugcucaugaaacugcggaagccccgcaucacggcuaccauuugguccucuggaaaaaucaucugcacaggcgccaccagcgaagaggaagccaaguuuggggcuagacggcuugcccgcucccugcagaagcucggauuccaaguuauuuuuacagauuucaaaguggucaaugugcuggcuguuuguaacaugccuuuugagaucagacugccggaguucaccaagaauaaccggccccaugccucuuaugaaccugagcuccaccccgcggugugcuaccgcauuaaaagccugagagccacacuucagaucuuuuccaccggcucuauuacggucaccgggccuaaugugaaggcuguggccacagcugucgaacagaucuaucccuucguuuuugagagccggaaagaaauucuguga

SEQ ID NO: 76645 - RNA, 1128 nt, Artificial Sequence
  derived and/or modified sequence opt5 from TBPL2__Homo_sapiens__NP_950248
auggccagcgcucccuggccugagagagugccgcggcugcucgcgccccgccugccuuccuaucccccucccccuccgaccgucggccuuagaucuauggaacaggaggaaacauaccuggagcucuaccuggaccaaugcgccgcucaggaugggcuugcucccccucggagcccccuguucuccccuguugugcccuaugacauguacauccucaacgccucuaauccggauacggccuuuaacagcaauccugaagugaaggagaccuccggagacuucucuagcgucgaucuguccuuucugcccgacgaggugacacaggaaaacaaagaucagccuguuauuagcaagcacgagaccgaagaaaauucugagucccaaagcccccagucucgccuccccuccccuagcgagcaggacgugggccuggggcuuaacucuuccagccuguccaauucucauagccagcuccacccgggagauacagacuccguccaacccagcccugagaaacccaacucugauucccugagccuugccucuaucaccccuaugacacccaugaccccgauuagcgaauguugcggcaucgugccucagcugcagaauauuguuuccacggugaaccucgcuuguaagcuggaccugaaaaagaucgcccuccaugcgaagaaugccgaguauaaccccaaaagauucgcugccgucaucaugcggauucgcgaaccuagaaccacagcucugaucuuuucuagcgggaagauggugugcaccggagccaaauccgaggagcagagccggcuugcggcccgcaaguacgcuagagugguccaaaaacugggcuuccccgcccgguuucucgauuucaagauucagaauaugguuggcucuugugacgugcgcuuuccuaucagacuggaagggcuugugcugacacaccagcaauucuccagcuaugagcccgaacucuuuccgggacugauuuaccggauggucaagccucgcaucgugcugcucauuuucguuucuggcaaagugguccugaccggggcuaaggagagauccgaaaucuacgaggccuuugagaacaucuaucccauucuuaaaggauucaagaaagccuga

SEQ ID NO: 76646 - RNA, 2049 nt, Artificial Sequence
  derived and/or modified sequence opt5 from TBR1__Homo_sapiens__NP_006584
augcagcuggagcacugccucagccccuccaucaugcugucuaagaaauuccuuaacgugagcuccucuuacccucauagcggcggguccgaacugguccuccacgaccauccgauuaucucuaccacagauaaucuggagagaagcagcccccuuaagaaaauuacgcggggaaugaccaaccaauccgacacagauaauuuuccugacucuaaggauucccccggcgacguucagcgcagcaaacugucuccugugcucgaugggguguccgaacugagacacagcuucgacggaucugccgcugaucgguaucugcucucccagagcucccagccccaaucugccgcgaccgcuccuagcgccauguuuccguaccccggccagcaugggccugcccaccccgcuuucuccaucggaagcccuucucgcuauauggcccaccaucccgucauuacaaacggcgcuuacaauucccugcuuagcaacucuagcccgcagggcuauccuaccgccggguaccccuauccucagcaauacggacacuccuaccagggcgcgcccuuuuaucaguucucuagcacacagcccgggcuggugccuggaaaggcccaaguuuaccucuguaauagaccgcuguggcuuaaguuucaucggcaccagaccgagaugaucaucacgaaacagggccgcagaauguuccccuuucuguccuucaacauuagcgggcucgacccuaccgcucacuauaauaucuuuguggaugucauucuggccgaccccaaccauuggcgguuccaaggaggcaagugggugccuugcggcaaagcugauacaaauguucaggggaaccgcguguacaugcaccccgacucuccgaauaccggagcccauuggaugagacaggaaaucuccuuuggcaagcugaaacucacaaacaauaagggggcgagcaacaacaauggacagauggucgugcugcaaucucuucacaaguaucagccucggcugcauguggucgagguuaacgaggacggcaccgaagauacgucccagcccgggcgcgugcagacauucaccuucccugagacacaauuuauugccgugaccgcuuaccagaauaccgacaucacacagcucaaaauugaucacaaccccuucgccaagggauuuagagacaauuaugauacgaucuacaccggcugugacauggaucggcugacaccuagccccaacgacuccccgcgcucucagaucgucccuggcgcuagauacgccauggccgggagcuuccuucaagaucaguuuguguccaauuaugcuaaagcgcgguuccaccccggagccggcgcugggcccggaccuggcaccgacagaucuguuccgcauacaaacgggcugcucagcccccagcaggccgaagauccuggcgcccccuccccucaacgcugguuugugacccccgcuaauaaccggcuggacuucgccgcgagcgcuuacgacacggccacagauuuugccggaaaugcugccacccugcucucuuaugcugccgcgggcgucaaggcccugccucuucaggcugccgggugcaccggaagaccccugggcuacuaugcugacccguccggguggggagcccgcagcccuccccaguacuguggcacaaaaucuggguccgugcucccuugcuggcccaacagcgcggccgcugccgcucggauggccggcgccaauccguaucugggagaggaggcugaaggccuugcggccgagagaucuccucugcccccuggggcugccgaagaugccaagcccaaagaccucagcgauuccagcuggauugagacccccucuuccaucaagagcauugacuccucugauagcggaaucuacgaacaagcuaagcgccggagaauuuccccugccgacacaccgguuucugagagcuccucuccccugaaaagcgaggugcuggcgcagcgcgauugugaaaagaacugcgcuaaagacaucuccggcuacuauggguucuacagccacucuuga

SEQ ID NO: 76647 - RNA, 1236 nt, Artificial Sequence
  derived and/or modified sequence opt5 from TBRG1__Homo_sapiens__NP_116200
augagccugcucgacggccuggccuccucucccagagcuccucuucagagcuccaaggcccggaugaaaaagcugccgaaaaagucucaaaacgagaaauaccgccucaaguaucugagacuucggaaggcggcuaaagccaccguguucgaaaaugccgcuaucugcgaugagauugcccgccuggaagagaaguuucucaaagcuaaggaagagagacgguaccugcugaaaaagcuccugcagcuucaggcccugacagagggggaaguccaggcggccgcucccagccacuccucuagccucccucugacguauggaguugccuccagcgugggcaccauccaaggggcuggacccauuucuggcccuuccacaggggccgaggaacccuucggaaagaaaaccaagaaagagaagaaagagaagggcaaagaaaacaauaagcuggaggugcugaagaaaacauguaagaaaaagaaaauggcgggcggggcccgcaagcucguccagccuaucgcucuggacccgagcggaagacccguguuuccuauuggccuugggggacucaccguuuacucucugggcgaaaucaucacagaucggcccggguuccacgacgaguccgccauuuauccugugggauacugcagcacccgcaucuaugcuucuaugaagugucccgaucagaaaugccuuuacacgugucagauuaaggacggcggcguccaaccgcaguuugaaaucgugccugaggaugacccccagaacgccauuguuuccagcuccgccgaugcuugccacgcggagcugcucagaaccaucucuacaaccauggggaaacugaugccuaaucuucugcccgccggagcugacuucuuuggcuucagccaucccgccauucacaaccucauccaguccuguccuggggcccggaagugcaucaauuaccaaugggugaaauuugaugucuguaagccgggagacggccagcugcccgaagggcugccugagaacgaugcugccaugagcuucgaagcguuucagcgccaaauuuucgacgaggaccagaaugauccccuccugccuggaucucuugaccugcccgaacuccagccggcugccuuuguguccagcuaucagccuauguaccugacacaugagccccuuguggauacccaucugcaacaccucaagucuccuagccagggcucccccauccagucuagcgacuga

SEQ ID NO: 76648 - RNA, 1158 nt, Artificial Sequence
  derived and/or modified sequence opt5 from TBX10__Homo_sapiens__NP_005986
auggccgcuuuccugagcgccggccucgggauccuggcgcccuccgagaccuacccucuuccgacaacgucuagcggaugggaacccagacugggcuccccuuuucccucugggccuugcaccagcuccacaggagcucaggccguggccgagcccaccggccaagggccuaagaacccgcgggucucucgcguuacagugcagcucgaaaugaaaccccugugggaggaguucaaucagcuuggaaccgaaaugauugugacaaaggcuggcagacggauguuuccucccuuccaggucaaaauccugggcauggacagccucgccgauuaugcucugcugauggacuuuauuccucucgaugacaagcgcuacagauaugccuuccacuccagcgcguggcugguggccgggaaagcugaucccgccaccccgggacggguucauuuucacccugacucucccgcuaagggcgcccaauggaugcgccagaucguguccuucgauaaacuuaagcugacgaacaaucuccuggacgauaacgggcauauuauccuuaauagcaugcacagauaccagccucgguuucaugucguguucguugacccccgcaaggauucugagagauaugcgcaggaaaacuuuaaauccuucaucuuuaccgagacacaauucaccgccgugacagcuuaccagaaucaccggauuacccagcugaagaucgccagcaaccccuucgcuaaaggauuucgcgaaucugaccucgauuccuggccugucgccccgagaccccugcugagcgugccugcccggucccacucuagccucucccccugugugcugaagggcgcuacggaccgcgagaaggacccuaauaaagcgagcgccucuacauccaagacccccgcuuggcuucaucaccagcugcucccgccucccgagguccugcuugccccugccacauauagacccguuaccuaccaaagccuguacucuggggcuccuagccaucucggcauuccccggaccagaccggccccuuauccccugcccaacauccgcgcggaucgggaccagggaggccugccucucccggcugggcugggacuucugucccccacaguggugugccucggcccugggcaggauucucaauga

SEQ ID NO: 76649 - RNA, 1824 nt, Artificial Sequence
  derived and/or modified sequence opt5 from TBX18__Homo_sapiens__NP_001073977
auggccgagaagagacggggcagccccugcuccaugcugucucucaaagcucacgccuucagcguggaagcgcugaucggggcugagaagcagcaacagcuucagaaaaagcgcagaaaacugggagccgaagaggccgcuggcgccgucgacgaugggggauguucccggggcgggggagcuggcgaaaagggcucuagcgagggggacgagggagccgcgcucccuccgcccgccggcgcuaccuccgggccugcccgcucuggagcugaucuggaaagaggcgccgccgggggaugcgaggacggcuuucagcaaggcgcgagcccccuugcuuccccugggggaagccccaagggcucuccugcccggucccuggcucgcccggggacaccccucccuagcccccaggccccuagaguugaucugcagggagccgaacuguggaaacgguuccaugagauuggcacggagaugaucauuaccaaggcugggcgcagaauguuucccgcgaugcgggugaaaaucucuggacucgacccgcaccagcaauacuauauugccauggauaucgugccugucgacaacaagcgcuacagauauguguaccauuccagcaaauggaugguugcuggcaaugccgauucucccgugccuccccgggucuauauccaccccgacuccccugccagcggcgaaacauggaugcgccaggugauuuccuucgauaagcugaagcugaccaacaaugagcuggacgaucaggggcauaucauucuccacucuaugcacaaauaccagccgagaguucaugugauccggaaggacuguggagacgaucugagccccauuaaaccuguccccuccggcgaaggggugaaggcuuuuagcuucccugagacaguguuuaccacagucaccgccuaucaaaaccagcagaucacgagacuuaaaauugaccgcaaucccuucgcgaagggauuucgggauucuggcagaaaccgcauggggcuggaagcucucguugaguccuacgccuucuggcggccgagccugagaacccugacauuugaggacaucccuggcauccccaaacaaggaaaugccucuagcuccacccuccugcagggcacagggaacggagugccugcuacccacccccaucuucugucuggcagcuccugcagcucuccugccuuccaccucgggcccaauacgucccagcuguguagccuugcuccggccgauuacucugcgugcgcccgcuccggacugacacucaaccgguauagcaccucccuggcugaaacauacaauagacugaccaaccaggccggcgagaccuuugcuccuccccgcacacccucuuaugugggggucagcuccucuacgagcgugaauauguccaugggcggaaccgacggcgauacauucagcuguccucaaaccucucucuccaugcagauuagcgggaugucuccgcagcugcaguacaucaugcccuccccuagcucuaacgccuucgcgacaaaucaaacccaccagggaagcuauaacacguuucggcuucauucccccugcgcccuguacggcuauaacuucagcacaucuccuaagcucgcugccucccccgaaaagauuguuagcucccaggggucuuuucugggaagcuccccuucuggcaccaugaccgacagacagaugcuucccccgguggaggggguccaccuucucagcuccggcggacaacagucuuucuuugauagccgcacacugggcucccugacccucucuagcucccaggugagcgcucauaugguuuga

SEQ ID NO: 76650 - RNA, 1347 nt, Artificial Sequence
  derived and/or modified sequence opt5 from TBX19__Homo_sapiens__NP_005140
auggccaugagcgagcugggcaccagaaagcccuccgacgggacagugucucaccuccugaacgucguugaaagcgagcuucaggcuggacgggaaaaaggcgauccuacggagaagcaacugcagaucauucucgaagacgccccgcuguggcagcgcuucaaagaggugaccaaugagaugaucgugacaaagaacgggagacggauguuucccguccuuaaaauuuccgugaccggacuggauccuaaugcgauguacucucuccugcuggacuucguucccacagauagccaucgcuggaaguaugugaacggcgaaugggucccugcugggaagcccgagguguccucucacagcugcguuuacauccauccugacuccccgaauuuuggagcccacuggaugaaagcccccauuagcuucucuaaggugaaacucaccaacaagcugaauggcggcgggcagaucaugcuuaacucccugcauaaauaugaaccucaaguccacaucgugagagugggaagcgcucaccggauggucacaaauuguucuuuucccgagacccaguucauugccguuacggcuuaccagaacgaggaaaucaccgcccucaagauuaaguauaauccuuuugcgaaagccuuccuggaugcuaaggagcgcaaccaucuuagagacgugcccgaagccaucuccgagagccagcacgugacauacucucaucugggcggguggauuuuuagcaauccggauggagucugcaccgcuggcaacagcaauuaucaauacgccgcgccucucccccugccugcuccccacacacaccaugggugugaacacuacuccggacugcggggccaucgccaggcccccuauccuucugccuacaugcacagaaaccauagcccguccgugaaccucaucgaguccucuuccaauaaccugcagguuuucagcggccccgacucuuggaccagccuuuccucuacgccucacgcuagcauucuguccgugccccacacaaaugggccuaucaaccccggaccgagcccuuaucccugccucuggaccaucucuaauggcgccgggggaccuuccggccccgggccugagguccaugccagcacacccggagcuuuucugcuuggcaacccggcggugaccucuccucccuccguucugagcacccaggcccccacauccgcuggcguggaaguccucggggagccuucucugacgagcauugccguguccaccuggacagccgucgcuucucacccguucgccggauggggcgggcccggagcgggcgggcaucacagcccuuccagccuggauggcuga

SEQ ID NO: 76651 - RNA, 1119 nt, Artificial Sequence
  derived and/or modified sequence opt5 from TBX1__Homo_sapiens__NP_005983
augcacuucagcaccgugacaagagacauggaggccuuuacggcuuccucucugagcucccucggcgccgcugggggauuccccggcgcggccucuccuggggccgauccguacggaccccgggaaccucccccucccccuccgcgcuaugaccccugcgcugccgcugccccuggcgcgcccgggccucccccgccuccccaugccuacccuuuugcucccgccgcuggagccgcgaccagcgccgcugccgagcccgaaggcccuggcgcuuccugugccgccgcugcgaaggccccggucaaaaagaacgcuaaaguugccggggugucugugcagcuggagaugaaggcccuuugggaugaguucaaucaacugggaacagaaaugaucgucaccaaagcuggcagacggauguuucccacauuccaggugaagcucuuugggauggacccuauggccgauuauaugcugcuuauggacuucguucccguggaugacaagcgcuacagauaugcguuucacagcuccagcuggcuggucgcuggaaaagccgauccugccacccccggccgggugcauuaccacccggacucuccugcuaagggggcccaguggaugaaacagauuguuuccuucgauaagcucaaacugacaaacaaucugcucgacgauaacggacauaucauucugaauagcaugcaccgcuaucaacccagauuucacguggucuacguggacccucggaaggacucugagaaguacgcugaagagaacuucaaaaccuuuguguucgaagagacgcgcuucaccgccgucacagcguaucagaaucauagaaucacccagcuuaagauugccuccaaccccuuugcuaaaggcuuccgggauugcgacccugaggauuggccccgcaaucacagaccgggcgcccugccucucaugagcgcuuuugcccggucucgcaaccccguugcgucccccacacagccuagcgggaccgaaaagggacuggugacggagggcuccgggcuucaaccgggacugcucgacgugcugcugaaacccccuucuaagaaaagcgaaucccucagacccccucauuguaaggauacauga

SEQ ID NO: 76652 - RNA, 1344 nt, Artificial Sequence
  derived and/or modified sequence opt5 from TBX20__Homo_sapiens__NP_001071121
auggaguucaccgccagccccaagccucagcuguccucuagagcuaacgccuuuagcaucgcggcucucauguccucuggcgggagcaaagaaaaggaggccacagaaaauacgauuaaaccgcuggagcaauucguggaaaaguccucuugcgcccagccccuuggagagcugaccagccucgacgcucacggcgaguuugggggaggcuccgggagcucuccuuccucuucuucccuguguacagaaccccuuaucccuaccacacccauuaucccuagcgaggaaauggccaaaauugcuugcucucuggagaccaaggagcucugggauaaguuccaugaacugggaacagagaugaucaucaccaaauccggccggcgcauguuuccgacgauuagagucagcuucuccggcguugaccccgaagccaaguacaucgugcugauggauauugugccugucgacaacaaacgguaucgcuacgcguaucacagaucuagcuggcucguggccgggaaggcugaucccccucugcccgcccggcuuuacguucauccggacuccccuuuuaccggagagcagcugcucaaacagauggugagcuucgaaaaggucaagcugacaaauaacgagcuugaucaacacggccauaucauucugaauagcaugcacaaauaucagccccgcgugcacaucauuaagaaaaaggaccauaccgcuucccuccugaaccugaaaagcgaggaauuuagaacauucaucuuuccugagaccguuuucacggccgugacagcguaccagaaucagcucaucaccaagcugaaaauugauucuaaccccuuugccaagggguuccgggacagcucccgccuuacagauaucgaaagagagucugucgaaagccugauucaaaagcacuccuaugcucggagccccauccgcaccuacggaggcgaggaggacgugcucggggaugaaucucagaccacaccuaauagaggauccgccuucacgaccagcgacaaccugucucuuuccagcuggguguccucuagcuccucuuuuccgggcuuccagcauccccagagccugacagcucucggcaccuccacagccagcauugccaccccuaucccccacccuauccaagggucucugcccccguacucccggcugggaaugccucucacgcccagcgcuauugcgucuuccaugcagggcagcgggccuacauuucccucuuuccacaugccucgcuaucaucacuacuuucagcaaggacccuaugccgcuauccagggccugagacauagcuccgccgucaugaccccguucguuuga

SEQ ID NO: 76653 - RNA, 1608 nt, Artificial Sequence
  derived and/or modified sequence opt5 from TBX21__Homo_sapiens__NP_037483
augggcaucguggagcccgggugcggagacaugcugaccggcacagaaccuaugccggggagcgaugaggggagagcccccggcgcugacccucagcaccgguacuucuaucccgaaccuggggcccaagaugcggacgagcgcagaggaggcggcucccucgggucucccuacccuggaggcgcucuggucccggcucccccuagccgguuucuuggggccuaugccuaucccccucgcccccaggccgcuggauucccgggcgccggggaauccuuuccucccccugcggaugccgagggauaccagcccggcgagggcuacgcugcccccgacccuagagcugggcuguauccgggaccccgggaagauuacgcccucccugcgggccuggagguuucugggaaacuucgcguggcccugaacaaucaucuccuguggagcaaguucaaccagcaccaaacggaaaugauuaucaccaagcagggaagacggauguuucccuuccuguccuuuacaguggcuggccucgagccuaccucucauuaccgcauguucgucgacgugguucugguggaucagcaccauuggagauaucagagcgggaaauggguccaauguggaaaggccgagggcuccaugcccggcaaucggcuuuacgugcacccggacagcccuaacacaggggcucacuggaugcgccaggaaguuucuuuuggaaaacugaagcucaccaauaacaagggcgccuccaauaacgugacacagaugauuguccugcagagccuucauaaauaucaacccagacugcacaucguggaggugaaugauggggaaccugaggccgcuugcaacgcgucuaauacccauauuuucacguuucaggaaacccaguucaucgccgucacagcuuaccaaaacgccgagaucacccagcucaagauugacaauaaccccuuugccaaaggauuccgggagaauuucgaauccauguauacaagcguugauaccucuaucccuagcccgcccggcccuaacugucaguuucugggaggcgaccacuacagcccccugcuccccaaccaguauccugugccgucccgcuucuaccccgaccugccuggacaagcuaaggauguggucccccaggccuacuggcuuggcgcgccuagagaccacucuuaugaggcugaauuucgggccgugagcaugaaacccgccuuccugccuuccgcucccgggccgacgaugagcuacuauagaggacaggagguucucgccccuggcgcuggguggcccguggccccucaguaucccccgaagaugggaccugcgucuugguuucgccccaugcggacacugccuauggaacccggccccgggggcuccgagggaagaggcccugaggaucaagggccgccccuugucuggaccgaaauugccccuauccgccccgagagcucugacagcggacugggcgaaggggauuccaagcggagacgcgugucuccuuaccccagcuccggagacuccucuuccccugcuggcgccccgagccccuucgauaaagaggcugaagggcaguuuuacaauuauuucccuaacuga

SEQ ID NO: 76654 - RNA, 1563 nt, Artificial Sequence
  derived and/or modified sequence opt5 from TBX22__Homo_sapiens__NP_001103348
auggcccugagcuccagagcucgggccuucucuguggaggcgcucgucggccgccccagcaagagaaaacugcaggacccuauccaagcugaacagccggagcuucgggaaaagaaagggggagaggaagaggaggaacgcagauccucugccgccggcaagagcgagccccuggaaaaacagccuaagaccgagcccuccacaucugcuagcuccgggugcggaagcgauucuggcuacgggaacuccagcgagucucucgaagagaaggacauucagauggaacugcaaggauccgagcuuuggaaacgguuucacgauaucggcacggaaaugauuaucaccaaggccggccgcagaauguucccuagcguucgggugaaagugaaggggcuggaccccggaaaacaguaucaugucgcuauugaugugguuccuguggacucuaagcgcuacagauaugucuaccacuccagccaguggaugguggccggcaauacagaucaucucuguaucaucccgcgguuuuauguucaccccgacuccccuugcucuggggagaccuggaugcgccagauuaucagcuucgauagaaugaagcugacaaacaaugagauggacgauaaaggacauauuauccugcaauccaugcacaaguacaaaccccgggugcacgucauugaacagggcagcucuguggaccucucccagauccagagccugccuaccgagggggugaagacauuuucuuucaaagaaaccgaguuuacgaccgucacagcguaucaaaaccagcagauuaccaagcugaaaaucgaacgcaaucccuucgccaagggauuuagagauacaggccggaacagaggcguucuggacgggcuccuggagaccuacccguggcgcccuagcuucacgcuugacuuuaagacauucggagcugauacccaauccggcucuagcggguccagccccgugacaucuuccggaggcgccccuagcccccuuaauucucuccugucuccccuguguuuuagcccuauguuccaucucccgaccuccucucuggggaugcccugcccugaggcuuaccuucccaacgugaaucugccucucuguuauaaaaucugccccaccaacuucuggcagcagcagccgcugguccuuccugcccccgaacggcuggcgagcuccaauucuagccaaucccucgccccucugaugauggaggugcccaugcugagcucucucggaguuacaaacuccaagagcggcuccuccgaagacagcucugaucaguaccugcaggcuccuaauagcacgaaccagaugcuuuauggccugcaaucccccgggaauauuuuucucccgaacagcaucaccccugaggcccugucuuguuccuuccaccccagcuacgacuuuuauagauacaacuucuccaugcccucucgccuuauuagcggauccaaucaucugaaagugaacgaugacucucaggucagcuuuggcgaagggaagugcaaucacgugcacugguauccugcuaucaaccauuaccucuga

SEQ ID NO: 76655 - RNA, 2139 nt, Artificial Sequence
  derived and/or modified sequence opt5 from TBX2__Homo_sapiens__XP_011523460
augagagagcccgcccuggcugccagcgcgauggcuuaccacccuuuccaugccccgcggcccgccgacuuuccuauguccgcuuuccucgccgcugcccagcccucuuucuucccugcgcuggcccuucccccuggcgcucuggccaagccgcuccccgauccugggcuggcuggagccgcggccgcugccgcugccgccgcugcggccgcugaagccggccuucacgugagcgcccuggggccccauccucccgcugcccaccuccgcucccugaaaucucuggagccggaagacgaggucgaagaugacccuaagguuacccucgaggcgaaagagcugugggaucaauuucauaagcugggaacagaaauggugaucacgaaaagcggcagacggauguuucccccuuuuaaggugcgcgucuccgggcuggacaagaaagcuaaguauauucuccugauggauaucguggccgccgacgauugcagauacaaauuccacaacucucgguggaugguugcuggaaaggccgaccccgagaugcccaaacgcauguauauucacccugauagcccggcuaccggcgaacaguggauggccaagcccguggcguuucauaaacuuaagcugacaaauaacaucuccgacaagcacggcuucaccauucucaauagcaugcauaaauaccagccuagauuucacaucguccgggccaacgauauccugaagcugcccuauucuacauuccgcaccuacguguuuccugagacagacuucauugcuguuaccgccuaucagaaugacaaaaucacgcaacucaagauugauaacaaucccuucgcuaaaggguuuagagacaccggaaacggccggcgcgagaagagaaagcagcugacacuuccgucccugcggcucuacgaggaacacuguaaaccugaacgcgauggggccgagagcgacgcgucuuccugcgaucccccucccgccagagaaccucccaccagcccgggagcugccccuucuccccugcggcuucauagagcucgcgccgaggagaaguccugugccgcugacagcgaucccgaaccugagcggcuguccgaagagagagcgggcgccccgcucgggcgcucucccgcuccugacagcgccucccccacacggcugaccgaaccugagagagcccgcgagcggagaagccccgaacgcggaaaagagccugcugaaucuggcggcgaugggcccuucggacugcggucccucgagaaggaaagagccgaggcgcgccggaaagacgagggcagaaaggaagcugccgaggggaaggaacagggacuggccccgcuugugguccagacggauagcgcuucuccucugggcgccgggcaccuccccggacuggcguuuagcucccaucuucacggccaacaguucuuuggcccucugggggcuggacagccccucuuccugcauccgggccaguuuacaauggggccuggagccuucucugccaugggcauggggcaccuucucgcuagcguggccggcggaggcaaugggggaggcgggggacccggcaccgcugccgggcuggacgcgggcggacuuggcccugccgcuuccgccgcuagcacagccgcccccuuucccuuccaccugucucaacauaugcucgcuucccaggggaucccuaugccgaccuuuggaggccuguuccccuacccuuauaccuacauggcggccgcugccgccgcugccagcgcgcugcccgcuacaucugccgccgcugccgcggcugccgccgcugggucccuuagccgguccccuuuucucggaucugcccgccccagacugcgguucagcccuuaucagauuccggugacgauucccccuuccaccucucugcucacaaccggccuggcuagcgagggguccaaagccgcgggcggaaacagcagagagcccucuccucuucccgaacuggcccuccgcaaggucggcgcuccguccagaggggcccugagcccuucuggauccgcuaaagaggccgccaaugaacugcaaagcauccagcggcuuguuucuggccucgagagccagcgcgcucugucccccgggagagaaagccccaaguga

SEQ ID NO: 76656 - RNA, 2172 nt, Artificial Sequence
  derived and/or modified sequence opt5 from TBX3__Homo_sapiens__NP_005987
augagccuguccaugagagaccccgugaucccuggcaccucuauggccuaccacccguuccucccccaucgggcuccugauuuugccaugagcgcgguccuggggcaccagcccccuuucuuucccgcucuuacacugccuccgaacggagccgccgcucucucccugcccggcgcccuugcuaagccuauuauggaccaacugguuggggccgcggagacgggaauccccuucucuagccucggcccucaggcccaucugcgcccccugaaaaccauggaaccggaggaagagguggaagaugacccuaaggugcaccucgaggcuaaagagcugugggaucaguuucauaagagagggacagaaauggucauuaccaaauccggacggcgcauguuucccccuuucaaggugagaugcucuggccuugacaagaaagccaaguauauccugcucauggauauuaucgcugccgacgauugucgguacaaauuccacaauagccgcuggaugguugcgggcaaggccgaccccgagaugcccaaaagaauguauauccacccugauuccccggcuacaggggaacaguggaugagcaagguggucaccuuucauaagcugaaacuuacaaacaauauuucugacaagcacggauucaccauccugaacuccaugcauaaauaccaaccccgguuucacauugugcgcgccaaugauauccucaagcugccuuauagcacguucagaaccuaccuguuucccgagacagaguucauugcuguuaccgccuaucagaacgacaaaaucacacagcucaagauugacaauaacccuuucgccaaaggcuuucgggauaccgggaauggacgcagagaaaagcggaagcagcugacgcuucaaucuaugcgcguguucgacgagagacacaaaaaggaaaacggcacauccgaugagucuagcuccgaacaggcugcguuuaauugcuucgcccaggcuagcucccccgccgccucuaccgucgggacaagcaaccugaaagaccucuguccguccgagggagagagcgaugcugaagccgagucuaaggaggaacauggcccugaagcgugcgacgcugccaaaaucuccaccaccacaagcgaggagcccugucgggauaagggcucuccugccgugaaggcucaccuguuugccgcugaaagaccccgcgacagcgggcggcuugauaaagccuccccugacucuagacauagccccgcgacgaucuccagcucuacccgcggacugggcgccgaggaacggagauccccggugcgcgaggggacagcuccugccaaggucgaagaggcucgggcccuccccggaaaagaggcguucgcuccccugaccguucagacagaugccgccgcugcccaccuggcccaaggcccucucccggggcugggauuugcucccggccuugcgggccagcaguucuuuaaugggcauccucuguuccuccaccccagccaauuugccaugggaggcgcuuucucuuccauggccgccgcugggaugggaccucugcuugccaccgugagcggcgcguccacgggggugucuggccuggacagcacagcuauggccuccgccgcugccgcgcagggacucucuggcgcuagcgccgccacccugcccuuucaucugcagcagcacguccucgcuucccaagggcuggccaugagcccuuucggaucucuuuuccccuacccguacaccuauauggcugccgcggccgcugccuccagcgcugccgccucuuccagcgugcacagacauccuuuucugaaccucaauacaaugcgcccccggcugagauacucuccuuauagcauucccguuccggugccugacggcuccagccugcuuaccacagcucuccccucuauggcggccgcugccgggccucuggauggaaaggucgccgcucuggccgcgucccccgcuagcguggccguugacuccggcucugaacucaacagccgcuccucuacgcugagcuccucuagcaugucccuuagccccaaacugugcgccgagaaggaagcugccaccucugagcuccaguccauccagcggcuggugagcgggcuggaggcgaagccugauagaucucgguccgcuagcccguga

SEQ ID NO: 76657 - RNA, 1638 nt, Artificial Sequence
  derived and/or modified sequence opt5 from TBX4__Homo_sapiens__NP_060958
augcugcaggacaagggccucagcgaguccgaagaggccuucagagcucccgggccugcccugggagaagcgucugcugccaacgccccggagcccgcucuugccgcuccuggccugagcggggccgcgcucggaucucccccuggccccggggccgauguggucgcugccgcugccgcggaacaaaccaucgagaauauuaaaguuggacugcacgagaaggaacuuuggaaaaaguuucaugaggccggcacagaaaugaucauuacgaaagcuggccggcgcauguucccuuccuacaaggugaaggugaccgggaugaacccgaaaacaaaguauauccugcucauugacaucguccccgccgaugaccacagauacaaauuuugcgauaauaaguggaugguggcuggaaaagccgagccugccaugcccggccggcuguauguucauccugacagccccgcuaccggggcgcacuggaugcgccagcugguguccuuccagaagcucaagcugacaaacaaucaucuugauccguuuggacacaucauucugaacucuaugcacaaauaccagccuagacuccauaucgucaaggccgacgagaauaacgcuuucggcagcaaaaauaccgccuuuuguacacacguguuccccgaaaccuccuuuauuagcguuacgucuuaucaaaaccauaagaucacccagcugaaaauugagaauaacccuuucgccaagggguuucggggauccgaugacagcgaucuucgcguggcuagacugcagucuaaagaauaccccgucaucuccaagagcauuaugcggcagcgccucaucucuccccaacuguccgccacaccugacgugggcccgcugcucggcacccaccaggcgcugcagcacuaucagcaugagaauggggcucacagccaacuugccgaaccccaggaucugccucucuccacauuccccacccagagagacucuagccuguuuuaccauugccuuaagcggcgcgacggaacgagacaccuggaucucccuuguaaacgguccuaccuggaggcccccagcucugugggcgaggaccauuauuuccgcuccccgccucccuacgaucaacagaugcugagcccuucuuauugcagcgaagucacacccagagaggcuuguauguacuccgggucuggaccugaaaucgccggcguuagcgggguggacgaucugcccccgccuccccucuccugcaacauguggaccagcgugucucccuauacauccuacagcguccagaccauggagaccgugccuuaucagccguuccccacacacuuuacggcuaccacaaugaugccucggcuucccacccugucugcccaauccagccagccucccggaaaugcgcacuucuccguuuacaaccagcucucucagagccaagugagagaacgcggcccuuccgccucuuuuccccgggagagaggccugccgcaggggugugagcgcaagccucccagcccucaucuuaacgcugccaaugaguuccuguacucccagacauuuagccucucucgggaauccagccugcaguaucacucuggaaugggcaccgucgaaaacuggacggacggguga

SEQ ID NO: 76658 - RNA, 1407 nt, Artificial Sequence
  derived and/or modified sequence opt5 from TBX5__Homo_sapiens__NP_542448
auggagggcaucaagguguuccugcacgaaagagagcucuggcugaaauuucaugaagucgggaccgagaugauuaucacaaaggccggacggcgcauguuccccagcuacaaaguuaaggugacgggccuuaacccuaaaaccaaguauauucugcucauggacaucgugccggcugaugaccacagauacaaguuugccgauaauaaaugguccgucacagggaaggcggaacccgcuaugccuggacggcuguaugugcaucccgacucuccugccaccggcgcccacuggaugcgccagcuuguuagcuuccaaaaacugaagcucacaaacaaucaucuggaucccuuugggcacauuauccugaacuccaugcacaaauaccagccuagacuccauaucgugaaggcugacgagaauaacggauucggcucuaagaauaccgccuuuugcacacacgucuucccggagaccgcuuuuauugccgugacgagcuaucagaaccauaaaaucacccagcugaagauugaaaauaaccccuucgcgaaaggcuuucggggguccgaugacauggagcuucaccgcaugucuagaaugcaaagcaaggaauacccuguugugccccgguccacaguccgccagaaaguggccagcaaucacucuccuuucuccagcgagucuagagcucuguccaccagcucuaaccucggaucccaguaucagugugagaauggcgugagcgggcccucccaagaucugcuuccgccucccaacccuuacccccugccccaggaacauucucagaucuaccacugcacaaagcggaaagaggaagaguguagcaccacggaccauccuuauaagaagccguacauggaaacaucccccagcgaggaggauucuuuuuaucgcuccagcuacccucagcaacagggacucggcgccucuuauagaaccgaaagcgcucagcggcaagccugcauguacgcguccucugcucccccuagcgagcccgucccgucccuggaagacauuagcuguaauacauggccuucuaugcccuccuauagcucuugcaccguuaccacagugcagccuauggaucgccugcccuaccagcacuucuccgcccauuucacgagcgggccucucgugcccagacuggccggaauggcuaaccacggcuccccgcagcuuggcgaggggauguuucaacaccagaccucugucgcccaucagccugugguucggcaguguggaccccaaacaggccugcagagccccgggacccuccagccuccggaguuccuguacucccacggagugcccagaacacuuucuccucaucaguaucacagcguccacggcguggggaugguucccgaaugguccgacaacagcuga

SEQ ID NO: 76659 - RNA, 1311 nt, Artificial Sequence
  derived and/or modified sequence opt5 from TBX6__Homo_sapiens__NP_004599
auguaccaccccagagagcuguauccuagccucggcgccggguaccggcugggaccggcucagcccggcgccgacuccucuuucccucccgcgcuugcugaaggguaucgcuacccugagcuggauacccccaagcucgacugcuuucugagcggaauggaagccgccccuagaacacuugcugcccauccgccccugccucuccugcccccugcuaugggcacggagcccgccccguccgcgccugaagcccugcacucucuccccggggugagccugucccuugagaaccgggagcuguggaaagaguucucuagcgucggaaccgaaaugaucauuacaaaggcuggccgcagaauguuuccugccugucggguuuccgugaccggccucgaucccgaagcucgcuaucuguuccuucuggacgugauccccgucgauggggccagauaccgguggcaaggacgcagaugggagccuagcggcaaagcggagccgcggcuccccgaccgcguguauauucauccugauucucccgccacaggggcucacuggaugagacagccuguuuccuuucaucgggugaagcugaccaauagcacacuggacccccacggacaccucauccugcauucuaugcacaaauaccagccgcgcauucaucuugucagagccgcucagcugugcucccaacacuggggcgggauggccagcuuccgguuuccugaaaccacguucaucucugugaccgccuaccagaacccccagaucacacagcucaagauugcugcgaauccuuuugccaagggauucagagagaacggccgcaauuguaaacgggaaagagaugcucgcguuaagcggaaacugagaggccccgagccugccgccaccgaggcuuauggguccggagacacacccggcgggccgugcgauagcacccuuggaggcgacauccgcgaauccgauccugagcaagcccccgcgcccggggaagcuacggccgccccugcuccgcuguguggaggccccucugccgaggcuuaccuccugcacccugccgcguuucauggcgcccccagccaucugccuacacggucccccagcuucccugaagcucccgacucugggagauccgccccguauagcgcugccuuucucgagcugccucacggaucuggcgggagcggauaccccgcggccccucccgcugugccguucgccccucacuuccuucagggcgggcccuuuccucugcccuauaccgcucccggcggauaccucgacgucggcuccaagccuauguauuga

SEQ ID NO: 76660 - RNA, 1224 nt, Artificial Sequence
  derived and/or modified sequence opt5 from TBXA2R__Homo_sapiens__NP_963998
auguggcccaacggcagcucccuggggccuugcuucagaccgaccaauaucacacucgaggaacggcgccugauugccucucccugguuugcugccagcuucuguguggucggacuugcguccaaccugcucgcucugucuguucuugccggcgccagacaagggggaagccacacgcgguccucuuuucugaccuuccucugcggccuggugcugacagacuuucucgggcugcuugugaccggaacaaucgucgugagccagcaugcugcccuguucgaguggcacgcuguugauccuggcugucgccucugcagauuuaugggcguggucaugauuuucuuugggcugagcccccuucugcucggagccgcgauggccuccgaacgguaccugggcaucacccgcccuuucucuagacccgcuguggccucccagcggcgcgcuugggccacaguugggcuggugugggcggccgcucucgcccugggacuucugccucuccugggcgucgggagauauaccgugcaguacccgggaagcugguguuuucuuacgcugggcgcugagucuggcgacguggccuucgggcuccuguuuuccaugcugggaggccucagcgucgggcugucuuuccuucugaauaccguuuccguggccacacucugccauguguaucacggacaggaagcugcgcaacagcggccccgcgauagcgaggucgagaugauggcccagcugcuuggcauuauggugguugcuuccguguguuggcugccucuccuggucuucaucgcccagaccgugcugagaaaucccccugccaugucucccgcugggcaacucagccggacaaccgaaaaggagcugcuuaucuaccugcgcguugccacguggaaccagauucucgacccguggguguauauccuguuuagacgggcgguccugagacgccuucagccucggcucuccacaagaccccgccggagccugacccuguggccuucucucgaauacuccggaacaauuagcgcucauugcaaccugagacuucccggcucuagcgauucccgcgccucugccagccgggcugccggcaucaccggggugucccacugugcuagacccugcaugcuguucgacccugaguuugaucuccuggccggaguccagcugcuuccguucgagcccccuaccggcaaagcgcucagccgcaaggacuga

SEQ ID NO: 76661 - RNA, 1605 nt, Artificial Sequence
  derived and/or modified sequence opt5 from TBXAS1__Homo_sapiens__NP_001052
augauggaggcccugggcuuccucaagcuggaagugaacgggcccauggucaccguugcucuuagcguggcccugcucgcgcugcuuaaaugguacuccacaucugcuuuuagcagacuggagaagcucggacugcggcacccuaaaccgucccccuucaucggcaaucugacguuuuuccgccagggguuuugggaaucucaaauggagcucagaaagcuguauggaccucuuugcggcuacuaucuggggcggcgcauguucauugugaucagcgaacccgacaugauuaaacagguccucguggagaacuuuuccaauuucaccaacagaauggccucuggacuggaguuuaagagcguugccgauuccgugcuuuuccugcgggacaagcgcugggaagaggucagaggcgcucucaugagcgccuuuucuccugaaaaacugaaugagauggugccccugaucucccaggcuugugaucuccugcuugcccaucugaagcgguacgcggagagcggcgacgccuucgauauucagcgcugcuauuguaacuacacaaccgacguuguggcuucugucgccuuugggacaccuguggauuccuggcaagcuccggaagaccccuucgugaaacacugcaagagauucuuugaguucuguaucccucggcccauccucguccugcuucugagcuuuccuucuauuaugguuccccucgcccgcauccugccgaauaaaaacagagaugaacugaauggauucuuuaacaagcucauucggaaugugaucgcgcugcgcgaccagcaggccgcugaggaaagacggagagauuuccuucagauggugcuggacgcccgccauuccgcuagcccuaugggcguccaagauuuugacauugugcgggacguuuucuccucuaccgggugcaagcccaacccuagcagacagcaccagcccucccccauggcccgcccucucacaguggaugagaucgucggacaggccuuuauuuuccugaucgcuggcuaugagaucauuaccaauacgcuuagcuuugcgaccuaccugcucgccacaaacccggacugucaagaaaaacugcugcgggagguggauguuuucaaggaaaaacauauggcucccgaguuuugcucucucgaagaggggcugccuuaccuugacauggugaucgccgagacccugagaauguaucccccugccuuccgcuucacacgggaagcugcccaggauugugagguccucggacagcgcauucccgcgggcgcugugcuggaaauggccgucggcgcccugcaccacgacccggagcauuggccuucccccgaaaccuuuaauccugagagauucacggcugaggcccggcaacagcacagacccuuuacauaccuuccuuucggggcuggaccccgcagcugccucggcgugcggcuggggcugcucgaaguuaagcugacccuucugcaugugcuccacaaauuuagauuccaggccuguccggagacacaggucccucugcaacuggaaucuaagagcgcgcuuggacccaaaaacggcguguauaucaagauuguuucccgguga

SEQ ID NO: 76662 - RNA, 213 nt, Artificial Sequence
  derived and/or modified sequence opt5 from TCAIM__Homo_sapiens__NP_001025010
auguucugccaccugagacccaugcggcgccucugucuggagaagaucuuuccucauugguucccguuuagcagagcccuuuccggcgcugaagccgugaacgcgcugcggcccuucuacuuugcuguccacccugacuucuuugggcagcaucccguugagcgcgaugacaccuggaaaucuuuccaaugcccuagcgauuuuucccucuga

SEQ ID NO: 76663 - RNA, 504 nt, Artificial Sequence
  derived and/or modified sequence opt5 from TCAP__Homo_sapiens__NP_003664
auggccaccagcgagcuguccugcgaagugucugaggaaaacugugagagacgggaggcuuucugggccgaguggaaggaccucacacugagcacgcgccccgaggaaggcugcucccuucacgaggaagauacccagagacaugagacauaccaccaacaggggcagugucagguccugguucaacggucuccuuggcucaugaugcgcaugggaauccugggcagagggcuucaggaguaucagcugccguaccagcgggugcucccccugccuauuuuuacccccgcgaaaaugggagcuacaaaggaagaacgcgaagacaccccuauccaacugcaggagcuccuggcccuugaaacagcccugggcgggcagugcguggauagacaggaggucgcugagauuaccaaacaacugcccccugugguuccggugagcaagcccggagcccuccggcgcucccuuucuagaagcaugucccaggaagcucagcggggcuga

SEQ ID NO: 76664 - RNA, 906 nt, Artificial Sequence
  derived and/or modified sequence opt5 from TCEA1__Homo_sapiens__NP_006747
auggaggacgaaguggucagauucgccaagaaaauggauaagaugguucagaaaaagaacgcugccggcgcgcuggaccuccugaaagagcuuaagaauauccccaugacccuggaacuccugcaaagcacacggauugggauguccgugaacgcuauccgcaagcagucuacggaugaggaagugaccagccuugccaaaucccugauuaagucuuggaaaaagcuccuggacggaccuagcacagagaaagaucuggacgagaagaagaaagaaccggccaucaccucccaaaauucucccgaggcuagagaagagagcacauccagcggcaacgucucuaaucggaaggaugagaccaacgcccgcgacacauacguguccagcuuuccuagagcucccucuaccuccgauagcguucggcucaaaugccgcgaaaugcuggccgcggcccuuagaacgggggacgauuauauugcuaucggagccgacgaggaggaacugggcucucagaucgaagaggcuauuuaccaggagauccggaauaccgauaugaaguauaaaaaccgcgugagaucccggauuagcaaucucaaggacgccaaaaacccuaaucugcgcaagaacguccuuugugggaauauucccccugaccuguucgcgagaaugacagccgaagagauggcuuccgaugaacucaaggagaugcggaaaaaccugaccaaggaagccauccgcgagcaccagauggcuaaaacaggaggcacccagacggaccuguuuacaugcggcaaguguaaaaagaagaauugcaccuacacacaggugcaaaccagaucugccgaugagccgaugaccacauucguuguguguaacgaaugcgggaaccgguggaaauuuuguuga

SEQ ID NO: 76665 - RNA, 900 nt, Artificial Sequence
  derived and/or modified sequence opt5 from TCEA2__Homo_sapiens__NP_003186
augaugggcaaggaggaagagaucgccagaauugcucggcgccuggacaaaauggugaccaagaaaagcgccgaaggggcgauggaucuccugagagagcuuaaggcuaugcccaucacacugcaccuccugcaguccacgcgggucggaaugucuguuaacgcccuucgcaaacaaagcuccgacgaagaggugauugcccuggcuaagucucucaucaagagcuggaaaaagcugcuggaugccuccgacgcuaaagccagagagcggggccgcgggaugccucucccgaccucuagcagagaugcguccgaagcccccgacccuagccggaagcgccccgagcugccuagagcucccucuacaccucggauuaccacauucccgcccgugccugugaccugcgaugccguccgcaauaaauguagagaaaugcuuacagcugcccugcagaccgaccaugaucacguugcgaucggagccgacugcgagcggcucuccgcucagaucgaggaauguauuuuucgcgaugugggcaacacggacaugaaguacaagaauagaguccggagcagaaucucuaaccugaaagaugccaagaaucccgaccuucgccggaacgugcugugcggggcuauuaccccucagcaaaucgccguuaugacauccgaggaaauggccagcgacgagcucaaagaaauuagaaaggcuaugaccaaagaggcgauccgcgagcaucagauggcccggacaggaggcacccagacggaucuguucacauguggcaagugccgcaaaaagaauuguaccuauacacaggugcaaaccagaucuuccgacgaacccaugaccacauuugucgugugcaacgagugugggaaucgguggaaguucugcuga

SEQ ID NO: 76666 - RNA, 1032 nt, Artificial Sequence
  derived and/or modified sequence opt5 from TCEA3__Homo_sapiens__XP_011540358
augggccaggaggaggaacugcucagaaucgccaagaaacuggaaaagaugguggcucggaaaaacaccgagggggcccuugaccugcucaagaaacugcacagcugccaaauguccauucagcuucugcagacaacgcgcaucggagucgcgguuaauggcgugagaaagcauuguucugauaaggaaguggucagccucgcuaaagugcugauuaagaacuggaaacggcugcucgacucccccgggccuccgaagggagagaaaggcgaggaacgcgagaaggccaagaaaaaggaaaaagggcuggagugcucugauuggaagcccgaggccggacuuagcccuccccggaaaaagagagaagacccuaaaacccgcuccaauucuagcaaguccaaggcugagagccccaaaacaccuucuuccccgcugacccccacauucgccagcucuaugugucuccuggcuccuugcuaccuuaccggcgauuccguuagagacaaguguguggaaaugcugagcgccgcgcucaaagccgaugacgauuauaaggacuacggcgucaacugcgauaaaauggcuucugagaucgaagaccacauuuaucaggagcugaaguccacagauaugaaguaccggaaucgcgugagaagccggaucuccaaccugaaagacccccgcaauccugggcucagacggaacguucugucuggagccaucagcgcuggccuuauugccaagaugaccgcggaggaaauggccuccgacgagcugcgcgaacucagaaaugcuaugacgcaagaggccauccgggaacaucagauggcuaaaaccgggggaacaaccacagaucuguuucaguguagcaagugcaaaaagaagaacuguaccuauaaucaggugcaaacgagaucugccgacgagcccaugacaaccuucguccuuugcaacgaguguggcaaucgcuggaaaccgccuuggcggaugcccagaaaccuguccaauuuuguggccuuccucgugcuguga

SEQ ID NO: 76667 - RNA, 480 nt, Artificial Sequence
  derived and/or modified sequence opt5 from TCEAL1__Homo_sapiens__NP_001006641
auggacaagcccagaaaagagaacgaagaggaaccucagagcgccccgaagaccgaugaggaacggcccccuguggagcacucccccgagaaacaaucuccugaagaacagagcuccgaggagcagucuagcgaggaagaguucuuucccgaggaacugcucccugaacugcuuccggagaugcugcucuccgaggaaagacccccucaggagggccugucucgcaaggaccuuuucgaagggcggcccccuauggagcaacccccgugcggagucggcaaacauaagcuggaagaggggagcuuuaaggagcgccucgcuagaucccggccucaguuccgcggagauauccacggcagaaaucugagcaacgaagagaugauucaggccgcggacgaacuggaggaaaugaaacggguucgcaauaagcucaugaucaugcauuggaaagcuaagagaucucggcccuacccuauuuga

SEQ ID NO: 76668 - RNA, 684 nt, Artificial Sequence
  derived and/or modified sequence opt5 from TCEAL2__Homo_sapiens__NP_525129
auggagaagcuguucaacgaaaaugagggcaugcccagcaaccaggggaaaaucgacaaugaggaacaaccuccgcacgaaggaaagcccgagguggccugcauucucgaggauaaaaagcuggaaaacgagggcaauaccgaaaacacagggaaaagagucgaggagccucuuaaggacaaggaaaaacccgaguccgcuggaaaggccaaaggcgaagggaagucugagcggaaaggaaagagcgaaaugcagggcggcuccaagacggaggggaaaccugagcgcggaggcagagcggaaggggagggagaacccgauucugagcgggaaccugagagcgagggcgaaccggaguccgaaacccgcgcugccgggaagagacccgccgaggacgauaucccucggaaagcuaagcgcaaaacaaauaagggacuggcccaguaccucaaacaguauaaggaagcuauucaugacaugaacuuuucuaaugaggauaugaucagagaguucgacaacauggcccggguugaagauaagcgcagaaaaagcaagcaaaaacugggcgcguuucuuuggaugcagcggaaucugcaggaccccuucuacccucgcggccccagagaguuucgcgggggaugucgggccccgagacgggauaccgaagacauuccuuauguguga

SEQ ID NO: 76669 - RNA, 1077 nt, Artificial Sequence
  derived and/or modified sequence opt5 from TCEAL4__Homo_sapiens__NP_001287830
augcccgccggcgggcaggcuccucaacugaccccggugauccccgccuucugggaggcgagaggacucccuaacagcaagggccgggacaaaguccacauuugccagugugaagaguggaaggggcauaucuccuacguugaacgcgauauuacaacgucugagaucaaaagccugccccagguguccgugagagcuuuucacgccgccucuggaacccuugaauggcggaagggcaauggguauggacgcggcaaaggcuggggguggggaagagucgagagccgggaggcuggcccuuccguggaccgcgaugggggacugagaguuugcuguucucagcggagcgccaagcccgaaaaggaggaacaaccugugcagaacccgcgcagauccgucaaagaccggaagcgcagaggcaaucucgauauggagaaacuguacagcgagaacgaagggauggcuucuaaucagggaaagauggagaacgaagaacagccccaagacgaacggaaaccugaggugacaugcacccuugaggauaagaagcuggaaaaugagggcaaaacagaaaacaagggcaaaaccggggacgaggaaaugcucaaggauaaaggaaagcccgaguccgagggcgaagccaaagagggaaagagcgaacgcgagggggaaucugagauggagggcggguccgaaagagagggaaagccugaaauugagggcaaacccgagagcgaaggcgagccggggucugaaacacgggcggccggaaagagaccugcugaggacgauguuccccgcaaagccaagcggaaaaccaauaagggccuggcucauuaucugaaggaauacaaagaggccauccacgacaugaacuucuccaaugaggauaugaucagagaauuugacaacauggcgaaggugcaggacgagaaacgcaagagcaaacagaagcucggggccuuccuguggaugcagcggaaucuucaagauccuuuuuaucccagaggaccccgcgaguuccggggcggguguagagcuccucgccgggacauugaggauaucccguacgucuga

SEQ ID NO: 76670 - RNA, 303 nt, Artificial Sequence
  derived and/or modified sequence opt5 from TCEAL7__Homo_sapiens__NP_689491
augcagaagcccugcaaagagaacgaaggcaagccuaaauguagcgugccgaagagagaggaaaaacggcccuacggggaguucgaacgccaacagaccgagggaaauuuuagacagcggcugcuccagucccuggaggaguucaaggaagacaucgauuaucgccacuuuaaggacgaagagaugacaagagagggcgaugaaauggagcggugccuugaagagauucgcgggcugcggaaaaaguucagagcccuccauucuaaccaccgccauagcagagaccggccuuaccccaucuga

SEQ ID NO: 76671 - RNA, 291 nt, Artificial Sequence
  derived and/or modified sequence opt5 from TCEB1__Homo_sapiens__NP_001191793
auguacgugaagcugaucagcuccgacggccacgaguucauugucaaaagagaacaugcccucaccucugggacaaucaaggcuaugcugagcggacccggccaguuugccgagaacgaaacgaaugagguuaacuuccgggaaauuccuucccacgugcuuucuaaagugugcauguauuuuaccuacaagguccgcuauacaaauagcuccaccgagaucccggaguuccccauugcgccugaaaucgcucuggagcuccugauggccgccaacuuucuugauuguuga

SEQ ID NO: 76672 - RNA, 357 nt, Artificial Sequence
  derived and/or modified sequence opt5 from TCEB2__Homo_sapiens__NP_009039
auggacguguuccugaugaucagacggcacaagaccacaauuuuuacggaugccaaagagagcuccaccgucuucgaacucaagcgcaucguugagggcauucugaaaagacccccugacgaacagcggcuuuacaaggaugaccaacugcucgaugacgggaaaacacugggagagugcggcuuuaccucucagacagcucgcccgcaggcccccgcgaccguggggcuugcuuucagagccgaugacacauuugaagcccuguguaucgagccuuucagcucucccccugagcuccccgaugugaugaagccucaggacuccggaagcuccgcuaacgaacaagccguccaguga

SEQ ID NO: 76673 - RNA, 1641 nt, Artificial Sequence
  derived and/or modified sequence opt5 from TCEB3C__Homo_sapiens__NP_663628
auggccgcuggcagcaccacacugagagccguggggaagcuccagguccggcuggcgacgaaaaccgagcccaagaaacuugaaaaguaccugcaaaaacucuccgcucugccuaugacagccgacauccuugccgagaccggcauucgcaagacaguuaagagacugcggaaacaccagcaugugggagauuucgcucgcgaccucgccgcuagauggaagaaacuggugcuggucgaucggaacaccgggccggacccccaggauccugaagagucugccagccgccagagauuuggagaagcgcuccaagagcgggagaaggccuggggcuuccccgaaaaugcuacagccccucgcucccccucucacagcccugagcauagacggaccgcucgcagaacgccgcccgggcagcagcggccucacccccgcuccccuucuagagaaccccgggccgagagaaaacgcccgcggauggcgccugccgacagcggaccccauagagauccucccacccgcacagcuccccugccuaugccggagggccccgaaccugccgugcccggcgagcagccugggcggggacacgcucacgccgcccaaggcgggccccuucugggacagggcugccaggggcagccgcaaggagaagcuguuggcucccauagcaagggccacaagucuuccagaggggcgagcgcccagaaaucuccucccgugcaggagucccaaagcgaacgccuccaggcugccggagccgacucugcuggcccuaagaccguccccucccauguguuuagcgagcugugggauccuuccgaggccuggaugcaggcgaacuaugaccuucugucugcuuucgaagccaugacaagccaggccaaucccgaggcucucuccgccccggcucugcaagaagaggccgcguuuccugggcggagaguuaacgccaaaaugcccguguacagcggaucucgccccgcuugucagcugcaggucccuacccuccggcagcaaugccugagagugccgcgcaauaaccccgaugcccuuggcgacguggaaggggucccuuauuccguucuggagcccgugcucgagggauggacgccugaucagcuguaccggacagaaaaggacaaugcugcccuugcgagagagaccgacgaacuguggcggauccacugucuccaggauuucaaagaggaaaagccccaggagcacgagagcuggcgcgaacuguaucugagacuccgggacgccagagagcaacgccugcggguggucacaaccaaaauuagaucugcucgcgaaaacaagccuagcggcagacagaccaagaugaucugcuuuaauuccguggccaaaacacccuacgaugcuucucggcgccaggaaaagagcgccggcgccgcugacccggggaacggagagauggagccugcgcccaaaccugccggcuccagccaggcucccucugggcuuggagauggcgacgggggcuccguuagcggaggcgggucuuccaauagacaugccgccccggcugauaagacgcggaaacaagccgcgaagaagguggcuccucugauggccaaagccauucgcgacuauaagggaagauucagccggcgcuga

SEQ ID NO: 76674 - RNA, 3234 nt, Artificial Sequence
  derived and/or modified sequence opt5 from TCERG1__Homo_sapiens__NP_001035095
auggccgagagaggcggggacggaggcgaaagcgagcgguucaaccccggggaacugcgcauggcucagcaacaggcccucagauuucggggacccgcgccgcccccuaaugcugugaugcgcgggcccccuccccugaugagaccuccgcccccuuucggcaugaugcggggacccccucccccgccuagacccccuuuuggccgcccucccuucgaucccaacaugccgcccaugccucccccuggcgggauucccccgccuaugggacccccucaccuucagcggcccccuuuuaugcccccgccuauguccucuaugcccccucccccgggcaugauguuucccccugggaugcccccugucaccgcccccggaacgccugcccugcccccgacagaggaaaucuggguugagaauaagaccccugacggcaaaguguacuauuacaacgcucgcacaagagagagcgccuggaccaagcccgauggggugaaagucauccagcaauccgaacucacaccuaugcuggcugcccaggcccaggugcaggcccaagcucaggcccaggcucaggcccaagcgcaggcccaggcucaagcccaggcucaggcccaggcccaagcucaggcgcaggcccaggcucaagcccaggcccaggcucaggcccaagcgcaggcucaggcccaggcccaagcucaggcccaggcucaagcccaggcgcagguucaggcccaagugcaggcucagguccaggcccaagcugugggagccucuacccccacaaccagcuccccggcgccugccguuucuacgagcaccuccagcucuacacccuccagcaccacaucuaccacgacaaccgcuacauccguggcccagaccgucagcaccccuacaacgcaggaccagacccccucuuccgcugugagcguggccacacccaccgucuccguuucuaccccugccccgacagcuacgcccgugcaaacagugccucagccccauccucagacccuucccccugcggucccgcacagcgugccccaaccuaccacagccauucccgcuuucccucccguuauggugccgccuuuccgggucccccugcccggcaugccuaucccccucccuggcgugcugccggggauggcgcccccuauuguucccaugauccauccucagguggccaucgcugccucccccgcgacccuggcuggagccacagccgucagcgaguggacggaauauaagaccgcugauggcaaaacauacuauuacaauaaccgcacccucgagucuacaugggagaagccgcaggaacugaaggagaaagaaaaacuugaggagaagauuaaggaaccuaucaaagagcccuccgaggaaccucugcccauggaaaccgaggaagaggacccuaaggaggaacccauuaaggagaucaaagaggaaccgaaggaagaggagaugacggaagaggaaaaagccgcgcagaaggcuaaaccuguggccaccgcccccauucccgggacaccuuggugcgucguguggaccggagaugagagaguguuuuucuauaauccgacaacccggcucagcaugugggaccgccccgaugaccugaucggcagagcugauguugacaagauuauccaagagccuccccacaaaaaggggauggaggaacuuaagaaacugcggcauccuacgcccacaaugcucucuauccagaaguggcaguuuagcauguccgccauuaaagaggaacaggaacugauggaggagaucaacgaagaugagccugucaaggcuaaaaagagaaagcgcgacgacaauaaagauauugacucugaaaaggaggccgcgauggaagccgagaucaaagcugcccgggagagagcuauugugccgcuggaagcccgcaugaagcaauucaaagauaugcuccuggagcggggaguuagcgccuuuuccaccugggaaaaggagcuucacaagaucguguucgaccccagauaccugcuccugaacccuaaagaacgcaagcaggucuucgaucaguacgugaaaacacgggcugaggaggaaagacgcgagaagaaaaauaagaucaugcaggcgaaggaagacuuuaaaaagaugauggaggaggccaaauucaacccccgggcuaccuuuagcgaguucgccgccaagcacgcuaaagauucuagauuuaaggccauugagaaaaugaaggaccgcgaagcgcuuuucaaugaauuuguggcugccgcccggaagaaagaaaaggaggauuccaaaaccagaggcgagaagaucaaaagcgacuucuuugaacugcucucuaaccaucaccuggauucccaaagccggugguccaagguuaaggacaaagucgagucugacccucgcuauaaggcuguggauagcuccucuaugagagaagaccuguucaaacaguacauugagaagaucgccaaaaaucucgauagcgaaaaggagaaggagcuggaacggcaggcgagaauugaggcuucccuucgcgaacgggagagagaagugcagaaagcccgcagcgagcaaacaaaggagaucgacagagaacgggagcagcauaaacgcgaagaggccauccagaacuuuaaggcucugcucucugauauggucagauccagcgacgugucuugguccgauacgcggcgcacccugagaaaagaccaccggugggagagcggcucucuucuggaacgcgaggaaaaggagaaacucuucaacgaacacauugaggcccugaccaagaagaaaagagagcauuuucggcaacugcucgaugaaacaagcgcuaucacacugaccuccacguggaaggagguuaaaaagauuaucaaagaagacccccgcuguauuaaguucucuagcuccgauagaaagaaacagcgggaguucgaagaguauaucagagacaaguacauuacagccaaagcggauuuucgcacccuucugaaggagaccaaauucaucacauaucggagcaagaagcucauccaggaauccgaccagcaccugaaagacguggagaagauucugcaaaaugauaaaagauaccuuguccucgacugcgugccggaggaacgccggaagcugaucguugccuauguggaugaccuggauagacgcgggccuccuccuccucccaccgcuucugaacccacacggagaagcacgaaauga

SEQ ID NO: 76675 - RNA, 1761 nt, Artificial Sequence
  derived and/or modified sequence opt5 from TCERG1L__Homo_sapiens__NP_777597
augcaggccggcgcuagauuccaacggcgcagacggcagcugcagcagcaacagccccgcagacggcagccucuccuguggccgauggacgccgagcccccucccccucccccuuggguguggauggucccggggagcgcgggacuucugcgccucuccgcuggcguuguggugcccccuguccugcuugccucugcucccccucccgccgccccgcugcucccugggcugcccggauggccugcucccagcgaacccgugcugccucuccugccgcuucccuccgccccugauucugcggccgcugccgcugcccaccccuuuccugcgcugcauggccaguggcucuuugggggacacagccccucccugggccuuccgccuucuagcaccguugagcuggugcccgucuuuccucaucucugccccuccgcccuggcuacaccuaucggcaagagcuggauugacaaaagaauccccaacuguaagauuuucuuuaauaacucuuucgcccuggauuccacguggauccacccggaagagagccgguuuuuccaugggcacgaaaaaccucgccuccuggcuaaucaaguggccguuucucuuuccagacccgcccccgcuagccggccucugccgaccgugguccucgcgccccagccuauucccggaggcugccacaacucucugaaggugacauccagcccugccaucgcuaucgccaccgccgcugccgcggcuaugguguccgucgaccccgagaaucuucgcgggccuucucccagcuccguucagccgagacauuuucugacacucgccccuauuaaaaucccccugcggaccagcccugugucugauacacgcaccgagagaggacggguggccagacccccggcucugaugcuccgcgcccagaagucccgggacggcgauaaggaagacaaagagccucccccuaugcuugggggaggcgaagauagcacggcuagaggcaaccgccccgucgccucuacccccgugccugggagcccgugguguguuguguggacaggagacgaucgggucuucuuuuucaaucccaccaugcaccuuuccgugugggagaagccuauggaccugaaagauagaggcgaccucaaccgcauuaucgaggaucccccucauaagcggaaacuggaagcgcccgccacagacaauucugacgggagcuccagcgaggauaacagagaagaccaagauguuaagaccaagcgcaaucggacggagggaugcggcucuccuaaaccggaagaggcuaagagagaggacaaagggacacgcacacccccuccccagauucuucugccucucgaggaacgggugacccacuuuagagauaugcugcuggaacggggagucuccgccuucagcaccugggagaaggaacuccacaaaaucguguucgacccccgcuaccugcuucugaacucugaggagagaaagcagauuuuugaacaauucgucaaaacccggaucaaggaggaauauaaggagaaaaaguccaaacuccugcuggcuaaggaagaguuuaaaaagcugcucgaggaaagcaagguguccccgagaacaacguucaaagaguuugccgaaaaguacggccgcgaucagcgguucagacugguucagaaacgcaaggaccaggagcauuucuucaaucaauuuauccugauucucaaaaagagagauaaggagaaccggcugcgccuuagaaaaaugcgguga

SEQ ID NO: 76676 - RNA, 2049 nt, Artificial Sequence
  derived and/or modified sequence opt5 from TCF12__Homo_sapiens__NP_003196
augaacccccagcaacagagaauggccgcuaucggcaccgacaaggagcugagcgaucuccuggacuucuccgccauguuuucuccuccggugaauagcgggaaaacacggcccacgacccuuggauccucucaguucagcggcuccgggauugaugaacgcggaggcacaaccucuugggggacaagcggacagccuucccccagcuacgacucuuccagaggcuuuaccgauagcccucacuauucugaccaucugaacgauucccggcucggcgcgcacgaggggcugagccccacaccuuucaugaauagcaaccuuaugggaaagaccuccgaacgcggcagcuuuucccuguacucuagagacacggggcucccgggaugccaaagcucccugcugcggcaggaucucggccuggggagccccgcucagcuuucuuccagcggaaaaccuggcaccgccuauuacucuuucagcgccacauccucucgcagacggccccugcaugacagcgcugcccucgauccucugcaggcuaagaaaguccgcaagguucccccgggccuuccuuccagcguguaugcccccucuccuaauuccgacgauuuuaacagagagagccccucuuaccccuccccuaagccgcccaccagcauguucgcguccacauuuuucaugcaagacgggacccacaauucuagcgaccugugguccucuagcaacggaaugucccagccuggcuuugggggaauccucggcacgagcacaucucauaugucccagagcagcuccuaugggaaucugcacagccacgaucggcugucuuacccgccucauagcgugucccccaccgacauuaacacaagccucccgccuaugucuuccuuccaccgcggaagcaccuccucuagccccuacgucgccgcuucccauaccccucccaucaauggcucugauagcauucugggcacaagagggaacgccgcuggauccucucagacgggcgacgcccuugggaaagcgcuggccagcaucuauuccccugaucacaccucuucuuccuuucccagcaauccgucuacaccugugggaucccccagcccccucaccggcacaucucaauggccucggcccgggggccaggcucccuccagcccuuccuacgaaaacagccugcacucucuucagagccgcauggaggacagacuggaucggcucgacgaugccauccauguucugagaaaucacgcugugggacccuccaccucucugccugccggccauagcgacauucacucccuccuggggcccucucauaacgccccuaucggaagccuuaacuccaauuauggcgggucuagccuggucgcuuccagccgcucugcguccauggugggaacgcaccgggaggauagcguuucucucaacggcaaucacuccgugcugagcuccacagucaccaccucuagcacagaccuuaaccauaagacccaagaaaauuacagagggggccugcagucccagagcggaacaguggugacgaccgagauuaaaacagaaaacaaggagaaagacgagaaucuccacgaacccccgucuuccgaugacaugaagucugaugacgagucuagccagaaggauaucaaagucuccucucgcggccggaccagcuccacaaacgaagacgaggaucugaauccugaacaaaagauugagagagagaaagaacgccggauggccaacaaugcuagagagcgccugcggguuagagacaucaacgaagccuucaaggagcucgggcgcaugugucagcugcaucuuaaaucugaaaagccccagaccaaacugcucauucugcaccaggccguggcugugauccugagccuugagcaacagguccgggagagaaaucucaacccuaaggccgcgugccugaagcggcgcgaagaggaaaaaguguccgcuguuagcgccgagcccccgacgacccugccuggaacacaccccggccucucugaaaccacaaauccuauggggcauauguga

SEQ ID NO: 76677 - RNA, 600 nt, Artificial Sequence
  derived and/or modified sequence opt5 from TCF15__Homo_sapiens__NP_004600
auggccuucgcucugcucagacccgugggcgcccacguccuguacccugacguucggcuucugagcgaggaugaagagaaccgcuccgaaucugacgcgagcgaucaguccuuugggugcugugagggaccggaagcugccagacggggccccgggccuggaggcgggcgcagagccggaggcggcgggggagcuggccccgugguggucgugcggcaacgccaggccgcuaaugccagagagcgggaccgcacccagucuguuaacacagcguucacggcccucagaacccugaucccuacagagcccguggaucggaaacuuagcaagauugaaacccugcgccucgcuuccucuuauaucgcccaucuggcuaauguccugcuccugggggacagcgccgaugacggacagccuugcuuuagagcggccggcuccgcuaagggggccgugccggcugccgccgauggaggccggcaaccccgcagcauuuguacauucugccuuucuaaccagagaaaaggcgggggacggagagaccugggcggguccugucucaagguucgcggaguggcuccucugcggggccccagacgcuga

SEQ ID NO: 76678 - RNA, 1038 nt, Artificial Sequence
  derived and/or modified sequence opt5 from TCF19__Homo_sapiens__XP_005249391
augcugcccugcuuccagcuccugagaaucggcgggggacggggcggggaccuuuacaccuuucacccuccggccggagcuggcuguacauaucgccuggggcauagagccgaucucugcgacguggcgcugcggccccaacaggagccuggacuuauuagcggcauccacgcugaacugcaugccgagccccgcggcgaugacuggagagucucccucgaagaucacucuagccaggggacgcugguuaacaaugugcggcugccucgcggacauagacucgagcuguccgacggcgaucuucugaccuucgggcccgaaggaccuccgggcacaucucccagcgaguuuuacuucauguuucagcaagugcgggucaagccucaggacuucgccgcuauuaccaucccccgcuccagaggggaggcccgggugggagcuggcuuucgcccuaugcuccccucucagggcgccccgcagagaccucugagcacauucucccccgcgccuaaagccacccuuauucugaacagcaucgggucucucuccaagcugcggccccaaccccugacauuuagcccuucuuggggaggcccgaaaucccuccccguuccugcucccccuggggaaaugggaaccacgcccagcgccccgccucagcgcaauagacggaagucugugcacagaguccuggcugagcuugaugacgaauccgagcccccugagaaucccccucccgugcugauggaaccgcgcaaaaagcuccggguugauaaggccccucugacccccacaggcaacagacgcgggcggcccagaaaauauccugugagcgcgccgauggcucccccugccgucggaggcggcgagcccugugccgcuccuugcuguugccuuccccaggaagagaccguggccugggugcagugugacgggugcgaugucugguuccacguugccugugugggaugcuccauccaagcugcgcgcgaagccgacuuucgguguccuggcugcagagcugggauucagacauga

SEQ ID NO: 76679 - RNA, 5883 nt, Artificial Sequence
  derived and/or modified sequence opt5 from TCF20__Homo_sapiens__NP_005641
augcagagcuucagagagcaauccucuuaccacggcaaccagcagagcuauccccaggaagugcauggguccucucggcuggaggaguucagcccucgccaagcccagauguuccagaauuuuggaggcaccgggggauccucuggcagcuccgggagcggaucuggcggcgggagacggggagcugccgcggcugccgccgcuauggccuccgaaaccagcggccaccagggguaccaaggauuccgcaaggaagcuggcgacuuuuauuacauggccgggaacaaagauccggucacgaccggaacaccccagccuccccagagacggccuucuggccccguucaguccuauggcccuccgcaagggagcucuuucggaaaucaguacggcuccgaggggcaugugggacaguuucaagcgcagcacagcggccuugggggagugucccauuaucagcaggacuacaccggccccuucucuccuggcagcgcccaauaccagcagcaggcuuccagccaacagcagcagcaacagguccagcagcugcgccaacagcuguaucagucucaccaaccccugccucaggccacagggcagcccgcuuccagcucuagccaccuccagccgaugcaaagaccuuccacccugcccucuagcgccgcgggauaccagcuucgggugggccaguuugggcagcauuaucaauccagcgccucuuccuccucuuccagcuccuucccuucuccccagcgcuuuagccaguccggacagucuuacgauggcagcuauaacguuaaugcugggucccaauacgagggccacaacgugggaagcaaugcccaggcuuauggcacacagucuaacuacuccuaccaaccccagagcaugaagaauuucgaacaggccaaaaucccucaggggacccaacagggacagcagcaacagcagccgcagcaacagcagcaucccucucagcacgucaugcaauauacgaacgccgcuaccaagcugccucuccagucccaggugggccaauacaaucagcccgagguuccugugagaagccccaugcaguuucaccagaacuucucuccgauuagcaauccuucccccgcggccagcgucgugcaaucuccuuccugcagcuccacacccucuccucugaugcagaccggggaaaaccugcaguguggacagggcagcgugcccauggggucccggaaucgcauccuccaacugaugccgcagcuuucuccuacacccagcaugaugcccuccccuaacucucaugcugccggcuucaaaggauuuggccuggagggggucccggagaagagacucaccgaccccggacugagcucccuuagcgcccugucuacgcagguugcuaaccucccuaauacagugcagcacaugcugcuguccgaugcccucacaccccaaaagaaaacaagcaagcggccuucuuccagcaaaaaggcggacucuugcaccaacuccgaaggcagcucccagcccgaggaacagcugaaaagcccuauggcugagucucuugaugggggauguagcuccucuagcgaagaccaaggcgagcgcgugagacagcuguccgggcagucuaccagcuccgauacaacguauaagggcggagccucugagaaggccggcagcucccccgcucagggggcccaaaaugaaccgccucggcucaacgcuagccccgccgcgagagaggaagccaccucuccuggagcuaaagacaugccccuguccagcgauggcaauccgaaggucaacgagaaaacaguggggguuauugugucucgcgaagccaugaccggacgggucgagaagccuggcgggcaggacaaaggcucccaggaggaugaccccgcugccacacagagaccucccagcaauggaggcgcgaaggaaaccucccaugccucucuuccccaaccugagccgcccgggggaggcgggagcaaaggaaacaagaauggcgacaacaauuccaaccacaauggcgaagggaacggacagagcggccauucugcugccgggccuggauucacgucccgcacagagcccagcaagucuccuggcagccugcgguacuccuauaaagauucuuuugggagcgcugugcccagaaauguuuccggauucccucaguacccgaccggccaggaaaagggcgacuuuaccgggcacggagagcgcaaaggccggaacgagaaguuccccucucuccugcaagaagugcugcagggguaucaccaucacccugauagacgcuacagccgguccacacaggagcaucagggaauggccggcagccucgaagggaccacaagacccaacguccuggugucucaaacgaaugagcuugccucccgcggacugcucaacaaaagcaucggcucccugcuugagaauccucacuggggccccugggaacggaagucuagcuccaccgcuccggagaugaagcagauuaaccugacagacuacccuauccccagaaaauuugaaaucgagccccagucuagcgcgcacgaaccugggggaucccucagcgagcggcgcucugucauuugcgauaucagcccccugagacaaauugugcgggacccuggcgcccauagccuggggcacaugucugcugauaccagaaucggacgcaaugaccggcucaacccgacacugucccagagcguuauucuucccggcgggcuggugucuauggagaccaagcucaaaagccaguccggacagaucaaggaagaggauuucgaacaaucuaaaagccaggccuccuuuaauaacaaaaagagcggcgaccauugucacccucccuccauuaaacaugagucuuauagaggcaaugccagcccuggggcugccacgcacgauucccugucugacuacggaccccaggacagccgcccgaccccuaugagacggguccccggccgcgucgggggcagagaaggcaugcgggggcgcuccccuucucaguaucacgauuucgcggagaagcugaaaaugagccccggaagaucccggggcccuggcggggacccccaucacaugaacccgcauaugacauuuagcgagcgcgcuaauagaucuucccuucacaccccuuucagccccaacucugaaacacucgccuccgccuaccaugcuaauacccgggcccacgcguauggagaucccaacgcuggccugaauagccaacugcacuacaagcgccagauguaucagcagcaaccugaggaauacaaagacuggucuuccgggagcgcccagggaguuaucgccgcugcccagcauagacaagagggcccgcggaagucccccagacagcagcaguuucucgaucgcgugcggagcccucugaagaacgacaaagaugggaugauguacggacccccugucggcacguaucacgaccccucugcucaagaagccggcagaugccuuaugagcuccgaugggcugccuaacaagggaauggagcucaaacauggcucucagaagcugcaggagagcuguugggaccugucccgccagacaucuccggcgaaaagcuccgggcccccuggaaugucuagccaaaagcgguacggacccccucacgaaaccgaugggcacggacuugccgaggcuacacaguccagcaaacccggcucugugaugcucagacugccgggccaggaagaccauuccagccagaauccucugaucaugcgccggagagugcgcucuuucauuucccccauccccagcaagcggcaaucccaggauguuaagaacucuagcaccgaggacaaagggagacuccugcacuccagcaaggagggagccgacaaggcuuucaauucuuaugcccaucuuucccacagccaggauauuaagucuaucccuaaacgggacagcuccaaggaucugcccucuccugacagccgcaacugcccggccgucacccucacaucccccgcuaagacgaaaauucugccucccagaaagggccgggggcugaaacuugaagcgaucgugcaaaagaucaccucuccuaauauucgcagaagcgccuccagcaacucugcugaggccggaggcgauacagugacccucgacgauauccugucccugaaaagcgggcccccggaaggcggauccgucgccgugcaggacgcugauauugagaagcggaagggcgaaguugccucugaccucgugagcccugcgaaucaggagcugcaugucgagaaaccccuuccuagauccucugaagaguggcgcgggagcguggaugacaagguuaaaacagaaacccacgcugagacggugacagccggaaaggaacccccuggcgccaugaccuccaccacaagccagaaacccgggucuaaccaaggacggccggauggcucccucgggggaaccgcuccucucaucuuucccgacagcaagaaugugcccccugugggcauucuggccccggaggcgaaccccaaggcugaggaaaaagagaaugacacaguuacgaucucuccuaagcaggaaggcuuucccccuaaaggguacuuucccuccggaaagaaaaagggcagaccuaucgggagcgugaacaaacagaagaagcagcaacagcccccgccucccccuccccagccgccucagauucccgagggaucugccgauggcgaacccaaaccuaagaaacaacgccagcggagagagcgccggaagcccggggcccagccuagaaaacgcaagaccaagcaggcugucccgaucguggagccccaagaaccugagauuaaacugaaguaugccacacagccccuugacaaaaccgaugcuaagaauaaauccuucuacccuuauauccacguggucaacaagugugaacucggcgccguuugcacaauuaucaaugcggaggaggaggaacagaccaagcuggugagaggacggaaaggccaacgcagccugacgcccccuccgucuagcaccgaauccaaggcccuccccgcuagcuccuuuaugcugcaggggccuguggucacagagucuagcgugaugggacaucuuguuuguugccugugcggcaaaugggccuccuacagaaacaugggggaccucuucggacccuuuuacccucaggauuaugcugccacccugcccaagaacccgccucccaaacgggccacagaaaugcagucuaaggugaagguccgccacaaaagcgcuuccaauggcucuaagaccgacacagaggaggaagaggaacaacagcagcagcaaaaagagcagagaagccuggcggcccauccccgguucaagagacgccaccgguccgaagauuguggcgggggaccuagaagccuuucucgcggccugcccugcaaaaaggcugccaccgagggguccagcgagaagacggugcucgacucuaaaccuuccguuccgacaaccagcgaaggaggccccgagcuggaacuccagauuccugagcugccccuugauucuaacgaauuuugggugcacgagggguguauccugugggccaauggaaucuaccucgucugcggccggcuguauggccugcaggaggcucuugaaauugccagagagaugaaguguucccauugccaagaagcgggggcuacccugggauguuacaacaaaggcugcagcuuccgguaucacuacccuugugccaucgacgccgauugccuccugcaugaggagaauuuuucugugcgcugucccaagcacaaaccgccucuccccugcccucugcccccgcuucagaacaagacagcuaaagggucccugagcaccgaacagagcgagagaggauga

SEQ ID NO: 76680 - RNA, 540 nt, Artificial Sequence
  derived and/or modified sequence opt5 from TCF21__Homo_sapiens__NP_003197
augagcaccggcucccugucugacguggaggaucuccaggaagucgagaugcuggaaugcgacgggcuuaagauggauagcaacaaagaguucguuacauccaaugaaucuacggaggagagcuccaacugugaaaauggaucuccccaaaagggcagagggggacugggcaaacggcgcaaggccccuaccaaaaagagcccgcucuccggggugagccaggagggaaaacaggugcagagaaacgcugccaaugcgcgggaacgcgcuagaaugcggguccugucuaaggccuuuucccgccuuaagacaacccugcccugggugccucccgacacaaaacucagcaagcuggauacccugagacucgccucuuccuacaucgcucaucugcggcaaauucuugccaacgacaaauaugagaauggcuacauccacccuguuaaccugacauggcccuucaugguggcuggcaagccugagagcgaucucaaggaagucgugaccgccucucgccugugcgggacgaccgcguccuga

SEQ ID NO: 76681 - RNA, 2031 nt, Artificial Sequence
  derived and/or modified sequence opt5 from TCF25__Homo_sapiens__NP_055787
augagcagacgggcccugcgcagacuccggggcgagcagcgcgggcaagaaccccugggaccuggcgcccuucacuucgaccugagagaugacgaugacgcugaggaagaggggccgaagcgggaacucggagugcgcagacccggcggggcgggaaaagagggcguccggguuaacaaucgcuuugagcugaucaacauugaugaccuugaagaugacccuguggugaauggcgagagauccgggugcgcucugaccgaugccgucgcccccggaaacaagggccgggggcagcgcggaaauacagaaucuaaaacggacggcgaugacaccgagacagugccuagcgagcagucccaugcuucugggaagcucagaaagaaaaagaaaaagcagaaaaacaagaaaagcuccaccggagaagccucugagaauggccuggaagauaucgaccggauucuggagcgcaucgaagacagcacaggccucaacagacccgggccugcuccgcuguccagccggaagcacguucuuuacguggagcauagacaccugaaucccgauaccgagcucaagcgcuauuucggagcccgggcgauucugggcgaacaaagaccucgccagcggcagagagucuaccccaaauguacauggcuuaccacgccuaagucuaccuggccccgcuauuccaaaccggggcugagcaugcggcuccuggagucuaagaaaggacuguccuuuuucgccuuugaacauagcgaggaauaccagcaagcucagcacaaguuccucguggccguugagucuauggagccuaacaauaucgugguccugcuucagacaucccccuaucacguggacagccugcuccagcuguccgaugcuugcagauuucaagaagaccaggagauggcccgcgaucuuguggaacgggcgcuguacucuauggagugugccuuccauccucucuuuagccugaccuccggcgcuugcagacuggacuaucgccggcccgaaaaccggagcuucuaccucgcccuguacaaacagaugucuuuucuugagaagagaggguguccccgcacagcucuggaguauugcaagcucauccugucccuugaaccugaugaggacccgcuguguaugcuccugcugauugaucaccucgcccugagagcccggaauuacgaauaucuuaucagacuguuccaagagugggaggcucaucgcaaccucagccagcugcccaauuuugcguucucugucccucuggccuacuuccuucucagccagcagaccgaccugcccgaaugcgagcaauccucugcucggcagaaagccagccugcucauucagcaggcccugacgauguuuccuggaguucuucugccccuccuggaauccuguagcgugagaccggaugcuucuguguccagccaccgcuucuuuggcccuaacgccgagaucucucaacccccugcgcugucccagcuugucaaccucuaucugggcagaagccacuuccuguggaaggaacccgcuacaauguccuggcucgaggagaaugugcaugaaguucugcaggccguggacgccggggacccugcugucgaggccugcgaaaaccggcgcaaagugcuuuaccagagagcuccccggaauauucaccgccauguuauccugucugagauuaaggaagccguggcggcccucccgccugaugucaccacacaaagcgugaugggauuugacccccugcccccuuccgauaccaucuauucuuacgucagaccggagcggcugagccccaucucccacggcaacaccauugcucuuuucuuucgcagccuccugccuaauuacacaauggagggggaaagacccgaggaaggaguggccggcgggcugaaccggaaucagggccucaaccgccugaugcuugcuguuagagacaugauggccaauuuccaucugaacgaucucgaggcgccucacgaagacgaugccgagggagagggcgaaugggacuga

SEQ ID NO: 76682 - RNA, 1956 nt, Artificial Sequence
  derived and/or modified sequence opt5 from TCF3__Homo_sapiens__NP_001129611
augaaccagccccaaagaauggccccugugggcaccgacaaggagcugagcgaucuccuggacuucuccaugauguuuccgcuucccgucacaaaugggaaaggacggccugcuucucuggccggcgcgcaguucgggggaagcggccucgaagaucgccccuccucugggagcuggggauccggcgaccagucuagcuccagcuuugauccuucuagaacguucuccgagggcacccacuuuacagaaagccauucuucccugagcagcuccaccuuccuugggcccggacugggcggaaagagcggggagcggggcgcuuacgccuccuuugggcgcgacgccggaguuggcggccucacacaggcuggguuccugucuggagaacuggcccucaacagcccuggcccgcugucccccagcgggaugaaaggaaccucucaauauuacccuuccuauagcggcucuagcagacggcgcgcugccgaugggucccuugacacacagcccaagaaagugagaaaggugccucccggacugccgucuagcgucuacccucccuccagcggcgaggauuauggccgggacgcgaccgccuacccuucugcuaagacgcccuccagcaccuaucccgccccuuuuuacguggcugaugggucucuccacccguccgccgagcuguggucucccccuggacaggcgggcuucgggcccaugcuuggaggcggguccucuccucugccccucccgccuggcagcggacccguuggcuccucugggagcuccagcacauuuggaggccugcaucagcacgaacgcaugggguaccaacugcauggagccgaggugaauggcgggcucccuucugcuuccagcuucucuuccgcccccggcgcuaccuauggaggcgucagcucucacacaccucccgugagcggggccgacucccugcuuggaagcagaggcaccacggccgggucuuccggagaugcucugggcaaagcgcucgccagcaucuacuccccggaccacucuagcaacaauuuuuccucuagcccuuccacacccguugggucuccccagggccuggcuggaaccagccaguggccucgggccggcgccccgggggcucuuucccccagcuaugacggaggccugcaugggcuccagucuaagauugaagaucaccuggacgaggccauccaugugcugcgcucccacgcggucggaacagcuggcgauaugcacacccuccugccugggcauggcgcccuugccagcggauucaccggccccaugucucucgggggaagacacgcuggccuggucgggggaucccauccugaggacggccuggccggcagcacaucucuuaugcacaaccaugcugcccugcccucccaaccugggacgcuccccgaucugagccggccgccugacuccuacagcggacugggccgcgcgggggccaccgcugccgcuucugaaauuaaaagagaggaaaaggaggaugaagagaauacaagcgccgcggaccacuccgaggaagagaaaaaggaacucaaggcuccccgggccagaaccucuagcacagaugaggugcugucccuugaagagaaagaccugcgcgaucgggagagacgcauggccaacaaugcucgggaaagagugcgcguucgggacaucaacgaggccuucagagaacucggacgcaugugccagaugcaccugaagucugacaaagcccagaccaagcugcuuauucuccaacaggcuguccaggugauccugggccuggagcagcaagugcgggaaagaaaucucaacccuaaagcggccugucugaagcgccgggaggaggaaaaagugagcgggguugugggagauccccagaugguccuuuccgcuccgcauccuggccugucugaggcccacaaucccgccggccauauguga

SEQ ID NO: 76683 - RNA, 2322 nt, Artificial Sequence
  derived and/or modified sequence opt5 from TCF4__Homo_sapiens__NP_001230155
auguucagcaagagacuggagaaaaucccccaggugccucuccuguuuccguucauuuuuaucauucuuaccaacuacuccaagauggaaggcgccgucgagucucaacccagcuucuuuaaaacaucccaggacaucguuacgugcaccuggguggaaaauuguuauucuagcuucucccggcgcccucuggagcagauguuuugcaagcaccagucuaaaaacauuaucagcuggacagggaugguggcucauaccuguaaucccuccacacucggaggccaagggcugugcgauuucgccaagaugcaccaucagcagagaauggcggcucuuggaaccgacaaggaacugagcgaucuccuggacuuuucugccauguucuccccucccgucagcucuggcaaaaacgggccuacaucccuggccagcggacacuuuaccggcucuaauguggaggaucgguccagcuccggcucuugggggaacggaggccauccgagccccucccgcaauuacggggacggaacgccuuaugaucacaugaccagcagagaccucggcucucacgauaaccugucucccccuuucguuaauagccggauccagucuaagacagagcgcgggagcuacuccucuuauggaagagaaagcaaccuucaaggcugucaucagcagucccugcucggcggggacauggauaugggaaaucccggcacccugagcccgacaaaaccugggucucaguacuaucaauacuccagcaacaauccccggcgcagaccucuucacucuuccgcuauggaggugcagaccaagaaaguccggaaggugccucccggacugcccagcuccguuuacgccccgucugcuagcacggccgacuauaaccgcgauucccccggcuacccuucuagcaagcccgcgacauccaccuuuccuagcucuuucuucaugcaggacgggcaucacuccagcgaccccuggucuuccagcucuggaaugaaucaaccgggcuaugccggcaugcucgggaacagcucccacauuccucagagcuccuccuacugcagccugcauccccacgaaagacuguccuauccuucucauagcuccgcugauaucaacucuagccugcccccuauguccacauuucaccggucuggaaccaaucauuacagcaccuccagcuguacacccccggccaacggcacggacucuauuauggcuaaucgcggguccggagccgcgggcagcucucagaccggggaugcccucggcaaagcucuugccuccaucuauagcccugaccacacaaacaauucuuucuccagcaaccccuccacccccgugggaagcccuccgucucugagcgcuggcacagccgucugguccagaaaugggggacaggccucuagcucccccaacuacgagggcccucuccacucucugcaaagccggauugaggauagacuugaacgccuggacgaugcuauccaugugcuccggaaucacgcgguggggcccuccaccgccaugccuggaggccauggggacaugcacggcauuaucggacccucucacaacggcgcuaugggagggcugggcagcggguacggaacgggccugcucuccgccaauagacauagccugauggucgggacacaccgcgaggauggcguugcccuucggggaucucauucccugcucccuaaccaggugcccgugccgcagcugccuguccagagcgcuaccucucccgaccuuaauccuccccaagauccguauagaggcaugccucccgggcugcagggacaguccgugagcuccggcucuagcgaaaucaaguccgacgacgagggggaugaaaaccuccaggacaccaaaagcucugaggauaagaaacuggacgaugacaagaaagauauuaaguccaucacacgcagccggucuagcaauaacgacgaugaggaccugaccccugaacaaaaggccgagagagaaaaagagcgccggauggcgaacaaugcuagagaacgccuccggguuagagauauuaacgaggccuuuaaggagcugggacggauggugcagcuucaccugaaauccgacaagccccagacaaaacuccugauccugcaucaggccgucgcugugauucuuucucucgaacaacagguucgcgagagaaaucugaaccccaaggccgcuugccugaagcggagagaagaggaaaaagugagcuccgagccuccgccccucucucuggccggcccucaccccgggaugggcgaugcgagcaaucacaugggacagauguga

SEQ ID NO: 76684 - RNA, 810 nt, Artificial Sequence
  derived and/or modified sequence opt5 from TCF7__Homo_sapiens__NP_001128323
auguacaaggagaccguguauagcgccuucaaccugcucaugcacuaucccccuccguccggcgcugggcagcauccccaaccucagcccccucugcacaaagccaaucagcccccucauggagucccgcagcuuucucuguacgaacacuuuaacagcccccauccuacacccgcgccugcugacaucucccaaaagcagguucacagaccccuccagacgccggaucugucuggcuucuacagccuuaccuccgggucuaugggacagcugccucacacagugagcugguuuacccaucccucccucaugcugggcagcggggugccuggacaccccgccgccauuccccauccugcuaucgucccgcccucuggcaaacaagagcugcagccuuucgaccggaaucucaagacacaggccgaauccaaagcugagaaggaagccaagaaacccaccauuaagaaaccucugaacgcguuuaugcuuuauaugaaggagaugcgcgccaaagugaucgcugagugcacacugaaggaaagcgccgcuauuaaucagauccucggcagacgguggcacgcccugucucgcgaggaacaagcgaaguacuaugagcuugccagaaaagagcggcagcugcacaugcagcucuaccccgggugguccgcucgcgauaacuacggaaagaaaaagagacggagccgcgaaaaacaucaagagucuaccacggaaaccaauuggccgagagagcugaaggacggcaacgggcaggaaucccugagcauguccucuagcuccagcccugccuga

SEQ ID NO: 76685 - RNA, 1767 nt, Artificial Sequence
  derived and/or modified sequence opt5 from TCF7L1__Homo_sapiens__NP_112573
augccccagcugggcgggggaggcgggggaggcgggggaggcagcggcgggggaggcggguccucugccggagcugccggcgggggagacgaucucggcgcgaacgacgagcugaucccuuuccaagaugaaggcggggaggaacaggagccgagcuccgacucugcuagcgcccagagagaucuugacgaagugaaguccucucuggucaaugagagcgagaaccaguccucuagcuccgauagcgaagccgagcggcgcccccaaccuguuagagacaccuuucagaaaccccgggauuacuucgcugaagugcgcagaccucaggacucugccuuuuucaagggacccccuuauccgggcuaccccuuucucaugauuccugaucuguccagccccuaucuuucuaaugggccucugucccccggaggcgcucggacauaccuccagaugaaauggccgcugcuggacgugccuagcuccgccacggucaaggauacccgcucucccagcccugcgcaccucuccaacaaagugcccguugugcaacauccccaccauaugcacccucugacaccgcuuaucaccuauagcaaugaccauuucucucccggguccccucccacacaccugagcccugagauugaccccaagaccggaaucccgagaccuccccacccuucugagcucagccccuacuauccucugucccccggcgccgucggccagauuccgcauccucuuggguggcuggugccccagcagggacaacccauguacucucucccuccgggcggguuucggcaccccuacccugcucuggccaugaacgcuagcauguccagccugguuucuucccgcuucagcccccauaugguggccccugcgcaccccggacucccuacaucuggcaucccccacccggccaucgucuccccuauugugaagcaggaacccgcuccucccagccuguccccggccgugucugucaaaagcccuguuaccgugaagaaagaggaagagaagaaaccccaugugaagaagccucuuaaugcuuuuaugcuguauaugaaagaaaugagagccaaggucguggccgagugcacgcucaaagaguccgcugcgaucaaccagauucuggggcggaaguggcacaaucuuucucgcgaggaacaagccaaauacuaugaacuggcuagaaaggagcggcagcuccauagccagcuguaccccaccugguccgcccgcgauaacuauggcaaaaagaagaaaagaaagcgggaaaaacagcugagccaaacacagucucagcagcaaguucaggaggccgagggagcucucgccuccaagagcaaaaagcccugugugcaguaccugccuccggaaaagcccugcgacucuccugcguccagccacggcucuaugcuugauagccccgcuaccccuuccgccgcccuggcuagccccgccgcuccugccgcgacacauucugagcaggcccaaccgcucucccugaccacgaaacccgaaacaagagcucagcuugcccugcacagcgcugccuuccucuccgcgaaggccgcugccucuagcuccgggcagaugggaucucagccuccccugcugagccgcccucucccccugggcuccaugccgaccgcccuucuggcuucuccucccagcuuucccgccacacuccacgcucaucaagcgcugccuguccugcaggcccagccccuuucccucgugaccaaaagcgcucacuga

SEQ ID NO: 76686 - RNA, 1809 nt, Artificial Sequence
  derived and/or modified sequence opt5 from TCF7L2__Homo_sapiens__NP_001139746
augccccagcugaacggcgggggaggcgacgaucucggggccaaugacgagcugaucagcuucaaggaugaaggagagcaagaagagaaauccucugaaaacagcuccgcugagagagaccuugccgaugugaagucuagccuggucaaugaguccgaaaccaaccagaauagcagcuccgacagcgaggcggaacggcgcccuccgcccagaucugaguccuuucgggauaaaagccgcgagucucucgaagaggcugccaagagacaggacggcgggcuguucaaaggaccucccuacccuggcuaucccuuuauuaugaucccugaucuuacauccccguaccugcccaacggcagccucucuccuacggcccggacccugcacuuccaguccgggagcacacauuauuccgcuuacaagaccauugaacaccaaaucgccguucaguaucugcagaugaaguggccccuccuggacgugcaggcuggaucucuucaaagccgccaggcccugaaagaugcgagauccccuagccccgcccauauugugucuaauaaggucccggugguucagcacccucaucacgugcacccccucacaccucugaucaccuacuccaacgagcauuuuacacccggcaaucccccuccgcaccuucccgcugacgucgauccuaaaaccgggaucccccggccuccccauccgccugacauuagccccuauuacccucugucucccggaacggugggccagaucccucacccccucggguggcugguuccgcaacagggacagccuguguaccccauuaccacaggcggcuuccgccaccccuauccuaccgcccugacagucaacgcuagcauguccagauuuccgccccauauggugccuccccaccauacccuccacacgacagggaucccucaucccgccauugugaccccuacagucaagcaagaaucuagccaguccgacguuggaagccugcacucuuccaaacaccaggauagcaagaaggaggaggagaaaaagaaaccccauaucaagaaaccgcuuaaugcguucaugcuguacaugaaggagaugcgggccaaagugguggcugaaugcacccucaaggagucugccgcuauuaaccagauccugggccgcagauggcacgcccuuucccgggaagaacaagccaaguauuacgagcuggcucgcaaagaaagacagcuccauaugcagcuguauccuggguggagcgcgcgggacaauuacggaaagaaaaagaaaagaaagcgcgauaagcagcccggcgagaccaacgacgccaauacaccuaaaaagugucgggcucuguuugggcucgauagacaaacgcuguggugcaaacccugucgccggaagaaaaagugcgucagauauauccagggagaaggcuccugucuuucuccgccuagcuccgacggcucucugcucgauucucccccucccucccccaaccugcuugggagcccuccgcgcgacgccaagucucagaccgagcagacacaaccccugucccucagccugaaaccugauccccuggcccaccucucuaugaugccucccccuccggcucugcuucuggccgaagcgacccacaaggcuuccgcccucugccccaacggagcccuggaccugccucccgcugcccuucagccugcugcccccagcucuagcauugcgcagccguccacaagcucucuccauucccacagcucccuggccggcacccagccucaaccccugucucucgugacgaaaagccuggaguga

SEQ ID NO: 76687 - RNA, 1503 nt, Artificial Sequence
  derived and/or modified sequence opt5 from TCFL5__Homo_sapiens__NP_006593
augagcggccccgggccuagagagccgcccccugaagccggagcugccggcggggaggcggcuguggaaggagccggcgggggagacgccgcucugggcgagcccggccucuccuucaccacaacggaucugucucuugucgaaaugaccgagguugaguacacacagcugcaacacauccucugcagccauauggaagccgcugccgacggggagcuggaaacccggcuuaacuccgcgcugcucgccgcugccggaccuggcgcuggggccggaggcuuugcggccgggggacagggcggcgcugcccccguguauccugugcuguguccgucugcucuggccgccgaugcucccugccucgggcacauugacuuccaggagcugcgcaugaugcuucugagcgaggcgggagccgcugaaaagacauccggcgggggagauggcgccagagcccgggcugacggggccgcgaaagagggagcuggcgccgccgcugccgcugccggcccugauggggcgcccgaagcccgcgcuaagccugccgucagagugcggcucgaggaccgcuuuaauucuauccccgcugaaccgccucccgccccuagaggacccgagcccccugagccgggcggggcgcugaacaaucuuguuacccugauucggcaucccagcgaacucaugaacgugccucugcagcaacagaauaaauguacagcccuggucaagaacaaaaccgcugccacgaccacagcucuccaguucaccuacccccuguuuacaaccaaugccugcuccacgagcggaaacucuaaucuuucccagacacaaucuagcuccaacagcuguucugugcuggaggccgcuaagcaccaggauaucggccucccucgcgcguucuccuuuugcuaucagcaggaaauugagagcaccaagcaaacacugggguccagaaauaaaguucuucccgaacagguguggaucaaggucggcgaggccgcucuguguaaacaggcccucaagcggaaccgcucuagaaugcggcaacuggacaccaauguggagcgcagagcccugggagaaauccagaacgugggcgagggggcuaccgccacacagggagcguggcagagcuccgaaagcucucaagcuaaucucggcgagcaggcccaguccgggccgcagggaggccggagccaaagacgcgaacggcauaacagaauggagcgcgaucggagacgccggauuagaaucugcugugacgagcugaaccuucuggucccuuucugcaaugccgaaacggauaaagcuaccacacuccaguggaccacagccuuucugaaguacauucaggagcgccacggggacucucuuaagaaagaauuugagagcguuuucuguggcaagaccggacggagacugaaacucacgcgccccgacucccuggugacaugcccugcgcagggcucucugcaaagcucccccagcauggagaucaaguga

SEQ ID NO: 76688 - RNA, 5832 nt, Artificial Sequence
  derived and/or modified sequence opt5 from TCHH__Homo_sapiens__NP_009044
augagcccccugcuccgguccaucugcgacauuaccgagaucuucaaccaguacgugucucacgauugugacggcgccgcucugacaaagaaagaucuuaagaaucugcucgaacgggaguuuggggccguccugcgcagaccucacgacccgaaaacgguugaucuuauucuggaacuccuggaccuggauagcaacggacggguggacuucaaugaguuucuccuguucaucuuuaagguggcgcaggcuugcuauuacgcccuuggccaggccaccgggcuggaugaagagaaacgcgcuagaugugacggaaaggagucccuccugcaggaucggcgccaggaagaggaccaaagacgguucgaaccccgcgauagacagcuugaggaggaaccuggccagcggcgcagacagaagcggcaagagcaggaacgcgagcuggccgaaggggaggagcagucugaaaaacaggagagacucgaacaacgggacagacagcgccgggacgaggaacuguggagacagcgccaagaguggcaggagcgggaagagagacgcgcugaagaggaacagcugcagagcugcaagggacacgagacagaggaauuucccgaugaggaacaacuccggagacgcgagcugcuugagcugcggagaaaaggccgcgaagagaagcagcagcagcggagagaacggcaagaccgcgucuuccaggaggaagaggagaaagaauggagaaagcgggagaccgugcucagaaaggaagaggaaaaacugcaggaggaggaaccucagcgccaacgggagcuucaggaagaggaagaacaacugagaaagcucgagcgccaggaacugagacgggagcgccaagaagaggagcagcagcaacagagacugcggcgcgaacagcagcucagacggaaacaagaggaggaacgcagagaacagcaggaggagcggcgcgaacagcaagagagacgggaacagcaggaggaaagacgcgagcagcaacugcggagagagcaggaggaacgccgggaacagcaacuuagacgcgagcaggaagaggagcggagagaacagcagcugcgccgggagcaagaagaggagagacgggaacagcagcuccgcagagagcagcaacugcggcgcgaacagcagcuuagacgggagcagcaacugagacgcgaacagcagcuccggagagagcagcaacugcgccgggagcagcagcugagacgcgaacaacagcuccggagagagcagcagcugcgcagagaacaagaggaggaacggcaugagcagaagcacgaacaggagcgcagagaacagcggcuuaaacgcgagcaagaagagagacgggauuggcugaagagagaggaagagacagaacgccaugagcaggagcggagaaaacagcagcucaagcgcgaccaagaagaggaacggagagagcgguggcugaagcuggaagaggaggaacgcagagagcagcaggaacggcgcgagcaacagcuuagacgggaacaggaggagcgcagagaacagcggcucaaacgccaagaggaagaggaaagacugcagcagcggcugagauccgagcagcaacuccgccgggagcaggaagagagacgcgaacagcugcuuaagcgggaggaggagaaacggcuggagcaggaacgccgggagcaaagacucaagcgcgaacaggaggagcggagagaucagcugcugaaacgcgaagaggaacggagacagcaacgccuuaagagagagcaggaggaacggcucgagcagcgccugaagagagaagagguugaacggcuggagcaagaagagagacgggagcagcgccucaaaagagaggaacccgaagaggagcggcgccagcagcugcuuaagucugaggaacaagaagagagacggcagcagcagcugcgcagagaacaacaggagcggcgcgagcagagacucaaacgggaagaggaagaggaacgccuggagcagagacugaagcgggagcacgaagaggaacgcagagagcaagaacuugccgaggaggaacaggagcaggcgcgggaaagaauuaaaagccgcaucccuaaguggcaauggcagcucgaguccgaggccgacgcucggcagagcaagguguauucuagaccgcgcaaacaggaaggccaacggagacgccaggagcaggaagagaagcggagacgccgggaauccgagcugcaguggcaagaggaagagagagcccaccgccagcagcaggaagaggaacaacggagagauuuuaccuggcaguggcaggcugaggagaaaagcgaacgggggagacaacgccugucugcccggcccccucucagagagcagcgcgaaagacagcugcgggcggaggaacgccagcaaagagagcagcgguuccuucccgaggaagaggaaaaggagcagcgcagacggcagcgcagagagcgggaaaaagagcugcaauuucucgaagaggaggaacagcugcagcgcagagagcgggcccagcaacugcaggaagaggaagacggacuucaggaggaucaggaacgcagacggucccaagagcagagacgcgaccagaaguggcgguggcaacucgaggaagagagaaagcgccggagacauacacuguacgcuaaaccugcccugcaggaacagcuccgcaaggagcagcaacugcuucaggaagaggaggaggaacugcagcgggaagagagagagaaacgccggagacaggaacaagagcggcaguaucgcgaagaggaacagcuccagcaagaggaggaacagcugcugagagaggaacgggagaagcgcagacggcaggaaagagagcgccaauaccggaaagauaagaaacuucagcagaaggaggaacagcugcucggcgaggaacccgagaagagacgccggcaagaaagagagaaaaaguaucgcgaggaagaggaacugcagcaggaggaggaacagcuccugagagaggaacgggagaaacgcagacggcaagaaugggagcgccaguacagaaagaaagacgagcuucagcaggaagaggaacaacugcuccgggaggaacgcgagaagagacggcugcaggagagagaacgccaguaccgggaggaagaggaacugcagcaagaggaggaacagcuucugggggaggaaagagagacccgccggagacaggagcucgaacgccaauaucggaaggaggaggaacugcagcaggaagaggagcagcuccugagagaggaaccggaaaaacggcgcagacaagagcgggaacgccaguguagagaggaggaggaacuucagcaggaagaggaacaacugcuccgggaggagcgcgaaaagagacggagacaggagcuggaacgccaguaccgggaggaggaagagguccagcaagaagaggaacagcugcuuagagaggagccugaaaaacgccggagacaggagcuggaacgccaauaucgggaggaagaggagcuccagcaggaagaggaacagcugcucagagaggaacaagagaagcgccggcaggagagagaacgccaguacagagaggaagaggagcugcagcggcaaaaacgcaagcagagauaucgggacgaagaucagagaagcgaccuuaaguggcagugggagcccgaaaaagagaacgcugugcgcgauaauaagguuuacugcaaaggacgggaaaacgagcaauucagacagcuggaggacucucagcugcgggaucgccaaucccagcaggaccuccagcaucugcuuggcgaacaacaggagagagaucgggaacaggagcgcagacgguggcagcaacgcgacagacauuuuccugaagaggagcagcuggaacgggaggaacagaaggaggccaaacgcagagauagaaagagccaggaagagaagcaacuccugcgcgaggaaagagaggaaaaacggagacgccaggagacggaccggaaguucagagaggaggaacagcuccugcaggaacgcgaggaacaaccccuucggagacaggagcgcgaucggaaauucagagaggaggaacugcgccaccaggaacaagggcggaaguuucuggaggaggaacagagacuccgccggcaggagagagaacgcaaauuccugaaggaggaacagcaacuucggugucaggagagagaacagcagcugagacaagaccgggaucgcaaauuuagagaggaggaacagcagcucucccggcaggagcgcgacagaaaguuccgggaagaggagcaacaggugcgcagacaggaacgggagcgcaaguuucuggaagaggaacaacagcucagacaggagcggcaccgcaaauucagagaggaggaacagcugcuucaagaacgggaggaacagcagcugcaucgccaggagagagaccggaaguuucuggaggaggaacaacagcucagacgccaggaacgggauagaaaauuccgcgagcaggaacugcggucucaagagcccgagagaaaguuucuugaagaggaacagcagcugcaccgccagcaacggcagagaaaauuccuccaggaggagcaacagcugcgccggcaggaaagaggacagcaacgccggcaggacagagaucggaaguuucgcgaggaggaacagcucagacaggaacgggaggagcaacagcugagcagacaggaacgcgaccggaaguucagacuugaggaacagaaaguccgcagacaagagcaggaacggaaguuuauggaggaugagcagcaacugcgcagacaggaaggccagcagcaacugcggcaggagcgcgacagaaaauuccgggaagaugagcagcuccugcaggaacgcgaggagcaacagcuucauagacaggaacgggaccgcaaguuccuggaggaggaaccucagcucagacggcaagagagagaacagcagcugcgccacgaucgggacagaaaauuucgcgaggaggaacagcugcuccaagaaggcgaggagcagcagcuucggagacaagaacgcgaucggaaguucagagaggaggaacagcagcugcgccggcaggaaagagagcggaaguuucugcaagaggaacagcagcuccgcagacaggagcuggaacggaaauuccgcgaggaggaacaacuuagacaggagaccgaacaggagcagcugcggagacaagaacgcuaucggaagauccucgaggaggaacagcugagaccggagcgcgaggaacagcaacugcggagacaggaacgcgaccggaaauuuagagaggaggaacagcuccgccaggagagagaagaacaacagcuucggucccaggaaagcgaucgcaaguucagagaggaggaacagcugcggcaagagcgcgaggaacagcagcugagaccccagcaacgggacgggaaauaccgcugggaggaggaacagcuccagcuggaggaacaagaacagagacuucggcaggagagagaccgccaguaccgggccgaggaacaauuugcuacacaggagaagucuagacgcgaggagcaggaacuguggcaggaggaggaacaaaagcggagacaggagcgggaacgcaaacucagagaggaacauauucggcgccagcagaaggaggagcaaagacacagacaggugggagaaaucaaaucccaggagggcaaggggcacggacgccugcuggaaccuggcacccaucaguucgcgagcgugcccgucagaucuagcccucucuaugaguacauucaagagcagcggucccaguauagacccuga

SEQ ID NO: 76689 - RNA, 1497 nt, Artificial Sequence
  derived and/or modified sequence opt5 from TCHP__Homo_sapiens__XP_011537139
auggcccugcccacccucccuagcuacuggugcucccagcaaagacugaaccagcagcuugcucggcagcgcgagcaagaagccagacugcggcagcagugggagcaaaauucucgcuauuucagaaugagcgacaucuguuccucuaagcaggcggaauggagcuccaaaacaucuuaccagcggagcaugcacgcuuaucagcgcgagaagaugaaagaagagaagagacggucccucgaggcccgcagagaaaaacugcggcagcuuaugcaagaggaacaggaucugcucgcccgcgagcuggaggaacugagacucagcaugaaccugcaggagcggcgcauuagagaacaacauggcaaacuuaagucugcuaaagaggaacagcggaagcugaucgccgagcagcuccuguacgagcacuggaaaaagaauaacccgaaacuuagagaaauggagcuggaccuccaucagaagcacguggucaauuccugggaaaugcaaaaggaggaaaagaagcagcaggaggcuacggccgagcaggaaaacaaacgcuaugagaaugaauacgagcgggcgagacgcgaagcccuggagcggaugaaggcugaggaagagagacgccaacuggaagauaaacuccaggccgaggcucugcuucagcagauggaggaacugaagcucaaagagguugaagccaccaagcugaagaaagagcaagaaaaccuucugaagcagcggugggagcucgagagacuggaagaggaacgcaaacagauggaggcguuucggcagaaggccgaacuggggagauuccuccgccaucaauauaaugcucagcugagccggagaacacagcaaauucaggaggagcuugaagccgaccggcgcauccugcaggcucuccuggagaaagaagaugagucucagagacuucaccuggcccggagagaacaagugauggccgacguggcuuggaugaagcaggcgauugaggagcagcuccagcuggaacgcgcccgggaggcugaacugcaaaugcuccugagagaggaggccaaggaaaugugggagaaacgcgaagccgagugggcuagagaacgguccgcccgcgauagacuuaugagcgagguccugaccggacggcagcagcagauccaagagaagaucgaacagaaccgcagagcgcaggaggaaucucucaaacaccgggagcaacugauucgcaaucuggaagaggugagagagcuugcucggcgcgaaaaggaggaauccgagaaacucaagagcgccagaaagcaggaacuggaggcccagguugcugagcggagacugcaggccugggaagcugaccaacaggaggaagaggaggaagaggaagcccgccggguggagcagcucuccgaugcgcugcuucagcaagaagccgagacaauggcugagcagggcuacagacccaaaccuuacgggcaucccaagaucgccuggaacuga

SEQ ID NO: 76690 - RNA, 1845 nt, Artificial Sequence
  derived and/or modified sequence opt5 from TCIRG1__Homo_sapiens__NP_006044
augaccuuccugaucagcuacuggggcgagcagauugggcaaaagaucagaaaaauuacagacugcuuucacugucauguguuccccuuucuccagcaggaagaggcccggcugggagcucugcagcaacugcagcagcagucccaagaacuccaggagguccugggcgaaacggagcgcuuccuuucucagguucuggggagagugcuccagcugcugccuccgggacaagugcagguccacaagaugaaagccguguaucucgcgcugaaccagugcagcguuuccaccacacauaagugucuuaucgcugaggccuggugcucugugcgggaucugcccgcccuccaagaagcucugcgcgacagcuccauggaggaaggcgucucugccguggcucaccggauuccuuguagagauaugcccccuacccuuauccgcacaaauagauuuaccgccagcuuccaggggaucguugacgcguacggagugggccgguaucaggaggucaaccccgccccuuacacaauuaucaccuuuccguuccuguuugcugugauguucggcgauguggggcauggacuccugauguuucuguucgcccucgcuaugguccuggccgagaaucgccccgcgguuaaagccgcucagaacgaaauuuggcaaacguuuuucagaggccgguaucuucugcuccugauggggcuuuucuccaucuacaccggauuuauuuauaaugagugcuucagccgcgccacaucuaucuuuccuuccggcuggagcguggcugccauggccaaccagucugggugguccgacgcuuuccuggcgcagcacaccaugcucacacuggaucccaaugugaccggagucuuucugggcccuuaccccuucggcauugacccgaucuggagccucgccgcuaaccaccugucuuuucuuaauuccuucaagaugaagaugagcgugauccuggggguugugcauauggccuuuggagucgugcucggcguuuucaaccacgugcauuuugggcagagacaccggcugcuucuggaaacgcucccugagcugacauuccugcucggacuguuuggcuaccuugucuuccuggugauuuauaaauggcucugugucugggccgcucgcgccgcguccgcucccucuauccugauucacuucaucaauauguuucuguucagccauuccccuagcaacagacuucucuacccccggcaagaagugguucaggccacccuggugguccuggcccucgcuauggugcccauucugcuucuggggacaccucuccaccuucugcauagacaccgccggagacuucgccggagaccggccgaucgccaggaggagaauaaggcuggacuccuggaccugcccgaugccucuguuaacggcugguccagcgacgaagagaaagcgggcgggcucgaugacgaagaggaagccgagcuggugccuucugagguccuuaugcaucaggcuauccacaccaucgaauuuugccugggaugugugagcaauaccgccuccuaucuccggcugugggcucugucucuugcccacgcgcaacucagcgaggugcugugggccaugguuaugagaauuggccuggggcucggacgcgaagucggcguggcugccgugguccuggugcccaucuucgcugccuuugccguuaugacaguggcuauucuucuggucauggaggggcucuccgcguuccugcaugcccugcggcuucacuggguggaauuucagaacaaguucuacagcggcacgggauauaaacucucuccuuuuaccuucgcugccacagacgauuga

SEQ ID NO: 76691 - RNA, 345 nt, Artificial Sequence
  derived and/or modified sequence opt5 from TCL1A__Homo_sapiens__NP_001092195
auggccgagugccccacccugggcgaagcugugacagaccacccugauagacucugggccugggagaaguucgucuaccuggacgaaaaacagcaugcguggcuuccgcugacgaucgagauuaaggaucggcuccaacugcgcguucuucugagacgggaagacguggugcucgggcgccccaugaccccuacacagaucggacccagccugcugccuauuauguggcagcucuaucccgauggcagauaccgguccucugacagcuccuuuuggcgccuggucuaucacaucaaaauugaugggguggaggacaugcuucuggagcuccugccugaugacuga

SEQ ID NO: 76692 - RNA, 387 nt, Artificial Sequence
  derived and/or modified sequence opt5 from TCL1B__Homo_sapiens__NP_004909
auggccagcgaggcuuccgugagacugggcguucccccugggcggcucuggauccagcgcccgggaauuuacgaagacgaggaaggcagaaccugggucacaguggugguccgguucaaccccucucgcagagagugggcccgggcgagccaagggucccgcuaugaaccuucuaucacggugcaccuguggcagauggcuguucauaccagagagcuucugagcuccggacagaugcccuuuucucagcucccugccguguggcaacuguaccccggccggaaguaucgcgccgcugauagcuccuucugggagauugccgaccacgggcagaucgauagcauggaacagcuuguccugacauaccagccugagagaaaagacuga

SEQ ID NO: 76693 - RNA, 1302 nt, Artificial Sequence
  derived and/or modified sequence opt5 from TCN1__Homo_sapiens__NP_001053
augagacagagccaccaacugccccucgugggccugcuucuguucuccuuuaucccuucucagcucugcgagauuugugaagucagcgaggaaaacuacauccggcugaagccgcuucugaauaccaugauucaguccaacuauaaucgcgggacaucugccguuaacguggugcucagccugaaacuggucggaauccagauucaaacgcucaugcagaagaugauccagcagaucaaauacaaugugaaguccagacugucugacguuagcuccggcgagcuugcucugauuauccucgcccugggggugugccggaacgcggaagagaaucuuauuuaugauuaccaucugaucgacaaacucgagaacaaguuccaagcugaaauugagaauauggaagcccacaacggaacaccccugaccaauuauuaccagcugagccucgauguccuggcccuuugucuguuuaacggcaauuauucuaccgcugaggugguuaaccauuucacaccugagaauaagaacuacuacuuugggucccaguucagcguggacaccggagccauggcuguccucgcccugacaugcgugaaaaagucucuuaucaacggccagauuaaagcggaugaaggcucccugaagaauaucagcaucuauaccaaaucucucguggagaagauucuguccgaaaagaaagagaacgggcugaucggaaauacguuuagcaccggcgaagccaugcaagcucucuucgucuccucugacuacuauaacgagaaugauuggaacugucagcagacacugaauaccguucuuacagagauuagccaaggggccuuuuccaaccccaaugcugccgcccaggugcugccugcgcucaugggaaagaccuuccuggacaucaacaaagauagcucuugcguguccgcuagcggcaauuuuaacauuucugccgacgaacccaucacggucacaccuccggauagccaguccuacaucucugugaauuauagcguucgcauuaacgagaccuacuucacaaaugugaccguccuuaacggguccguguuucugagcguuauggaaaaggcucagaaaaugaacgacaccaucuucggauucacaauggaggaaagaucuuggggccccuauauuacguguauccaaggccucugcgccaauaacaaugaucggaccuacugggagcugcuguccgggggagagccucucagccagggcgccgggucuuacgugguccgcaacggagaaaaucuggaggugagaugguccaaguauuga

SEQ ID NO: 76694 - RNA, 1284 nt, Artificial Sequence
  derived and/or modified sequence opt5 from TCN2__Homo_sapiens__NP_000346
augagacaccugggcgccuuccucuuucugcuuggggugcugggagcucucaccgagaugugcgaaauccccgagauggacagccaucuggucgaaaagcugggccagcaccuucucccuuggauggaucggcugucccuggagcaucucaacccgucuauuuacguugggcugcgccuuagcucccugcaagccggaacaaaagaagaccucuaucugcacucucuuaagcugggcuaccagcagugucuccuggggagcgcguucuccgaggaugacggagauugccagggcaaacccucuaugggccaacuggcucucuaucugcuugcccugagagccaauugugaguuugugcgggggcauaagggagaccgccucgugagccagcugaaaugguuccuugaagaugagaagagagcuaucggccacgaccacaaggggcauccucacacguccuacuaucaguacggacugggcauucucgcccugugccugcaucagaaacggguccacgauagcgugguugacaagcuccuguaugcuguggaacccuuucaccaagggcaucacucugucgauaccgccgcgauggccggacuugcuuucacaugucugaaacgcuccaacuuuaauccuggcagacggcagcgcaucaccauggccauuagaacagugcgggaggagauccucaaggcucagacccccgaaggccauuucgggaacguuuacagcacaccucuggcccuucaguuucugaugaccucuccgaugcgcggagcggagcucggcacggccugccugaaagcuagaguggcccugcucgcuucccugcaagacggggccuuccagaaugcccuuaugaucagccagcugcuccccguccugaaccacaagaccuacauugaucugaucuuuccugacugucuugcuccccgggugaugcucgaaccugcggccgagacaauuccccaaacccaggaaaucauuucugugacacugcagguccugucccuccugccgccuuaucgccagagcaucuccguucuugcuggaucuaccguggaggacgugcugaagaaagcccaugagcucggcggguucacguacgaaacacaagccagccuguccggacccuaucugaccagcgucaugggcaaggcugccggcgagagagaauuuuggcagcuucuccgggauccuaauacaccccugcugcaggggauugcggacuacagacccaaagauggagagaccaucgaacuccgccuggugucuugguga

SEQ ID NO: 76695 - RNA, 4236 nt, Artificial Sequence
  derived and/or modified sequence opt5 from TCOF1__Homo_sapiens__NP_000347
auggccgaggcuagaaagcggcgcgaacugcucccccugaucuaccaccaucuucugagagccggcuaugugcgggcggcucgcgaggucaaagaacagagcgggcaaaagugcuuccucgcccagccuguuacccugcuugacauuuacacacacuggcagcagacguccgagcugggaagaaaacggaaggccgaagaggaugcugcccuccaagcuaaaaagacccgcgugucugacccgaucagcacauccgagucuagcgaagaggaagaggaggccgaagcggagaccgccaaggcuacacccagacuggccuccaccaacucuagcgugcugggcgcugaucucccuuccagcaugaaagaaaaggccaaagcggagacagaaaaggccgggaaaaccggaaauucuaugccccauccugcuacgggcaagaccgucgccaaccugcuuuccggaaagagcccccggaaaucugcugagccuuccgccaauacaacccuggugagcgagacagaagaggaagggucuguuccggccuuuggcgcugcggccaagcccggcaugguguccgcugggcaggccgacagcuccucugaggauaccagcuccagcucugacgaaacggaugucgaggugaaagccuccgagaagauucuccagguucgcgcugccagcgcgccugcuaaaggaacacccggcaagggggccaccccugcgcccccgggaaaagcuggcgccguggcuucucagacaaaggccgggaagccugaagaggacagcgaauccucuagcgaggaauccagcgauucugaggaggaaacccccgcggccaaagcucugcuucaagccaaggcuuccggaaaaaccagccaggucggcgccgcgucugccccugcuaaggagucccccagaaaaggcgccgcucccgccccuccggggaagacaggacccgccguggcuaaggcgcaggccggcaaacgggaagaggacagccaguccucuagcgaggaauccgauucugaggaagaggcuccugcccaagccaagcccagcgggaaagcuccucaggugcgcgccgcguccgcucccgccaaggaaagcccgagaaaaggagccgcuccugcgcccccucggaagacgggccccgccgcugcccagguccaaguugggaagcaggaggaggacucucgcuccagcucugaagaguccgauagcgacagagaagcccuggcugccaugaacgcugcccaggugaaaccucucggaaagucuccccaggugaaaccggcgagcaccaugggcaugggcccucuggggaagggagccggccccgugcccccugggaaagucggaccggcuacacccuccgcccaaguuggcaagugggaggaagacagcgagucuuccagcgaggaauccucugauagcuccgacggggaggugccuaccgcugucgcccccgcccaggaaaagucucugggcaauauccuccaggcuaaaccuacaagcucccccgcgaagggaccuccccagaaagccggcccgguggcuguucaagugaaggccgagaaaccuauggauaacucugaaagcuccgaggagagcucugacuccgccgauagcgaagaggcucccgccgcgaugaccgcugcccaggccaagccugcucugaaaauuccccagacgaaggccuguccgaagaaaacaaauaccaccgcgucugcuaaggucgccccugugcgggucgggacacaggcccccagaaaagcuggaaccgccacauccccugcuggcagcucucccgccguggccgggggaacgcaacgccccgccgaagacuccagcuccagcgaggagucugauagcgaagaggaaaagaccggccuugcuguuacaguggggcaggccaaauccgucggcaagggacuucaggugaaggcugccucuguuccugugaaaggcagccucgggcagggaaccgccccgguccugcccggcaagacagggccuaccgugacgcaagugaaagcugagaagcaggaagacuccgagucuagcgaggaagaguccgauucugaagaggcggccgcuagccccgcccagguuaaaaccuccgucaagaagacacaagccaaagcuaacccugccgcggcucgggcccccagcgccaagggaaccaucucugcuccuggcaaaguggugacagccgcggcccaggcuaagcagagauccccgagcaaagucaagcccccugugcgcaauccccagaacucuaccguucuugcccgggggccugcuuccgugcccagcgucggcaaggccguggcuacggccgcgcaagcccagacaggaccggaagaggacuccggcucuagcgaggaagaguccgauagcgaagaggaagcugagacccuggcccagguuaaaccuucugggaagacacaccagaucagagcugcccucgcccccgcuaaagagagcccccgcaagggagcggccccuacacccccuggcaaaaccgggccguccgcugcccaagccggaaagcaggacgacucuggcagcuccucugaagagagcgauuccgacggggaagcucccgccgcggugaccucugcccaggucauuaaaccuccccugaucuucguggauccuaaucggagccccgcuggcccggccgcuacgccugcccaggcgcaagccgcuuccacccccagaaaggcccgcgcuagcgagucuacagcccgguccagcuccucugagagcgaagacgaggauguuauuccugcuacccagugccugacacccggaaucagaaccaacguggucacgaugccuacagcccauccccgcauugcgccgaaggccuccauggcuggcgccucuagcuccaaagaaagcucucggaucuccgacgggaagaaacaggagggaccugcuacccaagugagcaagaaaaaucccgccucucucccccugacccaggccgcgcuuaaggugcuggcucagaaggccuccgaagcucagccuccggucgccagaacacaacccagcucuggcguugauagcgccguggggacccucccugcuacaucuccccaguccacgagcgugcaggccaaaggaaccaacaagcugcggaaaccuaaacuucccgagguccagcaagcgacaaaggccccugaguccagcgacgauuccgaagacucuagcgauuccucuagcggcuccgaggaagacggcgaggggccgcagggagcuaagucugcccacacccugggccccacaccuagccgcaccgaaacgcucguggaggagaccgcugccgaauccagcgaggaugacguuguggcgcccucucagucccugcugagcggguauaugacaccuggacucacccccgccaauucucaggcuuccaaggccacaccgaaacuggacagcucuccuuccgucagcuccacccuugcugccaaggaugaccccgauggcaaacaagaagcuaagccccagcaggccgcggggaugcugagcccuaaaacaggaggcaaggaggccgcuucuggcaccacgccccaaaagagcagaaaaccuaagaaaggggccggaaacccgcaggcuuccacacucgcccugcagucuaacauuacccagugucugcuuggccaacccuggccucucaaugaagcccaggugcaggcgagcguugugaagguccugaccgagcugcucgagcaggaacggaaaaaggugguugacacaaccaaggaguccucuagaaaagggugggaaagccgcaagcggaaacuguccggagaucaacccgcugccagaacgccucgcucuaagaaaaagaaaaagcugggcgccggggagggaggcgaggcuagcgugucccccgaaaagacaagcaccacaucuaaaggcaaggccaaaagagacaaggcuuccggggaugucaaagagaagaagggaaaaggcagccuggggucucagggagccaaggacgaaccggaggaggaacuccagaaaggcauggggaccguggagggaggcgaucaguccaacccuaagagcaaaaaggaaaagaaaaaguccgacaaacggaagaaagauaaggagaagaaagaaaagaaaaagaaagcgaagaaagccucuacaaaggacagcgagucccccagccaaaagaaaaagaaaaagaaaaagaagaccgcugaacagacgguguga

SEQ ID NO: 76696 - RNA, 981 nt, Artificial Sequence
  derived and/or modified sequence opt5 from TCP10__Homo_sapiens__NP_004601
auggagaagacccccgccgcugccgaagugccuagagaggacagcaacgcgggcgaaaugccgucccugcagcaacagaucacaucucuccaccaggagcuggggcggcagcaaagccuuugggcugauauucaucgcaaacugcagucccacauggacgcccucagaaagcagaaccgggaacugcgcgaggagcuuagaggacugcagcggcaacagugggaagccggcaaaaagcccgcugccucuccucaugcugggcgcgagagccacacgcucgcccuggaacccgcguucggaaaaaucucccaucugucugccgaugaggacaccacaccuaaguacgcuggcagaaagagccaguccgccacccuccuggggcagcgguggagcucuaaccaccuugcucccccuaaaccgaugucccugaagacagagcgcauuaauagcggaaaaacacccccucaagaagauagagagaagucucccccuggccggcgccaggacagaucccccgccccgaccggccggccuacccccggggcggaacgcagaggagucagcgaggauggcaaaaucaugcacccuucuucccggagcccccagaacuccgggggaagaaagucucccguucaagccagccaggcuacgacccuccaggaacagacagccgcugcccgcggcgccgaccgguccagcucugugcugggguccagcgagggaggcuuucuuucuagagugcaagcugaugaguucgcgagcuccgccccugacucugcugaacgccagaaucugccggucaaucccccuagcucccucgagauugcccaggccauggauaccaagaugaaaaaggaagaggugcaggaagagaaacggcaucccaagggcaaagcugacgauugcagacgcagcggguuuccuucugaguuccccggagcccugcacgcggcuccgucccggcaagacaugggcccuuga

SEQ ID NO: 76697 - RNA, 1062 nt, Artificial Sequence
  derived and/or modified sequence opt5 from TCP10L2__Homo_sapiens__NP_001138593
augcuggaaggccagcucgaagccagagagcccaaggaagggacccacccugaggacccgugccccggagcuggcgccgcgauggagaaaacacccgcugccgccgaggugccccgggaggauagcaacgcuggggaaaugccuucccugcaacagcagaucacgucucuucaucaggagcugggacgccaacagagccucugggccgacauucacagaaagcugcagucccauauggaugcccuucggaaacagaaucgcgaacugagagaggagcuccggggccugcaacgccagcagugggaagcugggaagaaacccgcggccucuccucacgcuggaagagagagccauacccuggcccucgaaccggcuuucggcaagaucuccccucugucugccgacgaggaaacaaccccuaaguacgcgggccggaaaagccaguccgccacacuucuggggcaacgcuggagcucuaaccaccucgcucccccuaagcccaugucccugaaaaccgagagaauuaauagcggaaagacaccgccucaggaggaucgggaaaaaucucccccuggccgcagacaggaccggucccccgcccccaccgggcgcccuacgccgggagcugagagacgggaagucagcgaggauggcaagaucaugcaccccucuuccagaagccuucaaaacuccgggggacgcaagucuccuguucaggccagccaggccgcuacccugcaggaacaaacagcggccgcuggcguggccgaccgguccagcucugugcucggcuccagcgaagggggauuucugucuagaguccaggccgaggaguucgcuagcuccucucccgauagcgccgaacgccagaaucugccugugaaucccccguccagccucgaaauugcgcaggcuauggacaccaaaaugaagaaagaggaaguucaagaggagaagcggcauccuaacggcaaagccgaugacuguagacgcucuggguuucccuccgaguucccuggagcccugcacgcugcccccagccggcaggauaugggcccuuga

SEQ ID NO: 76698 - RNA, 1530 nt, Artificial Sequence
  derived and/or modified sequence opt5 from TCP11L1__Homo_sapiens__NP_060863
augagcgagaaccuggacaaguccaaugugaacgaagccggcaaaucuaagagcaaugauuccgaggaagggcucgaggacgcugucgaaggagccgaugaggcgcugcagaaagcuaucaagucugacagcuccucuccccaaagaguucagcggccucacagcuccccgccccgcuucgugaccguggaggaacuucuggagacagccagaggcgucacgaacauggcccucgcucaugaaauugugguuaauggggauuuucagaucaaaccuguggagcugcccgagaacagccuuaagaagcgggucaaagaaauugugcacaaggccuucugggacugccugucuguucagcucuccgaggauccucccgcuuacgaccaugccaucaaacuggugggagaaauuaaggagacccugcucagcuuucugcuuccuggccacacacgccugagaaaucaaaucaccgaaguccucgaucuggaccuuaucaaacaggaggcggagaacggggcccuggauauuucuaagcucgcugaauuuaucauuggaaugaugggcacacugugugccccggcucgggacgaggaagugaagaaacugaaggauaucaaagagauugugccccucuuucgcgaaaucuucuccguccuggaccuuaugaagguugacauggccaauuuugcgauuagcucuaucagaccucaucugaugcagcaguccguggaguaugagcggaaaaaguuccaagaaauccucgagcgccagcccaacagccuggauuuugugacccaguggcuugaagaggccuccgaagaccugaugacacagaaauacaagcacgcucucccugucggcgggauggccgcuggaucuggcgauaugcccagacugagcccgguggccguucaaaauuaugccuaccugaagcuccugaaaugggaccaccuucagcggccuuuccccgagaccgugcugauggaucagucccgcuuucaugagcuccaacugcagcuugaacagcugacgauucucggggcuguccugcuggugaccuucagcauggcggccccuggaaucucuucccaggcugacuuugccgagaagcucaaaaugauuguuaagauccugcuuacagauaugcaucugcccagcuuccaccucaaagacgugcugaccacaauuggcgaaaaggucugccuggaggugucuagcugucuuucccucugcgggucuagccccuucaccacggauaaggagacaguccugaaaggacaaauccaggccguggcuuccccugacgauccgaucagacggauuauggaaagccgcauccugaccuuucucgagacauaucuggccucuggccaccagaagccccuuccuaccguucccggcgggcuguccccugugcagagagaacucgaggaagucgcgauuaaauucgcucggcuggugaacuacaauaagaugguuuucugucccuauuacgacgccauccugagcaaaauucuugugagaucuuga

SEQ ID NO: 76699 - RNA, 1206 nt, Artificial Sequence
  derived and/or modified sequence opt5 from TCP1__Homo_sapiens__NP_001008897
augagcuccaagaucauuggcaucaacggggacuucuuugccaauaugguggucgaugcuguucuggccauuaaauacaccgacaucagaggacagccccgguauccugugaacucugugaauauucucaaggcgcacggccgcagccaaauggaguccaugcugaucucuggguacgcucuuaacugcgucgugggaagccagggcaugccgaaaagaaucguuaaugccaagauugccugucuggauuucucccuccagaaaacaaagaugaagcugggggugcaggucgugaucacggaccccgaaaaacuugaucaaauucggcagcgcgagucugacaucaccaaggaacggauucagaaaauccuggcuacaggagccaacguuauucucaccacaggcggcaucgaugacaugugccugaaguauuuuguggaggcuggggccauggcggucagacgcgugcugaaaagagaucucaagcggaucgccaaggcuagcggagccaccauucuguccacacuugcuaaucuggaaggcgaggagaccuucgaagccgcgaugcucgggcaggccgaggaagugguccaagagcgcaucugugacgaugagcugauucuuaucaaaaacacgaaggcuagaaccagcgccucuauuauccugcggggagcuaaugacuuuaugugcgaugaaauggagcgcucccuccaugacgcccuguguguugugaaaagagugcuggaaagcaagucugucgugccuggcgggggagccguugaggcugcgcucuccaucuaccuggaaaacuaugccacaagcaugggcucucgggagcagcuugcuauugccgaguucgcccgcucccugcucgugauccccaauacccuggcugucaacgccgcgcaggacagcacagaucuuguggcuaaacugagagccuuucacaaugaagcccagguuaacccugagcggaagaaucucaaauggauuggccuggaccuguccaacgggaagcccagagauaacaagcaagcuggaguguucgaaccuaccaucgucaaagugaagucucucaaauuugccacggaggcugccauuacaauccugcgcaucgacgaucuuauuaagcugcauccggaaagcaaagacgauaagcacggcuccuacgaggacgcgguccauagcggggcccucaaugauuga

SEQ ID NO: 76700 - RNA, 312 nt, Artificial Sequence
  derived and/or modified sequence opt5 from TCTA__Homo_sapiens__NP_071503
auggccgagagcugguccggccaggcucugcaagcccuccccgcgaccgugcugggggcucuuggaucugaguuccugagagaaugggaagcccaggacaugcgggucacacucuuuaagcugcuucugcucuggcugguucugagccuccugggcauccagcuugccuggggguucuacggaaacacggugaccggccuguaucaccgcccugggcucggaggccagaauggcuccacaccggaugggucuacccauuuucccagcugggagauggcugccaacgaaccucugaaaacacacagagaguga

SEQ ID NO: 76701 - RNA, 1506 nt, Artificial Sequence
  derived and/or modified sequence opt5 from TCTE1__Homo_sapiens__XP_011512640
augcaggacaccgugacaacgagcgcccugcucgaucccucccacucuagcgucuccacccaagacaacucuagcacaggcgggcauaccuccucuacaagcccucagcuguccaagccgagcaucacccccguuccugcuaaaucuagaaauccccacccucgggccaacauucgcagaaugcggcgcaucauugcggaggaucccgaauggucccuugcuaucgugccucugcucacagagcugugcauucagcauaucaucagaaauuuccagaagaacccgauucuuaaacaaaugcugcccgaacaccagcagaaggugcucaaucaucugagcccugaccugccccucgccgucaccgccaaccugaucgauucugagaauuacuggcuucgguguugcaugcaccgcuggccugugugucacguugcucaucacggaggcuccuggaaaagaauguuuuucgaacggcaucuggagaaccuccugaagcacuuuauucccgggacgaccgacccggccgugauccuugaucugcucccucugugccgcaauuaugucagacgggugcacguugaccaguuccugcccccugugcaacuccccgcucagcugcgccccggagaucagagcgacucuggcuccgagggggaaauggaggaaccuacagucgaucauuaccagcuuggagaccugguggccggccucagccaccuggaggagcuugaucugguguaugacgucaaggacuguggcaugaacuuugaauggaaucucuuccuguuuaccuacagagauugccugucccucgcggccgcuauuaaagccugucauacacugaagaucuucaaacuuacccggucuaagguugacgaugacaaagcucgcauuaucaucagaagccugcucgaucacccggugcuggaggaacuugaccugucccaaaaccucauuggggaucggggagccagaggcgcggccaagcugcugagccauucucgccuccgggugcugaaucuugcuaacaaucaggucagagcccccggggcucagucccuggcccacgcccucgcucacaacacgaaccugaucagccugaaucuucgccucaacugcauugaggacgaaggaggccaagcgcuggcccaugcucugcagacaaauaagugucucaccacacugcaccuugggggaaacgagcugucugagccuaccgccacccuccugagccaggugcuggccaucaauacaacgcuuaccuccauuaaccucucuugcaaucauaucggccuggauggcgggaaacagcugcucgaaggaaugagcgacaacaagacacugcuugaguuugaucugcggcucuccgacguugcucaagaaagcgaguaucugaucggccaggcccuguacgcgaauagagaagcugcccgccagcgggcccuuaaccccucucacuucauguccaccauuacagcuaaugggccugagaacagcgugggauga

SEQ ID NO: 76702 - RNA, 1764 nt, Artificial Sequence
  derived and/or modified sequence opt5 from TCTN1__Homo_sapiens__NP_001076006
augagaccccggggccugccuccgcuccuggugguccuucuggggugcugggccagcguuuccgcucagaccgacgccacacccgcggugacgaccgagggacucaacucuacagaagcugcccuggccaccuucggcacauuuccuagcaccagacccccugggacaccccgcgcuccuggaccguccucuggcccccggccuacccccgugacggaugucgccgugcuuuguguuugcgaccugagcccugcucaaugugauaucaauugcuguugcgaccccgauuguuccucuguggacuucagcgucuuuuccgccugcagcgugccgguugugaccggggauucucaguucuguucccagaaggcggucauuuacagccucaacuuuacagccaauccuccccagcgcguguucgagcugguggaccaaaucaacccuucuaucuuuugcauucacauuaccaauuauaaacccgcucuguccuucaucaaccccgaagucccugaugagaauaacuuugacacacucaugaagaccagcgauggauucacgcugaaugccgaaucuuacguuuccuuuacaaccaaacuugacaucccgacagcugccaaguaugaguacggcgugccccugcagaccagcgauuccuuccucagauuuccuucuagccugaccuccagccuuuguacagacaacaaucccgcggccuuccuggugaaccaggcugucaaaugcacgcggaagauuaaucucgagcagugcgaagagaucgaagcccugucuauggcuuucuauuccagcccugagauucugcgcgugcccgacucuagaaagaaaguuccgaucaccgugcaaagcauugucauccagucccucaacaagacacugacccggcgcgaggauacagacgugcuucagccuacccugguuaaugccggccauuuuucucucugugugaacgucgugcuggaagucaaauacagccuuacguauacagaugccggggaggugaccaaggcugaccuguccuucguucucggaaccgugagcucugucgugguuccccugcagcaaaaauuugaaauucacuuccugcaggagaacacacagccugugccccucuccggcaauccuggguacgucgugggacugccccuugcggccggcuuucaaccgcauaaggggagcggaaucauccagaccacaaacagauacggccagcugacgauucuccacucuaccacagaacaggauugccuggcucuugagggcgugcggaccccuguucuguucggguauacaaugcaauccggauguaagcuccgccugaccggcgcccugcccugccagcucgucgcccagaaagucaagagccugcuuugggggcagggauuucccgacuacguggcuccuuucggcaauucccaagcccaggauaugcuggacugggugccgauccauuuuauuacgcagucuuucaacagaaaagauagcugucagcuccccggggcgcuggugaucgagguuaaguggaccaaauauggaucccugcuuaauccucaagcuaagauugugaacgucacagccaaucucaucucuagcuccuuucccgaagccaacagcggcaaugagcggaccauccugauuucuacagcugugaccuucguugacguguccgccccugcugaagccggcuuucgcgcgcccccugccaucaacgcuagacugcccuucaauuucuuuuucccguuugucuga

SEQ ID NO: 76703 - RNA, 2091 nt, Artificial Sequence
  derived and/or modified sequence opt5 from TCTN2__Homo_sapiens__NP_001137322
augggcuuccagcccccugccgcucugcuccugagacuuuuucugcuccaagggauccugcggcuucuguggggagaccucgccuucauuccgcccuuuauccgcaugagcggcccugcgguguccgcuucucuggucggggauaccgagggaguuacagugagccuggccgugcuccaggacgaagccggcauucugcccaucccuacgugcgggguccuuaacaaugagaccgaagauugguccgugacaguuauucccggagcugugcuggaggucaccgugagauggaagcggggccucgacugguguucuagcaacgaaacagauuccuucucugagagcccuugcauccugcagacccuucugguuuccgccagccacaauucuuccuguagcgcucaucuccugauccagguggagauuuacgccaacucuucccugacacacaaugcgagcgaaaacgucaccgugaucccgaaucaaguguaucagccccucggcccuugccccuguaaccugacggccggggcuugcgacguccgcuguugcugugaucaggaguguucuuccaaucuuaccacacuguuuagacggagcugcuucaccggaguuuuuggcggggacgugaacccucccuucgaucagcucugcuccgccggaacaaccacgcgcggcgugccggacugguuuccuuuccugugcguccaaucuccccuugcuaauacaccuuuucugggguacuucuaucauggagccgugagccccaaacaggauuccagcuuugaaguuuacguggacaccgaugcgaaggacuucgccgacuucggcuauaaacagggcgaucccauuaugacagucaagaaggcuuacuuuaccaucccucaggugucucucgccgggcaauguaugcagaacgcuccgguugccuuccugcacaauuuugacgugaaaugcgucaccaaccuggagcucuaucaggagagagauggaauuaucaaugccaagauuaaaaacguggcucugggcgggaucgucacacccaaggugaucuacgaagaggcgacggaccuugauaaauucauuaccaacacagaaaccccucugaauaacggauccacaccccggaucguuaauguggaggaacauuacauuuuuaaguggaacaauaacaccaucagcgagauuaaugucaaaaucuuccgcgccgagaucaacgcucaccaaaagggcauuaugacgcagagauuugugguuaaguuccucucuuauaauagcgggaacgaagaggaacuguccggaaauccuggcuaccagcuuggcaaacccgugcgggcccugaacaucaaucgcaugaacaaugucacaacccuccaccuguggcagucugccgggagaggacuguguaccagcgcuacauuuaagccgauucucuucggcgagaacgugcuguccgggugccuucuggaagugggaaucaacgagaauuguacccaacuccgggagaacgccguugaacgccuggacagccugauucaggcgacacaugucgcuaugagaggcaauucugauuaugccgaccuuuccgauggguggcucgagaucauccggguggacgccccugaucccggcgcugacccucuggccagcucugugaacggaaugugccuggacauucccgcucaccucuccauccgcauucugaucagcgaugccggcgcggucgaagggauuacgcagcaggagauccuuggaguggaaaccagauuuuccucuguuaauuggcaauaccaguguggccugacaugcgagcauaaagccgaccuccugccuauuagcgcuuccgugcaguucaucaagauccccgcccagcugccgcacccucuuacccgguuucaaauuaacuauacagaguacgauuguaauagaaacgaagucugcuggccccagcuccuguaucccuggacccaguacuaccagggggagcugcacucucaauguguggcuaaaggacuccugcuucuccuguuccugacgcuggcccuuuuccucagcaauccuuggacccgcaucugcaaggcguauuccuga

SEQ ID NO: 76704 - RNA, 1380 nt, Artificial Sequence
  derived and/or modified sequence opt5 from TCTN3__Homo_sapiens__NP_001137445
augcggacaccccagcuggcccuccugcaaguguucuuucuugucuucccugauggcguucggccgcagcccagcuccucuccuagcggggcugugcccaccucccuggagcuccagcgcggaacggauggcgggacccugcagucuccuagcgaagccacagcgaccagacccgcugugccuggacuuccgacagucgugcccacccugguuacaccuuccgcccccggcaaccggaccguggaccucuuuccuguccugcccaucugcgugugugaucugacgccgggggccugcgacauuaauuguugcugugaucgcgacugcuaccuccugcacccuagaaccguuuucucuuuuugucuucccggaagcgugcgguccagcucuugggucugcguggauaacuccgugaucuuccgcagcaauucuccuuuucccuccagagucuucauggacagcaacggcauucggcaauuuuguguucaugugaauaacugcuuccuggagucuaaguccacaaccuguacacgcuuuuucaaaaaucucgcuagcuccugcacccuggauucugcccuuaacgcugccagcuauuacaauuuuacggugcugaagguccccagauccaugacagacccucagaacauggaagcguuccagcagagcaccgccgcuucucucacauccccgcggagcggcaaucccggguauaucgugggaaaaccucugcuggcccucaccgaugacauuucuuacagcaugacccugcuucaaucccagggcaacgggucuugcagcguuaagcgccacgaggugcaguucggagucaaugcuaucuccggcuguaaacugagacucaagaaggccgauugcagccaucugcagcaagaaaucuaucagacacuucacgggcggccccgcccugaguacguggcgauuuuuggaaacgccgaccccgcucagaaaggcggcuggacgagaauccugaaucggcauuguucuauuuccgccaucaacugcaccagcuguugccucauuccgguuucucuggagauccaagugcugugggcuuaugucgggcuccuguccaacccucaggcccacgugagcggagucagauuccuuuaccagugucaguccauucaagacucucagcagguuacagaaguuagccugaccacacucgugaauuuugucgauaucacccagaagccccaaccuccccgcggccagccuaaaauggacuggaaguggcccuucgacuuuuucccguuuaaaguggccuucuccagagggguguuuucucagaagugcagcguguccccuauccugauucuuugucugcuccugcugggaguccucaaccuggagacgauguga

SEQ ID NO: 76705 - RNA, 519 nt, Artificial Sequence
  derived and/or modified sequence opt5 from TDGF1__Homo_sapiens__NP_001167607
auggccaucagcaagguguucgagcugggccucgucgcugggcugggacaccaggaauuugccagacccucccggggcuaccuugcguuccgcgacgauucuauuuggccucaagaggaaccggcuaucagaccccggagcucccagcgcguuccucccauggggauucagcauucuaaagagcugaacagaaccugcugucucaauggaggcacaugcaugcuggggagcuuuugugccugcccucccuccuucuauggacggaacugugaacacgacgugcgcaaggagaauugcggcucugugccucaugauacguggcuuccgaaaaaguguagccugugcaaauguuggcacggccagcucagaugcuuuccccaagccuuccugccugggugugacggacuggucauggaugagcaucucguggcuucccggacccccgaacugccucccagcgcccgcacaaccacauuuaugcuuguuggcaucugccugucuauucaguccuacuauuga

SEQ ID NO: 76706 - RNA, 1233 nt, Artificial Sequence
  derived and/or modified sequence opt5 from TDG__Homo_sapiens__NP_003202
auggaggccgaaaacgcuggcagcuacucccugcagcaagcccaggcguucuauaccuuucccuuccagcagcucauggcugaggccccuaauauggccguggucaacgaacaacagaugccggaggaaguucccgcuccugcccccgcucaggagccugugcaggaggcccccaaggggagaaaacggaagccucgcacaacggaaccgaaacaacccguggagccuaagaaacccgucgaaucuaaaaagagcggaaaguccgcgaagucuaaagagaagcaggagaaaaucaccgacacauuuaaggugaagagaaaaguugaucgguucaauggcgugagcgaagccgagcugcuuaccaagacacugccugacauucucaccuuuaaccuggauaucgucauuaucgggauuaaucccggacuuauggcugccuacaaaggccaccauuauccggggccuggaaaccacuucuggaagugccuguuuauguccggccucucugaagugcagcugaaucauauggacgaucacacacugcccggcaaauacgggaucggauucaccaacaugguugagcgcacgaccccuggcagcaaggaccucuccagcaaagaauuuagagaagggggacggauccuggugcagaaacuucaaaaguaucagccccgcauugcugucuucaauggcaaguguaucuacgagauuuuuagcaaggagguguucggggugaaagucaagaaccuggaguuuggacuccagccccauaaaaucccugauacagaaacccugugcuauguuaugccguccagcucugccagaugugcgcaauucccccgggcccaggacaaggugcacuacuacauuaaacuuaaggaucugcgcgaccagcucaagggcaucgagagaaauauggaugugcaggaaguccaauauacauucgaccugcagcuggcucaggaggaugccaaaaagauggcugugaaagaggaaaaguacgacccuggcuaugaggccgccuacgggggagcuuauggcgaaaaccccugcuccagcgagccuuguggguuuucuuccaauggacucauugaaagcguugagcugcggggcgaguccgcguucucugggauccccaacggacaguggaugacccaaucuuuuacggaccagaucccguccuucagcaaucacugcggcacacaggaacaggaggaagagucucaugccuga

SEQ ID NO: 76707 - RNA, 1221 nt, Artificial Sequence
  derived and/or modified sequence opt5 from TDO2__Homo_sapiens__NP_005642
augagcggcugccccuuccuggggaacaauuuuggauacaccuucaagaaacucccuguggagggcuccgaagaggacaagucucagacaggggucaacagagccagcaaaggaggccugaucuaugggaauuaccuucaccuggaaaagguucucaacgcucaagagcugcaguccgaaacgaaaggaaauaagauucaugaugagcaccuuuuuaucauuacccaucaggccuaugagcugugguucaagcagauccucugggaacuggacucugugcgggagauuuuucaaaacggccacgugcgcgaugaaagaaauaugcugaaagucgugagccggaugcaucgcguuuccgugauccucaagcugcuuguccagcaguucucuauccuggagacaaugaccgcgcucgacuuuaacgauuucagagaguaccugagcccggcuuccggcuuucagagccuucaauuccggcugcucgaaaauaaaauuggggugcugcagaacaugcgcguucccuauaauagacggcacuaccgcgacaacuuuaagggagaggaaaaugagcugcuccugaaaucugaacaggagaagacacuucuggagcucguggaagccuggcuggagagaaccccuggccuugaaccccacggguucaacuuuuggggaaagcuggagaaaaauaucacacggggccucgaagaggaguucauucgcauccaggccaaggaagaguccgaagagaaagaggaacaagucgcugaguuccagaagcagaaagaagugcugcugagccucuuugaugagaagagacaugaacaucugcuuucuaaaggggagcggcgccuguccuauagagcccuccaaggagcucugaugauuuacuucuaccgggaggaaccuagauuucaggugcccuuccagcuucugaccagccucauggacaucgauucucugaugacgaaguggcgcuauaaccacgucuguaugguucaccggaugcugggcuccaaggccggcaccgggggaagcuccggcuaccacuaucucagaucuacagugagcgaccgcuacaaaguguuugucgaucuguucaaccuuuccaccuaucugauuccucggcauuggaucccgaagaugaaucccacaauccacaaauuucucuacaccgcggaguauugcgacagcucuuacuucuccagcgaugaaucugacuga

SEQ ID NO: 76708 - RNA, 1032 nt, Artificial Sequence
  derived and/or modified sequence opt5 from TDP1__Homo_sapiens__XP_006720263
augaugcugcuccuguacgaggaaggccuuagaguggucauccacaccagcaaccugauucaugccgacuggcaccagaagacacaagggaucuggcucucuccccuguauccucggauugcugauggaacgcauaaauccggcgagagcccgacccacuucaaggccgaccuuaucuccuaccugauggcguauaaugcucccucucucaaagaauggauugauguuauccauaagcacgaccugagcgagacaaacguguaccugaucggguccaccccuggacgcuuucagggcucucagaaagauaauugggggcacuucagacucaagaagcugcuuaaagaccaugccagcuccaugcccaacgccgaaagcuggccuguggucggacaguuuucuuccgugggcagccugggcgcugaugagucuaaguggcucugcuccgaguucaaagaaagcaugcugacacuugggaaggagucuaaaacccccggaaaguccagcguuccucuguaucucauuuacccguccguggaaaauguccggacaucucuggagggcuaucccgccgggggaagccugccuuacuccauccaaaccgcugagaagcagaacuggcuccacagcuacuuucauaaauggucugccgaaacguccggccgcagcaaugcgaugccccacauuaagaccuauaugagaccuucucccgacuucagcaaaaucgccugguuucuggugacauccgcuaaccuuucuaaggccgcuuggggagcccuggagaaaaaugggacccagcucaugauucggagcuacgaacugggcguucuuuuccugccguccgcguuuggccucgauagcuucaaggugaaacagaaguuuuucgccgggucucaagagccuauggcuacauuucccgucccuuaugaccugccucccgaacuguacggauccaaggaucgccccuggaucuggaacauuccguaugugaaagcccccgacacccacggcaauaugugggugccuagcuga

SEQ ID NO: 76709 - RNA, 1089 nt, Artificial Sequence
  derived and/or modified sequence opt5 from TDP2__Homo_sapiens__NP_057698
auggagcugggcagcugccucgaagggggaagagaggccgcugaagaggaaggcgagcccgaggugaagaaacggcgccugcuuugugucgaguucgccuccguugcgucuugcgacgcugccguggcccaguguuuucuggcugaaaacgauugggaaauggagagagcccucaauagcuacuucgagccuccgguggaagaguccgcucuggaacggcgccccgagaccaucucugaaccuaagacauaugucgaccuuacgaacgaggagaccacagauagcaccacauccaaaauuucucccagcgaagacacccaacaggagaauggguccauguuuagccugaucacauggaacauugauggacucgaccugaauaaccugucugaaagagcccggggcgugugcuccuaccucgcgcuguauagcccugauguuaucuuccuucaggaggugauucccccuuacuauucuuaccugaagaaacgcuccagcaauuaugaaaucaucaccgggcacgaggagggauacuuuacggccauuaugcucaagaagucuagagucaaacugaagucccaggaaaucauuccguuccccagcaccaaaaugaugcggaaccuucugugugugcauguuaauguguccggcaacgagcucugccugaugacaucucaccuggaaagcacccgcggccaugcugccgagagaaugaaucaacucaagaugguccugaaaaagaugcaggaagcuccugaguccgccacagugaucuuugcgggggacaccaaccuucgggaucgcgaggugacgagauguggaggccugcccaauaacauugucgacguuugggaguuccucgggaagccuaaacacugccaguacacaugggauacccagaugaauagcaaccugggaaucacagccgcuuguaaacuucgguuugaccgcauuuucuuuagagccgcugccgaagaaggccauaucaucccccggucucuggaucuccuggggcuggagaagcucgacugcggaagauucccguccgaccacuggggccugcuuuguaaccuggauauuauccucuga

SEQ ID NO: 76710 - RNA, 3570 nt, Artificial Sequence
  derived and/or modified sequence opt5 from TDRD1__Homo_sapiens__NP_942090
augagcgugaagucccccuucaacgucaugucuagaaauaaccuggaggccccuccgugcaaaaugaccgaacccuuuaauuucgagaagaacgaaaauaaacucccuccccacgagagccugcgguccccuggcacacuucccaaccauccuaauuuucgccugaagucuagcgaaaacgggaauaaaaagaacaauuuccuccugugugagcagacgaagcaauaccuugcuucccaggaggacaacucuguuagcuccaauccgaacggaaucaauggcgaagugguggggagcaaaggagauagaaagaaacugcccgccggcaacucugucuccccucccagcgcggagucuaacuccccucccaaggaagugaauauuaaaccggggaacaauguucggccugcuaagagcaagaaacucaacaagcugguggaaaauucucuguccaucagcaaccccggacucuuuaccucccugggcccuccccuucgcucuacaaccugccacagauguggccuguucgggagccuccggugcucccaguguaaacagacauauuacugcagcaccgccugucaacgcagagacuggucugcccauuccauugucugccggcccgugcagccuaauuuucacaagcuggagaacaaaagcucuaucgagacaaaggauguugaggugaauaacaaaagcgacuguccgcuuggagucaccaaggaaauugcuaucugggccgagcgcaucauguucuccgaucugagaucucuccagcugaagaaaacgauggaaauuaagggcaccgugacagaguuuaaacaucccggggacuucuaugugcagcuguacagcuccgagguccucgaauauaugaaucaacugagcgcuucucuuaaggagaccuacgccaacguucacgaaaaagauuauaucccugugaagggagaggugugcauugcgaaguacacagucgaccagaccuggaaucgggccaucauucagaacguggauguucagcaaaagaaggcucacgugcuguacaucgacuauggcaaugaagagauuaucccccucaaccgcaucuaccaucugaacagaaauauugaucuuuuuccucccugugccaucaaaugcuucgucgcuaacgugauuccggccgaggggaauugguccagcgacugcaucaaggcgacgaaaccucugcucauggaacaguauuguucuauuaagaucguugauauccuggaggaagagguggucacauuugccguggaagucgagcugcccaacuccggaaagcuccuggaccacgugcuuauugagaugggcuacggccugaaaccuagcgggcaggacuccaagaaagaaaaugcugaucaaucugaccccgaggauguuggaaagaugaccacagaaaacaauaucguggucgacaaaagcgaucucauuccuaaggugcugacccuuaacguuggcgacgaguucugcgggguggucgcccauauccagacccccgaggauuucuuuugucagcagcugcaauccggacggaagcucgcugaacugcaggccucucugagcaaauauugcgaccagcucccgccucgcuccgauuucuaccccgccauuggcgacaucuguugcgcucaguuuagcgaggaugaccaaugguauagagcgucugugcuggccuacgcuuccgaagagagcgugcuuguuggguacgucgacuauggaaauuucgaaauccugucucucaugcggcugugucccauuaucccuaagcugcuugagcucccgaugcaggccauuaaaugcgugcuggccggcgugaagcccucccugggcaucuggacaccugaggcuauuugucucaugaaaaagcugguccagaacaaaaucauuacggugaagguuguggauaaacuugaaaauagcucucuggucgagcucaucgacaaaagcgaaacaccccacguguccguuagcaaggugcugcuggaugccggguuugcggucggagagcagucuauggugaccgacaaaccuuccgauguuaaggaaaccagcgugccccuuggcgucgaggggaaagugaacccucucgaguggacauggguggaacugggagucgaccaaaccguugaugugguggucugcgugaucuacucccccggcgaguucuauugucacguucugaaggaagacgcucucaagaaacugaaugaucuuaacaagucucuggccgagcauugccagcagaaacucccgaauggguuuaaggccgaaauuggccagccuugcugugcuuucuuugccggagacggcagcugguacagagcucuggugaaagagauccugcccaacgggcacgucaaggugcauuucguugauuauggaaacauugaggaagugacggccgacgagcuucgcaugaucuccucuacauuucucaaucugccuuuccaaggcauucggugccagcuggcggauauccagagcagaaacaagcacugguccgaagaggccaucacccgcuuucaaaugugugucgcugggauuaaacuccaggcccgggugguugaggugaccgaaaauggaaucggcgucgagcugacagaccuuucuaccugcuaccccagaauuaucagcgacgugcugauugaugaacaucucgugcugaaguccgcuagcccgcacaaagaccugccuaacgaucgccuugucaauaagcacgagcuccagguucaugugcaggggcugcaagccacaucuuccgcggaacaguggaaaacgaucgagcugcccguggacaagaccauccaggccaacguccucgagauuaucagcccuaaucuguucuaugcccuucccaagggcaugcccgaaaaccaggagaaacuguguaugcucacagcugaacugcuggaguacugcaaugcuccuaagucucggccgcccuacagaccucgcauuggagaugccuguugcgccaaauauaccuccgacgauuucugguaccgggcugugguucuuggcacaagcgacaccgauguggaaguccuguaugcggacuacgggaacaucgagacgcucccccuguguagagugcaaccuauuaccucuucccaccucgcccugcccuuucagaucauccgcugcagccuugagggacugauggaacucaauggcuccagcucucagcugauuaucaugcugcuuaagaacuucaugcugaaucagaacguuaugcucagcgugaaagggauuacaaagaauguccauaccguguccgucgagaaauguucugaaaacggaacaguggauguugcugacaagcuggugaccuuuggccucgccaagaacaucacgccucaacggcagagcgcccugaauacagagaaaauguauagaaugaacugcugcuguaccgaacuucagaagcaagucgagaaacacgagcacauucuucucuuccugcugaauaacuccacaaaucagaacaaguuuaucgaaaugaaaaagcugcugaagaaaaccgcuucucucgggggcaagccgcuguga

SEQ ID NO: 76711 - RNA, 2235 nt, Artificial Sequence
  derived and/or modified sequence opt5 from TDRD3__Homo_sapiens__NP_001139542
auggcccagguggcuggcgccgcgcugagccaagcugggugguaccucuccgacgagggaaucgaagccugcaccucuagccccgauaaggucaacguuaaugacauuauccugauugcccuuaacacagaucugagaacgaucggcaaaaaguuccucccuuccgacauuaauucugggaaaguggagaagcuggaaggaccgugugugcuucagauccagaaaauccggaacgucgcugcccccaaggauaaugaggaaagccaggcugccccucgcaugcugagacuccaaaugaccgacggccacauuuccugcacagcgguggaguuuucuuauaugagcaagaucucccugaacacacccccugggaccaaaguuaagcugagcggaauuguggauaucaaaaauggcuuccuccugcuuaacgacucuaauaccacaguccugggcggggagguggaacaucucauugagaagugggaacugcagcggucccuuagcaaacacaaccgcucuaauaucggaaccgagggcgggcccccuccguuuguucccuucggacagaagugugugucccauguccagguggauagcagagagcuggaccggcgcaagacgcuccaagugaccaugccugucaaacccacaaacgauaaugacgaauuugagaagcagagaaccgccgcuauugccgaaguugcuaaaucuaaggagacaaaaaccuucggcgggggaggcggcggggcccgguccaaccugaauaugaacgcggccggaaaccgcaauagagaagugcugcagaaggagaaaagcacgaaguccgagggcaagcacgaagggguguaccgggagcucgucgaugaaaaagcucugaagcauaucacagagaugggauuuucuaaagaagccagccgccaggcucuuauggacaacggcaauaaccuggaggccgcccucaaugugcugcuuaccuccaacaagcaaaaaccuguuauggggcccccgcugagaggacggggcaagggccgcgggagaauccggagcgaggacgaagaggaucucggaaaugcuagaccuucugcgcccuccacacuguucgacuuucuggaaagcaagaugggcacccucaacguggaggaaccuaaaucucagccccagcaacugcaccaggggcaguaucgcagcuccaauaccgagcagaacggagucaaggauaauaaccaccuucggcaucccccuagaaaugacacacgccaaccgcggaacgagaaacccccuagauuccagcgcgauucucagaauagcaaguccgugcuggaaggcagcgggcucccccggaacagaggcucugagcgcccuuccacgagcucuguuuccgaagugugggccgaggaccggauuaaaugcgauagacccuacagccgcuaugaccggaccaaggauacauccuacccgcugggaucucagcacagcgacggcgcuuuuaagaaaagagauaacuccaugcaaucucggagcgggaagggaccuuccuucgccgaggccaaagaaaauccccuuccucagggcagcgucgacuauaacaaucagaagcgcgggaaaagagagucucagaccuccauccccgacuacuuuuacgauagaaagagccaaacaauuaacaaugaggcuuucucuggaaucaagauugaaaaacauuucaacgugaauaccgacuaucagaacccuguccgguccaauagcuuuaucggcgugcccaacggggaaguugagaugccgcugaagggccgccggaucggaccuauuaaacccgccggccccgugacggcggucccuugugaugacaagaucuucuacaauucugggccgaaaagacgcagcggacccauuaagccugagaaaauccucgaauccagcauucccauggaguaugcuaagauguggaagccuggcgaugaaugcuuugcccuguacugggaggacaacaaauucuauagagccgaaguggaggcucugcacucuuccgggaugacagccguugugaaguuuaucgauuacggaaauuaugaggaaguccuccugagcaacaucaaacccauucagaccgaggcuugggaagaggaaggcaccuacgaccagacacuugaguuccggcgcgggggcgauggacaaccuagacgguccacccgccccacacagcaguuuuaccaaccgccuagagcccggaauuga

SEQ ID NO: 76712 - RNA, 2946 nt, Artificial Sequence
  derived and/or modified sequence opt5 from TDRD5__Homo_sapiens__NP_001186020
augagcgagcaggaaagaauccaagagugccugcggaaggaaauucgcucccuccugaucucuaccaaagacggccuuagcccccaggagcuggaaaaggaguaccuccugaugguggggaaccaccuuccucugcggauucucggauauagauccacaauggagcugguccuggauaugccggacguugugcgcgugugucccggcgccgggggaacggucauccucaaagcuauuccugaugaaucuaccaagggcaucgccagccugguggcgaaacagagauccucucauaaacuucggaauagcaugcacaaggggcgccccuccaucuacagcggaccuagaucucaucggcgcguucccuauagaggccggguggcuccuauucugccggccgucgugaaauccgagcucaaggaccugcuugcccugagccccguucuccugucugauuucgaaaaggcuuuugccaagcgcuucggcagauccuuucaguacaugcaauauggguuccugagcauguuugaggugcucaacgcugccucugacgucaucuccguggagcagacacgggcgggaagccugcuuaugcugaaaaaguccgugaccgaagagaagccucgcggcugccccgccgggaaaauuuucacacagccuuuuagaaugaagcagggaucuuacagcaccggcuuccccgucgcuaaaccguguuuuucccaaccuacaagcaauauggaacccccuaagcagaucaugucuauggagaaaaccuccaagcucaacguuguggaaacgagccggcugaaucacaccgagaaacuuaaccagcuggagaauacauucaagucugugauugcccagaucgggcccggaggcaccauuagcuccgaacucaagcauaaaaucaaguuugucgugucuaaauuccccgagggccuguuuaucagcaagcugcucggggaauaugagguuauuuucaaagaacaacuguccccuaagaaacuuggauuccugaacgugacagagcucgucggcgcucugagcgauauccuucacguggaguuuagaaaggggcaccaggaccugcucguuuucgaugccgacaagaaaccgcugcccccugugcagucugauaagaaaauugaagcgaaggccugcgucuccucucccccucgcaauagccuguccaccgcugccgugaaggagacggucuggaacugucccagcaaaaagcaaaaagaaccgcagcagaagaucugcaaaaagccuaaucucgugguuaagccccugcagcuucaaguggagacaaacaaauccgaacugaaucucgcuauggccaaccaugacauuccucccgaugccgucccuaauaagaaacugugucggcugcccccgcuugacaccucuagccucaucggaguguuuguugaguacaucauuuccccuucucaguucuacaucagaauuuauagccgcgacuccagcgagcugcuggaagauaugaugaucgagaugcggagaugcuacucuaaccagcucguguccgaccgcuaugucaugcccgaauguuuuauucagcccggccaccugugcugugugcggaucagcgaggauaaguggugguacagagugaucauucaucgcguucuugagaaacaagaagucgagguguucuauccugacuuugggaacaucggaauugugcagaagucuucccugcgguuccucaaaugcugcuacacaaagcugccggcucaggcgauccccuguagccuggccugggucagaccuguggaggaacacuggaccucuaaggcuauucuucaguuucaaaaacucugcggccugaagccccugguuggcguggucgaugaauauguggacgggauccucaauauuuuccugugugauaccagcuccaacgaggacguuuacuuucaccaugugcuucgcacagagggacacgccaucgucugccgggaaaauaucagcucuaaaggcuucuccgagcugaacccucucgcccuguacacgaccagcuccgggggacccgaagauauugugcugacagagcuuggcuauccuucucagcagcauuacuuuaaugaagacagaaagaucagcccccaguccaaagagucugagcuccggauucuggaugaaaucccgaccgggaugccuugucuggagagcguuacaauuggcgacgacaucugggaugaaaacuggcucccccugcaagcuaagaugggaaagggcggggacgccgcgucccaccuuuucaccgcuucucugggaggcaaaaaucaguauagcuccugcaaggagaugccucagaaagauugguguuucagcacgcccaaggacacaugggaugacucuuggcaaccguccgggcucgugaacggaaccaaagucgaagugcauaagccugaggugcugggcgcccaggagaagaauaccgggacaaaccgcacccagaaacagcuggauaucaauggcagcucugacuccagcacacuucccaagcucgaagaguuuugcacgucucugacccaauccgaacagagcgccgauggaucccagagcgagccuaacaauucucagacacaacccaaacagauucagcugagcaccgcugcccccuguuccacaaccgcugucgacgauucugccgagaagccuagcggcuccguugaaucuagcccggagauccucaaaaacgaagacuucuccucuagcagagcgauuacgcuguacaaggauaagcggcaggaguccguggaccaacuuagccugauccucucuuaugaaugccagauuucccagaaacuguacauccccagaagcaccgccacagcugcccugggggcugccgcgcgccuugccaccucucggucccugcuccacugguauccuagcgugaagagaauggaggcuuga

SEQ ID NO: 76713 - RNA, 6291 nt, Artificial Sequence
  derived and/or modified sequence opt5 from TDRD6__Homo_sapiens__NP_001010870
augugcagcacccccggcaugccugccccgggggcuucccuggcccucagagugucuuucgucgacguucaccccgaugugaucccugugcagcuguggggacuugucggcgagcggcgcggggaauaccugagacucagccgggagauucaagaagcggcugccacacgcggacagugggcccugggcuccgcuucugccagccccggggagcuuugucuggugcagguuggacuccuguggcauagaugccggguggucucccgccaggcucaagaaucuagaguguuucugcucgacgagggccggacgaucaccgccggcgcggggagccuggccccuggacgcagagaguucuuuaaccuucccuccgaaguucugggcugugugcucgcugggcuggucccugccggaugcggcgcugggagcggagagccgccccagcacuggccugccgaugcgguggacuuccuuucuaaucugcagggcaaggaagugcauggcuguguccucgauguucugcugcuccaccggcuggugcuucuggaggugcccgacgucuuucagcaaaugcgcgagcucgggcuggccagacgggugccugauucccuuuuccgcagccugcucgaaagauaucugacagcugccaccgcuucuguuggauccggcgugcccguccugagccgggugccgcucaaacagaagcagccugggcuggacuacuuuuauccccagcuucaacugggaguuacagaggccguggucauuacccaggugugccauccucacagaauccacugucagcuccgcucugucucccaagaaauucaucggcugagcgaguccauggcccagguguacagaggcucuacagggaccggagaugaaaacagcacguccgcuaccugggaggagcgcgaagagagccccgacaaacccggcucuccuugcgcguccuguggccuugaugggcacugguaucgggcccugcuccuggaaacauucagaccgcagcgcugcgcucagguucugcauguggacuacggacggaaggagcucgucagcuguucuagccugagauaucuucugcccgaauacuuucgcaugccugugguuaccuaccccugcgcccucuauggccugugggaugggggacggggcugguccagaucucaagugggggaccugaaaacacuuauccucggcaaggccgucaaugcuaagaucgaguucuacugcagcuuugagcacguguauuacgugucccuguauggagaagacggcauuaaccugaaucgcguuuucgggguccagagcuguugccucgccgaucgggugcugcagucucaggcgaccgaggaagaggaaccugagacgucccaaagccagucucccgcugaggaaguggacgaggaaaucucccuuccggcccugagaagcauucggcucaaaaugaacgccuuuuacgaugcucaggucgaguucgugaagaauccuuccgaguucuggauccgccugagaaaacacaacguuacauuuucuaagcugaugcggagaauguguggauucuauagcuccgccucuaaacuugacggcgugguccucaagcccgaaccugaugaccugugcugugugaaguggaaagagaauggguacuaccgcgcuauuguuaccaagcuggaugacaaaagcguggaugucuuucucguggaccggggaaacuccgaaaauguugauugguaugacgugagaaugcugcuuccccaguuccgccaacugccuauccucgccgucaagugcacacuggcggacauuuggccccugggcaaaaccuggagccaggaggccgugucuuuuuucaagaaaaccgugcuucauaaggaacucgucauccacauccuggauaagcaggaccaucaguacguuauugagauccuggaugaguccagaacaggggaagagaacauuagcaaagugaucgcucaagccggcuaugcuaaguaccaggaauuugagacgaaagaaaauauucucgugaacgcccacucuccgggacaugucuccaaucacuucaccacagagagcaacaagaucccuuuugcgaaaaccggcgagggggaacagaaggccaagcgggagaacaaaacaaccucugugagcaaggcucuguccgacacgacaguugugaccaauggaagcaccgaacuugucgugcaagagaaaguuaagcgcgccucuguguauuucccccugaugcagaacugucucgaaaucaaacccggcuccagcuccaagggggagcuggaggucggaucuacaguggaaguuagagugagcuacgucgagaauccuggcuauuuuuggugccagcugacccggaacauucaggggcuuaagacacucauguccgauauccaauacuacuguaaaaauacggcugccccgcaccagcgcaacacccuggccugccuggcuaagagaacagugaaucggcaguggucucgcgcgcucauuagcggcauccaguccguggaacaugucaacguuaccuucguggacuauggagauagagagauggugucugucaaaaauauuuacagcaucuccgaggaauuucugaaggugaaagcccaagcuuuccgguguagccuuuauaaccugauccagcccguuggccagaauccuuucgugugggacgucaaggccauucaggccuuuaacgaguucaucgauaaugcuuggcaaaagaaccucgaacugaaaugcacaauuuuugcccuggcgucuaucaaugaggaacuuuucaacauuguggaccugcucacccccuuucaguccgcuugccacuuccugguugagaagcgccucgccagaccugugaaacugcagaagccccuugagagcucuguccaacugcauuccuacuuuuauagcacgcacgauaugaaaaucgggucugaagagcucguguacauuacccacaucgacgauccuuggacauucuauugucagcuggcccggaacgcuaauauccuggaacagcuuuccugcagcauuacccagcuguccaagguccuccugaaccucaaaacaagcccccugaauccgggaacccuuugucuggccaaguacacggacggcaacugguacagagggaucgugauugagaaggaaccuaaaaagguuuuuuucguggacuuuggaaauaucuaugucgugacaucugaugaccuccugcccauuccuagcgaugcguacgacguucugcuucugcccaugcaagcugugcgcugcucccucucugauaucccggaccauaucccugaggaggucguggugugguuccaggaaaccauucuggauaaaagccucaaggcccugguugucgccaaagaccccgauggcacacuuaucauugagcuguauggggacaacauccagauuuccgcuucuaucaauaagaagcugggccuccugagcuacaaagaucggaucagaaagaaagaauccgaggugcuuuguucuaccaccgaaacacuggaggagaagaacgaaaauaugaaacucccuugcacggaguaucugagcaaguccgugggauacaagcuccccaacaaagaaauucuggaggagagcuauaagccccagaucaauucuuccuacaaagaacuuaagcugcugcaaagccucaccaaaacaaaccuggucacccaguaccaggacucugugggcaauaagaacucccagguuuuuccucuuacaaccgagaagaaagaagagauuagcgccgaaacgccgcugaagacagcucgcguggaggccacccucuccgagcggaaaaucggggauucuugugacaaggaccugccccucaaauucugcgaauucccucaaaagaccauuaugcccggauuuaaaacaaccgucuaugugagccacaucaaugaucuguccgacuucuacguucagcuuaucgaggaugaagcggagauuagccaucugucugaaagacugaacuccgugaagacacgcccugaguauuacgucggccccccucuccagcggggggacaugaucugugccguguuuccggaggauaaccugugguauagagcuguuauuaaggaacagcaacccaaugaccuucugagcgugcaguucaucgauuacggaaacgucucuguggugcacacgaauaaaauuggccgccucgaccuggucaacgccauccucccuggccugugcauucauuguagccuucagggguuugagguucccgauaauaagaacuccaaaaagaugaugcacuauuucucucaacggaccagcgaagcugccaucagaugcgaguuugugaaauuccaggaccggugggaagugauccuggccgaugagcacggaauuaucgcugacgacaugauuucccgcuacgcgcugucugagaagagccaggucgaacucuccacacaggugaucaagagcgccucuuccaaaagcguuaauaaguccgauauugacaccucuguguuucugaacugguacaauccugagaaaaagaugaucagagcuuaugccacagucaucgauggccccgaauacuucuggugccaauuugccgacaccgagaaacuucagugucuggagguggaaguucagacggcuggggagcagguggccgaucggcgcaacugcauuccguguccuuauaucggagaccccugcauugucagauaccgggaagauggccauuauuacagagcgcucaucaccaauauuugugaggacuaucuggugagcguccgccugguggauuucgggaacaucgaagacugcguugaucccaaggcucucugggccaucccuuccgagcuucugucugugcccaugcaagccuucccuuguugccugagcggauuuaauauuuccgagggccucuguagccaggaaggcaacgacuacuucuacgagaucauuacagaagaugugcuggagaucaccauucuugaaauccggagagacgucugcgacauuccgcuggcuaucguugaucucaagucuaaagggaaguccaucaaugagaaaauggagaaguauagcaaaacaggaauuaagucugcccugcccuacgaaaacaucgacuccgagauuaagcagacccugggcagcuauaaccucgauguggggcuuaaaaagcugucuaauaaagcggugcagaacaagaucuacauggaacaacagacagacgagcuggcugaaauuaccgagaaagaugucaauaucaucggaacgaagccuagcaacuuucgcgaccccaagacagauaauauuugugagggcuucgaaaacccuugcaaagacaagaucgauaccgaggaacucgagggggagcuggaaugccaccuuguggacaaagccgaguuugaugacaaguaucugauuaccggauucaauacacuccugccccaugccaacgaaaccaaagagauccuggaacucaauucccuugagguuccgcugucuccugaugacgagagcaaggaauuucuggagcucgaauccauugagcugcagaacagccuuguggucgacgaagagaaaggcgagcugucccccgugccucccaaugucccucucucucaagaaugugugacgaagggcgcuauggagcuguucacacugcagcucccccuuagcugcgaagccgagaagcagccggaacuggagcugccuaccgcucagcucccccuggaugacaaaauggauccccuuucccuggggguuucucaaaaggcccaggagagcauguguacagaagacaugcggaaauccucuugcguggagagcuuugaugaccagagacgcaugucccuccaccugcauggagcggauugugacccuaagacccagaacgaaaugaauaucugcgaggaggaauucgucgaguacaaaaaccgggaugccaucagcgcucugaugccgcucuuuucugaagaggaauccagcgacggcucuaagcacaauaacgggcuucccgaucacauuuccgcccaacugcagaauacauauacccugaaggcuuucacggugggaagcaaauguguuguguggucuucccucagaaacaccuggagcaagugcgagauccuggagacagccgaagagggcacccgcguccuuaaccuguccaaugggauggaagagauugugaacccugaaaauguguggaacggaauccccaaacucgacaagagcccucccgagaaaagaggccuggagguuauggaaauuuga

SEQ ID NO: 76714 - RNA, 3075 nt, Artificial Sequence
  derived and/or modified sequence opt5 from TDRD7__Homo_sapiens__NP_001289813
auggccugcaccgagacagcuagaaucgcccagcugguggcgcggcaacgcagcuccaagagaaaaacgggccggcaggucaacugucagaugcgcguuaagaaaaccaugcccuucuuucucgaagggaagccuaaagcuacacugagacagccgggauucgccucuaauuuuagcgugggcaagaagcccaacccugcuccccuucgggacaaaggaaauuccgugggggucaagccugaugccgagaugucucccuacaugcugcacaccacacucggcaacgaagccuucaaagacauuccugugcaacgccauguuaccaugagcacaaauaacagauuuuccccgaaggcuucucugcagcccccucuucagaugcaccugagccggaccuccacgaaagagaugagcgauaaucucaaccagaccguggaaaagcccaaugucaagccucccgccucuuauacauacaaaauggacgaggugcaaaaccgcaucaaggagauucugaauaaacauaacaaugggaucuggauuuccaagcugccgcacuucuauaaagaacucuacaaggaggaucugaaccagggaauccuucagcaguuugaacauuggccucacaucugcaccguugagaaacccuguagcggcggccaagaccugcuccuguauccugcgaagagaaagcagcuucugcggucugagcucgauacagaaaaagugccccugagcccccugccugggccgaagcagacgcccccucucaaaggaugccccaccgucauggccggcgacuucaaggagaaaguggcugaucugcuugugaaguacacaagcgggcugugggccucugcucucccuaaggccuuugaagagauguauaaagucaaguuccccgaagacgcgcugaaaaaucuugccucccugagcgauguuuguuccauugacuacaucucuggaaacccgcaaaaggcuauucucuacgccaaacugccucugcccaccgauaagauccagaaggacgcuggccaggcccacggggacaacgauauuaaagccaugguggagcaggaguaucuccaaguggaagagagcaucgcugaauccgcgaauacauuuauggaggacauuaccgucccuccccugaugaucccuaccgaagccagccccucugugcuuguuguggagcuguccaacacaaaugaggucgugauccgcuacguuggaaaggauuauagcgcugcccaggaacucauggaggacgaaaugaaagaguacuauucuaagaacccgaaaauuacgccugugcaggccgucaaugugggccagcugcuugcugucaacgccgaagaggaugcguggcugagagcucaagugaucagcaccgaggaaaauaagauuaagguuugcuacguggacuauggcuucuccgagaacgucgaaaaaucuaaggccuacaaacucaaucccaaguuuuguagccuguccuuccaggccacaaaaugcaagcuggcugggcucgaggugcugagcgaugaccccgaucuuguuaaaguggucgagucucugaccuguggaaagaucuucgccguggaaauucucgacaaggcugauaucccucuggugguucuguacgacacauccggcgaggacgauaucaacauuaaugcgaccugccuuaaagccaucugugacaagagccucgaaguccaucuccagguggaugccauguauacgaacgugaaagucacaaauauuugcucugacgggacccuguacugccaggugccguguaagggacugaacaaacuguccgaucuucugcggaagaucgaggacuauuuucacugcaagcauaugaccagcgaauguuucguuucccuccccuuuugcggcaaaauuugucuguuccacugcaaggggaaauggcugcgcguggagaucacaaauguccacucuagcagagcucuugaugugcaauuucucgacuccggaaccguuacaucugugaaggucagcgagcugcgggaaaucccucccagauuccugcaggagaugauugccaucccuccccaggcuauuaaauguugccucgccgaucugccucaguccaucggcauguggacgcccgacgcggugcuuuggcugcgcgauagcguucucaacuguucugacugcuccauuaaggugaccaaggucgaugaaacacggggcaucgcccauguguaccuguuuaccccgaaaaacuucccugacccccacagaagcauuaaucgccaaaucacaaacgcugaccuguggaagcaucagaaagauguguuucuuucugccaucuccagcggggcugacucuccuaauagcaagaacggaaauaugcccauguccggcaacaccggggagaauuuccggaaaaaccucacggaugucauuaagaaguccaugguugaccacaccucugccuuuuccacagaggaacugccgccucccgugcaucugagcaaaccuggagagcacauggauguguauguccccguggccugucaccccggcuacuucguuauccagccuuggcaagaaauucauaagcucgaggugcugauggaagagaugauccuuuauuacuccgucucugaagagagacacauugcuguggagaaagaccagguuuacgcggccaagguggaaaauaaauggcaucgcguccugcucaaggggauccugaccaacggccuggugagcguuuaugagcuugauuacggaaaacacgaacucgugaauauccggaagguccagccgcugguggacauguuuagaaagcugcccuuccaggcugugacagcccaacucgccggcgucaaaugcaaccagugguccgaggaggcuucuaugguuuuccgcaaucacguggaaaagaaaccucugguggcccuuguccagaccgugauugagaacgcgaaucccugggaucggaagguuguggucuaucugguggacacgagccucccugauacagacaccuggauccaugauuuuauguccgaauaccugauugagcugucuaaaguuaacuga

SEQ ID NO: 76715 - RNA, 4149 nt, Artificial Sequence
  derived and/or modified sequence opt5 from TDRD9__Homo_sapiens__NP_694591
augcugagaaagcucaccaucgagcagauuaacgacugguucacaaucggcaaaacggugaccaaugucgaacugcuuggggcucccccugcuuuuccggccggagcggcucgggaggaaguucaacgccaggauguggcccccggcgccgggccugcugcccaggcucccgcccuggcgcaggccccugcuagacccgccgcugccuucgagcggagccucucccaacgcucuagcgaaguggaguacauuaacaaguauagacagcuggaggcgcaggaacuugacgucugccgguccgugcagccuacaucuggaccgggcccccgcccuagccuggccaaacucuccucuguuaccuguauccccgggacaaccuacaaguauccugaucugcccauuagcagauacaaagaggaaguggucucccugaucgagagcaauucugugguuaucauucacggagcuacaggcuccggcaagagcacccaacucccgcaguauauccuggaccauuacgugcagcggucugccuauugcuccauugucgugacgcagccucgcaagaucggggcuagcucuauugccagauggaucuccaaagagcgggccuggacccuuggaggcguggucggguaccaaguuggacuggaaaagauugcuacagaggauacccgccucaucuacaugacaaccggcgugcugcuucagaaaaucgugagcgcgaagucccugauggaauuuacgcacauuaucauugacgagguccaugaaagaacagaggagauggauuuccuccugcuggugguucggaaacuccugcgcaccaacucuagauuugugaaggucgugcuuaugagcgccacaaucuccuguaaggaguucgcugacuauuuugccguucccgugcagaauaaaaugaacccugccuacauuuucgaggucgaagggaagccccacagcguggaggaauauuaccugaaugaucucgagcauauccaccacucuaaacugagcccccaucuucuggaggaaccugucaucaccaaggacauuuaugagguggcuguuucccucauccaaauguuugaugaccuggauaugaaagaaucuggaaacaaggccuggagcggcgcgcaguucgugcuggagcgguccucuguccucguguuucugccgggccuuggggaaauuaauuacaugcacgagcugcucaccagccugguucauaaaagacuucagguguauccccugcacuccagcgucgcucucgaggaacagaacaauguguuccugucuccugugcccggauaccgcaagaucauucuguccacaaacaucgccgagagcucuguuacggucccugacgugaaguacgugaucgacuuuugccucacccggacacuggucugugaugaagacaccaauuaucaaucccuuagacugagcugggccuccaaaacaucuugcaaccagcgcaagggccgggcugggagagugagccgcggauacuguuaucggcucguucacaaagauuucugggacaauuccauucccgaucauguggucccggagaugcugagaugcccucugggcucuaccauccuuaaggugaaacuccuggacaugggggagccccgcgcccugcucgcuacggcccugagcccucccggacuuuccgauauugaacggacaauccugcuccugaaggagguuggcgcgcuggccgugagcggccagagagaagacgagaacccucacgauggggaacuuaccuuccucggacgcguccuggcucagcugcccgugaaccaacagcucggcaagcugauuguucuugggcauguguuuggaugucuggacgagugccucaucauugccgcugcccugucucugaaaaauuucuuugcgaugccguuccggcagcaccuugauggcuacagaaacaaggucaauuuuuccgggagcucuaaauccgacuguaucgcccucguggaggcuuucaagaccuggaaagccugccggcagacaggcgaacugcgcuauccuaaggacgagcugaacuggggaagacucaauuacauccaaauuaagcggaucagagaaguggcugagcuguaugaagaacuuaaaacccgcauuagccaguuuaacaugcaugucgauucucggagacccguuauggaccaggaguacaucuacaagcagcgcuucauucugcaaguggugcucgccggcgccuuuuaucccaauuacuucacauuugggcagccugaugaagagauggcugucagagaacuggcgggaaaagacccgaagacgaccgugguucugaaacacauucccccuuauggcuuccuuuacuauaagcagcuccaaagccuguuucggcagugcggacaggugaaguccaucgucuucgauggggccaaagccuucguggaguuuagccgcaaccccacagaaagauucaagacccugccugccguuuacauggccaucaaaaugucucagcucaaggugucccuggagcuuagcguccacuccgcugaggaaaucgagggcaaagugcaagggaugaauguuucuaagcugcggaacacacgcgugaaugucgacuuucagaaacagaccguggaucccaugcaagugagcuucaacacguccgacagaucucagaccgucacagaucuccugcugaccauugacguuacagaagugguggaggucggccauuuuuggggauaucggaucgaugagaauaacagcgaaauucuuaagaagcugaccgccgagaucaaucagcucacgcuggugccucuccccacacacccgcauccugaccugguuugucuugcgcccuucgcugauuuugacaaacagcgcuacuucagagcccaggugcuguacgucuccggcaacucugccgaaguguuuuucguugacuaugggaacaagagccacguggaucuccaucugcugauggagaucccuugccaauuucuugaacugcccuuccaggcucucgaguuuaaaauuuguaagaugcggccguccgccaaaagccuggucugcggaaagcacuggucugacggcgcgucccagugguucgcuagccucgugucuggguguacccugcuugucaagguguucuccguugugcacagcguccugcauguggauguuuaccaauauucuggagugcaggacgccaucaauauucgcgauguccucauccagcagggcuacgccgagcugacagaagaguccuaugaaagcaaacaaucccacgaggugcugaaggggcuuuuuagcaaaucuguggaaaacaugaccgacggcagcguuccuuuccccaugaaggaugacgagaaauaccugauuagaauccuccuggaguccuuuucuaccaauaagcucggaacaccuaacugcaaggcugaacugcauggccccuucaaucccuaugagcuuaaaugucacagccugacgcggaucuccaaguuuagaugcgucuggauugaaaaagagucuaucaacagcgugauuaucuccgaugccccugaagaccugcaccagcgcaugcucguggcugccucucugagcauuaaugcgaccggguccacaaugcuucugcgggagaccagccucaugccgcauauccccggacugccugcccuccugucuaugcuuuucgcucccgucauugagcugagaaucgaucagaacggcaaguacuacacaggggugcuguguggacucggcuggaauccugccaccggggcuuccauccugcccgaacacgacauggagcuugccuuugauguucaguucagcguggaagacgucguggagguuaacauucugcgcgccgcuaucaauaaacucgugugcgacggcccuaacggauguaagugccugggcccggagcgggucgcgcaacuccaggauauugccagacagaagcugcuugggcuguuuugccagucuaaaccccgcgaaaagaucgugccuaaauggcaugagaagcccuaugaauggaaucaaguugacccuaaacuggugauggagcaggcugaucgggaauccagcagaggaaagaacacguuccucuaccagcugcacaaacuugucgugcugggcacauga

SEQ ID NO: 76716 - RNA, 1551 nt, Artificial Sequence
  derived and/or modified sequence opt5 from TDRKH__Homo_sapiens__NP_001077433
augagcaccgagagaacauccuggacgucucugagcaccauccagaagauugcccucggccuggggauccccgcuuccgccacaguggcguacauucuuuaucggcgcuacagagaaucucgggaggaacgccugaccuucgucggagaggacgauaucgaaauugagaugagaguuccucaagaggcugugaaacucaucaucggccggcagggggccaacauuaagcagcugcgcaaacagacaggagccagaaucgacguggauaccgaagacgucggcgaugagcgggugcuucugauuagcggguuuccgguucaagccuccggagccaagaucacaugcgacaaagaaucugagggcacccuccugcugagccgccucauuaagaucuccggcacgcagaaggagguggcugccgcgaaacaccugauucuugaaaaggucagcgaggaugaggaacugagaaaacggaucgcccauucugcugaaacccgcgugcccagaaagcagccuaucuccguucggcgcgaggacaugacagagcccgggggagccggcgaaccugcucucuggaaaaauaccucuagcuccauggagcccacagccccucuggugaccccgcccccuaaagggggaggcgauauggcggucguggugagcaaggaagggucuugggagaagcccuccgacgauagcuuccagaaguccgaagcccaagcuauuccugagaugcccauguuugagaucccgucuccugacuucagcuuucacgccgaugaauaucuugaggucuacguuuccgcuagcgaacaucccaaccacuucuggauucagaucgugggaucuagaucccugcagcucgacaaacuggugaaugagaugacgcagcauuaugaaaacagcgucccugaggaccugacagugcacguuggcgauauuguggccgcuccccuccccaccaauggcucuugguaccgggcuagaguccuggggacacuugagaacggaaaucuggaccucuauuuuguggauuucggcgacaacggggauuguccucugaaggaccuucgcgcgcugcggagcgauuuucucucccugccguuccaagccaucgaaugcucucuggcuagaaucgcccccagcggagaccagugggaggaagaggcccucgaugaguuugaccgccugacccacugugcugauuggaaaccucuuguugccaagauuuccagcuacgugcagaccggcaucucuacauggcccaaaauuuaccuguaugacacguccaaugggaagaagcucgacaucggacuggaacuuguccauaaaggcuacgcgauugagcugccugaagauaucgaggaaaaccgggcugugcccgacaugcucaaggauauggccaccgagacagacgccagccugucuacccugcucacagagaccaaaaaguccagcggcgaaaucacgcacacacuguccugccuuucucugagcgaggcugccuccaugucuggggaugacaaucucgaagaugacuaucugcuguga

SEQ ID NO: 76717 - RNA, 597 nt, Artificial Sequence
  derived and/or modified sequence opt5 from TDRP__Homo_sapiens__NP_001243042
auguggaagcugggcagagggcgggugcuccuggacgagcccccugaagaggaagauggacuucgcggcgggccgcccccugccgcugccgcggcugcccaggcccaaguccagggagcuagcuucagaggcuggaaagagguuaccucccuguuuaacaaggacgaugaacagcaccuccuggagcggugcaaaucucccaagagcaaagggacaaaucuucgccugaaggaggaacucaaggccgagaaaaaguccggauucugggacaaccuggugcugaaacagaauauccaaucuaagaaaccugaugaaauugagggcugggagcccccuaagcucgcucuggaagacaucagcgccgauccggaggacacggugggcgggcaucccuccuggucuggaugggaagaugacgcgaagggcagcaccaaauacacaucccuugccagcucugcuaacuccagcagauggucucugcgggccgcugggcgccucauuaaggaggucuggaucaauuuuucccagcugauuaucagcuucagaaaacacugucuugcccauuaucgggaacugcgccucugcaucaaguacuga

SEQ ID NO: 76718 - RNA, 1281 nt, Artificial Sequence
  derived and/or modified sequence opt5 from TEAD1__Homo_sapiens__NP_068780
auggagcccagcuccuggucuggcagcgaauccccugccgagaacauggaaagaaugucugacagcgcugauaagccgaucgacaaugaugccgaggggguguggucccccgacauugaacagucuuuccaagaggcgcuggcuaucuacccucccugcggacggcgcaaaauuauccucagcgaugagggcaagauguaugggagaaacgaacugauugcccgguacaucaaacuucgcaccggaaagacaagaacgcggaaacaggucuccagccacauccagguucuggcccgcagaaagucucgggacuuucauuccaagcucaaagaucagaccgcuaaggacaaagcccugcaacacauggcugccaugagcucugcgcagauuguguccgccacagcuauccauaauaagcucggccugccugggauuccccgcccuaccuucccgggagcccccggcuuuuggccuggcaugauccagacagggcagcccggaagcucucaagaugugaaaccuuucguccagcaggcuuaucccauucagccggccgugaccgcgccuauccccggcuuugagccugccuccgcucccgcccccagcguuccugcuuggcaagggagauccauuggaacaaccaagcuccggcugguggaauuuucugccuuucuggagcagcagcgcgacccggauagcuacaacaagcaccucuucguccauaucggccacgccaaucacuccuauagcgacccccugcuugagucuguggauaucagacaaauuuacgacaaauuuccugaaaagaaagggggacugaaggagcuuuucggcaaaggcccccagaacgcuuucuuccugguuaaguuuugggcggaccuuaauuguaacauccaggaugacgccggggcuuucuauggagugacgucccaguacgaaagcucugagaauaugaccgucacaugcagcaccaaaguguguuccuucggcaagcaaguggucgaaaagguugagacagaguacgcccgguuugaaaacgggcgcuucguguauagaauuaaucggucuccuaugugcgaguacaugaucaacuuuauucauaaacugaagcaccuccccgaaaaauauaugaugaauagcgugcuggagaacuucaccauccugcucgucgugacgaauagagauacacaggaaacccugcuuuguauggccugcguuuuugagguguccaacagcgagcauggagcucagcaccacaucuaccgccuggucaaggacuga

SEQ ID NO: 76719 - RNA, 1353 nt, Artificial Sequence
  derived and/or modified sequence opt5 from TEAD2__Homo_sapiens__NP_001243587
augggcgagcccagagccggggcugcccuggacgauggaagcggcuggaccggguccgaagagggaucugaagagggcacagggggaagcgaaggcgcgggcggggacggaggcccugaugcugagggggugugguccccggacaucgagcagucuuuccaagaagcccucgccauuuaucccccuugcggacggcgcaagaucauucugagcgaugagggcaaaauguacgggagaaacgaacuuaucgcucgguacauuaagcugcgcacgggaaaaaccagaacacggaagcaggucuccucucacauccagguucucgcccgcagaaaaagccgggagauccaguccaagcugaaggaccaagugagcaaagauaaggcuuuucagaccauggccacaaugucuuccgcgcagcuuauuagcgcccccucucugcaggcuaaacucggcccuaccggcccccaagugguccaggccuccgagcuguuccaguuuuggagcgggggaucuggcccuccguggaaugugcccgacguuaagccuuucucccagacacccuuuacccugagccucacgccucccuccaccgaucugccgggguaugaaccuccccaagcucuuucuccucugcccccucccacaccgucucccccugccuggcaggcgcgcggacucggcaccgccagacugcagcuuguggaguucuccgcuuuugucgaacccccugacgccguggauagcuaccaacggcaucuguucguucacaucucucagcauugucccuccccgggggcuccuccccucgagagcguggacguccgccagauuuaugauaaauuuccugaaaagaagggaggccugagagagcuguacgaccgggggcccccucacgccuucuuucucgugaaauucugggccgaccugaacugggggcccucuggagaggaagcuggcgcgggcggaagcaucuccucuggcggguuuuauggcgugagcucccaguacgagagccuugaacauaugacacugaccugcagcuccaaggucuguagcuucggaaaacaaguuguggagaagguggaaacggagcgcgcccagcucgaggauggcagauucgucuaccggcugcuuagaucuccgaugugcgaauaucuggugaauuuucuccacaaacugcgccagcugccugagcgguacaugaugaacuccguucucgaaaauuucacaauucuucagguggucaccaacagagacacacaagagcugcugcucuguaccgcuuauguguuugaaguuagcaccuccgagcgcggggcccagcaccauaucuaccggcuggugagagauuga

SEQ ID NO: 76720 - RNA, 1308 nt, Artificial Sequence
  derived and/or modified sequence opt5 from TEAD3__Homo_sapiens__NP_003205
auggccagcaacuccuggaaugcuucuagcucccccggcgaggccagagaagacgggccugagggacuggauaagggccucgacaacgaugcggaagggguguggucuccggacaucgagcagagcuuccaagaagcucuggccauuuaucccccuugcggacggcgcaaaaucauucuuuccgaugagggcaagauguacgggagaaaugagcugaucgcccgguacauuaaacuccgcaccggaaagacaagaacgcggaaacaggucucuagccacauccagguucuggcucgcaagaaggugagagaauaucaggugggcaucaaagccaugaaccuugaccaagucuccaaggauaaagcucugcagagcauggccucuauguccagcgcgcagauugugucugccuccguucuccagaauaaguuuucucccccuagcccccugccucaagcuguguucuccaccagcucccgguuuuggucuagcccgccccugcucggccagcagccugggcccucccaggacaucaaaccuuucgcccaacccgcuuacccgauucagccuccccugccucccacacuuagcucuuaugagccccuggccccucucccguccgcggccgcuagcguccccguguggcaggaucgcaccaucgccucuagcagacugcggcuucuggaauacuccgcuuuuauggagguucaacgcgacccugauacauauucuaagcaucucuucgugcacauuggacagaccaaccccgccuuuagcgacccuccccuggaggccgucgaugugagacagaucuacgacaaguucccggagaaaaagggcgggcugaaagaacucuacgaaaagggaccucccaaugcguuuuuccuggugaaauuuugggcugaccuuaacuccacaauucaggagggcccuggggccuucuauggagucagcucucaauacuccagcgcugauucuaugaccaucuccguuagcacgaagguguguuccuuuggcaaacagguggucgaaaagguggagaccgaguaugcccggcuggaaaauggccgcuucguuuacagaauccaucggucucccaugugcgaguauaugauuaacuucauccacaagcucaaacaucugccugaaaaguacaugaugaauagcgugcuugagaacuuuacaauucugcaggucgugaccuccagagacucucaggaaacacuccugguuaucgccuucguguuugaggucagcaccuccgagcacggggcucaacaccauguguauaaacuggucaaggauuga

SEQ ID NO: 76721 - RNA, 1305 nt, Artificial Sequence
  derived and/or modified sequence opt5 from TEAD4__Homo_sapiens__NP_003204
auggagggcaccgccgggacaaucacgagcaacgaaugguccucucccaccagcccugagggauccacagcuucuggcgggagccaggcccuggacaagccgauugauaaugacgcggaaggaguguggucccccgauaucgagcaaucuuuccaggaagcucucgccauuuacccucccugcggcagacggaaaaucauucugagcgacgaggggaagauguauggacgcaacgagcuuaucgccagauacaucaaacugcggaccggcaagacacgcaccagaaaacaggucuccagccacauucagguucucgcucggcgcaaggccagagaaauccaagcuaagcugaaagaucaggccgcgaaggacaaagcccuucagucuauggcugccauguccagcgcucagauuaucucugccacagcguuucauuccagcauggcccuggcucggggcccugggcgccccgccgugucuggauucuggcaaggcgcucucccugggcaggccggaaccucccacgaugugaagccguuuagccagcagacguaugccguccaacccccucugccccugccuggcuucgagucccccgcugggccggcgccuucucccagcgccccucccgcucccccuuggcagggaagauccguggccagcucuaaacucuggaugcuggaauuuuccgccuuccuugagcagcaacaggacccggauaccuacaauaagcaucuguuuguucacauuggccagagcucucccagcuauuccgacccuuaccucgaggcuguggauauccggcagauuuaugacaaguuccccgaaaagaagggcgggcugaaagaucuuuuugagcgcggaccuucuaacgccuucuuucuggucaaguucugggcggaccucaauacaaacaucgaagacgagggcagcuccuuuuacggggugagcucucaauacgaaucccccgagaauaugaucauuaccuguagcacaaaaguuugcucuuucggaaaacagguggucgagaaaguggaaaccgaguaugcuagauacgaaaacggccauuauuccuaccggauccaccgcagcccgcugugugaguauaugauuaauuucauccacaagcugaagcaucucccugaaaaauacaugaugaacuccgugcuggagaauuuuacgauucuucaggucguuacaaacagagauacccaggagacacugcucugcaucgccuauguguucgaagugucugccagcgagcacggggcucaacaucacaucuaccggcuggucaaggaauga

SEQ ID NO: 76722 - RNA, 1896 nt, Artificial Sequence
  derived and/or modified sequence opt5 from TEC__Homo_sapiens__XP_011512038
augaacuucaauaccauccuggaggaaauucucaucaagagaagccagcaaaagaagaaaacaucuccccugaacuacaaggagcggcuuuuugugcugacgaaauccaugcucaccuauuacgaaggccgcgccgagaagaaguauagaaaaggguucauugacgucagcaagaucaaaugcguugaaauugugaagaaugaugacggagugaucccuugucagaacaaauacccguuucaggucgugcacgaugcuaauacacuguauaucuucgcccccuccccucagucucgggaccuuuggguuaagaagcugaaagaggagauuaagaacaauaacaauaucaugauuaaauaccaucccaaguuuuggaccgauggcagcuaucaaugcugucgccagacagaaaaacucgcgccugggugcgagaaguacaaccuguucgaauccucuaucagaaaagcucugcccccugccccggagaccaagaagcggagacccccucccccuauuccccucgaggaagaggacaauagcgaagagaucguggucgccauguacgauuuucaggcugccgaaggacacgaccugcgccuugagcggggccaggaguaucugauucucgagaaaaacgaugugcauugguggcgcgcuagagacaaguacgggaaugaaggauauaucccguccaacuacguuacaggcaaaaagagcaauaaccuggaucaauaugaaugguacugucggaacaugaaucgcucuaaagccgagcagcuucugagauccgaagacaaggagggcggguucauggugcgggauagcucucagccuggacucuauaccgucucccuguacacgaaguuuggcggggagggaagcucuggcuuccgccacuaccauaucaaagaaaccacaaccucccccaagaaauauuaccuggcggagaagcacgccuuugggagcauuccugaaaucauugaguaucacaaacauaacgcugccggacucgugacaagacugcgguaccccguguccgucaagggcaagaaugcucccaccacggccggcuucucuuaugaaaaaugggagaucaacccuagcgagcuuacauuuaugagagaacugggguccggacucuucggcguugugcgccuggggaaguggcgggcgcaguacaaaguggccauuaaggcuaucagagagggagccaugugcgaagaggacuucaucgaggaagcuaaagucaugaugaaacuuacccacccgaagcuggugcaacucuauggcguuuguacacagcagaaacccauuuacaucgugaccgaguuuauggaacgcgggugccugcugaauuuccuccggcaaagacagggacauuuuagccgcgacguccugcuuucuaugugucaggaugugugcgagggcauggaauaccuggagcggaacuccuucauucacagagaccucgccgcccgcaauugucugguuagcgaggcuggcguggucaaggugucugauuuugggauggcgcgguauguccuugacgaucaguacaccagcuccucuggagccaaauucccugugaaguggugucccccugaaguuuuuaacuauagcagauucuccagcaaaucugacgugugguccuuuggcguccugaugugggagguguucacagaagggcgcaugcccuuugagaaguacacgaauuaugaaguugugaccauggucacacggggacacagacucuaccaaccgaaacuggcuagcaacuauguguacgaggugaugcugcggugcuggcaggagaagccugaaggccgccccucuuucgaggaucuccugagaaccaucgacgaacuuguugagugcgaagagacauuugggcgguga

SEQ ID NO: 76723 - RNA, 3804 nt, Artificial Sequence
  derived and/or modified sequence opt5 from TECPR2__Homo_sapiens__NP_001166102
auggccagcaucuccgagcccgugaccuucagagaauuuugcccucuguacuaucuccugaacgcuauuccgacaaagauccagaaaggcuuccggucuauugucguuuaccuuacggcccuggacaccaauggggauuauaucgcggugggaagcuccauuggcaugcucuaccuguauugucgccaccuuaaccaaaugagaaaguacaauuuugaggggaaaacagaaucuaucaccguggucaagcugcucagcugcuucgacgaucugguggcugccggaacagccuccggccggguugcuguguuucagcuggucucuagccuccccgggcgcaacaaacagcugagacgguucgacgugaccggaauccauaaaaauuccauuacagcccuugcuuggagcccuaacggcaugaagcuguuuucuggcgaugacaaggggaagaucguuuauuccagccucgaucuggaccagggacuuuguaauucucaacuggugcucgaggaacccuccagcauuguccagcuggauuacucucagaaagugcugcucguguccacccugcagcgcagccuucuguucuacacggaggagaaguccgucagacaaaucggcacccagccucggaaaucuacagggaaguuuggagccugcuucauucccggccucuguaagcagagcgaccugacccuuuaugcgucccgcccugggcugagacucuggaaagccgauguucacggaacagugcaggcuaccuuuauccugaaggacgccuucgcuggcggcgugaaaccguuugaacugcauccccggcucgagagcccuaacucuggguccugcagccugcccgaacgccaccuuggacuggucucuuguuucuuccaagagggcugggugcucagcuggaaugaguacuccauuuaucugcuugauacgguuaaccaggccacaguggcggggcuggaaggaucuggcgacaucgucagcguguccugcaccgagaaugaaaucuuuuuccucaagggggacagaaacauuauccggauuagcucucgcccugagggacugacauccaccguuagagauggccuggaaaugagcggcuguucugagcgggugcauguccagcaagccgagaaacuccccggggcuaccguguccgaaacaagacugcgcggaagcuccauggccucuagcgucgcuuccgagccgcggucuagaagcuccagccuuaauucuacggacuccggcagcgggcugcucccucccggacugcaggccaccccugaacugggcaaggggucucagccccuuucccagcgcuuuaacgccaucagcucugaggauuucgaccaagaacucgugguuaaacccauuaaggugaagcggaaaaagaaaaagaaaaagacagagggcggaagcagauccacaugccacagcucucuggaguccaccccuuguagcgaauuuccgggcgauucuccccagucccugaauaccgaccuccugagcaugacguccucuguccuugggagcuccguggaucagcugucugcugagagcccugaccaggaauccagcuucaacggagagguuaacggcgugccccaagaaaauacagauccugagaccuuuaacguccucgaggugucuggguccaugcccgacagccuggcggaagaggaugacauccgcaccgaaaugccgcacugccaucacgcccauggacgggagcugcuuaauggcgcuagagaggacguugggggcucugaugugacaggacucggcgacgaaccuugccccgccgaugacgggccuaacuccacccagcugcccuuccaggagcaggauagcucuccuggagcccacgacggcgaagauauccaacccauugggccgcaguccacauuuugugaggucccucugcucaauagccugacggugcccuccagccuuucuugggcucccagcgccgaacaguggcugccuggaacccgcgcggacgagggcuccccgguggagcccucucaggaacaagauauccucacaagcauggaggcuuccgggcaccugucuaccaaccuguggcaugccgucacagacgaugacaccggccagaaggaaauuccuaucagcgagcgggugcuuggauccguuggcgggcagcucacgcccgugucugcccuggcugccagcacccacaaaccuuggcuggaacaacccccuagagaucagacacucaccuccagcgacgaggaggacauuuacgcucauggacugcccucuuccagcucugaaacauccgucaccgagcuuggcccgagcugcucccagcaggaucugucucgccucggggccgaagacgcgggacugcugaagccugaucaauucgccgagagcuggaugggcuauuccgggcccggcuacggaauccuuagccucgugguuucugaaaaauauaucuggugucuggacuacaagggcgggcuguuuugcuccgcucucccuggagccggccugcgguggcagaaauucgaggaugcugugcagcaggucgccgugagccccucuggggcgcuucuguggaagauugagcaaaagagcaauagagccuuugcuuguggaaaaguuacgaucaagggcaaacggcacugguacgaagcccucccgcaggcuguguucgucgcccuguccgacgauacagccuggauuauccgcaccucuggcgaccuguaucuucagacagggcugagcguggauagaccuugcgcucgggcggugaaggucgacugucccuacccucucucccagauuaccgccagaaacaauguugugugggcucugaccgagcaacgcgcccuccuguaucgggaaggagugucuagcuucugccccgagggcgagcaguggaaaugugauaucgucuccgaaagacaggcccuugagcccgugugcauuacacugggggaccaacagacgcucugggcucuggauauccauggaaaccugugguuucgcaccggcaucauuagcaagaagccucagggggacgacgaucacugguggcagguuucuaucacagacuacguggucuucgaucaauguucccuuuuucagaccauuauccacgccacacauagcguggcgaccgcugcccaggccccgguugaaaaaguggcugacaagcugagaauggccuucuggucccagcaacuccagugccagcccucucugcucggagucaauaacagcggcguguggauuuccucuggcaaaaaugaguuucacguugcgaaggggagccugaucggaacguauuggaaccauguggucccucggggcacagcuuccgccaccaaaugggccuucgugcuugcuagcgccgcucccaccaaggaagggucuuuucuguggcucugccaguccagcaaagaucuguguucuguguccgcccaaagcgcgcagucucgcccuagcacaguccagcugcccccugaggccgagaugagagcuuacgccgcuugccaggacgcccuuugggcccuggauucccucggacaaguuuucauccggacccugucuaagagcuguccgacaggcaugcacuggacgcgccucgaccugucccagcuuggggcugugaagcugaccagccuggcgugcggaaaucagcacauuugggccugugauuccagaggcggcguguauuuucgggucgggacacaaccccucaacccuucucugaugcuucccgcuuggaucaugauugaaccucccgugcagguuagccgcuccuga

SEQ ID NO: 76724 - RNA, 927 nt, Artificial Sequence
  derived and/or modified sequence opt5 from TECR__Homo_sapiens__NP_612510
augaagcacuacgagguggaaauccuggacgccaaaaccagagagaagcucugcuuccuggauaaagucgaaccccaugcuacaauugccgagaucaagaaccuuuuuacgaaaacccacccucagugguauccggcgcggcaaagccugcgccucgaccccaagggcaagucccugaaagaugaagacguucuucagaagcugccuguggggacaaccgcuacacucuacuucagagaucugggagcccagauuucuugggugaccgucuuucugacagaguaugccggcccccucuucaucuaccugcuguuuuauuuccgggugccuuuuauuuacgggcauaaauaugacuucaccagcucccgccacacgguugugcaucuugcuuguaucugccacucuuuucacuacaucaagagacuccuggagacccuuuucguccaucgguuuagccacggaacaaugccccugcgcaauauuuucaaaaacuguaccuacuauuggggcuuugccgcuuggauggccuacuauaucaaucauccucucuacacaccgcccaccuauggggcgcagcaagugaagcuggcccuggcuauuuucguuaucugccagcucggaaacuucuccauucacauggcccugagagaucuucggccugcuggcucuaagacgcgcaaaauccccuacccuacaaagaaucccuuuaccuggcuguuccuccuggugagcuguccgaacuauacauacgaagucggcuccuggauuggguuugccaucaugacccagugccuuccuguggcgcuguucagccucgugggauuuacccagaugacaaucugggccaaaggcaagcacagaucuuaccugaaagaguuccgggacuaucccccucugcgcaugcccauuauccccuuucuccuguga

SEQ ID NO: 76725 - RNA, 1092 nt, Artificial Sequence
  derived and/or modified sequence opt5 from TECRL__Homo_sapiens__NP_001010874
auguucaagagacacaaaagccuggccuccgagcggaagcgcgcucuccugucucagagagccacccgguuuauccuuaaagacgauaugcgcaacuuccauuuucugagcaagcucgugcuguccgcgggcccccuuagaccuacaccggcugucaaacacucuaagacgacccauuucgaaauugagaucuuugacgcccaaacacggaagcagauuugcauccuggauaaaguuacccagagcuccacaauucacgacgugaagcagaaauuccauaaggccugucccaaaugguacccuucucgcguggggcuccaacuggaaugcggaggccccuuucugaaggauuauaucaccauccagagcauugcugccuccagcaucgucacacucuacgcuaccgaccuggggcaacaggugucuuggacgaccguuuuccuugccgaguauacaggaccucugcucauuuaccugcuguuuuaucuuagaauccccuguauuuacgauggcaaggaauccgcgcggcgccucagacacccugugguccaccuggccugcuucugucauugcauccacuauauucgguaccugcucgagacccuguuugugcauaaaguuagcgcugggcacacaccgcuuaagaaucugaucaugucuugugccuucuacuggggauuuaccuccuggaucgcuuauuacauuaaccacccccucuauacgccucccagcuucggcaaucgccagaucacagugucugccauuaacuuccugaucugcgaggcgggcaaucauuuuauuaacgucaugcuuucccacccuaaucauaccgggaacaaugccuguuuccccagcccgaacuacaauccuuuuacauggauguucuuucugguguccugccccaacuauaccuacgaaaucggaucuuggaucagcuucaccgugaugacacagacgcucccugucggcauuuuuacccugcugauguccauccagaugagccucugggcucagaaaaagcacaaaauuuaucugagaaaguucaauucuuacauccaucggaaauccgccaugauucccuuuauccuuuga

SEQ ID NO: 76726 - RNA, 6468 nt, Artificial Sequence
  derived and/or modified sequence opt5 from TECTA__Homo_sapiens__NP_005413
augaacuacagcuccuuccugagaaucugggugucuuuuauuuucgcccugguccagcaccaagcucagccucgggagcugauguauccuuuuuggcagaaugacaccaagacaccgaagguugaugacggcagcuccucugaaaucaaacuugccauucccguguucuuuuucggggugccuuaccgcacggucuaugugaacaauaacggaguugugagcuuuaauguccuggugucccaguucacccccgagucuuuuccucucacagauggcagagcguucguugcucccuuuugggccgacgugcauaacgggauccggggagaaauuuacuaucgcgagaccauggaaccugccauccugaaaagagcuacaaaggauauccggaaauacuucaaggacauggccaccuuuagcgcuacaugggucuucauugugaccugggaggaggugacguucuauggcggguccagcaccacaccggucaauaccuuucaagccguucuugugucugauggauccuacacauucacccuguuuaacuacuaugaaaucaauuggacgacaggcaccgcgagcggcggggacccccucacaggacugggcggggugauggcccaggcuggauucaacggcgggaaucugaccaacuuuuucucucucccuggaucccgcacccccgagauugucaauauccaggaaacaacgaacgugaauguuccuggcagaugggccuuuaagguggauggcaaagagauugaccccgcuaacgggugcaccagccggggacaguuccugcgcagaggcgaggucuuuugggaugaccuuaacuguacagugaagugccggugucuggauuucaauaacgaaaucuacugccaagaggccucuuguuccccguaugaaguuugcgagccuaaagggaaguuuuucuacuguagcgcgguggaaaccuccacaugcgucguguuuggagagccccacuaucauaccuucgacggcuuccucuuucacuuccaggggucuugugccuaccugcuugcucgccagugccugcagacgagcucccuccccuuuuucagcgucgaggccaaaaaugaacauagacggggaucugcuguguccuggguuaaggagcugagcguggaagucaacggcuauaagauucugauccccaaaggcucuuacgggcgcgugaagguuaaugaccucgugacaagccugcccgucacccuugaucugggaaccgugaaaaucuaccaauccggcauuucuacagccguggagaccgacuuugggcuccugguuacauucgauggacagcacuaugccagcaucuccgucccuggcagcuacauuaacucuacgugugggcuuugcggcaauuauaacaagaauccgcuggacgauuuucucagacccgacggacggccugcuauguccgugcuggaucugggcgaaagcuggagaguguaccacgcggacuggaaaugcgauucugggugugucgacaacugcacccagugugaugccgcuacagaggcccucuauuucggauccgacuacugcggcuuucugaauaagaccgacgggccccuuugggaguguggaacagugguugauccuaccgccuucgugcauagcugcgucuaugaccuguguuccgugcgcgauaacggcacgcuccugugccaagcuauccaggccuacgcgcuuguuugucaggcucuggggauucccaucggcgacuggcggacccagacaggaugcgugucuaccguccaauguccgagcuuuucccacuacucugugugcacaagcuccugcccugauaccuguagcgaccucacggccucuagaaauugcgccacacccuguaccgaaggcugcgaguguaaccagggguucguucuguccacaagccagugcgugccucugcauaaauguggaugcgauuuugacggccacuauuacaccaugggggaguucuucugggcuaccgccaauuguacaguccagugccucugugaggaaggaggcgauguguauugcuuuaacaagacgugcgggucuggcgaggugugugcugucgaggacggauaccaaggcugcuuccccaagcgcgaaaccguuugucugcuuucccagaaccaggugcugcacacauuugauggggccagcuaugcguucccuucugaguuuagcuacacccuccugaaaacaugccccgaacggccggaguaucuggagaucgacauuaauaagaaaaagccugaugccggacccgcuuggcuuagaggccuccgcauccugguggccgaccaggaagucaaaauugggggaaucggcgcuuccgaggugaagcugaacgggcaagaaguugagcuccccuucuuucauccuagcggcaagcuggaaauuuaccggaauaaaaacucuaccacgguggaguccaagggagucgugacaguucaguacagcgacaucggccuucuguauaucagacucuccaccaccuacuucaauuguacagggggacugugcggcuuuuauaacgccaaugcgucugaugaguucugucugccgaacgggaaaugcaccgacaaucuugccguguuucucgaaagcuggacaacguucgaggaaauuuguaacggagagugcggcgaucugcugaaggcuuguaauaacgacuccgaacuccugaaauucuaccgcucucggagcagaugcggcaucauuaaugaucccuccaacucuagcuuucuugagugccacggggucgugaauguuaccgccuauuaccgcacaugucuguuccggcucugccaguccggaggcaacgagagcgaacugugugacucuguggcuagauaugccuccgccugcaagaacgcugaugucgagguggggccuuggcggaccuacgacuuuuguccccuggaaugcccugagaauagccauuucgaagaguguaucacaugcaccgagacgugugaaacccuuacacucggacccauuugcguggauucuuguuccgagggcugccagugcgacgaaggguacgcgcugcugggaagccaaugugucacccgcucugagugcggcuguaacuuugagggccaccagcucgccacaaaugaaaccuucuggguugaucuggacugccagaucuuuuguuauugcuccgggacagauaacagagugcauugugagaccauuccuugcaaggacgacgaauacuguauggaggaaggaggccuuuauuacugccaagcucggacggaugccagcuguaucguguccggguauggacacuaccugacauucgacggcuuucccuucgauuuucagaccagcugcccgcucauccugugcaccacagggucuagaccuagcuccgacucuuuccccaaauuugucgugaccgccaagaaugaggaucgcgacccuagccuggcucuuuggguuaaacagguggaugucacgguguucggauauuccauuguuauccaccgggccuacaagcauacagugcucgucaacucugagagacuguaccugccccucaaacugggccagggcaagauuaauaucuucagcuuuggguuccacguggucguggaaaccgacuuuggacuuaagguuguguaugauuggaaaacauuccuguccauuaccgucccgcgcucuaugcaaaacagcacauacggccucugugggagauauaauggaaacccugacgaugaccuggagaugcccaugggccugcuugcguccagcgugaaugaauuugggcagucuuggguuaagcgggacaccuucugccaggugggauguggcgaucgcugcccuuccugugcuaaagucgagggcuuuagcaaggugcagcaacugugcucucucauccccaaccagaaugccgccuucuccaaaugucauagcaaggugaaccccacguuuuucuacaaaaauugccuguuugacuccuguaucgaugggggagcuguucagaccgccugcucuuggcuccagaacuaugcgagcacaugucaaacccagggcauuacagucaccggguggagaaacuacacguccugcacagugaccuguccuccgaauagccacuaugaaucuugcguguccgucugccagccccggugugcugccauccgccucaagagcgacugcucucacuacuguguggagggaugccauugugaugccggcuacguucuuaacggaaagagcugcauucugccucacuccuguggaugcuauucugacggcaaauacuaugagcccaagcaacucuucuggaauagcgauuguacaagacggugccgcuguuuuagacggaacgugauccagugcgacccucgccagugcaaauccgaugaagagugugcucugagaaauggcguccgggggugcuucucuaccaagaccagcuacugucuggccgcuggaggcgggguguucagaacauuugacggagccuuccuucgcuuucccgcgaacugcgccuucguucuguccacgauuugucagaaacucccugauaucagcuuucaacugaucauuaauuucgacaaguggucugcuccgaaccucaccaucauuucccccguguauuuuuacaucaaugaggaacagauucugaucaacgaucggaauacagucaaggugaacggcacccagguuaaugugccuuucaucacagggcuugccaccaaaauuuauagcuccgaaggauuucuggucaucgacacgucucccgacauucagaucuacuacaacggcuucaaugugauuaagaucagcauuuccgagagacuccaaaacaaagugugcggccugugugggaauuuuaacggagaucugacagacgauuaugucacccuucgcggcaagccuguugugucuagcgugguccuggcucaguccuggaaaaccaacgggaugcagaagcggccccucgccccgagcugcaaugagcugcaguucucucaauacgccgcuaugugugacaacgugcauauccagaagaugcagggagauggcuauugccucaaacugacagacaugaagggguuuuuccagccuuguuacggacuucuggauccccugcccuucuaugaauccugcuaccucgacggcugcuauagccacaaaaaguuucaacuguguggcucucuugcggccuacggggaggcuugcagauccuucggaauccugagcaccgaauggauugagaaagagaauuguucuggcguuguggaagauccuugcgucggggccgacugucccaaccgcacaugcgagcucggaaauggccgggaacugugugggugcaucgagccuccgcccuacggcaacaauagccaugauauuaucgacgccgaagugacguguaaggcugcccagauggagguuuccauuucuaagugcaaacucuuucagcugggauucgagagagaaggcgugcgcaucaacgaucggcaauguaccgggaucgagggagaagacuuuauuagcuuccagaucaauaacacaaagggcaauugcgggaacauuguccaguccaauggaacccacaucauguauaaaaacacacuuuggauugagagcgcgaauaacaccggcaacaucaucacgagagaccggaccauuaauguggaauuuuccugcgcuuacgagcuggauaucaagauuucucuggacagcgucgugaaaccuaugcucuccguuaucaaccugacagugcccacccaggaggggucuuucauuacaaagauggcccuuuauaaaaaugccagcuacaagcacccuuaucgccaaggcgaagugguccugaccacaagagauguucucuacgugggaguguuugucgugggcgcugacgccacgcaucugauccucacccugaacaaguguuaugcgacacccacccgggauuccaaugacaaacuucgcuacuucauuaucgaaggcgggugccagaaccugaaggauaauaccaucgggauugaagagaacgcuguuucucugacauguagauuucacgugacggucuucaaauuuaucggggacuacgaugaagugcaucuccacugcgccgucagccugugugacuccgagaaguauagcugcaaaauuaccuguccgcauaauucucggaucgccacagauuacaccaaggagccuaaggaacagauuaucuccgugggacccaucagacgcaaacggcuugacuggugcgaggacaacggcgggugugaacagauuugcacaagcagaguugauggcccucuguguucuugcgugaccggaacgcuccaagaggacggcaaguccugccgcgcuagcaauucuuccauggagcugcaggucuggacacuccugcuuaucaugauucagaucagccuguggcacuucguguauaaauccgggaccaccagcuga

SEQ ID NO: 76727 - RNA, 822 nt, Artificial Sequence
  derived and/or modified sequence opt5 from TEF__Homo_sapiens__NP_001138870
auggacaugcccgaggugcucaagagccugcuggaacacucccuuccuuggccggagaaaagaaccgauaaggaaaaaggcaaggagaaacuggaagaggacgaggccgcugccgcgucuacaauggcugucagcgccucccucaugcccccuaucugggauaagacgauucccuacgacggggaaucuuuccaucuggaguauauggaucuugacgaauuucugcucgagaacggaaucccugccagccccacccaccuggcucauaaucugcuccugccuguugccgagcuugaaggcaaggaguccgcuucuagcuccacagccagcccgcccucuuccagcaccgcgauuuuccagccuucugaaacaguguccagcaccgagucuucccuggaaaaagagcgggagacacccagcccuaucgaucccaacugcguggaagucgacgugaauuuuaacccggauccugccgaccucguucuguccucugugcccgggggagagcuuuucaauccucgcaagcacaaauuugcugaagaggaucugaagccccaacccaugauuaaaaaggccaagaaagucuucgugccugacgaacagaaggaugagaaauacuggaccagacggaagaaaaacaauguugcugccaagcgcagcagagacgcgcggcgccucaaagagaaccagaucacgaucagagccgcuuuucuggaaaaggagaauaccgcccugcggacagaaguggcugagcuccgcaaggaagucggcaaauguaagaccauuguguccaaauaugagacaaaguacgggccgcuguga

SEQ ID NO: 76728 - RNA, 1083 nt, Artificial Sequence
  derived and/or modified sequence opt5 from TEFM__Homo_sapiens__NP_078959
augagcggcuccgugcuguucaccgccggggagagauggcggugcuuucucacacccucucgcagcucccuguacugggcccuucacaacuucuguugcagaaagaaaucuacgaccccuaagaaaaucacaccgaaugucaccuuuugugacgaaaacgcuaaggagcccgaaaaugcgcuggauaaacucuucagcuccgagcagcaagcuagcauucugcauguucuuaacacagccagcaccaaggaacuggaggccuuucggcuccugcgcggaagacgguccaucaauauuguggagcaccgcgaaaacuucggcccuuuucagaaucuggagagccucaugaacgugccccuguucaaguauaaaucuacaguccaggugugcaauuccauccuuuguccuaagaccgggagagaaaaacggaagucucccgagaaccgcuuucugagaaaacuccugaagccugacauugagcgggaacgccuuaaggcuguuaauucuaucaucuccauuguguucggaacgagacggaucgccugggcucaucuggaucgcaaacucaccguccuggacuggcagcaaagcgauagauggucucugaugcggggcauuuacuccagcuccguguaucucgaggaaaucucuagcauuaucuccaagaugccgaaagccgacuuuuacguucuggagaagacagggcuuagcauucagaacucuucccuguuccccauccuccugcacuuucauaucauggaagcgaugcuuuaugcccugcucaauaaaaccuucgcucaggauggacagcaccaagugcugagcaugaacagaaaugccgucggcaagcacuucgagcugaugauuggcgacucucgcacaagcgggaaagagcucgugaagcaguuucuguucgauuccauccuuaaggcugacccucggguguuuuuccccucugauaaaauuguccauuacagacagauguuucugagcaccgaacuccagcgcguugaggaacuguaugacucccuucugcaagccaucgcguucuacgagcucgccguguuugauagccagccuuga

SEQ ID NO: 76729 - RNA, 3375 nt, Artificial Sequence
  derived and/or modified sequence opt5 from TEK__Homo_sapiens__NP_000450
auggacagccuggccucccucgugcugugcggcgucucucuucugcucagcgggaccguugagggagcuauggaucugauccuuauuaacucccugccccucgugucugacgccgaaacaagccugacguguaucgcguccggcuggagaccucacgagccgauuaccaucgggcgggauuucgaagcucugaugaaucagcaucaagacccccucgaggugacacaggaugucacccgcgaaugggccaagaaagugguuuggaagagagagaaagccucuaagauuaacggagcuuacuuuugcgagggccgggugcgcggggaagccaucagaauccggacaaugaaaaugcgccagcaggcuagcuuccugccugccacccuuacaaugaccgucgacaagggagauaaugugaacauuuccuuuaagaaaguucugaucaaggaggaagacgcggugauuuauaaaaauggcagcuucauccacucuguccccagacaugaggugccugauauucucgaggugcaucugccccacgcccaaccucaggacgcuggcgucuacuccgcccgguauaucgggggaaaccuuuuuacgagcgcuuucacccgccugauuguuagacggugugaagcccagaaguggggcccggagugcaaucaccucuguacagcgugcaugaacaauggggugugucacgaagauaccggagagugcaucugucccccuggcuuuauggggcgcacaugcgaaaaagccugugagcugcauaccuucggaagaacgugcaaggagcggugcucuggccaggaaggcuguaaguccuacguguuuugccugcccgacccuuauggguguagcugcgcuacaggauggaaaggccuccaauguaacgaggccugccaccccggguucuacggaccggauuguaagcugcgcugcucuuguaauaacggcgaaaugugcgacagauuucaggggugucuuugcuccccuggauggcagggccugcagugcgagcgggaaggcauccccagaaugaccccuaaaauugucgaccuccccgaucauaucgaggugaauagcgggaaguucaaccccauuuguaaggcuuccggauggccucugccgacaaaugaggaaaugacccuuguuaaacccgacggcaccgugcugcacccuaaagauuuuaaccacacagaccauuucucugucgccaucuucacgauucaccgcauccugcccccugauagcgggguguggguuugcuccgugaacaccgucgccggaaugguggagaagcccuuuaauaucagcgucaaggugcucccgaaaccucugaacgcucccaauguuauugacacaggccauaacuucgcggugaucaauauuucuuccgaaccuuauuuuggggauggccccaucaagagcaaaaagcuccuguacaaaccugucaaccacuacgaggccuggcaacauauucaggugaccaaugaaaucguuacacuuaacuaucuggagccccggaccgaguacgaacucugugugcagcuggucagacgcggagagggcggggaaggacacccgggcccugugcggagauucacgacagcuucuaucgggcuuccgcccccucgcggacugaaucuccugcccaagagccaaaccacccugaaccucacauggcagcccauuuuuccuuccucugaggacgauuucuauguggagguugaacggagaagcguccagaaguccgaccagcaaaauaucaaagugcccggcaaccugaccagcgugcuucugaauaaccuccacccucgcgagcaguacgucgugcgggccagaguuaauacaaaggcccagggggaauggucugaggaucugacggcuuggacccuguccgacauucuucccccucagcccgaaaacaucaaaauuagcaacaucacacauucuuccgccgugauuagcuggaccauccucgacggcuauuccaucucuagcauuacaauccgcuacaagguccaaggcaaaaaugaggaucagcacguggacguuaagauuaagaacgcgaccaucacgcaguaucagcugaaaggacuggagccggaaaccgcuuaccaaguggauauuuuugccgagaauaacaucggguccucuaauccugccuucagccaugaacucgucacacugcccgagucccaggcuccugccgaccuuggaggcgggaagaugcugcucaucgcuauucugggaagcgccggcaugaccugccugacagugcuucucgcguuucugaucauucugcagcucaaacgggccaacguucagagacggauggcucaagccuuccagaaugugcgcgaggaacccgcuguccaguuuaacucugggacccuggcccuuaauagaaaggugaaaaacaauccggauccuacgaucuaccccgugcuggacuggaacgauauuaaguuccaagacgucaucggcgagggaaauuuuggccagguucucaaggcgcggaucaaaaaggaugggcugagaauggacgccgcuauuaaacgcaugaaggaauaugccuccaaagaugaccaccgggauuucgcuggagagcuggaagugcuuuguaagcucggccaccauccuaacaucauuaaucugcugggggccugcgagcacagaggauaccucuaucuggccaucgaauacgcuccccauggcaaccuucuggacuuccuccgcaaaagcagagugcuggagacagaccccgcguuugccauugcuaacucuaccgccuccacacugagcucucagcagcuucuccacuucgccgcugaugucgcccgggggauggacuaucugagccaaaagcaguuuauccaucgcgaucuggcggcuagaaauauccucgugggcgagaacuacguugccaagauugccgacuucggacugucccggggccaggaaguguaugucaaaaagaccauggggcgccuuccugugagauggauggcuaucgagagccugaauuacucuguuuacaccacaaacuccgauguguggagcuauggaguccuccugugggaaauugugucccugggcgggacgccguacuguggaaugaccugcgccgagcuuuaugagaaacugccccagggcuaccggcucgaaaagccucugaauugugacgaugagguuuaugaccucaugcgccaaugcuggagagaaaaacccuacgagcggccuucuuuugcgcagauccuggugagccuuaaccgcaugcuggaagagagaaagacauaugucaauaccacacucuacgagaaguucaccuacgcuggcauugauuguuccgccgaagaggccgcuuga

SEQ ID NO: 76730 - RNA, 1257 nt, Artificial Sequence
  derived and/or modified sequence opt5 from TEKT1__Homo_sapiens__NP_444515
auggccaagcugcuccagcccccuccgaaauuccugcccagcgaguggcacaucgcuaacaagaaucaauaccauagagccgacgcgcagcggucccgcucugaaagacuuguggcugagagccagcggcuggucgaugaaauugagaaaaccacacgcaagucccagucugacguuaacaaaaagcucgaacaaagacuggaggaggugcaguuuuggaagaaagaacuugaugacaagcuggagcagcucgugaaugucacggaugaccugcugaucuauaaaauucggcucgaaaaggcccuggagacccuuaaagagccucugcacaucacagaaaccugccucgccuaccgcgagaagagaauuggcaucgaucuggugcaugacacaguugaacacgagcuuaucaaggaagcugagauuauccaggggauuauggcccugcucacccggacacuggaggaagcuagcgagcaaauccgcaugaacagauccgccaaauauaaucuggaaaaggaucucaaagacaaguucguggcgcugaccauugaugacaucuguuuuucucuuaacaauaacagccccaauauucgguacuccgagaacgccguccgcaucgaaccuaauagcgugucucuggaggauuggcucgacuucuccagcacgaacguugagaaagcugacaagcagagaaauaacucucugaugcuuaaagcccugguggaucggauccucucccagaccgcuaaugaccugcgcaagcagugcgaugucguggacacagccuuuaagaacggacugaaagauaccaaggacgcgagagauaaacucgccgaccaucuggcuaaggugauggaagagauugccagccaagagaaaaacaucacagcucuugaaaaggccauucuggaucaggaaggccccgccaaggucgcucacacccggcucgagacgagaacacaccgcccuaauguugagcugugucgggacguggcgcaguauagacuuaugaaagaagugcaagagaucacccauaacgucgcccgccugaaggaaacacucgcucaggcccaggccgagcugaaagggcugcaccggagacagcucgcucugcaagaggaaauucaggugaaggagaauaccaucuacaucgaugaaguucuuugcaugcagaugcgcaaaucuauuccgcugcgggacggagaggaccauggcgugugggccgggggacucagacccgaugcggucuguuga

SEQ ID NO: 76731 - RNA, 1458 nt, Artificial Sequence
  derived and/or modified sequence opt5 from TEKT5__Homo_sapiens__NP_653275
auggaguuccugggcaccacacagacggccagcuacugcgggcccaagaaauguugcggacucaccucccugccugcugugcaagccccggucauccaggaauguuaucagcccuacuaucuuccuggcuacagauaucugaacucuuggcggcccagccucuuuuacaagauugcgaauguucagacaugcccugacgaguccaccucuacacugagacccccuaccauccuuccgacacugcgcagcgcucucuucucccgguauucuccccacgauugggaccaaagcaaccagcuccaggugcgcggggccgaagccuccagacugugggcuagccggcugaccgaugacucuaugcgccugcuucaggauaaagaccaacugacgcaucagaugcaggagggaaccuguagaaaucucggccagcggcuguccgauauuggguuuuggaaaagcgaacuuucuuacgagcuggaccgccuccugacagagaaccaaaaucuggaaaccgugaagagacggcucgagugcgccgcuaacgaagucaauuguccucuucagguggcccuggagugccuguaccaccgcgagaagagaaucggaauugaucucguucaugacaacguggaaaagaaucugauccgggaggucgaucuucugaaauguugccaggaacaaaugcgcaagcucgcgcagagaaucgacauucagaugcgggauaacagagacgcccagcacgugcuggagcgcgaccuggaagauaaauccagcgcucaauguaucgacgagaagugcuucaaucuccggaacacaucugauugcauuuccuuuuuccauggcauggagaaaaucgacggcaccauuagcguucccgaaacgugggccaaguuuuccaaugauaacaucaagcacucucagaauaugagagcuaacagcauucagcugcgcgaggaagccgagcaccuuuucgaaacacuguccgaccagauguggcggcaauuuaccgauacaaaccucgcguucaaugccagaaucagcgaggugaccgacgucaaaaacaagcugcagacccagcuugcuaaaacacugcaggagaucuuucaagccgaaaauacgauuaugcuccuggagcgcucuaucauggcuaaggaagggccucugaaaguggcccagacccggcucgaguguagaacacgccggcccaacauggaacugugcagagauauuccgcagcuuaagcuggugaaugaggucuucaccaucgacgauacacuccagacccugaaacugcgccuucgggagacgcaagacacacuccagcugcugguuaugaccaaguguagacucgaacaugagcuggccauuaaggcuaacacccuuugcaucgacaaagaaaaguguaugggaaugcggaaaacauuuccuugcacaccccgccuggugggccacaccuga

SEQ ID NO: 76732 - RNA, 2514 nt, Artificial Sequence
  derived and/or modified sequence opt5 from TELO2__Homo_sapiens__NP_057195
auggagcccgccccuagcgaagugagacuggcuguccgggaggccauccacgcgcucuccucuagcgaagacggcgggcauauuuucugcacccuggagucccuuaagcgcuaccugggagaaauggagccgcccgcucucccuagagagaaagaagaguuugccucugcccacuucagccccguucugcggugucuugcuucccgccugucuccugccuggcucgaacugcugccccauggcagacucgaggagcugugggcuagcuuuuuccuugaagggccugccgaucaggcguuucuggugcucauggagacaaucgaaggagccgcuggcccguccuuccggcugaugaagauggcccgccuucuggcuagauuucuccgggaggggcgccuggccgugcugauggaagcgcaaugcagacagcagacgcagcccggauucauucuccugcgggagacccuucugggcaaagucguggcccucccugaccaccugggcaaccgccuucaacaggagaaucuggcugaauuuuucccccagaacuauuuuagacuccugggggaggaaguugugcggguccugcaggccgugguugauagccuccaaggaggccuggacucuuccgugagcuucgucucucaggugcuugggaaggcuugugugcauggacgccagcaggagauccugggcguccucguuccuagacuggccgcccuuacacaaggguccuaccugcaccagcgggugugcuggagacucguggaacagguccccgaucgcgcuauggaggcggugcugaccggacugguugaggccgcucucggcccggaagugcugagccggcuucugggcaaucucgucgugaaaaacaagaaggcccaauuuguuaugacacagaaacugcuguuccuucagucuagacucaccacaccuaugcugcagucccugcucgggcaccuggccauggacagccaacgccggccccuucugcuccaggugcugaaggagcugcuugaaaccuggggauccucuagcgcuauuagacauacgccucucccccagcagcgccacgucuccaaagccgugcugaucugucuggcgcaacucggcgagcccgaacugcgggauagcagagacgagcuucuggcuucuaugauggccggggucaagugccgccucgauuccagccugccuccggugcggagacugggaaugaucguugccgagguggucucugcucgcauucaucccgaaggcccuccccuuaaauuccaguaugaggaagacgagcucagccuggagcugcucgcccuggcuuccccucagcccgccggggauggagcgucugaagccggcaccagccuugugccggcuacagccgagccucccgcugaaaccccugccgagaucguugacggcggggugccccaggcgcaacuggccggauccgauagcgaccucgacucugaugacgaauuugucccuuacgauauguccggcgaccgggagcuuaagagcucuaaggcucccgccuaugugagagauuguguggaggcucugacaaccuccgaagacauugagcggugggaagccgcccugcgcgcucucgaggggcugguuuacagaagcccgacggcgacacgggaagucuccguggagcuggccaaagugcuccugcaccuugaggaaaagaccugcgucgugggauucgcuggccugagacagcgcgcccucguugccgugacagucaccgauccugcucccguggccgacuaucugaccucucaguuuuacgcgcugaauuacagccuucggcagagaauggauauccuggacguucucacacuggcugcccaagagcucucccgccccgggugucugggcagaacgccucagccgggaucucccagcccuaacacccccugccuuccugaagccgcugugucccagcccggcagcgccgucgcgucugauuggcgggugguuguggaggaacgcauuagauccaaaacacaacggcugagcaaagggggaccucgccagggccccgcugggucuccguccagauucaauagcgucgccggacacuuuuucuuuccucuccugcagcgguucgaccgcccccuggugaccuuugaccuucugggcgaggaucagcucgugcuggggagacucgcccauacacugggcgcucuuaugugucuggccgucaacaccacgguugcuguggccaugggaaaggcgcuccuggaguucgugugggcccugcgguuucacaucgacgcuuauguccgccaaggccuucugucugccgugagcuccguucuccugagccucccugcugccagacugcuugaagaucugauggacgagcugcucgaagcccggucuuggcuggcugauguggcggagaaggaccccgaugaggacugcagaacacuugcccugcgcgcucuccugcuccugcagcggcuuaaaaauagacugcugccgccugccucccccuga

SEQ ID NO: 76733 - RNA, 8178 nt, Artificial Sequence
  derived and/or modified sequence opt5 from TENM1__Homo_sapiens__NP_055068
auggaacagaccgacugcaagcccuaccaaccucugcccaaagugaagcacgaaauggaccucgccuauaccuccuccucugacgagagcgaagauggcagaaaaccccggcaguccuacaacucucgcgagacgcugcaugaauauaaucaggagcuuagaaugaacuacaauagccagucccggaagcgcaaagaggucgaaaagucuacccaagagauggaguucugugagaccagccacacccugugcuccggguaucagacagacaugcauagcguuucuagacacggguaccagcucgagaugggcuccgauguggacaccgaaacagagggggcugccagcccugaucaugcgcugcggauguggauccgcggaaugaagucugaacacuccagcugucuuucuuccagagcuaacagcgcccugucccucaccgacacggaucacgagcggaaaucugacggcgaaaauggguuuaaguucagccccgugugcugugauauggaggcccaggcuggauccacccaagacguccagagcucuccucauaaccaguuuacauuccgcccccugccuccgcccccucccccuccccacgccugcaccugugcuagaaaaccgccucccgccgcggauucccugcagcggcgcagcaugacaaccagaucucaaccuagccccgccgcucccgccccuccgacguccacacaggacucugugcaucuccacaauagcuggguucugaacuccaauauuccccuugagacccggcacuuucuguucaagcauggcagcggaucuagcgcuaucuuuagcgccgcgucucagaacuauccucucacauccaauaccguguacucucccccuccccgcccgcugccuagauccaccuucucccggcccgccuuuacauucaacaaaccuuacagaugcuguaauuggaagugcacggcucuuagcgccaccgcuauuacagucacccuggcccuccugcuggccuaugugaucgcuguucaccucuuugggcugacauggcaacuucagcccguggaaggagagcuguacgcgaacggcgucuccaaggggaaucgcggaaccgaaucuauggacacgacauauagcccuauuggcgggaaaguguccgauaagagcgagaaaaagguguuccagaaaggacgggccaucgacaccggcgaagucgauaucggcgcucagguuaugcaaaccauucccccggggcucuuuuggagauuccagaucacaauucaucacccuaucuaccugaaguucaacauuucucuugccaaagacucccugcucggaaucuauggccgccggaacauuccgcccacccauacacaguuugauuucgugaagcugauggacgggaagcagcuggugaaacaagauagcaagggaucugacgauacgcagcacuccccuagaaaucucauccugaccagccuucaggagacaggcuuuaucgaguacauggaccaggggccgugguaucuggccuucuacaacgauggcaagaagauggaacaagucuuugugcucaccacagcuauugagaucauggacgacuguucuaccaauugcaacggcaauggcgaaugcauuagcgggcacugucauugcuuccccggauuucugggcccugauugugcccgcgacuccugccccguucuuugugggggaaacggcgaguacgaaaaagggcacugcgugugucggcauggcuggaagggaccugagugcgauguccccgaggaacaguguaucgacccuacgugcuucggccacgggaccuguauuaugggagugugcaucugcguucccggcuauaagggggagaucugugaagaggaggauugccuggacccgauguguagcaaucacggaauuugcgugaaaggcgaaugucauugcucuacaggguggggcggagucaacugugagaccccucuccccgugugccaggaacaguguuccggccacgggacauuucugcuggaugcgggagucugcagcugugacccuaaguggaccggcuccgauugcucuacggagcucugcacaauggaaugugggagccauggagugugcuccagaggcaucugucaaugcgaggagggguggguuggccccaccugugaagaacgcucuugccacagccauuguacagaacacggacagugcaaagacggcaagugugagugcuccccggggugggaaggagaucacuguaccauugcucauuaccuggacgccgugcgggauggcugcccugggcuuugcuucggaaauggcagauguacccuggaccagaacggguggcacugcgucugucaagugggcuggucuggaacaggcugcaauguugugauggagaugcucuguggggacaaccuggauaaugacggagauggccugacggacugcgucgaucccgacuguugccagcagagcaacuguuauaucuccccucuuugccaggggagccccgauccccucgaccugauucaacagucucagacccuguuuucccagcauacaagccgccucuucuacgaucggaucaaauuucugaucggaaaggacucuacccacgugauuccuccggagguguccuucgauagcagacgggccuguguuauccgcggccaagucguggcuauugacggcacaccccuugugggggucaaugugucuuuccugcaucacuccgauuauggauuuaccaucagcagacaggacggcuccuucgaccucguugccauugggggaaucagcgugauucugaucuuugaucggucuccuuuccugcccgaaaagagaacgcuuuggcucccuuggaaccaguuuaucgucguggagaaaguuacaaugcagcgcguggucagcgaucccccuuccugcgauauuucuaacuucaucagcccgaaucccauugugcugccuagcccccugaccucuuuuggcgggagcugcccugaacggggaaccaucguucccgagcuccaagugguccaggaagagauuccgaucccuuccucuuucgugagacugagcuaccuuuccagccgcacacccggcuauaagacccugcucagaauccugcugacacacucuacgauucccgugggcaugaucaaaguccaucuuaccguugcuguggaggggcggcucacacagaagugguuuccugccgcgauuaaccugguguacaccuucgccuggaauaaaacagacaucuacggacaaaaggucuggggccuggcugaagcccucguguccguuggguaugaguacgaaaccugucccgauuuuauucugugggagcagcgcacggugguccuucagggauucgagauggacgcuagcaaccugggcggguggucucucaauaagcaccauauccugaacccucaguccggaaucauucacaaaggcaauggcgaaaacauguuuaucagccaacagccgcccgugauuuccaccaucauggggaauggacaccagagaucuguugccugcacaaacuguaauggcccugcgcauaacaauaagcuguucgcccccguggcucuugccagcgggccugauggauccgucuaugugggcgacuucaacuuuguucggcgcauuuuccccagcggaaauucuguguccauccucgagcugagcaccucuccggcucacaaauacuaucuggccauggauccugucagcgaaucccucuaccugucugacacaaacaccagaaagguguauaaacuuaagagccugguggagacaaaagaucucuccaagaacuuugaagucguugccggaaccggcgaccagugccugcccuucgaccaaucucauuguggcgaugggggacgggcuagcgaggcgucccugaauagcccucgcggcaucacgguggacagacacggguuuauuuacuucguggauggaacaaugauccggaagauugacgagaacgccgucaucaccaccgugauuggcucuaaugggcuuacauccacccagccccugagcugcgauuccggaauggacaucacgcagguucgccucgaauggccuacagaucuggcugugaaccccauggacaauucucucuacguccuggauaacaauauugugcuucagaucagcgagaacagacggguuagaaucauugccggccgcccgauccauugucaagugccuggcauugaccacuuucuggucuccaaaguggccauccacucuacccucgaaagcgcucgggccauuuccgucagccauucugggcugcuguucaucgcggagacagaugaaagaaaggugaaucgcauccagcagguuaccacaaacggagagauuuauaucauugcuggcgcccccaccgacugcgauuguaaaaucgaccccaauugcgacuguuuuuccggggauggaggcuacgccaaggacgcuaaaaugaaggccccuagcucucuugcgguguccccggaugggacgcuguaugucgcugaccucggaaacgugcggauuagaaccaucagccgcaaucaggcccaccugaacgauaugaauaucuacgagauugccucucccgcugaccaagaacucuaucaguucacaguuaacggcacccaucugcacacacuuaaccugaucacccgggauuacguguauaauuuuacguacaacagcgagggcgaccucggggccauuacauccucuaauggaaacagcguccacaucagacgcgaugcuggcgggaugccucuguggcugguggugcccggaggccagguuuacuggcuuaccauuuccagcaaugggguccugaagcggguguccgcccaaggauauaaccucgcgcugaugacauacccuggcaauaccggccuccuggccaccaaaucuaacgaaaauggguggacaacgguguaugaguacgaccccgaaggacaucuuaccaacgcuacauucccuaccggcgaggucagcuccuuccacucugaucuggagaagcugacaaaaguggaacucgacaccagcaauagagagaacguucugauguccacgaaucuuacagccaccucuaccaucuauauucugaagcaggaaaacacacagagcaccuaccgggugaauccggaugggucccuccgcgucacauuugcuagcggaauggagaucggccugucuuccgagccccauauccucgccggggccgugaacccuacgcugggcaaaugcaauauuagccuucccggagaacacaacgcuaaccugaucgaguggagacagcggaaggaacaaaauaagggcaacguuucugcguucgagcgcagacugcgggcccauaauagaaaccuccuguccauugacuuugaccacaucacccgcacagggaaaauuuaugaugaccaccggaaguucacccuuagaauccuguacgaucagacaggacgcccuauccucuggagccccgugucucgguacaaugaagucaacauuaccuauuccccgagcggccuggugacguuuauccagagagggaccuggaaugagaaaauggaguacgaccaguccggaaagauuaucagccgcacaugggcugauggcaaaauuuggucuuauaccuaccucgaaaagagcguuaugcugcuucugcauucccaacggagauauaucuucgaguacgaccagccugauugccugcucucugugacaaugcccagcaugguccgccacucccugcagaccaugcuuucugugggguauuacagaaacaucuacacacccccugacagcuccacgucuuuuauucaggauuauagccgggacggccgccugcuccaaacccugcaucucggaacaggcagacgggugcuguacaaguauaccaaacaggcccgccuuuccgaaguccuguacgauaccacacagguuacgcugaccuaugaggaaagcucuggggugaucaagacaauucaccucaugcacgacggauucaucuguaccauuagauaccggcaaacaggcccccugaucgggagacagauuuuucgcuucuccgaggagggacuugugaaugcccgguuugacuauagcuacaacaauuucagagucaccucuaugcaggcugugaucaacgaaacgccucugccgaucgaucucuaccgcuauguugacguguccggccggacagagcaguuugggaaauucagcgucauuaauuacgaucugaaccaagugaucaccaccacaguuaugaagcauaccaaaauuuucuccgccaauggccaggugaucgaaguccaguaugagauucugaaggcgaucgcuuacuggaugacaauccaguaugacaacgugggaagaauggucauuugcgauauccgggugggcguugacgccaacauuacccgcuacuuuuaugaauacgaugccgacgggcaacuccagacggugucugugaaugauaaaacacaguggagauacagcuaugaccuuaacggaaauaucaaccugcugucccacggcaagagcgcucggcucacaccccugcgcuacgaucuuagagaccggauuacacgccugggggagauccaguauaagauggaugaggacggauuccucagacaacggggcaaugacaucuuugaauacaacucuaauggccugcugcagaaagccuauaacaaggcguccggguggaccguccaguacuauuacgauggacucggccgcagaguugcuagcaaaucuagccuugggcagcaucugcaauucuuuuacgccgaccugacgaauccuauucgggugacccaccucuauaaccauacauccucugagaucaccagccuguacuaugaucuucagggacaccugauugccauggaacucuccucuggcgaggaguacuauguggcuugugacaauacagggacaccccuggccgucuucagcuccagaggacaggugaucaaggaaauucuguacacaccuuauggcgauaucuaccacgacaccuaccccgauuuucaaguuauuaucggcuuccaugggggacucuaugacuuucuuacgaaacuggugcaccugggccagcgcgauuacgacgucguggcugggcgguggacaaccccgaaccaucacaucuggaagcagcucaaucugcuuccuaagcccuucaaccuguauagcuuugagaauaacuacccugucggaaaaauucaggauguggccaaguauaccacagacaucagaucuuggcucgaacuguucggcuuucaacugcauaacguucuccccggguucccuaaacccgagcuugaaaaucuggagcugaccuacgagcuccugcgccuucagacaaagacgcaggaaugggacccgggaaaaaccauucugggcauccagugcgagcuccaaaagcagcugcggaacuucauuucccuggaucagcucccuaugacacccagauauaaugacggccgcugucuugaagggggaaagcagccccgguuugcggccgugccuagcgucuucggcaaagggaucaaguuugcuaucaaagauggaauugugaccgccgacaucauuggcguugcuaacgaggauuccagacgccuggccgccauccugaauaacgcucacuaccucgaaaaucugcacuucacaauugaggggcgggacacccauuacuuuaucaaacuuggaucucuggaggaagaucucgugcugaucggcaacacgggcgggagacgcauucuggagaauggagucaacgugaccgugagccaaaugacauccguucucaauggccggaccagacgcuucgcggacauccagcuucagcacggggcccugugcuuuaacauuagauauggaacaaccgucgaagaggagaaaaaucaugugcuggagaucgcucggcaacgcgccguggcccaggcuuggacgaaggagcagagacggcuccaggaaggcgaggaagggauuagagccuggacagagggagagaagcaacagcugcuuucuaccggccggguccagggcuacgauggguauuucguucugagcguggaacaguaccucgagcuguccgacagcgcgaacaauauccacuuuaugcgccaaucugaaauuggaagacgguga

SEQ ID NO: 76734 - RNA, 8298 nt, Artificial Sequence
  derived and/or modified sequence opt5 from TENM2__Homo_sapiens__NP_001116151
auggacgugaaggauagacggcaccgcagccugaccagaggccggugcgggaaagagugucgcuacacauccucuagccucgacuccgaagauugcagaguccccacgcagaagucuuauagcuccucugagacccugaaagccuacgaccaugauagccggaugcacuauggaaaccgcguuacagaccuuauccauagagaauccgaugaguucccucggcaaggcaccaauuuuacacuggcugaacucgggauuugugagccgagcccccaccgcucuggauacugcuccgacaugggcauccugcaucagggguauagccuuucuaccggauccgaugccgacagcgauacagagggcggcaugucuccugaacacgcgauuagacugugggggcggggaaucaagucccgcagaagcuccggccucucuagccgggagaacuccgcucugacccugacggacagcgauaaugaaaacaaaucugacgacgagaaugggcgccccauuccucccaccuccagcccuucucuccugccgagcgcccagcuucccuccucucacaacccucccccugugagcugucagaugccccugcucgauuccaauacaagccaucaaaucauggacaccaacccggaugaggaauucucuccuaauuccuaccugcuuagagccugcagcggaccccagcaggcuucuuccagcggcccucccaaccaccauucccagucuacacugcggcccccucucccgcccccucacaaucacacccugagccaucaccauuccucugccaacagccugaauagaaacucccucacgaaucgccggagccaaauccacgcucccgccccugcgcccaacgaccuggccacaaccccggagucugugcagcuucaggauuccuggguccugaacagcaaugugccucucgaaacaagacauuuucuguucaagaccucuuccgggagcaccccccuuuuuucuagcuccagcccuggauauccccugacaucuggcacgguuuacaccccucccccgcgccuccugccucggaacacauucuccagaaaggcuuuuaaacugaagaaacccagcaaguacuguuccuggaaaugcgccgcucucucugccauugcggccgcucugcuucuggccauccuccuggcuuauuucauugccaugcaccuucugggccucaauuggcagcugcaacccgccgacgggcacaccuuuaacaauggaauccgcacaggccugccugggaacgaugacguggcuaccaugccgagcggaggcaagguccccuggucccucaagaauucuagcauugauuccggggaggcggaagugggacggagaguuacgcaggaggugccucccggcgucuucuggcgcucucagauccauauuagccaaccucaguuucugaaauucaacaucucccuuggcaaggacgcccuguuugggguguacauccggagaggacuccccccuagccacgcucaguaugauuucauggagcgccuggacggcaaagaaaaguggucuguggucgaguccccccgggaaagacggagcauucagacacugguucaaaaugaggccguguucgugcaguaccuugacgucgggcucuggcaucuggccuuuuauaacgauggaaaagacaaggaaauggugucuuucaauaccguugugcuggauuccguccaggacuguccgcgcaacugccacggcaauggggagugugugagcggcguuugccacugcuuuccuggauuccucggcgcugauugugccaaagcggcuugccccgugcuguguucugggaacggacaguacuccaagggcaccugccaauguuauagcggguggaagggagccgagugcgacgucccuaugaaucaguguaucgaucccuccugcggcgggcauggcagcuguauugacggaaacugcguguguucugccggcuacaaaggggaacacugcgaggaagucgauugccuugacccgacauguagcucccauggagugugcguuaacggcgagugucugugcucuccuggguggggaggccucaauugugaacuggcuagagugcagugccccgaucaguguagcgggcacggcaccuaccugccugacacaggacuuugcuccugugaucccaacuggaugggccccgacugcucugucgagguguguagcguugacugcgggacgcauggagugugcaucggcggggccugucggugcgaggaaggauggaccggcgcugccugugaucaaagagucugccacccucgcuguauugagcacgggacaugcaaggacggcaaaugugaaugccgggagggauggaauggcgagcauuguaccaucgaugggugcccggaccucuguaacggaaauggcagaugcacacuggggcagaacuccuggcagugcgugugucagaccggauggcgcggccccggcugcaauguggcgauggaaacgucuugugccgauaacaaggacaaugagggggauggacugguugacugccucgauccugacuguugccugcaaagcgcuugucagaacucccuucugugcagaggcagccgggauccccucgacaucauucagcaagggcagaccgauuggccugccgucaaaucuuuuuaugaccgcaucaagcugcuggcuggaaaggacuccacacacauuauccccggcgaaaauccuuucaacagcucucuugugucccucauuagagggcagguggucaccacagauggaaccccgcuggugggcguuaaugugagcuuugucaaauaccccaaguauggcuacacgaucacacggcaggacgggaccuucgaucugaucgccaacggaggcgcgucccucacacugcauuuugagcgcgccccuuucaugucucaagaaagaaccguguggcuucccuggaauagcuuuuaugcuauggacacccugguuaugaaaacagaggagaacuccauuccuagcugugaucucucuggguucgugcggcccgacccgaucauuaucuccagcccucugucuacguuuuucagcgccgcucccggacagaaccccauugucccugaaacccaggugcugcacgaggaaaucgagcuucccggcuccaauguuaagcuccgcuaccugucuagcagaacagccggguauaaaucccugcucaagauuaccaugacacagucuaccgugccucugaaccuuauccggguccaucugaugguggccguggaaggacaccucuuccaaaagagcuuucaggcuuccccgaaucuggcguacacguucaucugggauaaaacagacgccuacggccagcgcgucuauggccugagcgaugcuguugugucugugggguuugaguacgagaccugccccucccuuauucugugggaaaagagaaccgcccuccugcagggauucgagcucgacccuagcaaccugggcggguggucccuugauaaacaccauauccugaaugucaagucuggaauucuccacaaaggcacaggggaaaaccaauuucugacccagcagcccgccaucauuacaagcaucaugggaaauggccggagacgcuccaucucuuguccuagcugcaacggccuggcugaggggaauaagcuucuggcccccguggcgcucgcuguuggaauugacggcucccuguaugugggggacuucaacuacauccggagaauuuuuccgagccgcaaugucacgucuauccucgaacugcggaacaaggaguucaaacauuccaauaacccugcccacaaguauuaccuugccguggaucccguuagcggaucucuguauguguccgacaccaauagcagacgcauuuaccgggucaaaucucucagcggcacaaaggaucuggcugggaacuccgaggugguugccggaaccggcgaacaaugccugccuuuugacgaggcgagauguggcgaugggggaaaagcuaucgacgccacacuuaugucuccccgcggcaucgccguggauaagaacgggcugauguacuucgucgacgcuaccaugauucggaaaguggaucagaauggaaucauuagcacgcuccugggcuccaacgaccucaccgccgugagaccucugagcugcgauuccucuauggacgucgcucagguucggcuugaauggcccacagaucuggccgugaauccgauggacaacagccuguaugugcucgagaauaacgucauccugcgcauuaccgagaaucaccagguguccaucaucgcggggagaccuaugcauugucaaguucccggaauugacuacucucuuagcaagcuggccauccacuccgcucucgaaucugccagcgcuauugccaucucccauacaggcgugcuguauauuaccgagacagaugaaaagaaaaucaaccggcuccgccaggucaccacgaauggcgagauuugccugcuugccggggcugcgagcgacugugauugcaagaacgacgugaauuguaacugcuacucuggagaugacgccuaugcuacagaugccauccugaauucccccagcucucuggccguugcuccugacggcaccaucuacauugccgaucucgggaacaucagaauucgggcgguguccaaaaauaagccgguccugaacgcuuuuaaucaguaugaagccgccagccccggagagcaggagcuuuacguguucaacgcugacggcauccaccaauacaccgucucucuggugacaggggaauaucucuacaacuuuaccuauuccacggauaaugacguuacagagcugauugauaacaauggaaacagccucaaaaucagacgcgacuccagcggcaugccucggcaucugcuuaugcccgacaaucagaucauuacccugacagugggcaccaacgggggacugaaggucgugucuacacagaaucucgaacugggccuuaugaccuacgaugggaacacgggacugcucgccaccaagagcgacgagacaggcuggaccacauucuaugauuacgaccacgaagggagacugaccaauguuacgcgcccuacaggcguggucaccucccuccaccgggagauggagaaaucuaucacaauugauaucgaaaacagcaauagagacgaugacgugaccgugauuaccaaccuguccucuguugaggcgagcuauacagucgugcaggaucaagugcgcaauuccuaccagcuuuguaacaauggaacgcugcgggucauguacgcuaacggcauggggaucucuuuccauagcgaaccccacgugcuggccggaaccaucacaccuaccauuggcagaugcaacaucucccucccgauggagaaugggcugaacagcauugaauggcgccuuagaaaggagcagaucaaaggaaagguuacaauuuuuggccggaaacugcgcgugcaugggagaaaucuccugucuaucgacuaugaucggaacauucgcaccgagaagaucuacgacgaccacagaaaguucacgcugcggaucauuuaugaucaggucggcagacccuuucucuggcuuccuuccagcggacuggccgcugugaauguuucuuacuucuuuaacggccgccuggccgggcuccaacggggagcuauguccgaaagaacagacaucgauaaacagggccgcauugugagccggauguucgccgacgggaaggucugguccuauucuuaccuggauaaaagcauggugcuucugcuccagucccaaagacaguauaucuuugaguacgacagcucugaucggcugcuggcgguuaccaugcccuccguggcccgccacagcaugucuacccauacaagcauuggauacaucagaaauaucuauaacccucccgaauccaaugcuucugucauuuucgacuacagcgaugacggccggauccucaagaccuccuuucuugggacaggccgccagguguucuauaaauacggaaagcugucuaagcugagcgagauuguguaugauuccacggccgucaccuuuggcuacgacgagacaaccgggguucucaaaauggugaaccugcagagcggaggcuucucuuguacaaucagauaucggaagauugggccgcuuguggauaaacaaaucuaccgcuucuccgaagagggaauggucaaugcuagauuugacuacaccuaucacgacaacagcuuccggaucgccuccauuaagccugugaucucugaaacgccccugcccguugaucucuaccgcuaugacgagauuagcggcaaaguggaacauuuuggcaaguucggggucaucuacuaugauauuaaucagaucauuaccacagccgugaugacccuguccaaacacuuugacacacauggaagaaucaaggagguucaguacgagauguuccggucucugauguauuggaugaccgugcaguacgauagcaugggcagagucaucaagcgcgaacucaaacuugggccuuacgcuaacacaacgaaguauaccuacgacuaugauggagacggccaacugcaguccguggcggucaaugaucggcccacauggagauacagcuaugaccugaacgggaaccuccaccugcuuaauccuggaaacucugugcgccugaugccgcuccgguacgaucugagagaccgcauuacccggcugggcgacguucaguauaaaaucgaugacgauggcuaccucugccagagaggguccgacauuuuugaguacaauagcaagggacuucugacccgcgccuauaacaaagcuucuggcugguccgugcaauaccgguaugauggggugggaagacgcgccagcuacaagacaaaucugggccaccaucuccaguauuucuacucugaccugcacaaccccacgcggaucacccaugucuauaaucacuccaacagcgaaauuacaucucuuuacuacgaucugcaggggcaccucuuugccauggagagcuccagcggagaagaguauuacguugcuuccgacaauaccggcacaccucuggccguguucucuaucaacggccugaugaucaagcaacuccaguauaccgcguacggggagauuuauuacgauagcaaucccgacuuucagauggugaucggauuccauggcgggcuuuaugauccucugacgaaacugguccacuuuacacagagagacuacgaugugcucgcuggacgcuggaccucccccgacuacaccauguggaagaacguuggcaaagaaccggccccuuucaaucuguauauguucaagucuaacaauccccuuagcuccgagcuggaccucaaaaacuacgugacagaugucaagucuuggcuggugauguuuggguuccaacugagcaacauuaucccuggauuucccagagccaagauguauuucgucccucccccguacgaacucuccgagagccaggcuucugaaaauggccagcuuauuaccggcgugcagcaaacaaccgagcggcauaaccaggccuuuauggcgcuggaggggcagguuaucacgaaaaagcugcacgccuccauccgcgaaaaagcuggacauugguucgccacaaccacaccuauuaucggcaaggggauuauguuugcuaucaaagagggaagagugaccacgggcgucagcucuauugccuccgaagacagccggaagguggcuucuguucucaauaacgccuauuaccuggauaagaugcacuauuccaucgaggggaaagacacccacuacuucgugaagauuggaagcgcggauggcgaccuugucacacugggcaccacaaucgggagaaaagugcucgagucuggagugaauguuaccgucucccagcccacacugcuggugaacggccggacccgcagauuuacgaauaucgaauuccaauacagcacacuccuucugagcauucgguaugggcugacccccgauacccucgacgaggaaaaggcccgcgugcuggaucaggcuagacagcgggcccuuggaacagcuugggccaaagagcagcaaaaggcccgcgacggcagagaagggucccggcuguggaccgagggagagaagcagcagcuccugucuacaggccgcguccaaggcuacgaaggguauuacguucugccuguggagcaguauccggaacucgcugauagcuccucuaacauccaguuucuuagacagaaugagaugggaaaacgguga

SEQ ID NO: 76735 - RNA, 8100 nt, Artificial Sequence
  derived and/or modified sequence opt5 from TENM3__Homo_sapiens__NP_001073946
auggacgugaaggagagacggcccuacugcagccugaccaaaucccgcagagaaaaggagcggcgcuauacaaacucuagcgccgauaaugaagaguguagagucccuacgcagaaauccuacucuagcuccgaaacccucaaggcuuucgaccacgauucuagccggcugcuuuauggcaaccgcguuaaagaccuggugcauagagaggccgaugaguuuacacggcaagggcagaauuucacccuccgccagcugggagugugcgaaccggcgacaagacggggccuugcuuuuugugccgagauggggcugccccaccgcggauacuccaucagcgccggcucugacgcugauaccgaaaacgaggccgucauguccccugagcaugcuaugagacucugggggcggggagugaagagcggccgcucuuccugccugagcucuagauccaauagcgcccugacacucaccgacacggaacacgagaacaaguccgauucugaaaaugagcagcccgcgagcaaccaaggccaguccacccugcagccucuucccccuagccauaaacagcacucugcccaacaccauccguccauuacaagccugaaucggaacucucucaccaauagacgcaaccagagccccgcuccucccgccgcucugccugccgaacuucagacaacccccgaguccguucagcugcaagacucuugggugcucgggagcaaugucccgcuggagucccggcacuuccuguuuaagacgggaacaggcaccacaccucucuucagcaccgcgacccccggguauacaauggccucuggauccguguacagcccucccacgagaccccugccucgcaacacccuuucucgguccgcuuuuaaauucaagaaaagcuccaaguauuguucuuggaagugcacagcccugugugcuguuggcgugagcguccuccuggccauccuucuguccuacuuuauugccaugcaucucuucgggcugaauuggcagcugcagcaaaccgaaaacgauacauuugagaacggaaaagugaauucugacaccaugccgacgaacacagugagccuccccuccggcgauaauggcaagcuggggggauucacccaggaaaacaauaccaucgacagcggcgagcuugacauugggagacgcgcuauccaggaaaucccucccggaauuuuuuggcggucucagcuguucaucgaucaaccucaguuccucaaauuuaacauuucccugcagaaggacgcgcuuaucggcgucuacgggagaaaaggacugcccccgagccacacacaguaugauuucguugagcuccuggacggcucucgccugauugcccgggagcaaagaucccuccuggaaaccgagcgcgcuggccggcaggccagaagcgugucucuucacgaagccggguuuauccaguaccuggauagcggaauuuggcaucucgcuuucuauaaugacggcaagaacgccgagcagguguccuuuaauacaaucgucaucgaaagcgugguugagugcccucggaacugucacgggaauggagagugcgugucuggcacgugucauugcuuccccggguuucugggcccugauugcucccgcgcggcuugucccguccugugcagcggaaacggccaauacuccaaagggagaugucuuugcuucucuggauggaagggcaccgaaugugacgugccuacaacccagugcauugauccccagugugggggacggggcaucugcauuauggggagcugugccugcaauuccggcuauaagggagagucuugugaagaggccgacugcaucgauccgggcugcagcaaccacgggguuuguauucauggagagugccacuguuccccuggcugggggggaucuaauugcgaaauccucaaaacaaugugucccgaccagugcagcggccacgggaccuaccugcaagaguccggcagcuguacgugcgaccccaacuggaccggaccugauuguucuaacgaaaucugcuccguggacuguggcagccauggggucugcaugggaggcacaugcagaugugaggaaggguggaccggaccggcuugcaaucagcgcgccugucacccccggugcgcugagcauggcacauguaaggaugggaaaugcgaguguucucagggcuggaacggagaacacugcaccauugagggcuguccugggcugugcaauuccaacggaagauguacgcucgaccaaaauggcuggcacugcgugugccagcccggguggcgcggagccggcugugaugucgcgauggaaacacugugcaccgacagcaaggauaacgagggcgacgggcuuaucgauuguauggacccugauugcugucugcagucuuccugccagaaucaacccuauuguagaggacucccugacccccaggauauuaucagccagucccugcagagcccgucucaacaggccgcuaaaagcuuuuacgaccggauuuccuuccugaucggcucugacagcacacaugugaucccuggggaaucccccuuuaacaagucucuugccagcguuauucgcggacaggugcucaccgcugauggcaccccucugaucggggucaauguguccuucuuucacuaccccgaguauggauacacaauuacgagacaggacggcauguucgaucugguugccaacggcggggcgucucucacccugguguucgagcggagcccguuucuuacacaauaucauaccgucuggaucccuuggaauguguucuacgugauggacacacugguuaugaagaaagaagagaacgauauucccuccugcgaccucagcggauuuguccgcccuaaucccaucauugugucuuccccccugagcaccuucuuuagaucuuccccugaagauagcccgaucauccccgagacgcaggugcugcacgaagagacaaccauuccuggcaccgaccuuaagcucuccuaucugucuagccgggccgcuggguacaaauccguccugaagaucacaaugacccagagcauuauccccuucaaccucaugaaagugcaucugaugguugccguggucggacgccuuuuucaaaagugguucccugcuucucccaaucuggccuauacauuuauuugggauaagacggacgccuacaaccagaaaguguacggccucuccgaggcuguugugagcgucggguaugaauacgagucuugucuggaucugacccuuugggaaaagagaacagcgauccuccagggauaugagcuggacgccagcaacaugggcggcuggacccuggauaaacaccacgugcucgacguucagaaugggauccuguacaagggaaacggcgagaaucaauucauuucccagcagccuccgguggucucuagcaucauggggaacggacggcgcagauccauuucuugccccagcuguaauggccaggcugacgggaacaaacuucuggccccuguggcccucgcuugcggaaucgauggcucccuguaugugggcgacuuuaauuacguccggagaauuuuccccagcgggaacguuacaucugugcuggaacuuuccagcaauccugcccaucgcuauuaccuggcgaccgaucccgugacgggagaccucuacgucuccgauaccaacacacggagaaucuaucgcccgaagucucugaccggcgcuaaggaccucacaaaaaaugccgaggugguugccgggaccggagaacaaugccugccuuuugaugaggcucgguguggcgacgggggaaaggccguggaagcgacacuuaugagccccaaaggcauggcugucgauaagaacggccugaucuacuucguggacgggaccaugauuagaaaaguugaucagaauggaaucauuuccacgcuccugggcucuaacgaccugacaagcgcccgcccccuuaccugcgacaccuccaugcacaucagccaggugcggcuggaguggccuacagaucucgccauuaaucccauggacaacucuaucuauguccuggauaacaaugugguucuccagaucaccgagaacagacaagugcgcauugcugccgggcggccuaugcauugucaggucccgggaguggaauaccccgugggcaagcacgcuguccagacgacacuggaguccgccaccgcgaucgccguuagcuauucuggggugcuuuacauuacagaaaccgacgagaaaaagaucaauagaauucggcaggugacaaccgauggagaaaucucccuggucgcuggcauuccuagcgagugcgacuguaagaacgaugccaauugcgacuguuaucaaucuggcgauggguacgcuaaagacgccaagcucagcgcccccuccucucuggcugcgagcccugauggaacgcuguacaucgccgaccuuggcaacauccgcauuagagcuguguccaaaaauaagccccugcucaacagcaugaauuucuaugagguugccuccccgaccgaucaggaacuguacaucuuugacauuaacgggacacaucaguauaccgugucucucgucacaggagacuaccuguauaauuucagcuacuccaacgauaaugacaucaccgccgugacggauucuaacggcaauacacuucggauucgcagagacccuaaccggaugcccguuagaguggucagcccugauaaucaagugaucuggcugaccaucgggacaaacggaugccugaaauccaugaccgcucagggccucgagcugguccuuuuuaccuaucacggcaacucugggcugcucgccacaaagagcgacgaaacgggauggaccacauucuuugauuacgacuccgagggccgccugaccaaugugacauuccccaccgggguugugacgaaccuccacggagauauggacaaggcgauuacagucgauaucgaaagcucuucccgggaggaggacgugagcauuaccucuaaucuguccagcaucgauucuuuuuacaccaugguucaggaccagcuuagaaacuccuaucaaauuggcuacgacgggagccugcgcaucaucuaugcuuccggccuggauagccauuaccagacagaaccucacgugcucgccggaaccgccaaucccacagucgcuaaacggaacaugacgcugccgggcgagaaugggcagaaccuuguggaauggagauuccgcaaggagcaggcccaaggaaaagugaauguuuuuggccggaagcugagagucaacgggcgcaaucuccugucuguggacuucgauagaaccacaaaaaccgagaagauuuaugacgaucaucggaaguuucuccugcgcaucgcguacgacacaagcggacacccuacccuuuggcugcccuccucuaaacugauggcugugaacgucacguauagcuccaccggccagauugccucuauccagagagggacaaccagcgaaaagguggauuacgacggccagggacggauuguuucccgcguguucgccgauggcaaaacauggucuuacaccuaucucgagaagagcaugguccugcuucugcacucccaaagacaguacaucuucgaauaugacaugugggaucggcucagcgcuauuacaaugcccucuguggccagacauacgaugcagaccauccgcuccaucggguacuaucggaauauuuacaacccuccggagagcaaugcuucuaucauuacagacuauaacgaagagggacugcuccugcaaaccgccuuucuuggcaccuccagacgcguucuguucaaauaccggagacagacacggcugagcgagauccucuacgacuccacgcgcgugucuuuuaccuaugaugaaacagcggggguccugaagaccgugaaccuucagagcgacggauucauuuguacaaucagauaccggcagaucggcccccugauugaucgccaaaucuuuagauucuccgaggacgggaugguuaaugcccgguuugauuauagcuacgacaacucuuuccgcgugaccuccaugcagggcgucauuaaugaaacgccucuccccaucgaucuguaucaguuugacgauauuagcggaaagguggagcaguucggcaaauuuggggugaucuacuaugacaucaaccaaauuaucucuacagcugucaugaccuacaccaagcacuucgaugcccauggaagaauuaaagaaauccaguacgagauuuuucggagccugauguauuggaucacaauucaguacgacaauaugggccgcguuaccaagagagagaucaaaaucgggccuuucgcuaacacaaccaaguaugccuacgaauaugauguggacggacagcuccaaacgguguaccuuaaugagaaaauuauguggcgguauaacuacgaccugaauggcaaccugcaccuccugaaucccuccaacucugccagacuuacaccucugcgcuacgaucuccgggacagaaucacccgccugggcgauguccaguaucggcuggacgaagauggguuccucagacagcgcggaacagagauuuuugaauacagcuccaagggccuucugacccggguguauucuaaggggagcggauggacgguuaucuacagauaugacggccuggggcgccggguguccagcaaaaccucucucggacagcaucugcaauucuuuuacgcugaucuuacauauccgaccagaauuacacacgucuacaaucacuccagcuccgagaucaccucucuguacuaugaccuccagggccaucuguucgcgauggagaucagcuccggcgaugaauuuuacauugccucugacaacacagggaccccccuggcuguguucagcuccaauggacucaugcuuaagcagauccaauauacggccuacggcgagauuuauuuugauagcaacaucgacuuccagcugguuauuggguuucacggaggccuguacgacccucucacaaaacugauccauuucggggaacgcgauuaugacauccuugccggacgguggaccacccccgauauugagaucuggaagagaauuggcaaagacccugcucccuuuaaccuguacauguuccgcaauaacaauccggccucuaagauccacgaugugaaggacuacauuacagaugucaacuccuggcucgugaccuuuggcuuccaccugcauaaugcgaucccuggguuccccguccccaaauuugaccugacagagccuagcuaugaacucgugaagucucagcagugggaugacauucccccuaucuucggaguucaacagcagguggcuagacaggccaaagccuuucuuucccugggcaagauggcugaggugcaagucagccggcgcagagccgggggagcgcagucuuggcugugguucgccacgguuaaaucccucaucggcaagggggugaugcuggcugugagccagggacggguccagaccaacgugcuuaauauugccaacgaagauugcaucaagguugcugccgugcugaauaacgcuuuuuaccucgagaaucugcacuucacaauugaaggcaaagacacccauuauuuuaucaagacaaccacgccggagucugaucugggcacccucagacuuacaagcgggcggaaagcccuggagaacggaauuaaugucaccgugucccaaagcacaaccgucgugaacggccgcacgagacgguucgcggacguugaaaugcaguuuggggcccuggcucuccacgugcgcuacggaaugacacuggacgaggaaaaggccagaauccuugagcaggcucggcaacgcgcccuggccagagcuugggcgcgggaacagcagcgcgucagagauggcgaggagggggcccggcucuggaccgaaggagagaaacgccagcugcuguccgcuggcaaggugcaaggcuaugacggguacuauguucucucuguggaacaguaccccgagcuugccgauagcgccaauaacauccaguuccugagacaguccgaaauuggacggcgcuga

SEQ ID NO: 76736 - RNA, 8310 nt, Artificial Sequence
  derived and/or modified sequence opt5 from TENM4__Homo_sapiens__NP_001092286
auggacgugaaggagagaaaacccuaccggagccugacccgcagacgggaugcggaacgcagauauacauccucuagcgcugacuccgaggaaggcaaggcuccucagaaaucuuacagcuccucugagacgcucaaggcguaugaucaagacgcucggcuggcuuacgggagccgcgucaaagauaucguuccgcaggaagccgaggaguucugcagaaccggggcuaacuucacccuucgggaacugggccucgaggaagugacacccccucacgggacacuguaucgcaccgacauuggacuuccccacuguggcuacuccaugggggccggaagcgaugcugacauggaggccgauacagugcugucuccugagcaccccgucagacucuggggccgguccacccgcagcggcagaucuuccugccugagcucucgggccaauuccaaccugacgcucaccgacacagaacaugagaauaccgaaacagaucacccugggggacugcagaaccaugcccgccuuagaaccccgcccccuccccugagccacgcucacacgccuaaucagcaucacgccgcuuccaucaacucucucaaucggggcaacuucacacccagaagcaauccguccccugcccccaccgaccauagccugucuggggagccucccgcgggaggcgcccaagaacccgcucacgcccaggagaacuggcuucucaauuccaacauuccucucgagacacgcaaucuggggaagcagccguuucugggaacccuccaggauaaccugaucgaaauggacauucuuggcgcuagccggcacgacggcgccuauucugaugggcauuuccuguuuaagcccggaggcaccagcccucucuucuguacaacgucccccggguacccucugaccucuagcacaguguacucucccccgccuagaccccuuccucgcagcaccuuugcccggcccgcuuucaaucugaaaaagccuagcaaauauugcaacuggaagugugcggcccucuccgcuaucguuaucagcgccacacuggugauucugcucgccuacuuugucgcuaugcaccuguucggacuuaacuggcaucugcaacccauggagggccagauguaugaaaucaccgaggacacggccucuuccuggccggugccuacagauguuagccucuaccccuccgggggaaccggccuggaaacccccgacagaaaaggcaaggggacaaccgagggaaagccuucuagcuuuuucccggaggauuccuuuauugacucuggcgaaaucgauguggggcgccgggcgagccagaaaauucccccuggaacauucuggagaucccaggucuucaucgaccaccccgugcaucuuaaguuuaaugugagccugggcaaagcugcccucgucgggauuuauggccgcaagggacugccucccucucacacgcaauucgauuuuguugagcugcucgacggccggagacugcuuacccaggaagcccgcucccuggaggggacaccucggcagagcagaggaaccgugcccccgucuucccacgaaacaggcuucauccaauaccucgauagcgggaucuggcaucuggcuuuuuauaacgacggaaaagagucugagguggucagcuuccugaccacggccauugaauccguggacaauugcccuagcaacuguuacggcaauggggauugcaucucuggcaccugucacugcuuucuuggauuccucggccccgacugugggcgggcuuccugcccuguucugugcagcggaaacggccaguacaugaaggggcgcugucugugccauuccggauggaaaggcgccgagugugaugugcccacaaaucagugcauugacgucgcguguucuaaccacgggaccugcaucacaggcaccuguauuugcaauccgggauauaagggcgaaagcugugaggagguggauugcauggacccuacguguuccgggagaggaguuugcgugcggggcgaaugccacuguucugucggguggggaggcacaaacugcgagacccccagagccacaugucucgaucagugcagcgggcauggcaccuuucugccugacaccggacuuuguuccugcgaucccucuuggacaggccacgacuguagcaucgaaaucugcgcugccgauugugggggacauggcgugugcgucgggggaacgugucgcugcgaggacggcuggaugggcgcugccugcgaucaacgggcgugucaccccagaugcgccgaacaugggaccugucgcgacggaaagugcgaguguuccccuggcuggaauggggagcacugcacaauugcucacuaccuggacagagugguuaaagaaggauguccgggccucugcaacgggaauggacgguguacccuggaucugaacggcuggcauugcgugugucagcuuggcuggcgcggggccggaugcgacacaagcauggagaccgcuugcggcgauucuaaggacaaugauggggacggacucgucgauuguauggaccccgauugcugucugcagccucugugccacaucaacccccucugucugggcuccccuaacccccuugacauuauccaggaaacgcaagugccuguuagccagcagaaucugcauucuuucuaugauagaauuaaauuucucguggggcgggacuccacacacaucaucccgggagagaaccccuucgauggcggccaugccugcgucauucgcggacaggugaugaccagcgacggaaccccucuggugggcguuaauaucucuuuugucaacaauccccuguucggguacacaauuuccagacaagacgggagcuucgaucuugugaccaacggcgggaucuccauuauccuccgguuugaacgcgccccuuucauuacacaggagcacacgcuguggcugcccugggacagauuuuucgugauggagaccaucaucaugcggcacgaagagaaugaaauuccgagcugugaucucucuaacuuugcucgcccuaaucccgucgugagccccuccccucugacaucuuucgcgagcuccugcgccgagaagggacccaucguuccugaaauucaggcccuucaggaggagaucucuauuagcggcuguaaaaugagacuguccuaucucucuagccggaccccgggcuacaaguccgugcugagaaucagccugacacaucccaccaucccuuuuaaccuuaugaagguccaccucaugguggccguugaagggcgccuguuccggaaaugguuugccgcugcccccgaccugucuuauuacuucauuugggauaagacggacguguacaaucaaaaagucuuuggacucuccgaggcguucgugagcguuggcuaugaauacgagucuugcccugaucugauccuuugggagaagagaaccacagugcugcagggguaugaaauugacgcuuccaaacucggaggcuggagccuggauaagcaucacgcccugaacauccaguccgggauucuucacaagggaaauggcgagaaccaauuugucucucagcagcccccggugaucggcagcaucauggggaauggacgccggagauccauuagcuguccuucuugcaacggccuggccgacgggaacaaacuccuggcucccguggcccugaccugcggauccgauggcagccuguacgucggggacuucaauuauauccgccggauuuucccuucuggaaacguuacaaauauccuugaacugagaaacaaggacuuucgccauagccacucccccgcgcauaaauacuaucucgcuaccgauccuaugucuggcgccguguuccugagcgacuccaauucucggagaguguuuaagauuaaaagcacagucgugguuaaggaucuggugaagaacuccgaggucguggccggcaccggggaccagugucuucccuucgaugacacgcggugcggagauggcgggaaagcuacagaagccacccugaccaauccgcgcggaaucacaguugacaaguuuggccucaucuacuucguggaugggaccaugauuagacggaucgaccaaaacggaauuaucagcacgcugcucggcucuaaugaucugacauccgcucgcccucuuagcugugacuccgucauggauauuucucaggugcaccuggaguggcccaccgaccucgccaucaaccccauggacaauagccuguacguucuggauaacaaugugguccuucagauuuccgagaaccaucaggugagaaucguggcgggccggccuaugcacugccaagucccggggaucgaccacuuucugcucucuaaaguugccauucaugcuacacuggaaagcgccaccgcucucgccgugucccacaauggagugcuguauaucgccgagacagaugaaaagaaaauuaacagaauccgccaggucaccacgagcggcgagauuucucuuguggcuggggcgcccuccggaugugacugcaagaacgaugccaauugugacugcuucagcggcgaugacggguacgcuaaagaugccaagcugaacaccccuucuucccuggccguuugugcugacggcgaacucuauguggccgaucugggaaauauccggaucagauuuauucgcaagaacaaacccuuccuuaauacacagaacauguacgagcugagcucuccuaucgaccaggagcucuaucuguuugauaccacaggcaagcaucucuacacccaaagccugcccacgggggacuaucuuuacaauuucacauacaccggagacggcgauauuacacugaucaccgacaacaaugggaacauggucaaugugcggagagauuccaccggaaugccucuguggcucguugugccggacggccaggucuauugggugacaauggggacgaacucugcgcugaaaagcgucaccacacagggccacgaacuugcuaugaugaccuaccacggaaauuccggccugcucgccacaaagagcaacgagaauggguggaccacguucuaugaauacgauuccuuuggacgccugacaaacgugaccuuccccaccggccaaguuucuagcuuucgguccgacacagauucuagcgugcauguccagguggagaccuccucuaaagacgauguuacaauuacgaccaaucucagcgccuccggggcuuucuauacacugcuucaggaccaggugagaaacagcuacuauaucggagccgauggcucucugcgccugcuccuggcgaacgggauggaagucgcccuucaaaccgagccucaucugcucgccggcacagugaaucccaccgugggaaagagaaacguuacgcugccuaucgacaauggccucaaccuggucgaguggcggcagcgcaaggaacaggccagaggacaggugaccguguuuggacggcgccuuagaguccauaaucggaaccugcugucccucgacuucgauagagugacacgcaccgagaaaauuuacgacgaucaccggaaguuuacacugagaauccuuuacgaccaagcuggccgccccagccuguggucuccguccagccggcucaaugggguuaacgugaccuauucuccuggaggcuacauugccggcauccagagagggauuauguccgaacggauggaguaugaucaggcuggacgcaucacaagcagaauuuucgccgacggcaaaacgugguccuacaccuaucuggaaaaguccaugguccugcuccuucauucucagcggcaauacaucuuugaguucgauaaaaaugaccgccugagcuccgugacaaugcccaacguugcgagacagacccuggagaccauccggucugugggguauuaccgcaauauuuaccagcccccugaaggaaacgccagcgucauccaggauuuuacagaggacggccaccuccugcacacguucuaucuugggaccggaagacgggugauuuacaaguauggcaagcuguccaaacucgcugaaacacuguacgauaccacaaagguuucuuuuaccuaugacgagacggccggcaugcugaaaacaaucaaucuccaaaacgagggguuuaccugcaccauucgcuacagacagaucggaccccuuaucgaucggcagauuuucagauuuacagaagagggcauggugaaugcucgcuucgacuauaacuacgacaacagcuuucgggucaccuccaugcaagccgugaucaaugaaacaccucugccgauugaucuguacagauaugacgaugugucugggaagaccgagcaguucggaaaauuuggcgucaucuacuaugacauuaaccagaucaucacgacagccguuaugacccauacaaagcacuucgaugcuuacgggcgcaugaaggaagugcaguaugagauuuuucggagccucauguacuggaugaccgugcaauaugacaauaugggaagagucgugaaaaaggagcugaaaguuggccccuacgcgaacacgacccgcuacuccuaugaauacgaugccgacggccagcuucagacagugagcaucaaugauaagccucuguggcgguauucuuacgaccucaacgggaaucugcaucugcucucccccggaaacagcgcuagacuuaccccucugcgcuaugauauucgggacagaaucacacgccugggcgacguccaguacaaaauggaugaggacggguuccuccggcaaagaggaggcgauauuuuugaauauaauucugccgggcugcuuaucaaggccuacaaccgcgcuggauccuggagcgugagauaccgguaugacggccugggccgcagaguuuccucuaaaagcucccacagccaccaucuccaguucuuuuacgccgaucugaccaaucccacaaaggugacccaccuguauaaccauucuuccagcgagauuacgucucucuacuaugaccuucaggggcaccuguucgcgauggaacugagcuccggagaugaguuuuacaucgcuugugacaauaucggcacaccgcucgccgucuucucugggaccggacugaugauuaagcagauccuuuauaccgccuacggcgagauuuacauggauacaaacccuaauuuccaaaucauuaucggguaucauggaggccuguacgacccccucaccaaacuggugcacaugggccggagagauuaugacguccuggcugggcgguggacaagcccugaucacgaacucuggaagcaucuuuccucuagcaacgugaugcccuuuaaccuguacauguucaaaaauaacaauccuaucuccaacagccaggacauuaagugcuuuaugacggacguuaauucuuggcugcucaccuucggauuucagcugcacaacgugauccccggcuauccgaaaccugauauggacgccauggagcccuccuacgaacuuauucauacacaaaugaagacccaggagugggauaauagcaaguccauccugggggugcagugcgagguccagaaacaacucaaggcguucguuacacuggaacgcuuugaccagcuguauggaucuaccauuacgagcugucagcaggcccccaaaaccaagaaauucgcuuccucuggcagcguguuugggaagggagugaaguucgcccucaaagauggcagagucacaaccgacaucaucuccguggcuaacgaggauggccggcgcguugccgcuauucuuaaucacgcccauuaccuggaaaaccugcacuuuacaaucgacgggguggauacccacuacuucgucaagccuggaccgagcgagggcgaccucgcgauucuggggcuuucuggaggcagacggacgcuggaaaauggggugaacgucacagugucccaaaucaauaccguucucaacggacgcacaagacgguauaccgauauucagcugcaguacggcgcccugugccucaauacccgcuauggcacaacgcuugacgaggagaaagcuagagugcuggaacuggcccggcagcgcgcugucagacaagccugggcccgggagcagcagcgccucagagaaggggaggaaggacugcgggcuuggaccgagggcgagaagcagcaagugcuuagcacagggagaguucagggauacgauggcuuuuucgugaucucugucgaacaguaucccgagcuguccgacagcgcgaacaacauucauuucaugcgccaaucugaaauggggcggagauga

SEQ ID NO: 76737 - RNA, 7884 nt, Artificial Sequence
  derived and/or modified sequence opt5 from TEP1__Homo_sapiens__XP_005268084
auggagaagcugcacggccacgugagcgcucaccccgacauccucucccuggaaaacagaugccuugcuaugcugccugaucuccagccgcuggagaaacuucaucagcacgucucuacccauagcgacauucugucccucaagaaucagugucuggcuacacugcccgaucucaagacgauggaaaagccucacggguacguuucugcgcaccccgacauccugagccuugagaaccagugccuggcuacccucuccgaucugaagacaauggaaaagccucauggccacgugucugcccaucccgacauucuuagccuggagaaucggugucucgccacccuguccagccugaagucuacaguguccgcuagcccucucuuccagucucugcaaaucucccacaugacccaggccgaucuuuaucgcgucaacaauagcaacugccugcucucugagccgcccuccuggagagcucagcacuuuagcaaaggccuggaccuuuccacauguccuauugcccugaagucuaucagcgcgaccgaaacggcccaggaggcuacccucgggcggugguucgauuccgaagagaaaaagggagccgagacacaaaugcccagcuacucucugucccugggcgaagaggaagagguggaagaccucgcuguuaaacugaccagcggggauucugagagccauccugagcccacagaccacgugcuucaggaaaagaagauggcccugcucucccugcuuugcucuacccuggucagcgaggugaauaugaacaauacguccgauccgacacucgcggccaucuuugaaauuugucgcgagcuggcucugcucgaaccugaguucauccugaaagccagccuuuaugcuagacagcagcugaacguucggaauguggccaacaauauucucgccaucgcugcguuucugcccgccugccgcccucaucugagacgguacuucugugcuauuguccaacuucccucugacuggauccagguggccgagcucuaucagucccuggccgaaggagacaagaacaaacuggugccccucccugcuugccugcgcaccgccaugacagauaaguuugcgcaauucgacgaguaccagcuugcuaaauauaauccgagaaagcaccgggccaaacgccaucccagacggccuccccgcagcccuggcauggaacccccguuuucucacagauguuucccucgguacauuggcuuucugagagaggaacagcgcaaguucgagaaggccggggauaccgucuccgagaaaaagaaucccccucgguuuacccucaaaaagcugguucagagacugcacauccauaaacccgcucaacacgugcaggcccuucucggauaccgcuauccuagcaaccugcagcuguucucccggucuagacuccccggcccgugggacagcucccgcgcugggaagcggaugaagcugucuagaccugaaacaugggagcgcgaacuuagccugcggggaaauaaagccuccgugugggaggagcucaucgaaaacggcaagcugcccuucauggcgaugcugagaaaucuuugcaaccuccugcgcgucgggauuagcucucggcaucacgagcugauccuccagagacugcaacacgccaaauccgugauucauagccggcaguuucccuuccgcuuucuuaaugcucacgaugccaucgacgcucuggaagcccagcucagaaaccaggcgcugccuuucccgucuaauauuacgcugaugcggagaauccuuacccgcaacgagaagaaucggcccagacgcagauuucucugccaucugucccggcaacagcugcgcauggccaugagaaucccuguucucuacgaacagcugaaacgggagaaacuucgcgugcacaaggcuagacaguggaaauaugauggagagaugcugaaccgguaccgccaagcccucgaaacagcugucaaucugagcgugaagcauucucugccccuucugccuggcagaaccguucucguguaucugacagacgccaacgccgaucggcucugucccaaaagcaauccucagggacccccgcugaacuacgcccuucugcucauugggaugaugaucacccgcgcggagcaggucgacgugguccugugcggaggcgauacgcugaagacagccgugcuuaaagcugaagaggggauucugaagaccgccaucaagcuccaagcccagguucaggaguucgacgagaaugacggauggucccugaacaccuuuggcaaauaucuccugagccuugcugggcagagagugccugucgaucgggugauucugcucggacaaucuauggacgauggcaugaucaacguugccaagcagcuguacuggcagagagugaacuccaaaugucuguucgucggcauccuucugcgccgggugcaguaccucagcacagaccugaaccccaaugaugugacccucuccgggugcacagacgcgauucugaaguuuaucgcugagcacggagccucucaccuucuggaacauguuggccaaauggauaaaauuuucaagaucccucccccgccugggaaaacgggaguccagagccugagaccccucgaggaagacaccccuagcccccuggcccccgugucucagcagggcuggcgcagcauucggcuuuuuaucuccucuacauucagagauaugcacggggagcgcgaccugcuccugcggagcgugcucccugcucugcaagccagagcggcuccgcaucgcauuucccuucacggcaucgaucugcgguggggagucaccgaagaggagacaagacggaaccgccagcuggaagugugucucggcgagguugaaaaugcccagcuguuuguggggauccuuggaagcagauauggcuacauucccccuucuuauaaccugcccgaccauccucacuuccacugggcccaacaguaccccuccgggcggagcgucaccgagauggaggugaugcaguuccucaaucgcaaccagagacugcaaccuucugcucaggcccucaucuauuuucgggauuccagcuuccugucuuccguuccggacgcuuggaaguccgacuuuguguccgaaagcgaggaagccgcgagacgcauuucugagcuuaagagcuaccugucccggcagaaaggaaucacgugcagacgcuaucccugugaauggggcggggucgccgcuggccggccuuacgugggaggccuggaggaguucgggcagcucguucugcaagauguguggaauaugauucagaaacuuuaccugcagcccggagcccuccuggaacagccugucucuauccccgacgaugaccucgugcaagcuaccuuucagcagcugcagaaaccgccuagccccgccagaccccgccuucugcaagauacagugcagcggcugaugcucccucauggcagacugucccuugucaccgggcagucuggacaaggcaagacagccuuccuggcuagccucguuuccgcgcugcaggcccccgacggggcuaaaguggccucucugguguuuuuccacuuuagcggcgcccgcccugaucagggacucgcucuuacccugcugagacggcucugcacguaucugcgcggccagcuuaaggagccgggggcccugcccuccacauacagaagccucgucugggaacugcaacagcggcugcucccuaagucugcggagucccuucaucccggacagacccaggugcugaucauugacggcgcugaucgccugguugaccaaaacgggcagcucaucagcgauuggauuccuaaaaagcugcccagaugugugcaccuuguccugucuguguccagcgacgccggacucggcgaaacacuggagcagucccagggggcccacguucuggcucucggcccgcuugaggccucugcgcgggcuagacuggugcgcgaagaacuggcccucuauggaaaacggcuggaagagagcccuuucaauaaccaaaugagacuucugcucgucaagcgcgaauccggccggccccuguaccugagacucgugaccgaucaucuucggcuguuuacccuguaugagcagguuagcgagcgccucagaacacugccugccacggugccccuucugcuccagcacauccugucuacccuggaaaaagagcaugggccugacguccucccccaagcucuuacagcccuggaagugacccgguccggacugacaguggaccagcuccacggcguccugagcguuuggcgcacccuuccgaaggggacgaagucuugggaggaggcuguggccgcgggaaauagcggcgauccuuaccccaugggccccuucgccugccuggugcagucccucagaucucugcugggggaaggaccucucgagcggccgggcgcucgccuuugucugcccgacgggccucugagaacagccgcuaaacggugcuauggaaagcgccccggccucgaagauaccgcccauauucugaucgccgcucagcuuuggaaaaccugcgacgcggaugccagcgggacauuuagauccuguccucccgaggcucugggagaccucccuuaccaucugcugcaaucuggcaaccggggccuccuuagcaaguuccugaccaaucugcacgucguggccgcccaucucgaacuggggcuuguuuccagacugcucgaggcucacgcccuguacgcgagcucugugccgaaagaggaacagaagcugcccgaggcugaugucgccguguuccgcacauuucuccggcagcaggccuccauccuuagccaauauccuagacugcugccccagcaggcugccaaccagccucucgacagcccccugugccaucaagcgucucuucugagccgccgguggcaccuccagcacacgcugagauggcugaacaagccgcgcaccaugaaaaaucagcaguccucuagccucucccuugccguuuccucuuccccuacagcuguggccuucagcaccaacggacaacgggcugccgucggcacagcuaaugggaccguguaccugcuggaucucagaacguggcaggaagagaagucugucguguccggaugugacggcauuagcgccugccuguuucuuucugaugacacccuguuccucacagcguuugacgggcugcuggaacucugggaucugcagcauggaugucgcguucuucaaaccaaagcccaccaguaucagaucacaggcugcugucugagccccgacugccggcuccuggcuaccgugugucuuggcgggugccugaagcucugggauacagucagaggacagcuggccuuccaacauaccuaccccaaaucccugaacuguguggcuuuucacccugagggccagguuauugccacggggucuugggccggaagcaucuccuucuuucagguggacggccucaaggucacaaaagaucugggggcucccggagcgagcauucgcacccuugccuucaaugugccuggcggcgugguugcugucgggcggcuggacuccaugguggagcucugggccuggagagaaggagcccgccuggcugccuuuccggcgcaucacggcuucguggccgcugcccuuuuccugcacgcugggugccagcuccugaccgccggagaggauggcaagguccaaguguggucugggagccugggaagaccccggggccaucucggcucccugucucuuagcccugcgcuguccguugcccucucucccgacggggaucgcguggcugucggauauagagccgacggcauccggaucuacaagauuagcuccgggagccagggagcucagggccaggcccuggauguggcuguuucugcccuugcguggcuguccccuaaagugcucgucagcggggccgaagacggaucucugcaaggcugggcucugaaggagugcucccuccagagccuguggcuucugucuagauuucagaaacccgugcucggccuggccacaucccaagaacuucuggcuagcgccuccgaggauuucaccguucagcucuggccgcggcagcugcugacgcgcccucacaaggccgaggacuuucccugugggacagaacucagaggacaugagggcccugugagcugcuguucuuucagcaccgacgggggaucccuggcgacaggcgggcgggaucgcucucuucugugcugggacgucagaacccccaaaacaccugugcucauccacagcuuucccgcuugucaccgggauugggugaccggaugcgccuggacgaaggacaaccugcuuauuuccuguucuagcgauggcuccgucggccugugggacccggaaucugggcagcgccucggacaauuccugggccaucagagcgcuguuuccgccguggccgcuguggaggagcacgucgugagcguuucuagagaugggacccugaaggugugggaccaucagggagucgaacucacauccaucccugcccacagcggccccauuucucauugcgcggccgcuauggagccccgggccgcugggcagccuggcuccgaacugcuugugguuaccgugggacuggauggcgccacacgccucuggcacccgcugcuugucugucaaacccacacgcugcucgggcauagcggacccgugagagcggccgcugucuccgagacaucuggccugaugcugaccgccagcgaagacggguccgugcggcucuggcagguuccuaaagaggcugaugacacaugcaucccccgcagcucugccgcugugaccgccguggcgugggccccugauggauccauggcugucagcggcaaucaggccggggagcugauucuuuggcaggaagcuaaggccguugccaccgcgcaagcucccggccacaucggagcccugaucuggucuagcgcccauacauuuuucgugcucuccgcugacgagaaaauuucugaauggcaagugaagcugagaaaaggcagcgccccugggaaccuuucccugcaccucaaucggauccugcaggaggaccugggaguccuuacgucucuggauugggcucccgacggccauuuucucauucuggccaaggcggaucucaagcugcuuuguaugaaaccgggggacgccccuagcgaaaucugguccagcuauaccgagaaccccaugauucugucuacacacaaggaguacggaaucuucgugcugcaaccuaaagaucccggcguucucuccuuucugcgccagaaggaaagcggggaguucgaagagagacuuaauuuugacaucaaccuggaaaauccgucccggacccucauuucuaucacacaggcuaaaccugagagcgaguccucuuuccugugcgccagcuccgauggcauucucuggaaccuggcuaagugcagccccgaaggagaguggaccacgggcaauauguggcagaagaaagccaacacacccgaaacccaaaccccugggacagaccccucuaccuguagagaguccgaugcgagcauggacucugaugccuccauggacagcgagccuacaccgcaccugaagacgcgccagcggagaaaaauccauucuggauccgugaccgcccuucacguccugcccgaacuccuggugacagccagcaaggaccgcgaugucaaacuuugggagcggccuucuaugcagcugcucggccuguucagaugcgaagggagcguguccugucucgagcccuggcugggagcuaacagcacccugcagcuugccguuggcgacgugcaaggcaaugucuacuuucugaacugggaauga

SEQ ID NO: 76738 - RNA, 897 nt, Artificial Sequence
  derived and/or modified sequence opt5 from TEPP__Homo_sapiens__NP_950247
augggcaucgugugcgcccagugcagcuucauucugcuccuguccaucauuagagcucggcccccuccguuucuuuucugcccccugucuagccaacgcaccgaguccccuuacaagcccguccaccucgggcugggaccuacagacaaaguugccgcgaucgcuauggccagaauuaucgaucuugugcccugggacgauggcucuacgcauguguaugccagcccugcuauccugcucccgauggaacggcagcgcaaccagcuggccggggucaagcagcaacuguaccaccccgcucucccuacccugagacauauggaccgggauacagugaaagccugucuucccgacgagcacugccaguccaccacauauugucgcaaggaugaauuugacaaugcgcauuucacccugcucggaguuccuaacaaaccccugcagugccuugauauuacagccaccggccagaagcugagaaaucgguaccacgaggggaagcucgcuccgaucgccccuggaauuaaccgcguggacuggcccuguuuuacgagagcuaucgaagauuggucucacuucgucagcuccgccggcgaguuuaaacugccuugccugcggaagcgcgcggagggccucagcggguaugccgugagauaccugaaacccgacguuacccaaacauggcggcaggaagcucuuuguggagccugggcuggccgccccugcucuccugauuccccgagacccuauccuuguugucccccucaguacugccugagccagaaucccucucucgaccgguacgggcaaaagccgcugccuuucgacucccuuaacaccuuucgcagcuucggaucuuccuauagcagagugaauuaccugacacccuggcauuga

SEQ ID NO: 76739 - RNA, 1260 nt, Artificial Sequence
  derived and/or modified sequence opt5 from TERF1__Homo_sapiens__NP_003209
auggccgaggacgugagcuccgcugcccccucuccuagaggcugcgcggaugggcgggacgcugauccgaccgaagaacagauggccgaaacagagcgcaacgacgaggagcaauucgagugucaggaacugcucgagugccagguccagguuggagcccccgaagaggaggaagaggaagaggaagaugcuggccugguggccgaggcugaggccguggcggccggguggaugcuugacuuucugugucucagccugugcagagcuuuccgggauggacgcuccgaagacuuuagacggacgcgcaauucugccgaggcuaucauucacggccuuagcucccugaccgccugucaacucagaacaaucuacauuugccaguuccugacccggaucgcggccgggaagacacuggaugcucaguuugaaaacgacgagcgcauuaccccucucgaaucugcccugaugaucuggggaagcaucgagaaagagcaugauaaacuucacgaagagauucagaaucugaucaaaauucaagcuaucgccgucuguauggaaaacggcaauuucaaggaggccgaagagguguuugagagaauuuucggcgaccccaacucccauaugccuuuuaaaagcaagcuccugaugaucauuucucagaaggauacauuccacuccuuuuuccagcauuuuagcuauaaucacaugauggaaaagaucaagucuuacguuaacuaugugcuuuccgagaaaagcucuaccuuccugaugaaggcugcggccaaagucguggaauccaagcggacgcgcaccaucacaagccaggacaagcccuccgggaaugacguugagauggagaccgaagcuaaccucgauacaagaaaacggucucacaagaaucuguuccugagcaaacuccaacauggaacccagcagcaagaccugaacaagaaagagcgcagagugggcacgccucaguccacaaagaaaaagaaggaaagccggagagccaccgagucucgcauuccggucuccaaaagccagcccgugacaccugaaaagcaccgggccagaaaacgccaggcuuggcuuugggaggaggauaagaaucugcggucuggggugagaaaauacggagaaggcaacuggagcaagauccuccugcauuauaaguuuaauaaccgcaccuccgucaugcuuaaagaccgguggagaaccaugaagaaacugaagcucauuucuagcgauuccgaggacuga

SEQ ID NO: 76740 - RNA, 1629 nt, Artificial Sequence
  derived and/or modified sequence opt5 from TERF2__Homo_sapiens__NP_005643
auggccgcuggcgccgggaccgcgggacccgcuagcggcccugggguggucagagacccggccgccucccagccccggaagcgcccuggaagagagggcggggaaggagcucggcgcucugauacaauggccggcggcgggggaagcuccgacggcucugggagagcugccggacggcgcgcgagcagauccucuggccgggcccgcagagggcggcacgagcccggacugggcggcccugcugaacgcggggccggagaggcuagacucgaagaggccguuaaccggugggugcugaaauucuacuuucaugaggcgcuucgcgccuucagaggcagccgguauggggauuuuagacaaauccgcgacauuaugcaggcucugcucgugcggccccugggaaaggaacacacggucuccagacuucugcgcgugaugcagugccucagccggaucgaggaaggcgagaaucuggauuguucuuucgacauggaggccgaacugaccccucucgaguccgcuauuaacguucuggaaaugaucaaaacagaguuuacccuuacagaagccguggucgagagcucuagaaagcuggugaaagaggccgcuguuauuaucugcaucaagaauaaggaguucgaaaaagcguccaagauucucaaaaagcauaugagcaaagauccgaccacacagaagcugcgcaacgaccuucugaauaucauucgggaaaagaaccucgcccaccccgugauccaaaauuuuucuuacgagaccuuccagcagaaaaugcugagauuucuggaaucccaucucgaugacgcugagccuuaucugcuuacgauggccaagaaagcccucaagagcgaguccgcugccucuagcaccgggaaagaagauaagcagcccgcgccuggacccgucgagaaaccgccucgcgaacccgcucggcaacugagaaacccucccacaaccauuggcaugaugacacugaaggccgccuucaagacccuuuccggcgcucaggacagcgaggccgcuuuugccaaacuggaucagaaggaccucgugcugcccacgcaggcgcugccugccucuccggcucucaaaaauaagcgcccccggaaagacgaaaacgaguccagcgccccugcugauggggagggaggcucugaacugcaacccaagaauaagagaaugacaaucagccggcuugugcuggaggaagacucccagucuaccgagccuagcgccgggcucaacuccagccaggaggcggccucugcucccccguccaaaccuacaguccugaaucaaccccuuccuggagaaaagaaccccaaaguuccuaagggcaaauggaauagcucuaacgggguggaggaaaaggagaccuggguggaagaggaugagcuguuccagguccaggccgcucccgacgaagauuccaccacaaacauuacgaagaaacagaaguggaccguggaggaaagcgaguggguuaaagccggcgugcaaaaguacggagaaggcaauugggccgcuaucuccaaaaacuauccguuugucaaucgcacagcggugaugaucaaggacagauggcggaccaugaagagacucgggaugaacuga

SEQ ID NO: 76741 - RNA, 1200 nt, Artificial Sequence
  derived and/or modified sequence opt5 from TERF2IP__Homo_sapiens__NP_061848
auggccgaagcuauggaccugggcaaggaucccaacgggccuacccacagcuccacacucuucgugagagacgauggaucuagcauguccuuuuacguccggccgucucccgccaaacgcagacugagcacgcuuauccugcauggcgggggaaccguuugccgggugcaggaaccuggcgcggugcuccuggcucaacccggggaggcccuugccgaagcuagcggagacuucauuucuacacaguauauccuggauugugucgagcgcaaugaaagacucgagcuggaggccuaccggcugggcccugcuagcgccgcggacaccggcuccgaagccaagcccggggcucucgccgagggagcugccgaaccugagccgcagcgccacgcgggcagaauugccuuuacagaugcugacgauguggccauccugaccuauguuaaagagaacgcucggagccccucuuccgugacagggaaugcccuuuggaaggccauggaaaaauccucucugacccagcauuccuggcaaagccucaaggaccgcuaccugaagcaccuuagaggacaggagcauaaauaucugcucggcgaugcuccugucucucccuccagccagaagcugaaacggaaggcggaagaggacccugaagccgcugauuccggggagccccagaacaaacgcacgccggaccugccugaggaagaguacgugaaggaagagauucaagaaaaugaggaggccguuaagaaaaugcucguggaagccaccagagaguucgaagaggucgugguggacgaaucucccccugauuuugagauccacaucacaaugugcgacgaugacccucccacccccgaggaagauagcgagacacagccggacgaagaggaggaagaggaagaggaaaaggucucccagcccgagguuggagcugccauuaaaaucauucggcagcugauggagaaguucaaccuugaucugagcaccgugacgcaagcguuucucaaaaauucuggcgaacuggaggcuacauccgccuuccuugccagcggccagcgcgcugacggguauccuaucuggucuagacaggaugacauugaucugcaaaaggacgacgaagauacccgggaggcccucgugaaaaaguuuggagcucagaacgucgccagacgcaucgaguuccggaagaaauga

SEQ ID NO: 76742 - RNA, 3210 nt, Artificial Sequence
  derived and/or modified sequence opt5 from TERT__Homo_sapiens__NP_001180305
augcccagagccccucggugccgcgcugugagaagccugcuccggucccacuaccgcgagguccugccgcuugccaccuucguuagacggcugggcccccagggguggcgccucgugcaaagaggagacccugcggcuuuucgggcccugguggcccagugucuugucugcgugcccugggaugcucgcccucccccugccgcuccgucuuucagacagguuagcugucugaaggaacucguggcccggguccugcagcgccugugcgagagaggcgcgaaaaacgugcucgccuuuggguucgcucugcuugacggagcccggggcgggcccccugaggcuuuuacaacguccguucgcucuuaucugcccaauaccgugacagaugcccucagaggaagcggcgcguggggccugcuucugcggagagucggggacgaugugcucgugcaucugcuggcccgcugugcucucuucguccugguugccccuuccugcgcuuaccaaguguguggacccccgcuuuaucagcugggcgccgccacccaggcucggccucccccucacgcgucugggcccagacgccggcucggaugcgaaagagccuggaaccauagcgugcgcgaagcuggcgucccccuggggcuuccugccccgggagcccggagacgcggcggcuccgcuagccggucucugccccucccuaagagaccccgcagaggggccgcgccugagcccgagagaacaccggugggacagggcuccugggcucacccugggcggacccgcggacccagcgacagaggcuuuuguguugugucuccugcccggcccgccgaagaggcuacaucccuggaaggggcccugagcggaaccagacauucucacccuuccgucggccgccaacaccaugcuggacccccgagcacgucccggccucccagacccugggauaccccuugcccgcccguguacgccgagacaaaacacuuccucuauucuagcggggacaaggagcagcugcgcccuuccuuucuucugagcucucucagacccucccugaccggagcgcggcgccuuguugaaacaaucuuccugggcagcagaccuuggaugcccgggaccccucggcgccuccccagacugccgcagcgguacuggcagaugcgcccucuguuucucgagcugcuuggaaaucaugcccaaugucccuauggcgugcugcucaaaacgcacugcccucugagagcugccgucacacccgcugccggggugugcgcgcgggaaaagccgcagggcucugucgccgcuccugaggaagaggauaccgacccccgcagacuggugcagcuucuccggcaacacagcuccccuuggcagguuuacggauucgugagagccugucugcgccggcuggucccucccggccucugggggucuagacauaacgagcgccgguuucugagaaauacaaagaaauucauuagccuuggaaagcacgcuaaacugucccuccaggaacugaccuggaagaugagcgugcgcgauugcgccuggcugcggagaucucccggcguugggugugugccggccgcugagcaucgccuucgggaagagauccucgcgaaauuccugcacuggcugauguccgucuacgugguggaacuccugcggagcuuuuucuauguuaccgagacaacguuucagaagaaccggcuuuucuuuuaccgcaagucugucugguccaaacugcaaagcauuggaaucagacagcaucucaagcgggugcagcugcgcgagcuguccgaagccgaggugagacagcaccgggaagcuagacccgcccuucucaccucucgccugcgguucauuccuaaacccgacggccugagaccuaucgucaauauggauuaugugguuggggcccgcacauuucggagagagaagcgcgcugaacggcucaccagcagagugaaagcccuguucuccguccuuaacuacgagcgcgcgagacggcccggccugcucggagcuucugugcugggccuggacgacauccaccgcgccuggagaacauuuguucuucgggugcgcgcccaagauccuccgcccgagcucuauuucgucaagguggacguuaccggggcuuacgauacgauuccucaggacagacugacagaagugaucgccagcauuaucaaaccccagaauaccuauugcguccggagauacgcgguggugcagaaggcugcccauggacacguccgcaaggccuuuaaaucccauguuagcacccugacagaucuccaaccuuacaugcggcaguucguggcucaucugcaggagaccucuccccuuagagacgccguggucauugaacaguccagcucucugaacgaggcuuccagcggccucuuugauguguuccugcgcuucaugugucaccacgccguucggaucagagggaagucuuaugugcaaugccagggcauuccgcagggcagcauccuguccacacuucuguguagccucugcuacggggacauggagaauaaacuguuugcgggcauccggcgcgauggacuccugcuuagacuggucgacgauuuccuccuggugacgccucaccugacccaugccaagacauuucuuucuuaugcucggaccuccauucgcgccagccugacauucaacagaggcuuuaaagcugggcggaauaugcgcagaaaacucuucggaguucugcggcucaagugucacucccuguuucuugaccugcaagugaacucucuccagaccgucugcacgaauaucuacaagauucugcugcuucaggccuaucgcuuccaugccugugugcugcagcuccccuuucaccaacagguuuggaagaaccccaccuucuuucugagagugaucagcgacacagcuucccucugcuacucuauucugaaagcgaagaacgccggcaugagccuuggggcuaaaggagccgccggcccucugcccuccgaagcuguccaguggcugugccaccaggccuuccuccugaaacuuacccggcauagagugacauaugugccucugcucgggucucugcgcaccgcgcaaacgcagcucagccggaagcugccgggcacaacccuuacagcucuggaggccgccgcuaaucccgcccugccuuccgauuuuaagaccauccucgacuga

SEQ ID NO: 76743 - RNA, 564 nt, Artificial Sequence
  derived and/or modified sequence opt5 from TESC__Homo_sapiens__NP_001161797
augggcgccgcucacagcgccuccgaggaagugagagagcuggaagggaagaccggauucucuagcgaccagaucgagcaacuccaucggcgcuuuaaacagcuguccggcgaucagcccacaauuagaaaccuucggaaggggccuucuggacuggcggacgaaaucaauuucgaggauuuucucacgauuaugagcuacuuccgcccgaucgacaccacaauggaugaggaacaggucgagcuguccagaaaagaaaaacuucgguuucuguuccacauguaugacucugauagcgacggccgcauuacccucgaggaguacagaaacguuguggaggaacugcuguccgggaauccccauaucgaaaaggagagcgcucggucuaucgccgauggagccaugauggaagcugccuccgugugcaugggccaaauggagccugaccaggucuaugagggcauuacauuugaagauuuccucaagaucuggcaggggauugacaucgagaccaagaugcacgugcgcuuucugaacauggaaacaauggcucuuugucauuga

SEQ ID NO: 76744 - RNA, 1266 nt, Artificial Sequence
  derived and/or modified sequence opt5 from TES__Homo_sapiens__NP_056456
auggaccuggagaacaaggugaaaaagaugggccucgggcacgaacagggauucggcgcccccugccugaaauguaaggagaaaugcgaaggguuugagcuucauuucuggagaaagaucugucggaauugcaaguguggacaagaggaacacgauguccugcucagcaacgaggaagaccgcaaaguuggcaagcuguuugaggauaccaaauacacaacgcuuauugcuaagcugaaauccgacgggaucccuauguauaagagaaaugugaugauucucaccaacccgguggccgcgaagaaaaaugucucuaucaacacagugaccuacgaaugggcucccccuguucagaaucaggcccuggcccggcaguauaugcaaaugcugcccaaggagaaacagccuguggcuggaagcgagggcgcccaguaccgcaagaaacagcucgcuaagcaacugcccgcccaugaucaggacccuuccaaaugccacgaacuuucuccgagagaggucaaggaaauggagcaguucgugaagaaauauaagagcgaagcgcugggcguuggggaugugaaacuccccugugagauggacgcccagggaccuaagcaaaugaacauucccggcggggaucgguccaccccugcugccgucggagcuauggaggacaaaucugccgaacauaagcgcacacaguacagcugcuauuguugcaagcuguccaugaaagagggcgaucccgcgaucuacgccgaaagagcuggguacgacaaacuuuggcacccggccuguuuugugugcagcacaugccacgagcugcucguggauaugaucuauuucuggaagaaugaaaagcuguacuguggacggcauuauugcgacucugagaaaccucgcugugcuggcugcgacgagcugaucuuuuccaacgaauacacccaggccgagaaucaaaacuggcaccucaagcauuucuguugcuuugauugugacagcauucuggccggcgaaauuuaugucaugguuaaugauaagcccgugugcaaaccuuguuacgugaagaaccacgcugucgugugccaggggugucacaaugcgaucgaccccgagguucagagagugacguauaacaacuucucuuggcaugccuccaccgaaugcuuucuuugcagcuguugcucuaaaugucugauuggacagaaguucaugcccgucgagggcaugguguuuugcuccguugaguguaaaaagcggaugagcuga

SEQ ID NO: 76745 - RNA, 1566 nt, Artificial Sequence
  derived and/or modified sequence opt5 from TESPA1__Homo_sapiens__NP_001129502
auggaggccagcgugcugucccccaccucuugggaaaagagacgggcuuggcuccgccagagcagaaacuggcaaacacagguccuggaggaagaggccgcggcugcccuucaggacguuccugauccggaacccuccucucuggacgauguguuccaggagggcaauccuaucaacaaaauugaggacuggcuccaagauugcggguacagcgaagagggauuuuccgaagaggccggccaguucaucuauaauggguuuuguucucacggaacgagcuucgaggacgaucugacccuuggcgcugaagccacacugcucgcugccaacgggaagcuguuuucccggagcuuccuggagaccgcgcgccccugccagcuccuggaccuuggauguucucuggccuccagcucuaugacaggcggcaccaauaaaacauccagcucuauuuccgaaauccucgauaaggugcaggaggacgcugaagauguccuguuuagccuuggguucggacaagaggaccauaaagauaccucccgcauuccugcccgguuuuucacgacccccucucaggcuaagggcaucgacuuucagcuguuccucaagagccaggugcgcagaaucgagauggaagacccuugccugaugcuggccucccgguuuaaacaaguucagacacucgcggugaccgccgaugcuuucuucugucuguacagcuaugucucuaagacaccggugcagaaauuuacccccucccacauguucuggaacugcaaucauccuacggacguucccagcauucgcauccuuucuagagagccugaaccccaaagcccgcgggaucgccugagaaaggccauuuccaaaaugugucucuacacaugcccucgggacagacccccuccuccccacaacacccccaagagaaauucucuggaucaggugguccuugaggugauggacaaggugaaagaagagaagcaguuucugcagcaagauagcgaccucgggcaguucucccaggaggauccgguucccccugcugaaggcaaaaagcugcccacaagcccuuaucccugugucuuuugcugugaggaagagacccagcaacggaugucuaccgugcuggccccgucccagacacucgacagcaacccuaaagugcccugcugcacgcauucucugccuaucgaagauccccagugguccaccgacccugcccagauuagacgcgagcuuuguagccugcccgcuacaaauaccgagacacacccggcgaaggacgaaaccuucuggaaacggaaguccagagcccgcaagucucucuuucagaaaaaccugaugggacggaaggucaaaagccuugaucuguccaucacgcaacagaaguggaaacagucuguggacagaccugagcuccgccggagccugucccaacagccccaggauacauucgaccuggaagagguucaaagcaauucugaggaggaacagucccagagcagauggcccucucgcccucggcacccgcaucaccaucagaccuuugcugggaaggauuccuga

SEQ ID NO: 76746 - RNA, 6411 nt, Artificial Sequence
  derived and/or modified sequence opt5 from TET1__Homo_sapiens__NP_085128
augagcagaucccggcacgcccgccccucuagacuggugcggaaggaggacgucaacaaaaagaaaaagaauagccagcuccgcaaaaccacaaagggcgcuaacaagaauguugccuccgugaaaacgcugucuccugggaagcuuaaacaacugauccaggaaagagaugugaagaaaaagaccgagccgaagcccccuguccccgugcggagccuccugacacgcgcgggagcugccagaaugaaccuugaccggaccgaaguucuguuccagaauccugagucccucacaugcaacggcuuuaccauggcccugcgcucuacaagccuguccagacggcucagccagcccccucugguggucgcuaaaucuaagaaagugccgcuuuccaaggggcuggaaaaacaacaugauugugacuacaagauucuccccgcccugggaguuaaacacagcgagaaugauucugugccuaugcaggacacccagguccuucccgauaucgagacgcugauuggcgugcagaacccuucccuccugaaggggaagagccaagaaaccacacaguucuggucucagcgcguggaggacuccaaaaucaauauucccacccauagcggaccggcugccgaaauccugccuggcccccucgagggcacaagaugcggggagggacuguuuuccgaagagacccuuaacgauacgucuggcagcccuaagauguucgcgcaggacacagucugugcccccuuuccccaacgggcuaccccuaaaguuacaucccaggggaauccgagcauccagcuggaagagcucggaucucgcguggaaucccugaagcuuagcgauucuuaucuggaccccauuaaaagcgagcacgauugcuacccuaccuccucucucaacaaggugauccccgaccugaaucugagaaacugucucgcccugggcgggagcaccuccccuacaagcgucauuaaguuccuucuggcuggaucuaaacaagccacgcucggcgcgaagcccgaccaucaggaggccuuugaagcuaccgccaaucagcaggagguguccgauacaaccagcuuccugggccaagcuuuuggggccaucccgcaccagugggaacuuccuggagccgaccccguucacggcgaggcucugggggaaacaccugaucuccccgagauuccuggagcgauccccgugcagggcgaggucuucgggaccauucuggaccagcaagaaacgcugggaaugucuggcuccgugguuccggaucucccuguguuucugcccguccccccuaacccgaucgccacauucaacgcucccagcaaauggccugagccccaguccaccgugucuuauggccuugccguccagggggccauccagauucugccucucggaagcggccauaccccccaauccucuagcaauuccgaaaagaacagccugccucccgugauggcuaucucuaauguugagaacgaaaaacaggugcacauuuccuuucugccggccaauacacagggguucccucuugcgcccgagcggggacucuuccaugcuagccugggcaucgcccagcugucucaagccgggccuuccaagagcgacagaggcucuagccaggucuccgugaccagcacaguucacguggucaacacgaccguggugacaaugcccguuccgauggucucuaccuccagcuccucuuacacaacccuccugccuacgcuugagaagaaaaagcgcaaacggugcggagugugugaacccugccagcaaaagaccaauuguggcgagugcacauauuguaaaaacagaaagaauagccaccagauuugcaagaaacgcaagugcgaagagcugaaaaagaaaccuuccguggucgugccccucgagguuaucaaggaaaacaaacggccccagagagagaagaagccuaaagugcugaaggcugauuuugacaauaaaccggucaacgggcccaagucugaaagcauggauuacucccgcuguggacauggcgaggaacagaaacuggagcuuaauccucacaccguggagaacguuacaaagaaugaagacucuaugaccgggaucgagguggaaaaguggacgcaaaacaaaaagagccagcucacagaucaugucaaaggagacuucuccgccaacgugcccgaggcugaaaagagcaaaaauucugagguugacaagaagcggaccaaauccccuaagcuguuugugcagacagucagaaacggcauuaaacacgugcauugccugcccgccgagaccaaugugagcuucaagaaauuuaacaucgaagaguucgggaagacccucgaaaauaacucuuauaaguuucugaaagauacagcgaaucacaagaacgccauguccagcgucgcuacggacaugucuugugaucaccuuaaaggccgcuccaauguucugguguuccagcaaccuggauuuaacugcagcuccauuccgcauagcucucacagcaucauuaaucaucacgccuccauccacaacgagggcgaccagcccaagaccccugaaaauauccccucuaaagagccuaaggaugggagccccgugcagccgucccuccugucucugaugaaagaccggagacuuacacucgagcaggucguggcuauugaagcccugacccaacugagcgaggcgccuuccgaaaacucuagccccuccaagagcgagaaggaugaggaaucugagcagcgcacagccucccuccugaauagcuguaaagcuauccuuuacaccguucggaaggaccugcaggaucccaaccuccaaggagaaccucccaaacugaaccauugcccuucucuggagaagcaguccagcuguaauacgguggucuucaacggccagacaaccacccuuuccaauucucacauuaacagcgccacaaaucaggcuuccaccaaaagccaugaauacucuaaggugacaaacucccucagccuguuuaucccgaagucuaauagcuccaaaauugacacgaacaagucuaucgcccaagggauuaucacccuggauaauugcagcaacgaccuccaccagcugcccccuagaaauaacgagguugaguauuguaaucagcuucuggauuccucuaaaaagcucgacagcgacgaucuguccugccaggacgccacacauacccaaaucgaagaggauguggcuacacagcugacccagcuugcgagcauuaucaaaauuaacuacaucaagcccgaagacaagaaagucgagucuacgccuaccucccuggugacauguaauguucagcaaaaguauaaccaggaaaaaggaaccauucagcagaagcccccgagcuccgugcacaacaaucacggcucuagccucacaaaacaaaagaacccuacccagaagaaaacaaaguccacccccucucgggaucgcagaaaaaagaaaccuacggucgugagcuaccaggagaaugaccggcaaaagugggagaagcuguccuauauguacgggacaaucugcgauaucuggauugccagcaaauuccagaacuuuggccaguucugcccccaugacuucccuaccguguuuggaaagaucucuuccagcaccaaaauuuggaagccccucgcucagacaagaucuaucaugcaaccgaaaaccgucuucccuccccugacgcagauuaagcuucagcgcuaucccgaauccgccgaggaaaaaguuaagguggagccucuggauagccucucucuguuucaccugaagacagaaagcaauggcaaagccuucaccgacaaggcuuacaacucccaggugcaacuuacagucaaugccaaccagaaagcgcauccgcugacccagcccucuagcccucccaaucagugugcuaacgugauggccggggaugaccaaauccgguuucagcagguugugaaggagcaacucaugcaccagagacugccuacacuccccggaaucucccaugagaccccucugccggaaagcgcccuuacgcugcgcaaugucaacgugguuugcuccggcgggauuaccguggucucuacaaaaagcgaggaagagguguguuccucuagcuucggaaccuccgaguuuucuacagucgauagcgcucagaagaauuucaacgacuacgccaugaauuuuuucaccaaccccacgaagaaucucguguccaucacaaaagacagcgaacugccuaccugcucuugucuggauagaguuauucagaaggacaaaggccccuauuacacacaccuuggggcgggcccuuccguggcugccguccgggagaucauggaaaaccgcuauggacaaaagggcaacgccauuagaaucgagaucgugguuuacaccgggaaagaaggaaagagcucucacggcugccccauugcuaagugggugcugcggcgcuccagcgaugaggagaaaguccucugucuggugagacagcggaccgggcaucacugcccgacagccgugaugguuguccucaucauggugugggacggaauuccucugcccauggcugaucgccuuuauacggaacugaccgagaaucugaagucuuacaacggccaucccacagacagacgguguacccucaaugaaaaccgcacaugcaccugucagggcaucgauccugagacgugcggggccuccuuuagcuucggaugcuccuggagcauguauuuuaauggcuguaaauucgggagaucucccagcccucggagauuccgcauugacccguccucuccccugcacgaaaagaaccuugaggauaaucugcagagccucgcgacacggcuggccccuaucuacaaacaauacgcucccguggccuaucagaaccaggucgaguacgaaaauguggcuagagagugccgccucggauccaaggaaggccggccuuuuucugggguuaccgccugucuggacuucugcgcccacccccauagagauauucacaacaugaauaacggaagcaccguggucuguacacuuacccgcgaggacaaucggucccugggcgugaucccgcaggacgaacaacugcauguucucccucuguauaagcuuucugauacagacgaguuuggcagcaaagaggggauggaagcuaagaucaaauccggagcgauugaggugcuggcccccagacgcaagaaacggacgugcuucacccagccuguccccagaagcggcaagaaacgggcugccaugaugacagaagugcucgcccacaagauccgcgcuguugagaagaaaccuauucccagaaucaagcggaaaaacaauucuaccacaaccaacaacuccaagccgagcucucugccuacgcucggguccaauaccgagacagugcagcccgaagucaaaagcgagaccgaaccccauuuuauucugaaguccucugauaacacaaagaccuacagccuuaugccuuccgccccgcaccccgugaaagaggcgagcccuggauucucuuggucccccaagacagcuagcgccacgccugccccccugaaaaaugacgcuaccgccucuuguggcuuuagcgaacgcuccucuacaccucacugcaccaugcccagcgggagacuguccggagcgaacgcugccgccgcugauggcccgggcaucucucagcucggggagguggccccucugcccacccuuagcgcuccugucauggagccccugaucaauuccgaaccgagcacaggaguuacggagccucucaccccccaucaacccaaccaccagccuucuuuccugacauccccccaggaccucgccagcuccccuauggaagaggaugaacaacauucugaggcggacgagccgcccagcgaugaaccucuguccgacgauccccuuucuccugccgaggaaaagcugccccacauugacgaguauuggagcgauuccgaacacaucuuucuggacgcuaauauuggcgggguggccaucgcuccugcccauggaagcgugcucauugagugugcccggagagagcugcacgcuaccacaccggucgaacaucccaaccgcaaucacccuacccggcuuucucugguguucuaccagcauaaaaaccucaauaagccccagcacggcuuugagcugaacaagaucaaauucgaagcgaaggaggccaaaaauaagaaaaugaaggcuuccgagcagaaggaccaagccgccaacgaagggccugagcagagcucugaaguuaaugagcugaaccagauccccucccacaaagcucucacgcuuacacaugauaacguggucaccgugagcccguaugcccugacccacguugcgggaccuuacaaucauuggguguga

SEQ ID NO: 76747 - RNA, 6009 nt, Artificial Sequence
  derived and/or modified sequence opt5 from TET2__Homo_sapiens__NP_001120680
auggagcaggacagaaccaaccacguggaaggcaaucggcugagccccuuccucaucccuuccccgcccauuugccaaacagagccucuggccacgaagcuucagaacgggucuccccugccugaacgcgcucaucccgaggucaauggagauaccaaauggcacagcuuuaaguccuacuauggcaucccuuguaugaaagggucucagaacagcagaguuuccccggacuucacacaggaaucucggggauacagcaagugccuccaaaauggcgggauuaaacgcaccguguccgagcccagccugucuggacuucugcagaucaagaagcucaaacaggaucagaaggccaacggcgagagacggaauuuuggcgugucccaagaacgcaacccuggggagagcucucagcccaaugucuccgaccugagcgauaaaaaggaaucuguguccagcguugcgcaggagaacgcugugaaagacuucacauccuuuucuacccauaauuguagcggaccugagaaccccgaacugcagauucucaaugagcaagaaggcaaguccgccaacuaucacgauaagaauaucguccugcuuaaaaacaaggccgugcugaugccgaacggggcuacaguuagcgccucuuccguggagcauacccacggagaacuccuggagaaaacgcuuagccaguacuauccugacugcgucucuaucgcugugcagaagaccacaagccacauuaaugccaucaacucccaagcgaccaaugagcugucuugugaaauuacacaucccagccacaccuccggccagaucaacagcgcccagacgucuaauuccgagcucccucccaaacccgcugccguggucagcgaagcuugcgaugccgacgaugcggacaacgccucuaagcuggcugccaugcugaauacauguuccuuccagaaaccugagcaacuccagcagcagaagagcguuuuugaaauuugcccgucccccgcugagaacaauauccaagggaccacaaagcuggccucuggagaggaauucuguagcggcuccucuagcaaccuucaggccccuggcggguccagcgagagauaccugaaacagaaugaaaugaacggagcuuauuuuaagcagucuuccguguucaccaaagauagcuuuucugcgaccacaacgcccccucccccgucccaacuccugcuuagcccucccccuccccugccucaggugccccagcucccgucugagggcaagagcacccugaaugggggaguccuggaagagcaucaccacuacccuaaccaguccaauacaacccuccugcgggaggugaaaauugaaggcaagcccgaggcccccccuagccaaucuccgaaccccuccacacauguuugcagcccuucccccaugcuuucugaacgcccucagaacaauugugugaacagaaaugacauccagaccgcugggacgaugacagucccccugugcagcgagaagacccggccuauguccgagcaccucaaacauaaccccccgaucuucggaucuagcggcgaacugcaagacaauugccagcagcuuaugcgcaacaaggagcaggaaauucugaaaggcagagauaaggagcaaacccgggaccucgugccucccacacagcacuaccugaaaccuggguggaucgaacugaaggccccccgcuuucaucaggccgagucccaccucaagagaaaugaggcuucucugccgagcauucuucaguaucaaccuaaccuguccaaucagaugaccagcaaacaguacacaggaaacucuaauaugcccggcgggcucccucggcaggccuauacgcaaaagaccacacagcuggaacacaaaucccagauguaccaaguugagaugaaccagggacagagccagggcaccguggaucaacaucugcaguuccagaagcccucucaccagguccauuucuccaaaacagaccaccuucccaaggcgcacgugcaaagccucugugggaccagauuucauuuccagcagcgcgcugauucucagacggaaaagcugauguccccuguccugaaacaacaccucaaucagcaggccagcgagaccgaaccguuuuccaacagccaucugcuucagcacaagccccauaaacaagccgcucagacacagccuucucaaagcucccaccugccccagaaucagcagcaacagcagaagcuccagaucaaaaacaaggaggagauucugcaaaccuucccucacccccagucuaacaaugaccagcagcgggaaggcagcuuuuucggacaaacaaaaguggaggaaugcuuucauggcgagaaccaguauuccaagucuagcgaauucgagacccacaauguucagauggggcuggaggaagugcaaaacaucaauagacgcaacuccccuuacucucagacgaugaagagcuccgccuguaaaauccaggucagcugcucuaauaacacacaucuuguguccgagaauaaggaacagaccacacacccggagcucuuugcuggaaacaaaacccaaaaucugcaucacaugcaguauuuccccaacaauguuauuccuaagcaggaucugcuccaccgguguuuucaggagcaagaacagaaaagccagcaggccucugugcugcaaggcuacaagaacagaaaucaggacauguccgggcagcaggcggcccaacuugcucagcagcgcuaccugauccauaaccacgccaacgucuuccccgugccugaucaaggaggcagccauacccagacacccccgcagaaggacacgcagaaacacgcugcccuccgguggcaccugcugcaaaagcaggagcagcagcaaacccagcagccucagacagaauccugccauucucaaaugcacagacccauuaaaguggagcccggguguaagccucaugcgugcaugcacaccgcccccccugaaaauaaaacauggaagaagguuaccaaacaggagaacccgcccgcuagcugugauaauguccagcaaaaguccaucauugagacgauggaacagcaucuuaaacaguuucacgccaagagccucuucgaccacaaagcucugacacugaagucucagaagcaagugaaaguggagauguccggcccugucaccgugcucacccgccagacaaccgccgccgaacuggacagccauacacccgcucuugagcagcagacgaccucuagcgaaaagacaccuaccaaacggacagcggccuccguucugaacaauuucaucgagucucccagcaagcuccuggauaccccgaucaaaaaccugcuugacacgccugugaagacccaauaugauuuucccuccugcagaugugucgagcagauuaucgaaaaagacgagggaccuuucuacacacaccucggcgcugggcccaauguggccgccauucgcgaaaucauggaggaacgguuuggacagaagggcaaggcuauuagaaucgagcggguuauuuauaccgggaaagagggaaagucuagccagggcugcccuaucgccaaaugggugguccgcagauccagcucugaagagaagcugcugugccucgugcgggaaagagcggggcauacaugugaggcugccguuaucgugauucugauccuugucugggagggcauuccccugucccucgccgauaaacuguacagcgaacugaccgagacacuucgcaaguauggaacccugacgaaccggagaugcgcucucaaugaagagcgcacaugugccugccaaggccuggacccggaaaccuguggggcguccuucucuuuuggaugcagcugguccauguacuauaacggcuguaaguucgcuagaucuaaaaucccucggaaguuuaaacuccugggggaugaccccaaggaggaggaaaaacuugagagccaccugcagaaucucuccacccugauggcccccacauacaagaagcuggccccugaugcuuacaacaaucagauugaauaugagcaccgcgccccggaaugcagacuuggacugaaagagggccggcccuucagcggggugaccgcuugucucgacuuuugcgcccaugcgcaccgcgaucugcauaacaugcaaaauggcucuacgcucguguguacacugaccagagaggacaaccgggaauucggaggcaagccugaggaugaacagcuucacguccugccccucuacaaaguuuccgacguggacgaguuugggagcguggaagcccaggaggagaagaaacgcucuggagcuauccagguccuguccagcuucagacggaaggugcgcaugcuggccgaaccuguuaagacaugcagacaacggaaacuugaggcuaagaaagccgccgcugaaaagcugucuagccucgagaauuccucuaacaaaaacgagaaggaaaagagcgcgcccuccagaaccaaacagacagagaaugccagccaggcuaagcagcuggccgaacuccugcgccuuuccggcccugugaugcaacagucucagcagccgcaaccccugcagaaacagccuccccagccucaacagcagcaacggccccagcagcagcaaccgcaucacccucagaccgagagcgucaacuccuauucugccagcggguccacgaaucccuacaugagacgccccaacccugugucucccuauccuaauagcucccacaccagcgauaucuacggaucuacauccccgaugaacuuuuauagcaccucuucccaggcugccggcagcuaccugaauucuuccaaccccaugaauccuuaccccggccuccugaaccagaauacacaauauccuagcuaccagugcaacgggaaucuuuccguugacaacuguagccccuaucugggaucuuacagcccgcagucccagccuauggaucucuaucgguaccccucucaagacccucugagcaagcucucccugcccccuauucauacccuuuaucagcccagauucggcaauucucagagcuucacguccaaauaccugggguacggaaaccaaaacaugcagggcgauggguuuucuagcugcacaauccgcccgaaugugcaccaugucggaaagcugccucccuaucccacccacgaaauggacggccacuucaugggcgcgacaucccggcucccuccgaaccugagcaaucccaacauggauuacaaaaauggggagcaucacucuccuucccauauuauccacaacuauagcgcugcccccggaauguuuaauucuucccuucaugcccugcaccuccagaacaaggagaaugacaugcugagccacaccgcuaacggccucuccaagaugcugccugcccuuaaucaugauagaaccgcgugugugcaggggggacugcacaaacugucugacgcuaacggccaagaaaagcagccccucgcccugguucaggggguggccagcggagcugaggauaaugacgaagucugguccgauagcgagcagucuuuccuugacccugacauuggcggcguggccguggcucccacacauggguccauccugaucgaaugcgccaaacgcgagcuccacgcgacgaccccgcugaagaacccuaaucggaaccaucccacaagaauuagccucgucuuuuaccaacacaaaucuaugaacgagccuaagcacggacuggcccuuugggaagcuaagauggccgagaaagcucgggaaaaggaggaagagugugagaaauauggccccgauuacguuccgcagaagagccaugggaaaaaggugaagcgcgaaccugccgagccccacgaaaccuccgagcccacauaucugagauucaucaaaucucuggccgagcggaccaugagcgugacgacagacuccaccgucaccacaucuccuuacgcuuuuacccgcgugacaggacccuacaauagauauauuuga

SEQ ID NO: 76748 - RNA, 5388 nt, Artificial Sequence
  derived and/or modified sequence opt5 from TET3__Homo_sapiens__XP_005264244
augagccaguuccaagugccccuggccguccagccugaccucccgggccuguacgauuuuccccagagacagguuauggugggguccuucccuggaucuggccuuagcauggcuggguccgagucucaacugcggggaggcggggacggacgcaagaaaagaaagcggugcggcaccugugaacccugccgcagacucgagaacuguggcgccugcaccagcuguacgaaccggcgcacccaccagaucugcaaacugagaaagugugaagugcuuaaaaagaaggucgggcugcucaaagagguggaaauuaaggccggagagggcgcugggccuuggggacagggcgccgccguuaaaacaggguccgagcugucucccguggauggaccugucccgggccagauggacagcggccccguguaucacggggauucccggcaacugagcgcuucuggaguuccugugaacggcgcccgcgaacccgcugggccuucccuccugggaaccggcgggcccuggagagucgaccagaagccggauugggaggccgccccuggacccgcccacacagcucggcuugaagacgcccaugaucugguggcuuuuagcgccguggcggaggccgucucuuccuacggcgcucucagcacccgccuguaugagacauucaauagagaaaugucucgggaggccggcaacaauucccgcgggccuagacccggacccgaaggcugcagcgcuggguccgaggaccuugauacccugcagacggcccucgcccuggcucggcacggaaugaaaccuccgaacuguaauugcgacggccccgaauguccugauuaccuggaguggcucgaggggaagaucaagucuguugugauggaaggcggagaggaaagaccccgccugccuggcccccuuccgccuggggaggcgggacugcccgccccuagcacccggccccuccuguccagcgaagugccucagauuucuccccaagagggccuuccgcugucccagagcgcucucucuaucgccaaagagaagaacauuagccugcagacagccaucgcuaucgaagcccugacccaacucuccucugcgcugccucagcccagccauuccacaccccaggcuagcugcccucuuccggaggcccugucucccccugcccccuuuagauccccucagagcuaucuccgcgcucccucuuggccugucgugcccccggaagaacacuccagcuucgccccugacuccucugcuuuucccccugccacaccccggacggaguucccggaggcgugggggacagacaccccucccgccacaccuagaagcuccuggcccaugccccgcccuucuccggaucccauggcugagcuggaacaacuucugggaagcgccuccgacuacauucagagcguuuuuaaacggccugaggcucuccccaccaagccuaaagugaaggucgaagcccccucuuccagcccugcgccggcccccucuccugugcugcagagagaggcucccaccccuuccagcgagcccgauacacaccagaaagcccaaacggcucugcagcagcaucuccaccauaagcgcucucuguuccuugaacagguucacgacaccagcuuuccggccccuuccgagcccagcgcccccggcugguggccucccccuucuuccccggugccccggcugccugauagacccccuaaggagaaaaagaagaaacuccccacaccggcugggggcccugucggaaccgagaaagcggcccccggcaucaaaccuagcgugcgcaagcccauucaaaucaaaaagucccggccuagagaagcucagccccuguucccgccuguccggcagauugugcuggaggggcuucgcucucccgccagccaggagguucaagcccaucccccugcuccgcuccccgccucccagggaucugcggugccucugcccccugaacccagccuggcucucuuugccccuuccccgucuagagacagccugcuucccccuacacaggagaugcggucccccagcccuaugaccgcccugcaacccggcucuacggggccgcucccucccgcugaugacaaacuggaagaacugaucagacaguucgaagccgaguucggagauuccuuuggccuucccgggccucccagcgucccuauucaggacccggagaaucagcaaacaugccuccccgcgccugaaucucccuucgcuacccgcuccccuaagcagaucaaaaucgagagcucuggcgccgugaccguucuguccacaaccuguuuucauagcgaagagggaggccaggaagccacacccacgaaggcugagaacccgcugaccccuacacucuccggguuccuggagagcccccuuaaguaucuggauaccccuacaaaaucucuccuggacacccccgccaagcgggcucaggccgaauuuccuacgugcgacuguguggagcaaauugucgaaaaagaugagggacccuacuacacccaccugggcagcgggccgacaguggcguccaucagagagcuuauggaagaaagauauggagaaaagggcaaagccauuagaaucgagaaggugauuuacaccgggaaggaaggcaaaucuagccggggaugcccuaucgcuaaguggguuauccgcagacauacacucgaggagaaacugcugugucucguccggcaccgcgccggccaucacugccagaaugcugugauugugauccugauucuugccugggaagggauccccagaucccugggagacacccucuaucaggagcugacggauacacugcggaaguacggcaaccccaccucucgcagaugugggcuuaaugacgaucggacaugcgccugucagggaaaagacccuaauaccugcggcgcuagcuucuccuuuggcuguucuuggagcauguauuucaaugggugcaaguacgcgcgcuccaaaaccccgagaaaguuucggcucgccggagauaaccccaaggaagaggaaguccugagaaagagcuuccaagaccuggcuacagagguggccccucucuauaagcgccuggcgccccaggcuuaccagaaccaaguuacgaaugaggaaauugccaucgauugccggcuuggccugaaagaggggagaccuuuugcgggagugaccgcuuguauggacuucugcgcccacgcccauaaggaucagcacaaccucuacaauggcuguacagucgugugcacccugacaaaagaagacaaccgcuguguugggaagauccccgaggaugaacagcugcaugugcuuccucuguauaagauggcuaauaccgacgaguuuggaucugaggaaaaccagaaugccaaagucggcuccggcgcgauucaagugcucacggcuuucccccgggagguuagacgccugccggaaccugccaagagcugccggcagagacagcucgaggcccgcaaagcugccgcugagaagaaaaagauccagaaggaaaaacugucuacacccgagaagauuaaacaagaagcccuugagcuggcggggaucaccuccgacccuggacucagccugaagggcgggcugucccagcagggacuuaaacccucucugaagguggaaccgcagaaccacuucagcuccuuuaaguacagcggcaaugccgucguggagucuuauuccgugcucgggaacugucggccuagcgaucccuacucuaugaauagcgucuauuccuaccacucuuauuacgcucaacccagccugaccuccguuaacggauuccauucuaaauacgcccucccuagcuuuuccuauuacggcuuccccagcucuaauccuguguuuccgucccaguuccugggccccggggcuuggggacacagcggcuccucugggagcuuugagaagaaaccugaccuucaugcccugcacaacucccucucucccgccuauggaggcgcugaguucgcggagcugccuagccaggccgugcccacagaugcucaucacccuaccccgcaccaucagcaacccgccuacccugggcccaaggaauaucugcuuccuaaagcgccccugcuccacuccgucagcagagacccgucuccuuuugcucaguccagcaauugcuacaaccggucuauuaagcaggagcccguggauccccugacacaagccgaaccuguuccccgcgacgcgggaaaaaugggcaagacgccucucuccgaggugagccagaacggcgggccgucucaucuguggggacaguauagcggcgggcccuccaugucuccuaagagaaccaauggagucggcgggagcuggggaguguucuccagcggcgagucccccgcuaucguuccugauaaacuuucuagcuuuggcgccuccugucuggcccccucucacuucacagacgggcaguggggacuguuuccgggcgaagggcaacaggcugccagccauuccggaggccggcuccgcgggaagccuuggucucccugcaaauucggaaacagcaccuccgcgcuggccggcccuagccuuacagagaagcccugggcucugggcgccggggauuucaauucugcucucaaaggauccccgggcuuucaggacaagcuguggaacccuaugaagggggaagagggacgcauucccgccgcuggcgccagccagcucgaucgggcguggcaaucuuucgggcugccccuuggauccagcgaaaaacuguuuggcgcccugaagucugaggagaaacucugggacccuuucucccuggaagagggccccgcugaggaaccuccgagcaagggggccgugaaagaggaaaagggaggcgggggagcugaggaagaggaagaggagcuuugguccgauagcgaacacaauuuucuggacgagaacaucggcggggucgccguggcccccgcucacggcucuauccucauugaaugugcgagacgcgagcugcaugccaccacgccucucaagaaacccaaucggugccacccuaccagaaucagccugguuuucuaccagcauaagaaccuuaaucagcccaaccacggacuggcucugugggaagccaaaaugaagcagcucgccgagcgcgcucgggccagacaagaggaagcggcccgccugggccuugggcagcaggaggcuaaacuguacggaaagaagcggaaauggggcgggacaguggucgccgaaccucaacagaaggagaaaaagggaguggugccgaccagacaggcucucgccguccccacagacuccgcgguuaccgugucuagcuaugccuacacaaaagugaccggcccuuauucccgcuggauuuga

SEQ ID NO: 76749 - RNA, 750 nt, Artificial Sequence
  derived and/or modified sequence opt5 from TEX101__Homo_sapiens__NP_001123483
augggcacccccagaauccagcaucugcucauucugcuugugcugggggccagccuccugacauccggacuugagcuguacugccaaaagggccucucuaugacggucgaagcugacccugccaacauguucaauuggaccacagaggaaguugagaccugugauaaaggggcgcugugccaggaaacaauccugauuaucaaggcuggaaccgagacagccauucucgccaccaaaggcuguaucccggagggggaagaggcuaucacgauugugcagcacagcucucccccuggacugaucgugaccuccuauagcaacuacugcgaagacuccuuuuguaaugauaaggacucucuuagccaguucugggaguuuuccgagacaaccgccagcacagucucuaccacgcugcacugccccacauguguggcucucgggaccugcuucuccgccccuagccugcccuguccuaacggcacaacccggugcuaucaaggcaaacuugaaauuaccggaggcgggaucgagucuuccguugaagugaagggauguacagcgaugauuggcugccgccugaugagcgggauccucgccgucggaccgauguuugugagagaggcuugcccccaucagcugcugacgcagccucggaagaccgaaaauggcgccacaugucuccccauuccuguuuggggccugcagcuucugcucccccugcuucugccgucuuucauccacuuuuccuga

SEQ ID NO: 76750 - RNA, 2823 nt, Artificial Sequence
  derived and/or modified sequence opt5 from TEX11__Homo_sapiens__NP_001003811
augaucagcgcccacugcaaccugagacuccuguguuccucugacagcuccgcuucugccagccagguggcgggcaccacagaggucguugaaaaucuugugacgaacgauaauucccccaacauuccugaggcuaucgaccggcuguucucugauauugccaauaucaaccgcgaaagcauggccgagauuaccgacauccaaaucgaagagauggcugugaaucucuggaacugggcccugacaauugggggaggcuggcuugucaaugaggaacagaagaucagacugcauuacguggcuugcaaacuccuguccaugugugaggccagcuuugcgucugaacaguccauucagcggcugaucaugaugaacaugcgcauugggaaggaguggcucgaugccggaaauuuccugaucgcugacgagugcuuucaagccgcuguugccagccuugaacagcuguaugugaaacucauucagagaucuuccccggaggcggaucugaccauggaaaagaucacagucgagagcgaccacuuccgggugcuuucuuaccaggccgaauccgcuguugcccaaggcgauuuucagcgcgcuagcaugugugugcugcagugcaaagacaugcucaugagacugccccagaugaccuccucucugcaucaccucuguuauaacuucggggucgagacacaaaagaauaacaaguacgaggaaagcuccuuuuggcugagccagucuuaugauaucggaaaaauggacaagaaauccaccggcccugagaugcuugccaaggugcugcggcuccuggccacgaauuaccuugauugggacgacaccaaauauuacgauaaggcucugaacgcggugaaccucgccaauaaggaacaucugagcucucccggccuguuccucaaaaugaagauucugcuuaaaggggagacaagcaacgaggagcugcucgaggcugucauggaaauccugcaccuugacaugccucuggauuuuugccucaauauugccaagcugcugauggaccacgagcgcgaauccguuggauuccauuuucucaccaucauucacgagagauucaaaucuagcgaaaacaucggcaaggugcugauccuucauacagauaugcugcuccagcggaaagaggagcugcuggccaaggaaaagauugaggaaaucuuucuugcucaccaaaccgggcgccagcucacggccgaguccaugaauuggcugcacaacauucuguggagacaggcggcuagcucuuucgaggugcagaauuacacagacgcccuccaaugguauuacuauucccugcgguucuacagcaccgaugaaauggaccuugauuuuacaaaacugcagcgcaacauggccuguugcuaucucaaucugcagcagcuggacaaggcuaaagaggccgucgcugaagccgagagacaugauccccggaacguguucacccaauuuuacaucuucaagauugcgguuaucgaaggaaauucugagagagcccuucaggcuaucauuacccucgagaacauccugacagacgaagaguccgaagacaaugaucugguggccgagcgcggcagcccuacgaugcuccugucccuugcugcccaguuugcgcuggaaaacgggcagcaaauugucgccgagaaagcucucgaguaucuggcccagcacucugaagaccaggaacaggugcugaccgcuguuaagugucuucuccgguuccugcugccgaagaucgccgaaaugcccgagagcgaagauaaaaagaaagagauggacagacuccugacaugccuuaaucgcgccuuugugaagcugucccaaccuuucggagaggaagcucucucucuggagagccgggcgaacgaagcccagugguuuagaaaaaccgcuuggaaccuggccguccagugcgauaaggaccccgugaugaugcgcgaguucuuuauucuuuccuacaagaugagccaauucuguccuucugaucaggucauccucauugcccggaaaacaugccugcugauggcuguggccguugaccucgagcagggcagaaaggcguccaccgcuuuugaacagacgauguuccugagccgcgcccuugaggaaauccaaacauguaaugauauccauaacuuccugaaacagaccggcaccuuuucuaaugacuccugcgagaagcuccugcugcuuuacgaguucgaagugcgggccaaacugaacgauccccuccuggagagcuuucucgaaucugucugggagcugccgcaccuugaaacaaagaccuucgagacaauugcuaucauugccauggaaaagccugcgcauuauccccugaucgcucucaaagcccugaagaaagcccugcuucuguacaagaaagaggagccuauugacaucagccaguauuccaaguguaugcacaaucucgugaaccugagcguucccgauggggcuucuaauguggaacucugcccccuggaggaagucuggggauacuuugaggacgcccuuucccacaucagcagaacgaaagacuauccugaaauggagauucuguggcucauggugaaguccuggaacaccggcgugcugauguucucucgcagcaaguacgcuuccgccgagaaauggugugggcuggcgcuucgguuucugaaucaucucacaucuuucaaggaaagcuaugagacccagaugaacaugcuguacucccaacucguugaagcccugucuaauaacaaaggaccggucuuucacgagcauggcuacuggagcaaguccgauuga

SEQ ID NO: 76751 - RNA, 4494 nt, Artificial Sequence
  derived and/or modified sequence opt5 from TEX14__Homo_sapiens__NP_001188386
augagcagagccgugcggcugcccgucccuugcccgguucagcucggcacccugcgcaacgacucccuugaggcucaacugcacgaauacgugaagcaggggaauuaugugaaagucaagaaaauccucaagaaaggaauuuacguggaugccguuaacucucugggccagacagcgcuuuucguggcugcccugcucgggcugagaaaguuugucgacgugcugguugauuauggaagcgaccccaaucaucgguguuucgauggcuccacgccugugcacgccgcugccuuuucugggaaccaguggauccucagcaagcugcuugacgcuggaggcgaucugcgccuccaugacgagagaggccaaaaucccaaaaccugggcccugacagcggggaaggaacgguccacccagauugucgaguucaugcagcgcugcgccucucacaugcaggcuaucauucaaggauuuagcuacgaucuucugaaaaagaucgacuccccucagagacucguguauagccccucuugguguggcgggcuggugcagggaaacccuaauggcuccccgaaccggcugcucaaagccggggucaucagcgcucagaauauuuacucuuucggauuuggcaaggccaugcccugguuccaauuuuaucugacaggcgcgacccagauggccuaccuugggucccugccuguuaucggagaaaaggaggugauucaggcugaugacgagcccacauucagcuuuuucucuggcccuuacauggugaugaccaaccucgucuggaaugggucccgcgugacgguuaaagaacugaaccuucccacccauccgcacugcagcagacugcggcucgccgaucugcugaucgcugagcaagaacacuccucuaagcuccgccauccuuaucugcuucagcugauggccgugugucucagccaggaccuggagaaaacaagacuugucuacgagcggauuaccaucggaacacuguuuuccgugcuccacgaacgcagaagccaguuccccguucugcauauggaggugauuguccaucugcuccugcaaaucucugacgcccuucgguaucugcacuuccagggcuuuauccacagaucccucagcucuuacgcugugcacauuaucagcccuggggaagcgcgccugaccaaucuggaguauaugcuugaauccgaggaucggggaguccagagagaccucacgcgcgugccccugcccacacagcuguacaacugggccgcuccugagguuauucuccaaaaggccgccaccgugaaaucugauaucuauagcuucuccaugauuaugcaggaaauccugacagacgauaucccguggaagggccuugacggcagcgucgugaaaaaggcuguugugucugggaauuaccuggaggccgauguccggcuccccaagccuuacuaugacauugugaaauccggaauccaugugaagcagaaagauagaaccaugaaccugcaggacauucgcuacauccugaagaacgaucuuaaagacuuuaccggcgcgcaacggacacagcccacggaaagcccuagaguucagcgcuaugggcuccaccccgacgucaauguguaccugggacugaccucugagcauccgcgggaaacaccugauauggagauuaucgagcucaaggaaaugggcucccagccccacagcccuagagugcacucccuguucaccgaggggacacuugacccccaagcuccugaucccugccugauggcccgcgaaacccagaaccaggacgccccguguccugcucccuuuauggccgaggaagcuagcagccccuccacgggccaaccuucucucugcagcuucgagaucaaugagauuuauuccggaugucugauccuggaagaugacauugaggaaccgcccggcgccgcgagcucucuugaggccgaugggccuaaccaggucgacgagcucaaguccauggaagaggaacuggauaaaauggagcgggaggcuugcuguuuuggaagcgaagacgagucuuccagcaaggccgaaacagaguacucuuucgaugacugggauuggcagaauggcagccuguccagccucucucugcccgaauccaccagagaggcuaaaagcaaccuuaauaacauguccaccacagaagaguaucugaucucuaagugcgugcucgaccugaaaauuaugcagaccaucaugcaugagaaugacgaucggcugcgcaacauugaacaaauccuugacgagguugaaaugaagcagaaggagcaggaagagagaaugagccucugggccacaucccgggaguuuacgaaugcguacaaacugccucuggccguggggcccccuucucucaacuacauucccccgguccugcagcuuagcggaggccaaaagccugauaccuccgggaauuaucccacacugccuagauucccccgcaugcucccgacccugugcgacccuggcaaacagaacacagaugaacaguuucaguguacccaaggagcuaaggacucucuggagacgagccggauccagaauaccuccagccagggcagaccccgcgaaucuacagcccaagcuaaagccacccaguucaacuccgcccuuuuuacacugagcucucacagacaggggccuuccgcuagccccucuugccauugggauuccacccggaugagcguggagcccguuuccagcgagaucuacaacgcggaaucucgcaauaaggacgauggaaaggugcaccucaaauggaagauggaggucaaagaaauggccaagaaagcugccacgggccagcugacagugccuccguggcacccccaaagcucccucacccuggagucugaagccgagaacgagccugacgcccuucugcagcccccuauuagaagccccgaaaauacagauuggcagcggguuaucgaguaucaucgcgaaaacgacgagccuagagggaauggaaaguucgauaaaaccggcaacaaugacugugacuccgaucagcacgggcggcaaccgcgccucggcucuuucaccagcauuagacaucccuccccucggcagaaggaacagcccgagcacucugaggcuuuucaggcgagcuccgacacacugguggcugucgaaaagagcuacucucaucaauccaugcagagcacgugcucuccugaguccagcgaagauaucaccgacgaguuccugacacccgauggagaauauuuuuacuccucuaccgcccaggagaaccuugcccuggagacaagcuccccgaucgaagaggacuucgaaggcauucagggggcuuuugcccaaccucaggugagcggagaggagaaauuccagaugcgcaagauccucggcaaaaaugcggaaauucugcccagaucucaauuucagcccgugcgguccaccgaggaugaacaggaggaaacgagcaaggagucuccuaaagagcucaaggaaaaggacaucagccugacagauauucaggaccuuuccucuaucagcuaugagcccgauuccucuuucaaagaagcuagcuguaagaccccuaaaaucaaccacgccccgaccuccgucagcacaccccugucuccuggguccguuagcuccgccgcuucucaauacaaggacugccucgagagcauuaccuuucaggugaaaacagaguucgccuccuguuggaacucucaggaauuuauccagacgcugagcgacgauuucauuuccgugagagagcgcgcuaagaagcuggacagccuucugaccucuuccgaaacacccccuagccggcucaccggacugaaaagacucucuuccuuuaucggcgccgggagccccucucuggucaaggcgugcgauagcuccccgccucacgccacacaacgccggucucuucccaaaguggaggcuuucagccagcaucacauugacgaacugccucccccuucccaggagcugcucgaugacaucgaacugcuuaagcagcaacagggcagcuccaccguucugcaugagaauacggccucugauggaggcgggaccgcuaaugaccagagacaccucgaggaacaagagacagauagcaaaaaggaagacuccucuaugcugcucagcaaggagaccgaggaucugggagaagacacagagcgcgcccauuccacccuugaugaagaccuggagcgguggcugcagcccccggaagagucuguggagcuccaggaccugccuaaaggcagcgaaagagagacaaacaucaaggaucagaaagucggggaagagaagcgcaaacgggaagacuccauuacccccgagagacggaagucugagggagugcuuggcacgucugaagaggaugaacugaaauccuguuucuggaagcgccucggcuggagcgagucuuccagaaucauuguucuggaccaaagcgaucucucugacuga

SEQ ID NO: 76752 - RNA, 8370 nt, Artificial Sequence
  derived and/or modified sequence opt5 from TEX15__Homo_sapiens__NP_112561
augcccagcgacgccaaggauuccgugaacggcgaccugcuccugaauuggaccucucuuaaaaacauucugagcgggcucaaugcuuccuucccucugcacaacaauacgggaucuagcacggucaccacauccaagucuauuaaagauccgcggcuuaugcggcgcgaagaaagcaugggcgaacaguccagcaccgccgggcugaacgaaguucuccaauuugagaagucuuccgacaaugugaacagcgaaaucaaaucuacacccuccaauagcgcgucuuccagcgagguggucccuggagauugugcugugcugaccaacggccuggacacacccuguuucaagaccuccguuaaugauucucagagcugggcccauaacaugggguccgaggacuacgauugcauuccucccaauaaggugacgauggccggacaguguaaagaccagggcaacuuuagcuucccuaucucugucuccaaugugguuagcgaaguggagaaccaaaaccacucugaagagaaggcucagagagcccagcaggagagcggcaaugcuuauaccaaagaauacuccucucauauuuuucaagauagccaguccagcgaccucaagacaaucuaucagaccgggugccagacaucuaccgucuucccgcugaaaaagaagguguccaucgaugaguaccuucaaaacacgggaaaaaugaagaauuuugccgaccuggaagacagcucuaaacacgaggaaaagcagacauccuggaaagagauugauaacgacuucaccaaugagacaaagaucagccccauugauaacuauaucgugcuccaucaggaauacaaagaguccgaaucucacaauagcuuuggcaaguccugugacaagauucugaucacccaagagcuugaaauuaccaaaucuagcacauccacgaucaaggauaaagacgagcuggaucaccucgcgcuggaguggcagaucaccccuagcuucgaaucucugucccagaagcauccccagcacagcgucgaguaugaagggaacauucauacaucucucgccaucgcucaaaaacugauggagcuuaagcugggaaagauuaaucagaacuacgccuccaucauuaccgaggcuuuuccuaaacccaaggacaucccgcaggccaaagagauguucaucgauacaguuauuagcucuuacaauaucgagaccgcgcacgacagcuccaacugcagcauuacgcgggaacacaucugugugcaucgcaagaaugagaacgaaccugugucucucgagaauauucagagagauuauaaagagacagccuacgucgaagaccggggccaagaccacaaccuguuuugcaacucccagcuuagcaaugauaucuggcugaacgugaauuucaagaagcagaccgaccgcgagaaccagaaugaagcuaaagagaacuccgccucuuguguugaaaauaacaucgagaauauuuauggggauaagaaacaagacagccauaccaacgagaauuucuccaacaucgaugaaaaggaggacaaaaauuaccacaacauugaaauccucucuagcgaggaauuuuccacaaaguucaaucugauuugcagagaggauaacgcugugucugccgccaccgcucugcucgagagcgaagaggacacaaucuccgcggucaagcagaaagauacggaaaacaccggacggagcguggagcaucuggccucuacaaccuuucccaagacagcuuccagcucuguuuguguggccuccaaugccgcuauucagaucgccagcgcgaccaugccugcucuuucucugaacaaugacgaucaccagaucuaucaauucaaagaaacgugcuccagcgagucccccgacuuuggccuccuggucaagcaccgcgugagcgauugcgagauugacaccgacaaaaacaagucucaggagagcuuccaucaguccaucaaugagaaccuuguccugcaaucuauugaacucgagagcgagaucgaaauugagcuggaagauugugacgaugccuuuaucuuccagcaggacacacacucccaugagaauaugcugugcgaagaguuugugaccucuuacaaagcccucaagagcagaaucuccugggagggccugcuugcucuggauaacggggaaauggagguucucgaaucuacaaccggacgggagaauagcgaccagcacuauuccaaggaaagcaacuacuucuacucuuccacgcaaaauaacgagacagagcugaccagccccauucugcuuccugaucuccagaucaaaauuacaaauaucuuucgcccgggcuucucucccaccgccgacucccuggcucugaaggauagcuuuuguacccacgugacagaagccacgaaaccugagauuaacaaggaagacggggagauccucggauucgauaucuauucccagcccuucggcgaaaaugcggacuacccuugcgaggauaaagucgacaacauuagacaggagucugggcccgugagcaacuccgaaaucagccugucuuuugaccuuucccggaauaccgauguuaaccauacaagcgagaaucaaaacucugaaagccuguucaccgagccguccaaugugacaaccauugacgauggaucucgcugcuuuuucacaaagagcaagacagacuauaacgauaccaaaaauaagaaagaggucgaauccagaaucucuaagcggaaacuccacauuagcuccagagaccagaacaucccucauaaggaucugcgccggcacaagaucuacggcagaaaacgccggcugaccagccaggacucuuccgagugcuuuagcucccuuucucagggcagaauuaagacauucagccaauccgaaaaacauaucaagucugugcucaauauucugagcgaugaggccucccuguguaaaagcaagugccucucucgcaagcuggacaaagcugugguucaccuuaagaaagcccaccggagaguccauaccucccugcagcucaucacaaaggugggggaagaacgcaaaggaccccugccuaagagcuaugcuauuaucuguaacaauuuuugggagucuugcgaucugcagggcuacuccagcgugucucaacggaaauauuacagcacgaagcacuucuccucuaagagaaaauacgacaagcgccggaaaaagagagcccccaaagcggacauuagcaagucccuuacccaugucagcaagcacaaauccuauaagacaucuggggagaagaagugucucagccggaaauccauggccucuagcguguccaagucucauccuaccacaagccacaugggagaguuuugcaaccaggaacaccccgagucccagcugccgguuagcucuaccucccagagcacgucucaauccguguacuauaauagcucugucuccaacccuagccuguccgaagaacaccagcccuucagcggcaagaccgcuuaccucuuuucucccgaucacagcgacgagaaacugaucgaaaaggagaaucagaucgauacagccuuccuuuccucuaccagcaaauaugaaaagcuggagaaacauuccgcuaaccacaaugugaaggacgccacaaaggaaaacucuugcgaugccaacgagguuauuaaugagagcaacuccgugucucucagcuguaucaaagaaaauauuaacuccagcaccgggaaugacugcgaugcuacauguaucggccacaccaaggcgaaaacggacguccugauuucugugcuggauuccaacguuaagcauuuucuuaaugaccucuaccagcaaggaaaccugauccugagcgauugcaaacgcaaucucgaggugaaguggacagacccuaucgaaagaccgaagcagaacauuaucaccggcaauuuccugauggggccccuuaaccugacccucauugccucuaaaaaguauuccaucccucagcugagcgcugccgccgucacagauuccgagggagagucuagcaaauccuaccuggacaagcagcggauucuuaccguggacagcuucgcugccucuuccacggugccccacugugaacaaagcugcagagagaaagaacugcucaagacagagcaguguucuagcggcaauugccugcauaccgaugggaacgaaacaaaugucaccgagaacuacgagcucgacguugcguccggaacagaagaggauaaaucuuauggcgaaaacaucguggagcugagcuccucugacagcucccuucugcucaaggauaaugugaagggguccucuagcgaaaccuguaucgucaaaaaggacacggaggaucgcauuaccuggaaagugaagcaggcugagaaagccaaggacagcguuuacaagcgguccaugacagaaggcucuaccgugaacacagaguauaaaaaucagaagaaccaaaucagcgaagaguccugccugaaugagaagauuaucaccacgaaccugauugauucucaccuuagcacaaagaauaccacaaccgaguccgucccucugaaaaacaccgugagcaauccccucaacaagagagagaagaaaggagaaaucaagguuucuaaagacucccagagcgaucugacacuccauucugagauugccuacaucuccaagccuggcauccugggggugaaucacacgcccauucuuccggcucacagcgaaaccuguaaagucccuacacugcucaagaagcccgccucuuauguguccgacuuuaaagagaagcauugcagcgcgaaccacaccgcucugaucgccaaucugucucagauucuucaacgcgccgaugaggcuagcucccugcagauccuccaggaagagacaaaaguuugccugaacauucucccucuguucguggaagccuuugagagaaagcaggaauguagcgucgagcaaauccuuaucucccgggagcugcugguggaccagaaucucuggaacaacugcaaacauacccugaagcccugugcuguggacacgcuugucgaacugcagaugaugauggagacaauucaguucaucgaaaauaaaaagcgccaccucgagggagaaccgacccugagaucucuccugugguacgaugagacccuuuaugccgagcugcugggcaagccucggggguuucaacagcagagcaacuucuaccccggauuucagggccgccucaaauacaaugcguucugcgaacugcaaacauaucacgaccagcuuguugagcugcucgaagagaccaagagagagaagaacuccuacuauguguuucugaaguacaaaagacaggugaaugagugugaggccauuauggaacauugcucugauuguuucgacuuuagccucuccgucccuuucacaugcggggugaacuucggcgauucucuggaggaccuugaaauccugcgcaagagcacgcugaagcucauuaauguuuguggagauucccccaaagugcacagcuaucccggcaagcaagaccaucuguggaucaucauugagaugaucucuuccaaagucaacuuuauuaagaauaacgaggcugugagaguuaaaaucagccuuuacgggcuggaacacauuuucuuugaugccgcuaagaaucucguguggaaggagcggacccagucuuucuccaaaaaguauagccagaaaaaggacgaagaacgccugcucagagucaacaaaugcgccuuuucuaagcugcagaagaucuacgauacacuuuccaaagaccugaauaacgaaccuauuagcccgaucggacuggaggaggacaccaucauugccucucggaaguccgaucaucccaucaaugaagcuacaauuagcaucgagaacagcaaauucaacuccaaucuccuggcgcacccugacauuuguugcaucucugaaauccuugaucaagccgaguuugcugaccugaagaaacuccaggaucugacccugagaugcacggaccaccucgaaauucuuaagaaauacuuccagaugcugcaggauaacaauauggacaacaucuuuauuaccgaggagaaugugcuggaugucgugaucaaccauagccacgaagccauuauccucaagcccgaggccaucgaaauguauauugagaucguuaugguguccgaaacaauucauuuccugaaaaauucuaucgcuaagaaacuugacaaacaacgcuuucggggcaugcugugguucgaucucagccugcugccugagcucguccagugucaggagaaaauggccuccuuuucuuuccuuaaagacaacagcaccgaugugugccuguggaagguuauugaaacagcgguguccgagcugaagaaagaccucgacaucauuuguaaguacaaugaagcugucaacugcagcuaugccauccaucugcuuucuagagagcugcaggagcucuccgaaaucaaaaagcugcugaaaaagagcaaguacuucauuucuaccuauaucgauuuugugcccuacauugccuccaucaauuaugggagcacagugacggagcucgaauacaacuacaaucaauucuccacccuucugaaaaacguuaugucugcuccucgcaaggaccugggaaaaauggcccacauucggaaggucaugaaaacaaucgagcauaugaagaugaucuguaccaagaaugcggaacucaccauuagcuuuuuccugugccagaugcuuuauaacagacgcaaaauccugcagcucaagcggaaagagaagaugaacauucacaucgugaaaccgggcgagaauaacaauaaguuuuccauuucuacaaugcugcccccugugagcgaauguaucaacaagaauaucuccaacagcucuaaaaagagacccuccacggucgauaaaugcgaggacagccaggaacaacagcaggauaccacagugucuagcuguaagaaacugaagguugacaugaaagaugugaccaagauuaaucgcgagaaggcuacauucaaacauccucggaccacggggucccaccccaagucugaaaacaaaaucgucccgagcuccugcgacagccucaagagaaaucaucuuacaccuaaaaagguggagaugcaacggucucugcccggcucccugcucccccuggagaacccuaaggauaccugugccagcaaauccgaaucuaagauugaccuuaccguuagcuccgaucacuuuucuggacagcaggagaaucugaacagcaugaaaaagcgcaaugugaacuucuccgccgcugaaacaaaaucugacaagaaggacugcgccgcuuuugccaucugcgaucagaaaagcguccacggcaccuucucccccgaccaugggacacuccugcaaaaguuucugaaaaauagcccugauccgacccagaagucuugucucuccgacauuaaccccgagacggaugugagccuuguuccugacgcgucugugcuguccaaacccaucuucugcuuugucaaggaugugcacccugaccuggaaaugaacgauacaguguucgagcuccaggacaaugauauugucaacagcucuaucaagaauagcuccuguaugaccagccccgagccgaucugcauucagaacaaaaucccuacacugcaaauuaauaaacuucagcccaccgaaacggaguccgaagacaaauacaugaaggauacccugaacccuaauacaguucauaccuucggagccucuggccacaucacacucaacgugaaucagggggcugaguauagccuguccgagcagcaaaacgacaaaaauucuaaggugcugaugcagaacgccgcuaccuacuggaaugaacucccccagagcgccuguaacccuacauauaauuccucugagcaucuuuuuggaaccagcuaccccuauuccgccuggugcgucuaccaauacagcaacucuaacggcaaugcuauuacgcagacauaucagggcaucaccuccuacgaagugcagccgagcccuucugggcugcugaccacaguugcguccaccgcccaaggaacacacagcaaccuccuguauucucaguacuucacguauuuugcuggcgagccccaggccaauggguucgugcccgucaacggauacuuucagucccaaaucccugccagcaauuucagacagccgaucuuuucucaguaugcuucccaccagccccuuccucaagccaccuaccccuaccugccuaaccgguucgugcccccugaaguuccguggguguaugcgcccuggcaucaggagagcuuucacccuggccauuga

SEQ ID NO: 76753 - RNA, 942 nt, Artificial Sequence
  derived and/or modified sequence opt5 from TEX264__Homo_sapiens__NP_001230655
augagcgaccugcuccugcuuggccugaucgggggacucacccugcuucugcuccugacacugcucgccuucgcuggcuacuccgggcugcuugccggaguggaggucucugcgggcucucccccuauuagaaacguuacgguggcuuauaaguuucacauggggcuguacggagaaaccggccgccucuucacagaguccugcucuaucagcccgaaacugcgguccauugccguguauuacgauaauccccauauggucccucccgacaaguguagaugcgccgugggcucuauccuuagcgaaggggaggaauccccuagccccgagcugauugaucucuaucagaaauuuggauucaagguuuuuagcuucccugcuccgucccacguggucaccgccacauuucccuacaccacaauccugagcaucuggcuggcuacccggcgcgugcauccugcccucgacacguauauuaaagagagaaagcugugugcguacccccggcuugaaaucuaccaagaggaucagauucacuucaugugcccucuggcccgccagggcgacuuuuauguucccgaaaugaaggagaccgaguggaaauggagagggcucguggaagcuaucgauacacaggucgacggaaccggcgccgauacaaugucugacaccuccagcgugucucuggagguguccccggggagccgggaaacguccgcugccacacuuucuccuggagcgagcucccgcggcugggaugacggcgauaccagaagcgagcauucuuacuccgaaagcggggccucuggaagcuccuucgaggagcuggaccucgaaggcgaggggccccugggagaaucucggcuggacccuggcacagagccccucgggaccaccaaguggcugugggaacccacagcuccugagaaaggaaaggaguga

SEQ ID NO: 76754 - RNA, 456 nt, Artificial Sequence
  derived and/or modified sequence opt5 from TEX29__Homo_sapiens__NP_689537
auggaguacgugcuggaagucaagaacagccccagacaccuccugaaacaguucaccguuugcgacgugccucuuuaugauaucugugacuacaaugugucccgggaucgcugccaagagcugggcuguugcuuuuaugaaggggucuguuacaagaaagccgugccgauuuauauccauguuuucucugcucucauugugaucauugccggagcguuugucaucacaaucauuuacagagugauccaggagagccggaaggaaaaagcuauucccguugacguggcccugccucagaaguccucugagaaggccgagcuugcuagcuccucuagcaaacugggccucaagcccgccuccccugggcccccuagcgcuggaccgucuaugaaauccgaugaagacaaggaugacgucacgggcaccaucacagaggccgaagagaccgaggauuga

SEQ ID NO: 76755 - RNA, 561 nt, Artificial Sequence
  derived and/or modified sequence opt5 from TEX30__Homo_sapiens__NP_001273705
augaaccugccccaccucaugagccuggccucccaucuugcuucucacggcuucuuuugccugagauucaccuguaaggggcucaauaucgugcaucggauuaaagccuacaagagcguccugaacuaucuuaaaacauccggagaguacaagcuggcgggcguuuuucucgggggacgcucuaugggcagcagagcugccgccuccgugaugugccacaucgaaccugacgauggggacgauuucgugcggggacugauuuguaucucuuauccgcugcaucaccccaaacagcaacacaagcuccgcgacgaggaucuguuuagacuuaaggaaccuguccuguucgugagcggcuccgcugacgagaugugcgagaaaaaucuccuggaaaagguugcccagaaaaugcaggcuccccauaagauucacuggaucgagaaagccaaccauagcauggcggugaagggccggucuacgaaugaugucuuuaaggaaaucaacacccagauucuuuucuggauccaagagauuacagaaauggacaaaaagugucacuga

SEQ ID NO: 76756 - RNA, 648 nt, Artificial Sequence
  derived and/or modified sequence opt5 from TEX35__Homo_sapiens__NP_001164193
augagcgccaagagagcugagcugaaaaagacccaccucgugaaagaacggcauugcuggacauccaagaacuacaaagccgucugucuggagcuuaagcccgaaccuacgaagaccuucgacuauaaagcgguuaagcaggagggccgcuuuacaaaagcuggggugacccaagaucugaagaaugaacucagagaggugcgggaggaacugaaagagaagauggaagagaucaagcagauuaaagaccuuauggauaaggacuucgauaaacugcacgaguuugucgaaaucaugaaggagaugcagaaagacauggaugaaaagauggacauucucaucaacacacagaaaaauuacaagcugccgcugcgcagagcccccaaggagcaacaggaacuccggcugaugggaaaaacccaucgcgagccucagcuuagacccaagaaaauggauggcgccucuggggugaacggagcuccuugcgcccugcacaagaaaacaauggcuccccagaagaccaagcaaggcagccucgacccucugcaucacugugggacgugcugugagaaaugccuucugugugcccucaagaauaacuauaaucggggaauuuacgcggccguuggccugcuggaucucugguga

SEQ ID NO: 76757 - RNA, 603 nt, Artificial Sequence
  derived and/or modified sequence opt5 from TEX40__Homo_sapiens__NP_001034585
auggaggaaaagcccagcaaagugucccugaagucuagcgacagacagggcuccgaugaggaaucuguccacagcgacacccgggaucucuggacaacgaccacacugucccaagcucagcuuaacaugccucugucugagguuugcgaaggguucgacgaggagggacgcaauaucagcaaaaccagaggcuggcauuccccggggcggggaagccucgaugaaggcuacaaggcuucucacaaacccgaggaacuggacgagcaugcccuuguggagcuggaacuccaccgcggguccagcauggagauuaaccugggagaaaaggauacagcgucucagaucgaggcugaaaaguccagcucuauguccagccugaauauugccaaacauaugccucacagagccuauugggcugagcagcaaucccggcucccccugccucuuauggagcugauggaaaacgaggcccucgaaauccugaccaaggcccuucgcucuuaccagcugggcauuggcagagaccacuuucucacaaaagagcugcagcgguauaucgaagggcugaagaaacgcagaagcaagcggcucuacgugaauuga

SEQ ID NO: 76758 - RNA, 645 nt, Artificial Sequence
  derived and/or modified sequence opt5 from TFAM__Homo_sapiens__NP_001257711
auggccuuccugagaagcauguggggcgugcucuccgcucuggggcggucuggagccgagcuuugcaccggcugugggagccgccugagaucccccuuuucuuucgucuaccucccucggugguuuagcuccguucuggcgucuugcccgaagaaacccgugagcuccuaucuucgcuucagcaaggaacagcugccuaucuuuaaagcucaaaaccccgacgccaagacaacggagcucauuagacggaucgcccagcgcuggagagaacugccugauucuaaaaagaagauuuaccaggacgcuuaucgggccgaguggcaaguguacaaagaagagaucucccgcuucaaggagcagcugacccccagccagauuaugucucucgaaaaagagaucauggauaagcaccugaaaagaaaggcuaugacaaagaaaaaggaaaaacuuaagaccgucaaagagaauuggaagaaccuguccgacagcgagaaagaacucuauauccagcaugccaaggaggaugaaacacgguaccacaaugagaugaagucuugggaggaacagaugauugaggugggacgcaaagaccugcuuagacggaccaucaagaaacaacgcaaguauggcgcggaagaguguuga

SEQ ID NO: 76759 - RNA, 1296 nt, Artificial Sequence
  derived and/or modified sequence opt5 from TFAP2A__Homo_sapiens__NP_001027451
augcuggugcacagcuucuccgccauggacagacaugauggcaccucuaacgggacagcucggcucccccagcugggaacggucggccaaagcccuuacaccuccgccccgccccuuucucacacaccuaaugcggacuuucagcccccuuauuuucccccuccguaccagcccaucuauccucagagccaagaucccuacucccauguuaacgacccuuauucucugaauccccuccacgcucagccgcagccucagcaucccggguggccuggacaacgccagagccaggaguccggccugcuucacacccacagagggcugccccaucagcucagcggacuggauccccggcgcgacuacagacggcacgaagaucugcuccauggcccucacgcccugucuuccggccuuggggaccugagcauucacucucucccgcaugccaucgaggaagugccccacguggaggauccuggaauuaacauccccgaccaaacagucauuaagaaaggcccugugucccugagcaagucuaauuccaacgcuguuagcgccauccccaucaauaaagauaaccuuuucgggggaguggucaauccgaacgaaguguucugcuccguuccuggccgccugucucuccugagcuccaccagcaaguauaaagugacagucgcugaggugcagagacggcugucucccccugagugucucaaugccucccugcuugggggagugcugcgcagagccaagagcaagaacggcggccggucucuccgcgaaaaacuggacaagauugggcuuaaucugcccgcgggaagacggaaagcugccaacgucacccuccugacgagccugguugagggcgaagcugugcaucucgcccgcgauuuuggguacgugugcgagaccgaguucccugcgaaggccgucgcugaauuucugaauagacagcacuccgaccccaacgagcaagugacacggaaaaacaugcuucuggccaccaagcagaucuguaaggaguucacagaccuccuggcucaggauagaucuccgcuuggaaauagccgcccuaaccccauucuggaacccggcauccaguccugccucacccauuuuaaucugauuagccacggguucggaucuccugccguuugugccgcugugacggcgcugcaaaacuaccucacagaagcccugaaagcuauggacaagauguaucuuuccaauaacccgaauagccacaccgauaacaaugccaaaucuuccgacaaggaggagaaacaucggaaguga

SEQ ID NO: 76760 - RNA, 1383 nt, Artificial Sequence
  derived and/or modified sequence opt5 from TFAP2B__Homo_sapiens__NP_003212
augcacagcccucccagagaccaggccgcuaucaugcuguggaagcucguggagaacgucaaauacgaagauauuuaugaggaccggcaugauggcguuccgucccacucuagccgccugucccaacuugggucugugagccagggacccuacuccucugccccuccccugagccauaccccuuccagcgacuuccagcccccuuauuuuccgcccccuuaccagccccucccuuaucaccaaucucaggaucccuacucccaugugaaugacccguauagccugaacccucuucaccagccccagcaacacccuuggggccagagacagcggcaggaagucgggucugaggcgggaucccugcucccccaaccccgcgcugcccugccucagcugagcggccucgauccgagacgggacuaccauucugugcgcagacccgauguucugcuucacuccgcccaucacgggcuggacgcuggaaugggcgauagccucucccugcacggccuugggcauccuggaauggaagacgugcagucugucgaggaugccaauaacagcggcaugaaucugcucgaccaauccgugaucaagaaaguucccgugccucccaagagcgucacaucucugaugaugaacaaagacggguuccugggaggcauguccgugaauacgggggagguguuuugcagcgucccgggacggcucucucugcuuagcuccaccucuaaguacaagguuacagugggcgaagugcagcgcagacugagcccucccgagugucucaacgcuucccugcuuggcgggguccugcggcgcgccaaaagcaagaauggaggcagaucucuccgggaacgccuggagaaaauugggcugaaccucccugcgggaagacggaaggccgcuaaugugacccugcuuacaucccugguugagggcgaagccgugcaccucgcuagagauuucggguauaucugcgagaccgaauuucccgccaaagcggucagcgaguaccugaaccgccagcauacagacccuucugaucuucacucccggaagaauaugcugcucgccaccaagcagcuguguaaagaguucacggaccugcucgcucaagauagaacccccauuggaaacagccgcccguccccuauccuggaacccggcauccagucuugccuuacacauuuuagccugauuacccacggcuucggggcccccgcuaucugugccgcccucacagcucugcagaauuaucugaccgaggcgcuuaagggaauggacaaaauguuucucaacaacacgacaaccaaucggcacacauccggcgaagggccuggaucuaagaccggcgauaaagaggaaaagcauagaaaauga

SEQ ID NO: 76761 - RNA, 1353 nt, Artificial Sequence
  derived and/or modified sequence opt5 from TFAP2C__Homo_sapiens__NP_003213
augcuguggaagaucaccgacaacgugaaauacgaggaagauugcgaggacagacacgauggcagcuccaaugggaacccccgggucccucaucucucuagcgccggacagcaccuguauuccccggcucccccucuuucucauacaggcguugccgaauaccaacccccucccuauuucccuccgcccuaccagcagcuggcguauagccaguccgcugacccuuacucucaccucggggaggccuaugccgcugccauuaauccccugcaucaaccugcucccacgggaagccagcagcaggccuggccgggccgccaaucccaggaaggggcgggacuuccuagccaccacggcagacccgccggccugcucccucaucugucugggcuggaggcuggagccguguccgcucggcgcgaugccuacagacggagcgaccuccugcuuccccacgcgcaugcccuggaugcugccggccucgcugagaaccuggggcuucacgacaugccccaccagauggaugaagugcagaaugucgacgaucaacaucugcuccugcacgaccagaccgugauccgcaagggaccuauuucuaugaccaaaaacccgcugaaucuccccugucagaaggagcugguuggcgccgugaugaacccuacagaagucuuuugcuccgugcccgggagacuuagccugcucucuuccacaagcaaauacaagguuaccguggccgagguccaacggcgccuguccccucccgagugucuuaaugcuucucugcucggaggcgugcugagacgggcuaagagcaaaaacggcgggcgcucccugagagaaaagcucgauaaaaucggacugaaucuuccggccggccggcgcaaggcugcccaugugacacugcucaccagccuggucgagggggaagccguucaccuugcuagagacuucgccuaugugugcgaggcggaauuuccuucuaaacccguggcugaguaccugacgcggccucaucucggaggcagaaacgagauggccgcccgcaagaauaugcugcuggcugcccagcagcucuguaaggaguucaccgaacugcuuucccaggaccggacaccccacgggaccagcagacuggcuccuguccucgaaacaaacauucaaaauugccugucucacuuuagccugaucacccauggauucggcucccaggccaucugugcggccgugucugcgcuucagaacuauauuaaagaggcccucaucguuauugauaagagcuacaugaaccccggcgaccaguccccggcugauagcaauaaaacgcuggaaaagauggagaaacaccgcaaguga

SEQ ID NO: 76762 - RNA, 1017 nt, Artificial Sequence
  derived and/or modified sequence opt5 from TFAP4__Homo_sapiens__NP_003214
auggaguacuucauggugcccacccagaaggucccuagccugcaacacuuuagaaaaacagaaaaggagguuaucggcgggcucugcucccuggccaacauuccgcuuacgcccgaaacccagcgggaccaggagcgcagaauccggcgcgaaauugcuaauucuaacgagagacggcgcaugcagagcaucaaugccggauuccaaucccugaaaacacucauuccucauaccgauggcgagaagcugucuaaagcggcuauccuucagcagacagccgaauauaucuuuagccuggagcaggaaaagaccagacuccugcaacagaacacacagcugaagcgguucauucaggagcucuccgggucuagccccaaacgcagacgggccgaggacaaggaugaaggaaucggcuccccugacauuugggaggaugaaaaagcugaggaccugcgcagagaaaugaucgagcuucggcaacagcuggauaaggagcgcagcgugagaaugaugcucgaagaacaggugcggucucuggaagcccacauguaccccgagaaacuuaaggucauugcucaacaggugcagcugcagcaacagcaggaacagguuagacuccugcaucaagagaagcuggagcgcgaacagcagcagcuccggacccaacugcuuccuccgcccgccccuacgcaccaucccaccgugaucgucccugcgcccccgccucccccuucccaccacauuaaugugguuacaauggggcccagcucugugaucaacuccgucagcaccucuagacagaaucuggacacaaucgugcaggccauucagcauaucgagggaacccaagaaaaacaggagcucgaagaggagcagcgccgggcugugauugucaagcccguuagauccuguccugaagccccgacgagcgauacagcuuccgacucugaggccagcgauuccgacgcgauggaucaaagccgcgaggagcccucuggcgacggcgagcugccuuga

SEQ ID NO: 76763 - RNA, 1041 nt, Artificial Sequence
  derived and/or modified sequence opt5 from TFB1M__Homo_sapiens__NP_057104
auggccgcuagcggcaagcugucuaccugcagacugcccccucucccgacaauccgggagauuaucaaacuucugcgccuccaggccgcgaagcagcugucccagaacuuccuucuggaccucagacugacggauaaaauugugcggaaggcugggaaucugaccaacgccuacgucuaugaaguuggacccggcccugggggaaucacacgcagcauucucaaugccgacguggcugagcugcuuguggucgaaaaagauaccagauuuauccccggccugcagaugcucuccgacgccgcuccugggaagcugcggaucgugcacggagauguucuuacauucaagguggagaaagccuuuucugaaagccugaagcgccccugggaggacgauccuccgaacguccauauuaucggcaaucuccccuucuccgugucuaccccucugauuaucaaauggcuggagaacauuagcuguagagacggccccuuuguuuacgggcggacacagaugacccucacguuccaaaaggaaguggcggagcgccuggccgcuaauaccggauccaaacagagaagccggcuuucugucauggcccaguaucugugcaacgugcgccacaucuuuacaauuccuggccaggcuuucgugcccaagccggaagucgauguugggguggugcauuuuaccccucucauccaacccaagaucgagcagccuuucaaacuggucgagaaggugguucagaauguguuucaguucagacggaaauacugucaccgcggacuuagaaugcuguuucccgaagcccaacggcucgaguccacaggcagacugcuggaacucgcggacauugaucccacccugcgcccucggcagcuuagcaucucucauuucaagucccugugcgacgucuauagaaaaaugugugaugaggacccgcaacucuucgccuacaacuuucgcgaggaacugaagcggagaaaaagcaagaaugaggaaaaggaggaagacgaugcugagaacuaucgccuuuga

SEQ ID NO: 76764 - RNA, 1191 nt, Artificial Sequence
  derived and/or modified sequence opt5 from TFB2M__Homo_sapiens__NP_071761
auguggauccccguggucggccugccuagacggcuccgccugagcgcccuugcuggggccggaagauucugcauucugggcuccgaggcggcuacccggaagcaccucccggcccgcaaccauugugggcugucugacagcucuccccagcuuuggccugaacccgauuuuagaaauccuccccggaaagccuccaaggcuagccuggacuucaaacgcuacguuacagauagacggcucgccgagacgcuggcucaaaucuaucugggaaagccuucccgcccgccccaccuccugcuugaaugcaacccuggccccgggauucugacccaggcccuccuggaggcgggagccaaagugguggcucuugaaucugacaagacauuuaucccucaucuggagagccucggcaagaaucuggauggcaaacugagagucauucacugugacuucuuuaagcucgauccccgguccgggggagugaucaaaccgccugccaugagcucucgcggccuguucaagaaccuugggaucgaggcuguucccuggaccgccgacauuccucugaaaguggucggaauguuucccuccagaggcgaaaagcgggcgcucuggaagcuggccuacgaucuuuauagcugcacaucuaucuacaaauucgggcgcauugaggugaauauguuuaucggagaaaaggaguuccagaaacugauggcugaccccggcaacccugaucucuaucauguucuguccgugauuuggcagcuggccugugagaucaagguccuccacauggaaccguggagcucuuuugacauuuacaccagaaaaggcccccuggagaauccuaagcggagagaacuucuggaucaacuccagcagaaacuguaucuuauccagaugaucccccgccaaaaccuguucacaaagaaucucaccccuaugaacuacaauaucuuuuuccaucugcugaagcacugcuucgggcggagauccgcuacggugauugaccaccuccgcagccugacaccccuugacgcccgggauauucugaugcagaucggaaaacaggaggacgaaaagguggucaacaugcauccgcaggauuuuaaaacccucuucgagaccauugagagauccaaggacugugccuacaaauggcuguaugaugaaacacuggaggaccgcuga

SEQ ID NO: 76765 - RNA, 1353 nt, Artificial Sequence
  derived and/or modified sequence opt5 from TFCP2__Homo_sapiens__NP_001166924
auggccugggcucugaagcucccccuggccgacgaggugaucgaaagcggccuuguccaggauuucgacgcgucccugucugggauuggacaagagcucggcgcuggggccuacagcauguccgauguucuggcccuuccuaucuuuaaacaggaagagucuagccugccgcccgacaacgaaaauaagauucucccuuuccaguaugugcugugcgcugccaccucccccgcugugaaacugcacgaugagacacucacguaccugaaccagggacaaucuuaugagaucagaaugcuugacaaucggaagcugggcgaacucccugagauuaacgggaaacuggucaagagcaucuuucgcgugguuuuccaugauagacggcuucaguacaccgaacaccagcagcuggagggauggcgcuggaauagacccggcgaccggauccucgauauugacaucccuauguccgugggcauuaucgauccgcgcgccaaccccacacaacugaauaccgucgaguuucugugggacccugcgaagagaacaagcguguucauucagcccaaaggggccgaucggaagcagaaaaccgaccgcgaaaagauggagaaaagaacaccucaugaaaaggagaaguaucagcccucuuacgaaaccacgauccucaccgaguguuccccguggccugagauuacauauguuaacaauagccccucuccuggauuuaacuccagccacucuuccuucagccugggcgaagggaauggaucccccaaccaucaacccgagccuccgcccccugugaccgacaaucuucugcccacaaccacgccucaggaagcucagcaauggcuccaccggaaccgcuuuucuacauucaccagacuguuuacaaauuucagcggcgccgaucuucugaaacucacccgggacgaugucauccagaucugcgggcccgcugacggcauucgccuguuuaacgcccugaagggaagaauggugcggccgagacucaccaucuacgugugucaggagucccugcagcuucgcgaacaacagcagcagcaacagcagcagcaacagaaacacgaggauggcgacagcaacgggacauucuucgucuaccaugcgauuuaucuggaggaacucacggccguugagcugaccgaaaagaucgcucagcuguuuucuauuuccccuugccagaucagccaaaucuacaaacagggacccacaggcauucacgugcuuaucucugaugagaugauucagaauuuccaagaagaggccuguuuuauccucgacaccaugaaggagacaaacgauagcuaucauauuauccugaaauga

SEQ ID NO: 76766 - RNA, 1233 nt, Artificial Sequence
  derived and/or modified sequence opt5 from TFDP1__Homo_sapiens__XP_005268384
auggccaaggacgcuggccugaucgaggccaacggggaacucaaaguguucauugaucagaaucugagccccggaaagggcgucguuucccuuguggcggugcacccuucuaccgucaacccgcuggggaaacaacuccugcccaagacauuuggacagagcaaugugaacaucgcucagcagguugugauuggcacgccucaaagacccgccgccuccaauacccuugucguggggucuccucauacacccagcacccacuucgcuucccagaaccagccuucugacagcuccccguggagcgccggaaaacggaaucgcaagggcgagaagaacggcaaagggcugagacauuuuucuaugaagguuugcgaaaaagugcagcggaagggaacaaccuccuacaaugaggucgcugaugaacucguggccgaguucagcgcggccgacaaccacauccugcccaaugagucugcuuaugaucagaaaaacauucgcagacggguguacgacgcccugaauguccucauggcuaugaacaucaucuccaaggaaaagaaagagauuaaguggaucggccugccuacaaauagcgcccaagaaugucagaaccuugagguugagcgccagagacggcuggaacgcauuaaacaaaagcagucucagcuccaagagcugauccuucagcagauugcguuuaaaaaccuggugcagagaaaucggcaugccgaacaacaggcuuccagacccccucccccgaacagcgugauccaccucccuuucauuaucgucaauaccuccaagaaaacggugaucgauugcucuauuagcaacgacaaguuugaguaucuguucaauuuugauaacaccuucgaaauccacgacgauauugagguucugaagcgcauggggauggccuguggacucgaguccggcagcugcucugcugaagaccugaaaauggcccggucccuugugcccaaggcccuggagccuuacgucacagaaauggcucaggggaccgugggaggcguuuuuaucacaaccgcgggcagcacgucuaaugggacacgcuucagcgccuccgaucucaccaacggagcugacggcaugcuggccacaucuagcaaugggucccaguauagcggaucuagaguggagacccccgucuccuacgugggcgaagacgaugaggaggacgaugacuuuaacgaaaaugaugaggacgauuga

SEQ ID NO: 76767 - RNA, 1161 nt, Artificial Sequence
  derived and/or modified sequence opt5 from TFDP2__Homo_sapiens__NP_001171609
augaucauuagcacaccccagagacugaccuccucuggcagcgugcucaucggguccccuuacacgccggcccccgcuauggucacccaaacacacauugccgaggcgaccggauggguuccuggcgaccggaagcgcgcuagaaaauucaucgauucugacuuuagcgaauccaagcggucuaaaaagggggauaaaaacggaaagggccugcgccauuucagcaugaaggugugcgagaaagugcagagaaaggggacaaccuccuauaaugaagucgccgacgagcuugugagcgaauuuacaaacucuaauaaccaccuggccgcugauucccaggccuacgaccagaaaaauauucggcgcagaguuuaugaugcucucaacgugcugauggccaugaauaucaucagcaaggagaaaaaggagauuaaguggaucggacuucccaccaacucugcgcaagaaugucagaaucuggagauugaaaaacagcggcgcaucgagagaauuaagcagaaacgggcccaacuccaggagcugcugcuccagcagaucgcuuucaagaaccugguccaacgcaauagacagaacgaacagcaaaaucagggcccucccgcccuuaacuccacgauucagcugccuuuuaucaucauuaauaccagccggaaaacagugaucgacugcucuauuuccagcgauaaguucgaguaccucuuuaacuucgacaacaccuuugaaauccaugaugacauugagguucugaaacgcaugggcauguccuucgggcuugaaucuggaaaguguagccuggaggaucucaagcuggcuaaaucccuggugccgaaggcccucgagggcuauaucacagacaucagcaccgggcccucuuggcugaaucagggacuucugcucaacuccacgcaaagcgucucuaaucuggaccuuacaaccggcgcgacacugccucagagcuccgugaaccaggggcucugccuggaugccgaaguggcucuggccaccggacaguuucucgcucccaauucucaccaaagcuccagcgccgccucucauuguuccgagagcagaggcgaaaccccuugcucuuucaacgacgaggaugaagaggacgaugaggaagacuccagcucccccgaguga

SEQ ID NO: 76768 - RNA, 1218 nt, Artificial Sequence
  derived and/or modified sequence opt5 from TFDP3__Homo_sapiens__NP_057605
auggccaaguacgugagccugaccgaggcuaacgaagaacucaaaguccugauggacgaaaaucagacauccagacccguugccgugcacacgucuaccgugaacccucuuggcaagcaacugcucccgaaaacauucgggcagagcuccgucaauaucgaucaacaggugguuauuggaaugccccagcggccugcggcuucuaacauccccguggucggcagcccuaaucccccuuccacccauuuugccucucagaaccagcacagcuauuccagcccgcccugggccgggcagcauaaucgcaagggagagaaaaacggcauggggcugugcagacuuucuaugaaggugugggaaacaguucaacggaagggaaccacauccugucaggagguggucggcgagcugguggcuaaauuccgcgccgcuagcaaucacgccucuccuaacgaauccgcguacgacgugaagaauauuaaaagacggaccuaugaugcccucaacguccugauggcuaugaauaucauuagccgcgagaagaaaaagaucaaguggaucggccugacgaccaacucugcccagaauugccagaaccucagaguugaacggcaaaaacgccuggagagaauuaagcagaaacaguccgagcuucaacagcugauccuccagcagauugcuuuuaagaaccuggugcuucggaaucaauacguggaggagcaggucagccagcgcccccugccuaacuccgugauccauguucccuucauuaucauuucuagcuccaaaaagacagugaucaauuguagcaucucugacgauaaauccgaauaucucuuuaaguucaacagcucuuuugagauucacgacgauaccgaaguccugauguggauggggaugacauucggacuggagagcggcuccugcucugccgaggaccucaagauggcgagaaaucuggugccgaaagcccuugaaccuuacguuaccgagauggcucaggggacguuuggaggcguguucacaaccgccgggagccgguccaacggaacauggcugagcgcuucugaucucaccaauaucgccauuggcaugcuggccaccuccagcggcgggucucaauauuccggaagccgcgucgaaacacccgcuguggaggaagaggaggaagaggacaacaaugaugacgaucuuuccgaaaacgacgaggacgauuga

SEQ ID NO: 76769 - RNA, 1728 nt, Artificial Sequence
  derived and/or modified sequence opt5 from TFE3__Homo_sapiens__NP_006512
augagccacgccgcugagcccgccagagacggcguggaagcguccgcugaggggccucgggccgucuucguucugcucgaggaacgcagaccggccgauucugcucagcugcuuagccugaacucccuccugcccgaaucuggaaucguggccgacauugagcuugagaaugugcuggauccugacagcuuuuacgaacucaagucccaaccccugccucugcggucuagccuccccaucucccugcaggcuaccccugccacaccggcgacgcuuagcgccucuuccagcgcuggcgggucucgcacccccgccauguccucuagcuccagcuccagaguccugcuccggcagcagcugaugcgcgcucaagcccaggagcaggaaagacgggagcgcagagagcaggcggccgcugccccuuuccccucuccugcucccgccagcccggccauuuccgugguuggagugagcgcuggcgggcauacacuuucucggccucccccugcgcaagucccccgcgaagugcugaaaguucagacccaccucgagaaccccacaagauaucaucugcagcaggcccggcgccaacaggugaagcaguaccuguccaccacacucggaccuaaacuggcuagccaagcccuuaccccgcccccuggccccgccucugcucagccucugcccgccccggaagcggcucacacgaccggcccuacagggagcgcccccaauuccccuauggcccuccugaccaucggaucuagcuccgagaaggaaauugaugacgucaucgaugagaucauuagccuugagucuuccuauaacgacgaaaugcugagcuaccuccccggcgggacaaccggacugcagcugccuucuacgcuccccguguccggcaaucugcuugauguguauagcucccagggggucgcuacaccggccaucaccguuucuaacagcugcccugcugagcugcccaauauuaaaagagaaaucuccgagacagaagccaaggcgcuccugaaggagcggcagaaaaaggacaaccauaaucuuauugagagacgccggagauuuaacaucaaugaucgcauuaaagaacugggaacccucauccccaagucuagcgacccugagaugcgguggaacaaaggcaccauccugaaggccuccguggauuacauuagaaagcugcaaaaagaacagcagcgcagcaaggaccucgagucucggcaaagaucccuggaacaggcuaaucgcagccuucagcugcggauccaggagcucgagcugcaagcccagauucacggccugccggugcccccuacacccgggcuucucucucuggcuacgaccuccgccagcgacucucugaaaccugaacagcucgauaucgaggaagagggaagacccggcgcggccacauuccacgucgggggaggcccugcucagaacgccccgcaucaacagcccccugcucccccuagcgacgcccugcuugaucugcacuuucccuccgaccaucucggggaucugggagacccguuccaccugggccuugaggauauucucauggaagaggaagagggcgugguugggggacugagcggcggggcccugucuccucuccgcgcugcguccgacccccugcuuagcuccgugucuccugccgucagcaaggcuuccucucggagaagcuccuuuucuauggaagaggagagcuga

SEQ ID NO: 76770 - RNA, 1473 nt, Artificial Sequence
  derived and/or modified sequence opt5 from TFEB__Homo_sapiens__NP_001161299
augaccgccagcuccggcugggagcccgcuccugccgcgacaauggcuucuagaaucgggcugcggaugcagcucaugcgcgaacaagcccagcaggaggaacagagagagcggaugcaacagcaggccgugaugcacuacaugcagcaacagcagcagcaacagcagcaacagcugggaggcccgcccacgccugcuauuaacacccccguccauuuccagagcccucccccuguuccgggggaagugcuuaaggugcaguccuaucuggagaaucccacaucuuaccaccuccaacagagccagcaucagaaaguccgcgaguaucuguccgaaaccuacggaaacaaguuugccgcucacaucucuccugcccaaggcagccccaaaccucccccggcggccuccccuggggugagagcuggacauguucuuagcagcuccgccggcaauagcgcucccaacucuccuauggccaugcugcacauuggcuccaaucccgagcgggaacucgacgaugugaucgacaacauuaugcgccuggaugacguccugggguauaucaaucccgagaugcagaugccuaacacacucccgcugucuucuucccaccuuaauguguacagcuccgauccccagguuaccgcgucucuggugggagucacaagcuccagcugcccugccgaccucacccagaagagagagcugacggaugcugaaucucgggcccuugcuaaagagcgccaaaagaaggacaaccauaaucugaucgaaagacggcgcagauucaacauuaaugaucggaucaaagagcucggcaugcugauucccaaggccaacgaccuggaugugcgcuggaauaaagggaccauccucaaggccuccguggacuauauuagacggaugcagaaagaucugcaaaagagcagagaacuugagaaccacucucgccggcuggagaugacaaacaagcagcucuggcugagaauccaggaacuugagaugcaggcucgcguccauggacugccuaccacaagccccuccggcaugaauauggcggaacucgcccagcaaguugugaaacaggagcugccgucugaagaggggccuggagaggcucugaugcucggcgccgaagugcccgacccugagccccugccugcccuucccccgcaggcuccucugccccuccccacccagccuccgagccccuuucaccaccuggacuucucccauagccuuucuuuuggcgggcgggaagaugagggaccucccggcuacccugaaccccuggccccugggcacggaucccccuucccgagccucucuaagaaagaccuggaucugaugcuccuggacgauucccuucugccucucgcgagcgacccccugcuguccacgaugucuccugaggcuagcaaggccuccucuagacgcagcuccuuuagcauggaggaaggcgauguccuuuga

SEQ ID NO: 76771 - RNA, 957 nt, Artificial Sequence
  derived and/or modified sequence opt5 from TFEC__Homo_sapiens__NP_001018068
augacccuggaccaccagaucauuaaccccacacucaaguggagccaaccugccgugccguccggcgggccccugguccagcaugcucacacgacccuugauucugacgccggacugacagagaauccucucaccaaacugcuugcgaucggcaaggaagaugacaacgcucaguggcaucugagcggguccauucucgauguuuacucuggagagcagggcaucagccccauuaauauggggcugacauccgccucuugcccuagcucccugcccaugaaaagagaaaucaccgagacagacacccgggcccucgcuaaggaacgccagaaaaaggauaaccacaaucugaucgagagacggcgcagauauaacauuaauuaccggaucaaggagcuuggaacgcugauuccuaaaagcaacgacccggauaugcgcuggaauaagggcaccauccucaaagccucuguggaauauauuaaguggcugcagaaagagcagcagagagcucgggaacuugagcaucgccaaaagaagcuggagcaggccaacagacggcuccugcugcgcauccaggaacucgagauucaggcgagaacacacggccugcccacccuugccucccuggggacaguggaccucggagcucacgucaccaaacaacagagccauccugaacaaaauucuguggauuacugucaacagcugacgguuucccagggccccagcccugagcuuugcgaccaggccaucgcuuucucugauccccuguccuauuuuacagaccucagcuucuccgccgcgcugaaggaggaacaacggcuggacgggaugcuccuggaugacaccaucucuccguuuggaacagauccucuucugagcgccaccucccccgcugugagcaaagagucuucccgcagaagcucuuucagcuccgacgauggcgacgaacucuga

SEQ ID NO: 76772 - RNA, 255 nt, Artificial Sequence
  derived and/or modified sequence opt5 from TFF1__Homo_sapiens__NP_003216
auggccaccauggagaacaaggugaucugcgcucugguccucguuagcaugcuggcccuuggcacacuggcggaagcucagacggagaccuguacaguggcccccagagaacggcaaaauugcggguucccuggagugaccccgucccagugugccaacaaaggcugcuguuuugacgauacaguccgcggggugcccuggugcuucuacccuaauaccauugacguucccccugaggaagagugugaguuuuga

SEQ ID NO: 76773 - RNA, 390 nt, Artificial Sequence
  derived and/or modified sequence opt5 from TFF2__Homo_sapiens__NP_005414
augggcagacgggacgcccagcugcucgcugcccugcuugugcuggggcucugcgcgcuggcuggaagcgagaagcccuccccuugucaaugcucucgccuuagcccgcacaacagaaccaauuguggcuuccccgggaucacauccgaucagugcuuugacaacggauguugcuucgauucuagcgucacgggcguuccuugguguuuucauccccugccuaaacaggaauccgaccagugcgugauggaggugucugaucggcgcaauuguggguaccccggaauuagcccugaagagugcgccuccagaaaguguugcuucagcaacuuuaucuucgaagucccguggugcuuuuuccccaaaucuguggaggacugucacuauuga

SEQ ID NO: 76774 - RNA, 285 nt, Artificial Sequence
  derived and/or modified sequence opt5 from TFF3__Homo_sapiens__NP_003217
augaagagagugcugagcugcguccccgagccuaccguugugauggccgcucgggcccucuguaugcugggccuugugcuggcgcuccuguccucuagcuccgcugaagaguacgucgggcuuucugccaaccagugcgccgugccggcuaaagaccgcguugauuguggauauccccacgugacaccuaaggaaugcaauaacagaggcuguugcuucgacagccggauccccggggucccuugguguuuuaaaccccugcaagaggccgaaugcacguucuga

SEQ ID NO: 76775 - RNA, 1203 nt, Artificial Sequence
  derived and/or modified sequence opt5 from TFG__Homo_sapiens__NP_001007566
augaacggccagcuggaccucagcgggaagcugaucauuaaagcccaacuuggagaggauaucagacggauucccauccacaaugaagacauuaccuacgaugagcuggugcucaugaugcagcgcgucuucagaggcaagcugcuuuccaacgacgaaguuacaaucaaauauaaggaugaggacggggaucugaucacgauuuuugacucuagcgaucucuccuucgcuauccagugcucucggauucugaaacugacccucuuugugaauggacagccucgcccgcuggaaagcucccaagugaaguaccuuagacgggagcugaucgagcuccgcaacaaggucaauagacugcuugacucucuggaacccccuggcgagcccgggccuagcacaaacauucccgaaaaugauaccguggacggacgggaggagaaauccgccagcgauucuuccggcaagcagagcacacagguuauggcggcuucuauguccgccuucgacccucucaaaaaccaggacgaaaucaauaagaacgugaugagcgccuuuggccugaccgaugaccaagucucugggccgcccuccgcuccugccgaggaucgcagcggaacacccgacuccauugcuucuagcuccagcgccgcgcauccucccggcgugcagccgcagcagccucccuauaccggggcccaaacgcaggcuggacagaucgaaggccaaauguaccagcaguaucagcaacaggccggguacggagcucagcagccucaagccccuccccagcagccccagcaauauggcauccaguacucugcguccuacagccagcagaccggcccgcaacagccccagcaauuccagggguauggacagcagccuacaucucaagcccccgcuccugccuuuagcggccagccccagcagcugccggcucaaccuccccagcaguaccaggccuccaauuauccugcccaaaccuacacagcucagaccucucagcccacgaacuauacaguugcgccugccagccaacccgggauggcuccgucccagccuggagccuaccagcccagacccggcuucaccagccucccugggucuacaaugaccccgcccccuuccggacccaauccuuaugcccggaacagacccccuuuuggccagggcuacacccaacccgggccgggauaccgcuga

SEQ ID NO: 76776 - RNA, 2097 nt, Artificial Sequence
  derived and/or modified sequence opt5 from TF__Homo_sapiens__XP_011511402
augagacuggccgugggcgcucuccuggucugcgccguucuugggcugugucucgcggugcccgacaagaccgugcgguggugcgcugucagcgagcacgaagccacaaaaugucaguccuuccgcgaucauaugaagucugugaucccuagcgacggaccguccguugccugcgugaaaaaggcuucuuaccuggauuguauuagagccaucgcugccaacgaggcggacgccgucacgcuugaugcuggccugguguaugacgccuaccucgcucccaauaaccugaaaccuguuguggccgaauuuuaugggagcaaggaggauccccaaaccuucuacuaugcggucgccguggugaagaaagacuccggauuucagaugaaucagcugcggggcaagaaaucuugccacacagggcucggacgcagcgcuggcuggaacauuccuaucggccugcuuuacugugaucugcccgaaccuagaaagccgcucgagaaagccgucgcuaauuucuuuuccgggagcugcgcccccugugccgacggaaccgauuucccucagcugugccaacuuugucccggcugcgggugcucuacacugaaccaguauuuuggauacuccggcgcuuucaagugucucaaggacggggcgggagauguugccuuugugaaacauagcaccauuuucgagaaucuggcuaacaaggccgaccgggaccaguacgaacugcucugccuggauaauacacgcaaaccuguggacgaguauaaggauugucaccuugcccagguccccucucauaccgugguugcuagauccaugggcggcaaagaagaccugaucugggagcuccugaaccaagcccaggagcacuuugggaaggauaaaagcaaggaguuccagcuguuuucuuccccgcacggaaaggaccuucucuucaaagauagcgcgcauggcuuccugaaggugccuccccggauggacgcuaaaauguaccugggguaugaauacgucacggccauccgcaaucucagagaaggaaccugcccugaggcccccacagaugaauguaagcccgugaaauggugcgcucugucccaccaugagcggcuuaagugugacgaguggucuguuaacagcgugggcaagauugaaugcgucuccgccgagaccacagaagauuguaucgcuaaaauuaugaauggggaggccgacgcgaugagccuggacggaggcuuuguguauaucgccggcaagugcgggcucgucccugugcuggcugaaaacuacaauaaaucugauaacugugaggacaccccggaggccggauauuucgcuauugccguugugaagaaauccgcgagcgaucuuacgugggacaaccugaagggcaagaaaucuugccacacagccgucgggcgcaccgcuggauggaauauccccaugggccuccuguacaacaagauuaaucacugcagauuugaugaguucuuuagcgaagggugugccccuggcuccaaaaaggacucuagccugugcaaacucuguaugggauccggccugaaccuuugcgaacccaauaacaaggagggguacuauggauacacaggcgcuuuccggugucugguggaaaagggggauguugccuuugugaaacaucagaccgucccucaaaauaccggaggcaagaaccccgacccgugggccaaaaaucucaacgagaaggauuaugagcugcugugccuugacgggacacgcaaaccuguggaagaguacgcuaauugucaccucgcgagagcccccaaccaugcugugguuacgcggaaggauaaagaagccugcguccacaagauccugagacagcagcaacaucuguucggcagcaaugugaccgacuguucuggaaacuuuugccucuuccgcuccgagacaaaggaucugcuuuuucgggacgacaccgugugucuggccaaacuccacgauagaaauacauaugagaaguaccugggcgaagaguaugucaaagcuguggggaaccugcgcaagugcagcaccucuucccuucucgaagccugcacguuccggagaccuuga

SEQ ID NO: 76777 - RNA, 2514 nt, Artificial Sequence
  derived and/or modified sequence opt5 from TFIP11__Homo_sapiens__XP_011528381
augagccugucccaccucuaccgggacggcgaggggcggaucgaugacgaugacgaugaacgcgagaacuucgaaauuaccgacugggaucugcagaaugaguuuaaccccaauagacaacggcauuggcagacaaaggaagaggccacguauggagugugggcugagcgcgacucugaugacgaaagaccuagcuucggcgggaaacgggcccgcgauuacuccgcgccggucaacuuuaucucugcuggacuuaagaaaggcgccgccgaggaagcugagcuggaggacagcgaugacgaagagaagcccguuaaacaggacgauuucccuaaggacuuugggcccagaaagcucaaaaccggaggcaauuucaagccuucccagaaaggcuuugccgggggaacaaagucuuucauggauuuuggcagcugggaacggcacaccaaagggauuggacaaaagcugcuucagaagaugggcuaugugcccgggcgcggacugggcaaaaacgcucagggcaucauuaauccuaucgaggccaagcagagaaaagggaagggagcggugggcgccuacggguccgaacggacaacccaaagcaugcaggacuucccggucguggauucugaggaggaagcugaggaagaguuucagaaagaacucucccaguggcgcaaggaccccagcggaucuaaaaagaagccuaaauauuccuacaagacaguugaggagcugaaagccaagggcagaaucagcaaaaagcugaccgcuccccaaaaggaacucucucaggugaaagucauugauaugacggggcgggagcagaagguguauuacuccuacagccaaaucucccauaaacacaacguuccugacgauggacugccccuucagucucagcagcugccgcaaagcggcaaggaagccaaagcgccuggcuucgcccuccccgagcuggaacauaaucuucagcugcucauugaccugaccgagcaggagaucauucagaacgaucgccaacugcaguaugaaagagacaugguggucaaucucuuucacgagcuggaaaagaugacagaggugcuugaccacgaggaacgggugaucuccaaccugagcaagguccucgagaugguugaagagugcgaaagacgcaugcagccugauuguucuaauccccugacccuugacgagugcgcucggauuuucgagacacugcaggauaaauacuaugaagaguacagaauguccgaccgcguggaucucgccguggcuaucgucuauccccugaugaaggaauacuucaaagagugggacccucugaaggauuguaccuaugggacggaaaucauuagcaaauggaagucucuccuggagaacgaccaacuucugagccauggaggccaggaucucuccgccgacgccuuucaccggcugaucugggagguguggaugccguucguuagaaauauugugacacaguggcagccccgcaacugcgauccuauggucgacuuucuugauucuugggugcauaucauucccguuuggauccuggacaacauccucgaccaacugauuuucccuaagcugcagaaagaaguggagaauuggaacccccucaccgauacagucccgauccacagcuggauucacccuuggcugccccuuaugcaggcucggcuggaaccucucuacucccccaucagaagcaagcugucuuccgcgcugcaaaaauggcauccuagcgacucuuccgccaaacuuauucuccagcccuggaaggauguguuuaccccggggagcugggaggcuuucauggucaagaauaucgugccuaaacugggaaugugucugggcgaacucguuaucaacccccaccagcagcauauggacgccuuuuacugggugauugauugggaggggaugaucuccgucucuagccuggugggccuucuggagaagcacuucuuucccaaguggcuccaaguucugugcuccuggcugucuaauagcccuaacuaugaagagauuaccaaaugguaccuuggauggaaguccauguucagcgaccaggugcucgcccauccgucugucaaagauaaguuuaaugaagcucuggacaucaugaaccgcgccguguccagcaaugugggcgcguauaugcagcccggggcucgggagaacauugccuaccugacacacacggagagacgcaaagauuuccaguaugaagccaugcaagagcggagagaagcugagaauauggcccagcggggaaucggcguugcugccucuuccgucccuaugaacuuuaaggaccucauugaaaccaaggcggaggagcacaauaucguguucaugcccgugaucgggaaacgccaugaaggaaagcagcuguacacauucggcagaauugucaucuauauugauagaggggugguuuuugugcagggcgagaaaaccugggucccuacaagccuucaaucucugaucgacauggccaaguga

SEQ ID NO: 76778 - RNA, 561 nt, Artificial Sequence
  derived and/or modified sequence opt5 from TFPI2__Homo_sapiens__NP_001257933
auggaccccgccagaccucugggccucagcauccugcuucuguuccucaccgaggcugcccugggggaugcggcucaggaaccgacaggaaacaaugccgagauuugccuucugccccucgacuauggcccuugucgggcccugcugcuccgcuauuacuaugauagauacacgcaauccugccggcaguuucuguaugggggaugugaaggcaacgcuaauaacuucuacaccugggaggccugcgacgaugcuuguuggcgcaucgaaaaggugcccaaagucugcagacuucagguuucuguggacgaucagugugaggggagcacagagaaguacuuuuucaaucuguccucuaugaccugcgaaaaauuuuucagcggaggcugucaccggaaccgcauugagaauagauuuccugacgaagccacaugcaugggcuucugugcgcccaagaaaaacaccgagccugugaugcucuccccgauccuggccgucgaggggaugacaauuacccuucuggcuggacggaucgccaaugugcauguucaaaagcucuga

SEQ ID NO: 76779 - RNA, 756 nt, Artificial Sequence
  derived and/or modified sequence opt5 from TFPI__Homo_sapiens__NP_001027452
augaucuacaccaugaagaaagugcacgcccugugggcuagcgucugccuccugcuuaaccuggcccccgcgccucucaaugcugacuccgaggaagaugaggaacauacaauuaucacggacaccgagcugccgccccuuaagcugaugcacucuuucugugccuuuaaagccgaugacggcccuugcaaggcuauuaugaaaagauucuuuuucaacaucuuuacacggcagugugaagaguucauuuaugggggaugcgagggcaaucaaaaccgcuuugaaagccucgaggaauguaagaagaugugcaccagagauaaugccaaccggaucaucaaaacaacccugcagcaggagaagcccgacuucuguuuucuggaggaagauccugggauuugccgcggauacaucacaagauauuucuacaauaaccagaccaaacaaugugagcgguuuaaguauggcgggugccucggaaauaugaacaauuucgaaacgcuggaggaauguaaaaacauuugcgaggacggccccaauggcuuucagguugauaacuacgggacccagcuuaaugcugugaacaacucccugacaccucagucuaccaaggugccgagccucuucgucacaaaggagggaaccaaugacggcuggaaaaacgccgcgcauaucuaucaaguguuccugaaugccuuuugcauucacgcuuccauguucuuucuugggcuggauucuaucagcugucucugcuga

SEQ ID NO: 76780 - RNA, 762 nt, Artificial Sequence
  derived and/or modified sequence opt5 from TFPT__Homo_sapiens__NP_037474
auggagcuggaacagagagagggcaccauggccgcugugggguucgaagaguuuagcgcgcccccuggauccgaacucgcccugccgccccuuuucggcgggcacauccuggagucugagcucgaaacagaggucgaauuuguuagcggaggccuugggggauccggccugcgggagcgcgacgaggaagaggaagcugccagaggccggcgcagacggcaacgcgagcugaacagacggaaguaccaggcccucgggcgcagaugccgggaaauugaacaggugaaugagcgcgugcugaacagacugcaucagguccaacggaucacgcgcagacuccagcaggagcggagauuccugaugcgcgugcuugauucuuauggagacgauuaccgggcuagccaguuuaccauuguucuggaggacgaaggcucccaagggacagaugccccuacccccggaaaugcugagaacgaaccucccgagaaagagacacucucuccuccgagacgcacccccgccccucccgaaccuggcagccccgcgccgggggagggaccuuccggccggaagagacgccgggugcccagagacggccgccgggccgggaaugcucugacaccugaacuugcccccguccagaucaaaguggaggaagauuucggauuugaggcugacgaggcccuggauagcucuuggguuuccagaggccccgacaagcuccugccuuauccgacccuggcgagccccgccucugauuga

SEQ ID NO: 76781 - RNA, 1893 nt, Artificial Sequence
  derived and/or modified sequence opt5 from TFR2__Homo_sapiens__NP_001193784
auggccgcucugacccaggacaucagagccgcgcucagccggcaaaagcuggaucacguguggacagacacgcauuacgucggccuucaguuccccgauccugcucacccgaacacccugcauuggguugacgaggccgggaaggugggagaacagcucccccuggaggauccugacguguauugccccuacuccgccauuggcaaugucacaggggaacuuguguaugcucacuacggacgcccugaggaucugcaggaccucagagcccggggcguugaucccguggggcgccugcugcucgucagagugggaguuaucucuuuugcucaaaaggugaccaacgcccaggacuucggcgcgcagggcguccugauuuauccugaaccggccgauuuuagccaggaucccccuaaacccucccuuucuagccaacaggcuguguacgggcaugugcaccugggaacaggcgacccuuauacccccggguucccguccuuuaaucagacacaguucccucccgucgccucuagcggacucccuuccauccccgcucaacccauuagcgccgacaucgcgucucggcugcuucgcaagcugaaaggcccuguugccccgcaggaguggcaggggucccuccugggaagccccuaccaccugggcccuggccccagacuccggcugguggugaacaaucaucgcaccucuacgccuaucaacaauauuuuuggguguaucgagggaagauccgaacccgaccacuacgucgugauuggcgcucaacgggaugccugggggccgggagcugccaagagcgccguuggcaccgcuauccuucuggagcucgugcgcacauucucuuccauggucagcaacggguuuagaccucggcgcucccugcuuuucauuucuugggacggaggcgauuuuggcagcgugggguccaccgaauggcuggagggauaucucagcguucugcaucugaaggcgguggucuacgugucucucgacaaugccguccugggcgaugacaaauuccacgcuaagacaagcccccuucugaccucccucaucgagucugugcugaaacagguugauagcccuaaccacuccgggcagacgcuuuaugaacagguggucuuuacaaaucccucuugggacgccgaggugauuagaccucugcccauggauagcuccgccuacagcuucaccgcuuucguuggagugccggccgucgaauuuucuuucauggaggacgaucaagcguauccuuuucuccauacaaaggaagacaccuacgagaaccugcacaaagugcugcagggccggcuccccgcuguggcccaggccguugcucagcuggccgggcaacuucugaucagacucucccaugaccgccugcugccccuugauuucggccgguauggagacgucgugcucagacacaucggcaaucugaacgaguuuagcggggaucugaaggcucgcggacucacccugcaguggguguacucugcccggggcgacuacauuagagcggccgaaaaacuucgccaggagaucuauuccagcgaggaacgggaugaaagacugacacgcauguacaauguccggauuaugagaguggaguucuauuuucucucccaguacguuucuccugcugacagcccguuccgccauaucuuuauggggcggggagaucacacgcugggcgcccugcuugaccaccucagacugcugcgguccaacucuagcgggacccccggcgcuacauccagcaccggauuccaagagucucgcuuuagacggcagcucgcccugcuuacauggacccugcagggcgcggccaacgcucucuccggggauguguggaauauugacaacaauuucuga

SEQ ID NO: 76782 - RNA, 2283 nt, Artificial Sequence
  derived and/or modified sequence opt5 from TFRC__Homo_sapiens__NP_003225
augauggaccaggccagaagcgcuuucuccaaccuguuuggcggggagccccucucuuacacccgguucagccuggcccgccaaguggauggagacaauucccacgucgaaaugaaacuugcgguugaugaggaagagaacgcugacaauaacacaaaagccaaugugacgaagccuaaaagaugcucuggcagcaucuguuaugggaccauugccgugaucgucuuuuuccugauuggauuuaugaucggcuaccucggguauugcaagggaguggaaccgaaaacagagugugagcggcuggcuggcaccgaaucccccguucgcgaggaaccuggcgaggauuuccccgccgcuagacggcuuuacugggacgaucugaagcgcaagcucucugagaaacuggacagcacagauuuuaccgggacaauuaagcugcucaacgaaaauuccuaugugccuagagaggccggaagccagaaagacgaaaaccuggcgcuuuacgucgagaaucaguuccgggaauuuaagcugucuaaaguguggcgcgaucagcauuucguuaagauccaagugaaggacuccgcccagaacagcgucaucauuguggauaaaaauggcagacucguguaucuggucgagaaccccgggggauacguugcuuacucuaaggccgcuaccgugacgggcaaacuugugcacgccaauuuugggaccaagaaagacuucgaggaccuguauacaccugucaacggauccaucgugauuguucgggcgggcaagaucaccuuugccgaaaaaguggcuaaugccgagagccucaacgcuauuggcguccugaucuacauggaucagacaaaguucccgauugugaacgccgaacugucuuucuuugggcaugcccaccucggaaccggcgaccccuauacgccuggguuccccuccuuuaaucauacacaguucccucccagccgcuccucuggacugccgaacaucccuguucaaaccaucagcagagcugcggccgagaaacuuuuuggcaauauggaaggggauugccccuccgacuggaagacagauagcaccugucggauggugaccucugaguccaagaacgucaaacugacagugagcaauguccucaaggagauuaaaauccugaacauuuucggagugaucaagggcuuuguugaaccugaccacuacguggucgugggcgcucagcgcgaugccugggggcccggagccgcuaagucuggcguugggacggcccuucugcucaaacuggcgcagauguucagcgacauggugcugaaggauggauuucagcccuccagaucuauuaucuucgcuagcugguccgccggcgacuuugggagcgucggcgccaccgaguggcucgaaggauaucugucuucccuucaccugaaggcuuucacauacaucaaucucgauaaggccgugcugggcaccagcaacuuuaaagugucugcuuccccucuucuguauacacucauugagaagaccaugcaaaauguuaagcauccggucacggggcaguuccuguaccaggacagcaacugggccuccaaaguggaaaagcugacacucgacaaugcggccuuccccuuucuggcuuacucuggaaucccugccgugagcuucugcuuuugugaggauaccgacuaucccuaccuuggcaccacaauggauaccuauaaagagcugauugaacggaucccugagcucaacaaggucgcuagagccgcggccgaaguggcugggcaauucguuauuaaacugacacacgacguggagcugaaucuugauuacgagcgcuauaacucccagcuccugucuuuuguccgggaccugaaucaguacagagccgauaucaaggaaaugggacucagccugcaguggcuuuauuccgcucgcggcgacuucuuucgggccacgagcagacugaccacagauuucgggaacgccgagaagaccgaccgcuuugugaugaaaaagcucaacgaucggguuaugagaguggaauaccauuuccugucucccuacgucuccccgaaagagagcccuuuucgccacguguucuggggcucuggaucccacacacugcccgcgcuucucgaaaaucugaagcugcggaaacaaaacaauggcgcuuuuaacgagacccucuucagaaaucagcuggcccuugcuacguggaccauccagggggccgccaacgcucugagcggagacguuugggauauugacaaugaguucuga

SEQ ID NO: 76783 - RNA, 480 nt, Artificial Sequence
  derived and/or modified sequence opt5 from TGFA__Homo_sapiens__NP_001093161
auggugcccagcgccggccagcuggcucucuucgcccuggggaucguccuugcggcuugccaagcccuggagaacuccaccucuccucucagcgacccgcccguugccgcugccguggugucccacuuuaaugauuguccugacucucauacacaguucugcuuucacggaacguguagauuccugguccaggaagauaagcccgcuugcgugugucauagcggcuacguuggggcccggugcgagcacgcggaccuucuggccguggucgcugccucccagaaaaagcaagcuauuaccgcccucgugguugugucuaucgucgcgcuggccgugcugauuaucacaugugugcucauucauugcugucagguccgcaaacacugcgaaugguguagagcucugaucugccggcacgagaagccuagcgcccuucugaaaggacgcaccgcuugcugucauuccgaaacaguuguguga

SEQ ID NO: 76784 - RNA, 1173 nt, Artificial Sequence
  derived and/or modified sequence opt5 from TGFB1__Homo_sapiens__NP_000651
augcccccuagcggccugagacuccugccgcuucugcucccccugcuuuggcugcucgugcugaccccugggcggcccgccgcuggacuguccacaugcaagacgaucgacauggagcucgucaaacgcaagagaauugaagccauccggggccagauucugucuaaacuucgccuggcgagcccucccucccaaggggagguuccuccgggaccccucccugaagcugugcuggcccuuuacaacucuaccagagaucggguggccggcgagagcgcugaacccgagccugagcccgaagccgacuauuacgcuaaggaggucacacgcgugcugaugguugaaacccacaaugagaucuaugauaaauucaagcaguccacacauucuauuuacauguuuuucaacaccagcgagcucagagaagccgugccggagccuguccugcugucccgggcggaacuccgccugcuuagacugaagcucaaaguggagcagcacguugaacuguaucagaaguacagcaauaacucuuggcgguaucuuuccaaucgccugcucgcccccagcgacucuccugaguggcuguccuuugaugugacaggggucgugagacaauggcugagccggggaggcgagaucgaaggcuuccgccucucugcucauuguuccugcgacagcagagauaacacccuucagguggacaucaauggguuuacgaccggacggagaggcgaucuggccacaauucacgggaugaaccgccccuuccugcuccugauggcuacaccccuugagcgggcccagcaucugcaguccucuagacaccgccgggcgcucgacaccaauuacuguuuuagcuccaccgagaaaaacugcugugucagacaacuguacaucgauuuccgcaaggaccugggauggaaauggauucacgaaccuaagggcuaucaugccaauuuuugccucgggccgugucccuacaucuggagccuggauacgcaguauucuaagguucuugcucuguacaaccagcacaauccuggagccuccgcugcccccugcugugugccucaggcccucgaaccccugccgauuguguauuacgucggccggaaaccuaagguggagcaacugagcaacaugaucguuagaucuugcaaauguagcuga

SEQ ID NO: 76785 - RNA, 1386 nt, Artificial Sequence
  derived and/or modified sequence opt5 from TGFB1I1__Homo_sapiens__NP_001035919
auggaggaccuggaugcccuccugagcgaccuugaaaccacaacgucccacaugcccagaucuggcgcuccuaaggagcggccggccgaaccccugaccccucccccuagcuacgggcaucagccccaaacaggauccggcgagucuagcggggcguccggagauaaggaccaccucuauucuaccgugugcaagccucgcagcccgaaacccgcugccccugccgcucccccuuucuccagcuccuccggcguccuggggacaggacuuugugaacuggauagacuccugcaggagcugaacgccacccaguuuaauaucacagacgagauuaugagccaguuccccucuuccaagguugcuagcggcgaacaaaaagaggaucagucugaagacaagaagcggccgucccucccuagcucccccucuccuggccugcccaaagccagcgcgaccuccgccacgcuugagcuggaucgccucauggcuagccugucugacuuuagagugcagaaccaucuucccgccuccgggccuacccagccgcccguggucagcucuacaaaugagggaagcccuucucccccugaacccaccggcaaggggucucuggauacaaugcucggacugcugcaaagcgaccucucccggcgcggcgugccgacccaggcuaaagggcugugcggaagcuguaacaagccuaucgccggccagguugugacggcgcuuggcagagccuggcaccccgagcauuucgucugcgggggauguucuacagcucugggcggguccagcuuuuucgaaaaagauggagccccuuuuugccccgaguguuacuucgaacgguuuucuccucgcugcggcuucuguaaucagcccauuagacacaagauggugaccgcucucgggacacacuggcauccggagcacuuuugcuguguuuccugcggagagccuuucggcgacgaaggcuuucaugagcgggaagggcgccccuauugcagacgggacuuccugcaacuuuucgcuccccgcugucagggaugccagggcccuauccuggauaacuacauuagcgcccucuccgcccuguggcacccggacuguuuugugugcagagaguguuucgcgcccuuuucugggggcagcuucuuugaacacgagggacggccucugugcgagaaucauuuccacgccagacgcgggucccucugugcuaccugcggccugcccgucaccggacggugugugucugcccuuggcagacgcuuucauccugaucacuucacaugcacguuuugucugcggccccucaccaaggggagcuuccaagaaagagccggaaaaccuuauugccagcccugcuuucugaaacuuuucggcuga

SEQ ID NO: 76786 - RNA, 1329 nt, Artificial Sequence
  derived and/or modified sequence opt5 from TGFB2__Homo_sapiens__NP_001129071
augcacuacugcgugcugagcgccuuccucauccugcaucuugucaccguugcucugucccucucuacauguagcacgcuggacauggaucaguuuaugagaaagcggauugaggccauccgcggccaaauucuuuccaaacugaagcucaccucucccccugaagacuauccggagcccgaagaggugccucccgaagugaucagcauuuacaacuccacaagagaucugcugcaggagaaagcgucucggcgcgcugccgccugcgagagagaacggagcgacgaggaauauuacgcuaaggaggucuauaaaaucgauaugccucccuucuuuccuuccgagaccguguguccgguugugacaacccccagcgggucugucggaucccucugcagccgccagucucaggugcuguguggcuaccuugacgccaucccucccacauucuauagaccuuacuuucggauuguucgcuucgauguguccgcuauggaaaagaaugccagcaaccuggucaaggcggaguuuagaguguuccggcuccaaaaucccaaagcccgcgugccggaacagagaaucgagcuguaccagauucuuaagucuaaagaccugaccuccccuacgcagcgguauaucgauagcaaggucguuaaaacccgcgcugaaggggaguggcucuccuuugacgugacagaugccgugcacgaguggcugcaucacaaggacagaaaccugggauucaagauuucucuccauugccccuguugcaccuuugucccuagcaauaacuacaucauucccaauaaauccgaggaacuggaagcucgguucgccggcaucgaugggacaagcaccuauacgucuggagaccaaaagacaaucaaauccaccagaaagaaaaacagcggcaagacaccccaccuucugcucaugcugcuuccuucuuaccgccuggagagccagcagaccaaucggcgcaaaaagagagcgcucgacgccgcuuauuguuuucggaacgugcaggauaauugcugucugagaccgcuguacauugacuucaagcgcgaucucggcuggaaauggauccacgaacccaagggguauaacgccaauuucugcgcuggagccugcccuuaccugugguccucugacacccaacauagccggguucuuucccuguacaacacaauuaaucccgaggccagcgcuucuccuuguugcgugucccaggaucucgagccccugacgauccuuuauuacauuggcaaaaccccgaagaucgaacagcugagcaacaugaucgucaaaucuuguaagugcuccuga

SEQ ID NO: 76787 - RNA, 1239 nt, Artificial Sequence
  derived and/or modified sequence opt5 from TGFB3__Homo_sapiens__NP_003230
augaagaugcaccuucagagagcccucgugguccuggcucugcugaacuucgccaccguuagccucucccugucuacaugcacgacccuugacuuuggccauaucaaaaagaaacggguggaggcgauucgcgggcaaauccugagcaagcucagacugacaucucccccugaaccgaccgugaugacacacguccccuaccaggugcuggcucucuauaauuccacccgggagcugcuugaagagaugcauggagaacgcgaggagggcuguacacaggaaaacaccgagagcgaauacuaugccaaagagauucacaaguucgauaugauccaggggcuggccgagcauaaugaacucgcuguuugcccuaagggaauuacguccaaaguguuuagauucaacgucucuagcguggagaagaaucggaccaaccuguuucgcgccgaguucagaguucuucgggugcccaauccuuccagcaaacgcaacgaacaaagaaucgaacuguuucagauccuccggcccgacgagcacauugcuaagcagcgcuacaucggcgggaaaaaucugccuacaagaggaaccgccgaguggcugucuuucgaugucacagacaccgugcgggaauggcuccugcgcagagaguccaaccuuggccuggaaauuagcauccacuguccgugccauacguuucagcccaauggcgauauucucgagaacauccacgaagugauggagauuaaguucaagggggucgacaaugaggaugaccauggacggggcgaucuggggagacuuaaaaagcaaaaagaccaccacaacccucaucugauccucaugaugauucccccucaccgccuggauaaucccggacagggcgggcagcggaagaaaagagcgcuggacacaaacuauuguuuucgcaaccucgaagagaauugcuguguucggccgcuguacaucgauuucagacaggaccuuggauggaagugggugcaugaaccuaaaggcuauuacgccaacuuuugcucuggccccuguccuuaccugcgcuccgcugacaccacacacagcaccgugcucgggcuguauaauacccuuaaccccgaggccucugcuucccccugcugugucccucaagaucuggaaccgcucacaauccuguacuaugugggacggacgcccaagguugagcagcugagcaauaugguggucaaguccugcaaaugcucuuga

SEQ ID NO: 76788 - RNA, 2052 nt, Artificial Sequence
  derived and/or modified sequence opt5 from TGFBI__Homo_sapiens__NP_000349
auggcccuguucgugagacuccuggcucuugcccuggcgcucgcucugggccccgccgccacccuugcugggccugccaagagcccguaccagcugguccuccaacacucccggcugcgcggaagacagcauggccccaacguuugcgcugugcagaaagugaucgggacaaaucggaaguauuuuacgaacuguaaacagugguaccaacgcaagauuugcggaaaaucuaccgucaucagcuaugaguguugcccuggcuacgaaaaggugcccggggagaagggauguccugccgcgcugccccucuccaaucuguaugaaacacuuggcguugugggcucuaccacaacccagcuguacacagacagaaccgagaaacuccggccugaaauggaggggccgggcagcuucacgauuuuugcccccuccaacgaggcuugggccucucugccugcugaaguccuugauagccugguguccaauguuaacaucgagcuccugaaugcccugcgcuaucacauggugggaagacggguccucaccgacgaacugaagcaugggaugacacuuaccagcauguaccagaacucuaauauucagauccaccauuaccccaacggaaucgugacagugaauugcgcgcgccugcucaaagccgaucaccacgcuaccaacggcgucguucaucugauugacaaggugaucuccacgauuacaaauaacauccaacagauuaucgagauugaggauaccuucgaaacacuuagagccgcuguggccgccagcgggcugaauaccaugcucgagggaaacggccaguauacccugcuggcuccuacaaacgaagcguuugagaaaauccccucugaaacgcucaaucggauccugggcgacccggaggcccuucgcgaucugcucaacaaucacauucugaaguccgcuaugugugccgaggccaucgucgcugggcuuagcguggaaacccuggagggaacaacccucgaaguuggcugcucuggggacaugcugacaauuaacggaaaggccaucauuuccaauaaagauauccuggcgaccaacggcgugauccauuacauugacgagcuccugaucccugauagcgcuaagacgcuuuucgaacuggccgccgaguccgacgucucuacagcuauugaucucuuuagacaggccgggcugggaaaucaccugagcggcuccgagcggcuuacccuccuggcuccccugaacagcguguucaaagacggcaccccucccaucgacgcccacacacgcaaucuccugagaaaccauauuaucaaggaucaacuugcgucuaaauaucuguaccacgggcagacccucgaaacacugggaggcaagaaacugcggguuuuuguguauagaaauucccuuuguaucgagaacagcugcauugccgcucaugacaagcgcgggcgguacggaacccucuucacgauggauagaguccugacacccccuaugggcaccgugauggacguccugaagggggauaaucgcuuuucuaugcucguggccgcuauccagagcgccggccugacagaaacccuuaaccgggagggaguuuauacgguguucgcgccgaccaaugaagccuuuagagcucugcccccucgcgagcgguccagacuccugggcgacgccaaagagcuggcuaacauucuuaaguaccacaucggggaugaaauucucgucucuggaggcaucggggcccuggugcgccugaaaagccuccaaggagacaagcuggagguuucccuuaaaaacaauguggucagcgugaacaaggaacccguggccgagccugauauuauggcuacaaauggcguuguccaugugaucaccaacgugcugcagcccccggcgaaucggccucaggagagaggggacgaacucgccgauucugcucuggagaucuucaagcaggccuccgccuucagccgcgcuucucaacgguccgucagacuggcccccguguaccagaaacuucucgaacggaugaagcacuga

SEQ ID NO: 76789 - RNA, 1281 nt, Artificial Sequence
  derived and/or modified sequence opt5 from TGFBR1__Homo_sapiens__NP_001124388
auggaggccgcuguggccgcgcccagaccucggcugcuccugcuuguccuggcugccgccgcugccgcugccgcggcccuccugccgggcgcuaccgcccuucagugcuucugucaccugugcacaaaggacaacuuuacguguguuaccgaugggcucugcuucgugagcgugacagaaaccacagacaaagucauccauaauuccauguguauugcugagaucgaucugauuccccgcgacagaccuuuugugugcgcccccucuagcaagaccggauccguuacaaccacguacuguugcaaccaagaucacuguaauaaaaucgaacugccuaccacaggccucccccugcuugugcagcggaccauugcgcgcacaaucguccugcaggagucuaucgggaagggaagauucggcgaaguguggcgggggaaauggcgcggagaggagguugccgugaagauuuuuagcuccagagaggaacggucuugguuccgcgaagcugagaucuaucagaccgucaugcucagacaugagaacauucugggcuuuaucgccgcugacaauaaggauaacggcacguggacacaacuuuggcuggugagcgacuaccacgaacaugggucccucuucgauuaucugaaucgguacaccgugacagucgagggaaugauuaaacuggcccucagcaccgccucuggccuggcucaccuucacauggaaaucguugggacccagggaaagccugcgauugcccaucgcgaccugaaauccaagaacauccucgugaaaaagaauggcacaugcuguaucgcugaucuggggcuugccgugagacacgacagcgccacggauaccauugacaucgcuccgaaccaucgggucggaacaaagcgcuauauggcccccgaggugcuggacgauucuauuaauaugaaacacuuugaauccuucaagagagcggacaucuacgcuaugggccucguguuuugggagauugcccggagaugcagcaucggcgggauccacgaggauuaucagcugccuuacuacgaccugguucccucugauccuuccgucgaagagaugcgcaaagugguuugcgaacagaagcuccggcccaacauuccgaauagauggcaaagcugugaggcccugcgcgugauggcuaaaaucaugcgggaaugcugguaugccaacggagcugccagacuuaccgcgcugcgcauuaagaaaacacucucccagcugucucagcaggagggcaucaagauguga

SEQ ID NO: 76790 - RNA, 1779 nt, Artificial Sequence
  derived and/or modified sequence opt5 from TGFBR2__Homo_sapiens__NP_001020018
augggcagagggcugcuccggggacuguggccccuucacaucgugcuguggacccgcauugccagcacaaucccuccgcauguccagaaguccgacguugagauggaagcucaaaaagaugagauuaucugccccucuuguaacagaacggcccacccucuccggcauauuaauaacgacaugaucgugaccgauaauaacggcgcggugaaguucccccagcugugcaaauuuugugacguccgcuucagcacaugcgauaaucagaaguccuguaugucuaacugcagcaucaccuccauuugugaaaaaccucaggaggugugcguugcuguguggagaaagaaugacgaaaacaucacacuugagaccgucugucacgaucccaagcugccuuaccaugacuuuauucucgaggaugccgccucuccgaaaugcaucaugaaggagaaaaagaaacccggggaaacauucuuuauguguagcugcuccagcgacgaaugcaaugauaacauuaucuucucugaggaguauaauaccuccaacccugaccugcugcucgugauuuuucaaguuacgggaaucagccugcuucccccucugggcguggcuaucucugucauuaucauuuucuacuguuaucgggugaaucgccagcagaagcucuccagcaccugggaaacagggaagaccagaaaacugauggaguuuucugaacacugcgccaucauucuugaggaugaccgguccgacaucagcuccacaugugcuaacaauaucaaccacaacaccgaacugcuccccauugagcuggauacgcuggugggaaagggccgcuucgccgaggucuacaaagcgaagcucaaacagaauacaucugaacaauuugagaccguugccgugaagaucuucccguaugaagaguacgcuagcuggaaaacagaaaaggacauuuuuagcgauaucaaccugaagcaugagaauauucuucaguuccugaccgccgaggaaagaaaaaccgagcucggcaagcaguauuggcugaucacagcuuuccacgccaaagggaaccuucaggaauaccugacgcggcaugugaucagcugggaggaccuccgcaagcugggaucuucccuggcgagaggcauugcccaccuccacagcgaucauaccccuugcgggcggcccaaaaugccuaucguccaccgcgaccugaagucuagcaauauucuugugaagaacgaucugacauguugccucugugacuuuggacugucccuuagacuggaucccacccucucuguugacgaucuggcuaauagcggccaaguggggacagcccgguacauggcucccgaaguccuggaguccagaaugaaccucgagaauguggaauccuucaaacagaccgacguuuauucuauggcccuggugcuuugggagaugacgucccgcugcaacgccgucggagaagugaaggacuacgagccuccguuuggcagcaaaguccgggagcaucccuguguggaaucuaugaaggauaauguucugagagaccgcggccggccugagauccccuccuucuggcucaaccaccaggggauucaaauggugugcgaaacacugaccgaguguugggaucaugacccugaagcuagacugaccgcgcagugcgucgccgagcgcuuuagcgagcuugaacaccucgaucggcuguccggaagaucuugcagcgaggagaaaauccccgaagacggcucccugaauacaaccaaguga

SEQ ID NO: 76791 - RNA, 2583 nt, Artificial Sequence
  derived and/or modified sequence opt5 from TGFBRAP1__Homo_sapiens__NP_001136093
augaugagcaucaaggccuucacccugguguccgcugucgagagagaacuccugaugggcgacaaagagcggguuaacauugaaugcguggaguguugcgggcgcgaucuuuacgugggaacaaaugacuguuuugucuaucacuuccugcucgaagagagacccgugccugccggcccggcgacguuuaccgcuacaaagcagcugcaacggcaucuuggguucaaaaagcccguuaacgagcugcgcgccgccucugcucucaauagacugcuggugcucugcgauaacagcaucucccuggucaauaugcuuaaccuggaaccugugcccucuggagcccggauuaaaggcgcugccaccuuugcgcucaaugagaacccuguuagcggggaccccuucuguguggaagucugcaucauuuccgugaagcgcagaacaauccagauguuucugguguacgaggaucggguccagaucguuaaggaggugucuaccgccgaacagccucuugcuguggccgucgacggacacuuccugugucucgcucugacaacccaauauauuauccauaauuacagcacgggcgugucccaggaucuguuuccguauugcagcgaggaaagacccccuauuguuaaacgcaucggccggcaggaguuccuccuggccgggcccggaggccuugggauguuugcgaccguggccggaauuucucagcgcgcuccuguccacugguccgaaaacgugaucggcgccgcuguuagcuuccccuacgugauugcccuggacgaugaguuuaucacaguccauucuaugcucgaccaacagcagaagcagacccugccguucaaagaggggcacauccuucaagauuucgaaggaagagugauugucgccacauccaagggcguguauauccugguuccucucccccuggagaaacagauucaggaccugcucgcuagccggcgcguggaagaggcgcugguccuugccaagggcgcuagacggaauaucccuaaggaaaaauuucaagugauguacagacgcauucugcagcaggccggguucauccaguuugcccaacuccaguuccuggaggcuaaggagcuuuuucggucuggacagcuggauguuagagaacucaucucccuguaccccuuccugcuccccaccagcuccucuuuuacgcgcagccacccuccgcugcaugaguaugccgaccuuaaccagcugacacaaggcgaccaggaaaagauggcgaaguguaaacgguuccucauguccuaccugaaugaggugagaagcaccgaagucgcuaacggguauaaggaggauauugacacagcccugcuuaaacucuacgccgaggcugaucacgacucucugcuggaucuccuggugaccgaaaauuuuugccuucugaccgacuccgccgcuuggcucgagaagcauaagaaauauuucgcccugggacugcuuuaccacuauaacaaccaggaugcggccgcugugcagcucuggguuaauaucgucaacggcgacgugcaagauagcacacgcucugaccuguacgaauacauuguggauuuucugacguauugucucgacgaggagcuggucugggccuacgcugacugggugcuucaaaagagcgaagagguuggggugcaggucuucaccaaacggccccuggaugaacagcagaaaaauuccuuuaacccugacgauaucauuaauugccucaaaaaguaucccaaggcccuggugaaauaccuggagcaccuuguuaucgacaagagacuccagaaagaagaguaucauacacaccuggcggugcuguaccucgaggaaguccugcuucagcgcgccucugcuagcggaaagggcgccgaggcuaccgaaacacaagccaaacugcggagacuccugcagaaguccgaucuguaucgcgugcauuuccuucucgagcggcugcagggcgccgggcugccuauggaaagcgcuauccuccacggaaagcugggcgagcaugagaaagcgcuucacauucugguucacgaacuccaggacuucgccgcugccgaggauuacugccugugguguucugaagggagagaucccccgcaucggcaacagcuguuucacacccuucuggccaucuaccuccaugcuggaccuacggcccacgagcuggcgguggcugccgucgaccuccugaaccgccacgccacagaguucgacgcugcccaggugcuucagaugcugcccgauaccugguccgugcaacuccugugcccuuuucugaugggcgcgaugagagacagcauucaugcucggagaaccaugcaggucgcccuugggcuggcccgcucugaaaaucucaucuauacauacgauaagaugaaacugaagggcuccagcauucagcucuccgacaaaaagcugugucagaucugccaaaaccccuucugugagccuguuuuugugcgguaucccaauggaggccuugugcacacccauugcgcugccucuagacacacaaacccgagcuccucuagcccugggacgcgcaccuga

SEQ ID NO: 76792 - RNA, 8307 nt, Artificial Sequence
  derived and/or modified sequence opt5 from TG__Homo_sapiens__NP_003226
auggcccuggugcucgaaaucuucacccugcuugcuagcauuugcuggguguccgccaacaucuucgaauaccagguugacgcgcagccccugagaccuugugaacuccagcgggaaaccgcuuuccugaagcaggccgauuaugugccccagugcgccgaggacggcucuuuucaaacggugcagugucagaaugaugggagaagcugcuggugugucggagcuaacggcuccgaagugcuugggucuagacagcccggacggccuguugccugccugagcuucugucaacuccagaaacagcagauucugcuguccggcuacaucaauucuaccgacacaagcuaucucccccaaugccaggauuccggggacuacgcuccugugcagugugauguccaacaggugcagugcugguguguugacgccgagggaauggagguguauggcacccgccagcugggcagacccaagcggugcccucgcagcugcgaaauuagaaaccggcgccuucugcacggggucggagauaaaucuccgccccaauguuccgcggagggcgaauuuaugccugugcagugcaaguucgugaauacaaccgacaugaugaucuuugaucucguccacagcuacaacagauuccccgacgccuuuguuacauucucuuccuuucagcggcgcuucccugaggugagcggguauugucacugcgcugauucucagggaagagagcuggccgaaaccggccuugagcugcuccuggacgaaaucuacgacacgauuuuugcugggcuggaucuccccuccaccuucacagagaccacacuguaccggauccuucaacgcagauuccuggccgugcagagcgucauuuccggacgguuuagauguccgaccaaaugcgaaguggagcgcuucacggcgacaucuuuuggccauccuuauguucccagcugucggagaaauggcgacuaccaggccgugcagugccaaaccgaggggccuuguuggugcgucgaugcucagggaaaggaaaugcacggcacacgccagcagggggagccgcccuccugugccgaaggacaaagcugcgcuucugagcggcagcaggcccucuccagacuguauuucggcaccagcggguacuuuucucaacaugaccuuuucagcuccccugaaaagcgcugggccucuccgcggguggcuagauuugcgaccagcugucccccuacaaucaaagagcuguucguugauuccggacuccugcgccccaugguggagggccagagccagcaguuuucugucuccgaaaaccugcucaaggaggccauucgggcuaucuucccuagcagaggccuggcccgccuugcccugcaauuuacgaccaaucccaaacggcuccagcagaaccuguucgggggaaaguuucuugugaaugucggccaguucaaccugucuggggcucucggaacaagaggcaccuucaauuuuucccaauucuuucagcagcuggggcuggccagcuuccucaacggcggacggcaggaagaccuggcgaaaccgcuuuccgugggccuggauucuaauagcuccacagggaccccugaggcugccaagaaggacggaacgaugaacaaacccacaguuggcucuuuuggguucgaaauuaaccuccaagagaaucagaacgcccugaaguuucuggcuagccuucucgagcugccugaguuccugcucuuucugcagcacgccaucuccgugcccgaggaugucgcucgcgaccuuggagaugugauggaaaccguucugagcucucaaaccugugagcagacaccugagagacucuucgugcccuccugcaccacagaaggcagcuaugaggacguccaguguuuuucuggggaaugcuggugugucaauuccuggggcaaagagcugccgggaagccgggugagaggcgggcagccucgcugccccacggacugugaaaagcaacgggccagaaugcagucucugaugggaagccagcccgcgggcuccacccuuuucguuccugccugcacaagcgaggggcacuuucucccgguccaguguuucaacucugagugcuacuguguggaugcugaaggacaagccauccccggcacccgcuccgcuauugggaaaccuaagaaaugccccacaccuugccagcugcagagcgagcaggccuuccugagaaccgugcaagcgcuccuguccaauucuagcaugcuucccacgcuguccgacaccuauaucccucaguguucuacagauggccaguggcggcagguccaaugcaacggacccccggaacagguguuugagcucuaccagcgcugggaagcccaaaauaagggccaggaccugaccccugcuaagcugcuuguuaaaauuaugagcuacagagaggccgcuuccgggaacuucucucucuuuauccagagccuguaugaggccggacagcaagauguguuccccguccugucccaguacccuagccuccaggacgugccccuggccgcucuugaaggcaagcggccgcagccucgcgagaauauucugcucgaacccuaucuguuuuggcaaauccugaacgggcagcuuucucaguacccuggauccuauagcgauuucucuacaccccucgcgcauuuugaccugagaaauuguuggugcguugaugaggccggccaggaacuggaggggaugcgguccgagcccagcaaacucccuaccuguccgggcucuugcgaagaggcuaagcugcgcgugcuucaauucaucagagaaacggaggagauugucuccgccagcaacuccagccgguuuccccugggagaaucuuuccucguggccaaaggcauccgccugagaaaugaggaccuggggcuuccuccccuguuuccuccccgggaggcuuucgccgagcaguuccucagaggaagcgauuacgcgauucgccuggcugcccaguccacacucucuuuuuaucaacggagacgcuucagcccugacgauuccgccggcgcuucugcccugcuucggagcgggccguacaugccccagugugacgcguuuggauccugggaaccuguucagugccacgcuggcaccggccauuguuggugcguggacgagaaagggggauucauccccggcucucugacagccagaagccuccagauuccucaaugucccacaaccugcgagaagucccgcacaagcgggcugcugucuuccuggaagcaggcccggagccaggaaaacccgucuccuaaggaucuuuuuguccccgcuugccuggagacgggagaauacgccagacuccaggcuuccggcgccgggaccugguguguggaccccgcgagcggagaggaacugcgcccuggcuccucuagcuccgcccaaugccccagccucuguaaugugcugaaaucuggcguccuuucccggagaguuagcccuggguaugugccggcuugccgggccgaggauggaggcuucucucccgugcagugugaccaggcucaggggagcugcuggugugucauggauuccggagaggaagugccuggcacacgcguuaccgggggacaacccgccugcgagucuccuagauguccccugccguuuaacgccagcgaaguggucggcggcacaauccucugcgagaccaucuccgggccuacgggaucugcuaugcagcagugucagcugcugugccggcaaggcagcugguccguguuucccccugggccccuuauuugcagccuggaaucuggacgcugggagucccagcucccucagcccagagcgugucaacggccgcagcuguggcagacaauccagacccaaggccacuuucagcuccagcugccucccgggaagaugugcagcgccgacuacgcugaucuucugcagaccuuccaaguuuuuauucuggacgagcucacagccagaggauucugucagauccaggugaaaaccuuuggcacacuggucuccauucccgugugcaacaauucuagcguucaggugggcugucuuacgcgcgaacggcugggggucaacgugaccuggaaguccagacucgaggauaucccuguggccucucugccggaccuccacgauauugaacgcgcucuggucggaaaggaccuucugggccgguucacagaucugauccaaagcggguccuuccagcuccaucuggacagcaaaaccuuucccgccgagacaaucagauuccuucagggagaccacuuuggcaccucuccucgcacgugguucgggugcuccgagggauuuuaucaaguucugaccagcgaagcgucucaggauggccucggcugugugaagugccccgagggguccuacagccaggacgaagaguguauuccuugccccgugggauucuaucaggaacaagcuggcucucuggccugugucccuugcccgguggggcggacaaccaucagcgccggagcuuuuucccagacacauugcguuaccgauugucagagaaaugaggccggccuccagugcgaccaaaacgggcaguaccgcgcgucucagaaagauagaggaagcggcaaggcuuucuguguggacggcgaggggcggcgccugcccuggugggaaacagaggccccucuugaagauucccagugccugaugaugcaaaaauuugagaagguccccgaaagcaaggugauuuucgacgccaaugcuccuguugccgugagauccaaaguccccgauucugaguuuccggugaugcagugucugaccgacugcacggaggaugaggcuugcagcuucuuuacagucuccaccaccgaaccugaaaucucuugcgacuucuaugccuggacaagcgacaacguggcguguaugaccuccgaucagaagcgggacgcccucggaaauucuaaagcuacgagcuucggcucccugcgcugccaaguuaaggugagaagccacgggcaggauucucccgccgucuaccuuaaaaagggacagggcuccacaaccacacugcagaaacgguuugagcccaccggguuccaaaacaugcucagcggacuguacaauccuauuguguuuucugcuuccggcgccaaccucacagacgcccaucuguucugucuucuggcuugcgauagagaccuguguugcgauggcuuuguucucacccaggugcaagggggagcgaucaucugcggccugcuuagcucucccuccguccugcucuguaaugugaaggacuggauggauccuagcgaagccugggcuaacgccacgugcccgggggugaccuaugaccaggagucccaccaaguuauucugcgccugggagaucaggaguucaucaagagccucacaccccuugaaggcacccaggacacauuuaccaauuuccagcaagucuaccuguggaaagauucugacauggggagccggccugaguccaugggcuguagaaaggacacggugccccgcccugccucucccacagaagcuggacugaccacagagcucuuuagcccgguggaucugaaccaggucauugugaauggcaaccagucccuuucuagccagaaacacuggcuguucaagcaucucuuuuccgcccaacaggcgaaccuguggugccugucucgguguguucaggagcacagcuucugccaacucgcugaaaucaccgaguccgccagccuuuauuuuaccuguacacuguacccugaagcccaggugugcgacgauauuauggagucuaaugcucagggguguagacugauccucccccagaugccuaaagcccuguuccggaagaaggucauccuugaagacaaagugaagaacuucuauacgcgccugcccuuucaaaaacucaugggaauuuccaucagaaauaagguuccuaugagcgagaaaucuauuuccaacggcuucuuugagugcgaacggcgcugugaugcggaccccugcugcaccggguucggauuucugaaugugagccagcugaagggcggggaggucacaugucucacccuuaacucccugggcauccagaugugcucugaagagaauggaggcgccuggcgcauucuggauugugggagcccggacaucgaagugcauacauacccuuucggaugguaucagaagcccaucgcucaaaacaaugcccccuccuuuugcccucucguugugcugccgagccuuaccgagaaagucucucuggauuccuggcagagccucgcucugucuagcgugguggucgaccccuccauucggcacuucgauguugcccacgugucuacggcugccacaagcaacuuuuccgcggugcgcgaccugugucucucugagugcagccagcaugaagccugucuuaucaccacccugcagacacaaccuggcgcugucagaugcauguucuacgccgauacccaguccuguacacacagccugcaggggcaaaauugccggcuccugcuucgcgaggaagcuacgcauauuuacagaaagcccggaaucucucugcucuccuaugaggccagcgugccuuccguucccauuucuacccacggccggcugcuggggagaagccaggccauccaggugggcacauccuggaaacaggucgaccaauuucucggagugccuuacgcugcgcccccgcuugccgaacgccgguuccaggcuccugagccccugaacuggaccggcucuugggacgccagcaagccuagagccuccuguuggcagcccgggacacgcaccagcacgucuccgggaguuuccgaggauugccuguaucucaauguguuuauuccucagaacgucgcucccaaugccagcgugcuggucuucuuccauaacaccauggaccgggaagagucugaaggcuggcccgcgaucgauggguccuuucuugccgcugugggaaaccugaucguugugacagccagcuacagagugggcgucuucggcuuucucucuuccgggagcggagagguuucuggcaauugggggcugcuggaccaaguggcugcccucaccugggugcagacacacauucgcggauucggcggggauccucggagagucagccuugcggccgaccgcggaggcgcugauguggccuccauccaucugcugaccgcucgggccacaaacagccagcucuuuagacgcgcuguucugaugggcggguccgcccuuucucccgcggccgugauuagccaugagcgggcucagcaacaggccaucgcucuggccaaagaagucuccugcccuaugucuagcucccaggagguggucucuugucucagacagaagccggccaaugugcugaacgacgcgcaaacgaagcugcucgcuguuagcggacccuuccacuauuggggcccugugauugaugggcauuuucuucgcgaacccccugccagagcucugaaacggucccugugggucgagguggaccuccugaucggaagcucucaggaugacggccuuaucaaucgcgccaaggccguuaaacaguucgaagaguccagagggcggaccagcucuaagacagcuuuuuaccaagcccugcagaacucccucggaggcgaggacagcgaugcgagaguggaagccgcugccaccugguauuacucucuggagcacuccaccgacgauuacgcuagcuucucucgggcccuggaaaaugcgacacgcgacuauuuuauuaucugccccauuaucgauauggccuccgcuugggccaaaagagcucggggcaacgucuucauguaccaugccccugagaauuaugggcacggaagccucgaacuucuggcugacgugcaguuugcccugggccucccguucuaccccgcguaugaggggcaguucagccuggaggaaaagucccuuucucugaaaauuaugcaauacuuuagccacuucauccgcuccggaaacccuaauuaucccuacgaguuuucuagaaaggugccuacguucgccacccccuggccggauuuuguuccucgggcuggcggggaaaacuacaaggaguucagcgaacuccugcccaaucgccagggacugaaaaaggccgacuguuccuuuuggucuaaauauaucagcucccucaagacaagcgcugauggcgccaaaggcgggcagucugccgaguccgaggaagaggaacuuaccgcgggaagcggccugagagaggaccugcucucucugcaggagcccggguccaagacauacagcaaguga

SEQ ID NO: 76793 - RNA, 828 nt, Artificial Sequence
  derived and/or modified sequence opt5 from TGIF1__Homo_sapiens__NP_001265611
auggccgcugcccacagcggcagauccaucguggcggcuucugggagcgagaccgaagacgaggauuccauggacauuccccuggaucucucuagcuccgccggaucuggcaagcggcgcagacgggggaaccugccuaaagaaagcguccagauccuucgcgacuggcuguacgagcauagauauaaugccuacccguccgaacaagagaaggcucuccugagccagcagacacaccuuucuacgcugcagguuugcaacugguucauuaaugcccggcgcagacuccugcccgauaugcugcggaaagacggaaaggauccuaaccaauuuaccaucucccgcagaggcgcuaaaauuagcgagacaucuuccguggaaagcgugauggggaucaagaauuucaugcccgcccucgaggaaaccccuuuucauucuuguacagcgggacccaacccuacccugggccggccgcuuucccccaagccuagcucccccggcucuguccuggcccgcccuagcgugaucugccacacaaccguuacggcucucaaagacgugcccuucucccugugucagagcgucggggugggacagaauaccgauauucagcaaaucgccgcuaagaacuuuacagacaccucucuuauguauccggaggauacaugcaaauccggcccuagcaccaauacgcagucugggcuguucaacacacccccucccacacccccugaccucaaucaggauuuuagcggauuccagcugcugguugacguggcccucaagagagcggccgagauggaacugcaagcuaaacuuaccgccuga

SEQ ID NO: 76794 - RNA, 468 nt, Artificial Sequence
  derived and/or modified sequence opt5 from TGIF2-C20orf24__Homo_sapiens__NP_001186464
augagcgacuccgaucugggcgaggacgaagggcuccugucucuugccggaaagagaaaacggcgcggcaaccugcccaaggagagcgugaaaauccucagagauuggcuguaccuucaccgguauaaugcuuacccuuccgaacaggagaagcugucucucagcgggcaaaccaaccuguccguccugcaggacgaguuccucgauguuauuuauugguuucgccagaucauugccguggugcugggagucaucuggggcgugcuuccgcugagaggguuccucggaauugcgggcuuuugccugaucaaugcuggcguucuuuaccuguauuucucuaacuaccuccagaucgacgaagaggaauaugggggaacaugggagcugacgaaagaaggcuuuaugaccagcuucgcccuguuuauggugauuuggaucauuuucuacacagccauccauuacgauuga

SEQ ID NO: 76795 - RNA, 714 nt, Artificial Sequence
  derived and/or modified sequence opt5 from TGIF2__Homo_sapiens__NP_001186444
augagcgacuccgaucugggcgaggacgaagggcuccugucucuugccggaaagagaaaacggcgcggcaaccugcccaaggagagcgugaaaauccucagagauuggcuguaccuucaccgguauaaugcuuacccuuccgaacaggagaagcugucucucagcgggcaaaccaaccuguccguccugcagauuugcaauugguucaucaacgcccgcagacggcuccugccggacaugcuucgcaaagauggaaaggaccccaaucaguuuacaauuucuagacggggcgggaaggcgagcgauguugcucugccucgcggauccagccccucugugcucgccguguccgucccugcccccacgaacgugcugagccuuucuguuuguuccaugccucugcauagcggccagggcgaaaaaccggcugcccccuucccuagaggggagcucgagucucccaagccucuggugacccccggauccacacugacccuccugacacgggcugaagccggcagcccgaccgggggacuuuuuaauacaccucccccuaccccucccgagcaagacaaagaagauuucuccucuuuucagcugcucgucgagguggcgcugcagcgcgccgcugagauggaacuucagaagcaacaggaccccagccugccgcuccugcacacgcccaucccucugguuuccgagaacccccaguga

SEQ ID NO: 76796 - RNA, 726 nt, Artificial Sequence
  derived and/or modified sequence opt5 from TGIF2LX__Homo_sapiens__NP_620410
auggaggccgcugccgacggccccgcggaaacccagagcccuguggagaaggauuccccggcuaaaacacaaucucccgcccaggacacgagcaucauguccagaaacaaugccgauaccgggcggguccuggcucucccugaacacaagaaaaagcgcaaaggaaaccugcccgccgagucuguuaagauucuuagagacuggauguacaagcaucgguucaaggcuuauccuagcgaagaggagaagcagaugcuguccgagaaaacaaaucucucucugcuucagaucagcaacugguuuauuaaugcccgcagacggauccugcccgauaugcuccaacagcgcagaaacgacccuauuaucggccacaagaccgggaaagaugcgcaugccacacaucugcaguccaccgaggcuagcgugccggccaagucuggacccuccggcccugacaaugugcagagccugccccucuggccucugcccaaggggcaaaugucucgggaaaaacagccggauccugaguccgcucccagccagaaacuuacaggaaucgcccagccuaaaaagaaagucaaggugucuguuaccucccccagcucccccgagcuggugucuccugaagaacacgcggacuucagcuccuuucuccugcuugucgaugccgcugugcaacgcgccgcugaacuggagcucgagaaaaagcaggaaccgaaccccuga

SEQ ID NO: 76797 - RNA, 2454 nt, Artificial Sequence
  derived and/or modified sequence opt5 from TGM1__Homo_sapiens__NP_000350
augauggacggccccagaagcgauguggggcgguggggaggcaacccucugcagccgcccaccacaccuucccccgagccugaacccgagccugacgggcgcucuagacggggaggcgggcgcagcuucugggccagaugcuguggaugcuguuccugccggaaugcugccgaugacgauuggggcccggaacccucugacagccgcggcagaggguccucuagcggaacgcggcgcccuggcuccagagggagcgauucucggcgccccgucuccagaggaagcggcguuaacgcggcuggggacggaaccauccgggagggcaugcucguggugaauggcgucgaucugcuuucuucccgcagcgaccaaaacagacgggaacaccauacagaugaguacgaguaugacgaacugauugugagacgcgggcagccuuuucacaugcuccugcuucugucucggaccuacgaguccagcgauagaaucacacucgaacugcugauuggaaauaaccccgagguuggcaaggggacccaugugaucauuccggucggaaaaggcggguccggaggcuggaaggcccaggugguuaaagccucuggccagaaucucaaccugcgcgugcacacaagcccuaaugcuaucaucgggaaguuccaauuuaccguccggacgcaguccgacgccggagaguuccagcuucccuuugacccuagaaacgaaauuuauauccuguucaaucccuggugucccgaggauauuguguacguggaccaugaagauuggcgccaggaguauguccucaacgaaagcggccggaucuacuaugggaccgaggcucaaauuggagagagaacauggaauuacggccaguuugaccacgggguucuggaugccugccuuuacauccuggaccgccggggcaugccuuauggaggcagaggggauccggugaacgugucucgcgucauuuccgcgauggugaauagccucgacgauaacggaguucugaucggcaacuggucuggggacuacagccggggaaccaaucccuccgccugggugggcucugucgaaauccugcucagcuaucugagaacaggguacuccgugccuuauggccaguguuggguuuucgcuggagugaccacgacaguccuucggugccugggccucgccacccgcacagugaccaacuuuaauagcgcucacgauaccgacacaucucugacgauggacauuuacuucgaugagaacaugaaaccccuugaacaucugaaucacgacuccgucuggaacuuucauguguggaaugauuguuggaugaagagaccugaccuccccagcggguucgauggauggcagguuguggacgccaccccgcaagagacaucuuccggcaucuuuugcugugggccuugcagcgucgaauccauuaagaacggacugguguauaugaaauacgauacccccuucaucuucgcggagguuaauucugacaagguguacuggcagcggcaggaugacggcagcuuuaaaauugucuauguggaggaaaaggccaucgggacacugaucgugaccaaagcuauuuccucuaacaugagagaggauaucacguaccucuauaagcacccugaaggcagcgacgccgagcgcaaggcuguugaaacagccgccgcucacggauccaaacccaaugucuacgcgaaccggggcagcgccgaggauguggcuaugcaaguggaggcccaggacgccgucauggggcaggaccugauggugucuguuaugcuuauuaaucauuccagcucuagacgcaccgugaagcugcaccucuaucuguccgucaccuucuacacaggagugagcggcaccaucuuuaaagaaacaaagaaagagguugaacuugcuccuggggccucugauagagugacgaugcccgucgcguauaaggaguaccggccgcaucugguggaccagggagcuaugcuccugaacguuagcggccacgugaaagaguccgggcaaguccuggccaagcagcauaccuuccgccucagaacaccugaucugagccuuacccugcucggcgccgcuguggugggacaggaaugcgagguccagauuguuuuuaagaauccccugcccgugacacugaccaacguggucuuccggcuugaaggcucugggcuccaacgcccuaaaauccugaacgugggagacaucggcgggaaugagacgguuacccugagacaguccuuugugccgguccggcccggaccucgccagcucauugccagccuggauucuccccagcuuucccaagugcacggcguuauccagguggacgucgcuccugcccccggcgaugggggauucuuuagcgacgcgggcggggauucccaccugggagaaacaauuccuauggccucuagaggcggggcuuga

SEQ ID NO: 76798 - RNA, 1647 nt, Artificial Sequence
  derived and/or modified sequence opt5 from TGM2__Homo_sapiens__NP_945189
auggccgaggaacuggugcucgagagaugcgaccuggaacuugagaccaacggccgggaucaccauacagcugaccugugucgcgaaaagcucgucguuagacgggggcagcccuucuggcugacgcuucacuuugagggacgcaauuacgaggccagcguggauucccugaccuucucuguggucacaggcccugcgccgagccaagaagcugggaccaaagccagauuuccccuccgggacgccguggaggaaggagauuggacagcuaccguuguggaccagcaggauugcacacugucccugcagcucaccacgccugccaacgcucccaucggccuguaucgccuuucucuggaggccagcaccggguaccaaggauccucuuucguccucggccauuuuauucugcuuuucaaugcgugguguccugccgacgcuguguaucuggauagcgaggaagagagacaggaauacguucucacacagcagggcuuuaucuaucaaggguccgccaaguucauuaaaaacauccccuggaauuuuggacaguucgaggacggcauucuggauaucugccugauccuccuggacgugaacccuaaguuucuuaaaaaugcugggcgggauuguagccgcagaucuuccccggucuacgugggacggguggucagcggcaugguuaacugcaaugacgaccagggggugcugcucggacgcugggauaacaauuauggcgacggcgugucucccauguccuggauugggagcgucgauauccugagacgguggaagaaccacggaugucagcgcgugaaguacggccaaugcuggguuuucgccgcgguggccuguaccguccuuagaugccuggggauuccuacacgggugguuaccaauuacaacucugcucaugaccaaaauuccaaccuccugaucgaauauuuuagaaacgaguucggagagauucagggcgauaaaagcgaaaugaucuggaauuuccacuguuggguggaguccuggaugacgcgccccgaccugcagccuggguacgaaggauggcaggcccucgaucccacaccgcaggagaagucugaaggcaccuauugcugcggcccuguccccgugcgggcuauuaaagagggggaccugagcacaaaguacgaugccccuuuugucuucgccgaggugaacgcugacguuguggauuggauccagcaagacgacggauccguccacaaaagcaucaauagaucucuuauugugggccugaagaucuccaccaagagcguugggcgcgaugaacgggaggacauuacccauacauauaaauaccccgaaggaucuagcgaggaaagagaggcguuuacgcgcgccaaccaccucaauaagcuggcugagaaagaagagaccggcauggccaugcggaucagaguggggcaguccaugaacaugggcucugauuucgacgucuuugcccauauuacaaauaacaccgcugaagaguaugugugucgccuucugcucugcgcccggacagugagcuacaauggaauccugggccccgagugugggaccaaguaccugcucaaccugaaucuugaaccuuucuccggaaaagcgcugugcagcuggucuaucuguuga

SEQ ID NO: 76799 - RNA, 2082 nt, Artificial Sequence
  derived and/or modified sequence opt5 from TGM3__Homo_sapiens__NP_003236
auggccgcucugggcgugcagagcaucaacuggcaaaccgccuucaauagacaggcgcaccauacagacaaguuuuccucucaggagcucauucugcggcgcgggcagaacuuccaaguccuuaugaucaugaauaaaggacugggcagcaacgaaagacucgaguuuauuguuuccacggggcccuacccuucugaaagcgcuaugaccaaggccguguucccgcuguccaauggaucuagcggcgggugguccgccgugcuucaggcuagcaacggaaauacacugaccaucucuauuuccagccccgccucugcuccuaucggccgguauacaauggcccuccagaucuuuucccagggcgggauuagcucugucaaacugggaaccuucauccugcucuuuaaccccuggcugaauguggauuccguuuucaugggcaaccacgcggagcgcgaagaguacgugcaagaggacgccgggauuaucuuugucggaagcacaaauagaauuggcaugaucggguggaacuucggacaguuugaagaggauauucuuuccaucugccugucuauccucgaccggagccugaauuuccgcagagaugcugccaccgacguggcuucccggaacgauccuaaguauguuggccgcgugcuuagcgccaugauuaauucuaacgacgauaacggcguccuggcggggaauugguccggaacguacaccggcgggagagacccccggagcuggaacggaucuguggaaauccucaaaaauuggaagaagucuggcuuuuccccugugcgcuaugggcaguguugggucuucgccggaacacugaacaccgcucugagaucucucggcauuccgagccggguuaucacaaauuucaacuccgcccaugauaccgaccgcaaucugagcguggauguguacuaugaccccaugggcaacccucuugacaaagggucugauuccgucuggaauuuucacguguggaacgagggaugguucguuagaagcgaccugggccccucuuacgggggauggcaagugcucgaugcuacgccucaggagcggucccagggcgucuuucagugcgggcccgccagcgugauuggcguuagagaaggagacgugcaacugaauuucgauaugccguuuaucuucgccgaggucaacgcugaccgcaucacauggcuuuacgauaauaccacaggcaagcaguggaaaaacuccgucaauucucauaccauugggcgguauaucagcaccaaggcggugggauccaacgccagaauggacgugacagauaaauacaaguauccugaaggcucugaccaggagcgccagguuuuucaaaaggcucuggggaaacucaagcccaacacgccuuucgccgccaccagcuccaugggacuggaaacagaggagcaggaacccagcauuaucggcaaacugaagguggcugggaugcucgccgucggcaaagaggugaaucugguucuucugcucaagaaccugucucgggauaccaaaacagugaccgucaauaugacggcguggacaauuaucuacaacggaacccuugugcacgaaguguggaaggacuccgcuaccaugagccuggaccccgaggaagaggccgagcacccuaucaagauuucuuaugcccaguacgaaaaauaucucaaguccgauaauaugaucagaauuacagcuguuuguaaagucccggacgagagcgaagugguggucgagcgcgauaucauucuggacaaccccacccugacacucgaagugcugaaugaggcccggguuagaaagccugugaacguccagaugcuuuuuagcaauccccuggaugagccugugcgcgacugcguucucaugguggaaggcagcgggcugcugcuuggaaaccucaaaaucgauguccccacgcugggcccgaaggaggggucccgggugagauucgacauucugccuagccgcucuggaaccaagcaacuccuggcugauuuuuccuguaauaaauuccccgccaucaaggcgaugcuuagcaucgacguugccgaauga

SEQ ID NO: 76800 - RNA, 2055 nt, Artificial Sequence
  derived and/or modified sequence opt5 from TGM4__Homo_sapiens__NP_003232
augauggacgccagcaaggagcugcaagugcuccacaucgauuuccugaaccaagacaaugcugucucccaucacaccugggaauuucagacaucuagccccguuuucagacggggccagguguuucaucuucgccuggugcucaaccagccucugcaauccuaccaccagcuuaaacuggaguucucuacggggccgaaucccagcauugccaagcauacccucgucgugcuggauccuagaacacccuccgaccacuauaacuggcaggcgacccugcagaaugaaucuggaaaagagguuacaguggcugucaccagcuccccuaacgccauccucggcaaguaccaacugaaugugaaaacagggaaccacauucuuaagagcgaagagaauauccuguaucuccuguuuaaccccuggugcaaggaggauaugguuuucaugccugacgaagaugagcggaaagaauacauucuuaaugacaccggaugucauuaugugggcgccgcucgcucuaucaagugcaaaccguggaacuuugggcaguucgagaagaauguccuggauuguugcaucucccuccugacggagagcucucugaaacccaccgacagacgggauccugugcucgugugucgcgccaugugcgcuaugauguccuuugaaaagggacagggcguccugauuggcaacuggacaggggacuacgagggaggcaccgcccccuauaaguggacagggagcgcgccuauccuucagcaauacuacaauaccaaacaggccguuuguuucggacagugcuggguguuugcuggcauucugacgacagugcucagagcccuggggauccccgcucggucugucaccggauucgauuccgcccacgacacagaacgcaaccuuaccguggacaccuauguuaacgagaauggcgaaaagauuacaagcaugacgcaugauuccguguggaacuuucacgucuggaccgacgcguggaugaaaagaccggaucugccuaagggcuacgacggguggcaagccguggaugcuacaccccaggagcggucucagggaguuuucuguugcggcccuagcccccucaccgccauccgcaaaggggacauuuucaucguguaugauacaagauuugucuucuccgaggugaauggagaccggcugaucuggcuggucaagauggugaacggccaggaggaacuccacguuauuagcauggaaaccacgucuaucgggaaaaauauuuccacaaaggcugugggacaagaucgcagacgggacaucaccuacgaguauaaguaccccgaaggcagcucugaggagagacaggucauggaucaugccuuucugcuucugagcuccgaacgcgagcaccggagaccugugaaagaaaacuuccuccauaugucuguucagagcgacgacgugcugcuuggcaauuccgucaacuuuaccgugauucugaagcgcaaaacagccgcucuccagaaugugaacauccuggggagcuucgagcugcaacucuauaccggaaagaaaauggcgaagcugugugaucuuaauaagacaucucagauccagggccagguuuccgaagucacgcugacccucgacagcaaaacauacauuaacucucuggccauccuggaugacgagccggugauucggggguuuaucauugcugagaucguggaauccaaggagaucauggccagcgaagucuucaccuccuuucaauaccccgaguucucuauugagcuuccuaauacaggaagaaucggccagcuccuggugugcaacugcauuuuuaaaaauacccuggccaucccccucacggauguuaaguucagccuggaaucccuugggauuucuagccugcagaccuccgaccacggcacagugcagccuggagagaccauccaaagccagauuaaauguacacccaucaagaccggcccgaagaaauuuaucgucaagcucucuuccaaacaggugaaggaaauuaacgcucagaaaaucguucugauuacgaaguga

SEQ ID NO: 76801 - RNA, 1917 nt, Artificial Sequence
  derived and/or modified sequence opt5 from TGM5__Homo_sapiens__NP_004236
auggcccagggccuggagguggcucucaccgaccugcaaagcuccagaaacaauguccggcaccauacagaagagaucacgguugaucaccuucuggugcgcagagggcaggccuucaaccucacccuguacuuucggaaucgcucuuuccagcccggacuugacaacauuaucuuuguggucgaaacagaggaugcgguguaucuggacagcgaaccucagagacaagaguacguuaugaaugauuauggcuucauuuaccagggguccaagaacuggauccggccgugccccuggaauuauggacaguuugaggacaaaauuaucgauaucugucucaagcugcuggacaaaucucuccauuuccagaccgauccugcuacagacugcgcccugcgcggcagccccguguacgucuccagagugguuugugccaugauuaacucuaaugaugacaacggggugcuuaauggaaacuggagcgaaaauuauaccgauggcgcuaacccugccgaguggacaggcuccgucgcuauccugaagcaauggaaugccaccgggugccagcccgugcgguacggacaguguuggguguuugcggccgucaugugcacgguuaugcgcugucucggcauuccuaccagagugaucacaaacuucgacagcgggcacgacaccgauggaaaccugauuaucgacgaauacuaugauaauacaggccggauucuugggaacaaaaagaaggacaccaucuggaauuuucauguguggaacgagugcuggauggcucgcaaagaucugccgcccgccuacggaggcuggcagguccucgacgcuacgccucaagagaugucuaauggcguguauuguugcgggcccgccuccguuagagcgaucaaggaaggagagguggaucugaacuacgacacaccuuucgucuuuagcauggugaaugccgauuguaugucuuggcugguucagggcgggaaagaacagaagcuccaccaagacaccuccagcgugggaaacuucauuucuacaaaauccauccagagcgaugagcgggacgacauuaccgaaaauuauaaguacgaggagggcucccugcaggaacgccaggucuuucuuaaggcucugcaaaaacucaaggccagaucuuuccacgggagccagcggggagcugagcugcagcccuccagaccgaccagccuuucucaggauuccccucgcagccugcauacacccucucuccggccuagcgacgugguccaagugucccugaaauucaagcugcucgauccucccaacaugggccaggacaucugcuuuguucugcuugcccugaauaugucuagccaguucaaagaucucaaggugaaccuguccgcccagagccuucugcacgacggcucuccccucuccccguuuuggcaagauacggcuuucauuacccugagccccaaagaagcgaagacauauccuugcaagaucucuuacucccaguacagccaguaucuguccaccgacaaacucaucagaauuucugcccugggggaggaaaagagcucccccgagaaaauccuugucaauaagauuaucacacugucuuacccuagcauuaccaucaacgugcucggagcugccguugugaaucagccccuguccauccaagucauuuuuagcaacccgcugucugaacagguggaggauugugugcuuacgguugagggcuccggacucuucaaaaagcagcaaaaggucuuucugggggugcugaaaccucagcaucaggccagcaucauucucgaaacagugcccuucaagucuggccagcgccaaauccaggcuaacaugcgguccaauaaauuuaaggacauuaaaggguauagaaacgucuacguggauuucgcccuguga
